United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 47

SEQ ID NO: 1971282 - DNA, 14 bp, Homo sapiens
tgtcttgccagcca

SEQ ID NO: 1971283 - DNA, 18 bp, Homo sapiens
tgtcttgccagccagaag

SEQ ID NO: 1971284 - DNA, 15 bp, Homo sapiens
tgtcttggacactgt

SEQ ID NO: 1971285 - DNA, 22 bp, Homo sapiens
tgtcttgtacatgtgtagcctg

SEQ ID NO: 1971286 - DNA, 17 bp, Homo sapiens
tgtctttctattcataa

SEQ ID NO: 1971287 - DNA, 23 bp, Homo sapiens
tgtctttctattcataataaact

SEQ ID NO: 1971288 - DNA, 13 bp, Homo sapiens
tgtcttttgtcat

SEQ ID NO: 1971289 - DNA, 14 bp, Homo sapiens
tgtgaaaatgggtt

SEQ ID NO: 1971290 - DNA, 16 bp, Homo sapiens
tgtgaaaccacaggcc

SEQ ID NO: 1971291 - DNA, 21 bp, Homo sapiens
tgtgaaagtcagatgcccaga

SEQ ID NO: 1971292 - DNA, 17 bp, Homo sapiens
tgtgaaccaccacaccc

SEQ ID NO: 1971293 - DNA, 23 bp, Homo sapiens
tgtgaaccaccacacccagccca

SEQ ID NO: 1971294 - DNA, 14 bp, Homo sapiens
tgtgaacccaggac

SEQ ID NO: 1971295 - DNA, 18 bp, Homo sapiens
tgtgaagacccagcagga

SEQ ID NO: 1971296 - DNA, 16 bp, Homo sapiens
tgtgaaggtcttgcct

SEQ ID NO: 1971297 - DNA, 20 bp, Homo sapiens
tgtgaatatggactcagttt

SEQ ID NO: 1971298 - DNA, 18 bp, Homo sapiens
tgtgaatcagaccctacc

SEQ ID NO: 1971299 - DNA, 15 bp, Homo sapiens
tgtgaattcccaggt

SEQ ID NO: 1971300 - DNA, 14 bp, Homo sapiens
tgtgaattctgtga

SEQ ID NO: 1971301 - DNA, 19 bp, Homo sapiens
tgtgaattctgtgaagaat

SEQ ID NO: 1971302 - DNA, 18 bp, Homo sapiens
tgtgaattgcctgcagag

SEQ ID NO: 1971303 - DNA, 22 bp, Homo sapiens
tgtgacaacctttgtgtaataa

SEQ ID NO: 1971304 - DNA, 23 bp, Homo sapiens
tgtgacaacctttgtgtaataaa

SEQ ID NO: 1971305 - DNA, 22 bp, Homo sapiens
tgtgacacatatgcaccttgtg

SEQ ID NO: 1971306 - DNA, 22 bp, Homo sapiens
tgtgacaggaaagccctccccc

SEQ ID NO: 1971307 - DNA, 18 bp, Homo sapiens
tgtgaccaaaagttacat

SEQ ID NO: 1971308 - DNA, 19 bp, Homo sapiens
tgtgaccacatacgtgtta

SEQ ID NO: 1971309 - DNA, 22 bp, Homo sapiens
tgtgaccacatacgtgttagga

SEQ ID NO: 1971310 - DNA, 16 bp, Homo sapiens
tgtgacccagggtgca

SEQ ID NO: 1971311 - DNA, 17 bp, Homo sapiens
tgtgacctgctgagctc

SEQ ID NO: 1971312 - DNA, 21 bp, Homo sapiens
tgtgacgattatttatttctg

SEQ ID NO: 1971313 - DNA, 20 bp, Homo sapiens
tgtgactcgcttagctgaaa

SEQ ID NO: 1971314 - DNA, 23 bp, Homo sapiens
tgtgactcgcttagctgaaacct

SEQ ID NO: 1971315 - DNA, 23 bp, Homo sapiens
tgtgactctttttagggccaggc

SEQ ID NO: 1971316 - DNA, 12 bp, Homo sapiens
tgtgactggcac

SEQ ID NO: 1971317 - DNA, 19 bp, Homo sapiens
tgtgacttcagctctgttt

SEQ ID NO: 1971318 - DNA, 14 bp, Homo sapiens
tgtgagatgtaatt

SEQ ID NO: 1971319 - DNA, 16 bp, Homo sapiens
tgtgagcatctctgtg

SEQ ID NO: 1971320 - DNA, 20 bp, Homo sapiens
tgtcagagccaggctctgcc

SEQ ID NO: 1971321 - DNA, 21 bp, Homo sapiens
tgtcagagctatgttccctcc

SEQ ID NO: 1971322 - DNA, 22 bp, Homo sapiens
tgtcagagctatgttccctcca

SEQ ID NO: 1971323 - DNA, 18 bp, Homo sapiens
tgtcagagctgttggcct

SEQ ID NO: 1971324 - DNA, 19 bp, Homo sapiens
tgtcagagctgttggcctc

SEQ ID NO: 1971325 - DNA, 12 bp, Homo sapiens
tgtcagaggcta

SEQ ID NO: 1971326 - DNA, 23 bp, Homo sapiens
tgtcagatattttttcagaaata

SEQ ID NO: 1971327 - DNA, 19 bp, Homo sapiens
tgtcagcatgcatagtgct

SEQ ID NO: 1971328 - DNA, 11 bp, Homo sapiens
tgtcagccagc

SEQ ID NO: 1971329 - DNA, 17 bp, Homo sapiens
tgtcagccagccgccct

SEQ ID NO: 1971330 - DNA, 22 bp, Homo sapiens
tgtcagccagccgccctgggct

SEQ ID NO: 1971331 - DNA, 17 bp, Homo sapiens
tgtcagcccacagcagc

SEQ ID NO: 1971332 - DNA, 11 bp, Homo sapiens
tgtcagccttg

SEQ ID NO: 1971333 - DNA, 23 bp, Homo sapiens
tgtcagcgcaggtttagtttact

SEQ ID NO: 1971334 - DNA, 16 bp, Homo sapiens
tgtcagcttaaaattg

SEQ ID NO: 1971335 - DNA, 17 bp, Homo sapiens
tgtcaggaacagaagga

SEQ ID NO: 1971336 - DNA, 20 bp, Homo sapiens
tgtcaggaacagaaggatga

SEQ ID NO: 1971337 - DNA, 14 bp, Homo sapiens
tgtcaggacccagg

SEQ ID NO: 1971338 - DNA, 20 bp, Homo sapiens
tgtcaggacccaggccgcct

SEQ ID NO: 1971339 - DNA, 16 bp, Homo sapiens
tgtcaggtggggcagc

SEQ ID NO: 1971340 - DNA, 20 bp, Homo sapiens
tgtcaggtggggcagcttga

SEQ ID NO: 1971341 - DNA, 16 bp, Homo sapiens
tgtcataagaatgaat

SEQ ID NO: 1971342 - DNA, 17 bp, Homo sapiens
tgtcataagaatgaata

SEQ ID NO: 1971343 - DNA, 17 bp, Homo sapiens
tgtcatagaaagtgcca

SEQ ID NO: 1971344 - DNA, 22 bp, Homo sapiens
tgtcatagaaagtgccagaaag

SEQ ID NO: 1971345 - DNA, 13 bp, Homo sapiens
tgtcatataaacc

SEQ ID NO: 1971346 - DNA, 16 bp, Homo sapiens
tgtcatatattcatgt

SEQ ID NO: 1971347 - DNA, 18 bp, Homo sapiens
tgtcatatattcatgtaa

SEQ ID NO: 1971348 - DNA, 20 bp, Homo sapiens
tgtcatatattcatgtaata

SEQ ID NO: 1971349 - DNA, 21 bp, Homo sapiens
tgtcatatgtaggtgtctgca

SEQ ID NO: 1971350 - DNA, 12 bp, Homo sapiens
tgtcatattaaa

SEQ ID NO: 1971351 - DNA, 19 bp, Homo sapiens
tgtcatcaaatattaccaa

SEQ ID NO: 1971352 - DNA, 13 bp, Homo sapiens
tgtcatcactccc

SEQ ID NO: 1971353 - DNA, 14 bp, Homo sapiens
tgtcatcactccct

SEQ ID NO: 1971354 - DNA, 18 bp, Homo sapiens
tgtcatcattgtatatat

SEQ ID NO: 1971355 - DNA, 22 bp, Homo sapiens
tgtcatcattgtatatatgtgt

SEQ ID NO: 1971356 - DNA, 18 bp, Homo sapiens
tgtcatccccttgtgtca

SEQ ID NO: 1971357 - DNA, 16 bp, Homo sapiens
tgtcatcccgctcctg

SEQ ID NO: 1971358 - DNA, 19 bp, Homo sapiens
tgtcatcccgctcctgctg

SEQ ID NO: 1971359 - DNA, 20 bp, Homo sapiens
tgtcatcccgctcctgctga

SEQ ID NO: 1971360 - DNA, 23 bp, Homo sapiens
tgtcatcccgctcctgctgaaac

SEQ ID NO: 1971361 - DNA, 14 bp, Homo sapiens
tgtcatctctctgg

SEQ ID NO: 1971362 - DNA, 14 bp, Homo sapiens
tgtcatctgaggag

SEQ ID NO: 1971363 - DNA, 21 bp, Homo sapiens
tgtcatgaattcttatgctta

SEQ ID NO: 1971364 - DNA, 19 bp, Homo sapiens
tgtcatggaaaatgtcctg

SEQ ID NO: 1971365 - DNA, 22 bp, Homo sapiens
tgtcatggaaaatgtcctgtgg

SEQ ID NO: 1971366 - DNA, 18 bp, Homo sapiens
tgtcatgtacttcctgtg

SEQ ID NO: 1971367 - DNA, 19 bp, Homo sapiens
tgtcattaaaataaataaa

SEQ ID NO: 1971368 - DNA, 23 bp, Homo sapiens
tgtcattactgcctttggaagaa

SEQ ID NO: 1971369 - DNA, 15 bp, Homo sapiens
tgtcattatgtagaa

SEQ ID NO: 1971370 - DNA, 16 bp, Homo sapiens
tgtcattatgtagaaa

SEQ ID NO: 1971371 - DNA, 12 bp, Homo sapiens
tgtcattcagga

SEQ ID NO: 1971372 - DNA, 23 bp, Homo sapiens
tgtcattcaggaccccaacccct

SEQ ID NO: 1971373 - DNA, 20 bp, Homo sapiens
tgtcatttgagcagggctca

SEQ ID NO: 1971374 - DNA, 22 bp, Homo sapiens
tgtcatttgagcagggctcagc

SEQ ID NO: 1971375 - DNA, 15 bp, Homo sapiens
tgtcattttaaaatc

SEQ ID NO: 1971376 - DNA, 18 bp, Homo sapiens
tgtcattttaaaatctga

SEQ ID NO: 1971377 - DNA, 20 bp, Homo sapiens
tgtccaacaactccaggaaa

SEQ ID NO: 1971378 - DNA, 21 bp, Homo sapiens
tgtccaatggctgtaaactat

SEQ ID NO: 1971379 - DNA, 21 bp, Homo sapiens
tgtccaattatgcactggcca

SEQ ID NO: 1971380 - DNA, 12 bp, Homo sapiens
tgtccacctggc

SEQ ID NO: 1971381 - DNA, 15 bp, Homo sapiens
tgtccacctggcccc

SEQ ID NO: 1971382 - DNA, 22 bp, Homo sapiens
tgtccagacagagccctgtgag

SEQ ID NO: 1971383 - DNA, 18 bp, Homo sapiens
tgtccagaccattgtctt

SEQ ID NO: 1971384 - DNA, 20 bp, Homo sapiens
tgtccagaccattgtcttcc

SEQ ID NO: 1971385 - DNA, 17 bp, Homo sapiens
tgtccagactgtgggtg

SEQ ID NO: 1971386 - DNA, 21 bp, Homo sapiens
tgtccagcacagaaggaatct

SEQ ID NO: 1971387 - DNA, 12 bp, Homo sapiens
tgtccagcagct

SEQ ID NO: 1971388 - DNA, 13 bp, Homo sapiens
tgtccagcagctg

SEQ ID NO: 1971389 - DNA, 22 bp, Homo sapiens
tgtccagcagctgcgggtctga

SEQ ID NO: 1971390 - DNA, 19 bp, Homo sapiens
tgtccaggcactgctgccc

SEQ ID NO: 1971391 - DNA, 16 bp, Homo sapiens
tgtccaggccactgtg

SEQ ID NO: 1971392 - DNA, 18 bp, Homo sapiens
tgtccaggccactgtggc

SEQ ID NO: 1971393 - DNA, 20 bp, Homo sapiens
tgtccaggccactgtggcca

SEQ ID NO: 1971394 - DNA, 23 bp, Homo sapiens
tgtccatatcagacctctgatcc

SEQ ID NO: 1971395 - DNA, 19 bp, Homo sapiens
tgtccatggcagctggtct

SEQ ID NO: 1971396 - DNA, 14 bp, Homo sapiens
tgtccatgtgcttc

SEQ ID NO: 1971397 - DNA, 22 bp, Homo sapiens
tgtcccaagctttgaatacccc

SEQ ID NO: 1971398 - DNA, 16 bp, Homo sapiens
tgtcccaccaactctg

SEQ ID NO: 1971399 - DNA, 22 bp, Homo sapiens
tgtcccagaggttatctgcctg

SEQ ID NO: 1971400 - DNA, 19 bp, Homo sapiens
tgtcccagcagaagaggga

SEQ ID NO: 1971401 - DNA, 16 bp, Homo sapiens
tgtcccaggtcctcac

SEQ ID NO: 1971402 - DNA, 18 bp, Homo sapiens
tgtcccatttccttggag

SEQ ID NO: 1971403 - DNA, 20 bp, Homo sapiens
tgtcccatttccttggaggc

SEQ ID NO: 1971404 - DNA, 15 bp, Homo sapiens
tgtccccagggcccc

SEQ ID NO: 1971405 - DNA, 23 bp, Homo sapiens
tgtccccctgagatcagagtcct

SEQ ID NO: 1971406 - DNA, 22 bp, Homo sapiens
tgtccccggggtattagcacct

SEQ ID NO: 1971407 - DNA, 13 bp, Homo sapiens
tgtcccctctccc

SEQ ID NO: 1971408 - DNA, 13 bp, Homo sapiens
tgtcccctctgtc

SEQ ID NO: 1971409 - DNA, 14 bp, Homo sapiens
tgtcccctcttgac

SEQ ID NO: 1971410 - DNA, 15 bp, Homo sapiens
tgtcccctgtcccac

SEQ ID NO: 1971411 - DNA, 17 bp, Homo sapiens
tgtcccggttcaccttg

SEQ ID NO: 1971412 - DNA, 20 bp, Homo sapiens
tgtccctctttgcctgtgtg

SEQ ID NO: 1971413 - DNA, 21 bp, Homo sapiens
tgtccctctttgcctgtgtga

SEQ ID NO: 1971414 - DNA, 14 bp, Homo sapiens
tgtccctgcacttg

SEQ ID NO: 1971415 - DNA, 20 bp, Homo sapiens
tgtccctgcacttgcagact

SEQ ID NO: 1971416 - DNA, 22 bp, Homo sapiens
tgtccctgcacttgcagactct

SEQ ID NO: 1971417 - DNA, 23 bp, Homo sapiens
tgtccctgcacttgcagactcta

SEQ ID NO: 1971418 - DNA, 14 bp, Homo sapiens
tgtccctgctcctc

SEQ ID NO: 1971419 - DNA, 13 bp, Homo sapiens
tgtccctgtcacc

SEQ ID NO: 1971420 - DNA, 16 bp, Homo sapiens
tgtccctgtcaccaag

SEQ ID NO: 1971421 - DNA, 16 bp, Homo sapiens
tgtcccttgctgtttt

SEQ ID NO: 1971422 - DNA, 15 bp, Homo sapiens
tgtccgcctctgccc

SEQ ID NO: 1971423 - DNA, 16 bp, Homo sapiens
tgtccgttccaggagc

SEQ ID NO: 1971424 - DNA, 17 bp, Homo sapiens
tgtccgttccaggagca

SEQ ID NO: 1971425 - DNA, 15 bp, Homo sapiens
tgtcctaaggacaca

SEQ ID NO: 1971426 - DNA, 20 bp, Homo sapiens
tgtcctaaggacacactaat

SEQ ID NO: 1971427 - DNA, 20 bp, Homo sapiens
tgtcctacccaccctccttt

SEQ ID NO: 1971428 - DNA, 14 bp, Homo sapiens
tgtcctatgtgtga

SEQ ID NO: 1971429 - DNA, 22 bp, Homo sapiens
tgtcctccaacaataaagagct

SEQ ID NO: 1971430 - DNA, 17 bp, Homo sapiens
tgtcctcccatcccctg

SEQ ID NO: 1971431 - DNA, 18 bp, Homo sapiens
tgtcctcccatcccctgg

SEQ ID NO: 1971432 - DNA, 22 bp, Homo sapiens
tgtcctcccatcccctggactg

SEQ ID NO: 1971433 - DNA, 10 bp, Homo sapiens
tgtcctcctc

SEQ ID NO: 1971434 - DNA, 23 bp, Homo sapiens
tgtcctctcccctctgccctgta

SEQ ID NO: 1971435 - DNA, 13 bp, Homo sapiens
tgtcctctcgagc

SEQ ID NO: 1971436 - DNA, 17 bp, Homo sapiens
tgttcaccttatgtatt

SEQ ID NO: 1971437 - DNA, 17 bp, Homo sapiens
tgttcacgcaacttgaa

SEQ ID NO: 1971438 - DNA, 18 bp, Homo sapiens
tgttcagctccagctcac

SEQ ID NO: 1971439 - DNA, 20 bp, Homo sapiens
tgttcagctccagctcacca

SEQ ID NO: 1971440 - DNA, 21 bp, Homo sapiens
tgttcagcttcagacttttat

SEQ ID NO: 1971441 - DNA, 13 bp, Homo sapiens
tgttcatccaagg

SEQ ID NO: 1971442 - DNA, 23 bp, Homo sapiens
tgttcatgagtggatggatggac

SEQ ID NO: 1971443 - DNA, 13 bp, Homo sapiens
tgttcatggcaga

SEQ ID NO: 1971444 - DNA, 17 bp, Homo sapiens
tgttcattaaattttct

SEQ ID NO: 1971445 - DNA, 14 bp, Homo sapiens
tgttcatttcctca

SEQ ID NO: 1971446 - DNA, 18 bp, Homo sapiens
tgttcattttagtgactg

SEQ ID NO: 1971447 - DNA, 13 bp, Homo sapiens
tgttccccatctg

SEQ ID NO: 1971448 - DNA, 15 bp, Homo sapiens
tgttccctgcaccct

SEQ ID NO: 1971449 - DNA, 18 bp, Homo sapiens
tgttcctagtgaaagagg

SEQ ID NO: 1971450 - DNA, 23 bp, Homo sapiens
tgttcctcaccaataacttcaga

SEQ ID NO: 1971451 - DNA, 12 bp, Homo sapiens
tgttccttcaca

SEQ ID NO: 1971452 - DNA, 19 bp, Homo sapiens
tgttctagttagcaggaaa

SEQ ID NO: 1971453 - DNA, 14 bp, Homo sapiens
tgttctcaatgctt

SEQ ID NO: 1971454 - DNA, 20 bp, Homo sapiens
tgttctccgggtgtggcctc

SEQ ID NO: 1971455 - DNA, 17 bp, Homo sapiens
tgttttccactgtgcta

SEQ ID NO: 1971456 - DNA, 12 bp, Homo sapiens
tgttttccctga

SEQ ID NO: 1971457 - DNA, 16 bp, Homo sapiens
tgttttccctgacctc

SEQ ID NO: 1971458 - DNA, 14 bp, Homo sapiens
tgttttctcagaac

SEQ ID NO: 1971459 - DNA, 14 bp, Homo sapiens
tgttttctgctgtt

SEQ ID NO: 1971460 - DNA, 21 bp, Homo sapiens
tgttttgcactgacaagatgg

SEQ ID NO: 1971461 - DNA, 21 bp, Homo sapiens
tgttttgtacaattactaaat

SEQ ID NO: 1971462 - DNA, 10 bp, Homo sapiens
tgtttttaaa

SEQ ID NO: 1971463 - DNA, 16 bp, Homo sapiens
tgtttttaaaaatcat

SEQ ID NO: 1971464 - DNA, 12 bp, Homo sapiens
tgtttttaaaag

SEQ ID NO: 1971465 - DNA, 14 bp, Homo sapiens
tgtttttaagctgt

SEQ ID NO: 1971466 - DNA, 20 bp, Homo sapiens
tgtttttatgaagaaaaaat

SEQ ID NO: 1971467 - DNA, 19 bp, Homo sapiens
tgtttttcaatctcatctg

SEQ ID NO: 1971468 - DNA, 20 bp, Homo sapiens
tgtttttccttgtatttaaa

SEQ ID NO: 1971469 - DNA, 14 bp, Homo sapiens
tgttttttgaaaac

SEQ ID NO: 1971470 - DNA, 19 bp, Homo sapiens
tgttttttttttccactta

SEQ ID NO: 1971471 - DNA, 18 bp, Homo sapiens
ttaaaaaaagtatatatt

SEQ ID NO: 1971472 - DNA, 12 bp, Homo sapiens
ttaaaaaaataa

SEQ ID NO: 1971473 - DNA, 13 bp, Homo sapiens
ttaaaaaactaaa

SEQ ID NO: 1971474 - DNA, 12 bp, Homo sapiens
ttaaaaaagctt

SEQ ID NO: 1971475 - DNA, 21 bp, Homo sapiens
ttaaaaaataaaaaaatacag

SEQ ID NO: 1971476 - DNA, 15 bp, Homo sapiens
ttaaaaaataaatat

SEQ ID NO: 1971477 - DNA, 22 bp, Homo sapiens
ttaaaaaataaatataattggg

SEQ ID NO: 1971478 - DNA, 18 bp, Homo sapiens
ttaaaaacagctgtaact

SEQ ID NO: 1971479 - DNA, 19 bp, Homo sapiens
ttaaaaacagctgtaacta

SEQ ID NO: 1971480 - DNA, 15 bp, Homo sapiens
ttaaaaacaggaaaa

SEQ ID NO: 1971481 - DNA, 15 bp, Homo sapiens
ttaaaaacttccatc

SEQ ID NO: 1971482 - DNA, 16 bp, Homo sapiens
ttaaaaagcagtcctc

SEQ ID NO: 1971483 - DNA, 20 bp, Homo sapiens
ttaaaaagttaatcttcatg

SEQ ID NO: 1971484 - DNA, 18 bp, Homo sapiens
ttaaaaagttgcacatta

SEQ ID NO: 1971485 - DNA, 15 bp, Homo sapiens
ttaaaacaatttatt

SEQ ID NO: 1971486 - DNA, 16 bp, Homo sapiens
ttaaaaccatgcagct

SEQ ID NO: 1971487 - DNA, 15 bp, Homo sapiens
ttaaaactatccaat

SEQ ID NO: 1971488 - DNA, 21 bp, Homo sapiens
ttaaaagaatattttaacttc

SEQ ID NO: 1971489 - DNA, 22 bp, Homo sapiens
ttaaaagaatattttaacttcc

SEQ ID NO: 1971490 - DNA, 11 bp, Homo sapiens
ttaaaagagta

SEQ ID NO: 1971491 - DNA, 18 bp, Homo sapiens
ttaaaaggttgactcaag

SEQ ID NO: 1971492 - DNA, 17 bp, Homo sapiens
ttaaaagtttcaatgtg

SEQ ID NO: 1971493 - DNA, 22 bp, Homo sapiens
ttaaaagtttcaatgtgattct

SEQ ID NO: 1971494 - DNA, 16 bp, Homo sapiens
ttaaaataaaataatt

SEQ ID NO: 1971495 - DNA, 18 bp, Homo sapiens
ttaaaatataaattaaga

SEQ ID NO: 1971496 - DNA, 14 bp, Homo sapiens
ttaaaatatatata

SEQ ID NO: 1971497 - DNA, 16 bp, Homo sapiens
ttaaaatatatataaa

SEQ ID NO: 1971498 - DNA, 17 bp, Homo sapiens
ttaaaatatatataaat

SEQ ID NO: 1971499 - DNA, 18 bp, Homo sapiens
ttaaaatatatataaata

SEQ ID NO: 1971500 - DNA, 21 bp, Homo sapiens
ttaaaatatatataaatatat

SEQ ID NO: 1971501 - DNA, 16 bp, Homo sapiens
ttaaaatattcctgca

SEQ ID NO: 1971502 - DNA, 20 bp, Homo sapiens
ttaaaatctgatttaatgtt

SEQ ID NO: 1971503 - DNA, 14 bp, Homo sapiens
ttaaaatctggaaa

SEQ ID NO: 1971504 - DNA, 16 bp, Homo sapiens
ttaaaatctggaaatc

SEQ ID NO: 1971505 - DNA, 13 bp, Homo sapiens
ttaaaattagtga

SEQ ID NO: 1971506 - DNA, 14 bp, Homo sapiens
ttaaacaaaggttg

SEQ ID NO: 1971507 - DNA, 11 bp, Homo sapiens
ttaaacacctg

SEQ ID NO: 1971508 - DNA, 18 bp, Homo sapiens
ttaaacacctgacacatc

SEQ ID NO: 1971509 - DNA, 16 bp, Homo sapiens
ttaaacacgtgtctat

SEQ ID NO: 1971510 - DNA, 15 bp, Homo sapiens
ttaaacactgtaatc

SEQ ID NO: 1971511 - DNA, 17 bp, Homo sapiens
ttaaacagactttagct

SEQ ID NO: 1971512 - DNA, 12 bp, Homo sapiens
ttaaacagcagt

SEQ ID NO: 1971513 - DNA, 13 bp, Homo sapiens
ttaaaccagcaga

SEQ ID NO: 1971514 - DNA, 16 bp, Homo sapiens
ttaaaccagcagaaaa

SEQ ID NO: 1971515 - DNA, 15 bp, Homo sapiens
ttaaacttgacccag

SEQ ID NO: 1971516 - DNA, 17 bp, Homo sapiens
ttaaacttgtcagaatt

SEQ ID NO: 1971517 - DNA, 20 bp, Homo sapiens
ttaaactttgtgcctttgac

SEQ ID NO: 1971518 - DNA, 21 bp, Homo sapiens
ttaaagaggcgtcttgtattt

SEQ ID NO: 1971519 - DNA, 15 bp, Homo sapiens
ttaaagcaacatttt

SEQ ID NO: 1971520 - DNA, 19 bp, Homo sapiens
ttaaagcaacattttattt

SEQ ID NO: 1971521 - DNA, 21 bp, Homo sapiens
ttaaagcagagggactttgta

SEQ ID NO: 1971522 - DNA, 14 bp, Homo sapiens
ttaaagctgttatt

SEQ ID NO: 1971523 - DNA, 20 bp, Homo sapiens
ttaaagcttattaaaactca

SEQ ID NO: 1971524 - DNA, 15 bp, Homo sapiens
ttaaaggaaggaaaa

SEQ ID NO: 1971525 - DNA, 12 bp, Homo sapiens
ttaaaggagtta

SEQ ID NO: 1971526 - DNA, 15 bp, Homo sapiens
ttaaaggtagagatg

SEQ ID NO: 1971527 - DNA, 17 bp, Homo sapiens
ttaaagtaaaggcctca

SEQ ID NO: 1971528 - DNA, 15 bp, Homo sapiens
ttaaagtacctgtag

SEQ ID NO: 1971529 - DNA, 18 bp, Homo sapiens
ttaaagtatgttattgca

SEQ ID NO: 1971530 - DNA, 11 bp, Homo sapiens
ttaaataaaag

SEQ ID NO: 1971531 - DNA, 17 bp, Homo sapiens
ttaaataagaaactttt

SEQ ID NO: 1971532 - DNA, 17 bp, Homo sapiens
ttaaatacagacactaa

SEQ ID NO: 1971533 - DNA, 19 bp, Homo sapiens
ttaaatacagacactaagt

SEQ ID NO: 1971534 - DNA, 23 bp, Homo sapiens
ttaaatagcatctgctcttctct

SEQ ID NO: 1971535 - DNA, 12 bp, Homo sapiens
ttaaatcaaaag

SEQ ID NO: 1971536 - DNA, 18 bp, Homo sapiens
ttaaatcaaaagctgctt

SEQ ID NO: 1971537 - DNA, 11 bp, Homo sapiens
ttaaatcactg

SEQ ID NO: 1971538 - DNA, 12 bp, Homo sapiens
ttaaatcactga

SEQ ID NO: 1971539 - DNA, 22 bp, Homo sapiens
ttaaatcactgaggcattttta

SEQ ID NO: 1971540 - DNA, 20 bp, Homo sapiens
ttaaatcccattcataactt

SEQ ID NO: 1971541 - DNA, 13 bp, Homo sapiens
ttaaatcgttaga

SEQ ID NO: 1971542 - DNA, 13 bp, Homo sapiens
ttaaatctgcctt

SEQ ID NO: 1971543 - DNA, 15 bp, Homo sapiens
ttaaatgaaaatgta

SEQ ID NO: 1971544 - DNA, 14 bp, Homo sapiens
ttaaatgacagtga

SEQ ID NO: 1971545 - DNA, 22 bp, Homo sapiens
ttaaatggtgggaaccctcccc

SEQ ID NO: 1971546 - DNA, 19 bp, Homo sapiens
ttaaattgcttttgttgtg

SEQ ID NO: 1971547 - DNA, 16 bp, Homo sapiens
ttaaattttaaggtag

SEQ ID NO: 1971548 - DNA, 12 bp, Homo sapiens
ttaaattttcta

SEQ ID NO: 1971549 - DNA, 18 bp, Homo sapiens
ttaaatttttgtcatttt

SEQ ID NO: 1971550 - DNA, 19 bp, Homo sapiens
ttaaatttttgtcatttta

SEQ ID NO: 1971551 - DNA, 19 bp, Homo sapiens
ttaacaaaacaagaaagaa

SEQ ID NO: 1971552 - DNA, 16 bp, Homo sapiens
ttaacaattccaaagg

SEQ ID NO: 1971553 - DNA, 15 bp, Homo sapiens
ttaacagtcatttaa

SEQ ID NO: 1971554 - DNA, 17 bp, Homo sapiens
ttaacattaacatctat

SEQ ID NO: 1971555 - DNA, 13 bp, Homo sapiens
ttaaccagaataa

SEQ ID NO: 1971556 - DNA, 17 bp, Homo sapiens
ttaaccagcacatttct

SEQ ID NO: 1971557 - DNA, 17 bp, Homo sapiens
ttaaccagtacttctaa

SEQ ID NO: 1971558 - DNA, 15 bp, Homo sapiens
ttaacctcagtgtca

SEQ ID NO: 1971559 - DNA, 19 bp, Homo sapiens
ttaacctcagtgtcattta

SEQ ID NO: 1971560 - DNA, 19 bp, Homo sapiens
ttaacctctctaagccaca

SEQ ID NO: 1971561 - DNA, 18 bp, Homo sapiens
ttaacctgaattattcca

SEQ ID NO: 1971562 - DNA, 19 bp, Homo sapiens
ttaacctgtttatataatt

SEQ ID NO: 1971563 - DNA, 16 bp, Homo sapiens
ttaactaatttaaacc

SEQ ID NO: 1971564 - DNA, 15 bp, Homo sapiens
ttaactagaatttat

SEQ ID NO: 1971565 - DNA, 16 bp, Homo sapiens
ttaactagaatttatt

SEQ ID NO: 1971566 - DNA, 21 bp, Homo sapiens
ttaactagaatttattcaatt

SEQ ID NO: 1971567 - DNA, 12 bp, Homo sapiens
ttaactcaatat

SEQ ID NO: 1971568 - DNA, 15 bp, Homo sapiens
ttaactcattagact

SEQ ID NO: 1971569 - DNA, 15 bp, Homo sapiens
ttaactctctttatg

SEQ ID NO: 1971570 - DNA, 17 bp, Homo sapiens
ttaactgggtaatgaaa

SEQ ID NO: 1971571 - DNA, 21 bp, Homo sapiens
ttaactgggtaatgaaacaaa

SEQ ID NO: 1971572 - DNA, 22 bp, Homo sapiens
ttaacttaaaagattcactaaa

SEQ ID NO: 1971573 - DNA, 15 bp, Homo sapiens
ttaacttaaatagta

SEQ ID NO: 1971574 - DNA, 22 bp, Homo sapiens
ttaacttgagggtaataaactt

SEQ ID NO: 1971575 - DNA, 10 bp, Homo sapiens
ttaagacaag

SEQ ID NO: 1971576 - DNA, 15 bp, Homo sapiens
ttaagacgtgaatgt

SEQ ID NO: 1971577 - DNA, 13 bp, Homo sapiens
ttaagagatacat

SEQ ID NO: 1971578 - DNA, 13 bp, Homo sapiens
ttaagaggcaggg

SEQ ID NO: 1971579 - DNA, 14 bp, Homo sapiens
ttaagataattata

SEQ ID NO: 1971580 - DNA, 16 bp, Homo sapiens
ttaagatacactcctg

SEQ ID NO: 1971581 - DNA, 18 bp, Homo sapiens
ttaagatacactcctgct

SEQ ID NO: 1971582 - DNA, 17 bp, Homo sapiens
ttaagatatattttgag

SEQ ID NO: 1971583 - DNA, 13 bp, Homo sapiens
ttaagattaaatt

SEQ ID NO: 1971584 - DNA, 19 bp, Homo sapiens
ttaagattgtaattcagaa

SEQ ID NO: 1971585 - DNA, 20 bp, Homo sapiens
ttaagcattgggtgggtaaa

SEQ ID NO: 1971586 - DNA, 18 bp, Homo sapiens
ttaagcattttactgtct

SEQ ID NO: 1971587 - DNA, 22 bp, Homo sapiens
ttaagccaatatttactcatca

SEQ ID NO: 1971588 - DNA, 21 bp, Homo sapiens
ttaagcctcatatttaaagac

SEQ ID NO: 1971589 - DNA, 15 bp, Homo sapiens
ttaagcttgaagatt

SEQ ID NO: 1971590 - DNA, 20 bp, Homo sapiens
ttaagcttgaagattaggta

SEQ ID NO: 1971591 - DNA, 21 bp, Homo sapiens
ttaaggagaggagaaactgag

SEQ ID NO: 1971592 - DNA, 16 bp, Homo sapiens
ttaagggaaaaatata

SEQ ID NO: 1971593 - DNA, 22 bp, Homo sapiens
ttaaggtctgggagtgttctgt

SEQ ID NO: 1971594 - DNA, 19 bp, Homo sapiens
ttaaggtttgccctgcctg

SEQ ID NO: 1971595 - DNA, 17 bp, Homo sapiens
ttaagtatatagtatat

SEQ ID NO: 1971596 - DNA, 19 bp, Homo sapiens
ttaagtatatagtatattt

SEQ ID NO: 1971597 - DNA, 13 bp, Homo sapiens
ttaagtcagaaca

SEQ ID NO: 1971598 - DNA, 19 bp, Homo sapiens
ttaagtctgggatgtagaa

SEQ ID NO: 1971599 - DNA, 22 bp, Homo sapiens
ttaagtctgggatgtagaactt

SEQ ID NO: 1971600 - DNA, 12 bp, Homo sapiens
ttaagttacttc

SEQ ID NO: 1971601 - DNA, 14 bp, Homo sapiens
ttaagttagagaat

SEQ ID NO: 1971602 - DNA, 20 bp, Homo sapiens
ttaataaaaacttcagaaaa

SEQ ID NO: 1971603 - DNA, 13 bp, Homo sapiens
ttaataaaatgaa

SEQ ID NO: 1971604 - DNA, 17 bp, Homo sapiens
ttaataaacgaagataa

SEQ ID NO: 1971605 - DNA, 22 bp, Homo sapiens
ttaataaacgaagataaatcat

SEQ ID NO: 1971606 - DNA, 16 bp, Homo sapiens
ttaataacttgtccta

SEQ ID NO: 1971607 - DNA, 17 bp, Homo sapiens
ttaataccaaatatttt

SEQ ID NO: 1971608 - DNA, 15 bp, Homo sapiens
ttaatacttaacatt

SEQ ID NO: 1971609 - DNA, 22 bp, Homo sapiens
ttaatacttaacattgatttat

SEQ ID NO: 1971610 - DNA, 17 bp, Homo sapiens
ttaatatagctattttt

SEQ ID NO: 1971611 - DNA, 20 bp, Homo sapiens
ttaatatatcccagaaatta

SEQ ID NO: 1971612 - DNA, 17 bp, Homo sapiens
ttaatatctgagaagtg

SEQ ID NO: 1971613 - DNA, 22 bp, Homo sapiens
ttaatatctgagaagtgtatat

SEQ ID NO: 1971614 - DNA, 18 bp, Homo sapiens
ttaatatgctacagtact

SEQ ID NO: 1971615 - DNA, 22 bp, Homo sapiens
ttaatatggggatgcagcatta

SEQ ID NO: 1971616 - DNA, 23 bp, Homo sapiens
ttaatatgttaacctcagtgtca

SEQ ID NO: 1971617 - DNA, 14 bp, Homo sapiens
ttaatattattggg

SEQ ID NO: 1971618 - DNA, 22 bp, Homo sapiens
ttaatattcattgtataaaaat

SEQ ID NO: 1971619 - DNA, 16 bp, Homo sapiens
ttaatatttaaacagc

SEQ ID NO: 1971620 - DNA, 21 bp, Homo sapiens
ttaatatttaaacagcagtgt

SEQ ID NO: 1971621 - DNA, 20 bp, Homo sapiens
ttaatatttgctgacagctg

SEQ ID NO: 1971622 - DNA, 15 bp, Homo sapiens
ttaatattttgtatt

SEQ ID NO: 1971623 - DNA, 20 bp, Homo sapiens
ttaatcaggtcctcagagaa

SEQ ID NO: 1971624 - DNA, 15 bp, Homo sapiens
ttaatcgtgtcttca

SEQ ID NO: 1971625 - DNA, 15 bp, Homo sapiens
ttaatcttcagtttt

SEQ ID NO: 1971626 - DNA, 17 bp, Homo sapiens
ttaatctttctttacct

SEQ ID NO: 1971627 - DNA, 14 bp, Homo sapiens
ttaatgaaaatgtc

SEQ ID NO: 1971628 - DNA, 16 bp, Homo sapiens
ttaatgaaaatgtcag

SEQ ID NO: 1971629 - DNA, 14 bp, Homo sapiens
ttaatgaacaaatg

SEQ ID NO: 1971630 - DNA, 16 bp, Homo sapiens
ttaatgaactgtgaca

SEQ ID NO: 1971631 - DNA, 23 bp, Homo sapiens
ttaatgaagacccagtgtaaaga

SEQ ID NO: 1971632 - DNA, 12 bp, Homo sapiens
ttaatgactttt

SEQ ID NO: 1971633 - DNA, 18 bp, Homo sapiens
ttaatgactttttataat

SEQ ID NO: 1971634 - DNA, 20 bp, Homo sapiens
ttaatgcatgttaggaaaat

SEQ ID NO: 1971635 - DNA, 12 bp, Homo sapiens
ttaatgccttcc

SEQ ID NO: 1971636 - DNA, 16 bp, Homo sapiens
ttaatggctgataatt

SEQ ID NO: 1971637 - DNA, 15 bp, Homo sapiens
ttaatggtctaaaaa

SEQ ID NO: 1971638 - DNA, 17 bp, Homo sapiens
ttaatggtgccttcatt

SEQ ID NO: 1971639 - DNA, 12 bp, Homo sapiens
ttaatggttttt

SEQ ID NO: 1971640 - DNA, 19 bp, Homo sapiens
ttaatgtatagtaaatcac

SEQ ID NO: 1971641 - DNA, 18 bp, Homo sapiens
ttaatgtttgatttagta

SEQ ID NO: 1971642 - DNA, 18 bp, Homo sapiens
ttaattaaactgaagaag

SEQ ID NO: 1971643 - DNA, 22 bp, Homo sapiens
ttaattaatatgttcattaaat

SEQ ID NO: 1971644 - DNA, 13 bp, Homo sapiens
ttaattagatttt

SEQ ID NO: 1971645 - DNA, 19 bp, Homo sapiens
ttaattagccagtgaaaaa

SEQ ID NO: 1971646 - DNA, 20 bp, Homo sapiens
ttaattaggggttgctaaga

SEQ ID NO: 1971647 - DNA, 14 bp, Homo sapiens
ttaattattaatac

SEQ ID NO: 1971648 - DNA, 13 bp, Homo sapiens
ttaattcataatt

SEQ ID NO: 1971649 - DNA, 16 bp, Homo sapiens
ttaattcataattaga

SEQ ID NO: 1971650 - DNA, 11 bp, Homo sapiens
ttaattccaag

SEQ ID NO: 1971651 - DNA, 13 bp, Homo sapiens
ttaattctactaa

SEQ ID NO: 1971652 - DNA, 15 bp, Homo sapiens
ttaattctactaaat

SEQ ID NO: 1971653 - DNA, 19 bp, Homo sapiens
ttaatttatatttgaaatt

SEQ ID NO: 1971654 - DNA, 14 bp, Homo sapiens
ttaatttatggttt

SEQ ID NO: 1971655 - DNA, 20 bp, Homo sapiens
ttaattttcctggaaagact

SEQ ID NO: 1971656 - DNA, 20 bp, Homo sapiens
ttaatttttacatgaccaga

SEQ ID NO: 1971657 - DNA, 13 bp, Homo sapiens
ttaatttttgata

SEQ ID NO: 1971658 - DNA, 19 bp, Homo sapiens
ttaatttttttgagacaga

SEQ ID NO: 1971659 - DNA, 17 bp, Homo sapiens
ttaattttttttaatgt

SEQ ID NO: 1971660 - DNA, 17 bp, Homo sapiens
ttacaaaaatagtagaa

SEQ ID NO: 1971661 - DNA, 12 bp, Homo sapiens
ttacaaaatact

SEQ ID NO: 1971662 - DNA, 18 bp, Homo sapiens
ttacaaaatgaagtttta

SEQ ID NO: 1971663 - DNA, 15 bp, Homo sapiens
ttacaaacatgtggt

SEQ ID NO: 1971664 - DNA, 16 bp, Homo sapiens
ttacaaccaagaacat

SEQ ID NO: 1971665 - DNA, 19 bp, Homo sapiens
ttacaaggcacttgtcact

SEQ ID NO: 1971666 - DNA, 16 bp, Homo sapiens
ttacaatgcagaattt

SEQ ID NO: 1971667 - DNA, 16 bp, Homo sapiens
ttacacaattaattgt

SEQ ID NO: 1971668 - DNA, 15 bp, Homo sapiens
ttacacattctcaca

SEQ ID NO: 1971669 - DNA, 15 bp, Homo sapiens
ttacactacaagttt

SEQ ID NO: 1971670 - DNA, 22 bp, Homo sapiens
ttacactacacactgtgtactg

SEQ ID NO: 1971671 - DNA, 14 bp, Homo sapiens
ttacactctttgta

SEQ ID NO: 1971672 - DNA, 16 bp, Homo sapiens
ttacagaggaagttat

SEQ ID NO: 1971673 - DNA, 13 bp, Homo sapiens
ttacagctgcctg

SEQ ID NO: 1971674 - DNA, 16 bp, Homo sapiens
ttacagggcccaggtg

SEQ ID NO: 1971675 - DNA, 17 bp, Homo sapiens
ttacagggcccaggtga

SEQ ID NO: 1971676 - DNA, 18 bp, Homo sapiens
ttacagggcccaggtgag

SEQ ID NO: 1971677 - DNA, 14 bp, Homo sapiens
ttacaggtgtgaac

SEQ ID NO: 1971678 - DNA, 13 bp, Homo sapiens
ttacagtaaataa

SEQ ID NO: 1971679 - DNA, 17 bp, Homo sapiens
ttacataatcaaagcta

SEQ ID NO: 1971680 - DNA, 18 bp, Homo sapiens
ttacatcaaggcttcaaa

SEQ ID NO: 1971681 - DNA, 14 bp, Homo sapiens
ttacatctgtttta

SEQ ID NO: 1971682 - DNA, 17 bp, Homo sapiens
ttacatgattcatttta

SEQ ID NO: 1971683 - DNA, 23 bp, Homo sapiens
ttacatgcaatttattaaaatga

SEQ ID NO: 1971684 - DNA, 19 bp, Homo sapiens
ttacatgctgtgctctttg

SEQ ID NO: 1971685 - DNA, 17 bp, Homo sapiens
ttacatgtttaaattgt

SEQ ID NO: 1971686 - DNA, 13 bp, Homo sapiens
ttacatgtttgca

SEQ ID NO: 1971687 - DNA, 16 bp, Homo sapiens
ttacattaatgttaat

SEQ ID NO: 1971688 - DNA, 16 bp, Homo sapiens
ttacatttccaaatga

SEQ ID NO: 1971689 - DNA, 12 bp, Homo sapiens
ttacattttccc

SEQ ID NO: 1971690 - DNA, 14 bp, Homo sapiens
ttacatttttacaa

SEQ ID NO: 1971691 - DNA, 17 bp, Homo sapiens
ttacatttttacaataa

SEQ ID NO: 1971692 - DNA, 18 bp, Homo sapiens
ttacatttttacaataaa

SEQ ID NO: 1971693 - DNA, 21 bp, Homo sapiens
ttaccaatttaactagtcctg

SEQ ID NO: 1971694 - DNA, 17 bp, Homo sapiens
ttaccacgccttgacct

SEQ ID NO: 1971695 - DNA, 24 bp, Homo sapiens
ttacccaaaaactaaatctctaat

SEQ ID NO: 1971696 - DNA, 22 bp, Homo sapiens
ttacccagagaatatatacatt

SEQ ID NO: 1971697 - DNA, 18 bp, Homo sapiens
ttaccctaaaacatgtgt

SEQ ID NO: 1971698 - DNA, 18 bp, Homo sapiens
ttaccctcctagctttcc

SEQ ID NO: 1971699 - DNA, 22 bp, Homo sapiens
ttaccctgcgattttgcctgtg

SEQ ID NO: 1971700 - DNA, 17 bp, Homo sapiens
ttacctaaacagatata

SEQ ID NO: 1971701 - DNA, 18 bp, Homo sapiens
ttacctaaacagatataa

SEQ ID NO: 1971702 - DNA, 18 bp, Homo sapiens
ttacctcccctgccaggg

SEQ ID NO: 1971703 - DNA, 13 bp, Homo sapiens
ttacctcctgccc

SEQ ID NO: 1971704 - DNA, 20 bp, Homo sapiens
ttacctgacggacgtcctgc

SEQ ID NO: 1971705 - DNA, 18 bp, Homo sapiens
ttacctgatcatggtcag

SEQ ID NO: 1971706 - DNA, 21 bp, Homo sapiens
ttacctgatcatggtcagctc

SEQ ID NO: 1971707 - DNA, 22 bp, Homo sapiens
ttacctgcatgtgttgtacaat

SEQ ID NO: 1971708 - DNA, 15 bp, Homo sapiens
ttacctgccacttcc

SEQ ID NO: 1971709 - DNA, 15 bp, Homo sapiens
ttaccttaaaaagta

SEQ ID NO: 1971710 - DNA, 17 bp, Homo sapiens
ttaccttcaataaagta

SEQ ID NO: 1971711 - DNA, 19 bp, Homo sapiens
ttaccttcaataaagtatc

SEQ ID NO: 1971712 - DNA, 20 bp, Homo sapiens
ttacgcacacgtacttaaat

SEQ ID NO: 1971713 - DNA, 14 bp, Homo sapiens
ttacgtctttggag

SEQ ID NO: 1971714 - DNA, 12 bp, Homo sapiens
ttactaaaagaa

SEQ ID NO: 1971715 - DNA, 13 bp, Homo sapiens
ttactaaacattt

SEQ ID NO: 1971716 - DNA, 14 bp, Homo sapiens
ttactaaagcagtg

SEQ ID NO: 1971717 - DNA, 16 bp, Homo sapiens
ttactaaagcagtgtt

SEQ ID NO: 1971718 - DNA, 17 bp, Homo sapiens
ttactaaagcagtgttt

SEQ ID NO: 1971719 - DNA, 18 bp, Homo sapiens
ttactaaagcagtgtttt

SEQ ID NO: 1971720 - DNA, 19 bp, Homo sapiens
ttactaaagcagtgttttc

SEQ ID NO: 1971721 - DNA, 12 bp, Homo sapiens
ttactaaagtca

SEQ ID NO: 1971722 - DNA, 15 bp, Homo sapiens
ttactaaattgtata

SEQ ID NO: 1971723 - DNA, 15 bp, Homo sapiens
ttactacagttgttt

SEQ ID NO: 1971724 - DNA, 22 bp, Homo sapiens
ttactactattctgttaaaatc

SEQ ID NO: 1971725 - DNA, 16 bp, Homo sapiens
ttactatgcacaattt

SEQ ID NO: 1971726 - DNA, 12 bp, Homo sapiens
ttactcagccct

SEQ ID NO: 1971727 - DNA, 21 bp, Homo sapiens
ttactcataaggcatatacaa

SEQ ID NO: 1971728 - DNA, 14 bp, Homo sapiens
ttactcccttcctg

SEQ ID NO: 1971729 - DNA, 19 bp, Homo sapiens
ttactcctgtgggagcctc

SEQ ID NO: 1971730 - DNA, 22 bp, Homo sapiens
ttactcctttgcattccatgat

SEQ ID NO: 1971731 - DNA, 16 bp, Homo sapiens
ttactctccaacctgg

SEQ ID NO: 1971732 - DNA, 17 bp, Homo sapiens
ttactctgagcccaggc

SEQ ID NO: 1971733 - DNA, 22 bp, Homo sapiens
ttactctgcggtggtgccagag

SEQ ID NO: 1971734 - DNA, 16 bp, Homo sapiens
ttactgagcttctctg

SEQ ID NO: 1971735 - DNA, 18 bp, Homo sapiens
ttactgagcttctctgtg

SEQ ID NO: 1971736 - DNA, 21 bp, Homo sapiens
ttactgcatggggaaagagat

SEQ ID NO: 1971737 - DNA, 14 bp, Homo sapiens
ttactgctgtcatt

SEQ ID NO: 1971738 - DNA, 20 bp, Homo sapiens
ttactgctgtcattgtccat

SEQ ID NO: 1971739 - DNA, 21 bp, Homo sapiens
ttactggtttcagttgacaaa

SEQ ID NO: 1971740 - DNA, 18 bp, Homo sapiens
ttactgtctgtaagagaa

SEQ ID NO: 1971741 - DNA, 15 bp, Homo sapiens
ttactgttgcactga

SEQ ID NO: 1971742 - DNA, 18 bp, Homo sapiens
ttacttaaagcttgtttg

SEQ ID NO: 1971743 - DNA, 13 bp, Homo sapiens
ttacttacctaaa

SEQ ID NO: 1971744 - DNA, 13 bp, Homo sapiens
ttacttacctgca

SEQ ID NO: 1971745 - DNA, 15 bp, Homo sapiens
ttacttacctgcatg

SEQ ID NO: 1971746 - DNA, 19 bp, Homo sapiens
ttacttcactttaattctc

SEQ ID NO: 1971747 - DNA, 13 bp, Homo sapiens
ttacttcagggct

SEQ ID NO: 1971748 - DNA, 15 bp, Homo sapiens
ttacttcctaaattt

SEQ ID NO: 1971749 - DNA, 12 bp, Homo sapiens
ttacttctgcta

SEQ ID NO: 1971750 - DNA, 12 bp, Homo sapiens
ttacttgaactt

SEQ ID NO: 1971751 - DNA, 18 bp, Homo sapiens
ttacttgaactttccaaa

SEQ ID NO: 1971752 - DNA, 14 bp, Homo sapiens
ttacttgacctcct

SEQ ID NO: 1971753 - DNA, 18 bp, Homo sapiens
ttacttggtgtaattaat

SEQ ID NO: 1971754 - DNA, 17 bp, Homo sapiens
ttacttgtagaaatctg

SEQ ID NO: 1971755 - DNA, 20 bp, Homo sapiens
ttacttgtttgtaagattta

SEQ ID NO: 1971756 - DNA, 17 bp, Homo sapiens
ttactttaaaaggagcc

SEQ ID NO: 1971757 - DNA, 11 bp, Homo sapiens
ttactttctgt

SEQ ID NO: 1971758 - DNA, 18 bp, Homo sapiens
ttactttctgttgccaca

SEQ ID NO: 1971759 - DNA, 21 bp, Homo sapiens
ttactttggaatgactataaa

SEQ ID NO: 1971760 - DNA, 21 bp, Homo sapiens
ttactttttagtcttttactc

SEQ ID NO: 1971761 - DNA, 17 bp, Homo sapiens
ttagaaacatggttttg

SEQ ID NO: 1971762 - DNA, 22 bp, Homo sapiens
ttagaaagaagcccaatattat

SEQ ID NO: 1971763 - DNA, 17 bp, Homo sapiens
ttagaaagcaacttatc

SEQ ID NO: 1971764 - DNA, 13 bp, Homo sapiens
ttagaaatagaca

SEQ ID NO: 1971765 - DNA, 19 bp, Homo sapiens
ttagaaatcattgtagaaa

SEQ ID NO: 1971766 - DNA, 13 bp, Homo sapiens
ttagaaatcattt

SEQ ID NO: 1971767 - DNA, 17 bp, Homo sapiens
ttagaaattgcatttcc

SEQ ID NO: 1971768 - DNA, 13 bp, Homo sapiens
ttagaagtgtttt

SEQ ID NO: 1971769 - DNA, 15 bp, Homo sapiens
ttagaataaaattgt

SEQ ID NO: 1971770 - DNA, 12 bp, Homo sapiens
ttagaatatatt

SEQ ID NO: 1971771 - DNA, 11 bp, Homo sapiens
ttagacagagt

SEQ ID NO: 1971772 - DNA, 13 bp, Homo sapiens
ttagacagagtct

SEQ ID NO: 1971773 - DNA, 11 bp, Homo sapiens
ttagaccctgt

SEQ ID NO: 1971774 - DNA, 11 bp, Homo sapiens
ttagacctcag

SEQ ID NO: 1971775 - DNA, 12 bp, Homo sapiens
ttagacctcagc

SEQ ID NO: 1971776 - DNA, 13 bp, Homo sapiens
ttagacctcagcc

SEQ ID NO: 1971777 - DNA, 16 bp, Homo sapiens
ttagactggaacttga

SEQ ID NO: 1971778 - DNA, 16 bp, Homo sapiens
ttagactggacagctt

SEQ ID NO: 1971779 - DNA, 20 bp, Homo sapiens
ttagagaggtagcgagctgc

SEQ ID NO: 1971780 - DNA, 18 bp, Homo sapiens
ttagagattaatttgtgt

SEQ ID NO: 1971781 - DNA, 15 bp, Homo sapiens
ttagagattgcccca

SEQ ID NO: 1971782 - DNA, 15 bp, Homo sapiens
ttagagcttggacag

SEQ ID NO: 1971783 - DNA, 19 bp, Homo sapiens
ttagaggaaaaaaatgact

SEQ ID NO: 1971784 - DNA, 20 bp, Homo sapiens
ttagagtgcccttaaaataa

SEQ ID NO: 1971785 - DNA, 15 bp, Homo sapiens
ttagatgttttacaa

SEQ ID NO: 1971786 - DNA, 16 bp, Homo sapiens
ttagattagctctgga

SEQ ID NO: 1971787 - DNA, 16 bp, Homo sapiens
ttagattccaggatca

SEQ ID NO: 1971788 - DNA, 19 bp, Homo sapiens
ttagatttcaagaaaaaat

SEQ ID NO: 1971789 - DNA, 20 bp, Homo sapiens
ttagcacccttctgctgtat

SEQ ID NO: 1971790 - DNA, 13 bp, Homo sapiens
ttagcacttcttt

SEQ ID NO: 1971791 - DNA, 23 bp, Homo sapiens
ttagcagctcttcccctttcctg

SEQ ID NO: 1971792 - DNA, 22 bp, Homo sapiens
ttagcaggaaatagtgttcttt

SEQ ID NO: 1971793 - DNA, 16 bp, Homo sapiens
ttagcagtttgctttg

SEQ ID NO: 1971794 - DNA, 22 bp, Homo sapiens
ttagcatttagtccaatgtctt

SEQ ID NO: 1971795 - DNA, 17 bp, Homo sapiens
ttagcccaagaggtctg

SEQ ID NO: 1971796 - DNA, 22 bp, Homo sapiens
ttagcccaagaggtctgagccc

SEQ ID NO: 1971797 - DNA, 12 bp, Homo sapiens
ttagcctggagc

SEQ ID NO: 1971798 - DNA, 14 bp, Homo sapiens
ttagccttctctgt

SEQ ID NO: 1971799 - DNA, 18 bp, Homo sapiens
ttagccttgtgccctgcc

SEQ ID NO: 1971800 - DNA, 14 bp, Homo sapiens
ttagcggagacgga

SEQ ID NO: 1971801 - DNA, 14 bp, Homo sapiens
ttagctagaatgca

SEQ ID NO: 1971802 - DNA, 16 bp, Homo sapiens
ttcaaattgtcttttg

SEQ ID NO: 1971803 - DNA, 18 bp, Homo sapiens
ttcaacaattctaaaatg

SEQ ID NO: 1971804 - DNA, 21 bp, Homo sapiens
ttcaacacattacttgcacaa

SEQ ID NO: 1971805 - DNA, 17 bp, Homo sapiens
ttcaacatgttatttgt

SEQ ID NO: 1971806 - DNA, 19 bp, Homo sapiens
ttcaaccactgtaaaatga

SEQ ID NO: 1971807 - DNA, 17 bp, Homo sapiens
ttcaaccagcattttac

SEQ ID NO: 1971808 - DNA, 17 bp, Homo sapiens
ttcaaccattccccatg

SEQ ID NO: 1971809 - DNA, 13 bp, Homo sapiens
ttcaacgcagccc

SEQ ID NO: 1971810 - DNA, 15 bp, Homo sapiens
ttcaacgcagccctg

SEQ ID NO: 1971811 - DNA, 12 bp, Homo sapiens
ttcaactccaga

SEQ ID NO: 1971812 - DNA, 21 bp, Homo sapiens
ttcaactccagaagtggggct

SEQ ID NO: 1971813 - DNA, 18 bp, Homo sapiens
ttcaacttaaatcactga

SEQ ID NO: 1971814 - DNA, 23 bp, Homo sapiens
ttcaagaaaaaataaatggaaat

SEQ ID NO: 1971815 - DNA, 12 bp, Homo sapiens
ttcaagaaactg

SEQ ID NO: 1971816 - DNA, 20 bp, Homo sapiens
ttcaagaaactgaggaattt

SEQ ID NO: 1971817 - DNA, 22 bp, Homo sapiens
ttcaagacaccaaattccaaac

SEQ ID NO: 1971818 - DNA, 18 bp, Homo sapiens
ttcaagaccttctcccca

SEQ ID NO: 1971819 - DNA, 16 bp, Homo sapiens
ttcaagagacactgct

SEQ ID NO: 1971820 - DNA, 21 bp, Homo sapiens
ttcaagagtgcagttgattct

SEQ ID NO: 1971821 - DNA, 21 bp, Homo sapiens
ttcaagattggacatggtctc

SEQ ID NO: 1971822 - DNA, 12 bp, Homo sapiens
ttcaagccatgg

SEQ ID NO: 1971823 - DNA, 15 bp, Homo sapiens
ttcaagcgattctca

SEQ ID NO: 1971824 - DNA, 22 bp, Homo sapiens
ttcaagcgattcttgtgcctca

SEQ ID NO: 1971825 - DNA, 15 bp, Homo sapiens
ttcaagggaagaaac

SEQ ID NO: 1971826 - DNA, 21 bp, Homo sapiens
ttcaagggaagaaacactctt

SEQ ID NO: 1971827 - DNA, 19 bp, Homo sapiens
ttcaagtgatatatgtatt

SEQ ID NO: 1971828 - DNA, 22 bp, Homo sapiens
ttcaagtgcatgctctctgcag

SEQ ID NO: 1971829 - DNA, 17 bp, Homo sapiens
ttcaagttaaattttat

SEQ ID NO: 1971830 - DNA, 14 bp, Homo sapiens
ttcaagttattgta

SEQ ID NO: 1971831 - DNA, 17 bp, Homo sapiens
ttcaagttattgtacag

SEQ ID NO: 1971832 - DNA, 20 bp, Homo sapiens
ttcaagttattgtacagctg

SEQ ID NO: 1971833 - DNA, 12 bp, Homo sapiens
ttcaataaagct

SEQ ID NO: 1971834 - DNA, 11 bp, Homo sapiens
ttcaatattta

SEQ ID NO: 1971835 - DNA, 23 bp, Homo sapiens
ttcaatggtttgcaaggaagcca

SEQ ID NO: 1971836 - DNA, 15 bp, Homo sapiens
ttcaattcaaagctg

SEQ ID NO: 1971837 - DNA, 19 bp, Homo sapiens
ttcaattcagtgctgtact

SEQ ID NO: 1971838 - DNA, 12 bp, Homo sapiens
ttcaattcctct

SEQ ID NO: 1971839 - DNA, 16 bp, Homo sapiens
ttcaatttaattctta

SEQ ID NO: 1971840 - DNA, 22 bp, Homo sapiens
ttcacaaccagccacacagagc

SEQ ID NO: 1971841 - DNA, 13 bp, Homo sapiens
ttcacacacccct

SEQ ID NO: 1971842 - DNA, 15 bp, Homo sapiens
ttcacacaggtcctg

SEQ ID NO: 1971843 - DNA, 20 bp, Homo sapiens
ttcacacctcacgctctgga

SEQ ID NO: 1971844 - DNA, 16 bp, Homo sapiens
ttcacactgtgcgttt

SEQ ID NO: 1971845 - DNA, 15 bp, Homo sapiens
ttcacataccctccc

SEQ ID NO: 1971846 - DNA, 21 bp, Homo sapiens
ttcacatacgtgtctgtgtgt

SEQ ID NO: 1971847 - DNA, 15 bp, Homo sapiens
ttcacatttgatgta

SEQ ID NO: 1971848 - DNA, 22 bp, Homo sapiens
ttcaccacatgtgcacatgcac

SEQ ID NO: 1971849 - DNA, 19 bp, Homo sapiens
ttcaccagcaactctgact

SEQ ID NO: 1971850 - DNA, 13 bp, Homo sapiens
ttcaccatttccg

SEQ ID NO: 1971851 - DNA, 22 bp, Homo sapiens
ttcaccccccactcaccagtgt

SEQ ID NO: 1971852 - DNA, 13 bp, Homo sapiens
ttcacccctgcac

SEQ ID NO: 1971853 - DNA, 17 bp, Homo sapiens
ttcacccctgcacttca

SEQ ID NO: 1971854 - DNA, 19 bp, Homo sapiens
ttcacctgtttttaagctg

SEQ ID NO: 1971855 - DNA, 21 bp, Homo sapiens
ttcacctgtttttaagctgtt

SEQ ID NO: 1971856 - DNA, 15 bp, Homo sapiens
ttcaccttatgtatt

SEQ ID NO: 1971857 - DNA, 15 bp, Homo sapiens
ttcacctttggtgca

SEQ ID NO: 1971858 - DNA, 22 bp, Homo sapiens
ttcacctttggtgcagaggttt

SEQ ID NO: 1971859 - DNA, 14 bp, Homo sapiens
ttcacgcaacttga

SEQ ID NO: 1971860 - DNA, 16 bp, Homo sapiens
ttcacgcaacttgaaa

SEQ ID NO: 1971861 - DNA, 23 bp, Homo sapiens
ttcacgttgggtggagagagtat

SEQ ID NO: 1971862 - DNA, 17 bp, Homo sapiens
ttcactcagccacaccc

SEQ ID NO: 1971863 - DNA, 19 bp, Homo sapiens
ttcactcagccacacccca

SEQ ID NO: 1971864 - DNA, 22 bp, Homo sapiens
ttcactccggtgtgcctgcagc

SEQ ID NO: 1971865 - DNA, 22 bp, Homo sapiens
ttcactgaagaaaccttcagat

SEQ ID NO: 1971866 - DNA, 16 bp, Homo sapiens
ttcactggagttacat

SEQ ID NO: 1971867 - DNA, 19 bp, Homo sapiens
ttcactggagttacattaa

SEQ ID NO: 1971868 - DNA, 20 bp, Homo sapiens
ttcactgtaagactcattcc

SEQ ID NO: 1971869 - DNA, 22 bp, Homo sapiens
ttcactgtagaatgatttcatg

SEQ ID NO: 1971870 - DNA, 22 bp, Homo sapiens
ttcactgtgttggccaggctgg

SEQ ID NO: 1971871 - DNA, 14 bp, Homo sapiens
ttcacttgcttaaa

SEQ ID NO: 1971872 - DNA, 12 bp, Homo sapiens
ttcactttaaag

SEQ ID NO: 1971873 - DNA, 23 bp, Homo sapiens
ttcagaaataaaatgaaatgtct

SEQ ID NO: 1971874 - DNA, 13 bp, Homo sapiens
ttcagaaatatgt

SEQ ID NO: 1971875 - DNA, 13 bp, Homo sapiens
ttcagaacagagg

SEQ ID NO: 1971876 - DNA, 22 bp, Homo sapiens
ttcagaagacacaggggagcag

SEQ ID NO: 1971877 - DNA, 13 bp, Homo sapiens
ttcagaaggagaa

SEQ ID NO: 1971878 - DNA, 20 bp, Homo sapiens
ttcagaagtttggcaatagt

SEQ ID NO: 1971879 - DNA, 16 bp, Homo sapiens
ttcagaataagcttcc

SEQ ID NO: 1971880 - DNA, 10 bp, Homo sapiens
ttcagacccc

SEQ ID NO: 1971881 - DNA, 23 bp, Homo sapiens
ttcagacctgacaccgtccctca

SEQ ID NO: 1971882 - DNA, 12 bp, Homo sapiens
ttcagactcaga

SEQ ID NO: 1971883 - DNA, 21 bp, Homo sapiens
ttcagacttttatcaaaatcc

SEQ ID NO: 1971884 - DNA, 13 bp, Homo sapiens
ttcagagaatatc

SEQ ID NO: 1971885 - DNA, 20 bp, Homo sapiens
ttcagagactcagggcccca

SEQ ID NO: 1971886 - DNA, 20 bp, Homo sapiens
ttcagagagggcagaggggt

SEQ ID NO: 1971887 - DNA, 18 bp, Homo sapiens
ttcagagatgtaccatgt

SEQ ID NO: 1971888 - DNA, 13 bp, Homo sapiens
ttcagagcctagc

SEQ ID NO: 1971889 - DNA, 14 bp, Homo sapiens
ttcagaggctgcag

SEQ ID NO: 1971890 - DNA, 17 bp, Homo sapiens
ttcagagggaaagtaaa

SEQ ID NO: 1971891 - DNA, 18 bp, Homo sapiens
ttcagagttgtacactgt

SEQ ID NO: 1971892 - DNA, 16 bp, Homo sapiens
ttcagatcgtattaat

SEQ ID NO: 1971893 - DNA, 13 bp, Homo sapiens
ttcagcaactcag

SEQ ID NO: 1971894 - DNA, 18 bp, Homo sapiens
ttcagcaagacttctctt

SEQ ID NO: 1971895 - DNA, 21 bp, Homo sapiens
ttcagcacaccccaagggaca

SEQ ID NO: 1971896 - DNA, 23 bp, Homo sapiens
ttcagcaccctgggtgccattcc

SEQ ID NO: 1971897 - DNA, 15 bp, Homo sapiens
ttcagcactcagaaa

SEQ ID NO: 1971898 - DNA, 16 bp, Homo sapiens
ttcagcatatttatag

SEQ ID NO: 1971899 - DNA, 21 bp, Homo sapiens
ttcagccagaatcttcgtcct

SEQ ID NO: 1971900 - DNA, 20 bp, Homo sapiens
ttcagcccctcctctgccac

SEQ ID NO: 1971901 - DNA, 23 bp, Homo sapiens
ttcagcccctcctctgccacctc

SEQ ID NO: 1971902 - DNA, 23 bp, Homo sapiens
ttcagcctagccgacctcagcct

SEQ ID NO: 1971903 - DNA, 14 bp, Homo sapiens
ttcagcctctccca

SEQ ID NO: 1971904 - DNA, 18 bp, Homo sapiens
ttcagcgagacccttgca

SEQ ID NO: 1971905 - DNA, 20 bp, Homo sapiens
ttcagctaagctaggaatga

SEQ ID NO: 1971906 - DNA, 12 bp, Homo sapiens
ttcagctccagc

SEQ ID NO: 1971907 - DNA, 16 bp, Homo sapiens
ttcagctctctgtata

SEQ ID NO: 1971908 - DNA, 22 bp, Homo sapiens
ttcagcttgtaaatagctcagg

SEQ ID NO: 1971909 - DNA, 19 bp, Homo sapiens
ttcaggaaaaggcctgggg

SEQ ID NO: 1971910 - DNA, 18 bp, Homo sapiens
ttcaggaaaattgaatgc

SEQ ID NO: 1971911 - DNA, 16 bp, Homo sapiens
ttcaggacatggggca

SEQ ID NO: 1971912 - DNA, 20 bp, Homo sapiens
ttcaggacatggggcataga

SEQ ID NO: 1971913 - DNA, 15 bp, Homo sapiens
ttcaggactggctca

SEQ ID NO: 1971914 - DNA, 18 bp, Homo sapiens
ttcaggactggctcaccc

SEQ ID NO: 1971915 - DNA, 21 bp, Homo sapiens
ttcaggacttaacggctccag

SEQ ID NO: 1971916 - DNA, 18 bp, Homo sapiens
ttccagtacctttgtcac

SEQ ID NO: 1971917 - DNA, 18 bp, Homo sapiens
ttccagtctctgcatgta

SEQ ID NO: 1971918 - DNA, 21 bp, Homo sapiens
ttccagtgagcttatcatgct

SEQ ID NO: 1971919 - DNA, 13 bp, Homo sapiens
ttccagtgcatgt

SEQ ID NO: 1971920 - DNA, 22 bp, Homo sapiens
ttccagttcatctatggcagtc

SEQ ID NO: 1971921 - DNA, 19 bp, Homo sapiens
ttccagttctgacacacgt

SEQ ID NO: 1971922 - DNA, 14 bp, Homo sapiens
ttccataaccccag

SEQ ID NO: 1971923 - DNA, 23 bp, Homo sapiens
ttccataatctggactcctctgt

SEQ ID NO: 1971924 - DNA, 19 bp, Homo sapiens
ttccataatgtataaagaa

SEQ ID NO: 1971925 - DNA, 18 bp, Homo sapiens
ttccataattatgacagt

SEQ ID NO: 1971926 - DNA, 22 bp, Homo sapiens
ttccatcacccgtacaggcaat

SEQ ID NO: 1971927 - DNA, 13 bp, Homo sapiens
ttccatgcctgag

SEQ ID NO: 1971928 - DNA, 15 bp, Homo sapiens
ttccatgcctgaggg

SEQ ID NO: 1971929 - DNA, 16 bp, Homo sapiens
ttccatgcctgagggt

SEQ ID NO: 1971930 - DNA, 18 bp, Homo sapiens
ttccatgcctgagggtgg

SEQ ID NO: 1971931 - DNA, 23 bp, Homo sapiens
ttccatgcctgagggtggagact

SEQ ID NO: 1971932 - DNA, 19 bp, Homo sapiens
ttccatgtcgcctctgcat

SEQ ID NO: 1971933 - DNA, 12 bp, Homo sapiens
ttccatgttaaa

SEQ ID NO: 1971934 - DNA, 16 bp, Homo sapiens
ttccatttcttcctca

SEQ ID NO: 1971935 - DNA, 18 bp, Homo sapiens
ttccatttcttcctcact

SEQ ID NO: 1971936 - DNA, 22 bp, Homo sapiens
ttcccaaaatgttgaaatatga

SEQ ID NO: 1971937 - DNA, 18 bp, Homo sapiens
ttcccaaactacagaata

SEQ ID NO: 1971938 - DNA, 20 bp, Homo sapiens
ttcccaaactacagaataat

SEQ ID NO: 1971939 - DNA, 17 bp, Homo sapiens
ttcccaactgctctgcc

SEQ ID NO: 1971940 - DNA, 20 bp, Homo sapiens
ttcccaagagcatcatgcct

SEQ ID NO: 1971941 - DNA, 15 bp, Homo sapiens
ttcccaagctctgct

SEQ ID NO: 1971942 - DNA, 15 bp, Homo sapiens
ttcccaataaaagtg

SEQ ID NO: 1971943 - DNA, 15 bp, Homo sapiens
ttcccaatcagcact

SEQ ID NO: 1971944 - DNA, 16 bp, Homo sapiens
ttcccaatcagcactg

SEQ ID NO: 1971945 - DNA, 20 bp, Homo sapiens
ttcccacagcattcctccat

SEQ ID NO: 1971946 - DNA, 14 bp, Homo sapiens
ttcccaccagcatg

SEQ ID NO: 1971947 - DNA, 15 bp, Homo sapiens
ttcccaccagcatgt

SEQ ID NO: 1971948 - DNA, 23 bp, Homo sapiens
ttcccaccagcatgtcactccca

SEQ ID NO: 1971949 - DNA, 16 bp, Homo sapiens
ttcccagagaagctca

SEQ ID NO: 1971950 - DNA, 10 bp, Homo sapiens
ttcccagagg

SEQ ID NO: 1971951 - DNA, 11 bp, Homo sapiens
ttcccagaggc

SEQ ID NO: 1971952 - DNA, 18 bp, Homo sapiens
ttcccagcattcagtggt

SEQ ID NO: 1971953 - DNA, 23 bp, Homo sapiens
ttcccagctctccctctggccct

SEQ ID NO: 1971954 - DNA, 18 bp, Homo sapiens
ttcccataattttcttca

SEQ ID NO: 1971955 - DNA, 14 bp, Homo sapiens
ttcccatccccagc

SEQ ID NO: 1971956 - DNA, 16 bp, Homo sapiens
ttcccatgatgccgct

SEQ ID NO: 1971957 - DNA, 20 bp, Homo sapiens
ttcccattgcatcacctctg

SEQ ID NO: 1971958 - DNA, 13 bp, Homo sapiens
ttcccattttgga

SEQ ID NO: 1971959 - DNA, 15 bp, Homo sapiens
ttccccaaagtctta

SEQ ID NO: 1971960 - DNA, 18 bp, Homo sapiens
ttccccaaccacttcatt

SEQ ID NO: 1971961 - DNA, 13 bp, Homo sapiens
ttccccacagaac

SEQ ID NO: 1971962 - DNA, 12 bp, Homo sapiens
ttccccagacac

SEQ ID NO: 1971963 - DNA, 13 bp, Homo sapiens
ttccccagactca

SEQ ID NO: 1971964 - DNA, 21 bp, Homo sapiens
ttccccagactcagctccaga

SEQ ID NO: 1971965 - DNA, 22 bp, Homo sapiens
ttccccagactcagctccagaa

SEQ ID NO: 1971966 - DNA, 23 bp, Homo sapiens
ttccccagtgtggccccagcccg

SEQ ID NO: 1971967 - DNA, 17 bp, Homo sapiens
ttccccatggggctgcg

SEQ ID NO: 1971968 - DNA, 17 bp, Homo sapiens
ttcccccaccccagagt

SEQ ID NO: 1971969 - DNA, 22 bp, Homo sapiens
ttcccccttactacttcttgga

SEQ ID NO: 1971970 - DNA, 16 bp, Homo sapiens
ttccccgggggaggaa

SEQ ID NO: 1971971 - DNA, 15 bp, Homo sapiens
ttcccctcgctgtcc

SEQ ID NO: 1971972 - DNA, 17 bp, Homo sapiens
ttcccctcgctgtcctg

SEQ ID NO: 1971973 - DNA, 12 bp, Homo sapiens
ttcccctgtggt

SEQ ID NO: 1971974 - DNA, 14 bp, Homo sapiens
ttcccctgttcact

SEQ ID NO: 1971975 - DNA, 20 bp, Homo sapiens
ttccccttgcccttgccctg

SEQ ID NO: 1971976 - DNA, 21 bp, Homo sapiens
ttccccttgcccttgccctga

SEQ ID NO: 1971977 - DNA, 22 bp, Homo sapiens
ttccccttgcccttgccctgac

SEQ ID NO: 1971978 - DNA, 14 bp, Homo sapiens
ttccccttggcttc

SEQ ID NO: 1971979 - DNA, 17 bp, Homo sapiens
ttcccctttccccactc

SEQ ID NO: 1971980 - DNA, 22 bp, Homo sapiens
ttcccgagcaaagtctaaagtt

SEQ ID NO: 1971981 - DNA, 15 bp, Homo sapiens
ttcccgctcagccct

SEQ ID NO: 1971982 - DNA, 16 bp, Homo sapiens
ttcccgctcagccctc

SEQ ID NO: 1971983 - DNA, 17 bp, Homo sapiens
ttcccggagcacagccc

SEQ ID NO: 1971984 - DNA, 18 bp, Homo sapiens
ttcccggagcacagccct

SEQ ID NO: 1971985 - DNA, 20 bp, Homo sapiens
ttcccggagcacagccctgg

SEQ ID NO: 1971986 - DNA, 15 bp, Homo sapiens
ttccctaactctcgg

SEQ ID NO: 1971987 - DNA, 14 bp, Homo sapiens
ttccctacttcctg

SEQ ID NO: 1971988 - DNA, 16 bp, Homo sapiens
ttccctacttcctgtg

SEQ ID NO: 1971989 - DNA, 23 bp, Homo sapiens
ttccctaggctgagctggcattg

SEQ ID NO: 1971990 - DNA, 15 bp, Homo sapiens
ttccctatcaaaaca

SEQ ID NO: 1971991 - DNA, 17 bp, Homo sapiens
ttccctatcaaaacata

SEQ ID NO: 1971992 - DNA, 18 bp, Homo sapiens
ttccctatcaaaacatat

SEQ ID NO: 1971993 - DNA, 21 bp, Homo sapiens
ttccctattatttccgggtgg

SEQ ID NO: 1971994 - DNA, 13 bp, Homo sapiens
ttccctcaccccc

SEQ ID NO: 1971995 - DNA, 15 bp, Homo sapiens
ttccctcccaacaga

SEQ ID NO: 1971996 - DNA, 13 bp, Homo sapiens
ttccctccttccc

SEQ ID NO: 1971997 - DNA, 19 bp, Homo sapiens
ttccctccttcccttctct

SEQ ID NO: 1971998 - DNA, 17 bp, Homo sapiens
ttccctctcccaggccc

SEQ ID NO: 1971999 - DNA, 12 bp, Homo sapiens
ttccctctctag

SEQ ID NO: 1972000 - DNA, 23 bp, Homo sapiens
ttccctctcttgcctttcttatt

SEQ ID NO: 1972001 - DNA, 22 bp, Homo sapiens
ttccctctgagaattccaagga

SEQ ID NO: 1972002 - DNA, 15 bp, Homo sapiens
ttccctctttcccca

SEQ ID NO: 1972003 - DNA, 19 bp, Homo sapiens
ttccctctttccccacctc

SEQ ID NO: 1972004 - DNA, 20 bp, Homo sapiens
ttccctctttccccacctct

SEQ ID NO: 1972005 - DNA, 19 bp, Homo sapiens
ttccctgaaaacccagaga

SEQ ID NO: 1972006 - DNA, 23 bp, Homo sapiens
ttccctgagaaacccaccagcct

SEQ ID NO: 1972007 - DNA, 18 bp, Homo sapiens
ttccctgagtcaccagga

SEQ ID NO: 1972008 - DNA, 19 bp, Homo sapiens
ttccctgagtcaccaggaa

SEQ ID NO: 1972009 - DNA, 11 bp, Homo sapiens
ttccctgcacc

SEQ ID NO: 1972010 - DNA, 12 bp, Homo sapiens
ttccctggcctg

SEQ ID NO: 1972011 - DNA, 14 bp, Homo sapiens
ttccctgggaaggc

SEQ ID NO: 1972012 - DNA, 23 bp, Homo sapiens
ttccctgggggcagatatttccc

SEQ ID NO: 1972013 - DNA, 14 bp, Homo sapiens
ttcccttctatgca

SEQ ID NO: 1972014 - DNA, 22 bp, Homo sapiens
ttcccttctctccttccctctt

SEQ ID NO: 1972015 - DNA, 13 bp, Homo sapiens
ttcccttgaccat

SEQ ID NO: 1972016 - DNA, 20 bp, Homo sapiens
ttcccttgaccattggctgc

SEQ ID NO: 1972017 - DNA, 17 bp, Homo sapiens
ttcccttggatgtagtc

SEQ ID NO: 1972018 - DNA, 19 bp, Homo sapiens
ttccgaagaccttctgaag

SEQ ID NO: 1972019 - DNA, 21 bp, Homo sapiens
ttccgaagaccttctgaagat

SEQ ID NO: 1972020 - DNA, 16 bp, Homo sapiens
ttccgctcctttacct

SEQ ID NO: 1972021 - DNA, 22 bp, Homo sapiens
ttccgctgtcgccccaggccct

SEQ ID NO: 1972022 - DNA, 18 bp, Homo sapiens
ttccgggaataacatgat

SEQ ID NO: 1972023 - DNA, 19 bp, Homo sapiens
ttccgtctccctaaaataa

SEQ ID NO: 1972024 - DNA, 20 bp, Homo sapiens
ttccgtctccctaaaataaa

SEQ ID NO: 1972025 - DNA, 17 bp, Homo sapiens
ttccgtgaagggcaccg

SEQ ID NO: 1972026 - DNA, 20 bp, Homo sapiens
ttcctaaaaataagctttat

SEQ ID NO: 1972027 - DNA, 13 bp, Homo sapiens
ttcctacaaaatg

SEQ ID NO: 1972028 - DNA, 18 bp, Homo sapiens
ttcctacacccttggact

SEQ ID NO: 1972029 - DNA, 21 bp, Homo sapiens
ttcctacacccttggacttga

SEQ ID NO: 1972030 - DNA, 22 bp, Homo sapiens
ttcctacagaaatactgctctg

SEQ ID NO: 1972031 - DNA, 16 bp, Homo sapiens
ttctacaaccagagcc

SEQ ID NO: 1972032 - DNA, 18 bp, Homo sapiens
ttctaccatttcagagag

SEQ ID NO: 1972033 - DNA, 20 bp, Homo sapiens
ttctacccagagccttctcc

SEQ ID NO: 1972034 - DNA, 22 bp, Homo sapiens
ttctacccagagccttctcctg

SEQ ID NO: 1972035 - DNA, 21 bp, Homo sapiens
ttctacccagcgagccctggt

SEQ ID NO: 1972036 - DNA, 22 bp, Homo sapiens
ttctacgttatgaaaacagatg

SEQ ID NO: 1972037 - DNA, 15 bp, Homo sapiens
ttctacttttaaaga

SEQ ID NO: 1972038 - DNA, 14 bp, Homo sapiens
ttctagagaagagg

SEQ ID NO: 1972039 - DNA, 16 bp, Homo sapiens
ttctagccaaactatt

SEQ ID NO: 1972040 - DNA, 21 bp, Homo sapiens
ttctagctgttgagctgtttt

SEQ ID NO: 1972041 - DNA, 19 bp, Homo sapiens
ttctaggagtcaactggct

SEQ ID NO: 1972042 - DNA, 21 bp, Homo sapiens
ttctaggagtcaactggctgg

SEQ ID NO: 1972043 - DNA, 15 bp, Homo sapiens
ttctaggttctaaaa

SEQ ID NO: 1972044 - DNA, 18 bp, Homo sapiens
ttctagtctggtgttctg

SEQ ID NO: 1972045 - DNA, 20 bp, Homo sapiens
ttctagtctggtgttctgag

SEQ ID NO: 1972046 - DNA, 20 bp, Homo sapiens
ttctagtgatttcctgtata

SEQ ID NO: 1972047 - DNA, 22 bp, Homo sapiens
ttctagtgatttcctgtataat

SEQ ID NO: 1972048 - DNA, 20 bp, Homo sapiens
ttctagttagctgctttaaa

SEQ ID NO: 1972049 - DNA, 22 bp, Homo sapiens
ttctagttagctgctttaaatc

SEQ ID NO: 1972050 - DNA, 19 bp, Homo sapiens
ttctataaaatactggtat

SEQ ID NO: 1972051 - DNA, 17 bp, Homo sapiens
ttctatagccaaaaata

SEQ ID NO: 1972052 - DNA, 21 bp, Homo sapiens
ttctatagccaaaaatagcta

SEQ ID NO: 1972053 - DNA, 23 bp, Homo sapiens
ttctatcccacccaacagctcag

SEQ ID NO: 1972054 - DNA, 18 bp, Homo sapiens
ttctatgcaagccttgct

SEQ ID NO: 1972055 - DNA, 17 bp, Homo sapiens
ttctattcataataaac

SEQ ID NO: 1972056 - DNA, 13 bp, Homo sapiens
ttctattgaaaaa

SEQ ID NO: 1972057 - DNA, 18 bp, Homo sapiens
ttctattgcagttataga

SEQ ID NO: 1972058 - DNA, 12 bp, Homo sapiens
ttctattgtaaa

SEQ ID NO: 1972059 - DNA, 17 bp, Homo sapiens
ttctatttaaaaaataa

SEQ ID NO: 1972060 - DNA, 18 bp, Homo sapiens
ttctatttaaaaaataaa

SEQ ID NO: 1972061 - DNA, 15 bp, Homo sapiens
ttctatttatttact

SEQ ID NO: 1972062 - DNA, 17 bp, Homo sapiens
ttctatttttcttctaa

SEQ ID NO: 1972063 - DNA, 18 bp, Homo sapiens
ttctcaaatgctaaatgc

SEQ ID NO: 1972064 - DNA, 16 bp, Homo sapiens
ttctcaatgcttttct

SEQ ID NO: 1972065 - DNA, 12 bp, Homo sapiens
ttctcaccagga

SEQ ID NO: 1972066 - DNA, 13 bp, Homo sapiens
ttctcaccaggaa

SEQ ID NO: 1972067 - DNA, 14 bp, Homo sapiens
ttctcagatcttga

SEQ ID NO: 1972068 - DNA, 18 bp, Homo sapiens
ttctcagccccgggcctg

SEQ ID NO: 1972069 - DNA, 13 bp, Homo sapiens
ttctcagctccca

SEQ ID NO: 1972070 - DNA, 18 bp, Homo sapiens
ttctcaggacacaggcct

SEQ ID NO: 1972071 - DNA, 20 bp, Homo sapiens
ttctcaggacacaggcctgt

SEQ ID NO: 1972072 - DNA, 18 bp, Homo sapiens
ttctcagtcggtgtgtaa

SEQ ID NO: 1972073 - DNA, 20 bp, Homo sapiens
ttctcataggaaaagtacat

SEQ ID NO: 1972074 - DNA, 18 bp, Homo sapiens
ttctcatatgtagccctc

SEQ ID NO: 1972075 - DNA, 17 bp, Homo sapiens
ttctcatcatattgtat

SEQ ID NO: 1972076 - DNA, 21 bp, Homo sapiens
ttctcatcatattgtatgtaa

SEQ ID NO: 1972077 - DNA, 23 bp, Homo sapiens
ttctcatcatattgtatgtaagt

SEQ ID NO: 1972078 - DNA, 17 bp, Homo sapiens
ttctcatgtgatccttt

SEQ ID NO: 1972079 - DNA, 18 bp, Homo sapiens
ttctcatgtgatcctttt

SEQ ID NO: 1972080 - DNA, 18 bp, Homo sapiens
ttctcattccaacagtga

SEQ ID NO: 1972081 - DNA, 20 bp, Homo sapiens
ttctcattttcaatgcacat

SEQ ID NO: 1972082 - DNA, 17 bp, Homo sapiens
ttctcattttttaaaaa

SEQ ID NO: 1972083 - DNA, 14 bp, Homo sapiens
ttctccaaatgatt

SEQ ID NO: 1972084 - DNA, 18 bp, Homo sapiens
ttctccaacaagttgcct

SEQ ID NO: 1972085 - DNA, 13 bp, Homo sapiens
ttctccagccagc

SEQ ID NO: 1972086 - DNA, 19 bp, Homo sapiens
ttctccagcccacacccct

SEQ ID NO: 1972087 - DNA, 18 bp, Homo sapiens
ttctccaggattccaaag

SEQ ID NO: 1972088 - DNA, 19 bp, Homo sapiens
ttctccaggattccaaagt

SEQ ID NO: 1972089 - DNA, 20 bp, Homo sapiens
ttctccccccaacacaatct

SEQ ID NO: 1972090 - DNA, 14 bp, Homo sapiens
ttctccccctgggc

SEQ ID NO: 1972091 - DNA, 12 bp, Homo sapiens
ttctccctcacc

SEQ ID NO: 1972092 - DNA, 18 bp, Homo sapiens
ttctccggggtctgtgct

SEQ ID NO: 1972093 - DNA, 13 bp, Homo sapiens
ttctcctcccagg

SEQ ID NO: 1972094 - DNA, 14 bp, Homo sapiens
ttctcctgtcagag

SEQ ID NO: 1972095 - DNA, 12 bp, Homo sapiens
ttctcctgtgct

SEQ ID NO: 1972096 - DNA, 17 bp, Homo sapiens
ttctcctttattgctcc

SEQ ID NO: 1972097 - DNA, 17 bp, Homo sapiens
ttctcctttcacaacct

SEQ ID NO: 1972098 - DNA, 13 bp, Homo sapiens
ttctcctttttct

SEQ ID NO: 1972099 - DNA, 20 bp, Homo sapiens
ttctcgcattttctctagct

SEQ ID NO: 1972100 - DNA, 21 bp, Homo sapiens
ttctctacccatctcccccat

SEQ ID NO: 1972101 - DNA, 20 bp, Homo sapiens
ttctctcggggcgacccctc

SEQ ID NO: 1972102 - DNA, 23 bp, Homo sapiens
ttctctctaaaaataaaatgatg

SEQ ID NO: 1972103 - DNA, 20 bp, Homo sapiens
ttctctctatctggaattta

SEQ ID NO: 1972104 - DNA, 20 bp, Homo sapiens
ttctctgcttacccttcacc

SEQ ID NO: 1972105 - DNA, 14 bp, Homo sapiens
ttctctggctccag

SEQ ID NO: 1972106 - DNA, 21 bp, Homo sapiens
ttctctgggtaggtgttgaaa

SEQ ID NO: 1972107 - DNA, 20 bp, Homo sapiens
ttctctgtgcccctgtaaat

SEQ ID NO: 1972108 - DNA, 19 bp, Homo sapiens
ttctcttccctccttccct

SEQ ID NO: 1972109 - DNA, 20 bp, Homo sapiens
ttctctttcttattttgtaa

SEQ ID NO: 1972110 - DNA, 19 bp, Homo sapiens
ttctgaaaattaacactgc

SEQ ID NO: 1972111 - DNA, 17 bp, Homo sapiens
ttctgaaacttcataaa

SEQ ID NO: 1972112 - DNA, 20 bp, Homo sapiens
ttctgaaatgacagaatgct

SEQ ID NO: 1972113 - DNA, 22 bp, Homo sapiens
ttctgaaatgacagaatgctgt

SEQ ID NO: 1972114 - DNA, 22 bp, Homo sapiens
ttctgaactcaagctgcgttta

SEQ ID NO: 1972115 - DNA, 16 bp, Homo sapiens
ttctgaagctgacagc

SEQ ID NO: 1972116 - DNA, 16 bp, Homo sapiens
ttctgaataatttctt

SEQ ID NO: 1972117 - DNA, 17 bp, Homo sapiens
ttctgaataatttctta

SEQ ID NO: 1972118 - DNA, 15 bp, Homo sapiens
ttctgaatggctgca

SEQ ID NO: 1972119 - DNA, 14 bp, Homo sapiens
ttctgaattattat

SEQ ID NO: 1972120 - DNA, 14 bp, Homo sapiens
ttctgaccatttca

SEQ ID NO: 1972121 - DNA, 12 bp, Homo sapiens
ttctgagaaaag

SEQ ID NO: 1972122 - DNA, 16 bp, Homo sapiens
ttctgagaaagactat

SEQ ID NO: 1972123 - DNA, 18 bp, Homo sapiens
ttctgagaaggtccttaa

SEQ ID NO: 1972124 - DNA, 13 bp, Homo sapiens
ttctgagccttga

SEQ ID NO: 1972125 - DNA, 13 bp, Homo sapiens
ttctgagctgggc

SEQ ID NO: 1972126 - DNA, 19 bp, Homo sapiens
ttctgagcttttcatggaa

SEQ ID NO: 1972127 - DNA, 12 bp, Homo sapiens
ttctgagttcct

SEQ ID NO: 1972128 - DNA, 22 bp, Homo sapiens
ttctgatgggtcccaaaagctt

SEQ ID NO: 1972129 - DNA, 18 bp, Homo sapiens
ttctgatttttttgttgt

SEQ ID NO: 1972130 - DNA, 17 bp, Homo sapiens
ttctgcaactagccaag

SEQ ID NO: 1972131 - DNA, 21 bp, Homo sapiens
ttctgcacccagaaattcctt

SEQ ID NO: 1972132 - DNA, 15 bp, Homo sapiens
ttctgcagcaactcc

SEQ ID NO: 1972133 - DNA, 20 bp, Homo sapiens
ttctgcagcaactcccacga

SEQ ID NO: 1972134 - DNA, 21 bp, Homo sapiens
ttctgcagtagtctctgtgct

SEQ ID NO: 1972135 - DNA, 16 bp, Homo sapiens
ttctgccccagcttta

SEQ ID NO: 1972136 - DNA, 21 bp, Homo sapiens
ttctgctactttgctgctatg

SEQ ID NO: 1972137 - DNA, 14 bp, Homo sapiens
ttctgctcctctcc

SEQ ID NO: 1972138 - DNA, 18 bp, Homo sapiens
ttctgctcctctccaggc

SEQ ID NO: 1972139 - DNA, 21 bp, Homo sapiens
ttctgctcttccaaagctcct

SEQ ID NO: 1972140 - DNA, 17 bp, Homo sapiens
ttctgctgcccctgcag

SEQ ID NO: 1972141 - DNA, 15 bp, Homo sapiens
ttctgctggcctgga

SEQ ID NO: 1972142 - DNA, 10 bp, Homo sapiens
ttctggaaaa

SEQ ID NO: 1972143 - DNA, 11 bp, Homo sapiens
ttctggaaatt

SEQ ID NO: 1972144 - DNA, 21 bp, Homo sapiens
ttctggaaattttgtccattt

SEQ ID NO: 1972145 - DNA, 16 bp, Homo sapiens
ttgaaatataatgcaa

SEQ ID NO: 1972146 - DNA, 16 bp, Homo sapiens
ttgaaattatatctgt

SEQ ID NO: 1972147 - DNA, 18 bp, Homo sapiens
ttgaaattatgtatgttt

SEQ ID NO: 1972148 - DNA, 19 bp, Homo sapiens
ttgaaattgtttaagtgtt

SEQ ID NO: 1972149 - DNA, 19 bp, Homo sapiens
ttgaaatttaaaaataaag

SEQ ID NO: 1972150 - DNA, 12 bp, Homo sapiens
ttgaaattttaa

SEQ ID NO: 1972151 - DNA, 15 bp, Homo sapiens
ttgaacccctgtgtc

SEQ ID NO: 1972152 - DNA, 15 bp, Homo sapiens
ttgaactcctggcct

SEQ ID NO: 1972153 - DNA, 15 bp, Homo sapiens
ttgaactgccaagaa

SEQ ID NO: 1972154 - DNA, 15 bp, Homo sapiens
ttgaactttccaaaa

SEQ ID NO: 1972155 - DNA, 16 bp, Homo sapiens
ttgaagaaaagcactt

SEQ ID NO: 1972156 - DNA, 18 bp, Homo sapiens
ttgaagaagggaaattca

SEQ ID NO: 1972157 - DNA, 15 bp, Homo sapiens
ttgaagaatgttaag

SEQ ID NO: 1972158 - DNA, 19 bp, Homo sapiens
ttgaagaatgttaagactt

SEQ ID NO: 1972159 - DNA, 13 bp, Homo sapiens
tttctgtcattca

SEQ ID NO: 1972160 - DNA, 22 bp, Homo sapiens
tttctgtgtgcaccttaccaac

SEQ ID NO: 1972161 - DNA, 14 bp, Homo sapiens
tttctgttcatctt

SEQ ID NO: 1972162 - DNA, 14 bp, Homo sapiens
tttctgttgccaca

SEQ ID NO: 1972163 - DNA, 18 bp, Homo sapiens
tttcttaaataagaaact

SEQ ID NO: 1972164 - DNA, 19 bp, Homo sapiens
tttcttaaataagaaactt

SEQ ID NO: 1972165 - DNA, 15 bp, Homo sapiens
tttcttacagcacat

SEQ ID NO: 1972166 - DNA, 17 bp, Homo sapiens
tttcttacataattttt

SEQ ID NO: 1972167 - DNA, 16 bp, Homo sapiens
tttcttagtgcctgtg

SEQ ID NO: 1972168 - DNA, 15 bp, Homo sapiens
tttcttatttgcaat

SEQ ID NO: 1972169 - DNA, 21 bp, Homo sapiens
tttcttattttgtaataaact

SEQ ID NO: 1972170 - DNA, 13 bp, Homo sapiens
tttcttcgctgct

SEQ ID NO: 1972171 - DNA, 21 bp, Homo sapiens
tttcttctacaaccagagccc

SEQ ID NO: 1972172 - DNA, 13 bp, Homo sapiens
tttcttgcctcat

SEQ ID NO: 1972173 - DNA, 22 bp, Homo sapiens
tttcttgtgctgactaactata

SEQ ID NO: 1972174 - DNA, 16 bp, Homo sapiens
tttctttctttttctg

SEQ ID NO: 1972175 - DNA, 16 bp, Homo sapiens
tttctttgaatgcttt

SEQ ID NO: 1972176 - DNA, 22 bp, Homo sapiens
tttctttgaatgctttttgaat

SEQ ID NO: 1972177 - DNA, 22 bp, Homo sapiens
tttcttttctggaatgtaatca

SEQ ID NO: 1972178 - DNA, 22 bp, Homo sapiens
tttcttttgcccttcacagtgt

SEQ ID NO: 1972179 - DNA, 21 bp, Homo sapiens
tttctttttctggaaattttg

SEQ ID NO: 1972180 - DNA, 14 bp, Homo sapiens
tttgaaagaaaaat

SEQ ID NO: 1972181 - DNA, 19 bp, Homo sapiens
tttgaaagtgaataaactt

SEQ ID NO: 1972182 - DNA, 22 bp, Homo sapiens
tttgaacccccgccatccttca

SEQ ID NO: 1972183 - DNA, 19 bp, Homo sapiens
tttgaaggaggtgagggat

SEQ ID NO: 1972184 - DNA, 16 bp, Homo sapiens
tttgaagtacaattgt

SEQ ID NO: 1972185 - DNA, 13 bp, Homo sapiens
tttgaagtgtaat

SEQ ID NO: 1972186 - DNA, 17 bp, Homo sapiens
tttgaataaaaaacatt

SEQ ID NO: 1972187 - DNA, 20 bp, Homo sapiens
tttgaataaaaaacatttgt

SEQ ID NO: 1972188 - DNA, 23 bp, Homo sapiens
tttgaataaaaaacatttgtaca

SEQ ID NO: 1972189 - DNA, 19 bp, Homo sapiens
tttgaatcctctctctgtg

SEQ ID NO: 1972190 - DNA, 17 bp, Homo sapiens
tttgaatggtgcagaaa

SEQ ID NO: 1972191 - DNA, 20 bp, Homo sapiens
tttgaatgttatttgttatt

SEQ ID NO: 1972192 - DNA, 17 bp, Homo sapiens
tttgaatgtttatgttc

SEQ ID NO: 1972193 - DNA, 18 bp, Homo sapiens
tttgacagtgttgaaaat

SEQ ID NO: 1972194 - DNA, 22 bp, Homo sapiens
tttgacattgtatgtatctatt

SEQ ID NO: 1972195 - DNA, 22 bp, Homo sapiens
tttgacccactcacacttggag

SEQ ID NO: 1972196 - DNA, 17 bp, Homo sapiens
tttgacgggaggcctca

SEQ ID NO: 1972197 - DNA, 20 bp, Homo sapiens
tttgacgggaggcctcagtt

SEQ ID NO: 1972198 - DNA, 22 bp, Homo sapiens
ttttcttcccatttgtaatgta

SEQ ID NO: 1972199 - DNA, 13 bp, Homo sapiens
ttttcttctaaaa

SEQ ID NO: 1972200 - DNA, 19 bp, Homo sapiens
ttttcttctaaaatgcttt

SEQ ID NO: 1972201 - DNA, 13 bp, Homo sapiens
ttttcttgcagtt

SEQ ID NO: 1972202 - DNA, 14 bp, Homo sapiens
ttttcttgcagttt

SEQ ID NO: 1972203 - DNA, 15 bp, Homo sapiens
ttttctttgtaaagg

SEQ ID NO: 1972204 - DNA, 16 bp, Homo sapiens
ttttctttgtaaaggt

SEQ ID NO: 1972205 - DNA, 18 bp, Homo sapiens
ttttctttgtaaaggtca

SEQ ID NO: 1972206 - DNA, 16 bp, Homo sapiens
ttttctttgtgtagct

SEQ ID NO: 1972207 - DNA, 19 bp, Homo sapiens
ttttctttgtgtagctttg

SEQ ID NO: 1972208 - DNA, 20 bp, Homo sapiens
ttttgaactaataaaagcat

SEQ ID NO: 1972209 - DNA, 13 bp, Homo sapiens
ttttgaatgttat

SEQ ID NO: 1972210 - DNA, 15 bp, Homo sapiens
ttttgacggatgatt

SEQ ID NO: 1972211 - DNA, 11 bp, Homo sapiens
ttttgactctt

SEQ ID NO: 1972212 - DNA, 13 bp, Homo sapiens
ttttgactgcttg

SEQ ID NO: 1972213 - DNA, 20 bp, Homo sapiens
ttttgagagaaccttatatt

SEQ ID NO: 1972214 - DNA, 22 bp, Homo sapiens
ttttgagtggatggaggagaaa

SEQ ID NO: 1972215 - DNA, 16 bp, Homo sapiens
ttttgatatgagtata

SEQ ID NO: 1972216 - DNA, 14 bp, Homo sapiens
ttttgatggggaga

SEQ ID NO: 1972217 - DNA, 12 bp, Homo sapiens
ttttgatgtgaa

SEQ ID NO: 1972218 - DNA, 20 bp, Homo sapiens
ttttgatttgtactgaaaaa

SEQ ID NO: 1972219 - DNA, 21 bp, Homo sapiens
ttttgatttgtactgaaaaat

SEQ ID NO: 1972220 - DNA, 23 bp, Homo sapiens
ttttgcacgtcttgctatttgag

SEQ ID NO: 1972221 - DNA, 22 bp, Homo sapiens
ttttgcataagattaaaggaag

SEQ ID NO: 1972222 - DNA, 20 bp, Homo sapiens
ttttgcatctcacaaacata

SEQ ID NO: 1972223 - DNA, 19 bp, Homo sapiens
ttttgcatttgaataaagc

SEQ ID NO: 1972224 - DNA, 23 bp, Homo sapiens
ttttgccatgttggccaggctgg

SEQ ID NO: 1972225 - DNA, 15 bp, Homo sapiens
ttttgccattaaact

SEQ ID NO: 1972226 - DNA, 18 bp, Homo sapiens
ttttgcccttcacagtgt

SEQ ID NO: 1972227 - DNA, 12 bp, Homo sapiens
ttttgcctggct

SEQ ID NO: 1972228 - DNA, 16 bp, Homo sapiens
ttttgcttaaaatttt

SEQ ID NO: 1972229 - DNA, 16 bp, Homo sapiens
ttttggccaaagtgtt

SEQ ID NO: 1972230 - DNA, 17 bp, Homo sapiens
ttttggccaaagtgtta

SEQ ID NO: 1972231 - DNA, 18 bp, Homo sapiens
ttttggctctttcagaga

SEQ ID NO: 1972232 - DNA, 18 bp, Homo sapiens
ttttggggggtaatcagc

SEQ ID NO: 1972233 - DNA, 21 bp, Homo sapiens
ttttggtccaagttgtgctta

SEQ ID NO: 1972234 - DNA, 16 bp, Homo sapiens
ttttgtaacttcaaat

SEQ ID NO: 1972235 - DNA, 14 bp, Homo sapiens
ttttgtaataaact

SEQ ID NO: 1972236 - DNA, 14 bp, Homo sapiens
ttttgtacaattac

SEQ ID NO: 1972237 - DNA, 19 bp, Homo sapiens
ttttgtacaattactaaat

SEQ ID NO: 1972238 - DNA, 17 bp, Homo sapiens
ttttgtatagtaaagtg

SEQ ID NO: 1972239 - DNA, 20 bp, Homo sapiens
ttttgtattacatctaatgc

SEQ ID NO: 1972240 - DNA, 21 bp, Homo sapiens
ttttgtattacatctaatgct

SEQ ID NO: 1972241 - DNA, 18 bp, Homo sapiens
ttttgtattctttactaa

SEQ ID NO: 1972242 - DNA, 10 bp, Homo sapiens
ttttgtattt

SEQ ID NO: 1972243 - DNA, 15 bp, Homo sapiens
ttttgtcctgttatt

SEQ ID NO: 1972244 - DNA, 23 bp, Homo sapiens
ttttgtgactatatagagatgtt

SEQ ID NO: 1972245 - DNA, 17 bp, Homo sapiens
ttttgttaataataaga

SEQ ID NO: 1972246 - DNA, 18 bp, Homo sapiens
ttttgttaataataagat

SEQ ID NO: 1972247 - DNA, 14 bp, Homo sapiens
ttttgttatagaat

SEQ ID NO: 1972248 - DNA, 15 bp, Homo sapiens
ttttgttctgtattt

SEQ ID NO: 1972249 - DNA, 21 bp, Homo sapiens
ttttgttgtttcttaaataag

SEQ ID NO: 1972250 - DNA, 11 bp, Homo sapiens
ttttgttttct

SEQ ID NO: 1972251 - DNA, 15 bp, Homo sapiens
tttttaaaaaagctt

SEQ ID NO: 1972252 - DNA, 17 bp, Homo sapiens
tttttaaaaaagcttaa

SEQ ID NO: 1972253 - DNA, 23 bp, Homo sapiens
tttttaaaaatcataaactgtgt

SEQ ID NO: 1972254 - DNA, 15 bp, Homo sapiens
tttttaaagctacaa

SEQ ID NO: 1972255 - DNA, 17 bp, Homo sapiens
tttttaaatgaaaatgt

SEQ ID NO: 1972256 - DNA, 20 bp, Homo sapiens
tttttaacactagaaaacat

SEQ ID NO: 1972257 - DNA, 22 bp, Homo sapiens
tttttaactcaatattttccat

SEQ ID NO: 1972258 - DNA, 18 bp, Homo sapiens
tttttaagctgtttccat

SEQ ID NO: 1972259 - DNA, 12 bp, Homo sapiens
tttttaataaaa

SEQ ID NO: 1972260 - DNA, 14 bp, Homo sapiens
tttttaatcattta

SEQ ID NO: 1972261 - DNA, 15 bp, Homo sapiens
tttttacaaagccct

SEQ ID NO: 1972262 - DNA, 16 bp, Homo sapiens
tgtgtccagcagctgc

SEQ ID NO: 1972263 - DNA, 13 bp, Homo sapiens
tgtgtcctctccc

SEQ ID NO: 1972264 - DNA, 17 bp, Homo sapiens
tgtgtccttccctgcat

SEQ ID NO: 1972265 - DNA, 17 bp, Homo sapiens
tgtgtctctcgatgcca

SEQ ID NO: 1972266 - DNA, 20 bp, Homo sapiens
tgtgtctgcattgttattgt

SEQ ID NO: 1972267 - DNA, 14 bp, Homo sapiens
tgtgtctgctcagt

SEQ ID NO: 1972268 - DNA, 17 bp, Homo sapiens
tgtgtgaagttacacaa

SEQ ID NO: 1972269 - DNA, 17 bp, Homo sapiens
tgtgtgaattctgcaac

SEQ ID NO: 1972270 - DNA, 23 bp, Homo sapiens
tgtgtgacagaatcttgtatttg

SEQ ID NO: 1972271 - DNA, 14 bp, Homo sapiens
tgtgtgagcatctc

SEQ ID NO: 1972272 - DNA, 16 bp, Homo sapiens
tgtgtgatgaactttc

SEQ ID NO: 1972273 - DNA, 17 bp, Homo sapiens
tgtgtgatgaactttct

SEQ ID NO: 1972274 - DNA, 13 bp, Homo sapiens
tgtgtgcagtgaa

SEQ ID NO: 1972275 - DNA, 16 bp, Homo sapiens
tgtgtgcatgtatgtg

SEQ ID NO: 1972276 - DNA, 16 bp, Homo sapiens
tgtgtgcatgtgagca

SEQ ID NO: 1972277 - DNA, 15 bp, Homo sapiens
tgtgtgcctgtggca

SEQ ID NO: 1972278 - DNA, 17 bp, Homo sapiens
tgtgtggaagaaggaaa

SEQ ID NO: 1972279 - DNA, 22 bp, Homo sapiens
tgtgtggaaggcagggacagag

SEQ ID NO: 1972280 - DNA, 16 bp, Homo sapiens
tgtgtgggtctgggga

SEQ ID NO: 1972281 - DNA, 19 bp, Homo sapiens
tgtgtgggtctggggaggg

SEQ ID NO: 1972282 - DNA, 16 bp, Homo sapiens
tgtgtggtatatttgt

SEQ ID NO: 1972283 - DNA, 23 bp, Homo sapiens
tgtgtgtaggtattaaagatgtg

SEQ ID NO: 1972284 - DNA, 13 bp, Homo sapiens
tgtgtgtatgcta

SEQ ID NO: 1972285 - DNA, 16 bp, Homo sapiens
tgtgtgtatgtatgtg

SEQ ID NO: 1972286 - DNA, 21 bp, Homo sapiens
tgtgtgtctgtctttgtggga

SEQ ID NO: 1972287 - DNA, 18 bp, Homo sapiens
tgtgtgtgcatgtatgtg

SEQ ID NO: 1972288 - DNA, 12 bp, Homo sapiens
tgtgtgtgtgca

SEQ ID NO: 1972289 - DNA, 13 bp, Homo sapiens
tgtgtgtgtgtgt

SEQ ID NO: 1972290 - DNA, 15 bp, Homo sapiens
tgtgtgtgtgtgtgc

SEQ ID NO: 1972291 - DNA, 18 bp, Homo sapiens
tgtgtgtttaaataaagt

SEQ ID NO: 1972292 - DNA, 13 bp, Homo sapiens
tgtgttcattctt

SEQ ID NO: 1972293 - DNA, 19 bp, Homo sapiens
tgtgttccgggaataacat

SEQ ID NO: 1972294 - DNA, 15 bp, Homo sapiens
tgtgttgctatcctg

SEQ ID NO: 1972295 - DNA, 20 bp, Homo sapiens
tgtgttgtacaataccagat

SEQ ID NO: 1972296 - DNA, 14 bp, Homo sapiens
tgtgttgtctgtgc

SEQ ID NO: 1972297 - DNA, 18 bp, Homo sapiens
tgtgttgtctgtgcagct

SEQ ID NO: 1972298 - DNA, 12 bp, Homo sapiens
tgtgtttaaata

SEQ ID NO: 1972299 - DNA, 14 bp, Homo sapiens
tgtgtttaaataaa

SEQ ID NO: 1972300 - DNA, 20 bp, Homo sapiens
tgtgtttactttatgttact

SEQ ID NO: 1972301 - DNA, 13 bp, Homo sapiens
tgtgtttagattt

SEQ ID NO: 1972302 - DNA, 10 bp, Homo sapiens
tgtgtttcta

SEQ ID NO: 1972303 - DNA, 18 bp, Homo sapiens
tgtgtttctaaaactatg

SEQ ID NO: 1972304 - DNA, 14 bp, Homo sapiens
tgtgttttctgaat

SEQ ID NO: 1972305 - DNA, 23 bp, Homo sapiens
tgtgttttctgaataacatttgt

SEQ ID NO: 1972306 - DNA, 14 bp, Homo sapiens
tgtgtttttaaaag

SEQ ID NO: 1972307 - DNA, 23 bp, Homo sapiens
tgttaaaaaaataagaagaatgc

SEQ ID NO: 1972308 - DNA, 18 bp, Homo sapiens
tgttaaaatagacaactc

SEQ ID NO: 1972309 - DNA, 16 bp, Homo sapiens
tgttaaaatgtacact

SEQ ID NO: 1972310 - DNA, 24 bp, Homo sapiens
tgttaaatcccattcataactttc

SEQ ID NO: 1972311 - DNA, 14 bp, Homo sapiens
tgttaaatgaaacc

SEQ ID NO: 1972312 - DNA, 19 bp, Homo sapiens
tgttaacctcagtgtcatt

SEQ ID NO: 1972313 - DNA, 14 bp, Homo sapiens
tgttaataataaga

SEQ ID NO: 1972314 - DNA, 16 bp, Homo sapiens
tgttaataataagata

SEQ ID NO: 1972315 - DNA, 23 bp, Homo sapiens
tgttaatcttaggggagagcttt

SEQ ID NO: 1972316 - DNA, 19 bp, Homo sapiens
tgttaatgatagctactgt

SEQ ID NO: 1972317 - DNA, 14 bp, Homo sapiens
tgttaatgcatttt

SEQ ID NO: 1972318 - DNA, 18 bp, Homo sapiens
tgttaatgttgggattta

SEQ ID NO: 1972319 - DNA, 22 bp, Homo sapiens
tgttaattcagcactgatttca

SEQ ID NO: 1972320 - DNA, 22 bp, Homo sapiens
tgttaatttagaaaactttaaa

SEQ ID NO: 1972321 - DNA, 14 bp, Homo sapiens
tgttaatttgttat

SEQ ID NO: 1972322 - DNA, 17 bp, Homo sapiens
tgttaatttgttatgta

SEQ ID NO: 1972323 - DNA, 17 bp, Homo sapiens
tgttacataacaagaaa

SEQ ID NO: 1972324 - DNA, 22 bp, Homo sapiens
tgttaccaaagcaatatttccc

SEQ ID NO: 1972325 - DNA, 13 bp, Homo sapiens
tgttactaaagtc

SEQ ID NO: 1972326 - DNA, 22 bp, Homo sapiens
tgttactaaagtcacatataaa

SEQ ID NO: 1972327 - DNA, 12 bp, Homo sapiens
tgttactgaaat

SEQ ID NO: 1972328 - DNA, 23 bp, Homo sapiens
tgttactgaaatgaggagagaag

SEQ ID NO: 1972329 - DNA, 18 bp, Homo sapiens
tgttactgattctcctgt

SEQ ID NO: 1972330 - DNA, 12 bp, Homo sapiens
tgttacttacct

SEQ ID NO: 1972331 - DNA, 18 bp, Homo sapiens
tgttacttacctaaacag

SEQ ID NO: 1972332 - DNA, 16 bp, Homo sapiens
tgttactttggaatga

SEQ ID NO: 1972333 - DNA, 23 bp, Homo sapiens
tgttagagaggtagcgagctgct

SEQ ID NO: 1972334 - DNA, 21 bp, Homo sapiens
tgttagatagaatttccaata

SEQ ID NO: 1972335 - DNA, 21 bp, Homo sapiens
tgttagcccaaggttaaaaag

SEQ ID NO: 1972336 - DNA, 21 bp, Homo sapiens
tgttaggaggctgcatgctct

SEQ ID NO: 1972337 - DNA, 15 bp, Homo sapiens
tgttagtgtgtgtgc

SEQ ID NO: 1972338 - DNA, 17 bp, Homo sapiens
tgttagtgtgtgtgcat

SEQ ID NO: 1972339 - DNA, 18 bp, Homo sapiens
tgttagtgtgtgtgcatg

SEQ ID NO: 1972340 - DNA, 19 bp, Homo sapiens
tgttagtgtgtgtgcatgt

SEQ ID NO: 1972341 - DNA, 21 bp, Homo sapiens
tgttagtgtgtgtgcatgtgt

SEQ ID NO: 1972342 - DNA, 23 bp, Homo sapiens
tgttagtgtgtgtgcatgtgtgt

SEQ ID NO: 1972343 - DNA, 22 bp, Homo sapiens
tgttatcctgctagctgtagaa

SEQ ID NO: 1972344 - DNA, 15 bp, Homo sapiens
tgttattatcctgca

SEQ ID NO: 1972345 - DNA, 19 bp, Homo sapiens
tgttattattttgcactgt

SEQ ID NO: 1972346 - DNA, 21 bp, Homo sapiens
tgttattgggcaagtgattga

SEQ ID NO: 1972347 - DNA, 22 bp, Homo sapiens
tgttattgggcaagtgattgaa

SEQ ID NO: 1972348 - DNA, 14 bp, Homo sapiens
tgttatttaaagaa

SEQ ID NO: 1972349 - DNA, 15 bp, Homo sapiens
tgttatttaaatgag

SEQ ID NO: 1972350 - DNA, 22 bp, Homo sapiens
tgttatttctatttttgtagaa

SEQ ID NO: 1972351 - DNA, 19 bp, Homo sapiens
tgttcaaaaaaacactagt

SEQ ID NO: 1972352 - DNA, 18 bp, Homo sapiens
tgttcaagaaataaaaat

SEQ ID NO: 1972353 - DNA, 14 bp, Homo sapiens
ttgcaatggcagcc

SEQ ID NO: 1972354 - DNA, 16 bp, Homo sapiens
ttgcaatggcagcctt

SEQ ID NO: 1972355 - DNA, 19 bp, Homo sapiens
ttgcaatggcagccttggc

SEQ ID NO: 1972356 - DNA, 16 bp, Homo sapiens
ttgcaattattctaat

SEQ ID NO: 1972357 - DNA, 19 bp, Homo sapiens
ttgcacaagcttgtatata

SEQ ID NO: 1972358 - DNA, 22 bp, Homo sapiens
ttgcacaagcttgtatatacat

SEQ ID NO: 1972359 - DNA, 11 bp, Homo sapiens
ttgcacaattt

SEQ ID NO: 1972360 - DNA, 19 bp, Homo sapiens
ttgcacaatttgagcaatt

SEQ ID NO: 1972361 - DNA, 23 bp, Homo sapiens
ttgcacaatttgagcaattcatt

SEQ ID NO: 1972362 - DNA, 16 bp, Homo sapiens
ttgcacagctatgaag

SEQ ID NO: 1972363 - DNA, 20 bp, Homo sapiens
ttgcacaggttttcagcaac

SEQ ID NO: 1972364 - DNA, 17 bp, Homo sapiens
ttgcacatctctgcagt

SEQ ID NO: 1972365 - DNA, 12 bp, Homo sapiens
ttgcacatgtga

SEQ ID NO: 1972366 - DNA, 15 bp, Homo sapiens
ttgcacctttctagt

SEQ ID NO: 1972367 - DNA, 18 bp, Homo sapiens
ttgcactatgaaaatcag

SEQ ID NO: 1972368 - DNA, 18 bp, Homo sapiens
ttgcactcagcttttttc

SEQ ID NO: 1972369 - DNA, 13 bp, Homo sapiens
ttgcactgagggc

SEQ ID NO: 1972370 - DNA, 15 bp, Homo sapiens
ttgcagaaacatttt

SEQ ID NO: 1972371 - DNA, 16 bp, Homo sapiens
ttgcagacaggcaagc

SEQ ID NO: 1972372 - DNA, 22 bp, Homo sapiens
ttgcagacaggcaagcacctcc

SEQ ID NO: 1972373 - DNA, 19 bp, Homo sapiens
ttgcagagacaggacctga

SEQ ID NO: 1972374 - DNA, 20 bp, Homo sapiens
ttgcagagatttcctccatg

SEQ ID NO: 1972375 - DNA, 23 bp, Homo sapiens
ttgcagcagtgagtctcttcaga

SEQ ID NO: 1972376 - DNA, 12 bp, Homo sapiens
ttgcagcatttt

SEQ ID NO: 1972377 - DNA, 17 bp, Homo sapiens
ttgcaggctctgggctc

SEQ ID NO: 1972378 - DNA, 18 bp, Homo sapiens
ttgcaggctctgggctca

SEQ ID NO: 1972379 - DNA, 17 bp, Homo sapiens
ttgcaggctgagtccct

SEQ ID NO: 1972380 - DNA, 18 bp, Homo sapiens
ttgcagggagcatggctg

SEQ ID NO: 1972381 - DNA, 18 bp, Homo sapiens
ttgcataagattaaagga

SEQ ID NO: 1972382 - DNA, 22 bp, Homo sapiens
ttgcatagtaccaatcatttta

SEQ ID NO: 1972383 - DNA, 21 bp, Homo sapiens
ttgcatcagtattaatactaa

SEQ ID NO: 1972384 - DNA, 23 bp, Homo sapiens
ttgcatcagtattaatactaaaa

SEQ ID NO: 1972385 - DNA, 23 bp, Homo sapiens
ttgcatgtaaaatgcagtccaga

SEQ ID NO: 1972386 - DNA, 16 bp, Homo sapiens
ttgcatgtattgtaaa

SEQ ID NO: 1972387 - DNA, 21 bp, Homo sapiens
ttgcattattcatatgcttcc

SEQ ID NO: 1972388 - DNA, 14 bp, Homo sapiens
ttgcattgaatata

SEQ ID NO: 1972389 - DNA, 16 bp, Homo sapiens
ttgcattgtgtgagct

SEQ ID NO: 1972390 - DNA, 24 bp, Homo sapiens
ttgcatttagttttatggcatgat

SEQ ID NO: 1972391 - DNA, 15 bp, Homo sapiens
ttgcatttatggtca

SEQ ID NO: 1972392 - DNA, 14 bp, Homo sapiens
ttgcatttctgctc

SEQ ID NO: 1972393 - DNA, 16 bp, Homo sapiens
ttgccaactaagccct

SEQ ID NO: 1972394 - DNA, 21 bp, Homo sapiens
ttgccaatgaggtctgaaatg

SEQ ID NO: 1972395 - DNA, 17 bp, Homo sapiens
ttgccacaatgcctctc

SEQ ID NO: 1972396 - DNA, 22 bp, Homo sapiens
ttgccaccaccagatgagaagt

SEQ ID NO: 1972397 - DNA, 19 bp, Homo sapiens
ttgccaccactagagctga

SEQ ID NO: 1972398 - DNA, 14 bp, Homo sapiens
ttgccactgcctct

SEQ ID NO: 1972399 - DNA, 21 bp, Homo sapiens
ttgccactttggcttctcctg

SEQ ID NO: 1972400 - DNA, 15 bp, Homo sapiens
ttgccagaaagcata

SEQ ID NO: 1972401 - DNA, 22 bp, Homo sapiens
ttgccagacatgtggtgggaca

SEQ ID NO: 1972402 - DNA, 14 bp, Homo sapiens
ttgccagacttaaa

SEQ ID NO: 1972403 - DNA, 13 bp, Homo sapiens
ttgccagcacagg

SEQ ID NO: 1972404 - DNA, 21 bp, Homo sapiens
ttgccagcacaggggccccag

SEQ ID NO: 1972405 - DNA, 18 bp, Homo sapiens
ttgccagccagaagcctc

SEQ ID NO: 1972406 - DNA, 16 bp, Homo sapiens
ttgccaggcttaagga

SEQ ID NO: 1972407 - DNA, 16 bp, Homo sapiens
ttgccatgaggccttt

SEQ ID NO: 1972408 - DNA, 22 bp, Homo sapiens
ttgccatgaggcctttccccag

SEQ ID NO: 1972409 - DNA, 20 bp, Homo sapiens
ttgccatggagttgtgatca

SEQ ID NO: 1972410 - DNA, 14 bp, Homo sapiens
ttgccatgggcctg

SEQ ID NO: 1972411 - DNA, 15 bp, Homo sapiens
ttgccatgggcctgc

SEQ ID NO: 1972412 - DNA, 17 bp, Homo sapiens
ttgccatgggcctgctg

SEQ ID NO: 1972413 - DNA, 18 bp, Homo sapiens
ttgccatgggcctgctgc

SEQ ID NO: 1972414 - DNA, 16 bp, Homo sapiens
ttgccatgtagacccc

SEQ ID NO: 1972415 - DNA, 20 bp, Homo sapiens
ttgccatgttggccaggctg

SEQ ID NO: 1972416 - DNA, 21 bp, Homo sapiens
ttgccatgttggccaggctgg

SEQ ID NO: 1972417 - DNA, 14 bp, Homo sapiens
ttgccatttctctg

SEQ ID NO: 1972418 - DNA, 22 bp, Homo sapiens
ttgcccagagatgcctccaccg

SEQ ID NO: 1972419 - DNA, 11 bp, Homo sapiens
ttgcccaggca

SEQ ID NO: 1972420 - DNA, 14 bp, Homo sapiens
ttgcccaggcaggt

SEQ ID NO: 1972421 - DNA, 18 bp, Homo sapiens
ttgcccaggcaggtcttg

SEQ ID NO: 1972422 - DNA, 20 bp, Homo sapiens
ttgcccaggctggagtgcag

SEQ ID NO: 1972423 - DNA, 17 bp, Homo sapiens
ttgcccaggctggcctg

SEQ ID NO: 1972424 - DNA, 21 bp, Homo sapiens
ttgccccaaggctgctcagag

SEQ ID NO: 1972425 - DNA, 15 bp, Homo sapiens
ttgcccccatccctc

SEQ ID NO: 1972426 - DNA, 18 bp, Homo sapiens
ttgcccctccagagacag

SEQ ID NO: 1972427 - DNA, 19 bp, Homo sapiens
ttgccccttgggcctcccc

SEQ ID NO: 1972428 - DNA, 21 bp, Homo sapiens
ttgccccttgggcctcccccc

SEQ ID NO: 1972429 - DNA, 22 bp, Homo sapiens
ttgcccgccagcctcagtgcca

SEQ ID NO: 1972430 - DNA, 23 bp, Homo sapiens
ttgcccgccagcctcagtgccac

SEQ ID NO: 1972431 - DNA, 15 bp, Homo sapiens
ttgccctgacctccc

SEQ ID NO: 1972432 - DNA, 14 bp, Homo sapiens
ttgccctgcctgca

SEQ ID NO: 1972433 - DNA, 16 bp, Homo sapiens
ttgcccttcacagtgt

SEQ ID NO: 1972434 - DNA, 18 bp, Homo sapiens
ttgcccttcacagtgttt

SEQ ID NO: 1972435 - DNA, 20 bp, Homo sapiens
ttgcctaaatccaaagaaaa

SEQ ID NO: 1972436 - DNA, 19 bp, Homo sapiens
ttgcctaataaacatcctt

SEQ ID NO: 1972437 - DNA, 12 bp, Homo sapiens
ttgcctccacct

SEQ ID NO: 1972438 - DNA, 14 bp, Homo sapiens
ttgcctctctcagg

SEQ ID NO: 1972439 - DNA, 14 bp, Homo sapiens
ttgcctctgcctct

SEQ ID NO: 1972440 - DNA, 16 bp, Homo sapiens
ttgcctctgcctctga

SEQ ID NO: 1972441 - DNA, 18 bp, Homo sapiens
ttgcctctgcctctgaca

SEQ ID NO: 1972442 - DNA, 22 bp, Homo sapiens
ttgcctgaatccatcaggactt

SEQ ID NO: 1972443 - DNA, 13 bp, Homo sapiens
ttgcctgcagaga

SEQ ID NO: 1972444 - DNA, 16 bp, Homo sapiens
ttgcctgccagggccc

SEQ ID NO: 1972445 - DNA, 16 bp, Homo sapiens
ttgcctggctgtggag

SEQ ID NO: 1972446 - DNA, 14 bp, Homo sapiens
ttgcctgtaacaag

SEQ ID NO: 1972447 - DNA, 19 bp, Homo sapiens
ttgccttcttcacccagct

SEQ ID NO: 1972448 - DNA, 16 bp, Homo sapiens
ttgcctttccacctgc

SEQ ID NO: 1972449 - DNA, 17 bp, Homo sapiens
ttgcgaccatgtgtaga

SEQ ID NO: 1972450 - DNA, 12 bp, Homo sapiens
ttgcgccactgc

SEQ ID NO: 1972451 - DNA, 18 bp, Homo sapiens
ttgcgtggactctgcaca

SEQ ID NO: 1972452 - DNA, 14 bp, Homo sapiens
ttgctacaataaat

SEQ ID NO: 1972453 - DNA, 15 bp, Homo sapiens
ttgctacaataaatg

SEQ ID NO: 1972454 - DNA, 13 bp, Homo sapiens
ttgctacataatt

SEQ ID NO: 1972455 - DNA, 15 bp, Homo sapiens
ttgctattttatttg

SEQ ID NO: 1972456 - DNA, 19 bp, Homo sapiens
ttgctattttatttgtatt

SEQ ID NO: 1972457 - DNA, 19 bp, Homo sapiens
ttgctcaaatctattcaga

SEQ ID NO: 1972458 - DNA, 12 bp, Homo sapiens
ttgctcactcag

SEQ ID NO: 1972459 - DNA, 20 bp, Homo sapiens
ttgctcagtgcctcctggcc

SEQ ID NO: 1972460 - DNA, 11 bp, Homo sapiens
ttgctccaggg

SEQ ID NO: 1972461 - DNA, 14 bp, Homo sapiens
ttgctctggctgag

SEQ ID NO: 1972462 - DNA, 18 bp, Homo sapiens
ttgctcttctttctgaga

SEQ ID NO: 1972463 - DNA, 23 bp, Homo sapiens
ttgctgaaggctaaattcacagc

SEQ ID NO: 1972464 - DNA, 21 bp, Homo sapiens
ttgctggacggggactgggga

SEQ ID NO: 1972465 - DNA, 23 bp, Homo sapiens
ttgctggactgtcatagaaatta

SEQ ID NO: 1972466 - DNA, 17 bp, Homo sapiens
ttgctgttgttgcaggg

SEQ ID NO: 1972467 - DNA, 18 bp, Homo sapiens
ttgctgttgttgcaggga

SEQ ID NO: 1972468 - DNA, 18 bp, Homo sapiens
ttgcttacatttttacaa

SEQ ID NO: 1972469 - DNA, 20 bp, Homo sapiens
tgggcctcctctccctgcac

SEQ ID NO: 1972470 - DNA, 20 bp, Homo sapiens
tgggcctcctctgtccaggg

SEQ ID NO: 1972471 - DNA, 14 bp, Homo sapiens
tgggcctgctgctg

SEQ ID NO: 1972472 - DNA, 20 bp, Homo sapiens
tgggcctgcttttccaggat

SEQ ID NO: 1972473 - DNA, 13 bp, Homo sapiens
tgggcctggcctg

SEQ ID NO: 1972474 - DNA, 16 bp, Homo sapiens
tgggcctggcctgagc

SEQ ID NO: 1972475 - DNA, 17 bp, Homo sapiens
tgggcctggcctgagct

SEQ ID NO: 1972476 - DNA, 17 bp, Homo sapiens
tgggcctgggcctgctt

SEQ ID NO: 1972477 - DNA, 13 bp, Homo sapiens
tgggcctgtcccc

SEQ ID NO: 1972478 - DNA, 14 bp, Homo sapiens
tgggcctgtccccc

SEQ ID NO: 1972479 - DNA, 23 bp, Homo sapiens
tgggcctgtgcagcagcccagct

SEQ ID NO: 1972480 - DNA, 23 bp, Homo sapiens
tgggctaccccccctcctgctgc

SEQ ID NO: 1972481 - DNA, 15 bp, Homo sapiens
tgggctactggcagc

SEQ ID NO: 1972482 - DNA, 18 bp, Homo sapiens
tgggctactggcagctcc

SEQ ID NO: 1972483 - DNA, 22 bp, Homo sapiens
tgggctagtgtgagtggcagcc

SEQ ID NO: 1972484 - DNA, 13 bp, Homo sapiens
tgggctcagggct

SEQ ID NO: 1972485 - DNA, 14 bp, Homo sapiens
tgggctcagggctg

SEQ ID NO: 1972486 - DNA, 20 bp, Homo sapiens
tgggctcagggctggagtgc

SEQ ID NO: 1972487 - DNA, 13 bp, Homo sapiens
tgggctcctggct

SEQ ID NO: 1972488 - DNA, 15 bp, Homo sapiens
tgggctcctggctgc

SEQ ID NO: 1972489 - DNA, 18 bp, Homo sapiens
tgggctcctggctgccag

SEQ ID NO: 1972490 - DNA, 19 bp, Homo sapiens
tgggctcctggctgccagg

SEQ ID NO: 1972491 - DNA, 14 bp, Homo sapiens
tgggctctccacct

SEQ ID NO: 1972492 - DNA, 21 bp, Homo sapiens
tgggctctccacctcagcctt

SEQ ID NO: 1972493 - DNA, 15 bp, Homo sapiens
tgggctctgccccag

SEQ ID NO: 1972494 - DNA, 19 bp, Homo sapiens
tgggctctgccccagctct

SEQ ID NO: 1972495 - DNA, 23 bp, Homo sapiens
tgggctctgccccagctctggct

SEQ ID NO: 1972496 - DNA, 20 bp, Homo sapiens
tgggctgaactgagcctagc

SEQ ID NO: 1972497 - DNA, 13 bp, Homo sapiens
tgggctgacacct

SEQ ID NO: 1972498 - DNA, 19 bp, Homo sapiens
tgggctgacacctaccatg

SEQ ID NO: 1972499 - DNA, 17 bp, Homo sapiens
tgggctgagccctggca

SEQ ID NO: 1972500 - DNA, 15 bp, Homo sapiens
tgggctgccctggtg

SEQ ID NO: 1972501 - DNA, 17 bp, Homo sapiens
tgggctgccctggtgct

SEQ ID NO: 1972502 - DNA, 21 bp, Homo sapiens
tgggctgccctggtgctgcca

SEQ ID NO: 1972503 - DNA, 12 bp, Homo sapiens
tgggctggccca

SEQ ID NO: 1972504 - DNA, 14 bp, Homo sapiens
tgggctggcccagc

SEQ ID NO: 1972505 - DNA, 21 bp, Homo sapiens
tgggctggcccagccaactgc

SEQ ID NO: 1972506 - DNA, 19 bp, Homo sapiens
tgggctgtcaacattcaaa

SEQ ID NO: 1972507 - DNA, 15 bp, Homo sapiens
tgggctgtctgtcac

SEQ ID NO: 1972508 - DNA, 17 bp, Homo sapiens
tgggcttcagtggcagc

SEQ ID NO: 1972509 - DNA, 21 bp, Homo sapiens
tgggcttcagtggcagctgct

SEQ ID NO: 1972510 - DNA, 17 bp, Homo sapiens
tgggcttggacttcctg

SEQ ID NO: 1972511 - DNA, 21 bp, Homo sapiens
tgggctttgcaggctctgggc

SEQ ID NO: 1972512 - DNA, 16 bp, Homo sapiens
tggggaagactgtggc

SEQ ID NO: 1972513 - DNA, 21 bp, Homo sapiens
tggggacagttggcagagaag

SEQ ID NO: 1972514 - DNA, 23 bp, Homo sapiens
tggggacagttggcagagaaggc

SEQ ID NO: 1972515 - DNA, 17 bp, Homo sapiens
tggggaccctgtagagt

SEQ ID NO: 1972516 - DNA, 14 bp, Homo sapiens
tggggagacctggt

SEQ ID NO: 1972517 - DNA, 13 bp, Homo sapiens
tggggagaggcaa

SEQ ID NO: 1972518 - DNA, 23 bp, Homo sapiens
tggggagcacttgcgtcctgcag

SEQ ID NO: 1972519 - DNA, 12 bp, Homo sapiens
tggggagcagag

SEQ ID NO: 1972520 - DNA, 19 bp, Homo sapiens
tggggagcaggtctctggc

SEQ ID NO: 1972521 - DNA, 23 bp, Homo sapiens
tggggagcaggtctctggcagag

SEQ ID NO: 1972522 - DNA, 22 bp, Homo sapiens
tggggagccaacagaagcttcc

SEQ ID NO: 1972523 - DNA, 16 bp, Homo sapiens
tggggaggaaatagaa

SEQ ID NO: 1972524 - DNA, 12 bp, Homo sapiens
tggggaggaagg

SEQ ID NO: 1972525 - DNA, 12 bp, Homo sapiens
tggggaggcagc

SEQ ID NO: 1972526 - DNA, 17 bp, Homo sapiens
tggggaggcagctccaa

SEQ ID NO: 1972527 - DNA, 19 bp, Homo sapiens
tggggagggagacagagac

SEQ ID NO: 1972528 - DNA, 20 bp, Homo sapiens
tggggagttataaaaataca

SEQ ID NO: 1972529 - DNA, 17 bp, Homo sapiens
tggggataaaggagaag

SEQ ID NO: 1972530 - DNA, 16 bp, Homo sapiens
tggggatgtgggaggg

SEQ ID NO: 1972531 - DNA, 15 bp, Homo sapiens
tggggcaatggggag

SEQ ID NO: 1972532 - DNA, 16 bp, Homo sapiens
tggggcagaggggcag

SEQ ID NO: 1972533 - DNA, 17 bp, Homo sapiens
tggggcagaggggcagc

SEQ ID NO: 1972534 - DNA, 16 bp, Homo sapiens
tggggcagcttgaggg

SEQ ID NO: 1972535 - DNA, 13 bp, Homo sapiens
tggggcaggagta

SEQ ID NO: 1972536 - DNA, 18 bp, Homo sapiens
tggggcaggagtagctga

SEQ ID NO: 1972537 - DNA, 19 bp, Homo sapiens
tggggcaggagtagctgag

SEQ ID NO: 1972538 - DNA, 21 bp, Homo sapiens
tggggcatagaaactgaggag

SEQ ID NO: 1972539 - DNA, 18 bp, Homo sapiens
tggggcatagaactccgg

SEQ ID NO: 1972540 - DNA, 18 bp, Homo sapiens
tggggccctgggcctcag

SEQ ID NO: 1972541 - DNA, 19 bp, Homo sapiens
tggggccctgggcctcagt

SEQ ID NO: 1972542 - DNA, 11 bp, Homo sapiens
tggggcctggc

SEQ ID NO: 1972543 - DNA, 14 bp, Homo sapiens
tggggcctggcttg

SEQ ID NO: 1972544 - DNA, 20 bp, Homo sapiens
tggggcctggcttgctccag

SEQ ID NO: 1972545 - DNA, 20 bp, Homo sapiens
tgtgaggactgggggcacct

SEQ ID NO: 1972546 - DNA, 22 bp, Homo sapiens
tgtgaggattatgggtcctgca

SEQ ID NO: 1972547 - DNA, 13 bp, Homo sapiens
tgtgaggcagggg

SEQ ID NO: 1972548 - DNA, 14 bp, Homo sapiens
tgtgaggcccctgg

SEQ ID NO: 1972549 - DNA, 22 bp, Homo sapiens
tgtgaggcccctggacaagcag

SEQ ID NO: 1972550 - DNA, 14 bp, Homo sapiens
tgtgaggctgggcc

SEQ ID NO: 1972551 - DNA, 21 bp, Homo sapiens
tgtgagtcaccaagcccagtt

SEQ ID NO: 1972552 - DNA, 15 bp, Homo sapiens
tgtgagtggcagcca

SEQ ID NO: 1972553 - DNA, 19 bp, Homo sapiens
tgtgagtggcagccatgcc

SEQ ID NO: 1972554 - DNA, 22 bp, Homo sapiens
tgtgagtgtgtttgtgtgcatg

SEQ ID NO: 1972555 - DNA, 13 bp, Homo sapiens
tgtgatatctgaa

SEQ ID NO: 1972556 - DNA, 12 bp, Homo sapiens
tgtgatcaactg

SEQ ID NO: 1972557 - DNA, 16 bp, Homo sapiens
tgtgatgaggcagagg

SEQ ID NO: 1972558 - DNA, 14 bp, Homo sapiens
tgtgatggggtggg

SEQ ID NO: 1972559 - DNA, 23 bp, Homo sapiens
tgtgatggggtgggcagggctgg

SEQ ID NO: 1972560 - DNA, 15 bp, Homo sapiens
tgtgattcaaaagat

SEQ ID NO: 1972561 - DNA, 16 bp, Homo sapiens
tgtgattcctgcattt

SEQ ID NO: 1972562 - DNA, 17 bp, Homo sapiens
tgtgattctaatgtctt

SEQ ID NO: 1972563 - DNA, 21 bp, Homo sapiens
tgtgattctaatgtcttcatt

SEQ ID NO: 1972564 - DNA, 13 bp, Homo sapiens
tgtgattgaatct

SEQ ID NO: 1972565 - DNA, 14 bp, Homo sapiens
tgtgattttgtaca

SEQ ID NO: 1972566 - DNA, 12 bp, Homo sapiens
tgtgcaaatcct

SEQ ID NO: 1972567 - DNA, 20 bp, Homo sapiens
tgtgcaaattttaaaaagga

SEQ ID NO: 1972568 - DNA, 21 bp, Homo sapiens
tgtgcaagtcttgtcagaatt

SEQ ID NO: 1972569 - DNA, 14 bp, Homo sapiens
tgtgcacgtacaca

SEQ ID NO: 1972570 - DNA, 17 bp, Homo sapiens
tgtgcactagcctgtga

SEQ ID NO: 1972571 - DNA, 18 bp, Homo sapiens
tgtgcactagcctgtgat

SEQ ID NO: 1972572 - DNA, 17 bp, Homo sapiens
tgtgcactgacatgttt

SEQ ID NO: 1972573 - DNA, 21 bp, Homo sapiens
tgtgcactgacatgtttcaca

SEQ ID NO: 1972574 - DNA, 18 bp, Homo sapiens
tgtgcagactcaataaaa

SEQ ID NO: 1972575 - DNA, 22 bp, Homo sapiens
tgtgcagactcaataaaatcat

SEQ ID NO: 1972576 - DNA, 23 bp, Homo sapiens
tgtgcagactcaataaaatcatg

SEQ ID NO: 1972577 - DNA, 16 bp, Homo sapiens
tgtgcagactgtggct

SEQ ID NO: 1972578 - DNA, 12 bp, Homo sapiens
tgtgcagcagcc

SEQ ID NO: 1972579 - DNA, 16 bp, Homo sapiens
tgtgcagcagcccagc

SEQ ID NO: 1972580 - DNA, 18 bp, Homo sapiens
tgtgcagcagcccagctt

SEQ ID NO: 1972581 - DNA, 18 bp, Homo sapiens
tgtgcagtattttattaa

SEQ ID NO: 1972582 - DNA, 23 bp, Homo sapiens
tgtgcagtcccgtggagggtagg

SEQ ID NO: 1972583 - DNA, 20 bp, Homo sapiens
tgtgcatggaaatgtcctcc

SEQ ID NO: 1972584 - DNA, 12 bp, Homo sapiens
tgtgcatgtatg

SEQ ID NO: 1972585 - DNA, 18 bp, Homo sapiens
tgtgcatgtatgtgtgtg

SEQ ID NO: 1972586 - DNA, 14 bp, Homo sapiens
tgtgcatgtgagca

SEQ ID NO: 1972587 - DNA, 12 bp, Homo sapiens
tgtgcatgtgtg

SEQ ID NO: 1972588 - DNA, 12 bp, Homo sapiens
tgtgccagagcc

SEQ ID NO: 1972589 - DNA, 21 bp, Homo sapiens
tgtgccagagcctggggctct

SEQ ID NO: 1972590 - DNA, 11 bp, Homo sapiens
tgtgccagctc

SEQ ID NO: 1972591 - DNA, 18 bp, Homo sapiens
tgtgccagctcaggtgac

SEQ ID NO: 1972592 - DNA, 18 bp, Homo sapiens
tgtgccatagagtttaac

SEQ ID NO: 1972593 - DNA, 16 bp, Homo sapiens
tgtgccatgtcaaaca

SEQ ID NO: 1972594 - DNA, 21 bp, Homo sapiens
tgtgccatgtcaaacaaatag

SEQ ID NO: 1972595 - DNA, 20 bp, Homo sapiens
tgtgcccacatcccaggctt

SEQ ID NO: 1972596 - DNA, 22 bp, Homo sapiens
tgtgcccctcagagaggcatgt

SEQ ID NO: 1972597 - DNA, 13 bp, Homo sapiens
tgtgccctgcctt

SEQ ID NO: 1972598 - DNA, 11 bp, Homo sapiens
tgtgcctcagc

SEQ ID NO: 1972599 - DNA, 14 bp, Homo sapiens
tgtgcctcctcacc

SEQ ID NO: 1972600 - DNA, 14 bp, Homo sapiens
tgtgcctgccctgg

SEQ ID NO: 1972601 - DNA, 22 bp, Homo sapiens
tgtgcctgccctggagggaggc

SEQ ID NO: 1972602 - DNA, 17 bp, Homo sapiens
tgtgcctgctagagcaa

SEQ ID NO: 1972603 - DNA, 23 bp, Homo sapiens
tgtgcctttgggaggcagcatca

SEQ ID NO: 1972604 - DNA, 14 bp, Homo sapiens
tgtgcgcctacagg

SEQ ID NO: 1972605 - DNA, 14 bp, Homo sapiens
tgtgcgtctctctt

SEQ ID NO: 1972606 - DNA, 18 bp, Homo sapiens
tgtgcgtctctctttctc

SEQ ID NO: 1972607 - DNA, 16 bp, Homo sapiens
tgtgcgtgcgtgtgtg

SEQ ID NO: 1972608 - DNA, 14 bp, Homo sapiens
tgtgcgtgtgtgca

SEQ ID NO: 1972609 - DNA, 15 bp, Homo sapiens
tgtgctactttgcct

SEQ ID NO: 1972610 - DNA, 15 bp, Homo sapiens
tgtgctataaatcct

SEQ ID NO: 1972611 - DNA, 17 bp, Homo sapiens
tgtgctcccctttgcct

SEQ ID NO: 1972612 - DNA, 15 bp, Homo sapiens
tgtgctctggacagg

SEQ ID NO: 1972613 - DNA, 16 bp, Homo sapiens
tgtgctctggacaggc

SEQ ID NO: 1972614 - DNA, 13 bp, Homo sapiens
tgtgctctggagg

SEQ ID NO: 1972615 - DNA, 19 bp, Homo sapiens
tgtgctgaattctgcaatg

SEQ ID NO: 1972616 - DNA, 20 bp, Homo sapiens
tgtgctgcccgtcttcagcc

SEQ ID NO: 1972617 - DNA, 14 bp, Homo sapiens
tgtgctggagctgg

SEQ ID NO: 1972618 - DNA, 14 bp, Homo sapiens
tgtgctgtgcctgc

SEQ ID NO: 1972619 - DNA, 21 bp, Homo sapiens
tgtgctgtgcctgctagagca

SEQ ID NO: 1972620 - DNA, 19 bp, Homo sapiens
tgtgctgtgggcagcaccc

SEQ ID NO: 1972621 - DNA, 21 bp, Homo sapiens
tgtgctgtgggcagcaccctc

SEQ ID NO: 1972622 - DNA, 15 bp, Homo sapiens
tgtgcttacagtgac

SEQ ID NO: 1972623 - DNA, 13 bp, Homo sapiens
tgtgcttatgttt

SEQ ID NO: 1972624 - DNA, 14 bp, Homo sapiens
tgtgcttttcctat

SEQ ID NO: 1972625 - DNA, 14 bp, Homo sapiens
tgtggaaaaatatt

SEQ ID NO: 1972626 - DNA, 17 bp, Homo sapiens
tgtggaaagcctctgct

SEQ ID NO: 1972627 - DNA, 20 bp, Homo sapiens
tgtggaaagcctctgctgcc

SEQ ID NO: 1972628 - DNA, 22 bp, Homo sapiens
tgtggaatggattatagagtat

SEQ ID NO: 1972629 - DNA, 16 bp, Homo sapiens
tgtggacacagctctt

SEQ ID NO: 1972630 - DNA, 23 bp, Homo sapiens
tgtggagaggggtgcacccactc

SEQ ID NO: 1972631 - DNA, 15 bp, Homo sapiens
tgtggataagggaga

SEQ ID NO: 1972632 - DNA, 17 bp, Homo sapiens
tgtggatgtgtaaatgg

SEQ ID NO: 1972633 - DNA, 19 bp, Homo sapiens
tgtggatgtgtaaatggag

SEQ ID NO: 1972634 - DNA, 16 bp, Homo sapiens
tgtggcaaagtgctgt

SEQ ID NO: 1972635 - DNA, 20 bp, Homo sapiens
tgtggcaggcctaggacctc

SEQ ID NO: 1972636 - DNA, 18 bp, Homo sapiens
tgtggccatatttataga

SEQ ID NO: 1972637 - DNA, 15 bp, Homo sapiens
tgtggccccaggtgc

SEQ ID NO: 1972638 - DNA, 17 bp, Homo sapiens
tgtggccccaggtgcca

SEQ ID NO: 1972639 - DNA, 18 bp, Homo sapiens
tgtggccccaggtgccac

SEQ ID NO: 1972640 - DNA, 21 bp, Homo sapiens
tgtggccccaggtgccaccaa

SEQ ID NO: 1972641 - DNA, 14 bp, Homo sapiens
tgtggccctggcct

SEQ ID NO: 1972642 - DNA, 17 bp, Homo sapiens
tgtggccctggcctgct

SEQ ID NO: 1972643 - DNA, 20 bp, Homo sapiens
tgtggcctcacttccctggg

SEQ ID NO: 1972644 - DNA, 12 bp, Homo sapiens
tgtggcctcagc

SEQ ID NO: 1972645 - DNA, 15 bp, Homo sapiens
tgtggcctcagccct

SEQ ID NO: 1972646 - DNA, 17 bp, Homo sapiens
tgtggcctcagccctca

SEQ ID NO: 1972647 - DNA, 21 bp, Homo sapiens
tgtggcctgtgtccagcagct

SEQ ID NO: 1972648 - DNA, 22 bp, Homo sapiens
tgtggcctgtgtccagcagctg

SEQ ID NO: 1972649 - DNA, 12 bp, Homo sapiens
tgtggctcctgc

SEQ ID NO: 1972650 - DNA, 14 bp, Homo sapiens
tgtggctcctgcct

SEQ ID NO: 1972651 - DNA, 17 bp, Homo sapiens
tgtggctcctgccttga

SEQ ID NO: 1972652 - DNA, 14 bp, Homo sapiens
tgtgggagcctcgc

SEQ ID NO: 1972653 - DNA, 13 bp, Homo sapiens
tgtgggagggagc

SEQ ID NO: 1972654 - DNA, 15 bp, Homo sapiens
tgtgggatgtcctct

SEQ ID NO: 1972655 - DNA, 15 bp, Homo sapiens
tgtgggcttggcctt

SEQ ID NO: 1972656 - DNA, 14 bp, Homo sapiens
tgtgggggtggcca

SEQ ID NO: 1972657 - DNA, 16 bp, Homo sapiens
tgtgggggtggccatc

SEQ ID NO: 1972658 - DNA, 17 bp, Homo sapiens
tgtgggtgatcagaagg

SEQ ID NO: 1972659 - DNA, 14 bp, Homo sapiens
tgtgggtgttaatt

SEQ ID NO: 1972660 - DNA, 21 bp, Homo sapiens
tgtggtatgtagcccggccag

SEQ ID NO: 1972661 - DNA, 13 bp, Homo sapiens
tgtggtgatgaaa

SEQ ID NO: 1972662 - DNA, 22 bp, Homo sapiens
tgtggtgggttctttggaagga

SEQ ID NO: 1972663 - DNA, 13 bp, Homo sapiens
tcttctgtcatcc

SEQ ID NO: 1972664 - DNA, 17 bp, Homo sapiens
tcttctgtcatcccgct

SEQ ID NO: 1972665 - DNA, 12 bp, Homo sapiens
tcttcttatgca

SEQ ID NO: 1972666 - DNA, 14 bp, Homo sapiens
tcttcttcagaaga

SEQ ID NO: 1972667 - DNA, 16 bp, Homo sapiens
tcttcttcagaagaca

SEQ ID NO: 1972668 - DNA, 14 bp, Homo sapiens
tcttcttcttcaga

SEQ ID NO: 1972669 - DNA, 16 bp, Homo sapiens
tcttcttgtgtcctga

SEQ ID NO: 1972670 - DNA, 14 bp, Homo sapiens
tcttctttctgaga

SEQ ID NO: 1972671 - DNA, 22 bp, Homo sapiens
tcttcttttaaaccattttctt

SEQ ID NO: 1972672 - DNA, 18 bp, Homo sapiens
tcttctttttttgtgatg

SEQ ID NO: 1972673 - DNA, 18 bp, Homo sapiens
tcttgaactcctggcctc

SEQ ID NO: 1972674 - DNA, 22 bp, Homo sapiens
tcttgaatatttgcttaaaatt

SEQ ID NO: 1972675 - DNA, 23 bp, Homo sapiens
tcttgacagtatatttgaaactg

SEQ ID NO: 1972676 - DNA, 18 bp, Homo sapiens
tcttgacatgtaatgaat

SEQ ID NO: 1972677 - DNA, 11 bp, Homo sapiens
tcttgacccta

SEQ ID NO: 1972678 - DNA, 23 bp, Homo sapiens
tcttgagtactagaatttgtatt

SEQ ID NO: 1972679 - DNA, 13 bp, Homo sapiens
tcttgatgtcatg

SEQ ID NO: 1972680 - DNA, 16 bp, Homo sapiens
tcttgatgttgcttag

SEQ ID NO: 1972681 - DNA, 16 bp, Homo sapiens
tcttgcaatggcagcc

SEQ ID NO: 1972682 - DNA, 19 bp, Homo sapiens
tcttgcaatggcagccttg

SEQ ID NO: 1972683 - DNA, 21 bp, Homo sapiens
tcttgccagcattttcacatt

SEQ ID NO: 1972684 - DNA, 13 bp, Homo sapiens
tcttgccagccag

SEQ ID NO: 1972685 - DNA, 15 bp, Homo sapiens
tcttgccagccagaa

SEQ ID NO: 1972686 - DNA, 20 bp, Homo sapiens
tcttgccagccagaagcctc

SEQ ID NO: 1972687 - DNA, 13 bp, Homo sapiens
tcttgccccctca

SEQ ID NO: 1972688 - DNA, 20 bp, Homo sapiens
tcttgcccctccagagacag

SEQ ID NO: 1972689 - DNA, 16 bp, Homo sapiens
tcttgccccttgggcc

SEQ ID NO: 1972690 - DNA, 14 bp, Homo sapiens
tcttgcctctctca

SEQ ID NO: 1972691 - DNA, 16 bp, Homo sapiens
tcttgcctctctcagg

SEQ ID NO: 1972692 - DNA, 16 bp, Homo sapiens
tcttgcctgaggctca

SEQ ID NO: 1972693 - DNA, 20 bp, Homo sapiens
tcttgcctgaggctcaagag

SEQ ID NO: 1972694 - DNA, 14 bp, Homo sapiens
tcttgcctgcaccc

SEQ ID NO: 1972695 - DNA, 18 bp, Homo sapiens
tcttgcctttccacctgc

SEQ ID NO: 1972696 - DNA, 22 bp, Homo sapiens
tcttgcctttcttatttgcaat

SEQ ID NO: 1972697 - DNA, 18 bp, Homo sapiens
tcttgctcaaaaatctgt

SEQ ID NO: 1972698 - DNA, 15 bp, Homo sapiens
tcttgctctgctgac

SEQ ID NO: 1972699 - DNA, 23 bp, Homo sapiens
tcttgctctgctgacagacacag

SEQ ID NO: 1972700 - DNA, 18 bp, Homo sapiens
tcttgctggattaatgtt

SEQ ID NO: 1972701 - DNA, 14 bp, Homo sapiens
tcttgctttgctgt

SEQ ID NO: 1972702 - DNA, 17 bp, Homo sapiens
tcttggacactgtacaa

SEQ ID NO: 1972703 - DNA, 22 bp, Homo sapiens
tcttggacccctgaattcaatg

SEQ ID NO: 1972704 - DNA, 18 bp, Homo sapiens
tcttggacctctgctctg

SEQ ID NO: 1972705 - DNA, 18 bp, Homo sapiens
tcttggagaactttccat

SEQ ID NO: 1972706 - DNA, 20 bp, Homo sapiens
tcttggcattttcctcgcct

SEQ ID NO: 1972707 - DNA, 16 bp, Homo sapiens
tcttggcccctgtgtg

SEQ ID NO: 1972708 - DNA, 22 bp, Homo sapiens
tcttggcccctgtgtgagttga

SEQ ID NO: 1972709 - DNA, 18 bp, Homo sapiens
tcttggcttctgggacct

SEQ ID NO: 1972710 - DNA, 19 bp, Homo sapiens
tcttggcttctgggacctg

SEQ ID NO: 1972711 - DNA, 21 bp, Homo sapiens
tcttgggatgagaatgaaagc

SEQ ID NO: 1972712 - DNA, 15 bp, Homo sapiens
tcttgggctactggc

SEQ ID NO: 1972713 - DNA, 18 bp, Homo sapiens
tcttgggctactggcagc

SEQ ID NO: 1972714 - DNA, 14 bp, Homo sapiens
tcttggtattctta

SEQ ID NO: 1972715 - DNA, 17 bp, Homo sapiens
tcttggtcctgtcaccc

SEQ ID NO: 1972716 - DNA, 14 bp, Homo sapiens
tcttggtctcagct

SEQ ID NO: 1972717 - DNA, 17 bp, Homo sapiens
tcttggtctcagcttca

SEQ ID NO: 1972718 - DNA, 20 bp, Homo sapiens
tcttggtttggggagaaata

SEQ ID NO: 1972719 - DNA, 17 bp, Homo sapiens
tcttgtacatgtgtagc

SEQ ID NO: 1972720 - DNA, 19 bp, Homo sapiens
tcttgtacatgtgtagcct

SEQ ID NO: 1972721 - DNA, 24 bp, Homo sapiens
tcttgtacatgtgtagcctgtgca

SEQ ID NO: 1972722 - DNA, 11 bp, Homo sapiens
tcttgtatttg

SEQ ID NO: 1972723 - DNA, 20 bp, Homo sapiens
tcttgtatttgggccaaggt

SEQ ID NO: 1972724 - DNA, 20 bp, Homo sapiens
tcttgtcagaattggcctca

SEQ ID NO: 1972725 - DNA, 15 bp, Homo sapiens
tcttgtccacagtct

SEQ ID NO: 1972726 - DNA, 22 bp, Homo sapiens
tcttgtccatgtggttcttcaa

SEQ ID NO: 1972727 - DNA, 12 bp, Homo sapiens
tcttgtctctgg

SEQ ID NO: 1972728 - DNA, 11 bp, Homo sapiens
tcttgtgcatg

SEQ ID NO: 1972729 - DNA, 12 bp, Homo sapiens
tcttgtgcctca

SEQ ID NO: 1972730 - DNA, 18 bp, Homo sapiens
tcttgtgctcacgctccc

SEQ ID NO: 1972731 - DNA, 18 bp, Homo sapiens
tcttgtggaggatgaata

SEQ ID NO: 1972732 - DNA, 13 bp, Homo sapiens
tcttgttaatgca

SEQ ID NO: 1972733 - DNA, 14 bp, Homo sapiens
tcttgttttcagtt

SEQ ID NO: 1972734 - DNA, 19 bp, Homo sapiens
tctttaaaaagcagtcctc

SEQ ID NO: 1972735 - DNA, 16 bp, Homo sapiens
tctttaaaagaaagtt

SEQ ID NO: 1972736 - DNA, 21 bp, Homo sapiens
tctttaaagggatggcaagat

SEQ ID NO: 1972737 - DNA, 14 bp, Homo sapiens
tctttaagaaagta

SEQ ID NO: 1972738 - DNA, 14 bp, Homo sapiens
tctttaatcttcag

SEQ ID NO: 1972739 - DNA, 19 bp, Homo sapiens
tctttaatgtcacaggcag

SEQ ID NO: 1972740 - DNA, 20 bp, Homo sapiens
tctttaatgtcacaggcagg

SEQ ID NO: 1972741 - DNA, 14 bp, Homo sapiens
tctttacaataaac

SEQ ID NO: 1972742 - DNA, 18 bp, Homo sapiens
tctttacctgagaccagt

SEQ ID NO: 1972743 - DNA, 12 bp, Homo sapiens
tctttactttta

SEQ ID NO: 1972744 - DNA, 18 bp, Homo sapiens
tctttaggtgcctcctgt

SEQ ID NO: 1972745 - DNA, 15 bp, Homo sapiens
tctttatgactgttt

SEQ ID NO: 1972746 - DNA, 13 bp, Homo sapiens
tctttattcctcc

SEQ ID NO: 1972747 - DNA, 19 bp, Homo sapiens
tctttcaagtgaatctaaa

SEQ ID NO: 1972748 - DNA, 21 bp, Homo sapiens
tctttcaagtgaatctaaaag

SEQ ID NO: 1972749 - DNA, 18 bp, Homo sapiens
tctttccccacctcttcc

SEQ ID NO: 1972750 - DNA, 19 bp, Homo sapiens
tctttcccctcagagctct

SEQ ID NO: 1972751 - DNA, 18 bp, Homo sapiens
tctttcctctccaattgt

SEQ ID NO: 1972752 - DNA, 23 bp, Homo sapiens
tctttcctcttccccttgccctt

SEQ ID NO: 1972753 - DNA, 11 bp, Homo sapiens
tctttcctgtc

SEQ ID NO: 1972754 - DNA, 13 bp, Homo sapiens
tctttccttgtct

SEQ ID NO: 1972755 - DNA, 15 bp, Homo sapiens
tctttccttgtctct

SEQ ID NO: 1972756 - DNA, 17 bp, Homo sapiens
tctttccttgtctctca

SEQ ID NO: 1972757 - DNA, 21 bp, Homo sapiens
tctttctattcataataaact

SEQ ID NO: 1972758 - DNA, 17 bp, Homo sapiens
tctttctcactaaatct

SEQ ID NO: 1972759 - DNA, 18 bp, Homo sapiens
tctttctcactaaatctt

SEQ ID NO: 1972760 - DNA, 22 bp, Homo sapiens
tctttctctccttcttccctgt

SEQ ID NO: 1972761 - DNA, 17 bp, Homo sapiens
tctttctcttccctcct

SEQ ID NO: 1972762 - DNA, 17 bp, Homo sapiens
tctttcttactattggt

SEQ ID NO: 1972763 - DNA, 20 bp, Homo sapiens
tctttcttattttgtaataa

SEQ ID NO: 1972764 - DNA, 17 bp, Homo sapiens
tctttctttacctgaga

SEQ ID NO: 1972765 - DNA, 21 bp, Homo sapiens
tctttctttacctgagaccag

SEQ ID NO: 1972766 - DNA, 20 bp, Homo sapiens
tctttctttttctggaaatt

SEQ ID NO: 1972767 - DNA, 13 bp, Homo sapiens
tctttgaataaag

SEQ ID NO: 1972768 - DNA, 18 bp, Homo sapiens
tctttgaataaagtctga

SEQ ID NO: 1972769 - DNA, 14 bp, Homo sapiens
tctttgcagacagg

SEQ ID NO: 1972770 - DNA, 15 bp, Homo sapiens
tctttgcagagcctt

SEQ ID NO: 1972771 - DNA, 12 bp, Homo sapiens
tctttgcatgga

SEQ ID NO: 1972772 - DNA, 18 bp, Homo sapiens
tctttgctacaataaatg

SEQ ID NO: 1972773 - DNA, 22 bp, Homo sapiens
tctttgctacaataaatgctga

SEQ ID NO: 1972774 - DNA, 13 bp, Homo sapiens
tctttggaatgaa

SEQ ID NO: 1972775 - DNA, 19 bp, Homo sapiens
tctttggtttaatttaaag

SEQ ID NO: 1972776 - DNA, 23 bp, Homo sapiens
tctttgtaatgtcaccaccttcc

SEQ ID NO: 1972777 - DNA, 12 bp, Homo sapiens
tctttgttcagt

SEQ ID NO: 1972778 - DNA, 13 bp, Homo sapiens
tcttttactcctt

SEQ ID NO: 1972779 - DNA, 18 bp, Homo sapiens
tcttttagttttagttgc

SEQ ID NO: 1972780 - DNA, 14 bp, Homo sapiens
tcttttataggatt

SEQ ID NO: 1972781 - DNA, 13 bp, Homo sapiens
tcttttctctgtg

SEQ ID NO: 1972782 - DNA, 19 bp, Homo sapiens
tcttttctggaatgtaatc

SEQ ID NO: 1972783 - DNA, 20 bp, Homo sapiens
tcttttgaatccatgcttgg

SEQ ID NO: 1972784 - DNA, 21 bp, Homo sapiens
tcttttgcccttcacagtgtt

SEQ ID NO: 1972785 - DNA, 18 bp, Homo sapiens
tctttttaaaaagttgca

SEQ ID NO: 1972786 - DNA, 13 bp, Homo sapiens
tctttttcaaaaa

SEQ ID NO: 1972787 - DNA, 14 bp, Homo sapiens
tctttttttgtgat

SEQ ID NO: 1972788 - DNA, 16 bp, Homo sapiens
tgaaaaaaagtttaca

SEQ ID NO: 1972789 - DNA, 21 bp, Homo sapiens
tgaaaaaatgttctatatgca

SEQ ID NO: 1972790 - DNA, 23 bp, Homo sapiens
tgaaaaaatgttctatatgcatt

SEQ ID NO: 1972791 - DNA, 12 bp, Homo sapiens
tgaaaaactgat

SEQ ID NO: 1972792 - DNA, 18 bp, Homo sapiens
tgaaaaactgatcaaaaa

SEQ ID NO: 1972793 - DNA, 23 bp, Homo sapiens
tgaaaaactgatcaaaaataaac

SEQ ID NO: 1972794 - DNA, 15 bp, Homo sapiens
tgaaaaatatgtgct

SEQ ID NO: 1972795 - DNA, 13 bp, Homo sapiens
tgaaaaattctca

SEQ ID NO: 1972796 - DNA, 21 bp, Homo sapiens
tgaaaacagcccaggtcctcc

SEQ ID NO: 1972797 - DNA, 19 bp, Homo sapiens
tgaaaacatttcaaagctg

SEQ ID NO: 1972798 - DNA, 22 bp, Homo sapiens
tgaaaaccatccatctgtggaa

SEQ ID NO: 1972799 - DNA, 16 bp, Homo sapiens
tgaaaactattttaaa

SEQ ID NO: 1972800 - DNA, 12 bp, Homo sapiens
tgaaaactggaa

SEQ ID NO: 1972801 - DNA, 23 bp, Homo sapiens
tgaaaactggaataagaagcaaa

SEQ ID NO: 1972802 - DNA, 23 bp, Homo sapiens
tgaaaactgtttatggtattttc

SEQ ID NO: 1972803 - DNA, 22 bp, Homo sapiens
tgaaaagactccaaagaaatgt

SEQ ID NO: 1972804 - DNA, 22 bp, Homo sapiens
tgaaaagataggtttgagttca

SEQ ID NO: 1972805 - DNA, 16 bp, Homo sapiens
tgaaaaggcaaaaagc

SEQ ID NO: 1972806 - DNA, 21 bp, Homo sapiens
tgaaaaggttcttcatccctt

SEQ ID NO: 1972807 - DNA, 13 bp, Homo sapiens
tgaaaataataaa

SEQ ID NO: 1972808 - DNA, 17 bp, Homo sapiens
tgaaaatatatttaata

SEQ ID NO: 1972809 - DNA, 12 bp, Homo sapiens
tgaaaatcacta

SEQ ID NO: 1972810 - DNA, 15 bp, Homo sapiens
tgaaaatctaatatt

SEQ ID NO: 1972811 - DNA, 18 bp, Homo sapiens
tgaaaatgagcctgtaat

SEQ ID NO: 1972812 - DNA, 22 bp, Homo sapiens
tgaaaatgagcctgtaatcctc

SEQ ID NO: 1972813 - DNA, 21 bp, Homo sapiens
tgaaaatgcaacaacatgtat

SEQ ID NO: 1972814 - DNA, 23 bp, Homo sapiens
tgaaaatgcaacaacatgtataa

SEQ ID NO: 1972815 - DNA, 12 bp, Homo sapiens
tgaaaatgtact

SEQ ID NO: 1972816 - DNA, 14 bp, Homo sapiens
tgaaaatgtcagaa

SEQ ID NO: 1972817 - DNA, 18 bp, Homo sapiens
tgaaaatgtcagaaacca

SEQ ID NO: 1972818 - DNA, 13 bp, Homo sapiens
tgaaaattattta

SEQ ID NO: 1972819 - DNA, 17 bp, Homo sapiens
tgaaaattcaaaaagtg

SEQ ID NO: 1972820 - DNA, 23 bp, Homo sapiens
tgaaaattcaaaaagtgtttatt

SEQ ID NO: 1972821 - DNA, 19 bp, Homo sapiens
tgaaacaaataatcacatt

SEQ ID NO: 1972822 - DNA, 21 bp, Homo sapiens
tgaaacaagataactgagaat

SEQ ID NO: 1972823 - DNA, 16 bp, Homo sapiens
tgaaacacttctcatc

SEQ ID NO: 1972824 - DNA, 16 bp, Homo sapiens
tgaaacagaaacaaaa

SEQ ID NO: 1972825 - DNA, 17 bp, Homo sapiens
tgaaacagcctgggtga

SEQ ID NO: 1972826 - DNA, 23 bp, Homo sapiens
tgaaacattcacacagggctctt

SEQ ID NO: 1972827 - DNA, 18 bp, Homo sapiens
tgaaactagaagtcaaaa

SEQ ID NO: 1972828 - DNA, 17 bp, Homo sapiens
tgaaactggggcttgca

SEQ ID NO: 1972829 - DNA, 14 bp, Homo sapiens
tgaaagaaacagtt

SEQ ID NO: 1972830 - DNA, 14 bp, Homo sapiens
tgaaagaaggagca

SEQ ID NO: 1972831 - DNA, 18 bp, Homo sapiens
tgaaagagaaagactgat

SEQ ID NO: 1972832 - DNA, 18 bp, Homo sapiens
tgaaagaggcagcttgaa

SEQ ID NO: 1972833 - DNA, 11 bp, Homo sapiens
tgaaagcacag

SEQ ID NO: 1972834 - DNA, 18 bp, Homo sapiens
tgaaaggaagctccactg

SEQ ID NO: 1972835 - DNA, 13 bp, Homo sapiens
tgaaagggcccag

SEQ ID NO: 1972836 - DNA, 21 bp, Homo sapiens
tgaaagggtcaacggccctgt

SEQ ID NO: 1972837 - DNA, 21 bp, Homo sapiens
tgaaagtatattttcctccca

SEQ ID NO: 1972838 - DNA, 16 bp, Homo sapiens
tgaaagtctgtgtcca

SEQ ID NO: 1972839 - DNA, 21 bp, Homo sapiens
tgaaagtgaataaacttcagc

SEQ ID NO: 1972840 - DNA, 17 bp, Homo sapiens
tgaaagtttgcactgta

SEQ ID NO: 1972841 - DNA, 22 bp, Homo sapiens
tgaaatatttgcttatttatat

SEQ ID NO: 1972842 - DNA, 21 bp, Homo sapiens
tgaaatgaaacaaataatcac

SEQ ID NO: 1972843 - DNA, 19 bp, Homo sapiens
tgaaatgacctcaagatgt

SEQ ID NO: 1972844 - DNA, 21 bp, Homo sapiens
tgaaatgaggagagaaggaca

SEQ ID NO: 1972845 - DNA, 15 bp, Homo sapiens
tgaaatgggagatgg

SEQ ID NO: 1972846 - DNA, 19 bp, Homo sapiens
tgaaatgggagatggtcag

SEQ ID NO: 1972847 - DNA, 11 bp, Homo sapiens
tgaaatgtctt

SEQ ID NO: 1972848 - DNA, 15 bp, Homo sapiens
tgaaatgtttcacta

SEQ ID NO: 1972849 - DNA, 14 bp, Homo sapiens
tgaaattatatctg

SEQ ID NO: 1972850 - DNA, 17 bp, Homo sapiens
tgaaattatgtatgttt

SEQ ID NO: 1972851 - DNA, 23 bp, Homo sapiens
tgaaattatgtatgtttacatat

SEQ ID NO: 1972852 - DNA, 14 bp, Homo sapiens
tgaaattcccccac

SEQ ID NO: 1972853 - DNA, 23 bp, Homo sapiens
tgaaattgtttaagtgttgtaaa

SEQ ID NO: 1972854 - DNA, 19 bp, Homo sapiens
tgaaatttaaaaataaagc

SEQ ID NO: 1972855 - DNA, 24 bp, Homo sapiens
tgaaatttaaaaataaagctactg

SEQ ID NO: 1972856 - DNA, 20 bp, Homo sapiens
tgaaatttattagttaatat

SEQ ID NO: 1972857 - DNA, 22 bp, Homo sapiens
tgaaatttattagttaatatat

SEQ ID NO: 1972858 - DNA, 23 bp, Homo sapiens
tgaaatttcccacaccccagcgc

SEQ ID NO: 1972859 - DNA, 19 bp, Homo sapiens
tgaaattttctagactttc

SEQ ID NO: 1972860 - DNA, 20 bp, Homo sapiens
tgaacaaagaaaaaaatata

SEQ ID NO: 1972861 - DNA, 12 bp, Homo sapiens
tgaacaagaatt

SEQ ID NO: 1972862 - DNA, 14 bp, Homo sapiens
tgaacaagaattgg

SEQ ID NO: 1972863 - DNA, 19 bp, Homo sapiens
tgaacaagttgtttcattg

SEQ ID NO: 1972864 - DNA, 22 bp, Homo sapiens
tgaacaagttgtttcattgact

SEQ ID NO: 1972865 - DNA, 13 bp, Homo sapiens
tgaacacaattga

SEQ ID NO: 1972866 - DNA, 23 bp, Homo sapiens
tgaacacagctgctgaagaggca

SEQ ID NO: 1972867 - DNA, 19 bp, Homo sapiens
tgaacaccactttgtctct

SEQ ID NO: 1972868 - DNA, 18 bp, Homo sapiens
tgaacactggcaacaaca

SEQ ID NO: 1972869 - DNA, 16 bp, Homo sapiens
tgaacactgggggagg

SEQ ID NO: 1972870 - DNA, 17 bp, Homo sapiens
tgaacactgggggaggg

SEQ ID NO: 1972871 - DNA, 17 bp, Homo sapiens
tgaacatctcactttgc

SEQ ID NO: 1972872 - DNA, 20 bp, Homo sapiens
tgaaccacatcttgctctgc

SEQ ID NO: 1972873 - DNA, 23 bp, Homo sapiens
tgaaccacatcttgctctgctga

SEQ ID NO: 1972874 - DNA, 17 bp, Homo sapiens
tgaaccaccacacccag

SEQ ID NO: 1972875 - DNA, 20 bp, Homo sapiens
tgaaccaccacacccagccc

SEQ ID NO: 1972876 - DNA, 21 bp, Homo sapiens
tgaaccatcattataaacgtg

SEQ ID NO: 1972877 - DNA, 22 bp, Homo sapiens
tgaacccaggacaagcatggtc

SEQ ID NO: 1972878 - DNA, 19 bp, Homo sapiens
tgaacccaggaggtggagg

SEQ ID NO: 1972879 - DNA, 21 bp, Homo sapiens
tgaaccccatgggcttggact

SEQ ID NO: 1972880 - DNA, 16 bp, Homo sapiens
tgaacccttgtgcttg

SEQ ID NO: 1972881 - DNA, 14 bp, Homo sapiens
tgaacctatccttc

SEQ ID NO: 1972882 - DNA, 15 bp, Homo sapiens
tgaacctcagtttcc

SEQ ID NO: 1972883 - DNA, 21 bp, Homo sapiens
tgaacctgggaaccatgaagc

SEQ ID NO: 1972884 - DNA, 19 bp, Homo sapiens
tgaacctttaaagtaaagg

SEQ ID NO: 1972885 - DNA, 20 bp, Homo sapiens
tgaactatttctacacagtg

SEQ ID NO: 1972886 - DNA, 14 bp, Homo sapiens
tgaactcaagctgc

SEQ ID NO: 1972887 - DNA, 15 bp, Homo sapiens
tgaactcaagctgcg

SEQ ID NO: 1972888 - DNA, 11 bp, Homo sapiens
tgaactcctgg

SEQ ID NO: 1972889 - DNA, 20 bp, Homo sapiens
tgaactgagcctagctacct

SEQ ID NO: 1972890 - DNA, 20 bp, Homo sapiens
tgaactgattcacatctcat

SEQ ID NO: 1972891 - DNA, 23 bp, Homo sapiens
tgaactgggtacttgtggacaca

SEQ ID NO: 1972892 - DNA, 14 bp, Homo sapiens
tgaactgtgacagg

SEQ ID NO: 1972893 - DNA, 16 bp, Homo sapiens
tgaactgtgacaggaa

SEQ ID NO: 1972894 - DNA, 19 bp, Homo sapiens
tgaactgtgatggggtggg

SEQ ID NO: 1972895 - DNA, 17 bp, Homo sapiens
tgaacttgaggacacat

SEQ ID NO: 1972896 - DNA, 20 bp, Homo sapiens
tgaacttgagtaaataacaa

SEQ ID NO: 1972897 - DNA, 18 bp, Homo sapiens
tgaagaaacagataccat

SEQ ID NO: 1972898 - DNA, 20 bp, Homo sapiens
tgaagaacagtaactgccat

SEQ ID NO: 1972899 - DNA, 17 bp, Homo sapiens
tgaagaagagtttgcaa

SEQ ID NO: 1972900 - DNA, 20 bp, Homo sapiens
tgaagaatacttctcatttt

SEQ ID NO: 1972901 - DNA, 21 bp, Homo sapiens
tgaagaatacttctcattttt

SEQ ID NO: 1972902 - DNA, 15 bp, Homo sapiens
tgaagacccagcagg

SEQ ID NO: 1972903 - DNA, 16 bp, Homo sapiens
tgaagacctaaatgac

SEQ ID NO: 1972904 - DNA, 17 bp, Homo sapiens
tgaagacctaaatgacc

SEQ ID NO: 1972905 - DNA, 21 bp, Homo sapiens
tgaagacctaaatgacctcag

SEQ ID NO: 1972906 - DNA, 23 bp, Homo sapiens
tgaagacctaaatgacctcagca

SEQ ID NO: 1972907 - DNA, 20 bp, Homo sapiens
tgaagactcattcttctgta

SEQ ID NO: 1972908 - DNA, 20 bp, Homo sapiens
tgaagagaagctgagaagaa

SEQ ID NO: 1972909 - DNA, 23 bp, Homo sapiens
tgaagagaccaagactctgaaat

SEQ ID NO: 1972910 - DNA, 22 bp, Homo sapiens
tgaagagagatatatctgaaaa

SEQ ID NO: 1972911 - DNA, 20 bp, Homo sapiens
tgaagaggcaagagacagaa

SEQ ID NO: 1972912 - DNA, 18 bp, Homo sapiens
tgaagattctcctgtgct

SEQ ID NO: 1972913 - DNA, 22 bp, Homo sapiens
tgaagatttttaattacaataa

SEQ ID NO: 1972914 - DNA, 13 bp, Homo sapiens
tgaagcagtgcct

SEQ ID NO: 1972915 - DNA, 19 bp, Homo sapiens
tgaagcagtgcctcgaggc

SEQ ID NO: 1972916 - DNA, 21 bp, Homo sapiens
tgaagcagtgcctcgaggcac

SEQ ID NO: 1972917 - DNA, 20 bp, Homo sapiens
tgaagcatgtttcatgtttt

SEQ ID NO: 1972918 - DNA, 13 bp, Homo sapiens
tgaagccacagga

SEQ ID NO: 1972919 - DNA, 16 bp, Homo sapiens
tgaagccagatccacc

SEQ ID NO: 1972920 - DNA, 16 bp, Homo sapiens
tgaagccagtatttct

SEQ ID NO: 1972921 - DNA, 21 bp, Homo sapiens
tgaagccccttgtcctctccc

SEQ ID NO: 1972922 - DNA, 23 bp, Homo sapiens
tgaagccccttgtcctctcccgc

SEQ ID NO: 1972923 - DNA, 20 bp, Homo sapiens
tgaagcctctgccctgcctc

SEQ ID NO: 1972924 - DNA, 17 bp, Homo sapiens
tgaagcctgtgccacct

SEQ ID NO: 1972925 - DNA, 16 bp, Homo sapiens
tgaagctattgatgtt

SEQ ID NO: 1972926 - DNA, 15 bp, Homo sapiens
tgaagctggaagcac

SEQ ID NO: 1972927 - DNA, 22 bp, Homo sapiens
tgaagcttcactcactgtcaat

SEQ ID NO: 1972928 - DNA, 20 bp, Homo sapiens
tgaaggaataaattgctcct

SEQ ID NO: 1972929 - DNA, 21 bp, Homo sapiens
tgaaggaatagccagagagga

SEQ ID NO: 1972930 - DNA, 17 bp, Homo sapiens
tgaaggagaaaggagcc

SEQ ID NO: 1972931 - DNA, 20 bp, Homo sapiens
tgaaggagattttccttcct

SEQ ID NO: 1972932 - DNA, 16 bp, Homo sapiens
tgaaggataagagaaa

SEQ ID NO: 1972933 - DNA, 16 bp, Homo sapiens
tgaaggcagtctgaac

SEQ ID NO: 1972934 - DNA, 22 bp, Homo sapiens
tgaagggaaaggatattttctt

SEQ ID NO: 1972935 - DNA, 16 bp, Homo sapiens
tgaagggcttcttctt

SEQ ID NO: 1972936 - DNA, 15 bp, Homo sapiens
tgaagggggcggcct

SEQ ID NO: 1972937 - DNA, 23 bp, Homo sapiens
tgaagggtgacatcccaggaggg

SEQ ID NO: 1972938 - DNA, 13 bp, Homo sapiens
tgaagggtggggt

SEQ ID NO: 1972939 - DNA, 16 bp, Homo sapiens
tgaaggttaggattta

SEQ ID NO: 1972940 - DNA, 16 bp, Homo sapiens
tgaaggtttctgaaaa

SEQ ID NO: 1972941 - DNA, 18 bp, Homo sapiens
tgaaggtttctgaaaatt

SEQ ID NO: 1972942 - DNA, 11 bp, Homo sapiens
tgaagtaacct

SEQ ID NO: 1972943 - DNA, 17 bp, Homo sapiens
tgaagtatttctcactc

SEQ ID NO: 1972944 - DNA, 18 bp, Homo sapiens
tgaagtcacatcacagga

SEQ ID NO: 1972945 - DNA, 19 bp, Homo sapiens
tgaagtcaccgggatgaac

SEQ ID NO: 1972946 - DNA, 21 bp, Homo sapiens
tgaagtcactgcacagtgcat

SEQ ID NO: 1972947 - DNA, 21 bp, Homo sapiens
tgaagtcattgtcgctcagca

SEQ ID NO: 1972948 - DNA, 18 bp, Homo sapiens
tgaagtccctgttctcag

SEQ ID NO: 1972949 - DNA, 21 bp, Homo sapiens
tgaagtccctgttctcagctc

SEQ ID NO: 1972950 - DNA, 17 bp, Homo sapiens
tgaagtcgttgtgaggg

SEQ ID NO: 1972951 - DNA, 18 bp, Homo sapiens
tgaagtgatgatggatga

SEQ ID NO: 1972952 - DNA, 21 bp, Homo sapiens
tgaagtgggtggatcaccaga

SEQ ID NO: 1972953 - DNA, 14 bp, Homo sapiens
tgaagttaacagag

SEQ ID NO: 1972954 - DNA, 18 bp, Homo sapiens
tgaagttttatacactgg

SEQ ID NO: 1972955 - DNA, 18 bp, Homo sapiens
tgaataaaaaacatttgt

SEQ ID NO: 1972956 - DNA, 23 bp, Homo sapiens
tgaataaaaaacatttgtacatt

SEQ ID NO: 1972957 - DNA, 15 bp, Homo sapiens
tgaataaacttcagc

SEQ ID NO: 1972958 - DNA, 17 bp, Homo sapiens
tgaataaacttcagcac

SEQ ID NO: 1972959 - DNA, 13 bp, Homo sapiens
tgaataaagtctg

SEQ ID NO: 1972960 - DNA, 15 bp, Homo sapiens
tgaataaagtctgag

SEQ ID NO: 1972961 - DNA, 19 bp, Homo sapiens
tgaataaagtctgagtggg

SEQ ID NO: 1972962 - DNA, 16 bp, Homo sapiens
tgaatacccccagaga

SEQ ID NO: 1972963 - DNA, 17 bp, Homo sapiens
tgaatacccccagagac

SEQ ID NO: 1972964 - DNA, 14 bp, Homo sapiens
tgaatactaaatgg

SEQ ID NO: 1972965 - DNA, 14 bp, Homo sapiens
tgaatataaacact

SEQ ID NO: 1972966 - DNA, 18 bp, Homo sapiens
tgaatatattataatctt

SEQ ID NO: 1972967 - DNA, 15 bp, Homo sapiens
tgaatatcattaaat

SEQ ID NO: 1972968 - DNA, 21 bp, Homo sapiens
tgaatatggactcagttttct

SEQ ID NO: 1972969 - DNA, 12 bp, Homo sapiens
tgaatatttgct

SEQ ID NO: 1972970 - DNA, 17 bp, Homo sapiens
tgaatatttgcttaaaa

SEQ ID NO: 1972971 - DNA, 18 bp, Homo sapiens
tgaatcagaccctacccc

SEQ ID NO: 1972972 - DNA, 22 bp, Homo sapiens
tgaatcagaccctaccccacca

SEQ ID NO: 1972973 - DNA, 19 bp, Homo sapiens
tgaatctcccctcctcaca

SEQ ID NO: 1972974 - DNA, 13 bp, Homo sapiens
tgaatcttaattt

SEQ ID NO: 1972975 - DNA, 20 bp, Homo sapiens
tgaatcttgcacatatttga

SEQ ID NO: 1972976 - DNA, 14 bp, Homo sapiens
tgaatgaaatatca

SEQ ID NO: 1972977 - DNA, 15 bp, Homo sapiens
tgaatgacaacagaa

SEQ ID NO: 1972978 - DNA, 18 bp, Homo sapiens
tgaatgaggtcccaggca

SEQ ID NO: 1972979 - DNA, 15 bp, Homo sapiens
tgaatgcaaaccata

SEQ ID NO: 1972980 - DNA, 20 bp, Homo sapiens
tgaatgccttccgggccggg

SEQ ID NO: 1972981 - DNA, 23 bp, Homo sapiens
tgaatgctttttgaatgttattt

SEQ ID NO: 1972982 - DNA, 16 bp, Homo sapiens
tgaatggaagcaaaat

SEQ ID NO: 1972983 - DNA, 21 bp, Homo sapiens
tgaatggaagcaaaattataa

SEQ ID NO: 1972984 - DNA, 15 bp, Homo sapiens
tgaatggcctgcctt

SEQ ID NO: 1972985 - DNA, 20 bp, Homo sapiens
tgaatggctatgtttttaat

SEQ ID NO: 1972986 - DNA, 21 bp, Homo sapiens
tgaatggctatgtttttaatg

SEQ ID NO: 1972987 - DNA, 23 bp, Homo sapiens
tgaatggttccatgcctgagggt

SEQ ID NO: 1972988 - DNA, 15 bp, Homo sapiens
tgaatgtgcatttct

SEQ ID NO: 1972989 - DNA, 11 bp, Homo sapiens
tgaatgttctt

SEQ ID NO: 1972990 - DNA, 19 bp, Homo sapiens
tgaatgtttacactctttg

SEQ ID NO: 1972991 - DNA, 23 bp, Homo sapiens
tgaatgtttatgttctcagaatc

SEQ ID NO: 1972992 - DNA, 22 bp, Homo sapiens
tgaatgtttccaacctggagta

SEQ ID NO: 1972993 - DNA, 21 bp, Homo sapiens
tgaatgtttgaactgccaaga

SEQ ID NO: 1972994 - DNA, 16 bp, Homo sapiens
tgaattaaaaaagctc

SEQ ID NO: 1972995 - DNA, 14 bp, Homo sapiens
tgaattaagttatt

SEQ ID NO: 1972996 - DNA, 19 bp, Homo sapiens
tgaattaagttattgattt

SEQ ID NO: 1972997 - DNA, 21 bp, Homo sapiens
tgaattattttgttgtgattt

SEQ ID NO: 1972998 - DNA, 11 bp, Homo sapiens
tgaattcctgg

SEQ ID NO: 1972999 - DNA, 13 bp, Homo sapiens
tgaattctctcta

SEQ ID NO: 1973000 - DNA, 21 bp, Homo sapiens
tgaattctctctaaaaataaa

SEQ ID NO: 1973001 - DNA, 20 bp, Homo sapiens
tgaattctgtgaagaatgaa

SEQ ID NO: 1973002 - DNA, 17 bp, Homo sapiens
tgaattcttatgcttat

SEQ ID NO: 1973003 - DNA, 16 bp, Homo sapiens
tgaattgcctgcagag

SEQ ID NO: 1973004 - DNA, 15 bp, Homo sapiens
tgaattgtccccagt

SEQ ID NO: 1973005 - DNA, 19 bp, Homo sapiens
tgaatttagtgagatttac

SEQ ID NO: 1973006 - DNA, 14 bp, Homo sapiens
tgaatttattgccg

SEQ ID NO: 1973007 - DNA, 16 bp, Homo sapiens
tgaatttcctatctgt

SEQ ID NO: 1973008 - DNA, 13 bp, Homo sapiens
tgaatttctaaaa

SEQ ID NO: 1973009 - DNA, 20 bp, Homo sapiens
tgaatttcttcactgttgaa

SEQ ID NO: 1973010 - DNA, 21 bp, Homo sapiens
tgaatttgtaagcaacttgct

SEQ ID NO: 1973011 - DNA, 14 bp, Homo sapiens
tctggaagcctgga

SEQ ID NO: 1973012 - DNA, 20 bp, Homo sapiens
tctggaaggcccctcccagc

SEQ ID NO: 1973013 - DNA, 19 bp, Homo sapiens
tctggaagtccccgggagc

SEQ ID NO: 1973014 - DNA, 22 bp, Homo sapiens
tctggaatacatgaaatataga

SEQ ID NO: 1973015 - DNA, 22 bp, Homo sapiens
tctggaatgtaatcaatgtttc

SEQ ID NO: 1973016 - DNA, 14 bp, Homo sapiens
tctggaatttaatt

SEQ ID NO: 1973017 - DNA, 22 bp, Homo sapiens
tctggaccaaccctgtttcctg

SEQ ID NO: 1973018 - DNA, 13 bp, Homo sapiens
tctggacctcagg

SEQ ID NO: 1973019 - DNA, 13 bp, Homo sapiens
tctggacctcccc

SEQ ID NO: 1973020 - DNA, 11 bp, Homo sapiens
tctggagaagc

SEQ ID NO: 1973021 - DNA, 13 bp, Homo sapiens
tctggagagctag

SEQ ID NO: 1973022 - DNA, 14 bp, Homo sapiens
tctggagagctaga

SEQ ID NO: 1973023 - DNA, 21 bp, Homo sapiens
tctggagagctagaacctgga

SEQ ID NO: 1973024 - DNA, 23 bp, Homo sapiens
tctggagagctagaacctggagg

SEQ ID NO: 1973025 - DNA, 17 bp, Homo sapiens
tctggagcaagagagag

SEQ ID NO: 1973026 - DNA, 13 bp, Homo sapiens
tctggagccagag

SEQ ID NO: 1973027 - DNA, 15 bp, Homo sapiens
tctggagccagagag

SEQ ID NO: 1973028 - DNA, 12 bp, Homo sapiens
tctggagccctt

SEQ ID NO: 1973029 - DNA, 13 bp, Homo sapiens
tctggagcccttg

SEQ ID NO: 1973030 - DNA, 15 bp, Homo sapiens
tctggagctgctgtt

SEQ ID NO: 1973031 - DNA, 21 bp, Homo sapiens
tctggagctgctgttccaaca

SEQ ID NO: 1973032 - DNA, 17 bp, Homo sapiens
tctggaggctgcagagc

SEQ ID NO: 1973033 - DNA, 22 bp, Homo sapiens
tctggataccagatatttgaat

SEQ ID NO: 1973034 - DNA, 15 bp, Homo sapiens
tctggatccctggag

SEQ ID NO: 1973035 - DNA, 24 bp, Homo sapiens
tctggatcctgctgtggcctcact

SEQ ID NO: 1973036 - DNA, 17 bp, Homo sapiens
tctggattttcccctga

SEQ ID NO: 1973037 - DNA, 22 bp, Homo sapiens
tctggatttttacaaataaaga

SEQ ID NO: 1973038 - DNA, 13 bp, Homo sapiens
tctggcagccaca

SEQ ID NO: 1973039 - DNA, 18 bp, Homo sapiens
tctggcagccacacttct

SEQ ID NO: 1973040 - DNA, 22 bp, Homo sapiens
tctggcagccacacttctcagg

SEQ ID NO: 1973041 - DNA, 13 bp, Homo sapiens
tctggccaccctg

SEQ ID NO: 1973042 - DNA, 13 bp, Homo sapiens
tctggccctgcct

SEQ ID NO: 1973043 - DNA, 16 bp, Homo sapiens
tctggccctgccttct

SEQ ID NO: 1973044 - DNA, 17 bp, Homo sapiens
tctggcctcagcaggaa

SEQ ID NO: 1973045 - DNA, 16 bp, Homo sapiens
tctggctccgaaaaac

SEQ ID NO: 1973046 - DNA, 14 bp, Homo sapiens
tctggctgaaaaag

SEQ ID NO: 1973047 - DNA, 18 bp, Homo sapiens
tctggctgaacactggca

SEQ ID NO: 1973048 - DNA, 14 bp, Homo sapiens
tctggctgagctga

SEQ ID NO: 1973049 - DNA, 15 bp, Homo sapiens
tctggctgagctgaa

SEQ ID NO: 1973050 - DNA, 14 bp, Homo sapiens
tctggctgctgtat

SEQ ID NO: 1973051 - DNA, 18 bp, Homo sapiens
tctggctggtagagcagg

SEQ ID NO: 1973052 - DNA, 18 bp, Homo sapiens
tctgggaaataagagaga

SEQ ID NO: 1973053 - DNA, 13 bp, Homo sapiens
tctgggacctcag

SEQ ID NO: 1973054 - DNA, 18 bp, Homo sapiens
tctgggaggtctccactg

SEQ ID NO: 1973055 - DNA, 17 bp, Homo sapiens
tctgggatggaccctcg

SEQ ID NO: 1973056 - DNA, 23 bp, Homo sapiens
tctgggatggaccctcgcagcag

SEQ ID NO: 1973057 - DNA, 20 bp, Homo sapiens
tctgggcagtaaatccacag

SEQ ID NO: 1973058 - DNA, 12 bp, Homo sapiens
tctgggccaagt

SEQ ID NO: 1973059 - DNA, 13 bp, Homo sapiens
tctgggctcaggg

SEQ ID NO: 1973060 - DNA, 16 bp, Homo sapiens
tctgggctcagggctg

SEQ ID NO: 1973061 - DNA, 20 bp, Homo sapiens
tctgggctcagggctggagt

SEQ ID NO: 1973062 - DNA, 21 bp, Homo sapiens
tctgggctcctggaaccaatc

SEQ ID NO: 1973063 - DNA, 22 bp, Homo sapiens
tctgggctcctggaaccaatcc

SEQ ID NO: 1973064 - DNA, 22 bp, Homo sapiens
tctgggctgctacccagaaatc

SEQ ID NO: 1973065 - DNA, 19 bp, Homo sapiens
tctgggcttggggcttcct

SEQ ID NO: 1973066 - DNA, 19 bp, Homo sapiens
tctggggaggaagggccag

SEQ ID NO: 1973067 - DNA, 13 bp, Homo sapiens
tctggggccctgg

SEQ ID NO: 1973068 - DNA, 14 bp, Homo sapiens
tctggggccctggg

SEQ ID NO: 1973069 - DNA, 17 bp, Homo sapiens
tctggggttcagcccct

SEQ ID NO: 1973070 - DNA, 18 bp, Homo sapiens
tctggggttcagcccctc

SEQ ID NO: 1973071 - DNA, 23 bp, Homo sapiens
tctggggttcagcccctcctctg

SEQ ID NO: 1973072 - DNA, 22 bp, Homo sapiens
tctgggtggctcctgccactga

SEQ ID NO: 1973073 - DNA, 18 bp, Homo sapiens
tctgggtgttgaccactc

SEQ ID NO: 1973074 - DNA, 20 bp, Homo sapiens
tctgggttgcttatttccct

SEQ ID NO: 1973075 - DNA, 16 bp, Homo sapiens
tctggtgttctcaatg

SEQ ID NO: 1973076 - DNA, 21 bp, Homo sapiens
tctggtttagtgttctgtatt

SEQ ID NO: 1973077 - DNA, 20 bp, Homo sapiens
tctgtaacgcctgcttgtcc

SEQ ID NO: 1973078 - DNA, 20 bp, Homo sapiens
tctgtaatggaactgacccc

SEQ ID NO: 1973079 - DNA, 15 bp, Homo sapiens
tctgtaatttttcag

SEQ ID NO: 1973080 - DNA, 16 bp, Homo sapiens
tctgtacaaaaacaaa

SEQ ID NO: 1973081 - DNA, 13 bp, Homo sapiens
tctgtacacgtgt

SEQ ID NO: 1973082 - DNA, 13 bp, Homo sapiens
tctgtactgtaat

SEQ ID NO: 1973083 - DNA, 22 bp, Homo sapiens
tctgtataaaatgcaaaataaa

SEQ ID NO: 1973084 - DNA, 22 bp, Homo sapiens
tctgtataaacattaaatgtct

SEQ ID NO: 1973085 - DNA, 20 bp, Homo sapiens
tctgtatagattataaaatt

SEQ ID NO: 1973086 - DNA, 15 bp, Homo sapiens
tctgtatatacaata

SEQ ID NO: 1973087 - DNA, 13 bp, Homo sapiens
tctgtatatacat

SEQ ID NO: 1973088 - DNA, 20 bp, Homo sapiens
tctgtatatgttgtaataaa

SEQ ID NO: 1973089 - DNA, 18 bp, Homo sapiens
tctgtatcggagacagtg

SEQ ID NO: 1973090 - DNA, 19 bp, Homo sapiens
tctgtatcggagacagtga

SEQ ID NO: 1973091 - DNA, 13 bp, Homo sapiens
tctgtattttcat

SEQ ID NO: 1973092 - DNA, 19 bp, Homo sapiens
tctgtcaccagctatctgt

SEQ ID NO: 1973093 - DNA, 16 bp, Homo sapiens
tctgtcacccaggctg

SEQ ID NO: 1973094 - DNA, 20 bp, Homo sapiens
tctgtcagccagccgccctg

SEQ ID NO: 1973095 - DNA, 21 bp, Homo sapiens
tctgtcagccagccgccctgg

SEQ ID NO: 1973096 - DNA, 16 bp, Homo sapiens
tctgtcatctctctgg

SEQ ID NO: 1973097 - DNA, 21 bp, Homo sapiens
tctgtccaggccactgtggcc

SEQ ID NO: 1973098 - DNA, 13 bp, Homo sapiens
tctgtccagggcc

SEQ ID NO: 1973099 - DNA, 19 bp, Homo sapiens
tctgtccagggccctgagc

SEQ ID NO: 1973100 - DNA, 16 bp, Homo sapiens
tctgtcccctctcccc

SEQ ID NO: 1973101 - DNA, 17 bp, Homo sapiens
tctgtcccctctcccct

SEQ ID NO: 1973102 - DNA, 20 bp, Homo sapiens
tctgtccctcactgccttcc

SEQ ID NO: 1973103 - DNA, 22 bp, Homo sapiens
tctgtccctcactgccttccag

SEQ ID NO: 1973104 - DNA, 12 bp, Homo sapiens
tctgtcctggga

SEQ ID NO: 1973105 - DNA, 16 bp, Homo sapiens
tctgtcgcccagtctg

SEQ ID NO: 1973106 - DNA, 23 bp, Homo sapiens
tctgtctctagtttctttctgtt

SEQ ID NO: 1973107 - DNA, 13 bp, Homo sapiens
tctgtctctcttg

SEQ ID NO: 1973108 - DNA, 18 bp, Homo sapiens
tctgtctctcttgctttg

SEQ ID NO: 1973109 - DNA, 21 bp, Homo sapiens
tctgtctctgctcttgcctgc

SEQ ID NO: 1973110 - DNA, 15 bp, Homo sapiens
tctgtctgtctgtcc

SEQ ID NO: 1973111 - DNA, 14 bp, Homo sapiens
tctgtcttgccagc

SEQ ID NO: 1973112 - DNA, 15 bp, Homo sapiens
tctgtcttgccagcc

SEQ ID NO: 1973113 - DNA, 21 bp, Homo sapiens
tctgtgaacgatttagaaaga

SEQ ID NO: 1973114 - DNA, 14 bp, Homo sapiens
tctgtgaagaatga

SEQ ID NO: 1973115 - DNA, 21 bp, Homo sapiens
tctgtgactcgcttagctgaa

SEQ ID NO: 1973116 - DNA, 17 bp, Homo sapiens
tctgtgaggaaagcaca

SEQ ID NO: 1973117 - DNA, 18 bp, Homo sapiens
tctgtgaggtgctgatga

SEQ ID NO: 1973118 - DNA, 19 bp, Homo sapiens
tctgtgcactagcctgtga

SEQ ID NO: 1973119 - DNA, 22 bp, Homo sapiens
tctgtgcactagcctgtgatta

SEQ ID NO: 1973120 - DNA, 13 bp, Homo sapiens
tctgtgccagagc

SEQ ID NO: 1973121 - DNA, 15 bp, Homo sapiens
tctgtgccagagcct

SEQ ID NO: 1973122 - DNA, 18 bp, Homo sapiens
tctgtgccagagcctggg

SEQ ID NO: 1973123 - DNA, 19 bp, Homo sapiens
tctgtgccagagcctgggg

SEQ ID NO: 1973124 - DNA, 13 bp, Homo sapiens
tctgtgctgtgcc

SEQ ID NO: 1973125 - DNA, 18 bp, Homo sapiens
tctgtgctgtgcctgcta

SEQ ID NO: 1973126 - DNA, 22 bp, Homo sapiens
tctgtgctttgactcacctgtt

SEQ ID NO: 1973127 - DNA, 14 bp, Homo sapiens
tctgtggcctgtgt

SEQ ID NO: 1973128 - DNA, 17 bp, Homo sapiens
tctgtgggcttggcctt

SEQ ID NO: 1973129 - DNA, 11 bp, Homo sapiens
tctgtggtggg

SEQ ID NO: 1973130 - DNA, 20 bp, Homo sapiens
tctgtgtcaggtggggcagc

SEQ ID NO: 1973131 - DNA, 22 bp, Homo sapiens
tctgtgtcaggtggggcagctt

SEQ ID NO: 1973132 - DNA, 15 bp, Homo sapiens
tctgtgtccttccct

SEQ ID NO: 1973133 - DNA, 18 bp, Homo sapiens
tctgtgtccttccctgca

SEQ ID NO: 1973134 - DNA, 22 bp, Homo sapiens
tctgtgtgcaccttaccaactt

SEQ ID NO: 1973135 - DNA, 23 bp, Homo sapiens
tctgtgtggtatatttgtgtatg

SEQ ID NO: 1973136 - DNA, 19 bp, Homo sapiens
tctgtgtgtctgatgtttg

SEQ ID NO: 1973137 - DNA, 20 bp, Homo sapiens
tctgtgtttgaccttcacat

SEQ ID NO: 1973138 - DNA, 18 bp, Homo sapiens
tctgttcatttcctcaaa

SEQ ID NO: 1973139 - DNA, 21 bp, Homo sapiens
tctgttctcaaatgctaaatg

SEQ ID NO: 1973140 - DNA, 23 bp, Homo sapiens
tctgttgagtgcaacaagagcaa

SEQ ID NO: 1973141 - DNA, 17 bp, Homo sapiens
tctgttgatcccacttc

SEQ ID NO: 1973142 - DNA, 18 bp, Homo sapiens
tctgttgccacaaccctg

SEQ ID NO: 1973143 - DNA, 15 bp, Homo sapiens
tctgttgccaggcta

SEQ ID NO: 1973144 - DNA, 17 bp, Homo sapiens
tctgttgcccaggctgg

SEQ ID NO: 1973145 - DNA, 18 bp, Homo sapiens
tctgtttataaaaacaaa

SEQ ID NO: 1973146 - DNA, 18 bp, Homo sapiens
tcttaaaaaataaaaact

SEQ ID NO: 1973147 - DNA, 20 bp, Homo sapiens
tcttaaaaacagctgtaact

SEQ ID NO: 1973148 - DNA, 17 bp, Homo sapiens
tcttaaaatgtttcatt

SEQ ID NO: 1973149 - DNA, 17 bp, Homo sapiens
tcttaaaggcctggaac

SEQ ID NO: 1973150 - DNA, 16 bp, Homo sapiens
tcttaaataagaaact

SEQ ID NO: 1973151 - DNA, 18 bp, Homo sapiens
tcttaaataagaaacttt

SEQ ID NO: 1973152 - DNA, 19 bp, Homo sapiens
tcttaaataagaaactttt

SEQ ID NO: 1973153 - DNA, 23 bp, Homo sapiens
tcttaacacatgtccttgtgtgt

SEQ ID NO: 1973154 - DNA, 22 bp, Homo sapiens
tcttaatgctttcctccctggc

SEQ ID NO: 1973155 - DNA, 14 bp, Homo sapiens
tcttaattaaaaga

SEQ ID NO: 1973156 - DNA, 14 bp, Homo sapiens
tcttacaaacatgt

SEQ ID NO: 1973157 - DNA, 18 bp, Homo sapiens
tcttacccatatatctta

SEQ ID NO: 1973158 - DNA, 15 bp, Homo sapiens
tcttaccgtagcctc

SEQ ID NO: 1973159 - DNA, 24 bp, Homo sapiens
tcttactaaacattttgttattgg

SEQ ID NO: 1973160 - DNA, 21 bp, Homo sapiens
tcttagaagtggaccaggaca

SEQ ID NO: 1973161 - DNA, 19 bp, Homo sapiens
tcttaggaagagaaaccag

SEQ ID NO: 1973162 - DNA, 23 bp, Homo sapiens
tcttagtcgaatgttagattcct

SEQ ID NO: 1973163 - DNA, 20 bp, Homo sapiens
tcttatagaatatttattac

SEQ ID NO: 1973164 - DNA, 22 bp, Homo sapiens
tcttatatagcagcaaaaatat

SEQ ID NO: 1973165 - DNA, 18 bp, Homo sapiens
tcttattcagtaaaaaac

SEQ ID NO: 1973166 - DNA, 21 bp, Homo sapiens
tcttattcccaaactacagaa

SEQ ID NO: 1973167 - DNA, 22 bp, Homo sapiens
tcttattcccaaactacagaat

SEQ ID NO: 1973168 - DNA, 15 bp, Homo sapiens
tcttatttcatttct

SEQ ID NO: 1973169 - DNA, 12 bp, Homo sapiens
tcttatttctgt

SEQ ID NO: 1973170 - DNA, 12 bp, Homo sapiens
tcttatttgcaa

SEQ ID NO: 1973171 - DNA, 13 bp, Homo sapiens
tcttatttgcaat

SEQ ID NO: 1973172 - DNA, 16 bp, Homo sapiens
tcttatttgcaataaa

SEQ ID NO: 1973173 - DNA, 11 bp, Homo sapiens
tcttatttgct

SEQ ID NO: 1973174 - DNA, 23 bp, Homo sapiens
tcttatttgtttggtcactgcta

SEQ ID NO: 1973175 - DNA, 15 bp, Homo sapiens
tcttcaagctgtccc

SEQ ID NO: 1973176 - DNA, 16 bp, Homo sapiens
tcttcaataaattaag

SEQ ID NO: 1973177 - DNA, 22 bp, Homo sapiens
tcttcaataaattaagttttat

SEQ ID NO: 1973178 - DNA, 12 bp, Homo sapiens
tcttcacaacct

SEQ ID NO: 1973179 - DNA, 16 bp, Homo sapiens
tcttcactcagccaca

SEQ ID NO: 1973180 - DNA, 17 bp, Homo sapiens
tcttcactcagccacac

SEQ ID NO: 1973181 - DNA, 21 bp, Homo sapiens
tcttcactgccatgcctcaag

SEQ ID NO: 1973182 - DNA, 18 bp, Homo sapiens
tcttcagaagacactgca

SEQ ID NO: 1973183 - DNA, 16 bp, Homo sapiens
tcttcagagcaggggt

SEQ ID NO: 1973184 - DNA, 19 bp, Homo sapiens
tcttcagccacctctcttt

SEQ ID NO: 1973185 - DNA, 13 bp, Homo sapiens
tcttcagccatca

SEQ ID NO: 1973186 - DNA, 15 bp, Homo sapiens
tcttcagcgagaccc

SEQ ID NO: 1973187 - DNA, 16 bp, Homo sapiens
tcttcagctcccatag

SEQ ID NO: 1973188 - DNA, 13 bp, Homo sapiens
tcttcaggaggcc

SEQ ID NO: 1973189 - DNA, 16 bp, Homo sapiens
tcttcaggaggccctg

SEQ ID NO: 1973190 - DNA, 20 bp, Homo sapiens
tcttcaggaggccctggtgt

SEQ ID NO: 1973191 - DNA, 19 bp, Homo sapiens
tcttcagttttatctttaa

SEQ ID NO: 1973192 - DNA, 14 bp, Homo sapiens
tcttcatttcattg

SEQ ID NO: 1973193 - DNA, 21 bp, Homo sapiens
tcttcatttcattgtatgatg

SEQ ID NO: 1973194 - DNA, 14 bp, Homo sapiens
tcttccaaagcaca

SEQ ID NO: 1973195 - DNA, 15 bp, Homo sapiens
tcttccaaccccagc

SEQ ID NO: 1973196 - DNA, 20 bp, Homo sapiens
tcttccaaccccagctggcc

SEQ ID NO: 1973197 - DNA, 18 bp, Homo sapiens
tcttccagagcctaagaa

SEQ ID NO: 1973198 - DNA, 16 bp, Homo sapiens
tcttccagtgcaacaa

SEQ ID NO: 1973199 - DNA, 19 bp, Homo sapiens
tcttccagtgcaacaaaat

SEQ ID NO: 1973200 - DNA, 22 bp, Homo sapiens
tcttccagtttgctttgccctt

SEQ ID NO: 1973201 - DNA, 12 bp, Homo sapiens
tcttccataatg

SEQ ID NO: 1973202 - DNA, 13 bp, Homo sapiens
tcttcccatttgt

SEQ ID NO: 1973203 - DNA, 15 bp, Homo sapiens
tcttcccatttgtaa

SEQ ID NO: 1973204 - DNA, 13 bp, Homo sapiens
tcttccccttgcc

SEQ ID NO: 1973205 - DNA, 15 bp, Homo sapiens
tcttcccctttcctg

SEQ ID NO: 1973206 - DNA, 12 bp, Homo sapiens
tcttccctcagt

SEQ ID NO: 1973207 - DNA, 14 bp, Homo sapiens
tcttccctccttcc

SEQ ID NO: 1973208 - DNA, 19 bp, Homo sapiens
tcttccctgttttaaatta

SEQ ID NO: 1973209 - DNA, 22 bp, Homo sapiens
tcttcctaccaaatataaactt

SEQ ID NO: 1973210 - DNA, 19 bp, Homo sapiens
tcttcctagtatattagtt

SEQ ID NO: 1973211 - DNA, 13 bp, Homo sapiens
tcttcctcatcag

SEQ ID NO: 1973212 - DNA, 12 bp, Homo sapiens
tcttcctcctgg

SEQ ID NO: 1973213 - DNA, 14 bp, Homo sapiens
tcttcctctgctga

SEQ ID NO: 1973214 - DNA, 18 bp, Homo sapiens
tcttcctgcaaggactac

SEQ ID NO: 1973215 - DNA, 15 bp, Homo sapiens
tcttcctgctgctgt

SEQ ID NO: 1973216 - DNA, 22 bp, Homo sapiens
tcttcctgtaacacaagccaca

SEQ ID NO: 1973217 - DNA, 11 bp, Homo sapiens
tcttccttccc

SEQ ID NO: 1973218 - DNA, 12 bp, Homo sapiens
tcttccttcccc

SEQ ID NO: 1973219 - DNA, 14 bp, Homo sapiens
tcttccttccccca

SEQ ID NO: 1973220 - DNA, 15 bp, Homo sapiens
tcttccttgtgagga

SEQ ID NO: 1973221 - DNA, 19 bp, Homo sapiens
tcttcggggaactcctgga

SEQ ID NO: 1973222 - DNA, 20 bp, Homo sapiens
tcttcggtgtttaaagtcaa

SEQ ID NO: 1973223 - DNA, 14 bp, Homo sapiens
tcttcggtttctga

SEQ ID NO: 1973224 - DNA, 17 bp, Homo sapiens
tcttcggtttctgagca

SEQ ID NO: 1973225 - DNA, 16 bp, Homo sapiens
tcttctaaaatgcttt

SEQ ID NO: 1973226 - DNA, 15 bp, Homo sapiens
tcttctaaaattgaa

SEQ ID NO: 1973227 - DNA, 19 bp, Homo sapiens
tcttctacaaccagagccc

SEQ ID NO: 1973228 - DNA, 18 bp, Homo sapiens
tcttctacgtataaatat

SEQ ID NO: 1973229 - DNA, 13 bp, Homo sapiens
tcttctatttaaa

SEQ ID NO: 1973230 - DNA, 18 bp, Homo sapiens
tcttctatttaaaaaata

SEQ ID NO: 1973231 - DNA, 13 bp, Homo sapiens
tcttctattttgt

SEQ ID NO: 1973232 - DNA, 12 bp, Homo sapiens
tcttctccactg

SEQ ID NO: 1973233 - DNA, 13 bp, Homo sapiens
tcttctccaggct

SEQ ID NO: 1973234 - DNA, 14 bp, Homo sapiens
tcttctccaggctg

SEQ ID NO: 1973235 - DNA, 14 bp, Homo sapiens
tcttctccatctgg

SEQ ID NO: 1973236 - DNA, 13 bp, Homo sapiens
tcttctcctttca

SEQ ID NO: 1973237 - DNA, 14 bp, Homo sapiens
tcttctcctttcac

SEQ ID NO: 1973238 - DNA, 11 bp, Homo sapiens
tcttctctcaa

SEQ ID NO: 1973239 - DNA, 14 bp, Homo sapiens
tcttctcttcctgt

SEQ ID NO: 1973240 - DNA, 13 bp, Homo sapiens
tcttctgaaatga

SEQ ID NO: 1973241 - DNA, 22 bp, Homo sapiens
tcttctgaaatgaaacaaataa

SEQ ID NO: 1973242 - DNA, 20 bp, Homo sapiens
tcttctgtacgtctgacagg

SEQ ID NO: 1973243 - DNA, 21 bp, Homo sapiens
tcttctgtacgtctgacaggc

SEQ ID NO: 1973244 - DNA, 19 bp, Homo sapiens
tcttctgtatactgtggag

SEQ ID NO: 1973245 - DNA, 23 bp, Homo sapiens
tgaggatctagcttcatgcctca

SEQ ID NO: 1973246 - DNA, 14 bp, Homo sapiens
tgaggatgacagag

SEQ ID NO: 1973247 - DNA, 13 bp, Homo sapiens
tgaggatttcaag

SEQ ID NO: 1973248 - DNA, 20 bp, Homo sapiens
tgaggcaaaggccagcagca

SEQ ID NO: 1973249 - DNA, 16 bp, Homo sapiens
tgaggcaatgtcagga

SEQ ID NO: 1973250 - DNA, 21 bp, Homo sapiens
tgaggcaatgtcaggaacaga

SEQ ID NO: 1973251 - DNA, 16 bp, Homo sapiens
tgaggcactgataata

SEQ ID NO: 1973252 - DNA, 13 bp, Homo sapiens
tgaggcagaagaa

SEQ ID NO: 1973253 - DNA, 17 bp, Homo sapiens
tgaggcagacagcagct

SEQ ID NO: 1973254 - DNA, 24 bp, Homo sapiens
tgaggcagacagcagctcaggcac

SEQ ID NO: 1973255 - DNA, 22 bp, Homo sapiens
tgaggccaaacgttttgaacta

SEQ ID NO: 1973256 - DNA, 16 bp, Homo sapiens
tgaggccagaggtgct

SEQ ID NO: 1973257 - DNA, 12 bp, Homo sapiens
tgaggcccagcc

SEQ ID NO: 1973258 - DNA, 13 bp, Homo sapiens
tgaggcccagcct

SEQ ID NO: 1973259 - DNA, 17 bp, Homo sapiens
tgaggcccagcctgtcc

SEQ ID NO: 1973260 - DNA, 20 bp, Homo sapiens
tgaggcccagcctgtcctgg

SEQ ID NO: 1973261 - DNA, 13 bp, Homo sapiens
tgaggccccaggc

SEQ ID NO: 1973262 - DNA, 21 bp, Homo sapiens
tgaggcctcttggacctctgc

SEQ ID NO: 1973263 - DNA, 17 bp, Homo sapiens
tgaggcctgccctcagg

SEQ ID NO: 1973264 - DNA, 23 bp, Homo sapiens
tgaggcgccccaacccgtggagg

SEQ ID NO: 1973265 - DNA, 17 bp, Homo sapiens
tgaggctcaagaggccc

SEQ ID NO: 1973266 - DNA, 21 bp, Homo sapiens
tgaggctctgacccagtgaga

SEQ ID NO: 1973267 - DNA, 18 bp, Homo sapiens
tgaggctgagactgcggg

SEQ ID NO: 1973268 - DNA, 12 bp, Homo sapiens
tgaggctgggaa

SEQ ID NO: 1973269 - DNA, 15 bp, Homo sapiens
tgaggctgggccagc

SEQ ID NO: 1973270 - DNA, 17 bp, Homo sapiens
tgaggcttccaggctct

SEQ ID NO: 1973271 - DNA, 21 bp, Homo sapiens
tgaggcttccaggctcttcct

SEQ ID NO: 1973272 - DNA, 17 bp, Homo sapiens
tgagggaacagacagga

SEQ ID NO: 1973273 - DNA, 18 bp, Homo sapiens
tgagggatcacagggccc

SEQ ID NO: 1973274 - DNA, 16 bp, Homo sapiens
tgagggcagcagccag

SEQ ID NO: 1973275 - DNA, 19 bp, Homo sapiens
tgagggcagtggggagcat

SEQ ID NO: 1973276 - DNA, 18 bp, Homo sapiens
tgagggcagttcgcagcc

SEQ ID NO: 1973277 - DNA, 19 bp, Homo sapiens
tgagggcagttcgcagcca

SEQ ID NO: 1973278 - DNA, 11 bp, Homo sapiens
tgagggctggg

SEQ ID NO: 1973279 - DNA, 13 bp, Homo sapiens
tgagggctgggca

SEQ ID NO: 1973280 - DNA, 14 bp, Homo sapiens
tgagggctgggccc

SEQ ID NO: 1973281 - DNA, 16 bp, Homo sapiens
tgagggctgggcccac

SEQ ID NO: 1973282 - DNA, 21 bp, Homo sapiens
tgaggggaggatcactggagc

SEQ ID NO: 1973283 - DNA, 14 bp, Homo sapiens
tgaggggctcctgg

SEQ ID NO: 1973284 - DNA, 18 bp, Homo sapiens
tgagggtaataaacttag

SEQ ID NO: 1973285 - DNA, 19 bp, Homo sapiens
tgagggtccccacctggga

SEQ ID NO: 1973286 - DNA, 12 bp, Homo sapiens
tgagggtgactg

SEQ ID NO: 1973287 - DNA, 13 bp, Homo sapiens
tgaggtcccaggc

SEQ ID NO: 1973288 - DNA, 15 bp, Homo sapiens
tgaggtcccaggcag

SEQ ID NO: 1973289 - DNA, 17 bp, Homo sapiens
tgaggtcccaggcagag

SEQ ID NO: 1973290 - DNA, 22 bp, Homo sapiens
tgaggtcctgcatttctcagtc

SEQ ID NO: 1973291 - DNA, 17 bp, Homo sapiens
tgaggtgcccaggagaa

SEQ ID NO: 1973292 - DNA, 20 bp, Homo sapiens
tgaggtggaagccctccttc

SEQ ID NO: 1973293 - DNA, 15 bp, Homo sapiens
tgaggttaaaatata

SEQ ID NO: 1973294 - DNA, 20 bp, Homo sapiens
tgagtaaattggaaacattt

SEQ ID NO: 1973295 - DNA, 15 bp, Homo sapiens
tgagtcaaaagcctg

SEQ ID NO: 1973296 - DNA, 16 bp, Homo sapiens
tgagtcaccaagccca

SEQ ID NO: 1973297 - DNA, 17 bp, Homo sapiens
tgagtcaccaagcccag

SEQ ID NO: 1973298 - DNA, 13 bp, Homo sapiens
tgagtcacctcct

SEQ ID NO: 1973299 - DNA, 14 bp, Homo sapiens
tgagtcacctcctc

SEQ ID NO: 1973300 - DNA, 22 bp, Homo sapiens
tgagtcatgatctccctgccgc

SEQ ID NO: 1973301 - DNA, 15 bp, Homo sapiens
tgagtcctcctcttc

SEQ ID NO: 1973302 - DNA, 19 bp, Homo sapiens
tgagtcctgtctctgcctg

SEQ ID NO: 1973303 - DNA, 18 bp, Homo sapiens
tgagtcgaggacagggag

SEQ ID NO: 1973304 - DNA, 18 bp, Homo sapiens
tgagtcgtcatcactttt

SEQ ID NO: 1973305 - DNA, 20 bp, Homo sapiens
tgagtctacctgagcattca

SEQ ID NO: 1973306 - DNA, 16 bp, Homo sapiens
tgagtctcctctctga

SEQ ID NO: 1973307 - DNA, 17 bp, Homo sapiens
tgagtctcctctctgag

SEQ ID NO: 1973308 - DNA, 21 bp, Homo sapiens
tgagtctcctctctgagactg

SEQ ID NO: 1973309 - DNA, 15 bp, Homo sapiens
tgagtctgagtcctg

SEQ ID NO: 1973310 - DNA, 14 bp, Homo sapiens
tgagtctgcataaa

SEQ ID NO: 1973311 - DNA, 18 bp, Homo sapiens
tgagtctttaatcccagt

SEQ ID NO: 1973312 - DNA, 15 bp, Homo sapiens
tgagtgaatagcttt

SEQ ID NO: 1973313 - DNA, 17 bp, Homo sapiens
tgagtgaatggcaaagc

SEQ ID NO: 1973314 - DNA, 20 bp, Homo sapiens
tgagtgatcctccaacttca

SEQ ID NO: 1973315 - DNA, 14 bp, Homo sapiens
tgagtgattatttg

SEQ ID NO: 1973316 - DNA, 15 bp, Homo sapiens
tgagtgcaacaagag

SEQ ID NO: 1973317 - DNA, 20 bp, Homo sapiens
tgagtgcccactacgtgcca

SEQ ID NO: 1973318 - DNA, 14 bp, Homo sapiens
tgagtggaatgcag

SEQ ID NO: 1973319 - DNA, 17 bp, Homo sapiens
tgagtggaatgcaggga

SEQ ID NO: 1973320 - DNA, 18 bp, Homo sapiens
tgagtggaatgcagggaa

SEQ ID NO: 1973321 - DNA, 19 bp, Homo sapiens
tgagtggaatgcagggaag

SEQ ID NO: 1973322 - DNA, 21 bp, Homo sapiens
tgagtggatggaggagaaata

SEQ ID NO: 1973323 - DNA, 22 bp, Homo sapiens
tgagtggatggaggagaaataa

SEQ ID NO: 1973324 - DNA, 14 bp, Homo sapiens
tgagtggcagccat

SEQ ID NO: 1973325 - DNA, 18 bp, Homo sapiens
tgagtggcagccatgcct

SEQ ID NO: 1973326 - DNA, 20 bp, Homo sapiens
tgagtggcagccatgcctca

SEQ ID NO: 1973327 - DNA, 18 bp, Homo sapiens
tgagtgtcttaattaaaa

SEQ ID NO: 1973328 - DNA, 22 bp, Homo sapiens
tgagtgtgggagtgcagagaaa

SEQ ID NO: 1973329 - DNA, 23 bp, Homo sapiens
tgagttacaccagacctgttctg

SEQ ID NO: 1973330 - DNA, 23 bp, Homo sapiens
tgagttcctgtgggtgtgtctct

SEQ ID NO: 1973331 - DNA, 20 bp, Homo sapiens
tgagttccttataagaatta

SEQ ID NO: 1973332 - DNA, 23 bp, Homo sapiens
tgagttgacttgacagaacactg

SEQ ID NO: 1973333 - DNA, 20 bp, Homo sapiens
tgagttggtgttgacatgtg

SEQ ID NO: 1973334 - DNA, 19 bp, Homo sapiens
tgagtttcattctcctgcc

SEQ ID NO: 1973335 - DNA, 13 bp, Homo sapiens
tgagtttgcttat

SEQ ID NO: 1973336 - DNA, 18 bp, Homo sapiens
tgagtttttgatagcttt

SEQ ID NO: 1973337 - DNA, 19 bp, Homo sapiens
tgagtttttgatagcttta

SEQ ID NO: 1973338 - DNA, 14 bp, Homo sapiens
tgataaaattgtga

SEQ ID NO: 1973339 - DNA, 21 bp, Homo sapiens
tgataaaattgtgatgttttg

SEQ ID NO: 1973340 - DNA, 18 bp, Homo sapiens
tgataaatatttatgctt

SEQ ID NO: 1973341 - DNA, 16 bp, Homo sapiens
tgataagcaggaagga

SEQ ID NO: 1973342 - DNA, 15 bp, Homo sapiens
tgataagtggaaaaa

SEQ ID NO: 1973343 - DNA, 20 bp, Homo sapiens
tgataagtggaaaaaagaga

SEQ ID NO: 1973344 - DNA, 13 bp, Homo sapiens
tgaccccagggca

SEQ ID NO: 1973345 - DNA, 20 bp, Homo sapiens
tgaccccagggcacaggagc

SEQ ID NO: 1973346 - DNA, 15 bp, Homo sapiens
tgaccccctcccctg

SEQ ID NO: 1973347 - DNA, 13 bp, Homo sapiens
tgacccctttccc

SEQ ID NO: 1973348 - DNA, 20 bp, Homo sapiens
tgacccctttcccccacccc

SEQ ID NO: 1973349 - DNA, 21 bp, Homo sapiens
tgacccggcaccccctgcagc

SEQ ID NO: 1973350 - DNA, 22 bp, Homo sapiens
tgaccctccaccgcagaaggaa

SEQ ID NO: 1973351 - DNA, 23 bp, Homo sapiens
tgaccctccaccgcagaaggaag

SEQ ID NO: 1973352 - DNA, 16 bp, Homo sapiens
tgaccctcctgtccag

SEQ ID NO: 1973353 - DNA, 21 bp, Homo sapiens
tgaccctcctgtccagcaggt

SEQ ID NO: 1973354 - DNA, 22 bp, Homo sapiens
tgaccctggagcggctctcctg

SEQ ID NO: 1973355 - DNA, 23 bp, Homo sapiens
tgaccctggagcggctctcctga

SEQ ID NO: 1973356 - DNA, 20 bp, Homo sapiens
tgacccttccagacatacga

SEQ ID NO: 1973357 - DNA, 21 bp, Homo sapiens
tgacccttcccaatcagcact

SEQ ID NO: 1973358 - DNA, 16 bp, Homo sapiens
tgaccggcacctgcga

SEQ ID NO: 1973359 - DNA, 21 bp, Homo sapiens
tgacctcaagatgtcctcctt

SEQ ID NO: 1973360 - DNA, 20 bp, Homo sapiens
tgacctcaccggcatgctgg

SEQ ID NO: 1973361 - DNA, 22 bp, Homo sapiens
tgacctcaccggcatgctggcc

SEQ ID NO: 1973362 - DNA, 16 bp, Homo sapiens
tgacctcagctgcaca

SEQ ID NO: 1973363 - DNA, 21 bp, Homo sapiens
tgacctcagctgcacattcct

SEQ ID NO: 1973364 - DNA, 22 bp, Homo sapiens
tgacctcaggtgatccacccac

SEQ ID NO: 1973365 - DNA, 13 bp, Homo sapiens
tgacctccagctt

SEQ ID NO: 1973366 - DNA, 13 bp, Homo sapiens
tgacctccccacc

SEQ ID NO: 1973367 - DNA, 17 bp, Homo sapiens
tgagagaatctgcctgt

SEQ ID NO: 1973368 - DNA, 20 bp, Homo sapiens
tgagagaatgggtttactct

SEQ ID NO: 1973369 - DNA, 23 bp, Homo sapiens
tgagagaatgggtttactctcaa

SEQ ID NO: 1973370 - DNA, 19 bp, Homo sapiens
tgagagaattgtatcattt

SEQ ID NO: 1973371 - DNA, 20 bp, Homo sapiens
tgagagacccaaggaggaaa

SEQ ID NO: 1973372 - DNA, 21 bp, Homo sapiens
tgagagacccaaggaggaaaa

SEQ ID NO: 1973373 - DNA, 14 bp, Homo sapiens
tgagagagtgctga

SEQ ID NO: 1973374 - DNA, 15 bp, Homo sapiens
tgagagctaatttaa

SEQ ID NO: 1973375 - DNA, 16 bp, Homo sapiens
tgagagctgctctgga

SEQ ID NO: 1973376 - DNA, 21 bp, Homo sapiens
tgagaggaagatgaagagaag

SEQ ID NO: 1973377 - DNA, 23 bp, Homo sapiens
tgagaggacttttctttgtggct

SEQ ID NO: 1973378 - DNA, 16 bp, Homo sapiens
tgagaggcagaggcag

SEQ ID NO: 1973379 - DNA, 12 bp, Homo sapiens
tgagaggccctg

SEQ ID NO: 1973380 - DNA, 14 bp, Homo sapiens
tgagaggccctgga

SEQ ID NO: 1973381 - DNA, 16 bp, Homo sapiens
tgagaggccctggatc

SEQ ID NO: 1973382 - DNA, 23 bp, Homo sapiens
tgagaggccctggatcagcgtgg

SEQ ID NO: 1973383 - DNA, 21 bp, Homo sapiens
tgagaggcgacaggagtattt

SEQ ID NO: 1973384 - DNA, 14 bp, Homo sapiens
tgagaggggaacag

SEQ ID NO: 1973385 - DNA, 19 bp, Homo sapiens
tgagagtatcaggtctccc

SEQ ID NO: 1973386 - DNA, 19 bp, Homo sapiens
tgagagttggctcaggcag

SEQ ID NO: 1973387 - DNA, 22 bp, Homo sapiens
tgagataaccacaaccaggaag

SEQ ID NO: 1973388 - DNA, 16 bp, Homo sapiens
tgagataatatctgtg

SEQ ID NO: 1973389 - DNA, 18 bp, Homo sapiens
tgagataatatctgtgag

SEQ ID NO: 1973390 - DNA, 19 bp, Homo sapiens
tgagataatatctgtgagg

SEQ ID NO: 1973391 - DNA, 23 bp, Homo sapiens
tgagatagtagcatacatttata

SEQ ID NO: 1973392 - DNA, 14 bp, Homo sapiens
tgagatatacaaat

SEQ ID NO: 1973393 - DNA, 16 bp, Homo sapiens
tgagatctaagccttt

SEQ ID NO: 1973394 - DNA, 20 bp, Homo sapiens
tgagatctaagcctttccat

SEQ ID NO: 1973395 - DNA, 23 bp, Homo sapiens
tgagatctaagcctttccataag

SEQ ID NO: 1973396 - DNA, 18 bp, Homo sapiens
tgagattactttgtcccg

SEQ ID NO: 1973397 - DNA, 20 bp, Homo sapiens
tgagatttttgttttccact

SEQ ID NO: 1973398 - DNA, 19 bp, Homo sapiens
tgagcaaatgtggctcctg

SEQ ID NO: 1973399 - DNA, 22 bp, Homo sapiens
tgagcaagatcttgtctccact

SEQ ID NO: 1973400 - DNA, 14 bp, Homo sapiens
tgagcaattcattt

SEQ ID NO: 1973401 - DNA, 20 bp, Homo sapiens
tgagcaattcatttcacttt

SEQ ID NO: 1973402 - DNA, 14 bp, Homo sapiens
tgagcacatctggg

SEQ ID NO: 1973403 - DNA, 16 bp, Homo sapiens
tgagcacatctgggag

SEQ ID NO: 1973404 - DNA, 23 bp, Homo sapiens
tgagcaccccctcattcccctcg

SEQ ID NO: 1973405 - DNA, 21 bp, Homo sapiens
tgagcactaaggtgtgctctg

SEQ ID NO: 1973406 - DNA, 22 bp, Homo sapiens
tgagcactaaggtgtgctctga

SEQ ID NO: 1973407 - DNA, 22 bp, Homo sapiens
tgagcactcagtctagtgaaga

SEQ ID NO: 1973408 - DNA, 13 bp, Homo sapiens
tgagcactgccag

SEQ ID NO: 1973409 - DNA, 17 bp, Homo sapiens
tgagcactgccaggagg

SEQ ID NO: 1973410 - DNA, 19 bp, Homo sapiens
tgagcactgccaggaggga

SEQ ID NO: 1973411 - DNA, 20 bp, Homo sapiens
tgagcaggattttaatcttt

SEQ ID NO: 1973412 - DNA, 22 bp, Homo sapiens
tgagcaggcccgacagagagat

SEQ ID NO: 1973413 - DNA, 20 bp, Homo sapiens
tgagcagggctcagcgggga

SEQ ID NO: 1973414 - DNA, 18 bp, Homo sapiens
tgagcatgcacagctgct

SEQ ID NO: 1973415 - DNA, 20 bp, Homo sapiens
tgagcatgcacagctgcttg

SEQ ID NO: 1973416 - DNA, 14 bp, Homo sapiens
tgagcattcaggca

SEQ ID NO: 1973417 - DNA, 20 bp, Homo sapiens
tgagccaaacacactgtaaa

SEQ ID NO: 1973418 - DNA, 15 bp, Homo sapiens
tgagccacagaccac

SEQ ID NO: 1973419 - DNA, 24 bp, Homo sapiens
tgagccacagaccacctgcttctg

SEQ ID NO: 1973420 - DNA, 21 bp, Homo sapiens
tgagccactgcaccgggccac

SEQ ID NO: 1973421 - DNA, 16 bp, Homo sapiens
tgagcccagccacctc

SEQ ID NO: 1973422 - DNA, 18 bp, Homo sapiens
tgagcccagccacctccc

SEQ ID NO: 1973423 - DNA, 12 bp, Homo sapiens
tgagcccaggga

SEQ ID NO: 1973424 - DNA, 15 bp, Homo sapiens
tgagcccccggctag

SEQ ID NO: 1973425 - DNA, 22 bp, Homo sapiens
tgagccgagatcacgccactgc

SEQ ID NO: 1973426 - DNA, 23 bp, Homo sapiens
tgagccgagatcacgccactgca

SEQ ID NO: 1973427 - DNA, 21 bp, Homo sapiens
tgagccgagattgcgccactg

SEQ ID NO: 1973428 - DNA, 20 bp, Homo sapiens
tgagcctaaatctaatcagg

SEQ ID NO: 1973429 - DNA, 17 bp, Homo sapiens
tgagcctcagcatcctg

SEQ ID NO: 1973430 - DNA, 20 bp, Homo sapiens
tgagcctccatttctggctt

SEQ ID NO: 1973431 - DNA, 14 bp, Homo sapiens
tgagccttcagtct

SEQ ID NO: 1973432 - DNA, 21 bp, Homo sapiens
tgagccttttcttatataaga

SEQ ID NO: 1973433 - DNA, 13 bp, Homo sapiens
tgagcgaaatcat

SEQ ID NO: 1973434 - DNA, 13 bp, Homo sapiens
tgagctaggcatg

SEQ ID NO: 1973435 - DNA, 20 bp, Homo sapiens
tgagctatgattatgccact

SEQ ID NO: 1973436 - DNA, 16 bp, Homo sapiens
tgagctcagaccccca

SEQ ID NO: 1973437 - DNA, 12 bp, Homo sapiens
tgagctcaggct

SEQ ID NO: 1973438 - DNA, 14 bp, Homo sapiens
tgagctcaggctga

SEQ ID NO: 1973439 - DNA, 18 bp, Homo sapiens
tgagctcaggctgagccc

SEQ ID NO: 1973440 - DNA, 20 bp, Homo sapiens
tgagctcaggctgagcccag

SEQ ID NO: 1973441 - DNA, 21 bp, Homo sapiens
tgagctcaggctgagcccagc

SEQ ID NO: 1973442 - DNA, 22 bp, Homo sapiens
tgagctcaggctgagcccagcc

SEQ ID NO: 1973443 - DNA, 16 bp, Homo sapiens
tgagctccccaaaaac

SEQ ID NO: 1973444 - DNA, 20 bp, Homo sapiens
tgagctcggtggacccaggg

SEQ ID NO: 1973445 - DNA, 19 bp, Homo sapiens
tgagctctatttccccacc

SEQ ID NO: 1973446 - DNA, 12 bp, Homo sapiens
tgagctctgaga

SEQ ID NO: 1973447 - DNA, 20 bp, Homo sapiens
tgagctctgagaggccctgg

SEQ ID NO: 1973448 - DNA, 15 bp, Homo sapiens
tgagctcttcatgtt

SEQ ID NO: 1973449 - DNA, 18 bp, Homo sapiens
tgagctcttcatgtttca

SEQ ID NO: 1973450 - DNA, 15 bp, Homo sapiens
tgagctgaagacaaa

SEQ ID NO: 1973451 - DNA, 21 bp, Homo sapiens
tgagctgagttccttataaga

SEQ ID NO: 1973452 - DNA, 14 bp, Homo sapiens
tgagctgcagaaac

SEQ ID NO: 1973453 - DNA, 14 bp, Homo sapiens
tgagctggggcctg

SEQ ID NO: 1973454 - DNA, 22 bp, Homo sapiens
tgagctggggcctggagagggg

SEQ ID NO: 1973455 - DNA, 14 bp, Homo sapiens
tgagctgtatatat

SEQ ID NO: 1973456 - DNA, 23 bp, Homo sapiens
tgagcttagccttgtgccctgcc

SEQ ID NO: 1973457 - DNA, 19 bp, Homo sapiens
tgagcttggcagctgaact

SEQ ID NO: 1973458 - DNA, 24 bp, Homo sapiens
tgaggaagaagggataatagacac

SEQ ID NO: 1973459 - DNA, 20 bp, Homo sapiens
tgaggaagccccaagccatg

SEQ ID NO: 1973460 - DNA, 17 bp, Homo sapiens
tgaggaataattattta

SEQ ID NO: 1973461 - DNA, 19 bp, Homo sapiens
tgaggaattatcatgggaa

SEQ ID NO: 1973462 - DNA, 17 bp, Homo sapiens
tctgccccaagcagcca

SEQ ID NO: 1973463 - DNA, 18 bp, Homo sapiens
tctgccccaagcagccag

SEQ ID NO: 1973464 - DNA, 21 bp, Homo sapiens
tctgccccaagcagccagcca

SEQ ID NO: 1973465 - DNA, 16 bp, Homo sapiens
tctgccccaagccccc

SEQ ID NO: 1973466 - DNA, 12 bp, Homo sapiens
tctgccccaagg

SEQ ID NO: 1973467 - DNA, 12 bp, Homo sapiens
tctgccccaccc

SEQ ID NO: 1973468 - DNA, 15 bp, Homo sapiens
tctgccccaccctca

SEQ ID NO: 1973469 - DNA, 19 bp, Homo sapiens
tctgccccagtagtcagaa

SEQ ID NO: 1973470 - DNA, 21 bp, Homo sapiens
tctgcccccgtcttctctcca

SEQ ID NO: 1973471 - DNA, 15 bp, Homo sapiens
tctgccccttgggca

SEQ ID NO: 1973472 - DNA, 13 bp, Homo sapiens
tctgcccgcagag

SEQ ID NO: 1973473 - DNA, 15 bp, Homo sapiens
tctgcccgcagagcc

SEQ ID NO: 1973474 - DNA, 21 bp, Homo sapiens
tctgcccgcagagcccacgcc

SEQ ID NO: 1973475 - DNA, 13 bp, Homo sapiens
tctgccctgcctc

SEQ ID NO: 1973476 - DNA, 21 bp, Homo sapiens
tctgcctcaatgtgaatcaga

SEQ ID NO: 1973477 - DNA, 12 bp, Homo sapiens
tctgcctcccta

SEQ ID NO: 1973478 - DNA, 13 bp, Homo sapiens
tctgcctccctct

SEQ ID NO: 1973479 - DNA, 15 bp, Homo sapiens
tctgcctctattcaa

SEQ ID NO: 1973480 - DNA, 21 bp, Homo sapiens
tctgcctctgacacacagctc

SEQ ID NO: 1973481 - DNA, 16 bp, Homo sapiens
tctgcctgaacctggg

SEQ ID NO: 1973482 - DNA, 16 bp, Homo sapiens
tctgcctgcccaggcc

SEQ ID NO: 1973483 - DNA, 22 bp, Homo sapiens
tctgcctgcccaggcccctgcc

SEQ ID NO: 1973484 - DNA, 12 bp, Homo sapiens
tctgcctggcct

SEQ ID NO: 1973485 - DNA, 16 bp, Homo sapiens
tctgcctggcctggct

SEQ ID NO: 1973486 - DNA, 17 bp, Homo sapiens
tctgcctggcctggctc

SEQ ID NO: 1973487 - DNA, 20 bp, Homo sapiens
tctgcctggcctggctcccc

SEQ ID NO: 1973488 - DNA, 10 bp, Homo sapiens
tctgcctggg

SEQ ID NO: 1973489 - DNA, 16 bp, Homo sapiens
tctgcctgggcctgtg

SEQ ID NO: 1973490 - DNA, 17 bp, Homo sapiens
tctgcctgggcctgtgc

SEQ ID NO: 1973491 - DNA, 12 bp, Homo sapiens
tctgcctgtctc

SEQ ID NO: 1973492 - DNA, 18 bp, Homo sapiens
tctgcctttgtttctaaa

SEQ ID NO: 1973493 - DNA, 14 bp, Homo sapiens
tctgcggggcttct

SEQ ID NO: 1973494 - DNA, 17 bp, Homo sapiens
tctgcggggcttctggg

SEQ ID NO: 1973495 - DNA, 14 bp, Homo sapiens
tctgcgtcccccag

SEQ ID NO: 1973496 - DNA, 19 bp, Homo sapiens
tctgcgtcccccagccctc

SEQ ID NO: 1973497 - DNA, 22 bp, Homo sapiens
tctgcgtgactattttttaata

SEQ ID NO: 1973498 - DNA, 15 bp, Homo sapiens
tctgcgttacaacag

SEQ ID NO: 1973499 - DNA, 17 bp, Homo sapiens
tctgctacctcactggg

SEQ ID NO: 1973500 - DNA, 16 bp, Homo sapiens
tctgctcacatatctg

SEQ ID NO: 1973501 - DNA, 16 bp, Homo sapiens
tctgctcagcaggccc

SEQ ID NO: 1973502 - DNA, 18 bp, Homo sapiens
tctgctcagcaggcccta

SEQ ID NO: 1973503 - DNA, 20 bp, Homo sapiens
tctgctcctcccattcccct

SEQ ID NO: 1973504 - DNA, 13 bp, Homo sapiens
tctgctcctctcc

SEQ ID NO: 1973505 - DNA, 14 bp, Homo sapiens
tctgctcctctcca

SEQ ID NO: 1973506 - DNA, 20 bp, Homo sapiens
tctgctcctctccaggcacc

SEQ ID NO: 1973507 - DNA, 12 bp, Homo sapiens
tctgctctagcc

SEQ ID NO: 1973508 - DNA, 16 bp, Homo sapiens
tctgctctagccagga

SEQ ID NO: 1973509 - DNA, 13 bp, Homo sapiens
tctgctgaaggaa

SEQ ID NO: 1973510 - DNA, 19 bp, Homo sapiens
tctgctgacagacacaggc

SEQ ID NO: 1973511 - DNA, 21 bp, Homo sapiens
tctgctgacagacacaggccc

SEQ ID NO: 1973512 - DNA, 22 bp, Homo sapiens
tctgctgacagacacaggcccg

SEQ ID NO: 1973513 - DNA, 22 bp, Homo sapiens
tctgctgccccgcttccccaca

SEQ ID NO: 1973514 - DNA, 18 bp, Homo sapiens
tctgctggcctggatctc

SEQ ID NO: 1973515 - DNA, 15 bp, Homo sapiens
tctgctggcctggcc

SEQ ID NO: 1973516 - DNA, 16 bp, Homo sapiens
tctgctggttttaaca

SEQ ID NO: 1973517 - DNA, 12 bp, Homo sapiens
tctgctgttgcc

SEQ ID NO: 1973518 - DNA, 13 bp, Homo sapiens
tctgctgttgcca

SEQ ID NO: 1973519 - DNA, 19 bp, Homo sapiens
tctgctgttgccatagccc

SEQ ID NO: 1973520 - DNA, 17 bp, Homo sapiens
tctgcttacccttcacc

SEQ ID NO: 1973521 - DNA, 13 bp, Homo sapiens
tctgcttcagcct

SEQ ID NO: 1973522 - DNA, 14 bp, Homo sapiens
tctgcttcagcctc

SEQ ID NO: 1973523 - DNA, 13 bp, Homo sapiens
tctgcttctagta

SEQ ID NO: 1973524 - DNA, 18 bp, Homo sapiens
tctgcttcttcatcttga

SEQ ID NO: 1973525 - DNA, 16 bp, Homo sapiens
tctgcttttgctgggg

SEQ ID NO: 1973526 - DNA, 17 bp, Homo sapiens
tctgcttttgctggggt

SEQ ID NO: 1973527 - DNA, 15 bp, Homo sapiens
tctggaaaactcagg

SEQ ID NO: 1973528 - DNA, 16 bp, Homo sapiens
tctggaaaagcacttt

SEQ ID NO: 1973529 - DNA, 18 bp, Homo sapiens
tctggaaaatgtgaccca

SEQ ID NO: 1973530 - DNA, 9 bp, Homo sapiens
tctggaaat

SEQ ID NO: 1973531 - DNA, 13 bp, Homo sapiens
tctggaaatgtct

SEQ ID NO: 1973532 - DNA, 13 bp, Homo sapiens
tctggaagagagg

SEQ ID NO: 1973533 - DNA, 18 bp, Homo sapiens
tgacaaaataacatttga

SEQ ID NO: 1973534 - DNA, 23 bp, Homo sapiens
tgacaaaatatataatggtttac

SEQ ID NO: 1973535 - DNA, 16 bp, Homo sapiens
tgacaaattgtaacta

SEQ ID NO: 1973536 - DNA, 13 bp, Homo sapiens
tgacaacagaagc

SEQ ID NO: 1973537 - DNA, 15 bp, Homo sapiens
tgacaacatcccaca

SEQ ID NO: 1973538 - DNA, 19 bp, Homo sapiens
tgacaacatcccacagtgg

SEQ ID NO: 1973539 - DNA, 23 bp, Homo sapiens
tgacaacatttctatagccaaaa

SEQ ID NO: 1973540 - DNA, 15 bp, Homo sapiens
tgacaacctttgtgt

SEQ ID NO: 1973541 - DNA, 21 bp, Homo sapiens
tgacaacctttgtgtaataaa

SEQ ID NO: 1973542 - DNA, 16 bp, Homo sapiens
tgacaagataaaggaa

SEQ ID NO: 1973543 - DNA, 23 bp, Homo sapiens
tgacaaggattgctactgtccta

SEQ ID NO: 1973544 - DNA, 21 bp, Homo sapiens
tgacaagggctgacctgcctc

SEQ ID NO: 1973545 - DNA, 17 bp, Homo sapiens
tgacaataatttcaggt

SEQ ID NO: 1973546 - DNA, 17 bp, Homo sapiens
tgacaatagttatgcct

SEQ ID NO: 1973547 - DNA, 16 bp, Homo sapiens
tgacaatcctgaagaa

SEQ ID NO: 1973548 - DNA, 20 bp, Homo sapiens
tgacaatcctgaagaaacca

SEQ ID NO: 1973549 - DNA, 12 bp, Homo sapiens
tgacaatgcaat

SEQ ID NO: 1973550 - DNA, 19 bp, Homo sapiens
tgacaatgcaatgaaacag

SEQ ID NO: 1973551 - DNA, 14 bp, Homo sapiens
tgacaatggcagct

SEQ ID NO: 1973552 - DNA, 12 bp, Homo sapiens
tgacacacagca

SEQ ID NO: 1973553 - DNA, 14 bp, Homo sapiens
tgacacacagcact

SEQ ID NO: 1973554 - DNA, 15 bp, Homo sapiens
tgacacacagcactc

SEQ ID NO: 1973555 - DNA, 14 bp, Homo sapiens
tgacacacagctct

SEQ ID NO: 1973556 - DNA, 19 bp, Homo sapiens
tgacacacagctctgtcct

SEQ ID NO: 1973557 - DNA, 19 bp, Homo sapiens
tgacacacgtatttatatt

SEQ ID NO: 1973558 - DNA, 21 bp, Homo sapiens
tgacacataatttgaatggtg

SEQ ID NO: 1973559 - DNA, 16 bp, Homo sapiens
tgacaccgtccctcag

SEQ ID NO: 1973560 - DNA, 18 bp, Homo sapiens
tgacaccgtccctcagtg

SEQ ID NO: 1973561 - DNA, 21 bp, Homo sapiens
tgacaccgtccctcagtgata

SEQ ID NO: 1973562 - DNA, 18 bp, Homo sapiens
tgacacctaccatgctgc

SEQ ID NO: 1973563 - DNA, 19 bp, Homo sapiens
tgacacctaccatgctgct

SEQ ID NO: 1973564 - DNA, 18 bp, Homo sapiens
tgacacggtaggccaagc

SEQ ID NO: 1973565 - DNA, 19 bp, Homo sapiens
tgacacggtgaaatccagg

SEQ ID NO: 1973566 - DNA, 11 bp, Homo sapiens
tgacactgacc

SEQ ID NO: 1973567 - DNA, 14 bp, Homo sapiens
tgacagaacactgt

SEQ ID NO: 1973568 - DNA, 21 bp, Homo sapiens
tgacagaacactgtcttgaag

SEQ ID NO: 1973569 - DNA, 16 bp, Homo sapiens
tgacagaatcttgtat

SEQ ID NO: 1973570 - DNA, 18 bp, Homo sapiens
tgacagaatgctgtttta

SEQ ID NO: 1973571 - DNA, 13 bp, Homo sapiens
tgacagacacagg

SEQ ID NO: 1973572 - DNA, 16 bp, Homo sapiens
tgacagacacaggccc

SEQ ID NO: 1973573 - DNA, 18 bp, Homo sapiens
tgacagacacaggcccgg

SEQ ID NO: 1973574 - DNA, 20 bp, Homo sapiens
tgacagacacaggcccggct

SEQ ID NO: 1973575 - DNA, 14 bp, Homo sapiens
tgacagactctcgt

SEQ ID NO: 1973576 - DNA, 14 bp, Homo sapiens
tgacagagacccag

SEQ ID NO: 1973577 - DNA, 15 bp, Homo sapiens
tgacagagacccaga

SEQ ID NO: 1973578 - DNA, 17 bp, Homo sapiens
tgacagagacccagatc

SEQ ID NO: 1973579 - DNA, 21 bp, Homo sapiens
tgacagagcaagactctgtct

SEQ ID NO: 1973580 - DNA, 13 bp, Homo sapiens
tgacagaggcagc

SEQ ID NO: 1973581 - DNA, 14 bp, Homo sapiens
tgacagagtgagac

SEQ ID NO: 1973582 - DNA, 22 bp, Homo sapiens
tgacagagtgagactctgtctc

SEQ ID NO: 1973583 - DNA, 15 bp, Homo sapiens
tgacagagttcacta

SEQ ID NO: 1973584 - DNA, 20 bp, Homo sapiens
tgacagatacatagatggac

SEQ ID NO: 1973585 - DNA, 21 bp, Homo sapiens
tgacagatacatagatggacc

SEQ ID NO: 1973586 - DNA, 19 bp, Homo sapiens
tgacagatgtcagccgagc

SEQ ID NO: 1973587 - DNA, 22 bp, Homo sapiens
tgacagatgtcagccgagccgg

SEQ ID NO: 1973588 - DNA, 18 bp, Homo sapiens
tgacagctcttctaagga

SEQ ID NO: 1973589 - DNA, 12 bp, Homo sapiens
tgacagctgtcc

SEQ ID NO: 1973590 - DNA, 16 bp, Homo sapiens
tgacaggaaagccctc

SEQ ID NO: 1973591 - DNA, 21 bp, Homo sapiens
tgacaggaaagccctccccct

SEQ ID NO: 1973592 - DNA, 19 bp, Homo sapiens
tgacaggatgtggcactgc

SEQ ID NO: 1973593 - DNA, 20 bp, Homo sapiens
tgacagggcacaccgggcac

SEQ ID NO: 1973594 - DNA, 15 bp, Homo sapiens
tgacaggtaaactat

SEQ ID NO: 1973595 - DNA, 17 bp, Homo sapiens
tgacaggtaaattaaga

SEQ ID NO: 1973596 - DNA, 16 bp, Homo sapiens
tgacaggttcccagca

SEQ ID NO: 1973597 - DNA, 20 bp, Homo sapiens
tgacagtatatttgaaactg

SEQ ID NO: 1973598 - DNA, 21 bp, Homo sapiens
tgacagtatatttgaaactgt

SEQ ID NO: 1973599 - DNA, 18 bp, Homo sapiens
tgacagtccgtcaaaaca

SEQ ID NO: 1973600 - DNA, 21 bp, Homo sapiens
tgacagtgctctaggctgccc

SEQ ID NO: 1973601 - DNA, 18 bp, Homo sapiens
tgacagtggaactacatt

SEQ ID NO: 1973602 - DNA, 19 bp, Homo sapiens
tgacagtgttgaaaatgtt

SEQ ID NO: 1973603 - DNA, 16 bp, Homo sapiens
tgacataaagttgata

SEQ ID NO: 1973604 - DNA, 17 bp, Homo sapiens
tgacatcacttgtacaa

SEQ ID NO: 1973605 - DNA, 12 bp, Homo sapiens
tgacatctcttt

SEQ ID NO: 1973606 - DNA, 15 bp, Homo sapiens
tgacatcttatttac

SEQ ID NO: 1973607 - DNA, 16 bp, Homo sapiens
tgacatcttcaaagct

SEQ ID NO: 1973608 - DNA, 14 bp, Homo sapiens
tgacatgcactgac

SEQ ID NO: 1973609 - DNA, 15 bp, Homo sapiens
tgacatgcactgacc

SEQ ID NO: 1973610 - DNA, 17 bp, Homo sapiens
tgacatgcactgaccct

SEQ ID NO: 1973611 - DNA, 17 bp, Homo sapiens
tgacatgcatcatctca

SEQ ID NO: 1973612 - DNA, 13 bp, Homo sapiens
tgacatggctttg

SEQ ID NO: 1973613 - DNA, 15 bp, Homo sapiens
tgacatgtgcctgta

SEQ ID NO: 1973614 - DNA, 18 bp, Homo sapiens
tgacatgttatatatttt

SEQ ID NO: 1973615 - DNA, 18 bp, Homo sapiens
tgacatgtttcacaacag

SEQ ID NO: 1973616 - DNA, 22 bp, Homo sapiens
tgacattgtagagcttctggca

SEQ ID NO: 1973617 - DNA, 19 bp, Homo sapiens
tgacattgtatgtatctat

SEQ ID NO: 1973618 - DNA, 21 bp, Homo sapiens
tgacattgttggccaaagcca

SEQ ID NO: 1973619 - DNA, 17 bp, Homo sapiens
tgacatttctaacatat

SEQ ID NO: 1973620 - DNA, 18 bp, Homo sapiens
tgacattttaaaaaacaa

SEQ ID NO: 1973621 - DNA, 18 bp, Homo sapiens
tgaccaacaggctgttct

SEQ ID NO: 1973622 - DNA, 23 bp, Homo sapiens
tgaccaacatggagaaaccctgt

SEQ ID NO: 1973623 - DNA, 17 bp, Homo sapiens
tgaccaagaaaaagaaa

SEQ ID NO: 1973624 - DNA, 15 bp, Homo sapiens
tgaccaagagagaaa

SEQ ID NO: 1973625 - DNA, 17 bp, Homo sapiens
tgaccaagagagaaaga

SEQ ID NO: 1973626 - DNA, 20 bp, Homo sapiens
tgaccaatactactgtaaat

SEQ ID NO: 1973627 - DNA, 17 bp, Homo sapiens
tgaccaatctctgtgac

SEQ ID NO: 1973628 - DNA, 22 bp, Homo sapiens
tgaccacgctttctagctgttg

SEQ ID NO: 1973629 - DNA, 21 bp, Homo sapiens
tgaccacggacgtttccatca

SEQ ID NO: 1973630 - DNA, 22 bp, Homo sapiens
tgaccacggacgtttccatcag

SEQ ID NO: 1973631 - DNA, 22 bp, Homo sapiens
tgaccacgggcctcagtttccc

SEQ ID NO: 1973632 - DNA, 15 bp, Homo sapiens
tgaccactccagaga

SEQ ID NO: 1973633 - DNA, 18 bp, Homo sapiens
tgaccagacctagacctg

SEQ ID NO: 1973634 - DNA, 21 bp, Homo sapiens
tgaccagacctagacctgggc

SEQ ID NO: 1973635 - DNA, 22 bp, Homo sapiens
tgaccaggggtgatttcagaga

SEQ ID NO: 1973636 - DNA, 24 bp, Homo sapiens
tgaccagttctggccaggagctgg

SEQ ID NO: 1973637 - DNA, 19 bp, Homo sapiens
tgaccatcgtccttcctct

SEQ ID NO: 1973638 - DNA, 18 bp, Homo sapiens
tgaccattggctgcgcta

SEQ ID NO: 1973639 - DNA, 19 bp, Homo sapiens
tgacccaaaaatgttccct

SEQ ID NO: 1973640 - DNA, 16 bp, Homo sapiens
tgacccaagaggtggg

SEQ ID NO: 1973641 - DNA, 20 bp, Homo sapiens
tgacccacagcctctgcctg

SEQ ID NO: 1973642 - DNA, 16 bp, Homo sapiens
tgacccactcacactt

SEQ ID NO: 1973643 - DNA, 12 bp, Homo sapiens
tgacccactgct

SEQ ID NO: 1973644 - DNA, 21 bp, Homo sapiens
tgacccagccccttgagaaac

SEQ ID NO: 1973645 - DNA, 23 bp, Homo sapiens
tgacccagccccttgagaaacct

SEQ ID NO: 1973646 - DNA, 15 bp, Homo sapiens
tgacccagtccctgg

SEQ ID NO: 1973647 - DNA, 19 bp, Homo sapiens
tgaccccaaagagcctgga

SEQ ID NO: 1973648 - DNA, 22 bp, Homo sapiens
tgaccccaaagagcctggagaa

SEQ ID NO: 1973649 - DNA, 22 bp, Homo sapiens
tgcagggggtgtgtctgctcag

SEQ ID NO: 1973650 - DNA, 15 bp, Homo sapiens
tgcaggtacttcctc

SEQ ID NO: 1973651 - DNA, 12 bp, Homo sapiens
tgcaggtatttt

SEQ ID NO: 1973652 - DNA, 19 bp, Homo sapiens
tgcaggtattttaactgtg

SEQ ID NO: 1973653 - DNA, 18 bp, Homo sapiens
tgcagtactttacctcct

SEQ ID NO: 1973654 - DNA, 15 bp, Homo sapiens
tgcagtagtctctgt

SEQ ID NO: 1973655 - DNA, 21 bp, Homo sapiens
tgcagtcaacagttcaaagaa

SEQ ID NO: 1973656 - DNA, 16 bp, Homo sapiens
tgcagtccagaataag

SEQ ID NO: 1973657 - DNA, 19 bp, Homo sapiens
tgcagtccagaataagtgc

SEQ ID NO: 1973658 - DNA, 23 bp, Homo sapiens
tgcagtccagaataagtgctgtt

SEQ ID NO: 1973659 - DNA, 14 bp, Homo sapiens
tgcagtccccagtc

SEQ ID NO: 1973660 - DNA, 13 bp, Homo sapiens
tgcagtgaattgt

SEQ ID NO: 1973661 - DNA, 21 bp, Homo sapiens
tgcagtggtgcgatctgggtt

SEQ ID NO: 1973662 - DNA, 23 bp, Homo sapiens
tgcagttaatacttaacattgat

SEQ ID NO: 1973663 - DNA, 16 bp, Homo sapiens
tgcagttgacagcagg

SEQ ID NO: 1973664 - DNA, 14 bp, Homo sapiens
tgcagttttccagg

SEQ ID NO: 1973665 - DNA, 12 bp, Homo sapiens
tgcataagatta

SEQ ID NO: 1973666 - DNA, 21 bp, Homo sapiens
tgcataagattaaaggaagga

SEQ ID NO: 1973667 - DNA, 17 bp, Homo sapiens
tgcatagagccacgtat

SEQ ID NO: 1973668 - DNA, 19 bp, Homo sapiens
tgcatagaggtaccagcaa

SEQ ID NO: 1973669 - DNA, 20 bp, Homo sapiens
tgcatagtaccaatcatttt

SEQ ID NO: 1973670 - DNA, 21 bp, Homo sapiens
tgcatagtaccaatcatttta

SEQ ID NO: 1973671 - DNA, 16 bp, Homo sapiens
tgcatagtgctaagaa

SEQ ID NO: 1973672 - DNA, 13 bp, Homo sapiens
tgcatagtttgtt

SEQ ID NO: 1973673 - DNA, 23 bp, Homo sapiens
tgcatatcggaggtggtggagga

SEQ ID NO: 1973674 - DNA, 16 bp, Homo sapiens
tgcatcacctctgtaa

SEQ ID NO: 1973675 - DNA, 17 bp, Homo sapiens
tgcatcagaaagggagg

SEQ ID NO: 1973676 - DNA, 23 bp, Homo sapiens
tgcatcagaaagggagggctctg

SEQ ID NO: 1973677 - DNA, 13 bp, Homo sapiens
tgcatcagctgct

SEQ ID NO: 1973678 - DNA, 14 bp, Homo sapiens
tgcatcagtattaa

SEQ ID NO: 1973679 - DNA, 19 bp, Homo sapiens
tgcatcatcatagaaaaac

SEQ ID NO: 1973680 - DNA, 16 bp, Homo sapiens
tgcatccattcctcag

SEQ ID NO: 1973681 - DNA, 17 bp, Homo sapiens
tgcatccattcctcagg

SEQ ID NO: 1973682 - DNA, 21 bp, Homo sapiens
tgcatcccccagcactgatgt

SEQ ID NO: 1973683 - DNA, 16 bp, Homo sapiens
tgcatccccttggctg

SEQ ID NO: 1973684 - DNA, 15 bp, Homo sapiens
tgcatccggagaatt

SEQ ID NO: 1973685 - DNA, 19 bp, Homo sapiens
tgcatccgtagttccctga

SEQ ID NO: 1973686 - DNA, 14 bp, Homo sapiens
tgcatctcagccca

SEQ ID NO: 1973687 - DNA, 20 bp, Homo sapiens
tgcatctgggattcccacca

SEQ ID NO: 1973688 - DNA, 23 bp, Homo sapiens
tgcatctgggattcccaccaagg

SEQ ID NO: 1973689 - DNA, 12 bp, Homo sapiens
tgcatgatttta

SEQ ID NO: 1973690 - DNA, 13 bp, Homo sapiens
tgcatgattttat

SEQ ID NO: 1973691 - DNA, 12 bp, Homo sapiens
tgcatgctctgg

SEQ ID NO: 1973692 - DNA, 14 bp, Homo sapiens
tgcatgctctggaa

SEQ ID NO: 1973693 - DNA, 15 bp, Homo sapiens
tgcatggaaacctga

SEQ ID NO: 1973694 - DNA, 19 bp, Homo sapiens
tgcatggaaacctgaaaaa

SEQ ID NO: 1973695 - DNA, 23 bp, Homo sapiens
tgcatggacaccccttatccagg

SEQ ID NO: 1973696 - DNA, 14 bp, Homo sapiens
tgcatgtaaaatgc

SEQ ID NO: 1973697 - DNA, 15 bp, Homo sapiens
tgcatgtaaaatgca

SEQ ID NO: 1973698 - DNA, 16 bp, Homo sapiens
tgcatgtaaaatgcag

SEQ ID NO: 1973699 - DNA, 13 bp, Homo sapiens
tgcatgtgtgtat

SEQ ID NO: 1973700 - DNA, 19 bp, Homo sapiens
tgcatgtgtgtataagtgc

SEQ ID NO: 1973701 - DNA, 23 bp, Homo sapiens
tgcatgtgttgtacaataccaga

SEQ ID NO: 1973702 - DNA, 21 bp, Homo sapiens
tgcatgttgccatgaggcctt

SEQ ID NO: 1973703 - DNA, 22 bp, Homo sapiens
tgcatgttgccatgaggccttt

SEQ ID NO: 1973704 - DNA, 16 bp, Homo sapiens
tgcattccatgatttt

SEQ ID NO: 1973705 - DNA, 17 bp, Homo sapiens
tgcattccatgatttta

SEQ ID NO: 1973706 - DNA, 12 bp, Homo sapiens
tgcattctagta

SEQ ID NO: 1973707 - DNA, 20 bp, Homo sapiens
tgcatttagttttatggcat

SEQ ID NO: 1973708 - DNA, 15 bp, Homo sapiens
tgcatttataaatgt

SEQ ID NO: 1973709 - DNA, 19 bp, Homo sapiens
tgcatttatgagctcttca

SEQ ID NO: 1973710 - DNA, 20 bp, Homo sapiens
tgcatttatgagctcttcat

SEQ ID NO: 1973711 - DNA, 14 bp, Homo sapiens
tgcatttcctgaca

SEQ ID NO: 1973712 - DNA, 24 bp, Homo sapiens
tgcatttctggaccctccacttca

SEQ ID NO: 1973713 - DNA, 18 bp, Homo sapiens
tgcatttgagagaagcca

SEQ ID NO: 1973714 - DNA, 23 bp, Homo sapiens
tgcattttcaagatacatttcat

SEQ ID NO: 1973715 - DNA, 16 bp, Homo sapiens
tgccaaaaaaaaatac

SEQ ID NO: 1973716 - DNA, 19 bp, Homo sapiens
tgccaaattccatgtccct

SEQ ID NO: 1973717 - DNA, 18 bp, Homo sapiens
tgccaaattgtagttctt

SEQ ID NO: 1973718 - DNA, 19 bp, Homo sapiens
tgccaacaccttcttggct

SEQ ID NO: 1973719 - DNA, 20 bp, Homo sapiens
tgccaacctgatgccccttc

SEQ ID NO: 1973720 - DNA, 13 bp, Homo sapiens
tgccaactaagcc

SEQ ID NO: 1973721 - DNA, 16 bp, Homo sapiens
tgccaactggtcactg

SEQ ID NO: 1973722 - DNA, 13 bp, Homo sapiens
tgccaagtttgtt

SEQ ID NO: 1973723 - DNA, 15 bp, Homo sapiens
tgccacaatgcctct

SEQ ID NO: 1973724 - DNA, 21 bp, Homo sapiens
tgccacaatgcctctcccacg

SEQ ID NO: 1973725 - DNA, 23 bp, Homo sapiens
tgccacaatgcctctcccacgat

SEQ ID NO: 1973726 - DNA, 18 bp, Homo sapiens
tgccacacattgtgcttg

SEQ ID NO: 1973727 - DNA, 14 bp, Homo sapiens
tgccacaccctccc

SEQ ID NO: 1973728 - DNA, 16 bp, Homo sapiens
tgccacacttcaggct

SEQ ID NO: 1973729 - DNA, 14 bp, Homo sapiens
tgccacagagaaga

SEQ ID NO: 1973730 - DNA, 11 bp, Homo sapiens
tgccacagccc

SEQ ID NO: 1973731 - DNA, 13 bp, Homo sapiens
tgccacagcccca

SEQ ID NO: 1973732 - DNA, 17 bp, Homo sapiens
tgccacagccccacagc

SEQ ID NO: 1973733 - DNA, 21 bp, Homo sapiens
tgccacagccccacagcaccc

SEQ ID NO: 1973734 - DNA, 22 bp, Homo sapiens
tgccacatctgtgtctctggaa

SEQ ID NO: 1973735 - DNA, 16 bp, Homo sapiens
tgccaccaccagatga

SEQ ID NO: 1973736 - DNA, 17 bp, Homo sapiens
tgccaccactagagctg

SEQ ID NO: 1973737 - DNA, 16 bp, Homo sapiens
tgccaccagtcactgt

SEQ ID NO: 1973738 - DNA, 21 bp, Homo sapiens
tgccacccgtaggcagcctct

SEQ ID NO: 1973739 - DNA, 22 bp, Homo sapiens
tgccacccgtaggcagcctctc

SEQ ID NO: 1973740 - DNA, 19 bp, Homo sapiens
tgccaccctggggagaaag

SEQ ID NO: 1973741 - DNA, 20 bp, Homo sapiens
tgccaccctggggagaaagt

SEQ ID NO: 1973742 - DNA, 18 bp, Homo sapiens
tgccaccgccagaggaca

SEQ ID NO: 1973743 - DNA, 21 bp, Homo sapiens
tgccaccggggaacccagccc

SEQ ID NO: 1973744 - DNA, 16 bp, Homo sapiens
tgccactccctgagct

SEQ ID NO: 1973745 - DNA, 18 bp, Homo sapiens
tgccactcctgcttctct

SEQ ID NO: 1973746 - DNA, 13 bp, Homo sapiens
tgccactgacctc

SEQ ID NO: 1973747 - DNA, 16 bp, Homo sapiens
tgccactgacctcacc

SEQ ID NO: 1973748 - DNA, 13 bp, Homo sapiens
tgccactgccagg

SEQ ID NO: 1973749 - DNA, 21 bp, Homo sapiens
tgccactgccaggcacctggc

SEQ ID NO: 1973750 - DNA, 13 bp, Homo sapiens
tgccactgcctct

SEQ ID NO: 1973751 - DNA, 12 bp, Homo sapiens
tgccacttccca

SEQ ID NO: 1973752 - DNA, 16 bp, Homo sapiens
tgccacttgacattcc

SEQ ID NO: 1973753 - DNA, 17 bp, Homo sapiens
tgccacttgacattcct

SEQ ID NO: 1973754 - DNA, 23 bp, Homo sapiens
tgccactttggcttctcctgtga

SEQ ID NO: 1973755 - DNA, 18 bp, Homo sapiens
tgccagaacagtttgtac

SEQ ID NO: 1973756 - DNA, 20 bp, Homo sapiens
tgccagaacagtttgtacag

SEQ ID NO: 1973757 - DNA, 14 bp, Homo sapiens
tgccagacttaaat

SEQ ID NO: 1973758 - DNA, 23 bp, Homo sapiens
tgccagagcctggggcatcccag

SEQ ID NO: 1973759 - DNA, 23 bp, Homo sapiens
tgccagagctttgttttatatat

SEQ ID NO: 1973760 - DNA, 20 bp, Homo sapiens
tgccagccagaagcctctgc

SEQ ID NO: 1973761 - DNA, 15 bp, Homo sapiens
tgccagccagcagcc

SEQ ID NO: 1973762 - DNA, 17 bp, Homo sapiens
tgccagccagcagccag

SEQ ID NO: 1973763 - DNA, 12 bp, Homo sapiens
tgccagccatca

SEQ ID NO: 1973764 - DNA, 13 bp, Homo sapiens
tgccagccatcac

SEQ ID NO: 1973765 - DNA, 15 bp, Homo sapiens
tgccagccatcacaa

SEQ ID NO: 1973766 - DNA, 19 bp, Homo sapiens
tgggaaggctaagttcagt

SEQ ID NO: 1973767 - DNA, 15 bp, Homo sapiens
tgggaagtgaagccc

SEQ ID NO: 1973768 - DNA, 11 bp, Homo sapiens
tgggacagagg

SEQ ID NO: 1973769 - DNA, 11 bp, Homo sapiens
tgggacagccc

SEQ ID NO: 1973770 - DNA, 13 bp, Homo sapiens
tgggacagcccca

SEQ ID NO: 1973771 - DNA, 17 bp, Homo sapiens
tgggacagccccagggc

SEQ ID NO: 1973772 - DNA, 17 bp, Homo sapiens
tgggacattccaaagaa

SEQ ID NO: 1973773 - DNA, 20 bp, Homo sapiens
tgggaccaacacccctccca

SEQ ID NO: 1973774 - DNA, 18 bp, Homo sapiens
tgggaccagggatggggg

SEQ ID NO: 1973775 - DNA, 23 bp, Homo sapiens
tgggacccagctactctgtccag

SEQ ID NO: 1973776 - DNA, 21 bp, Homo sapiens
tgggacccatagatcttctga

SEQ ID NO: 1973777 - DNA, 21 bp, Homo sapiens
tgggacccctcccaacctcaa

SEQ ID NO: 1973778 - DNA, 15 bp, Homo sapiens
tgggaccgctacacc

SEQ ID NO: 1973779 - DNA, 22 bp, Homo sapiens
tgggaccgctacaccactctgg

SEQ ID NO: 1973780 - DNA, 15 bp, Homo sapiens
tgggactacaggcac

SEQ ID NO: 1973781 - DNA, 16 bp, Homo sapiens
tgggactacaggcacc

SEQ ID NO: 1973782 - DNA, 18 bp, Homo sapiens
tgggactcaatgcactga

SEQ ID NO: 1973783 - DNA, 20 bp, Homo sapiens
tgggactcaatgcactgaca

SEQ ID NO: 1973784 - DNA, 17 bp, Homo sapiens
tgggactgtgcctttgg

SEQ ID NO: 1973785 - DNA, 15 bp, Homo sapiens
tgggagaacctcagg

SEQ ID NO: 1973786 - DNA, 21 bp, Homo sapiens
tgggagaactttgtacagtgg

SEQ ID NO: 1973787 - DNA, 17 bp, Homo sapiens
tgggagacaaggaacca

SEQ ID NO: 1973788 - DNA, 23 bp, Homo sapiens
tgggagacgaacggaagggttgg

SEQ ID NO: 1973789 - DNA, 17 bp, Homo sapiens
tgggagagacactccca

SEQ ID NO: 1973790 - DNA, 14 bp, Homo sapiens
tgggagagccagct

SEQ ID NO: 1973791 - DNA, 16 bp, Homo sapiens
tgggagagccagctct

SEQ ID NO: 1973792 - DNA, 20 bp, Homo sapiens
tgggagcctgcaaactcact

SEQ ID NO: 1973793 - DNA, 13 bp, Homo sapiens
tgggagctgcctg

SEQ ID NO: 1973794 - DNA, 14 bp, Homo sapiens
tgggagctgcctgt

SEQ ID NO: 1973795 - DNA, 22 bp, Homo sapiens
tgggagctgcctgttcagctcc

SEQ ID NO: 1973796 - DNA, 20 bp, Homo sapiens
tgggagctggttagaaatgc

SEQ ID NO: 1973797 - DNA, 16 bp, Homo sapiens
tgggagcttgggaatg

SEQ ID NO: 1973798 - DNA, 18 bp, Homo sapiens
tgggaggcatggccctgg

SEQ ID NO: 1973799 - DNA, 12 bp, Homo sapiens
tgggaggccaag

SEQ ID NO: 1973800 - DNA, 13 bp, Homo sapiens
tgggaggccaagg

SEQ ID NO: 1973801 - DNA, 15 bp, Homo sapiens
tgggaggccaaggca

SEQ ID NO: 1973802 - DNA, 18 bp, Homo sapiens
tgggaggctgaggcagga

SEQ ID NO: 1973803 - DNA, 18 bp, Homo sapiens
tgggagggagcagacagg

SEQ ID NO: 1973804 - DNA, 15 bp, Homo sapiens
tgggagggggctcca

SEQ ID NO: 1973805 - DNA, 16 bp, Homo sapiens
tgggagggggctccat

SEQ ID NO: 1973806 - DNA, 19 bp, Homo sapiens
tgggaggtgagaccacctc

SEQ ID NO: 1973807 - DNA, 20 bp, Homo sapiens
tgggagtcaggacctccggg

SEQ ID NO: 1973808 - DNA, 23 bp, Homo sapiens
tgggagtcaggacctccggggag

SEQ ID NO: 1973809 - DNA, 21 bp, Homo sapiens
tgggataacagaggcaggagt

SEQ ID NO: 1973810 - DNA, 22 bp, Homo sapiens
tgggatctgtaaggaactggaa

SEQ ID NO: 1973811 - DNA, 20 bp, Homo sapiens
tgggattcaggaaaaggcct

SEQ ID NO: 1973812 - DNA, 21 bp, Homo sapiens
tgggattcaggaaaaggcctg

SEQ ID NO: 1973813 - DNA, 20 bp, Homo sapiens
tgggattcccaccaaggtct

SEQ ID NO: 1973814 - DNA, 23 bp, Homo sapiens
tgggattgacagaagcttctgcc

SEQ ID NO: 1973815 - DNA, 10 bp, Homo sapiens
tgggattgct

SEQ ID NO: 1973816 - DNA, 19 bp, Homo sapiens
tgggatttcttcgctgctc

SEQ ID NO: 1973817 - DNA, 14 bp, Homo sapiens
tgggattttaaaaa

SEQ ID NO: 1973818 - DNA, 12 bp, Homo sapiens
tgggcaacagag

SEQ ID NO: 1973819 - DNA, 14 bp, Homo sapiens
tgggcaacagagca

SEQ ID NO: 1973820 - DNA, 20 bp, Homo sapiens
tgggcaacccccagcctgct

SEQ ID NO: 1973821 - DNA, 21 bp, Homo sapiens
tgggcaacccccagcctgcta

SEQ ID NO: 1973822 - DNA, 18 bp, Homo sapiens
tgggcaatgaaaccaaag

SEQ ID NO: 1973823 - DNA, 19 bp, Homo sapiens
tgggcaatgatggcaattt

SEQ ID NO: 1973824 - DNA, 17 bp, Homo sapiens
tgggcacccacctccac

SEQ ID NO: 1973825 - DNA, 19 bp, Homo sapiens
tgggcacccacctccaccc

SEQ ID NO: 1973826 - DNA, 16 bp, Homo sapiens
tgggcacccccagcct

SEQ ID NO: 1973827 - DNA, 18 bp, Homo sapiens
tgggcacccccagcctgg

SEQ ID NO: 1973828 - DNA, 19 bp, Homo sapiens
tgggcacccccagcctggg

SEQ ID NO: 1973829 - DNA, 21 bp, Homo sapiens
tgggcacccccagcctgggcc

SEQ ID NO: 1973830 - DNA, 24 bp, Homo sapiens
tgggcacctctagtgctactgcta

SEQ ID NO: 1973831 - DNA, 13 bp, Homo sapiens
tgggcagaggctg

SEQ ID NO: 1973832 - DNA, 12 bp, Homo sapiens
tgggcagcaccc

SEQ ID NO: 1973833 - DNA, 13 bp, Homo sapiens
tgggcagcaccct

SEQ ID NO: 1973834 - DNA, 14 bp, Homo sapiens
tgggcagcaccctc

SEQ ID NO: 1973835 - DNA, 15 bp, Homo sapiens
tgggcagcaccctcc

SEQ ID NO: 1973836 - DNA, 18 bp, Homo sapiens
tgggcagcaccctccccc

SEQ ID NO: 1973837 - DNA, 18 bp, Homo sapiens
tgggcagcagctcagcct

SEQ ID NO: 1973838 - DNA, 14 bp, Homo sapiens
tgggcagctgtcat

SEQ ID NO: 1973839 - DNA, 21 bp, Homo sapiens
tgggcagctgtcatggaaaag

SEQ ID NO: 1973840 - DNA, 12 bp, Homo sapiens
tgggcagggctg

SEQ ID NO: 1973841 - DNA, 13 bp, Homo sapiens
tgggcagggctgg

SEQ ID NO: 1973842 - DNA, 21 bp, Homo sapiens
tgggcaggtctcctctgggag

SEQ ID NO: 1973843 - DNA, 20 bp, Homo sapiens
tgggcagtcgtaagggttgc

SEQ ID NO: 1973844 - DNA, 11 bp, Homo sapiens
tgggcagtgcc

SEQ ID NO: 1973845 - DNA, 17 bp, Homo sapiens
tgggcagtgcctcctgg

SEQ ID NO: 1973846 - DNA, 20 bp, Homo sapiens
tgcctctgaggccagcctgg

SEQ ID NO: 1973847 - DNA, 22 bp, Homo sapiens
tgcctctgaggccagcctggcc

SEQ ID NO: 1973848 - DNA, 19 bp, Homo sapiens
tgcctctgatatgggactg

SEQ ID NO: 1973849 - DNA, 20 bp, Homo sapiens
tgcctctgatatgggactga

SEQ ID NO: 1973850 - DNA, 15 bp, Homo sapiens
tgcctctgccatgcc

SEQ ID NO: 1973851 - DNA, 13 bp, Homo sapiens
tgcctctgcctct

SEQ ID NO: 1973852 - DNA, 14 bp, Homo sapiens
tgcctctgcctctg

SEQ ID NO: 1973853 - DNA, 17 bp, Homo sapiens
tgcctctgcctctgaca

SEQ ID NO: 1973854 - DNA, 13 bp, Homo sapiens
tgcctctgcctgt

SEQ ID NO: 1973855 - DNA, 14 bp, Homo sapiens
tgcctctgcctgtc

SEQ ID NO: 1973856 - DNA, 13 bp, Homo sapiens
tgcctcttcctcc

SEQ ID NO: 1973857 - DNA, 17 bp, Homo sapiens
tgcctgaagtcacacag

SEQ ID NO: 1973858 - DNA, 21 bp, Homo sapiens
tgcctgaatccatcaggactt

SEQ ID NO: 1973859 - DNA, 20 bp, Homo sapiens
tgcctgagctggggcctgga

SEQ ID NO: 1973860 - DNA, 11 bp, Homo sapiens
tgcctgagggt

SEQ ID NO: 1973861 - DNA, 18 bp, Homo sapiens
tgcctgagggtggagact

SEQ ID NO: 1973862 - DNA, 19 bp, Homo sapiens
tgcctgagtcacccatgaa

SEQ ID NO: 1973863 - DNA, 15 bp, Homo sapiens
tgcctgattttaaaa

SEQ ID NO: 1973864 - DNA, 19 bp, Homo sapiens
tgcctgcacccttcctcct

SEQ ID NO: 1973865 - DNA, 18 bp, Homo sapiens
tgcctgcagagagaagcc

SEQ ID NO: 1973866 - DNA, 22 bp, Homo sapiens
tgcctgcagccccgcgcctcct

SEQ ID NO: 1973867 - DNA, 16 bp, Homo sapiens
tgcctgcagcctcccc

SEQ ID NO: 1973868 - DNA, 17 bp, Homo sapiens
tgcctgcagcctccccc

SEQ ID NO: 1973869 - DNA, 14 bp, Homo sapiens
tgcctgccagggcc

SEQ ID NO: 1973870 - DNA, 13 bp, Homo sapiens
tgcctgcccaggc

SEQ ID NO: 1973871 - DNA, 14 bp, Homo sapiens
tgcctgcccaggcc

SEQ ID NO: 1973872 - DNA, 23 bp, Homo sapiens
tgcctgcccaggcccctgccacc

SEQ ID NO: 1973873 - DNA, 24 bp, Homo sapiens
tgcctgcccaggcccctgccaccc

SEQ ID NO: 1973874 - DNA, 16 bp, Homo sapiens
tgcctgccgcccaaag

SEQ ID NO: 1973875 - DNA, 15 bp, Homo sapiens
tgcctgcctctgcca

SEQ ID NO: 1973876 - DNA, 19 bp, Homo sapiens
tgcctgcctctgccatgcc

SEQ ID NO: 1973877 - DNA, 21 bp, Homo sapiens
tgcctgcctctgccatgccca

SEQ ID NO: 1973878 - DNA, 12 bp, Homo sapiens
tgcctgctagag

SEQ ID NO: 1973879 - DNA, 18 bp, Homo sapiens
tgcctgctagagcaaccc

SEQ ID NO: 1973880 - DNA, 22 bp, Homo sapiens
tgcctgcttggggggtgatgag

SEQ ID NO: 1973881 - DNA, 21 bp, Homo sapiens
tgcctggacatttgccttgct

SEQ ID NO: 1973882 - DNA, 15 bp, Homo sapiens
tgcctggaggacctg

SEQ ID NO: 1973883 - DNA, 16 bp, Homo sapiens
tgcctggaggacctga

SEQ ID NO: 1973884 - DNA, 18 bp, Homo sapiens
tgcctggaggacctgagc

SEQ ID NO: 1973885 - DNA, 19 bp, Homo sapiens
tgcctggaggatccctcca

SEQ ID NO: 1973886 - DNA, 12 bp, Homo sapiens
tgcctggccccc

SEQ ID NO: 1973887 - DNA, 12 bp, Homo sapiens
tgcctggcctgg

SEQ ID NO: 1973888 - DNA, 14 bp, Homo sapiens
tgcctggcctggct

SEQ ID NO: 1973889 - DNA, 12 bp, Homo sapiens
tgcctggctgtg

SEQ ID NO: 1973890 - DNA, 13 bp, Homo sapiens
tgcctggctgtgg

SEQ ID NO: 1973891 - DNA, 12 bp, Homo sapiens
tgcctgggcctg

SEQ ID NO: 1973892 - DNA, 14 bp, Homo sapiens
tgcctgggcctgtg

SEQ ID NO: 1973893 - DNA, 16 bp, Homo sapiens
tgcctgggcttatgcc

SEQ ID NO: 1973894 - DNA, 20 bp, Homo sapiens
tgcctggggattgggaggga

SEQ ID NO: 1973895 - DNA, 23 bp, Homo sapiens
tgcctggggattgggagggacag

SEQ ID NO: 1973896 - DNA, 17 bp, Homo sapiens
tgcctgggtggggctgc

SEQ ID NO: 1973897 - DNA, 15 bp, Homo sapiens
tgcctgggttttcta

SEQ ID NO: 1973898 - DNA, 23 bp, Homo sapiens
tgcctgggttttctaactgtaaa

SEQ ID NO: 1973899 - DNA, 19 bp, Homo sapiens
tgcctggtgcactgtgtct

SEQ ID NO: 1973900 - DNA, 16 bp, Homo sapiens
tgcctggtggcagctg

SEQ ID NO: 1973901 - DNA, 17 bp, Homo sapiens
tgcctggtgggccacgt

SEQ ID NO: 1973902 - DNA, 22 bp, Homo sapiens
tgcctgtagccccagtgacagc

SEQ ID NO: 1973903 - DNA, 13 bp, Homo sapiens
tgcctgtagttag

SEQ ID NO: 1973904 - DNA, 16 bp, Homo sapiens
tgcctgtagttaggaa

SEQ ID NO: 1973905 - DNA, 17 bp, Homo sapiens
tgcctgtagttaggaaa

SEQ ID NO: 1973906 - DNA, 23 bp, Homo sapiens
tgcctgtagttaggaaataaaac

SEQ ID NO: 1973907 - DNA, 15 bp, Homo sapiens
tgcctgtgcatgacc

SEQ ID NO: 1973908 - DNA, 18 bp, Homo sapiens
tgcctgtggcagaaaaga

SEQ ID NO: 1973909 - DNA, 21 bp, Homo sapiens
tgcctgtggccttgcccgcca

SEQ ID NO: 1973910 - DNA, 15 bp, Homo sapiens
tgcctgttcagctcc

SEQ ID NO: 1973911 - DNA, 20 bp, Homo sapiens
tgccttaaaaggagagaaga

SEQ ID NO: 1973912 - DNA, 14 bp, Homo sapiens
tgccttacctcctg

SEQ ID NO: 1973913 - DNA, 14 bp, Homo sapiens
tgccttagaacctt

SEQ ID NO: 1973914 - DNA, 17 bp, Homo sapiens
tgccttagaacctttct

SEQ ID NO: 1973915 - DNA, 16 bp, Homo sapiens
tgccttatcttgaaaa

SEQ ID NO: 1973916 - DNA, 17 bp, Homo sapiens
tgccttcagctctacag

SEQ ID NO: 1973917 - DNA, 18 bp, Homo sapiens
tgccttcagctctacagc

SEQ ID NO: 1973918 - DNA, 17 bp, Homo sapiens
tgccttcctcatcccct

SEQ ID NO: 1973919 - DNA, 21 bp, Homo sapiens
tgccttcctgtttaaaaaaag

SEQ ID NO: 1973920 - DNA, 13 bp, Homo sapiens
tgccttctccctg

SEQ ID NO: 1973921 - DNA, 13 bp, Homo sapiens
tgccttcttcacc

SEQ ID NO: 1973922 - DNA, 18 bp, Homo sapiens
tgccttgacaacagactg

SEQ ID NO: 1973923 - DNA, 17 bp, Homo sapiens
tgcctttagatgtgagc

SEQ ID NO: 1973924 - DNA, 23 bp, Homo sapiens
tgcctttctcgtggtagaagcca

SEQ ID NO: 1973925 - DNA, 11 bp, Homo sapiens
tgcctttctct

SEQ ID NO: 1973926 - DNA, 21 bp, Homo sapiens
tgcctttctctggctccagaa

SEQ ID NO: 1973927 - DNA, 19 bp, Homo sapiens
tgcctttcttatttgcaat

SEQ ID NO: 1973928 - DNA, 21 bp, Homo sapiens
tgcctttgaaattcccccact

SEQ ID NO: 1973929 - DNA, 22 bp, Homo sapiens
tgcctttttatttttgttttta

SEQ ID NO: 1973930 - DNA, 19 bp, Homo sapiens
tgcgaaaacttgaatctgt

SEQ ID NO: 1973931 - DNA, 18 bp, Homo sapiens
tgcgaaggggccctggtc

SEQ ID NO: 1973932 - DNA, 23 bp, Homo sapiens
tgcgaatggggcgatcaagtcca

SEQ ID NO: 1973933 - DNA, 13 bp, Homo sapiens
tgcgaatgtgcag

SEQ ID NO: 1973934 - DNA, 20 bp, Homo sapiens
tgcgagagaggtgggcagca

SEQ ID NO: 1973935 - DNA, 21 bp, Homo sapiens
tgcgagaggtccctgcttacc

SEQ ID NO: 1973936 - DNA, 18 bp, Homo sapiens
tgcgagatcgctggcaga

SEQ ID NO: 1973937 - DNA, 13 bp, Homo sapiens
tgcgagcatttcc

SEQ ID NO: 1973938 - DNA, 21 bp, Homo sapiens
tgcgatctgggttcactgcaa

SEQ ID NO: 1973939 - DNA, 17 bp, Homo sapiens
tgcgatcttcagagcag

SEQ ID NO: 1973940 - DNA, 19 bp, Homo sapiens
tgcgattttgcctgtgtct

SEQ ID NO: 1973941 - DNA, 19 bp, Homo sapiens
tgcgcaacaacaaggaccc

SEQ ID NO: 1973942 - DNA, 14 bp, Homo sapiens
tgcgcctacaggag

SEQ ID NO: 1973943 - DNA, 22 bp, Homo sapiens
tgcgcgcatgtaatcccagcta

SEQ ID NO: 1973944 - DNA, 21 bp, Homo sapiens
tgcgctcattttaggcctcct

SEQ ID NO: 1973945 - DNA, 20 bp, Homo sapiens
tgcgctctagcctgggcaac

SEQ ID NO: 1973946 - DNA, 19 bp, Homo sapiens
tgcgctggtggaccacagg

SEQ ID NO: 1973947 - DNA, 16 bp, Homo sapiens
tgcggaaaggagatgg

SEQ ID NO: 1973948 - DNA, 22 bp, Homo sapiens
tgcggacagccacggccaggcc

SEQ ID NO: 1973949 - DNA, 15 bp, Homo sapiens
tgcggcaggagcagg

SEQ ID NO: 1973950 - DNA, 16 bp, Homo sapiens
tgcggcaggagcagga

SEQ ID NO: 1973951 - DNA, 18 bp, Homo sapiens
tgcggcaggagcaggaac

SEQ ID NO: 1973952 - DNA, 21 bp, Homo sapiens
tgcggcaggagcaggaacaga

SEQ ID NO: 1973953 - DNA, 18 bp, Homo sapiens
tgcggccgcattccctga

SEQ ID NO: 1973954 - DNA, 15 bp, Homo sapiens
tgcggccgggctgcc

SEQ ID NO: 1973955 - DNA, 23 bp, Homo sapiens
tgcggccttccaccgggcctgaa

SEQ ID NO: 1973956 - DNA, 18 bp, Homo sapiens
tgcgggatggtcctgggg

SEQ ID NO: 1973957 - DNA, 17 bp, Homo sapiens
tgcgggcttttccccgg

SEQ ID NO: 1973958 - DNA, 17 bp, Homo sapiens
tgcgggggagctggaaa

SEQ ID NO: 1973959 - DNA, 18 bp, Homo sapiens
tgcgggggagctggaaat

SEQ ID NO: 1973960 - DNA, 16 bp, Homo sapiens
tgcgggtgagagtaat

SEQ ID NO: 1973961 - DNA, 17 bp, Homo sapiens
tgcggtggtgccagagg

SEQ ID NO: 1973962 - DNA, 23 bp, Homo sapiens
tgcgtacgtttcctgagaagtgt

SEQ ID NO: 1973963 - DNA, 16 bp, Homo sapiens
tgcgtatatgtgcgtc

SEQ ID NO: 1973964 - DNA, 23 bp, Homo sapiens
tgcgtatatgtgcgtctctcttt

SEQ ID NO: 1973965 - DNA, 18 bp, Homo sapiens
tgcgtcccccagccctca

SEQ ID NO: 1973966 - DNA, 21 bp, Homo sapiens
tgcgtcccccagccctcaggc

SEQ ID NO: 1973967 - DNA, 13 bp, Homo sapiens
tgcgtccctgtac

SEQ ID NO: 1973968 - DNA, 14 bp, Homo sapiens
tgcgtcctgcagag

SEQ ID NO: 1973969 - DNA, 17 bp, Homo sapiens
tgcgtctctctttctcc

SEQ ID NO: 1973970 - DNA, 13 bp, Homo sapiens
tgcgtggaccccg

SEQ ID NO: 1973971 - DNA, 16 bp, Homo sapiens
tgcgtggactctgcac

SEQ ID NO: 1973972 - DNA, 22 bp, Homo sapiens
tgcgtggactctgcacatgtct

SEQ ID NO: 1973973 - DNA, 14 bp, Homo sapiens
tgcgtggctgtggc

SEQ ID NO: 1973974 - DNA, 15 bp, Homo sapiens
tgcgtggctgtggca

SEQ ID NO: 1973975 - DNA, 12 bp, Homo sapiens
tgcgtgtgtgca

SEQ ID NO: 1973976 - DNA, 20 bp, Homo sapiens
tgcgtgtgtgcatgtatgtg

SEQ ID NO: 1973977 - DNA, 20 bp, Homo sapiens
tgcgtgttagtgtgtgtgca

SEQ ID NO: 1973978 - DNA, 22 bp, Homo sapiens
tgcgtgttagtgtgtgtgcatg

SEQ ID NO: 1973979 - DNA, 13 bp, Homo sapiens
tgcgttggagcca

SEQ ID NO: 1973980 - DNA, 15 bp, Homo sapiens
tgcgttggagccact

SEQ ID NO: 1973981 - DNA, 16 bp, Homo sapiens
tgcgttggagccactc

SEQ ID NO: 1973982 - DNA, 23 bp, Homo sapiens
tgcgttggagccactcctgtccc

SEQ ID NO: 1973983 - DNA, 20 bp, Homo sapiens
tgcgttttagagtatgcaag

SEQ ID NO: 1973984 - DNA, 13 bp, Homo sapiens
tgcgttttggaag

SEQ ID NO: 1973985 - DNA, 16 bp, Homo sapiens
tgctaaagttggaaag

SEQ ID NO: 1973986 - DNA, 17 bp, Homo sapiens
tgctaaagttggaaagt

SEQ ID NO: 1973987 - DNA, 18 bp, Homo sapiens
tgctaaatactgtacata

SEQ ID NO: 1973988 - DNA, 21 bp, Homo sapiens
tgctaaatactgtacatagat

SEQ ID NO: 1973989 - DNA, 12 bp, Homo sapiens
tgctaaatagtt

SEQ ID NO: 1973990 - DNA, 21 bp, Homo sapiens
tgctaaatggtcgcccaggag

SEQ ID NO: 1973991 - DNA, 22 bp, Homo sapiens
tgctaaatggtcgcccaggaga

SEQ ID NO: 1973992 - DNA, 22 bp, Homo sapiens
tgctaagaaatgctgaaaatca

SEQ ID NO: 1973993 - DNA, 22 bp, Homo sapiens
tgctaagaagcgagcactgacc

SEQ ID NO: 1973994 - DNA, 22 bp, Homo sapiens
tgctaagagaagtagaaatcat

SEQ ID NO: 1973995 - DNA, 16 bp, Homo sapiens
tgctacaaaaacacag

SEQ ID NO: 1973996 - DNA, 20 bp, Homo sapiens
tgctacaagaatgcaaaaaa

SEQ ID NO: 1973997 - DNA, 13 bp, Homo sapiens
tgctacaataaat

SEQ ID NO: 1973998 - DNA, 16 bp, Homo sapiens
tgctacaataaatgct

SEQ ID NO: 1973999 - DNA, 19 bp, Homo sapiens
tgctacaataaatgctgaa

SEQ ID NO: 1974000 - DNA, 14 bp, Homo sapiens
tgctacacagtata

SEQ ID NO: 1974001 - DNA, 21 bp, Homo sapiens
tgctacaccttagcagctctt

SEQ ID NO: 1974002 - DNA, 18 bp, Homo sapiens
tgctacagtactatgtaa

SEQ ID NO: 1974003 - DNA, 20 bp, Homo sapiens
tgctacagtactatgtaaat

SEQ ID NO: 1974004 - DNA, 18 bp, Homo sapiens
tgctaccaaggcccagct

SEQ ID NO: 1974005 - DNA, 22 bp, Homo sapiens
tgctacctcactggggtcctgg

SEQ ID NO: 1974006 - DNA, 14 bp, Homo sapiens
tgctactacaaaaa

SEQ ID NO: 1974007 - DNA, 21 bp, Homo sapiens
tgctactacccgagcccagct

SEQ ID NO: 1974008 - DNA, 12 bp, Homo sapiens
tgctactcctgt

SEQ ID NO: 1974009 - DNA, 17 bp, Homo sapiens
tgctactcctgtgctct

SEQ ID NO: 1974010 - DNA, 14 bp, Homo sapiens
tgctagagcaaccc

SEQ ID NO: 1974011 - DNA, 20 bp, Homo sapiens
tgctagatgtgcaaatgcaa

SEQ ID NO: 1974012 - DNA, 18 bp, Homo sapiens
tgctagcacttggagcca

SEQ ID NO: 1974013 - DNA, 20 bp, Homo sapiens
tgctagcacttggagccaag

SEQ ID NO: 1974014 - DNA, 18 bp, Homo sapiens
tgctaggcgagtgccagg

SEQ ID NO: 1974015 - DNA, 12 bp, Homo sapiens
tgctatatatat

SEQ ID NO: 1974016 - DNA, 15 bp, Homo sapiens
tgctatatatataaa

SEQ ID NO: 1974017 - DNA, 16 bp, Homo sapiens
tgctatattttcatga

SEQ ID NO: 1974018 - DNA, 22 bp, Homo sapiens
tgctatattttcatgacttttc

SEQ ID NO: 1974019 - DNA, 20 bp, Homo sapiens
tgctatcaaaataaattgaa

SEQ ID NO: 1974020 - DNA, 14 bp, Homo sapiens
tgctatggttttct

SEQ ID NO: 1974021 - DNA, 15 bp, Homo sapiens
tgctatgttagaagt

SEQ ID NO: 1974022 - DNA, 17 bp, Homo sapiens
tgctattaaattaatat

SEQ ID NO: 1974023 - DNA, 17 bp, Homo sapiens
tgctattatgtaacatc

SEQ ID NO: 1974024 - DNA, 21 bp, Homo sapiens
tgctattatgtaacatccaga

SEQ ID NO: 1974025 - DNA, 14 bp, Homo sapiens
tgctattctgtgtt

SEQ ID NO: 1974026 - DNA, 14 bp, Homo sapiens
tgctattgaactga

SEQ ID NO: 1974027 - DNA, 16 bp, Homo sapiens
tgctattgaactgagc

SEQ ID NO: 1974028 - DNA, 18 bp, Homo sapiens
tgctatttctggcctcag

SEQ ID NO: 1974029 - DNA, 21 bp, Homo sapiens
tgctatttctggcctcagcag

SEQ ID NO: 1974030 - DNA, 13 bp, Homo sapiens
tgctcaacctctc

SEQ ID NO: 1974031 - DNA, 13 bp, Homo sapiens
tgctcacagtctc

SEQ ID NO: 1974032 - DNA, 19 bp, Homo sapiens
tgctcaccaagctgttcca

SEQ ID NO: 1974033 - DNA, 15 bp, Homo sapiens
tgctcacgactcttc

SEQ ID NO: 1974034 - DNA, 18 bp, Homo sapiens
tgctcacgactcttcctg

SEQ ID NO: 1974035 - DNA, 13 bp, Homo sapiens
tgctcagccctga

SEQ ID NO: 1974036 - DNA, 17 bp, Homo sapiens
tgctcagccctgactgg

SEQ ID NO: 1974037 - DNA, 15 bp, Homo sapiens
tgctcagtgcctcct

SEQ ID NO: 1974038 - DNA, 18 bp, Homo sapiens
tgctcataacatctttga

SEQ ID NO: 1974039 - DNA, 22 bp, Homo sapiens
tgctcatcattccttgagaaaa

SEQ ID NO: 1974040 - DNA, 18 bp, Homo sapiens
tgctcattccttctggag

SEQ ID NO: 1974041 - DNA, 14 bp, Homo sapiens
tgctccagggtctt

SEQ ID NO: 1974042 - DNA, 18 bp, Homo sapiens
tgctccagggtcttgggc

SEQ ID NO: 1974043 - DNA, 17 bp, Homo sapiens
tgctcccagcagcccta

SEQ ID NO: 1974044 - DNA, 13 bp, Homo sapiens
tgctccccacacg

SEQ ID NO: 1974045 - DNA, 17 bp, Homo sapiens
tgctccccagccctggc

SEQ ID NO: 1974046 - DNA, 22 bp, Homo sapiens
tgctccccagccctggctctgc

SEQ ID NO: 1974047 - DNA, 23 bp, Homo sapiens
tgctccccagccctggctctgca

SEQ ID NO: 1974048 - DNA, 17 bp, Homo sapiens
tgctccccttcctgcca

SEQ ID NO: 1974049 - DNA, 20 bp, Homo sapiens
tgctcctagtttgacctcac

SEQ ID NO: 1974050 - DNA, 11 bp, Homo sapiens
tgctcctccag

SEQ ID NO: 1974051 - DNA, 13 bp, Homo sapiens
tgctcctccaggg

SEQ ID NO: 1974052 - DNA, 22 bp, Homo sapiens
tgctcctccagggccacgtgcc

SEQ ID NO: 1974053 - DNA, 15 bp, Homo sapiens
tgctcctctccaggc

SEQ ID NO: 1974054 - DNA, 14 bp, Homo sapiens
tgctcctctcccca

SEQ ID NO: 1974055 - DNA, 17 bp, Homo sapiens
tgctcctctccccagca

SEQ ID NO: 1974056 - DNA, 18 bp, Homo sapiens
tgctcgcttctcctccag

SEQ ID NO: 1974057 - DNA, 15 bp, Homo sapiens
tgctcggggtgcaca

SEQ ID NO: 1974058 - DNA, 16 bp, Homo sapiens
tgctcggggtgcacag

SEQ ID NO: 1974059 - DNA, 22 bp, Homo sapiens
tgctcggggtgcacaggagggg

SEQ ID NO: 1974060 - DNA, 13 bp, Homo sapiens
tgctctagccagg

SEQ ID NO: 1974061 - DNA, 14 bp, Homo sapiens
tgctctagccagga

SEQ ID NO: 1974062 - DNA, 16 bp, Homo sapiens
tgctctagccaggagt

SEQ ID NO: 1974063 - DNA, 23 bp, Homo sapiens
tgctctagccaggagtctgtgct

SEQ ID NO: 1974064 - DNA, 13 bp, Homo sapiens
tgctctagctggc

SEQ ID NO: 1974065 - DNA, 16 bp, Homo sapiens
tgctctagctggcagg

SEQ ID NO: 1974066 - DNA, 17 bp, Homo sapiens
tgctctagctggcagga

SEQ ID NO: 1974067 - DNA, 18 bp, Homo sapiens
tgctctagctggcaggac

SEQ ID NO: 1974068 - DNA, 19 bp, Homo sapiens
tgctctagctggcaggaca

SEQ ID NO: 1974069 - DNA, 21 bp, Homo sapiens
tgctctaggctgccccgggtc

SEQ ID NO: 1974070 - DNA, 18 bp, Homo sapiens
tgctctagtcttgctttg

SEQ ID NO: 1974071 - DNA, 21 bp, Homo sapiens
tgctctattgtagcatttctt

SEQ ID NO: 1974072 - DNA, 22 bp, Homo sapiens
tgctctcaccagctgctgctct

SEQ ID NO: 1974073 - DNA, 14 bp, Homo sapiens
tgctctcagcctcc

SEQ ID NO: 1974074 - DNA, 19 bp, Homo sapiens
tgctctcatgcctgcctga

SEQ ID NO: 1974075 - DNA, 12 bp, Homo sapiens
tgctctcccctg

SEQ ID NO: 1974076 - DNA, 23 bp, Homo sapiens
tgctctccgaccagacaccttga

SEQ ID NO: 1974077 - DNA, 18 bp, Homo sapiens
tgctctcctcttgccact

SEQ ID NO: 1974078 - DNA, 12 bp, Homo sapiens
tgctctcctttc

SEQ ID NO: 1974079 - DNA, 15 bp, Homo sapiens
tgctctctgcagcca

SEQ ID NO: 1974080 - DNA, 14 bp, Homo sapiens
tgctctcttcagga

SEQ ID NO: 1974081 - DNA, 15 bp, Homo sapiens
tgctctcttcaggag

SEQ ID NO: 1974082 - DNA, 18 bp, Homo sapiens
tgctctgaggcttccaga

SEQ ID NO: 1974083 - DNA, 22 bp, Homo sapiens
tgctctgatcatccactgtgcc

SEQ ID NO: 1974084 - DNA, 17 bp, Homo sapiens
tgctctgatgcatcaga

SEQ ID NO: 1974085 - DNA, 19 bp, Homo sapiens
tgctctgcaggcaccttag

SEQ ID NO: 1974086 - DNA, 12 bp, Homo sapiens
tgctctgcccct

SEQ ID NO: 1974087 - DNA, 14 bp, Homo sapiens
tgctctgccccttg

SEQ ID NO: 1974088 - DNA, 15 bp, Homo sapiens
tgctctgctgacaga

SEQ ID NO: 1974089 - DNA, 21 bp, Homo sapiens
tgctctgctgacagacacagg

SEQ ID NO: 1974090 - DNA, 13 bp, Homo sapiens
tgctctggcggct

SEQ ID NO: 1974091 - DNA, 16 bp, Homo sapiens
tgctctggcggcttcc

SEQ ID NO: 1974092 - DNA, 18 bp, Homo sapiens
tgctctggcggcttcctg

SEQ ID NO: 1974093 - DNA, 21 bp, Homo sapiens
tgctcttagtgcccgcctagg

SEQ ID NO: 1974094 - DNA, 17 bp, Homo sapiens
tgctcttctttctgaga

SEQ ID NO: 1974095 - DNA, 13 bp, Homo sapiens
tgctcttgcctgc

SEQ ID NO: 1974096 - DNA, 21 bp, Homo sapiens
tgctcttgcctgcacccttcc

SEQ ID NO: 1974097 - DNA, 17 bp, Homo sapiens
tgctcttggaaagctga

SEQ ID NO: 1974098 - DNA, 22 bp, Homo sapiens
tgctgaagggaccttgaagggt

SEQ ID NO: 1974099 - DNA, 14 bp, Homo sapiens
tgctgaattatttt

SEQ ID NO: 1974100 - DNA, 14 bp, Homo sapiens
tgctgaatttcagg

SEQ ID NO: 1974101 - DNA, 23 bp, Homo sapiens
tgctgacagacacaggcccggct

SEQ ID NO: 1974102 - DNA, 15 bp, Homo sapiens
tgctgacagctgacc

SEQ ID NO: 1974103 - DNA, 16 bp, Homo sapiens
tgctgacaggatgtgg

SEQ ID NO: 1974104 - DNA, 18 bp, Homo sapiens
tgctgacaggatgtggca

SEQ ID NO: 1974105 - DNA, 23 bp, Homo sapiens
tgctgacaggatgtggcactgct

SEQ ID NO: 1974106 - DNA, 22 bp, Homo sapiens
tgctgactccatatggaggcct

SEQ ID NO: 1974107 - DNA, 14 bp, Homo sapiens
tgctgactgtactc

SEQ ID NO: 1974108 - DNA, 22 bp, Homo sapiens
tgctgactgtactcctcccagg

SEQ ID NO: 1974109 - DNA, 21 bp, Homo sapiens
tgctgagaacctggccttcag

SEQ ID NO: 1974110 - DNA, 15 bp, Homo sapiens
tgctgagaatagtgt

SEQ ID NO: 1974111 - DNA, 15 bp, Homo sapiens
tgctgagcaccctct

SEQ ID NO: 1974112 - DNA, 17 bp, Homo sapiens
tgctgagctctgagagg

SEQ ID NO: 1974113 - DNA, 21 bp, Homo sapiens
tgctgagctctgagaggccct

SEQ ID NO: 1974114 - DNA, 23 bp, Homo sapiens
tgctgagctctgagaggccctgg

SEQ ID NO: 1974115 - DNA, 10 bp, Homo sapiens
tgctgagctt

SEQ ID NO: 1974116 - DNA, 15 bp, Homo sapiens
tgctgagcttagcct

SEQ ID NO: 1974117 - DNA, 16 bp, Homo sapiens
tgctgagcttagcctt

SEQ ID NO: 1974118 - DNA, 17 bp, Homo sapiens
tgctgagcttagccttg

SEQ ID NO: 1974119 - DNA, 24 bp, Homo sapiens
tgctgagcttagccttgtgccctg

SEQ ID NO: 1974120 - DNA, 15 bp, Homo sapiens
tgctgaggactccct

SEQ ID NO: 1974121 - DNA, 17 bp, Homo sapiens
tgctgaggtaataatta

SEQ ID NO: 1974122 - DNA, 15 bp, Homo sapiens
tgctgagttggtgtt

SEQ ID NO: 1974123 - DNA, 19 bp, Homo sapiens
tgctgatactatctcttgt

SEQ ID NO: 1974124 - DNA, 15 bp, Homo sapiens
tgctgcaaagtgcaa

SEQ ID NO: 1974125 - DNA, 21 bp, Homo sapiens
tgctgcaaagtgcaaatactc

SEQ ID NO: 1974126 - DNA, 19 bp, Homo sapiens
tgctgccacacttcaggct

SEQ ID NO: 1974127 - DNA, 22 bp, Homo sapiens
tgctgccacacttcaggctctt

SEQ ID NO: 1974128 - DNA, 16 bp, Homo sapiens
tgctgccatgccactg

SEQ ID NO: 1974129 - DNA, 18 bp, Homo sapiens
tgctgccatgccactgcc

SEQ ID NO: 1974130 - DNA, 16 bp, Homo sapiens
tgctgcccagcctcca

SEQ ID NO: 1974131 - DNA, 21 bp, Homo sapiens
tgctgccccgcttccccacag

SEQ ID NO: 1974132 - DNA, 23 bp, Homo sapiens
tgctgccccgcttccccacagaa

SEQ ID NO: 1974133 - DNA, 19 bp, Homo sapiens
tgctgccccgttccctgtc

SEQ ID NO: 1974134 - DNA, 20 bp, Homo sapiens
tgctgccccgttccctgtca

SEQ ID NO: 1974135 - DNA, 16 bp, Homo sapiens
tgctgccgcctcccag

SEQ ID NO: 1974136 - DNA, 19 bp, Homo sapiens
tgctgccgcctcccagcct

SEQ ID NO: 1974137 - DNA, 13 bp, Homo sapiens
tgctgcctaataa

SEQ ID NO: 1974138 - DNA, 17 bp, Homo sapiens
tgctgctcccatctgca

SEQ ID NO: 1974139 - DNA, 17 bp, Homo sapiens
tgctgctctctgaggga

SEQ ID NO: 1974140 - DNA, 11 bp, Homo sapiens
tgctgctgaga

SEQ ID NO: 1974141 - DNA, 20 bp, Homo sapiens
tgctgctgagaacctggcct

SEQ ID NO: 1974142 - DNA, 9 bp, Homo sapiens
tgctgctgt

SEQ ID NO: 1974143 - DNA, 14 bp, Homo sapiens
tgctgcttctcttg

SEQ ID NO: 1974144 - DNA, 18 bp, Homo sapiens
tgctgctttttggcacag

SEQ ID NO: 1974145 - DNA, 19 bp, Homo sapiens
tgctggacggcattcctgc

SEQ ID NO: 1974146 - DNA, 14 bp, Homo sapiens
tgctggactgagga

SEQ ID NO: 1974147 - DNA, 15 bp, Homo sapiens
tgctggactgaggac

SEQ ID NO: 1974148 - DNA, 19 bp, Homo sapiens
tgctggactgtcatagaaa

SEQ ID NO: 1974149 - DNA, 16 bp, Homo sapiens
tgctggagctggcttt

SEQ ID NO: 1974150 - DNA, 17 bp, Homo sapiens
tgctggataaaatgagg

SEQ ID NO: 1974151 - DNA, 17 bp, Homo sapiens
tgctggcacctcagaca

SEQ ID NO: 1974152 - DNA, 14 bp, Homo sapiens
tgctggccagcacc

SEQ ID NO: 1974153 - DNA, 15 bp, Homo sapiens
tgctggcctgtggca

SEQ ID NO: 1974154 - DNA, 17 bp, Homo sapiens
tgctggcggcgcagagg

SEQ ID NO: 1974155 - DNA, 19 bp, Homo sapiens
tgctggctgttggctgggg

SEQ ID NO: 1974156 - DNA, 19 bp, Homo sapiens
tgctgggaaccccgcagcc

SEQ ID NO: 1974157 - DNA, 21 bp, Homo sapiens
tgctgggaaccccgcagcccg

SEQ ID NO: 1974158 - DNA, 15 bp, Homo sapiens
tgctgggactggcca

SEQ ID NO: 1974159 - DNA, 19 bp, Homo sapiens
tgctgggattacaagcgtg

SEQ ID NO: 1974160 - DNA, 20 bp, Homo sapiens
tgctgggattacaggtgtga

SEQ ID NO: 1974161 - DNA, 15 bp, Homo sapiens
tgctgggctctccac

SEQ ID NO: 1974162 - DNA, 22 bp, Homo sapiens
tgctgggctctccacctcagcc

SEQ ID NO: 1974163 - DNA, 23 bp, Homo sapiens
tgctgggctctccacctcagcct

SEQ ID NO: 1974164 - DNA, 17 bp, Homo sapiens
tgctggggagtccctgc

SEQ ID NO: 1974165 - DNA, 18 bp, Homo sapiens
tgctggggcatgtgtgcc

SEQ ID NO: 1974166 - DNA, 21 bp, Homo sapiens
tgctggggcatgtgtgcctgt

SEQ ID NO: 1974167 - DNA, 16 bp, Homo sapiens
tgctgggtaaactgtg

SEQ ID NO: 1974168 - DNA, 18 bp, Homo sapiens
tgctggtaccactggaat

SEQ ID NO: 1974169 - DNA, 16 bp, Homo sapiens
tgctggttttaacaac

SEQ ID NO: 1974170 - DNA, 14 bp, Homo sapiens
tgctggttttccta

SEQ ID NO: 1974171 - DNA, 15 bp, Homo sapiens
tgctggttttcctaa

SEQ ID NO: 1974172 - DNA, 21 bp, Homo sapiens
tgctgtaactcagacattcca

SEQ ID NO: 1974173 - DNA, 22 bp, Homo sapiens
tgctgtaactcagacattccaa

SEQ ID NO: 1974174 - DNA, 16 bp, Homo sapiens
tgctgtaactgctgag

SEQ ID NO: 1974175 - DNA, 19 bp, Homo sapiens
tgctgtaactgctgagcca

SEQ ID NO: 1974176 - DNA, 20 bp, Homo sapiens
tgctgtacccttccacctcc

SEQ ID NO: 1974177 - DNA, 21 bp, Homo sapiens
tgctgtacccttccacctcct

SEQ ID NO: 1974178 - DNA, 17 bp, Homo sapiens
tgctgtcattgtccatg

SEQ ID NO: 1974179 - DNA, 20 bp, Homo sapiens
tgctgtcattgtccatgcct

SEQ ID NO: 1974180 - DNA, 21 bp, Homo sapiens
tgctgtcattgtccatgccta

SEQ ID NO: 1974181 - DNA, 18 bp, Homo sapiens
tgctgtgctctttgaaga

SEQ ID NO: 1974182 - DNA, 12 bp, Homo sapiens
tgctgtggccag

SEQ ID NO: 1974183 - DNA, 14 bp, Homo sapiens
tgctgtggcctggg

SEQ ID NO: 1974184 - DNA, 16 bp, Homo sapiens
tgctgtggcctgggca

SEQ ID NO: 1974185 - DNA, 21 bp, Homo sapiens
tgctgtgggcagcaccctccc

SEQ ID NO: 1974186 - DNA, 15 bp, Homo sapiens
tgctgtgtctgcacc

SEQ ID NO: 1974187 - DNA, 13 bp, Homo sapiens
tgctgtgtttatg

SEQ ID NO: 1974188 - DNA, 15 bp, Homo sapiens
tgctgttctggagct

SEQ ID NO: 1974189 - DNA, 17 bp, Homo sapiens
tgctgttgccatagccc

SEQ ID NO: 1974190 - DNA, 18 bp, Homo sapiens
tgctgttgttccttcaca

SEQ ID NO: 1974191 - DNA, 12 bp, Homo sapiens
tgctgtttcctt

SEQ ID NO: 1974192 - DNA, 14 bp, Homo sapiens
tgctgtttcctttt

SEQ ID NO: 1974193 - DNA, 13 bp, Homo sapiens
tgctgtttgagat

SEQ ID NO: 1974194 - DNA, 17 bp, Homo sapiens
tgctgtttgagatgtga

SEQ ID NO: 1974195 - DNA, 20 bp, Homo sapiens
tgctgttttcatctctgcca

SEQ ID NO: 1974196 - DNA, 13 bp, Homo sapiens
tgcttaaaatatg

SEQ ID NO: 1974197 - DNA, 12 bp, Homo sapiens
tgcttaaatatt

SEQ ID NO: 1974198 - DNA, 13 bp, Homo sapiens
tgcttaactggct

SEQ ID NO: 1974199 - DNA, 14 bp, Homo sapiens
tgcttaactggctg

SEQ ID NO: 1974200 - DNA, 13 bp, Homo sapiens
tgcttacagtgac

SEQ ID NO: 1974201 - DNA, 15 bp, Homo sapiens
tgcttacatttttac

SEQ ID NO: 1974202 - DNA, 17 bp, Homo sapiens
tgcttacatttttacaa

SEQ ID NO: 1974203 - DNA, 20 bp, Homo sapiens
tgcttacatttttacaataa

SEQ ID NO: 1974204 - DNA, 17 bp, Homo sapiens
tgcttacccttcacctt

SEQ ID NO: 1974205 - DNA, 18 bp, Homo sapiens
tgcttactaatgtgcccc

SEQ ID NO: 1974206 - DNA, 13 bp, Homo sapiens
tgcttagaaagtt

SEQ ID NO: 1974207 - DNA, 18 bp, Homo sapiens
tgcttagcctcctgacct

SEQ ID NO: 1974208 - DNA, 21 bp, Homo sapiens
tgcttagtatggttctcagat

SEQ ID NO: 1974209 - DNA, 21 bp, Homo sapiens
tgcttagtcacttatttcata

SEQ ID NO: 1974210 - DNA, 23 bp, Homo sapiens
tgcttagtcacttatttcataaa

SEQ ID NO: 1974211 - DNA, 13 bp, Homo sapiens
tgcttattgtact

SEQ ID NO: 1974212 - DNA, 17 bp, Homo sapiens
tgcttattttaaaattt

SEQ ID NO: 1974213 - DNA, 17 bp, Homo sapiens
tgcttcaaatccatcca

SEQ ID NO: 1974214 - DNA, 19 bp, Homo sapiens
tgcttcaaatccatccaga

SEQ ID NO: 1974215 - DNA, 16 bp, Homo sapiens
tgcttcaagtgttgct

SEQ ID NO: 1974216 - DNA, 19 bp, Homo sapiens
tgcttcaagtgttgctctt

SEQ ID NO: 1974217 - DNA, 15 bp, Homo sapiens
tgcttcaattaataa

SEQ ID NO: 1974218 - DNA, 23 bp, Homo sapiens
tgcttcaattaataaaaaatgga

SEQ ID NO: 1974219 - DNA, 12 bp, Homo sapiens
tgcttcacataa

SEQ ID NO: 1974220 - DNA, 12 bp, Homo sapiens
tgcttcagcctg

SEQ ID NO: 1974221 - DNA, 14 bp, Homo sapiens
tgcttcagcctgag

SEQ ID NO: 1974222 - DNA, 23 bp, Homo sapiens
tgcttcagcctgaggctgagact

SEQ ID NO: 1974223 - DNA, 17 bp, Homo sapiens
tgcttccttctgcaccc

SEQ ID NO: 1974224 - DNA, 19 bp, Homo sapiens
tgcttccttctgcacccag

SEQ ID NO: 1974225 - DNA, 18 bp, Homo sapiens
tgcttctaaatgcccagt

SEQ ID NO: 1974226 - DNA, 22 bp, Homo sapiens
tgcttctaggagtcaactggct

SEQ ID NO: 1974227 - DNA, 21 bp, Homo sapiens
tgcttctcagccccgggcctg

SEQ ID NO: 1974228 - DNA, 17 bp, Homo sapiens
tgcttctccaacactga

SEQ ID NO: 1974229 - DNA, 16 bp, Homo sapiens
tgcttctccctggctg

SEQ ID NO: 1974230 - DNA, 14 bp, Homo sapiens
tgcttctctacaga

SEQ ID NO: 1974231 - DNA, 22 bp, Homo sapiens
tgcttctcttgggaactccact

SEQ ID NO: 1974232 - DNA, 13 bp, Homo sapiens
tgcttctctttgt

SEQ ID NO: 1974233 - DNA, 19 bp, Homo sapiens
tgcttctgaactcaagctg

SEQ ID NO: 1974234 - DNA, 20 bp, Homo sapiens
tgcttctgaactcaagctgc

SEQ ID NO: 1974235 - DNA, 18 bp, Homo sapiens
tgcttctgcagcaactcc

SEQ ID NO: 1974236 - DNA, 19 bp, Homo sapiens
tgcttctgcagcaactccc

SEQ ID NO: 1974237 - DNA, 20 bp, Homo sapiens
tgcttctgcagcaactccca

SEQ ID NO: 1974238 - DNA, 20 bp, Homo sapiens
tgcttctggctcctccttcc

SEQ ID NO: 1974239 - DNA, 23 bp, Homo sapiens
tgcttctgttgtaatagtccatg

SEQ ID NO: 1974240 - DNA, 21 bp, Homo sapiens
tgcttcttcaagcacctgcag

SEQ ID NO: 1974241 - DNA, 14 bp, Homo sapiens
tgcttcttgcccct

SEQ ID NO: 1974242 - DNA, 19 bp, Homo sapiens
tgcttcttgccccttgggc

SEQ ID NO: 1974243 - DNA, 17 bp, Homo sapiens
tgcttgaacccaggaga

SEQ ID NO: 1974244 - DNA, 13 bp, Homo sapiens
tgcttgaaggaac

SEQ ID NO: 1974245 - DNA, 20 bp, Homo sapiens
tgcttgaaggaacagtgctg

SEQ ID NO: 1974246 - DNA, 13 bp, Homo sapiens
tgcttgagcccag

SEQ ID NO: 1974247 - DNA, 22 bp, Homo sapiens
tgcttgaggaggggcacctgcc

SEQ ID NO: 1974248 - DNA, 14 bp, Homo sapiens
tgcttgccgagcct

SEQ ID NO: 1974249 - DNA, 19 bp, Homo sapiens
tgcttgcctgcgttttgga

SEQ ID NO: 1974250 - DNA, 20 bp, Homo sapiens
tgcttggggggtgatgaggg

SEQ ID NO: 1974251 - DNA, 21 bp, Homo sapiens
tgcttggggggtgatgagggc

SEQ ID NO: 1974252 - DNA, 20 bp, Homo sapiens
tgcttgttaatgctttctga

SEQ ID NO: 1974253 - DNA, 12 bp, Homo sapiens
tgcttgttgtca

SEQ ID NO: 1974254 - DNA, 17 bp, Homo sapiens
tgcttgttgtcaagtat

SEQ ID NO: 1974255 - DNA, 17 bp, Homo sapiens
tgctttaaagtgtaata

SEQ ID NO: 1974256 - DNA, 23 bp, Homo sapiens
tgctttaaagtgtaataatatga

SEQ ID NO: 1974257 - DNA, 21 bp, Homo sapiens
tgctttaatatagctatcatt

SEQ ID NO: 1974258 - DNA, 23 bp, Homo sapiens
tgctttaatatagctatcatttc

SEQ ID NO: 1974259 - DNA, 15 bp, Homo sapiens
tgctttcaacttaaa

SEQ ID NO: 1974260 - DNA, 20 bp, Homo sapiens
tgctttcaacttaaatcact

SEQ ID NO: 1974261 - DNA, 22 bp, Homo sapiens
tgctttcaacttaaatcactga

SEQ ID NO: 1974262 - DNA, 19 bp, Homo sapiens
tgctttcccaccagcatgt

SEQ ID NO: 1974263 - DNA, 20 bp, Homo sapiens
tgctttccccgggggaggaa

SEQ ID NO: 1974264 - DNA, 15 bp, Homo sapiens
tgctttctgaagctt

SEQ ID NO: 1974265 - DNA, 14 bp, Homo sapiens
tgctttgaagcagt

SEQ ID NO: 1974266 - DNA, 19 bp, Homo sapiens
tgctttgaagcagttgtgt

SEQ ID NO: 1974267 - DNA, 22 bp, Homo sapiens
tgctttgaagcagttgtgtcag

SEQ ID NO: 1974268 - DNA, 17 bp, Homo sapiens
tgctttgatatttcaat

SEQ ID NO: 1974269 - DNA, 23 bp, Homo sapiens
tgctttgctgtctggtgtagctc

SEQ ID NO: 1974270 - DNA, 12 bp, Homo sapiens
tgctttgctgtt

SEQ ID NO: 1974271 - DNA, 14 bp, Homo sapiens
tgctttgcttttta

SEQ ID NO: 1974272 - DNA, 19 bp, Homo sapiens
tgctttgggaggccaaggc

SEQ ID NO: 1974273 - DNA, 14 bp, Homo sapiens
tgctttgggctgcc

SEQ ID NO: 1974274 - DNA, 15 bp, Homo sapiens
tgctttgggctttgc

SEQ ID NO: 1974275 - DNA, 18 bp, Homo sapiens
tgctttgggctttgcagg

SEQ ID NO: 1974276 - DNA, 19 bp, Homo sapiens
tgctttgtatccatgaggg

SEQ ID NO: 1974277 - DNA, 16 bp, Homo sapiens
tgctttgtgtgattga

SEQ ID NO: 1974278 - DNA, 17 bp, Homo sapiens
tgctttgtgtgattgaa

SEQ ID NO: 1974279 - DNA, 15 bp, Homo sapiens
tgctttgttttctaa

SEQ ID NO: 1974280 - DNA, 22 bp, Homo sapiens
tgcttttccaggatcctgcagg

SEQ ID NO: 1974281 - DNA, 12 bp, Homo sapiens
tgcttttgatgt

SEQ ID NO: 1974282 - DNA, 14 bp, Homo sapiens
tgcttttgatgtga

SEQ ID NO: 1974283 - DNA, 20 bp, Homo sapiens
tgcttttgatgtgaaaatca

SEQ ID NO: 1974284 - DNA, 14 bp, Homo sapiens
tgcttttgccactt

SEQ ID NO: 1974285 - DNA, 17 bp, Homo sapiens
tgcttttggtctgtgtg

SEQ ID NO: 1974286 - DNA, 15 bp, Homo sapiens
tgctttttggcacag

SEQ ID NO: 1974287 - DNA, 18 bp, Homo sapiens
tggaaaaagaaagaaaca

SEQ ID NO: 1974288 - DNA, 19 bp, Homo sapiens
tggaaaaatcttgggcaag

SEQ ID NO: 1974289 - DNA, 19 bp, Homo sapiens
tggaaaagaatacagaaag

SEQ ID NO: 1974290 - DNA, 22 bp, Homo sapiens
tggaaaagaatccctgcagcct

SEQ ID NO: 1974291 - DNA, 23 bp, Homo sapiens
tggaaaagaatccctgcagcctg

SEQ ID NO: 1974292 - DNA, 15 bp, Homo sapiens
tggaaaagcccagtg

SEQ ID NO: 1974293 - DNA, 18 bp, Homo sapiens
tggaaaagtcacacagac

SEQ ID NO: 1974294 - DNA, 22 bp, Homo sapiens
tggaaaagtcacacagacacac

SEQ ID NO: 1974295 - DNA, 15 bp, Homo sapiens
tggaaaataaatttt

SEQ ID NO: 1974296 - DNA, 17 bp, Homo sapiens
tggaaaatgtcctgtgg

SEQ ID NO: 1974297 - DNA, 14 bp, Homo sapiens
tggaaacaggacca

SEQ ID NO: 1974298 - DNA, 23 bp, Homo sapiens
tggaaacatttacaataaatatt

SEQ ID NO: 1974299 - DNA, 15 bp, Homo sapiens
tggaaacattttctt

SEQ ID NO: 1974300 - DNA, 13 bp, Homo sapiens
tggaaactggcca

SEQ ID NO: 1974301 - DNA, 10 bp, Homo sapiens
tggaaagaga

SEQ ID NO: 1974302 - DNA, 21 bp, Homo sapiens
tggaaagcatcacctcaggcc

SEQ ID NO: 1974303 - DNA, 17 bp, Homo sapiens
tggaaaggctcagtctc

SEQ ID NO: 1974304 - DNA, 20 bp, Homo sapiens
tggaaaggctcagtctcagg

SEQ ID NO: 1974305 - DNA, 17 bp, Homo sapiens
tggaaaggggagttgag

SEQ ID NO: 1974306 - DNA, 16 bp, Homo sapiens
tggaaaggtttcaaga

SEQ ID NO: 1974307 - DNA, 20 bp, Homo sapiens
tggaaataaacctggagatg

SEQ ID NO: 1974308 - DNA, 22 bp, Homo sapiens
tggaaataaacctggagatgat

SEQ ID NO: 1974309 - DNA, 23 bp, Homo sapiens
tggaaatattcatgcttcttcct

SEQ ID NO: 1974310 - DNA, 18 bp, Homo sapiens
tggaaatcatcgaaaatt

SEQ ID NO: 1974311 - DNA, 21 bp, Homo sapiens
tggaacaaaagttcgaaagaa

SEQ ID NO: 1974312 - DNA, 15 bp, Homo sapiens
tggaacaccaggctg

SEQ ID NO: 1974313 - DNA, 20 bp, Homo sapiens
tggaacagtcacccttctgg

SEQ ID NO: 1974314 - DNA, 21 bp, Homo sapiens
tggaacatgtcggagtagaaa

SEQ ID NO: 1974315 - DNA, 11 bp, Homo sapiens
tggaaccaatc

SEQ ID NO: 1974316 - DNA, 16 bp, Homo sapiens
tggaactctaccctgg

SEQ ID NO: 1974317 - DNA, 22 bp, Homo sapiens
tggaactgaccccctcccctga

SEQ ID NO: 1974318 - DNA, 16 bp, Homo sapiens
tggaacttctaatata

SEQ ID NO: 1974319 - DNA, 20 bp, Homo sapiens
tggaagaaattcctgtagca

SEQ ID NO: 1974320 - DNA, 23 bp, Homo sapiens
tggaagacgcaagggcctgatgg

SEQ ID NO: 1974321 - DNA, 14 bp, Homo sapiens
tggaagagaaatct

SEQ ID NO: 1974322 - DNA, 14 bp, Homo sapiens
tggaagagaggcac

SEQ ID NO: 1974323 - DNA, 16 bp, Homo sapiens
tggaagagaggcacct

SEQ ID NO: 1974324 - DNA, 17 bp, Homo sapiens
tggaagagaggcacctg

SEQ ID NO: 1974325 - DNA, 14 bp, Homo sapiens
tggaagagcagcct

SEQ ID NO: 1974326 - DNA, 17 bp, Homo sapiens
tggaagagcagcctgat

SEQ ID NO: 1974327 - DNA, 14 bp, Homo sapiens
tggaagattttaaa

SEQ ID NO: 1974328 - DNA, 22 bp, Homo sapiens
tggaagcatgtaggagaatcca

SEQ ID NO: 1974329 - DNA, 14 bp, Homo sapiens
tggaagccccccac

SEQ ID NO: 1974330 - DNA, 12 bp, Homo sapiens
tggaagccctcc

SEQ ID NO: 1974331 - DNA, 15 bp, Homo sapiens
tggaagccctccttc

SEQ ID NO: 1974332 - DNA, 16 bp, Homo sapiens
tggaagccctccttcc

SEQ ID NO: 1974333 - DNA, 16 bp, Homo sapiens
tggaagctgagcaggc

SEQ ID NO: 1974334 - DNA, 17 bp, Homo sapiens
tggaagctgagcaggcc

SEQ ID NO: 1974335 - DNA, 19 bp, Homo sapiens
tggaagctgagcaggcccg

SEQ ID NO: 1974336 - DNA, 17 bp, Homo sapiens
tggaagctgccctgccc

SEQ ID NO: 1974337 - DNA, 15 bp, Homo sapiens
tggaagctgtgtcct

SEQ ID NO: 1974338 - DNA, 15 bp, Homo sapiens
tggaaggcagggaca

SEQ ID NO: 1974339 - DNA, 11 bp, Homo sapiens
tggaaggcatg

SEQ ID NO: 1974340 - DNA, 14 bp, Homo sapiens
tggaaggcatggcg

SEQ ID NO: 1974341 - DNA, 14 bp, Homo sapiens
tggaaggctggctg

SEQ ID NO: 1974342 - DNA, 16 bp, Homo sapiens
tggaagggaagtgaga

SEQ ID NO: 1974343 - DNA, 18 bp, Homo sapiens
tggaagggggtgtgcgtg

SEQ ID NO: 1974344 - DNA, 21 bp, Homo sapiens
tggaaggtttgtatattgtca

SEQ ID NO: 1974345 - DNA, 13 bp, Homo sapiens
tggaagttttcag

SEQ ID NO: 1974346 - DNA, 22 bp, Homo sapiens
tggaatactaaaaatcatgaga

SEQ ID NO: 1974347 - DNA, 20 bp, Homo sapiens
tggaatcaaggaatcctgag

SEQ ID NO: 1974348 - DNA, 13 bp, Homo sapiens
tggaatcctttca

SEQ ID NO: 1974349 - DNA, 12 bp, Homo sapiens
tggaatctggag

SEQ ID NO: 1974350 - DNA, 13 bp, Homo sapiens
tggaatctggaga

SEQ ID NO: 1974351 - DNA, 14 bp, Homo sapiens
tggaatgaagcatg

SEQ ID NO: 1974352 - DNA, 16 bp, Homo sapiens
tggaatgaagcatgta

SEQ ID NO: 1974353 - DNA, 23 bp, Homo sapiens
tggaatgtaactatatcatcctt

SEQ ID NO: 1974354 - DNA, 18 bp, Homo sapiens
tggaattcagcaccctgg

SEQ ID NO: 1974355 - DNA, 19 bp, Homo sapiens
tggaattcagcaccctggg

SEQ ID NO: 1974356 - DNA, 16 bp, Homo sapiens
tggaatttgtaagttt

SEQ ID NO: 1974357 - DNA, 13 bp, Homo sapiens
tggacaaaatgga

SEQ ID NO: 1974358 - DNA, 14 bp, Homo sapiens
tggacaacccagaa

SEQ ID NO: 1974359 - DNA, 13 bp, Homo sapiens
tggacaagaagct

SEQ ID NO: 1974360 - DNA, 22 bp, Homo sapiens
tggacaagcagaggtggccaga

SEQ ID NO: 1974361 - DNA, 14 bp, Homo sapiens
tggacaaggaggtc

SEQ ID NO: 1974362 - DNA, 20 bp, Homo sapiens
tggacacagacccacacatg

SEQ ID NO: 1974363 - DNA, 15 bp, Homo sapiens
tggacacagctcttc

SEQ ID NO: 1974364 - DNA, 17 bp, Homo sapiens
tggacacagtgttccag

SEQ ID NO: 1974365 - DNA, 22 bp, Homo sapiens
tggacacattttctcctaggag

SEQ ID NO: 1974366 - DNA, 21 bp, Homo sapiens
tggacaccccttatccaggac

SEQ ID NO: 1974367 - DNA, 10 bp, Homo sapiens
tggacacctg

SEQ ID NO: 1974368 - DNA, 11 bp, Homo sapiens
tggacacctgc

SEQ ID NO: 1974369 - DNA, 14 bp, Homo sapiens
tggacagaggggca

SEQ ID NO: 1974370 - DNA, 14 bp, Homo sapiens
tggacagctgcttg

SEQ ID NO: 1974371 - DNA, 13 bp, Homo sapiens
tggacagctgtgc

SEQ ID NO: 1974372 - DNA, 18 bp, Homo sapiens
tggacagctgtgcctcgc

SEQ ID NO: 1974373 - DNA, 16 bp, Homo sapiens
tggacaggcatgttct

SEQ ID NO: 1974374 - DNA, 22 bp, Homo sapiens
tggacaggcatgttctctgagg

SEQ ID NO: 1974375 - DNA, 13 bp, Homo sapiens
tggacagtcctgg

SEQ ID NO: 1974376 - DNA, 14 bp, Homo sapiens
tggacagtctgagc

SEQ ID NO: 1974377 - DNA, 22 bp, Homo sapiens
tggacatcacagcagaatgaag

SEQ ID NO: 1974378 - DNA, 16 bp, Homo sapiens
tggaccaccagcccca

SEQ ID NO: 1974379 - DNA, 20 bp, Homo sapiens
tggaccaccagccccagcaa

SEQ ID NO: 1974380 - DNA, 14 bp, Homo sapiens
tggaccagaggaag

SEQ ID NO: 1974381 - DNA, 13 bp, Homo sapiens
tggaccaggacag

SEQ ID NO: 1974382 - DNA, 20 bp, Homo sapiens
tggacccagggatgacatgt

SEQ ID NO: 1974383 - DNA, 14 bp, Homo sapiens
tggaccccgcctcc

SEQ ID NO: 1974384 - DNA, 19 bp, Homo sapiens
tggacccctgaattcaatg

SEQ ID NO: 1974385 - DNA, 16 bp, Homo sapiens
tggacccgctctggac

SEQ ID NO: 1974386 - DNA, 19 bp, Homo sapiens
tggaccgcttcccagaggc

SEQ ID NO: 1974387 - DNA, 18 bp, Homo sapiens
tggaccgggtgggcctgg

SEQ ID NO: 1974388 - DNA, 19 bp, Homo sapiens
tggaccgggtgggcctggc

SEQ ID NO: 1974389 - DNA, 20 bp, Homo sapiens
tggaccgggtgggcctggcc

SEQ ID NO: 1974390 - DNA, 22 bp, Homo sapiens
tggacctcaggttcctaagact

SEQ ID NO: 1974391 - DNA, 13 bp, Homo sapiens
tggacctctgctc

SEQ ID NO: 1974392 - DNA, 13 bp, Homo sapiens
tggaccttcctgc

SEQ ID NO: 1974393 - DNA, 19 bp, Homo sapiens
tggaccttcctgccaccag

SEQ ID NO: 1974394 - DNA, 15 bp, Homo sapiens
tggacgcccagctga

SEQ ID NO: 1974395 - DNA, 16 bp, Homo sapiens
tggacggggactgggg

SEQ ID NO: 1974396 - DNA, 13 bp, Homo sapiens
tggactcctccca

SEQ ID NO: 1974397 - DNA, 13 bp, Homo sapiens
tggactcctctgt

SEQ ID NO: 1974398 - DNA, 15 bp, Homo sapiens
tggactcctctgtcc

SEQ ID NO: 1974399 - DNA, 15 bp, Homo sapiens
tggactctgcacatg

SEQ ID NO: 1974400 - DNA, 22 bp, Homo sapiens
tggactctgcacatgtcttgta

SEQ ID NO: 1974401 - DNA, 13 bp, Homo sapiens
tggactgggaggt

SEQ ID NO: 1974402 - DNA, 21 bp, Homo sapiens
tggactgtcatagaaattaca

SEQ ID NO: 1974403 - DNA, 22 bp, Homo sapiens
tggactttggttctctccagga

SEQ ID NO: 1974404 - DNA, 19 bp, Homo sapiens
tggacttttgggggttgga

SEQ ID NO: 1974405 - DNA, 23 bp, Homo sapiens
tggagaaataaaaatacctcttt

SEQ ID NO: 1974406 - DNA, 15 bp, Homo sapiens
tggagaaattattta

SEQ ID NO: 1974407 - DNA, 21 bp, Homo sapiens
tggagaactagaacctggagg

SEQ ID NO: 1974408 - DNA, 14 bp, Homo sapiens
tggagaagctctgt

SEQ ID NO: 1974409 - DNA, 14 bp, Homo sapiens
tggagaaggaaggc

SEQ ID NO: 1974410 - DNA, 22 bp, Homo sapiens
tggagaagtgtcgttttcataa

SEQ ID NO: 1974411 - DNA, 23 bp, Homo sapiens
tggagacactcctataaggagag

SEQ ID NO: 1974412 - DNA, 19 bp, Homo sapiens
tggagacagtagaggcatg

SEQ ID NO: 1974413 - DNA, 20 bp, Homo sapiens
tggagaccgcttcacccctg

SEQ ID NO: 1974414 - DNA, 13 bp, Homo sapiens
tggagactcctgc

SEQ ID NO: 1974415 - DNA, 19 bp, Homo sapiens
tggagactcctgccctgtt

SEQ ID NO: 1974416 - DNA, 19 bp, Homo sapiens
tggagactctgtggggcct

SEQ ID NO: 1974417 - DNA, 12 bp, Homo sapiens
tggagagaaggc

SEQ ID NO: 1974418 - DNA, 23 bp, Homo sapiens
tggagagaagtttctggccctgg

SEQ ID NO: 1974419 - DNA, 14 bp, Homo sapiens
tggagagcagctgg

SEQ ID NO: 1974420 - DNA, 13 bp, Homo sapiens
tggagagccctgg

SEQ ID NO: 1974421 - DNA, 14 bp, Homo sapiens
tggagagccctggg

SEQ ID NO: 1974422 - DNA, 20 bp, Homo sapiens
tggagagccctgggaccgct

SEQ ID NO: 1974423 - DNA, 20 bp, Homo sapiens
tggagagcctcttagtgatt

SEQ ID NO: 1974424 - DNA, 19 bp, Homo sapiens
tggagagctagaacctgga

SEQ ID NO: 1974425 - DNA, 23 bp, Homo sapiens
tggagagctagaacctggagagc

SEQ ID NO: 1974426 - DNA, 17 bp, Homo sapiens
tggagagctaggagcaa

SEQ ID NO: 1974427 - DNA, 23 bp, Homo sapiens
tggagagctaggagcaaagcctg

SEQ ID NO: 1974428 - DNA, 22 bp, Homo sapiens
tggagaggagggatgctgcctg

SEQ ID NO: 1974429 - DNA, 13 bp, Homo sapiens
tggagaggcggcc

SEQ ID NO: 1974430 - DNA, 14 bp, Homo sapiens
tggagaggcggcct

SEQ ID NO: 1974431 - DNA, 21 bp, Homo sapiens
tggagaggggcctgggaaagg

SEQ ID NO: 1974432 - DNA, 15 bp, Homo sapiens
tggagagtaaaaact

SEQ ID NO: 1974433 - DNA, 14 bp, Homo sapiens
tggagagtgagaat

SEQ ID NO: 1974434 - DNA, 17 bp, Homo sapiens
tggagagtgttcctgtt

SEQ ID NO: 1974435 - DNA, 23 bp, Homo sapiens
tggagatatttatggggggagaa

SEQ ID NO: 1974436 - DNA, 11 bp, Homo sapiens
tggagatgatg

SEQ ID NO: 1974437 - DNA, 12 bp, Homo sapiens
tggagatgatga

SEQ ID NO: 1974438 - DNA, 13 bp, Homo sapiens
tggagatgatgat

SEQ ID NO: 1974439 - DNA, 14 bp, Homo sapiens
tggagatgatgatg

SEQ ID NO: 1974440 - DNA, 14 bp, Homo sapiens
tggagatgcagagg

SEQ ID NO: 1974441 - DNA, 23 bp, Homo sapiens
tggagcaagaaggaaggaggcag

SEQ ID NO: 1974442 - DNA, 16 bp, Homo sapiens
tggagcaagagagagc

SEQ ID NO: 1974443 - DNA, 18 bp, Homo sapiens
tggagcagaaagccaggg

SEQ ID NO: 1974444 - DNA, 19 bp, Homo sapiens
tggagcagaaagccagggt

SEQ ID NO: 1974445 - DNA, 22 bp, Homo sapiens
tggagcagaaagccagggtcct

SEQ ID NO: 1974446 - DNA, 14 bp, Homo sapiens
tggagcatcccagg

SEQ ID NO: 1974447 - DNA, 15 bp, Homo sapiens
tggagcatcccaggc

SEQ ID NO: 1974448 - DNA, 13 bp, Homo sapiens
tggagcccgtgca

SEQ ID NO: 1974449 - DNA, 16 bp, Homo sapiens
tggagcctgaacatga

SEQ ID NO: 1974450 - DNA, 22 bp, Homo sapiens
tggagcgcacctgccccctggt

SEQ ID NO: 1974451 - DNA, 16 bp, Homo sapiens
tggagcggctctcctg

SEQ ID NO: 1974452 - DNA, 23 bp, Homo sapiens
tggagctaattaaggtttgccct

SEQ ID NO: 1974453 - DNA, 21 bp, Homo sapiens
tggagctcttggaagagctct

SEQ ID NO: 1974454 - DNA, 23 bp, Homo sapiens
tggagctcttggaagagctcttc

SEQ ID NO: 1974455 - DNA, 20 bp, Homo sapiens
tggaggaaaatccatggata

SEQ ID NO: 1974456 - DNA, 15 bp, Homo sapiens
tggaggaacagctcc

SEQ ID NO: 1974457 - DNA, 14 bp, Homo sapiens
tggaggaaggtgct

SEQ ID NO: 1974458 - DNA, 16 bp, Homo sapiens
tggaggaaggtgctga

SEQ ID NO: 1974459 - DNA, 17 bp, Homo sapiens
tggaggaaggtgctgag

SEQ ID NO: 1974460 - DNA, 13 bp, Homo sapiens
tggaggacagtgg

SEQ ID NO: 1974461 - DNA, 17 bp, Homo sapiens
tggaggacctgagcctg

SEQ ID NO: 1974462 - DNA, 20 bp, Homo sapiens
tggaggactagaacctggag

SEQ ID NO: 1974463 - DNA, 17 bp, Homo sapiens
tggaggagaaataaact

SEQ ID NO: 1974464 - DNA, 21 bp, Homo sapiens
tggaggagaagaattttcaga

SEQ ID NO: 1974465 - DNA, 19 bp, Homo sapiens
tggaggagctcaggacact

SEQ ID NO: 1974466 - DNA, 22 bp, Homo sapiens
tggaggagcttgggggatgact

SEQ ID NO: 1974467 - DNA, 23 bp, Homo sapiens
tggaggaggaggaggaggaggaa

SEQ ID NO: 1974468 - DNA, 15 bp, Homo sapiens
tggaggaggcctggg

SEQ ID NO: 1974469 - DNA, 21 bp, Homo sapiens
tggaggatgaatagatgtgat

SEQ ID NO: 1974470 - DNA, 20 bp, Homo sapiens
tggaggatggagagagggga

SEQ ID NO: 1974471 - DNA, 23 bp, Homo sapiens
tggaggcaggctccccctgcctt

SEQ ID NO: 1974472 - DNA, 14 bp, Homo sapiens
tggaggcctgatgc

SEQ ID NO: 1974473 - DNA, 12 bp, Homo sapiens
tggaggctgctc

SEQ ID NO: 1974474 - DNA, 21 bp, Homo sapiens
tggagggaatgaacctggagg

SEQ ID NO: 1974475 - DNA, 20 bp, Homo sapiens
tggagggcaaggggtttcca

SEQ ID NO: 1974476 - DNA, 12 bp, Homo sapiens
tggagggcagag

SEQ ID NO: 1974477 - DNA, 19 bp, Homo sapiens
tggagggcagagtgggctg

SEQ ID NO: 1974478 - DNA, 20 bp, Homo sapiens
tggagggctagaacctggag

SEQ ID NO: 1974479 - DNA, 21 bp, Homo sapiens
tggagggctagaacctggaga

SEQ ID NO: 1974480 - DNA, 23 bp, Homo sapiens
tggagggctagaatctggagagc

SEQ ID NO: 1974481 - DNA, 20 bp, Homo sapiens
tggagggcttggtaaaacac

SEQ ID NO: 1974482 - DNA, 20 bp, Homo sapiens
tggagggtaggggagtgtgg

SEQ ID NO: 1974483 - DNA, 20 bp, Homo sapiens
tggagggtgggagagcccag

SEQ ID NO: 1974484 - DNA, 13 bp, Homo sapiens
tggagggtggggc

SEQ ID NO: 1974485 - DNA, 22 bp, Homo sapiens
tggagtcagtaggtccaagggc

SEQ ID NO: 1974486 - DNA, 22 bp, Homo sapiens
tggagtcatggtccggtgtcct

SEQ ID NO: 1974487 - DNA, 21 bp, Homo sapiens
tggagtctgagtctgagtcct

SEQ ID NO: 1974488 - DNA, 18 bp, Homo sapiens
tggagtgagatcttacag

SEQ ID NO: 1974489 - DNA, 20 bp, Homo sapiens
tggagtgaggcttccaggct

SEQ ID NO: 1974490 - DNA, 23 bp, Homo sapiens
tggagtgaggcttccaggctctt

SEQ ID NO: 1974491 - DNA, 14 bp, Homo sapiens
tggagtgcagtgag

SEQ ID NO: 1974492 - DNA, 22 bp, Homo sapiens
tggagtgcgctcttggtccctg

SEQ ID NO: 1974493 - DNA, 17 bp, Homo sapiens
tggagttacattaatgt

SEQ ID NO: 1974494 - DNA, 16 bp, Homo sapiens
tggatactatatgata

SEQ ID NO: 1974495 - DNA, 17 bp, Homo sapiens
tggatatgtaaaacatt

SEQ ID NO: 1974496 - DNA, 16 bp, Homo sapiens
tggatcatgaaaagtg

SEQ ID NO: 1974497 - DNA, 20 bp, Homo sapiens
tggatcatgaggtcaggaga

SEQ ID NO: 1974498 - DNA, 20 bp, Homo sapiens
tggatcccaattcatttcat

SEQ ID NO: 1974499 - DNA, 20 bp, Homo sapiens
tggatcctgctgtggcctca

SEQ ID NO: 1974500 - DNA, 21 bp, Homo sapiens
tggatcctgctgtggcctcac

SEQ ID NO: 1974501 - DNA, 16 bp, Homo sapiens
tggatctaaataatac

SEQ ID NO: 1974502 - DNA, 18 bp, Homo sapiens
tggatctccaaggaccag

SEQ ID NO: 1974503 - DNA, 19 bp, Homo sapiens
tggatctgggaccctttcc

SEQ ID NO: 1974504 - DNA, 15 bp, Homo sapiens
tggatctggggactg

SEQ ID NO: 1974505 - DNA, 16 bp, Homo sapiens
tggatctgtccaagga

SEQ ID NO: 1974506 - DNA, 15 bp, Homo sapiens
tggatgaaattttct

SEQ ID NO: 1974507 - DNA, 19 bp, Homo sapiens
tggatgatataatgcgggt

SEQ ID NO: 1974508 - DNA, 15 bp, Homo sapiens
tggatgcctggtggc

SEQ ID NO: 1974509 - DNA, 18 bp, Homo sapiens
tggatgcctggtggcagc

SEQ ID NO: 1974510 - DNA, 19 bp, Homo sapiens
tggatgcctggtggcagct

SEQ ID NO: 1974511 - DNA, 20 bp, Homo sapiens
tggatgcctggtggcagctg

SEQ ID NO: 1974512 - DNA, 16 bp, Homo sapiens
tggatgctccagggca

SEQ ID NO: 1974513 - DNA, 17 bp, Homo sapiens
tggatgctccagggcag

SEQ ID NO: 1974514 - DNA, 16 bp, Homo sapiens
tggatggacagaatga

SEQ ID NO: 1974515 - DNA, 17 bp, Homo sapiens
tggatggaggagaaata

SEQ ID NO: 1974516 - DNA, 19 bp, Homo sapiens
tggatggaggagaaataaa

SEQ ID NO: 1974517 - DNA, 14 bp, Homo sapiens
tggatggatggaca

SEQ ID NO: 1974518 - DNA, 18 bp, Homo sapiens
tggatgggcattgggctg

SEQ ID NO: 1974519 - DNA, 22 bp, Homo sapiens
tggatgggcattgggctgacac

SEQ ID NO: 1974520 - DNA, 23 bp, Homo sapiens
tggatgggcattgggctgacacc

SEQ ID NO: 1974521 - DNA, 18 bp, Homo sapiens
tggatgtcccctgtccca

SEQ ID NO: 1974522 - DNA, 17 bp, Homo sapiens
tggatgtgtaaatggag

SEQ ID NO: 1974523 - DNA, 14 bp, Homo sapiens
tggatgtgtggggc

SEQ ID NO: 1974524 - DNA, 19 bp, Homo sapiens
tggattagctagaatgcac

SEQ ID NO: 1974525 - DNA, 14 bp, Homo sapiens
tggattattcattt

SEQ ID NO: 1974526 - DNA, 20 bp, Homo sapiens
tggattattcatttaaaatg

SEQ ID NO: 1974527 - DNA, 13 bp, Homo sapiens
tggattatttcat

SEQ ID NO: 1974528 - DNA, 16 bp, Homo sapiens
tggattcctaagcagt

SEQ ID NO: 1974529 - DNA, 13 bp, Homo sapiens
tggattctaaaat

SEQ ID NO: 1974530 - DNA, 14 bp, Homo sapiens
tggatttcagaaag

SEQ ID NO: 1974531 - DNA, 23 bp, Homo sapiens
tggatttcctattttaaaaccat

SEQ ID NO: 1974532 - DNA, 21 bp, Homo sapiens
tggatttttacaaataaagat

SEQ ID NO: 1974533 - DNA, 22 bp, Homo sapiens
tggatttttacaaataaagatg

SEQ ID NO: 1974534 - DNA, 17 bp, Homo sapiens
tggcaaaaatggctaga

SEQ ID NO: 1974535 - DNA, 13 bp, Homo sapiens
tggcaacagaagc

SEQ ID NO: 1974536 - DNA, 17 bp, Homo sapiens
tggcaacagagcaagac

SEQ ID NO: 1974537 - DNA, 23 bp, Homo sapiens
tggcaagcagggaaagctccacg

SEQ ID NO: 1974538 - DNA, 21 bp, Homo sapiens
tggcaagctagaacctggagg

SEQ ID NO: 1974539 - DNA, 22 bp, Homo sapiens
tggcaagttttgatatgagtat

SEQ ID NO: 1974540 - DNA, 14 bp, Homo sapiens
tggcaattttgtaa

SEQ ID NO: 1974541 - DNA, 22 bp, Homo sapiens
tggcacaactgtctaatgacac

SEQ ID NO: 1974542 - DNA, 15 bp, Homo sapiens
tggcacaggactgat

SEQ ID NO: 1974543 - DNA, 22 bp, Homo sapiens
tggcacagttttctgagaaaga

SEQ ID NO: 1974544 - DNA, 13 bp, Homo sapiens
tggcaccagcccc

SEQ ID NO: 1974545 - DNA, 19 bp, Homo sapiens
tggcaccagccccctggat

SEQ ID NO: 1974546 - DNA, 19 bp, Homo sapiens
tggcacccggcccctgctg

SEQ ID NO: 1974547 - DNA, 14 bp, Homo sapiens
tggcacctcagaca

SEQ ID NO: 1974548 - DNA, 16 bp, Homo sapiens
tggcacctcctgagaa

SEQ ID NO: 1974549 - DNA, 20 bp, Homo sapiens
tggcacggagagaaggccca

SEQ ID NO: 1974550 - DNA, 20 bp, Homo sapiens
tggcacggtggctcaggcct

SEQ ID NO: 1974551 - DNA, 14 bp, Homo sapiens
tggcactcccctga

SEQ ID NO: 1974552 - DNA, 18 bp, Homo sapiens
tggcacttagcccaagag

SEQ ID NO: 1974553 - DNA, 21 bp, Homo sapiens
tggcacttagctatcagaaga

SEQ ID NO: 1974554 - DNA, 12 bp, Homo sapiens
tggcagaaaaga

SEQ ID NO: 1974555 - DNA, 19 bp, Homo sapiens
tggcagaataatctttggg

SEQ ID NO: 1974556 - DNA, 19 bp, Homo sapiens
tggcagaccgggggccaga

SEQ ID NO: 1974557 - DNA, 19 bp, Homo sapiens
tggcagagaaggcctcttg

SEQ ID NO: 1974558 - DNA, 17 bp, Homo sapiens
tggcagatgtaggaggg

SEQ ID NO: 1974559 - DNA, 19 bp, Homo sapiens
tggcagatgtaggagggac

SEQ ID NO: 1974560 - DNA, 20 bp, Homo sapiens
tggcagatgtaggagggact

SEQ ID NO: 1974561 - DNA, 12 bp, Homo sapiens
tggcagccatgc

SEQ ID NO: 1974562 - DNA, 15 bp, Homo sapiens
tggcagccatgcctc

SEQ ID NO: 1974563 - DNA, 20 bp, Homo sapiens
tggcagccatgcctcatgcc

SEQ ID NO: 1974564 - DNA, 16 bp, Homo sapiens
tggcagccgtgccttc

SEQ ID NO: 1974565 - DNA, 18 bp, Homo sapiens
tggcagccgtgccttcag

SEQ ID NO: 1974566 - DNA, 21 bp, Homo sapiens
tggcagccgtgccttcagctc

SEQ ID NO: 1974567 - DNA, 22 bp, Homo sapiens
tggcagccgtgccttcagctct

SEQ ID NO: 1974568 - DNA, 23 bp, Homo sapiens
tggcagccgtgccttcagctcta

SEQ ID NO: 1974569 - DNA, 18 bp, Homo sapiens
tggcagctcctctccttg

SEQ ID NO: 1974570 - DNA, 18 bp, Homo sapiens
tggcagctgagagccctg

SEQ ID NO: 1974571 - DNA, 19 bp, Homo sapiens
tggcagctgagagccctgc

SEQ ID NO: 1974572 - DNA, 23 bp, Homo sapiens
tggcagctgagagccctgctgtg

SEQ ID NO: 1974573 - DNA, 19 bp, Homo sapiens
tggcagctgcggtccaccc

SEQ ID NO: 1974574 - DNA, 13 bp, Homo sapiens
tggcagctgcttt

SEQ ID NO: 1974575 - DNA, 11 bp, Homo sapiens
tggcagctgga

SEQ ID NO: 1974576 - DNA, 17 bp, Homo sapiens
tggcagctggaatttaa

SEQ ID NO: 1974577 - DNA, 14 bp, Homo sapiens
tggcagctgtcccc

SEQ ID NO: 1974578 - DNA, 14 bp, Homo sapiens
tggcaggagaatca

SEQ ID NO: 1974579 - DNA, 22 bp, Homo sapiens
tggcaggatgaccctgcgaagg

SEQ ID NO: 1974580 - DNA, 20 bp, Homo sapiens
tggcaggtgcagatgggctg

SEQ ID NO: 1974581 - DNA, 16 bp, Homo sapiens
tggcagtccagccagc

SEQ ID NO: 1974582 - DNA, 19 bp, Homo sapiens
tggcagtccagccagctcc

SEQ ID NO: 1974583 - DNA, 11 bp, Homo sapiens
tggcagtgtgt

SEQ ID NO: 1974584 - DNA, 16 bp, Homo sapiens
tggcagtttatattta

SEQ ID NO: 1974585 - DNA, 20 bp, Homo sapiens
tggcagtttatatttaactc

SEQ ID NO: 1974586 - DNA, 18 bp, Homo sapiens
tggcatcccctttattaa

SEQ ID NO: 1974587 - DNA, 21 bp, Homo sapiens
tggcatgaccatcctgtcctt

SEQ ID NO: 1974588 - DNA, 23 bp, Homo sapiens
tggcatggtgctttcaggtctgg

SEQ ID NO: 1974589 - DNA, 14 bp, Homo sapiens
tggcatgtcagagc

SEQ ID NO: 1974590 - DNA, 15 bp, Homo sapiens
tggcatgtcagagcc

SEQ ID NO: 1974591 - DNA, 16 bp, Homo sapiens
tggcattaattattaa

SEQ ID NO: 1974592 - DNA, 21 bp, Homo sapiens
tggccaaagccaaagctaggc

SEQ ID NO: 1974593 - DNA, 16 bp, Homo sapiens
tggccaaattatttgt

SEQ ID NO: 1974594 - DNA, 18 bp, Homo sapiens
tggccaaattatttgtgt

SEQ ID NO: 1974595 - DNA, 20 bp, Homo sapiens
tggccaaattatttgtgtaa

SEQ ID NO: 1974596 - DNA, 17 bp, Homo sapiens
tggccaagctgaggtgc

SEQ ID NO: 1974597 - DNA, 21 bp, Homo sapiens
tggccaagctgaggtgcccag

SEQ ID NO: 1974598 - DNA, 16 bp, Homo sapiens
tggccaagggggtgga

SEQ ID NO: 1974599 - DNA, 19 bp, Homo sapiens
tggccacccaacagcacca

SEQ ID NO: 1974600 - DNA, 18 bp, Homo sapiens
tggccaccccgtgccacc

SEQ ID NO: 1974601 - DNA, 19 bp, Homo sapiens
tggccacccgttctgctgg

SEQ ID NO: 1974602 - DNA, 14 bp, Homo sapiens
tggccaccctggcc

SEQ ID NO: 1974603 - DNA, 20 bp, Homo sapiens
tggccactccagacccctgg

SEQ ID NO: 1974604 - DNA, 21 bp, Homo sapiens
tggccactgggtctcactcct

SEQ ID NO: 1974605 - DNA, 21 bp, Homo sapiens
tggccacttgggtcttccctg

SEQ ID NO: 1974606 - DNA, 15 bp, Homo sapiens
tggccagacgctgcc

SEQ ID NO: 1974607 - DNA, 17 bp, Homo sapiens
tggccagagagggccca

SEQ ID NO: 1974608 - DNA, 21 bp, Homo sapiens
tggccagagagggcccagctg

SEQ ID NO: 1974609 - DNA, 22 bp, Homo sapiens
tggccagagctggaaggcaggg

SEQ ID NO: 1974610 - DNA, 18 bp, Homo sapiens
tggccagagctgggaggc

SEQ ID NO: 1974611 - DNA, 24 bp, Homo sapiens
tggccagagctgggaggcatggcc

SEQ ID NO: 1974612 - DNA, 17 bp, Homo sapiens
tggccagatgcaccagc

SEQ ID NO: 1974613 - DNA, 18 bp, Homo sapiens
tggccagatgcaccagcc

SEQ ID NO: 1974614 - DNA, 20 bp, Homo sapiens
tggccagatgcaccagccct

SEQ ID NO: 1974615 - DNA, 12 bp, Homo sapiens
tggccagcaccc

SEQ ID NO: 1974616 - DNA, 13 bp, Homo sapiens
tggccagcaccct

SEQ ID NO: 1974617 - DNA, 18 bp, Homo sapiens
tggccagcaccctctcct

SEQ ID NO: 1974618 - DNA, 21 bp, Homo sapiens
tggccagcaccctctcctggg

SEQ ID NO: 1974619 - DNA, 17 bp, Homo sapiens
tggccaggagctggagg

SEQ ID NO: 1974620 - DNA, 18 bp, Homo sapiens
tggccaggagctggagga

SEQ ID NO: 1974621 - DNA, 20 bp, Homo sapiens
tggccaggcaccccctggag

SEQ ID NO: 1974622 - DNA, 21 bp, Homo sapiens
tggccaggcaccccctggaga

SEQ ID NO: 1974623 - DNA, 17 bp, Homo sapiens
tggccagggtgagagct

SEQ ID NO: 1974624 - DNA, 15 bp, Homo sapiens
tggccaggtggccac

SEQ ID NO: 1974625 - DNA, 15 bp, Homo sapiens
tggccagtcctagag

SEQ ID NO: 1974626 - DNA, 21 bp, Homo sapiens
tggccagtcctagagctcctg

SEQ ID NO: 1974627 - DNA, 16 bp, Homo sapiens
tggccatcagggtggg

SEQ ID NO: 1974628 - DNA, 15 bp, Homo sapiens
tggccatccctgggc

SEQ ID NO: 1974629 - DNA, 16 bp, Homo sapiens
tggccatccctgggcc

SEQ ID NO: 1974630 - DNA, 19 bp, Homo sapiens
tggccatgcttcttgcccc

SEQ ID NO: 1974631 - DNA, 21 bp, Homo sapiens
tggccatgcttcttgcccctt

SEQ ID NO: 1974632 - DNA, 17 bp, Homo sapiens
tggccatgtcgcctgcc

SEQ ID NO: 1974633 - DNA, 22 bp, Homo sapiens
tggccccagcccgacaggcatg

SEQ ID NO: 1974634 - DNA, 12 bp, Homo sapiens
tggccccagggt

SEQ ID NO: 1974635 - DNA, 15 bp, Homo sapiens
tggccccagggttga

SEQ ID NO: 1974636 - DNA, 16 bp, Homo sapiens
tggccccaggtgccac

SEQ ID NO: 1974637 - DNA, 14 bp, Homo sapiens
tggcccccctccag

SEQ ID NO: 1974638 - DNA, 14 bp, Homo sapiens
tggccccctgtgcc

SEQ ID NO: 1974639 - DNA, 17 bp, Homo sapiens
tggccccctgtgccagc

SEQ ID NO: 1974640 - DNA, 19 bp, Homo sapiens
tggccccctgtgccagctc

SEQ ID NO: 1974641 - DNA, 20 bp, Homo sapiens
tggccccctgtgccagctca

SEQ ID NO: 1974642 - DNA, 21 bp, Homo sapiens
tggccccctgtgccagctcag

SEQ ID NO: 1974643 - DNA, 15 bp, Homo sapiens
tggccccgcagtgcc

SEQ ID NO: 1974644 - DNA, 20 bp, Homo sapiens
tggccccgggctctggccac

SEQ ID NO: 1974645 - DNA, 23 bp, Homo sapiens
tggccccgggctctggccaccct

SEQ ID NO: 1974646 - DNA, 20 bp, Homo sapiens
tggcccctcacctgggcctt

SEQ ID NO: 1974647 - DNA, 19 bp, Homo sapiens
tggcccctgcccccaaagg

SEQ ID NO: 1974648 - DNA, 20 bp, Homo sapiens
tggcccctgcccggctgcgg

SEQ ID NO: 1974649 - DNA, 21 bp, Homo sapiens
tggcccctgcccggctgcgga

SEQ ID NO: 1974650 - DNA, 18 bp, Homo sapiens
tggccctgccctctcctt

SEQ ID NO: 1974651 - DNA, 13 bp, Homo sapiens
tggccctggggtc

SEQ ID NO: 1974652 - DNA, 13 bp, Homo sapiens
tggcccttcctgg

SEQ ID NO: 1974653 - DNA, 16 bp, Homo sapiens
tggcccttcctggaca

SEQ ID NO: 1974654 - DNA, 19 bp, Homo sapiens
tggccgcaagcgcagggag

SEQ ID NO: 1974655 - DNA, 15 bp, Homo sapiens
tggccgcctccagga

SEQ ID NO: 1974656 - DNA, 17 bp, Homo sapiens
tggccgggtgcggtggc

SEQ ID NO: 1974657 - DNA, 22 bp, Homo sapiens
tggccgtggtccagctcttggc

SEQ ID NO: 1974658 - DNA, 14 bp, Homo sapiens
tggcctatgcacat

SEQ ID NO: 1974659 - DNA, 15 bp, Homo sapiens
tggcctcaaagcaag

SEQ ID NO: 1974660 - DNA, 18 bp, Homo sapiens
tggcctcacttccctggg

SEQ ID NO: 1974661 - DNA, 22 bp, Homo sapiens
tggcctcacttccctgggaact

SEQ ID NO: 1974662 - DNA, 17 bp, Homo sapiens
tggcctcagcaggaacc

SEQ ID NO: 1974663 - DNA, 13 bp, Homo sapiens
tggcctcagccct

SEQ ID NO: 1974664 - DNA, 21 bp, Homo sapiens
tggcctccacagttcgacctg

SEQ ID NO: 1974665 - DNA, 17 bp, Homo sapiens
tggcctcccaataaagc

SEQ ID NO: 1974666 - DNA, 21 bp, Homo sapiens
tggcctcctgcctctactggg

SEQ ID NO: 1974667 - DNA, 14 bp, Homo sapiens
tggcctcgcctggg

SEQ ID NO: 1974668 - DNA, 16 bp, Homo sapiens
tggcctcgcctgggcc

SEQ ID NO: 1974669 - DNA, 17 bp, Homo sapiens
tggcctcgcctgggccc

SEQ ID NO: 1974670 - DNA, 22 bp, Homo sapiens
tggcctctagaacacccactgg

SEQ ID NO: 1974671 - DNA, 14 bp, Homo sapiens
tggcctgagctggg

SEQ ID NO: 1974672 - DNA, 20 bp, Homo sapiens
tggcctgcctcccagccctg

SEQ ID NO: 1974673 - DNA, 22 bp, Homo sapiens
tggcctgctgggctctccacct

SEQ ID NO: 1974674 - DNA, 13 bp, Homo sapiens
tggcctggccggc

SEQ ID NO: 1974675 - DNA, 15 bp, Homo sapiens
tggcctggctctcct

SEQ ID NO: 1974676 - DNA, 17 bp, Homo sapiens
tggcctgtggcaggcct

SEQ ID NO: 1974677 - DNA, 16 bp, Homo sapiens
tggcctgtgtcactca

SEQ ID NO: 1974678 - DNA, 15 bp, Homo sapiens
tggcctgtgtccagc

SEQ ID NO: 1974679 - DNA, 22 bp, Homo sapiens
tggcctgtgtccagcagctgcg

SEQ ID NO: 1974680 - DNA, 21 bp, Homo sapiens
tggccttccccttttgcctgg

SEQ ID NO: 1974681 - DNA, 22 bp, Homo sapiens
tggccttccccttttgcctggc

SEQ ID NO: 1974682 - DNA, 17 bp, Homo sapiens
tggccttgtcaggaccc

SEQ ID NO: 1974683 - DNA, 18 bp, Homo sapiens
tggccttgtcaggaccca

SEQ ID NO: 1974684 - DNA, 21 bp, Homo sapiens
tggccttgtcaggacccaggc

SEQ ID NO: 1974685 - DNA, 23 bp, Homo sapiens
tggccttgtcaggacccaggccg

SEQ ID NO: 1974686 - DNA, 12 bp, Homo sapiens
tggcctttatta

SEQ ID NO: 1974687 - DNA, 15 bp, Homo sapiens
tggcgagaggagagg

SEQ ID NO: 1974688 - DNA, 16 bp, Homo sapiens
tggcgagaggagagga

SEQ ID NO: 1974689 - DNA, 17 bp, Homo sapiens
tggcgattccctctcac

SEQ ID NO: 1974690 - DNA, 20 bp, Homo sapiens
tggcgcgggaggcaccagct

SEQ ID NO: 1974691 - DNA, 21 bp, Homo sapiens
tggcggctactcagcagccct

SEQ ID NO: 1974692 - DNA, 22 bp, Homo sapiens
tggcggctactcagcagccctc

SEQ ID NO: 1974693 - DNA, 13 bp, Homo sapiens
tggcggcttcctg

SEQ ID NO: 1974694 - DNA, 17 bp, Homo sapiens
tggcgggcgcctgtagt

SEQ ID NO: 1974695 - DNA, 14 bp, Homo sapiens
tggcggggcaggag

SEQ ID NO: 1974696 - DNA, 15 bp, Homo sapiens
tggcggggcaggagg

SEQ ID NO: 1974697 - DNA, 13 bp, Homo sapiens
tggcggtgcctgg

SEQ ID NO: 1974698 - DNA, 15 bp, Homo sapiens
tggcgtaatgggcct

SEQ ID NO: 1974699 - DNA, 18 bp, Homo sapiens
tggcgtaatgggcctgcc

SEQ ID NO: 1974700 - DNA, 15 bp, Homo sapiens
tggctactctgtgcc

SEQ ID NO: 1974701 - DNA, 16 bp, Homo sapiens
tggctactctgtgcca

SEQ ID NO: 1974702 - DNA, 23 bp, Homo sapiens
tggctactctgtgccagagcctg

SEQ ID NO: 1974703 - DNA, 18 bp, Homo sapiens
tggctatcctagagaggc

SEQ ID NO: 1974704 - DNA, 18 bp, Homo sapiens
tggctcaagtcctctttt

SEQ ID NO: 1974705 - DNA, 13 bp, Homo sapiens
tggctcaggcaag

SEQ ID NO: 1974706 - DNA, 12 bp, Homo sapiens
tggctcaggcag

SEQ ID NO: 1974707 - DNA, 13 bp, Homo sapiens
tggctccacatcc

SEQ ID NO: 1974708 - DNA, 20 bp, Homo sapiens
tggctcccacaggcccttcc

SEQ ID NO: 1974709 - DNA, 19 bp, Homo sapiens
tggctccccacgagtcacc

SEQ ID NO: 1974710 - DNA, 13 bp, Homo sapiens
tggctcctccagg

SEQ ID NO: 1974711 - DNA, 19 bp, Homo sapiens
tggctcctcccggtgccca

SEQ ID NO: 1974712 - DNA, 17 bp, Homo sapiens
tggctcctgccactgac

SEQ ID NO: 1974713 - DNA, 15 bp, Homo sapiens
tggctcctgccttga

SEQ ID NO: 1974714 - DNA, 15 bp, Homo sapiens
tggctcctgtttcca

SEQ ID NO: 1974715 - DNA, 16 bp, Homo sapiens
tggctctcagaaggta

SEQ ID NO: 1974716 - DNA, 23 bp, Homo sapiens
tggctctgcaatgggcactggga

SEQ ID NO: 1974717 - DNA, 17 bp, Homo sapiens
tggctctgccagtcggt

SEQ ID NO: 1974718 - DNA, 19 bp, Homo sapiens
tggctcttctaacctcagc

SEQ ID NO: 1974719 - DNA, 23 bp, Homo sapiens
tggctgaaataaaagcctctggt

SEQ ID NO: 1974720 - DNA, 20 bp, Homo sapiens
tggctgacccagtccctggg

SEQ ID NO: 1974721 - DNA, 21 bp, Homo sapiens
tggctgacccagtccctgggg

SEQ ID NO: 1974722 - DNA, 22 bp, Homo sapiens
tggctgaccccaaagagcctgg

SEQ ID NO: 1974723 - DNA, 16 bp, Homo sapiens
tggctgactttgctct

SEQ ID NO: 1974724 - DNA, 15 bp, Homo sapiens
tggctgagggcagtt

SEQ ID NO: 1974725 - DNA, 22 bp, Homo sapiens
tggctgagggcagttcgcagcc

SEQ ID NO: 1974726 - DNA, 22 bp, Homo sapiens
tggctgagtggaatgcagggaa

SEQ ID NO: 1974727 - DNA, 14 bp, Homo sapiens
tggctgcagggagt

SEQ ID NO: 1974728 - DNA, 22 bp, Homo sapiens
tggctgccaggcgttggtgcca

SEQ ID NO: 1974729 - DNA, 17 bp, Homo sapiens
tggctgctgacaggatg

SEQ ID NO: 1974730 - DNA, 19 bp, Homo sapiens
tggctggatgaaattttct

SEQ ID NO: 1974731 - DNA, 23 bp, Homo sapiens
tggctggcagctgagagccctgc

SEQ ID NO: 1974732 - DNA, 22 bp, Homo sapiens
tggctggctaactggaagcatg

SEQ ID NO: 1974733 - DNA, 13 bp, Homo sapiens
tggctggctgagg

SEQ ID NO: 1974734 - DNA, 14 bp, Homo sapiens
tggctggctgaggg

SEQ ID NO: 1974735 - DNA, 15 bp, Homo sapiens
tggctggctgagggc

SEQ ID NO: 1974736 - DNA, 18 bp, Homo sapiens
tggctggctgagggcagt

SEQ ID NO: 1974737 - DNA, 14 bp, Homo sapiens
tggctggctgcagt

SEQ ID NO: 1974738 - DNA, 16 bp, Homo sapiens
tggctgggacattttc

SEQ ID NO: 1974739 - DNA, 15 bp, Homo sapiens
tggctggggcagagg

SEQ ID NO: 1974740 - DNA, 16 bp, Homo sapiens
tggctggggcagaggg

SEQ ID NO: 1974741 - DNA, 17 bp, Homo sapiens
tggctgggggcctcagt

SEQ ID NO: 1974742 - DNA, 12 bp, Homo sapiens
tggctgtattca

SEQ ID NO: 1974743 - DNA, 16 bp, Homo sapiens
tggctgtctctgtccc

SEQ ID NO: 1974744 - DNA, 15 bp, Homo sapiens
tggctgtgaggcccc

SEQ ID NO: 1974745 - DNA, 18 bp, Homo sapiens
tggctgtgcctctgcctg

SEQ ID NO: 1974746 - DNA, 17 bp, Homo sapiens
tggctgtggcacagact

SEQ ID NO: 1974747 - DNA, 14 bp, Homo sapiens
tggcttaatgttta

SEQ ID NO: 1974748 - DNA, 15 bp, Homo sapiens
tggcttaatgtttat

SEQ ID NO: 1974749 - DNA, 19 bp, Homo sapiens
tggcttattttttaaaata

SEQ ID NO: 1974750 - DNA, 21 bp, Homo sapiens
tggcttattttttaaaataat

SEQ ID NO: 1974751 - DNA, 17 bp, Homo sapiens
tggcttcaaaatagaga

SEQ ID NO: 1974752 - DNA, 23 bp, Homo sapiens
tggcttccagaaaaccccagcat

SEQ ID NO: 1974753 - DNA, 21 bp, Homo sapiens
tggcttccaggtatctccagg

SEQ ID NO: 1974754 - DNA, 21 bp, Homo sapiens
tggcttcccatccccagcgat

SEQ ID NO: 1974755 - DNA, 17 bp, Homo sapiens
tggcttcccgctcagcc

SEQ ID NO: 1974756 - DNA, 19 bp, Homo sapiens
tggcttcccgctcagccct

SEQ ID NO: 1974757 - DNA, 21 bp, Homo sapiens
tggcttcccgctcagccctcc

SEQ ID NO: 1974758 - DNA, 22 bp, Homo sapiens
tggcttcccgctcagccctccc

SEQ ID NO: 1974759 - DNA, 17 bp, Homo sapiens
tggcttctcctgtgacc

SEQ ID NO: 1974760 - DNA, 14 bp, Homo sapiens
tggcttctggagcc

SEQ ID NO: 1974761 - DNA, 11 bp, Homo sapiens
tggcttctggg

SEQ ID NO: 1974762 - DNA, 14 bp, Homo sapiens
tggcttctgggacc

SEQ ID NO: 1974763 - DNA, 13 bp, Homo sapiens
tggcttggcttta

SEQ ID NO: 1974764 - DNA, 13 bp, Homo sapiens
tggcttggggagc

SEQ ID NO: 1974765 - DNA, 14 bp, Homo sapiens
tggcttggggagca

SEQ ID NO: 1974766 - DNA, 19 bp, Homo sapiens
tggcttgtgattctgggat

SEQ ID NO: 1974767 - DNA, 14 bp, Homo sapiens
tggctttcccttcc

SEQ ID NO: 1974768 - DNA, 14 bp, Homo sapiens
tggcttttcactgc

SEQ ID NO: 1974769 - DNA, 15 bp, Homo sapiens
tggctttttaacatg

SEQ ID NO: 1974770 - DNA, 21 bp, Homo sapiens
tgggaaaaaagttttgatgaa

SEQ ID NO: 1974771 - DNA, 16 bp, Homo sapiens
tgggaaaacagaggaa

SEQ ID NO: 1974772 - DNA, 17 bp, Homo sapiens
tgggaaaacagaggaat

SEQ ID NO: 1974773 - DNA, 20 bp, Homo sapiens
tgggaaaagtgttattattt

SEQ ID NO: 1974774 - DNA, 21 bp, Homo sapiens
tgggaaagcattgtaaatgtg

SEQ ID NO: 1974775 - DNA, 23 bp, Homo sapiens
tgggaaaggaaaaccagggatag

SEQ ID NO: 1974776 - DNA, 19 bp, Homo sapiens
tgggaaaggacccacccat

SEQ ID NO: 1974777 - DNA, 22 bp, Homo sapiens
tgggaaatggtatgagctgagg

SEQ ID NO: 1974778 - DNA, 20 bp, Homo sapiens
tgggaacccaagtccaagca

SEQ ID NO: 1974779 - DNA, 20 bp, Homo sapiens
tgggaaccccgcagcccgtg

SEQ ID NO: 1974780 - DNA, 16 bp, Homo sapiens
tgggaacgtgactgcc

SEQ ID NO: 1974781 - DNA, 19 bp, Homo sapiens
tgggaactccactctcctt

SEQ ID NO: 1974782 - DNA, 16 bp, Homo sapiens
tgggaactctgacaag

SEQ ID NO: 1974783 - DNA, 22 bp, Homo sapiens
tgggaactctgacaagggctga

SEQ ID NO: 1974784 - DNA, 17 bp, Homo sapiens
tgggaactggttcaaga

SEQ ID NO: 1974785 - DNA, 23 bp, Homo sapiens
tgggaagaaagaatgcaagagtg

SEQ ID NO: 1974786 - DNA, 17 bp, Homo sapiens
tgggaagagaagggaag

SEQ ID NO: 1974787 - DNA, 17 bp, Homo sapiens
tgggaagatggtagcag

SEQ ID NO: 1974788 - DNA, 18 bp, Homo sapiens
tgggaagatggtagcaga

SEQ ID NO: 1974789 - DNA, 22 bp, Homo sapiens
tgggaagatggtagcagataaa

SEQ ID NO: 1974790 - DNA, 15 bp, Homo sapiens
tgggaagctgtactc

SEQ ID NO: 1974791 - DNA, 22 bp, Homo sapiens
tgggaagctgtactcagagcag

SEQ ID NO: 1974792 - DNA, 14 bp, Homo sapiens
tgggaaggctaagt

SEQ ID NO: 1974793 - DNA, 17 bp, Homo sapiens
tccaccacccaaaagtc

SEQ ID NO: 1974794 - DNA, 17 bp, Homo sapiens
tccaccatcaaatgctg

SEQ ID NO: 1974795 - DNA, 12 bp, Homo sapiens
tccacccacctc

SEQ ID NO: 1974796 - DNA, 17 bp, Homo sapiens
tccacccaccttggcct

SEQ ID NO: 1974797 - DNA, 12 bp, Homo sapiens
tccacccagcaa

SEQ ID NO: 1974798 - DNA, 17 bp, Homo sapiens
tccacccagcccattct

SEQ ID NO: 1974799 - DNA, 12 bp, Homo sapiens
tccacccaggag

SEQ ID NO: 1974800 - DNA, 13 bp, Homo sapiens
tccacccaggctg

SEQ ID NO: 1974801 - DNA, 17 bp, Homo sapiens
tccacccaggctgcact

SEQ ID NO: 1974802 - DNA, 18 bp, Homo sapiens
tccacccaggctgcactg

SEQ ID NO: 1974803 - DNA, 17 bp, Homo sapiens
tatatacatatgtagac

SEQ ID NO: 1974804 - DNA, 12 bp, Homo sapiens
tatatacatatt

SEQ ID NO: 1974805 - DNA, 18 bp, Homo sapiens
tatatacatattataaat

SEQ ID NO: 1974806 - DNA, 14 bp, Homo sapiens
tatatacatgtgtg

SEQ ID NO: 1974807 - DNA, 17 bp, Homo sapiens
tatatacatgtgtgtat

SEQ ID NO: 1974808 - DNA, 13 bp, Homo sapiens
tatatagagatgt

SEQ ID NO: 1974809 - DNA, 14 bp, Homo sapiens
tatatagagatgtt

SEQ ID NO: 1974810 - DNA, 16 bp, Homo sapiens
tatatagagatgtttt

SEQ ID NO: 1974811 - DNA, 19 bp, Homo sapiens
tatatagagatgtttttaa

SEQ ID NO: 1974812 - DNA, 13 bp, Homo sapiens
tatatagatgtgc

SEQ ID NO: 1974813 - DNA, 18 bp, Homo sapiens
tatatagcagcaaaaata

SEQ ID NO: 1974814 - DNA, 22 bp, Homo sapiens
tatatagcagcaaaaatataaa

SEQ ID NO: 1974815 - DNA, 13 bp, Homo sapiens
tatatagtatatt

SEQ ID NO: 1974816 - DNA, 18 bp, Homo sapiens
tatatagtatatttatac

SEQ ID NO: 1974817 - DNA, 11 bp, Homo sapiens
tatatataaat

SEQ ID NO: 1974818 - DNA, 11 bp, Homo sapiens
tatatatacat

SEQ ID NO: 1974819 - DNA, 12 bp, Homo sapiens
tatatatacata

SEQ ID NO: 1974820 - DNA, 13 bp, Homo sapiens
tatatatagaatc

SEQ ID NO: 1974821 - DNA, 12 bp, Homo sapiens
tatatatagtaa

SEQ ID NO: 1974822 - DNA, 15 bp, Homo sapiens
tatatatatatagta

SEQ ID NO: 1974823 - DNA, 14 bp, Homo sapiens
tatatatatatgta

SEQ ID NO: 1974824 - DNA, 14 bp, Homo sapiens
tatatatatattta

SEQ ID NO: 1974825 - DNA, 13 bp, Homo sapiens
tatatatatgtgt

SEQ ID NO: 1974826 - DNA, 14 bp, Homo sapiens
tatatatcataaag

SEQ ID NO: 1974827 - DNA, 15 bp, Homo sapiens
tatatatcataaagt

SEQ ID NO: 1974828 - DNA, 17 bp, Homo sapiens
tatatatcataaagtat

SEQ ID NO: 1974829 - DNA, 20 bp, Homo sapiens
tatatatctgataaaattgt

SEQ ID NO: 1974830 - DNA, 16 bp, Homo sapiens
tatatatgaagtaagt

SEQ ID NO: 1974831 - DNA, 14 bp, Homo sapiens
tatatatgccttat

SEQ ID NO: 1974832 - DNA, 13 bp, Homo sapiens
tatatatgtacag

SEQ ID NO: 1974833 - DNA, 21 bp, Homo sapiens
tatatatgtacagttatacat

SEQ ID NO: 1974834 - DNA, 14 bp, Homo sapiens
tatatatgtatatg

SEQ ID NO: 1974835 - DNA, 13 bp, Homo sapiens
tatatatgtgcag

SEQ ID NO: 1974836 - DNA, 19 bp, Homo sapiens
tatatatgtgtatatatac

SEQ ID NO: 1974837 - DNA, 21 bp, Homo sapiens
tatatatgtgtatatatacat

SEQ ID NO: 1974838 - DNA, 12 bp, Homo sapiens
tatatatgtgtg

SEQ ID NO: 1974839 - DNA, 18 bp, Homo sapiens
tatatatgtgtgtttaaa

SEQ ID NO: 1974840 - DNA, 12 bp, Homo sapiens
tatatattgtat

SEQ ID NO: 1974841 - DNA, 14 bp, Homo sapiens
tatatatttaaagg

SEQ ID NO: 1974842 - DNA, 14 bp, Homo sapiens
tatatattttaatt

SEQ ID NO: 1974843 - DNA, 14 bp, Homo sapiens
tatatatttttcaa

SEQ ID NO: 1974844 - DNA, 19 bp, Homo sapiens
tatatatttttcaaccagc

SEQ ID NO: 1974845 - DNA, 20 bp, Homo sapiens
tatatatttttcaaccagca

SEQ ID NO: 1974846 - DNA, 21 bp, Homo sapiens
tatatcaaggatgttctggct

SEQ ID NO: 1974847 - DNA, 13 bp, Homo sapiens
tatatcagaaaag

SEQ ID NO: 1974848 - DNA, 14 bp, Homo sapiens
tatatcagaatctg

SEQ ID NO: 1974849 - DNA, 23 bp, Homo sapiens
tatatcagcctgagtctcctgtg

SEQ ID NO: 1974850 - DNA, 13 bp, Homo sapiens
tatatcataaagt

SEQ ID NO: 1974851 - DNA, 15 bp, Homo sapiens
tatatctaatttata

SEQ ID NO: 1974852 - DNA, 17 bp, Homo sapiens
tatatctaatttataca

SEQ ID NO: 1974853 - DNA, 17 bp, Homo sapiens
tatatctatatctctaa

SEQ ID NO: 1974854 - DNA, 18 bp, Homo sapiens
tatatctatatctctaaa

SEQ ID NO: 1974855 - DNA, 15 bp, Homo sapiens
tatatctatcttata

SEQ ID NO: 1974856 - DNA, 12 bp, Homo sapiens
tatatctgaaaa

SEQ ID NO: 1974857 - DNA, 13 bp, Homo sapiens
tatatctgataaa

SEQ ID NO: 1974858 - DNA, 18 bp, Homo sapiens
tatatgaaatgtttcact

SEQ ID NO: 1974859 - DNA, 20 bp, Homo sapiens
tatatgagagaatcacacaa

SEQ ID NO: 1974860 - DNA, 17 bp, Homo sapiens
tatatgctcaaccagaa

SEQ ID NO: 1974861 - DNA, 16 bp, Homo sapiens
tatatggcaagaaagc

SEQ ID NO: 1974862 - DNA, 17 bp, Homo sapiens
tatatgtatatgtatat

SEQ ID NO: 1974863 - DNA, 14 bp, Homo sapiens
tatatgtatgtagt

SEQ ID NO: 1974864 - DNA, 17 bp, Homo sapiens
tatatgtatttattgtc

SEQ ID NO: 1974865 - DNA, 20 bp, Homo sapiens
tatatgtgcagtattttatt

SEQ ID NO: 1974866 - DNA, 14 bp, Homo sapiens
tatatgtgtatata

SEQ ID NO: 1974867 - DNA, 18 bp, Homo sapiens
tatatgtgtatatataca

SEQ ID NO: 1974868 - DNA, 19 bp, Homo sapiens
tatatgtgtatatatacat

SEQ ID NO: 1974869 - DNA, 12 bp, Homo sapiens
tatatgtgtgtg

SEQ ID NO: 1974870 - DNA, 15 bp, Homo sapiens
tatatgtgtgtttaa

SEQ ID NO: 1974871 - DNA, 16 bp, Homo sapiens
tatatgtgtgtttaaa

SEQ ID NO: 1974872 - DNA, 15 bp, Homo sapiens
tatatgttgtaataa

SEQ ID NO: 1974873 - DNA, 19 bp, Homo sapiens
tatattccaccattcacat

SEQ ID NO: 1974874 - DNA, 19 bp, Homo sapiens
tatattgaatatatcagaa

SEQ ID NO: 1974875 - DNA, 17 bp, Homo sapiens
tatattggtaacatcct

SEQ ID NO: 1974876 - DNA, 18 bp, Homo sapiens
tatattggtaacatcctt

SEQ ID NO: 1974877 - DNA, 21 bp, Homo sapiens
tatattggtaacatcctttct

SEQ ID NO: 1974878 - DNA, 21 bp, Homo sapiens
tatattgtatattctggaaaa

SEQ ID NO: 1974879 - DNA, 14 bp, Homo sapiens
tatatttaattgtg

SEQ ID NO: 1974880 - DNA, 21 bp, Homo sapiens
tatatttaattgtgtcatatt

SEQ ID NO: 1974881 - DNA, 19 bp, Homo sapiens
tatatttaatttttacatg

SEQ ID NO: 1974882 - DNA, 21 bp, Homo sapiens
tatatttagaccctgtttcct

SEQ ID NO: 1974883 - DNA, 21 bp, Homo sapiens
tatatttataactcatcataa

SEQ ID NO: 1974884 - DNA, 22 bp, Homo sapiens
tatatttataactcatcataaa

SEQ ID NO: 1974885 - DNA, 23 bp, Homo sapiens
tatatttataactcatcataaaa

SEQ ID NO: 1974886 - DNA, 17 bp, Homo sapiens
tcaggccagtgccagga

SEQ ID NO: 1974887 - DNA, 23 bp, Homo sapiens
tcaggccagtgccaggacagctg

SEQ ID NO: 1974888 - DNA, 23 bp, Homo sapiens
tcaggcccggctaactctggcac

SEQ ID NO: 1974889 - DNA, 13 bp, Homo sapiens
tcaggcctgtgtg

SEQ ID NO: 1974890 - DNA, 21 bp, Homo sapiens
tcaggcggggaggaggagctg

SEQ ID NO: 1974891 - DNA, 20 bp, Homo sapiens
tcaggctccattaggatttg

SEQ ID NO: 1974892 - DNA, 18 bp, Homo sapiens
tcaggctgagcccagcca

SEQ ID NO: 1974893 - DNA, 23 bp, Homo sapiens
tcaggcttccttggcatcacagg

SEQ ID NO: 1974894 - DNA, 16 bp, Homo sapiens
tcagggaaatggaggg

SEQ ID NO: 1974895 - DNA, 17 bp, Homo sapiens
tcagggaaatggagggt

SEQ ID NO: 1974896 - DNA, 19 bp, Homo sapiens
tcagggaaatggagggtgg

SEQ ID NO: 1974897 - DNA, 22 bp, Homo sapiens
tcagggaatttcaggaactaga

SEQ ID NO: 1974898 - DNA, 21 bp, Homo sapiens
tcagggacagagacacctgca

SEQ ID NO: 1974899 - DNA, 15 bp, Homo sapiens
tcagggaggtcattt

SEQ ID NO: 1974900 - DNA, 15 bp, Homo sapiens
tcagggatcttgcat

SEQ ID NO: 1974901 - DNA, 21 bp, Homo sapiens
tcagggcaactcggagagggc

SEQ ID NO: 1974902 - DNA, 14 bp, Homo sapiens
tcagggcaggcttg

SEQ ID NO: 1974903 - DNA, 16 bp, Homo sapiens
tcagggccagaaggag

SEQ ID NO: 1974904 - DNA, 19 bp, Homo sapiens
tcagggcctgagtgcttta

SEQ ID NO: 1974905 - DNA, 23 bp, Homo sapiens
tcagggcgataaaactaaatata

SEQ ID NO: 1974906 - DNA, 24 bp, Homo sapiens
tcagggctggaaaagtcacacaga

SEQ ID NO: 1974907 - DNA, 17 bp, Homo sapiens
tcagggtgaatcagatg

SEQ ID NO: 1974908 - DNA, 15 bp, Homo sapiens
tcagggtgggaagaa

SEQ ID NO: 1974909 - DNA, 19 bp, Homo sapiens
tcagggtgggaagaaagaa

SEQ ID NO: 1974910 - DNA, 17 bp, Homo sapiens
tcagggttggcccctgc

SEQ ID NO: 1974911 - DNA, 16 bp, Homo sapiens
tcaggtaacaggcaga

SEQ ID NO: 1974912 - DNA, 15 bp, Homo sapiens
tcaggtaggcccttg

SEQ ID NO: 1974913 - DNA, 17 bp, Homo sapiens
tcaggtaggcccttgtc

SEQ ID NO: 1974914 - DNA, 14 bp, Homo sapiens
tcaggtagtactgg

SEQ ID NO: 1974915 - DNA, 13 bp, Homo sapiens
tcaggtgccactc

SEQ ID NO: 1974916 - DNA, 21 bp, Homo sapiens
tcaggtgccactccctgagct

SEQ ID NO: 1974917 - DNA, 13 bp, Homo sapiens
tcaggtgctgcca

SEQ ID NO: 1974918 - DNA, 18 bp, Homo sapiens
tcaggtgctgccatccag

SEQ ID NO: 1974919 - DNA, 14 bp, Homo sapiens
tcaggtggggcagc

SEQ ID NO: 1974920 - DNA, 16 bp, Homo sapiens
tcaggtggggcagctt

SEQ ID NO: 1974921 - DNA, 21 bp, Homo sapiens
tcaggtggggcagcttgaggg

SEQ ID NO: 1974922 - DNA, 23 bp, Homo sapiens
tcaggttgacagtcccttgctga

SEQ ID NO: 1974923 - DNA, 22 bp, Homo sapiens
tcaggttgtctgaagtcactgc

SEQ ID NO: 1974924 - DNA, 15 bp, Homo sapiens
tcaggttgttaatgt

SEQ ID NO: 1974925 - DNA, 18 bp, Homo sapiens
tcaggttgttctgtataa

SEQ ID NO: 1974926 - DNA, 14 bp, Homo sapiens
tcaggttttgtaaa

SEQ ID NO: 1974927 - DNA, 19 bp, Homo sapiens
tcagtaatttagaaatcat

SEQ ID NO: 1974928 - DNA, 14 bp, Homo sapiens
tcagtaatttgagg

SEQ ID NO: 1974929 - DNA, 16 bp, Homo sapiens
tcagtaggtccaaggg

SEQ ID NO: 1974930 - DNA, 18 bp, Homo sapiens
tcagtagtttgagaccag

SEQ ID NO: 1974931 - DNA, 16 bp, Homo sapiens
tcagtataaattgtcg

SEQ ID NO: 1974932 - DNA, 12 bp, Homo sapiens
tcagtatagcat

SEQ ID NO: 1974933 - DNA, 20 bp, Homo sapiens
tcagtattttggagaaatta

SEQ ID NO: 1974934 - DNA, 23 bp, Homo sapiens
tcagtattttggagaaattattt

SEQ ID NO: 1974935 - DNA, 22 bp, Homo sapiens
tcagtcagttcccggagcacag

SEQ ID NO: 1974936 - DNA, 19 bp, Homo sapiens
tcagtccagatgccttcct

SEQ ID NO: 1974937 - DNA, 17 bp, Homo sapiens
tcagtcccatcagagag

SEQ ID NO: 1974938 - DNA, 18 bp, Homo sapiens
tcagtccccacagataac

SEQ ID NO: 1974939 - DNA, 19 bp, Homo sapiens
tcagtccgcctggccggct

SEQ ID NO: 1974940 - DNA, 12 bp, Homo sapiens
tcagtcctggtc

SEQ ID NO: 1974941 - DNA, 15 bp, Homo sapiens
tcagtctagctttta

SEQ ID NO: 1974942 - DNA, 19 bp, Homo sapiens
tcagtctgattcccaagct

SEQ ID NO: 1974943 - DNA, 20 bp, Homo sapiens
tcagtcttctctcactttga

SEQ ID NO: 1974944 - DNA, 19 bp, Homo sapiens
tcagtgacagagttcacta

SEQ ID NO: 1974945 - DNA, 12 bp, Homo sapiens
tcagtgccacta

SEQ ID NO: 1974946 - DNA, 14 bp, Homo sapiens
tcagtgccacttga

SEQ ID NO: 1974947 - DNA, 22 bp, Homo sapiens
tcagtgccacttgacattcctt

SEQ ID NO: 1974948 - DNA, 16 bp, Homo sapiens
tcagtgcctcctggcc

SEQ ID NO: 1974949 - DNA, 17 bp, Homo sapiens
tcagtgccttggagcag

SEQ ID NO: 1974950 - DNA, 12 bp, Homo sapiens
tcagtgctgtgg

SEQ ID NO: 1974951 - DNA, 14 bp, Homo sapiens
tcagtgctgtggcc

SEQ ID NO: 1974952 - DNA, 17 bp, Homo sapiens
tcagtgctgtggcctgg

SEQ ID NO: 1974953 - DNA, 11 bp, Homo sapiens
tcagtggcagc

SEQ ID NO: 1974954 - DNA, 20 bp, Homo sapiens
tcagtgggacaaaccagagc

SEQ ID NO: 1974955 - DNA, 21 bp, Homo sapiens
tcagtgtatggaaataaatgt

SEQ ID NO: 1974956 - DNA, 20 bp, Homo sapiens
tcagtgtcatttatgaaaag

SEQ ID NO: 1974957 - DNA, 19 bp, Homo sapiens
tcagtgtcctcttgctcaa

SEQ ID NO: 1974958 - DNA, 17 bp, Homo sapiens
tcagtgtggagaggggt

SEQ ID NO: 1974959 - DNA, 23 bp, Homo sapiens
tcagtgtggagaggggtgcaccc

SEQ ID NO: 1974960 - DNA, 20 bp, Homo sapiens
tcagtgttccctttcctact

SEQ ID NO: 1974961 - DNA, 22 bp, Homo sapiens
tcagttcaacctggtggcacca

SEQ ID NO: 1974962 - DNA, 19 bp, Homo sapiens
tcagttcctctttgcatgg

SEQ ID NO: 1974963 - DNA, 21 bp, Homo sapiens
tcagttcctctttgcatggaa

SEQ ID NO: 1974964 - DNA, 22 bp, Homo sapiens
tcagttgacaaaatatataatg

SEQ ID NO: 1974965 - DNA, 16 bp, Homo sapiens
tcagttggagaaaatg

SEQ ID NO: 1974966 - DNA, 12 bp, Homo sapiens
tcagttgttttc

SEQ ID NO: 1974967 - DNA, 16 bp, Homo sapiens
tcataaaataaagtat

SEQ ID NO: 1974968 - DNA, 16 bp, Homo sapiens
tcataaacagcattta

SEQ ID NO: 1974969 - DNA, 17 bp, Homo sapiens
tcataaacagcatttat

SEQ ID NO: 1974970 - DNA, 23 bp, Homo sapiens
tcataaacagcatttattacctt

SEQ ID NO: 1974971 - DNA, 13 bp, Homo sapiens
tcataaactgagc

SEQ ID NO: 1974972 - DNA, 13 bp, Homo sapiens
tcataaactgtgt

SEQ ID NO: 1974973 - DNA, 17 bp, Homo sapiens
tcataacaatgtatgtg

SEQ ID NO: 1974974 - DNA, 21 bp, Homo sapiens
tcataacatctttgaaaagaa

SEQ ID NO: 1974975 - DNA, 14 bp, Homo sapiens
tcataaccattccc

SEQ ID NO: 1974976 - DNA, 22 bp, Homo sapiens
tcataacgtaatgattatatga

SEQ ID NO: 1974977 - DNA, 13 bp, Homo sapiens
tcataaggcctgc

SEQ ID NO: 1974978 - DNA, 17 bp, Homo sapiens
tcataaggcctgccctc

SEQ ID NO: 1974979 - DNA, 18 bp, Homo sapiens
tcataaggcctgccctcc

SEQ ID NO: 1974980 - DNA, 14 bp, Homo sapiens
tcatacctctgacc

SEQ ID NO: 1974981 - DNA, 16 bp, Homo sapiens
tcatacttaagcaaaa

SEQ ID NO: 1974982 - DNA, 20 bp, Homo sapiens
tcataggaaaagtacattta

SEQ ID NO: 1974983 - DNA, 20 bp, Homo sapiens
tcataggcggtcatgtgtgc

SEQ ID NO: 1974984 - DNA, 22 bp, Homo sapiens
tcataggcggtcatgtgtgcat

SEQ ID NO: 1974985 - DNA, 17 bp, Homo sapiens
tcatagggtctcttcag

SEQ ID NO: 1974986 - DNA, 21 bp, Homo sapiens
tcatagggtctcttcaggttc

SEQ ID NO: 1974987 - DNA, 21 bp, Homo sapiens
tcatagtatggtggctgggtt

SEQ ID NO: 1974988 - DNA, 18 bp, Homo sapiens
tcatataaacctgatgtt

SEQ ID NO: 1974989 - DNA, 13 bp, Homo sapiens
tcatataaagtat

SEQ ID NO: 1974990 - DNA, 14 bp, Homo sapiens
tcatatattcatgt

SEQ ID NO: 1974991 - DNA, 21 bp, Homo sapiens
tcatatattcatgtaataaat

SEQ ID NO: 1974992 - DNA, 22 bp, Homo sapiens
tcatatattcatgtaataaatc

SEQ ID NO: 1974993 - DNA, 23 bp, Homo sapiens
tcatatatttaagccttttgtgt

SEQ ID NO: 1974994 - DNA, 18 bp, Homo sapiens
tcatatcctttgccccaa

SEQ ID NO: 1974995 - DNA, 15 bp, Homo sapiens
tcatatcttcctcat

SEQ ID NO: 1974996 - DNA, 12 bp, Homo sapiens
tcatatgaaaaa

SEQ ID NO: 1974997 - DNA, 16 bp, Homo sapiens
tcatatgaatgttctt

SEQ ID NO: 1974998 - DNA, 19 bp, Homo sapiens
tcatatgacatgccaccct

SEQ ID NO: 1974999 - DNA, 19 bp, Homo sapiens
tcatattgaatgtttccaa

SEQ ID NO: 1975000 - DNA, 14 bp, Homo sapiens
tcatattgtatgta

SEQ ID NO: 1975001 - DNA, 18 bp, Homo sapiens
tcatattgtatgtaagta

SEQ ID NO: 1975002 - DNA, 16 bp, Homo sapiens
tccagctgcctgggag

SEQ ID NO: 1975003 - DNA, 19 bp, Homo sapiens
tccagctggaattgctgct

SEQ ID NO: 1975004 - DNA, 23 bp, Homo sapiens
tccagctggaattgctgctctct

SEQ ID NO: 1975005 - DNA, 15 bp, Homo sapiens
tccaggaaaactgtt

SEQ ID NO: 1975006 - DNA, 12 bp, Homo sapiens
tccaggaaggca

SEQ ID NO: 1975007 - DNA, 13 bp, Homo sapiens
tccaggaaggcag

SEQ ID NO: 1975008 - DNA, 14 bp, Homo sapiens
tccaggaaggcagc

SEQ ID NO: 1975009 - DNA, 16 bp, Homo sapiens
tccaggaaggcagctg

SEQ ID NO: 1975010 - DNA, 22 bp, Homo sapiens
tccaggaatgcctcctccctgg

SEQ ID NO: 1975011 - DNA, 21 bp, Homo sapiens
tccaggagcaatttgcacatg

SEQ ID NO: 1975012 - DNA, 20 bp, Homo sapiens
tccaggagcacacggccctg

SEQ ID NO: 1975013 - DNA, 18 bp, Homo sapiens
tccaggatcctgcaggaa

SEQ ID NO: 1975014 - DNA, 19 bp, Homo sapiens
tccaggattgaagagcatt

SEQ ID NO: 1975015 - DNA, 18 bp, Homo sapiens
tccaggcatgctggcctc

SEQ ID NO: 1975016 - DNA, 19 bp, Homo sapiens
tccaggcatgctggcctcc

SEQ ID NO: 1975017 - DNA, 14 bp, Homo sapiens
tccaggccactgtg

SEQ ID NO: 1975018 - DNA, 16 bp, Homo sapiens
tccaggccactgtggc

SEQ ID NO: 1975019 - DNA, 20 bp, Homo sapiens
tccaggccactgtggccaga

SEQ ID NO: 1975020 - DNA, 21 bp, Homo sapiens
tccaggccactgtggccagag

SEQ ID NO: 1975021 - DNA, 23 bp, Homo sapiens
tccaggccactgtggccagagct

SEQ ID NO: 1975022 - DNA, 22 bp, Homo sapiens
tccaggcccctgaggactggag

SEQ ID NO: 1975023 - DNA, 15 bp, Homo sapiens
tccaggctcttcctg

SEQ ID NO: 1975024 - DNA, 20 bp, Homo sapiens
tccaggctcttcctggacct

SEQ ID NO: 1975025 - DNA, 23 bp, Homo sapiens
tccaggctctttggggtcagcca

SEQ ID NO: 1975026 - DNA, 14 bp, Homo sapiens
tccaggctgtttct

SEQ ID NO: 1975027 - DNA, 23 bp, Homo sapiens
tccagggaatccgcctgcagagg

SEQ ID NO: 1975028 - DNA, 21 bp, Homo sapiens
tccagggcatccgcagcccag

SEQ ID NO: 1975029 - DNA, 23 bp, Homo sapiens
tccagggccacgtgccaggcccg

SEQ ID NO: 1975030 - DNA, 16 bp, Homo sapiens
tccagggccctgagct

SEQ ID NO: 1975031 - DNA, 17 bp, Homo sapiens
tccagggccctgagctc

SEQ ID NO: 1975032 - DNA, 13 bp, Homo sapiens
tccagggtcttgg

SEQ ID NO: 1975033 - DNA, 21 bp, Homo sapiens
tccaggtcctggtggggcagc

SEQ ID NO: 1975034 - DNA, 15 bp, Homo sapiens
tccaggttcagcttg

SEQ ID NO: 1975035 - DNA, 20 bp, Homo sapiens
tccagtagtggacaacaggt

SEQ ID NO: 1975036 - DNA, 15 bp, Homo sapiens
tccagtatggaagaa

SEQ ID NO: 1975037 - DNA, 15 bp, Homo sapiens
tccagtctcctgaca

SEQ ID NO: 1975038 - DNA, 18 bp, Homo sapiens
tccagtgagcttatcatg

SEQ ID NO: 1975039 - DNA, 16 bp, Homo sapiens
tccagtgaggaaatgg

SEQ ID NO: 1975040 - DNA, 12 bp, Homo sapiens
tccagtgcatgt

SEQ ID NO: 1975041 - DNA, 14 bp, Homo sapiens
tccagtgcatgttg

SEQ ID NO: 1975042 - DNA, 23 bp, Homo sapiens
tccagtgggaggtgagaccacct

SEQ ID NO: 1975043 - DNA, 15 bp, Homo sapiens
tccagtggtaccagc

SEQ ID NO: 1975044 - DNA, 18 bp, Homo sapiens
tccagtggtaccagctca

SEQ ID NO: 1975045 - DNA, 17 bp, Homo sapiens
tccagtgttggctgtgt

SEQ ID NO: 1975046 - DNA, 21 bp, Homo sapiens
tccagtgttggctgtgtgaca

SEQ ID NO: 1975047 - DNA, 23 bp, Homo sapiens
tccagtgttggctgtgtgacaga

SEQ ID NO: 1975048 - DNA, 19 bp, Homo sapiens
tccagttcatgagaatcta

SEQ ID NO: 1975049 - DNA, 15 bp, Homo sapiens
tccagttgcaataaa

SEQ ID NO: 1975050 - DNA, 17 bp, Homo sapiens
tccagttgcaataaaat

SEQ ID NO: 1975051 - DNA, 20 bp, Homo sapiens
tccagttgcaataaaatagt

SEQ ID NO: 1975052 - DNA, 23 bp, Homo sapiens
tccataaccccaggcatcccatc

SEQ ID NO: 1975053 - DNA, 16 bp, Homo sapiens
tccataaggaatgtag

SEQ ID NO: 1975054 - DNA, 23 bp, Homo sapiens
tccataatctggactcctctgtc

SEQ ID NO: 1975055 - DNA, 13 bp, Homo sapiens
tccataatgccac

SEQ ID NO: 1975056 - DNA, 14 bp, Homo sapiens
tccataatgccact

SEQ ID NO: 1975057 - DNA, 20 bp, Homo sapiens
tccataatgtataaagaaca

SEQ ID NO: 1975058 - DNA, 21 bp, Homo sapiens
tccataattatgacagttata

SEQ ID NO: 1975059 - DNA, 20 bp, Homo sapiens
tccataggaatcatgttgga

SEQ ID NO: 1975060 - DNA, 18 bp, Homo sapiens
tccatatattagcattta

SEQ ID NO: 1975061 - DNA, 20 bp, Homo sapiens
tccatatattagcatttagt

SEQ ID NO: 1975062 - DNA, 12 bp, Homo sapiens
tccatattttca

SEQ ID NO: 1975063 - DNA, 13 bp, Homo sapiens
tccatcagctccc

SEQ ID NO: 1975064 - DNA, 13 bp, Homo sapiens
tccatcaggactt

SEQ ID NO: 1975065 - DNA, 20 bp, Homo sapiens
tccatgaagaccacatccac

SEQ ID NO: 1975066 - DNA, 14 bp, Homo sapiens
tccatgattttaca

SEQ ID NO: 1975067 - DNA, 21 bp, Homo sapiens
tccatgcctacagataattta

SEQ ID NO: 1975068 - DNA, 15 bp, Homo sapiens
tccatgcctgagggt

SEQ ID NO: 1975069 - DNA, 12 bp, Homo sapiens
tccatggaggag

SEQ ID NO: 1975070 - DNA, 14 bp, Homo sapiens
tccatggaggaggt

SEQ ID NO: 1975071 - DNA, 16 bp, Homo sapiens
tccatggcaccagccc

SEQ ID NO: 1975072 - DNA, 18 bp, Homo sapiens
tccatggcaccagccccc

SEQ ID NO: 1975073 - DNA, 14 bp, Homo sapiens
tccatggccacccc

SEQ ID NO: 1975074 - DNA, 22 bp, Homo sapiens
tccatggggaagtgctccccac

SEQ ID NO: 1975075 - DNA, 23 bp, Homo sapiens
tccatggggaagtgctccccaca

SEQ ID NO: 1975076 - DNA, 14 bp, Homo sapiens
tccatgtagcagga

SEQ ID NO: 1975077 - DNA, 17 bp, Homo sapiens
tccatgtagcaggactg

SEQ ID NO: 1975078 - DNA, 22 bp, Homo sapiens
tccatgtattcacacacccctc

SEQ ID NO: 1975079 - DNA, 19 bp, Homo sapiens
tccatgtcgcctctgcatt

SEQ ID NO: 1975080 - DNA, 18 bp, Homo sapiens
tccatgtggccccaggtg

SEQ ID NO: 1975081 - DNA, 20 bp, Homo sapiens
tccatgtggccccaggtgcc

SEQ ID NO: 1975082 - DNA, 18 bp, Homo sapiens
tccatgtggttcttcaaa

SEQ ID NO: 1975083 - DNA, 16 bp, Homo sapiens
tccatgtttgtaaaac

SEQ ID NO: 1975084 - DNA, 10 bp, Homo sapiens
tccattccca

SEQ ID NO: 1975085 - DNA, 13 bp, Homo sapiens
tccattcctcagg

SEQ ID NO: 1975086 - DNA, 19 bp, Homo sapiens
tccattgcttattcttgag

SEQ ID NO: 1975087 - DNA, 22 bp, Homo sapiens
tccattgcttattcttgagcac

SEQ ID NO: 1975088 - DNA, 19 bp, Homo sapiens
tccatttcacacaggtcct

SEQ ID NO: 1975089 - DNA, 15 bp, Homo sapiens
tccatttccagttca

SEQ ID NO: 1975090 - DNA, 12 bp, Homo sapiens
tccatttctcaa

SEQ ID NO: 1975091 - DNA, 22 bp, Homo sapiens
tccatttctggcttctagtctg

SEQ ID NO: 1975092 - DNA, 17 bp, Homo sapiens
tccatttggacaaaatg

SEQ ID NO: 1975093 - DNA, 14 bp, Homo sapiens
tccattttaaaaac

SEQ ID NO: 1975094 - DNA, 19 bp, Homo sapiens
tccatttttactaaagcag

SEQ ID NO: 1975095 - DNA, 15 bp, Homo sapiens
tcccaaacagagggc

SEQ ID NO: 1975096 - DNA, 20 bp, Homo sapiens
tcccaaacagagggccacac

SEQ ID NO: 1975097 - DNA, 21 bp, Homo sapiens
tcccaaagaagttctggtatg

SEQ ID NO: 1975098 - DNA, 13 bp, Homo sapiens
tcccaaccccagg

SEQ ID NO: 1975099 - DNA, 15 bp, Homo sapiens
tcccaaccccagggc

SEQ ID NO: 1975100 - DNA, 16 bp, Homo sapiens
tcccaactcgatgggc

SEQ ID NO: 1975101 - DNA, 22 bp, Homo sapiens
tcccaagagcatcatgcctctg

SEQ ID NO: 1975102 - DNA, 23 bp, Homo sapiens
tcccaagctttgaatacccccag

SEQ ID NO: 1975103 - DNA, 17 bp, Homo sapiens
tcccaaggactttccag

SEQ ID NO: 1975104 - DNA, 22 bp, Homo sapiens
tcccaaggactttccagtgagg

SEQ ID NO: 1975105 - DNA, 14 bp, Homo sapiens
tcccaaggagctga

SEQ ID NO: 1975106 - DNA, 15 bp, Homo sapiens
tcccaaggagctgat

SEQ ID NO: 1975107 - DNA, 20 bp, Homo sapiens
tcccaagtagtagtgtcttc

SEQ ID NO: 1975108 - DNA, 14 bp, Homo sapiens
tcccaataaagctg

SEQ ID NO: 1975109 - DNA, 16 bp, Homo sapiens
tcccaatcagcactga

SEQ ID NO: 1975110 - DNA, 19 bp, Homo sapiens
tcccaatcagcactgaaaa

SEQ ID NO: 1975111 - DNA, 20 bp, Homo sapiens
tcctggggccccgctgggat

SEQ ID NO: 1975112 - DNA, 13 bp, Homo sapiens
tcctggggcctcg

SEQ ID NO: 1975113 - DNA, 21 bp, Homo sapiens
tcctggggcctcggagcctca

SEQ ID NO: 1975114 - DNA, 17 bp, Homo sapiens
tcctgggggatgtgcac

SEQ ID NO: 1975115 - DNA, 22 bp, Homo sapiens
tcctgggtggctactctgtgcc

SEQ ID NO: 1975116 - DNA, 24 bp, Homo sapiens
tcctgggtggctactctgtgccag

SEQ ID NO: 1975117 - DNA, 17 bp, Homo sapiens
tcctggtacagcagggt

SEQ ID NO: 1975118 - DNA, 22 bp, Homo sapiens
tcctggtattatttacaatgca

SEQ ID NO: 1975119 - DNA, 13 bp, Homo sapiens
tcctggtctgtgc

SEQ ID NO: 1975120 - DNA, 20 bp, Homo sapiens
tcctggtcttgagatgtctt

SEQ ID NO: 1975121 - DNA, 18 bp, Homo sapiens
tcctggtgaggcccagcc

SEQ ID NO: 1975122 - DNA, 16 bp, Homo sapiens
tcctggtggggcagct

SEQ ID NO: 1975123 - DNA, 19 bp, Homo sapiens
tcctgtaattttgtagtag

SEQ ID NO: 1975124 - DNA, 23 bp, Homo sapiens
tcctgtacgaacccctcccctcc

SEQ ID NO: 1975125 - DNA, 14 bp, Homo sapiens
tcctgtagcatctt

SEQ ID NO: 1975126 - DNA, 15 bp, Homo sapiens
tcctgtagcatcttc

SEQ ID NO: 1975127 - DNA, 21 bp, Homo sapiens
tcctgtagcatcttctggagt

SEQ ID NO: 1975128 - DNA, 22 bp, Homo sapiens
tcctgtagcatcttctggagtc

SEQ ID NO: 1975129 - DNA, 22 bp, Homo sapiens
tcctgtagttgcgtggactctg

SEQ ID NO: 1975130 - DNA, 16 bp, Homo sapiens
tcctgtataatttaac

SEQ ID NO: 1975131 - DNA, 22 bp, Homo sapiens
tcctgtatttgttcccaagagc

SEQ ID NO: 1975132 - DNA, 17 bp, Homo sapiens
tcctgtcaccctggccc

SEQ ID NO: 1975133 - DNA, 19 bp, Homo sapiens
tcctgtccactctcggggc

SEQ ID NO: 1975134 - DNA, 21 bp, Homo sapiens
tcctgtccactctcggggccc

SEQ ID NO: 1975135 - DNA, 22 bp, Homo sapiens
tcctgtccactctcggggccct

SEQ ID NO: 1975136 - DNA, 13 bp, Homo sapiens
tcctgtccagcag

SEQ ID NO: 1975137 - DNA, 15 bp, Homo sapiens
tcctgtccagcaggt

SEQ ID NO: 1975138 - DNA, 15 bp, Homo sapiens
tcctgtcccagaggt

SEQ ID NO: 1975139 - DNA, 14 bp, Homo sapiens
tcctgtccctaccc

SEQ ID NO: 1975140 - DNA, 13 bp, Homo sapiens
tcctgtccctcac

SEQ ID NO: 1975141 - DNA, 21 bp, Homo sapiens
tcctgtcctcccatcccctgg

SEQ ID NO: 1975142 - DNA, 18 bp, Homo sapiens
tcctgtcctttgttatta

SEQ ID NO: 1975143 - DNA, 22 bp, Homo sapiens
tcctgtcgattagactggacag

SEQ ID NO: 1975144 - DNA, 12 bp, Homo sapiens
tcctgtctgcca

SEQ ID NO: 1975145 - DNA, 17 bp, Homo sapiens
tcctgtctgccagccag

SEQ ID NO: 1975146 - DNA, 15 bp, Homo sapiens
tcctgtgaccccacc

SEQ ID NO: 1975147 - DNA, 23 bp, Homo sapiens
tcctgtgcccctcagagaggcat

SEQ ID NO: 1975148 - DNA, 19 bp, Homo sapiens
tcctgtgctctggaggctg

SEQ ID NO: 1975149 - DNA, 13 bp, Homo sapiens
tcctgtggccagg

SEQ ID NO: 1975150 - DNA, 15 bp, Homo sapiens
tcctgtgggagcctc

SEQ ID NO: 1975151 - DNA, 23 bp, Homo sapiens
tcctgtgtcttgcaatggcagcc

SEQ ID NO: 1975152 - DNA, 24 bp, Homo sapiens
tcctgtgtcttgcaatggcagcct

SEQ ID NO: 1975153 - DNA, 15 bp, Homo sapiens
tcctgtgtgcagtga

SEQ ID NO: 1975154 - DNA, 14 bp, Homo sapiens
tcctgtgtggggag

SEQ ID NO: 1975155 - DNA, 22 bp, Homo sapiens
tcctgtgtggggaggcagctcc

SEQ ID NO: 1975156 - DNA, 23 bp, Homo sapiens
tcctgtgtggggaggcagctcca

SEQ ID NO: 1975157 - DNA, 14 bp, Homo sapiens
tcctgtgtgtgcgc

SEQ ID NO: 1975158 - DNA, 20 bp, Homo sapiens
tcctgttaacgtcatctcag

SEQ ID NO: 1975159 - DNA, 16 bp, Homo sapiens
tcctgttcaccttatg

SEQ ID NO: 1975160 - DNA, 21 bp, Homo sapiens
tcctgttcaccttatgtatta

SEQ ID NO: 1975161 - DNA, 17 bp, Homo sapiens
tccttaagtcagaacag

SEQ ID NO: 1975162 - DNA, 14 bp, Homo sapiens
tccttaatgatccg

SEQ ID NO: 1975163 - DNA, 17 bp, Homo sapiens
tccttaattcactccca

SEQ ID NO: 1975164 - DNA, 14 bp, Homo sapiens
tccttactcctgtg

SEQ ID NO: 1975165 - DNA, 16 bp, Homo sapiens
tccttactcctgtggg

SEQ ID NO: 1975166 - DNA, 15 bp, Homo sapiens
tccttactctgagcc

SEQ ID NO: 1975167 - DNA, 20 bp, Homo sapiens
tccttactctgagcccaggc

SEQ ID NO: 1975168 - DNA, 18 bp, Homo sapiens
tccttagcttagacctca

SEQ ID NO: 1975169 - DNA, 23 bp, Homo sapiens
tccttagcttagacctcagcctg

SEQ ID NO: 1975170 - DNA, 21 bp, Homo sapiens
tccttaggaaaatgcttctgt

SEQ ID NO: 1975171 - DNA, 22 bp, Homo sapiens
tccttaggaaaatgcttctgtt

SEQ ID NO: 1975172 - DNA, 16 bp, Homo sapiens
tccttataagaattaa

SEQ ID NO: 1975173 - DNA, 14 bp, Homo sapiens
tccttatttatcaa

SEQ ID NO: 1975174 - DNA, 21 bp, Homo sapiens
tccttcaaagtttaataaatt

SEQ ID NO: 1975175 - DNA, 21 bp, Homo sapiens
tccttcaagaactctgggctg

SEQ ID NO: 1975176 - DNA, 23 bp, Homo sapiens
tccttcaagaactctgggctgct

SEQ ID NO: 1975177 - DNA, 18 bp, Homo sapiens
tccttcaagttagctcag

SEQ ID NO: 1975178 - DNA, 20 bp, Homo sapiens
tccttcaagttagctcagga

SEQ ID NO: 1975179 - DNA, 19 bp, Homo sapiens
tccttcaccagagcccatg

SEQ ID NO: 1975180 - DNA, 16 bp, Homo sapiens
tccttcactcatccag

SEQ ID NO: 1975181 - DNA, 11 bp, Homo sapiens
tccttcatttc

SEQ ID NO: 1975182 - DNA, 13 bp, Homo sapiens
tccttccaggccc

SEQ ID NO: 1975183 - DNA, 20 bp, Homo sapiens
tccttcccaggagtggagga

SEQ ID NO: 1975184 - DNA, 9 bp, Homo sapiens
tccttcccc

SEQ ID NO: 1975185 - DNA, 18 bp, Homo sapiens
tccttcccccatcccctt

SEQ ID NO: 1975186 - DNA, 9 bp, Homo sapiens
tccttccct

SEQ ID NO: 1975187 - DNA, 14 bp, Homo sapiens
tccttccctggctt

SEQ ID NO: 1975188 - DNA, 14 bp, Homo sapiens
tccttccctgggaa

SEQ ID NO: 1975189 - DNA, 15 bp, Homo sapiens
tccttccctgggaag

SEQ ID NO: 1975190 - DNA, 16 bp, Homo sapiens
tccttccgctccttta

SEQ ID NO: 1975191 - DNA, 14 bp, Homo sapiens
tccttccttccctg

SEQ ID NO: 1975192 - DNA, 16 bp, Homo sapiens
tccttccttccctggc

SEQ ID NO: 1975193 - DNA, 21 bp, Homo sapiens
tccttctcgtttgctctagtc

SEQ ID NO: 1975194 - DNA, 16 bp, Homo sapiens
tccttctctgccccca

SEQ ID NO: 1975195 - DNA, 15 bp, Homo sapiens
tccttctgcacccag

SEQ ID NO: 1975196 - DNA, 18 bp, Homo sapiens
tccttctgcacccagaaa

SEQ ID NO: 1975197 - DNA, 12 bp, Homo sapiens
tccttctgcctt

SEQ ID NO: 1975198 - DNA, 13 bp, Homo sapiens
tccttgagcattt

SEQ ID NO: 1975199 - DNA, 14 bp, Homo sapiens
tccttgcacccctc

SEQ ID NO: 1975200 - DNA, 21 bp, Homo sapiens
tccttgcacccctcactctgg

SEQ ID NO: 1975201 - DNA, 16 bp, Homo sapiens
tccttgctctgcaggc

SEQ ID NO: 1975202 - DNA, 16 bp, Homo sapiens
tccttggagagcagct

SEQ ID NO: 1975203 - DNA, 18 bp, Homo sapiens
tccttggagagcagctgg

SEQ ID NO: 1975204 - DNA, 13 bp, Homo sapiens
tccttggaggaca

SEQ ID NO: 1975205 - DNA, 20 bp, Homo sapiens
tccttggcatcacagggcag

SEQ ID NO: 1975206 - DNA, 14 bp, Homo sapiens
tccttggtgcctgg

SEQ ID NO: 1975207 - DNA, 14 bp, Homo sapiens
tccttgtcaccagc

SEQ ID NO: 1975208 - DNA, 16 bp, Homo sapiens
tccttgtctctcattc

SEQ ID NO: 1975209 - DNA, 22 bp, Homo sapiens
tccttgtggtttatgtcatcat

SEQ ID NO: 1975210 - DNA, 16 bp, Homo sapiens
tccttgttttaagatt

SEQ ID NO: 1975211 - DNA, 23 bp, Homo sapiens
tccttgttttaagattgtaattc

SEQ ID NO: 1975212 - DNA, 17 bp, Homo sapiens
tcctttaaatccttcca

SEQ ID NO: 1975213 - DNA, 15 bp, Homo sapiens
tcctttacctaccac

SEQ ID NO: 1975214 - DNA, 22 bp, Homo sapiens
tcctttagcgcccagttgggtg

SEQ ID NO: 1975215 - DNA, 16 bp, Homo sapiens
tcctttatatttagtg

SEQ ID NO: 1975216 - DNA, 15 bp, Homo sapiens
tcctttatccctgag

SEQ ID NO: 1975217 - DNA, 19 bp, Homo sapiens
tcctttcacaaccttctgt

SEQ ID NO: 1975218 - DNA, 21 bp, Homo sapiens
tcctttcagggaatttcagga

SEQ ID NO: 1975219 - DNA, 11 bp, Homo sapiens
tcctttcctct

SEQ ID NO: 1975220 - DNA, 23 bp, Homo sapiens
tcctttctcagccgcttctgact

SEQ ID NO: 1975221 - DNA, 18 bp, Homo sapiens
tcctttctccagccagca

SEQ ID NO: 1975222 - DNA, 15 bp, Homo sapiens
tcctttctttctaac

SEQ ID NO: 1975223 - DNA, 20 bp, Homo sapiens
tcctttgaatcctctctctg

SEQ ID NO: 1975224 - DNA, 21 bp, Homo sapiens
tcctttgaatcctctctctgt

SEQ ID NO: 1975225 - DNA, 13 bp, Homo sapiens
tcctttgacattt

SEQ ID NO: 1975226 - DNA, 16 bp, Homo sapiens
tcctttgagaaagaaa

SEQ ID NO: 1975227 - DNA, 13 bp, Homo sapiens
tcccaccttggct

SEQ ID NO: 1975228 - DNA, 19 bp, Homo sapiens
tcccaccttggctgcaggg

SEQ ID NO: 1975229 - DNA, 18 bp, Homo sapiens
tcccacgaatttgctggg

SEQ ID NO: 1975230 - DNA, 14 bp, Homo sapiens
tcccacgtgggaga

SEQ ID NO: 1975231 - DNA, 22 bp, Homo sapiens
tcccactaagctttctcctttg

SEQ ID NO: 1975232 - DNA, 12 bp, Homo sapiens
tcccacttgtca

SEQ ID NO: 1975233 - DNA, 17 bp, Homo sapiens
tcccagaaccacactgt

SEQ ID NO: 1975234 - DNA, 14 bp, Homo sapiens
tcccagaagggagt

SEQ ID NO: 1975235 - DNA, 16 bp, Homo sapiens
tcccagagacaggaaa

SEQ ID NO: 1975236 - DNA, 17 bp, Homo sapiens
tcccagagacaggaaaa

SEQ ID NO: 1975237 - DNA, 20 bp, Homo sapiens
tcccagagcttattggccac

SEQ ID NO: 1975238 - DNA, 22 bp, Homo sapiens
tcccagagcttattggccactg

SEQ ID NO: 1975239 - DNA, 14 bp, Homo sapiens
tcccagaggccagg

SEQ ID NO: 1975240 - DNA, 15 bp, Homo sapiens
tcccagaggccagga

SEQ ID NO: 1975241 - DNA, 21 bp, Homo sapiens
tcccagaggttatctgcctgg

SEQ ID NO: 1975242 - DNA, 22 bp, Homo sapiens
tcccagagtcagaggagaagag

SEQ ID NO: 1975243 - DNA, 16 bp, Homo sapiens
tcccagatcctctgct

SEQ ID NO: 1975244 - DNA, 14 bp, Homo sapiens
tcccagatgctggg

SEQ ID NO: 1975245 - DNA, 19 bp, Homo sapiens
tcccagcagaagagggagg

SEQ ID NO: 1975246 - DNA, 22 bp, Homo sapiens
tcccagcagctgggccggccag

SEQ ID NO: 1975247 - DNA, 16 bp, Homo sapiens
tcccagccactcggga

SEQ ID NO: 1975248 - DNA, 22 bp, Homo sapiens
tcccagccactcgggaggctga

SEQ ID NO: 1975249 - DNA, 15 bp, Homo sapiens
tcccagccctatgga

SEQ ID NO: 1975250 - DNA, 16 bp, Homo sapiens
tcccagccctatggat

SEQ ID NO: 1975251 - DNA, 17 bp, Homo sapiens
tcccagccctatggatg

SEQ ID NO: 1975252 - DNA, 18 bp, Homo sapiens
tcccagccctatggatgt

SEQ ID NO: 1975253 - DNA, 19 bp, Homo sapiens
tcccagccctgccaggagg

SEQ ID NO: 1975254 - DNA, 21 bp, Homo sapiens
tcccagccctgccaggaggct

SEQ ID NO: 1975255 - DNA, 16 bp, Homo sapiens
tcccagctacacctga

SEQ ID NO: 1975256 - DNA, 22 bp, Homo sapiens
tcccagctactcaagaggctga

SEQ ID NO: 1975257 - DNA, 16 bp, Homo sapiens
tcccagctactcagaa

SEQ ID NO: 1975258 - DNA, 15 bp, Homo sapiens
tcccagctactcagg

SEQ ID NO: 1975259 - DNA, 17 bp, Homo sapiens
tcccagctactcaggag

SEQ ID NO: 1975260 - DNA, 16 bp, Homo sapiens
tcccagctactcggga

SEQ ID NO: 1975261 - DNA, 21 bp, Homo sapiens
tcccagctctccctctggccc

SEQ ID NO: 1975262 - DNA, 17 bp, Homo sapiens
tcccagctgtgctctgg

SEQ ID NO: 1975263 - DNA, 20 bp, Homo sapiens
tcccagctgtgctctggaca

SEQ ID NO: 1975264 - DNA, 21 bp, Homo sapiens
tcccagctgtgctctggacag

SEQ ID NO: 1975265 - DNA, 15 bp, Homo sapiens
tcccaggagacagtt

SEQ ID NO: 1975266 - DNA, 16 bp, Homo sapiens
tcccaggagacagttc

SEQ ID NO: 1975267 - DNA, 15 bp, Homo sapiens
tcccaggagaccatt

SEQ ID NO: 1975268 - DNA, 19 bp, Homo sapiens
tcccaggaggggcctctga

SEQ ID NO: 1975269 - DNA, 21 bp, Homo sapiens
tcccaggccccatgacctcca

SEQ ID NO: 1975270 - DNA, 23 bp, Homo sapiens
tcccaggccccatgacctccagc

SEQ ID NO: 1975271 - DNA, 16 bp, Homo sapiens
tcccaggcgccccttc

SEQ ID NO: 1975272 - DNA, 20 bp, Homo sapiens
tcccaggcgccccttccccc

SEQ ID NO: 1975273 - DNA, 22 bp, Homo sapiens
tcccaggcttcaccctgaatgg

SEQ ID NO: 1975274 - DNA, 20 bp, Homo sapiens
tcccagggccagggccctgc

SEQ ID NO: 1975275 - DNA, 23 bp, Homo sapiens
tcccagggccagggccctgcaga

SEQ ID NO: 1975276 - DNA, 12 bp, Homo sapiens
tcccaggggacc

SEQ ID NO: 1975277 - DNA, 17 bp, Homo sapiens
tcccaggggaccacacc

SEQ ID NO: 1975278 - DNA, 14 bp, Homo sapiens
tcccagtcatttaa

SEQ ID NO: 1975279 - DNA, 22 bp, Homo sapiens
tcccagtcatttaataaatgtg

SEQ ID NO: 1975280 - DNA, 23 bp, Homo sapiens
tcccagttcaggagtcccaagga

SEQ ID NO: 1975281 - DNA, 14 bp, Homo sapiens
tcccataccatcac

SEQ ID NO: 1975282 - DNA, 16 bp, Homo sapiens
tcccataccatcactg

SEQ ID NO: 1975283 - DNA, 18 bp, Homo sapiens
tcccatccatcagctccc

SEQ ID NO: 1975284 - DNA, 14 bp, Homo sapiens
tcccatccccagcg

SEQ ID NO: 1975285 - DNA, 17 bp, Homo sapiens
tcccatctaagctgcag

SEQ ID NO: 1975286 - DNA, 20 bp, Homo sapiens
tcccatctaagctgcagctt

SEQ ID NO: 1975287 - DNA, 22 bp, Homo sapiens
tcccatctaagctgcagcttcc

SEQ ID NO: 1975288 - DNA, 22 bp, Homo sapiens
tcccatctcctgatttctctga

SEQ ID NO: 1975289 - DNA, 20 bp, Homo sapiens
tcccatctgaaccactttgc

SEQ ID NO: 1975290 - DNA, 20 bp, Homo sapiens
tcccatctgctcctcccatt

SEQ ID NO: 1975291 - DNA, 17 bp, Homo sapiens
tcccatgagcctcagca

SEQ ID NO: 1975292 - DNA, 19 bp, Homo sapiens
tcccatgagcctcagcatc

SEQ ID NO: 1975293 - DNA, 14 bp, Homo sapiens
tcccatgatccaga

SEQ ID NO: 1975294 - DNA, 21 bp, Homo sapiens
tcccatgatgccgctcttctg

SEQ ID NO: 1975295 - DNA, 15 bp, Homo sapiens
tcccatgctgaatta

SEQ ID NO: 1975296 - DNA, 19 bp, Homo sapiens
tcccatgctgaattatttt

SEQ ID NO: 1975297 - DNA, 18 bp, Homo sapiens
tcccatgggggtgctgca

SEQ ID NO: 1975298 - DNA, 22 bp, Homo sapiens
tcccatgtatttatctctattt

SEQ ID NO: 1975299 - DNA, 18 bp, Homo sapiens
tcccatgtcacctcagct

SEQ ID NO: 1975300 - DNA, 17 bp, Homo sapiens
tcccatgttgcatgcct

SEQ ID NO: 1975301 - DNA, 22 bp, Homo sapiens
tcccattgcatcacctctgtaa

SEQ ID NO: 1975302 - DNA, 18 bp, Homo sapiens
tcccatttccttggaggc

SEQ ID NO: 1975303 - DNA, 22 bp, Homo sapiens
tcccattttgcaaaatttccag

SEQ ID NO: 1975304 - DNA, 22 bp, Homo sapiens
tccccaaaaacctcacccgagg

SEQ ID NO: 1975305 - DNA, 17 bp, Homo sapiens
tccccaaacccatcaga

SEQ ID NO: 1975306 - DNA, 18 bp, Homo sapiens
tccccaaactgtgccctg

SEQ ID NO: 1975307 - DNA, 21 bp, Homo sapiens
tccccaaactgtgccctgcct

SEQ ID NO: 1975308 - DNA, 23 bp, Homo sapiens
tccccaaactgtgccctgccttc

SEQ ID NO: 1975309 - DNA, 14 bp, Homo sapiens
tccccaaaggcatc

SEQ ID NO: 1975310 - DNA, 15 bp, Homo sapiens
tccccaaaggcatcc

SEQ ID NO: 1975311 - DNA, 17 bp, Homo sapiens
tccccacagaactgctt

SEQ ID NO: 1975312 - DNA, 19 bp, Homo sapiens
tccccacccccgctggggg

SEQ ID NO: 1975313 - DNA, 15 bp, Homo sapiens
tccccacctcttcct

SEQ ID NO: 1975314 - DNA, 17 bp, Homo sapiens
tccccacctcttccttc

SEQ ID NO: 1975315 - DNA, 23 bp, Homo sapiens
tccccaccttcaattcctgggcc

SEQ ID NO: 1975316 - DNA, 20 bp, Homo sapiens
tccccaccttccccagactc

SEQ ID NO: 1975317 - DNA, 18 bp, Homo sapiens
tccccacgagtcacctgc

SEQ ID NO: 1975318 - DNA, 14 bp, Homo sapiens
tcctttgcactgag

SEQ ID NO: 1975319 - DNA, 22 bp, Homo sapiens
tcctttgcattccatgatttta

SEQ ID NO: 1975320 - DNA, 21 bp, Homo sapiens
tcctttgttattatcctgcat

SEQ ID NO: 1975321 - DNA, 17 bp, Homo sapiens
tccttttattctgtacc

SEQ ID NO: 1975322 - DNA, 17 bp, Homo sapiens
tccttttgatggggaga

SEQ ID NO: 1975323 - DNA, 22 bp, Homo sapiens
tccttttgatggggagaaaggg

SEQ ID NO: 1975324 - DNA, 16 bp, Homo sapiens
tccttttgctgtcttt

SEQ ID NO: 1975325 - DNA, 14 bp, Homo sapiens
tccttttgtcccca

SEQ ID NO: 1975326 - DNA, 19 bp, Homo sapiens
tccttttgtccccagggcc

SEQ ID NO: 1975327 - DNA, 17 bp, Homo sapiens
tccttttgtgtacagtg

SEQ ID NO: 1975328 - DNA, 18 bp, Homo sapiens
tcctttttcaacttggaa

SEQ ID NO: 1975329 - DNA, 15 bp, Homo sapiens
tcctttttgcagtat

SEQ ID NO: 1975330 - DNA, 23 bp, Homo sapiens
tcctttttgcagtatatttctga

SEQ ID NO: 1975331 - DNA, 12 bp, Homo sapiens
tcgaacaaactg

SEQ ID NO: 1975332 - DNA, 14 bp, Homo sapiens
tcgaacaaactgat

SEQ ID NO: 1975333 - DNA, 16 bp, Homo sapiens
tcgaacaaactgatgc

SEQ ID NO: 1975334 - DNA, 16 bp, Homo sapiens
tcgaaccaaggcagcc

SEQ ID NO: 1975335 - DNA, 19 bp, Homo sapiens
tcgaaccaaggcagcctcc

SEQ ID NO: 1975336 - DNA, 20 bp, Homo sapiens
tcgaaccaaggcagcctcca

SEQ ID NO: 1975337 - DNA, 14 bp, Homo sapiens
tcgaactggctgca

SEQ ID NO: 1975338 - DNA, 15 bp, Homo sapiens
tcgaagcccttccag

SEQ ID NO: 1975339 - DNA, 15 bp, Homo sapiens
tcgaatgacactgtt

SEQ ID NO: 1975340 - DNA, 15 bp, Homo sapiens
tcgaattaatagctt

SEQ ID NO: 1975341 - DNA, 15 bp, Homo sapiens
tcgaccctttctctg

SEQ ID NO: 1975342 - DNA, 20 bp, Homo sapiens
tcgacctgcggctgctgtgt

SEQ ID NO: 1975343 - DNA, 22 bp, Homo sapiens
tcgacctgcggctgctgtgtgc

SEQ ID NO: 1975344 - DNA, 14 bp, Homo sapiens
tcgactcaggatcc

SEQ ID NO: 1975345 - DNA, 16 bp, Homo sapiens
tcgactcaggatccag

SEQ ID NO: 1975346 - DNA, 21 bp, Homo sapiens
tcgactcaggatccagtccct

SEQ ID NO: 1975347 - DNA, 20 bp, Homo sapiens
tcgagcagggtgctgtgggt

SEQ ID NO: 1975348 - DNA, 13 bp, Homo sapiens
tcgagccactgca

SEQ ID NO: 1975349 - DNA, 15 bp, Homo sapiens
tcgagccccctggat

SEQ ID NO: 1975350 - DNA, 13 bp, Homo sapiens
tcgagccctgcag

SEQ ID NO: 1975351 - DNA, 17 bp, Homo sapiens
tcgagcgccctgcagac

SEQ ID NO: 1975352 - DNA, 19 bp, Homo sapiens
tcgagcgccctgcagaccc

SEQ ID NO: 1975353 - DNA, 17 bp, Homo sapiens
tcgaggacaagtgagag

SEQ ID NO: 1975354 - DNA, 22 bp, Homo sapiens
tcgaggcaccggcgctgcaggt

SEQ ID NO: 1975355 - DNA, 20 bp, Homo sapiens
tcgaggctgcagtcagtcat

SEQ ID NO: 1975356 - DNA, 21 bp, Homo sapiens
tcgaggtagagtttgaaggag

SEQ ID NO: 1975357 - DNA, 23 bp, Homo sapiens
tcgaggtaggtggatcacctgag

SEQ ID NO: 1975358 - DNA, 19 bp, Homo sapiens
tcgaggttgccccttcccc

SEQ ID NO: 1975359 - DNA, 15 bp, Homo sapiens
tcgatctgtactgta

SEQ ID NO: 1975360 - DNA, 19 bp, Homo sapiens
tcgatgaagcccaataaac

SEQ ID NO: 1975361 - DNA, 21 bp, Homo sapiens
tcgattagactggacagcttg

SEQ ID NO: 1975362 - DNA, 16 bp, Homo sapiens
tcgattcaaactgctc

SEQ ID NO: 1975363 - DNA, 23 bp, Homo sapiens
tcgcacagattacttcagggctg

SEQ ID NO: 1975364 - DNA, 18 bp, Homo sapiens
tcgcagcaggtgcaagag

SEQ ID NO: 1975365 - DNA, 10 bp, Homo sapiens
tcgcagccac

SEQ ID NO: 1975366 - DNA, 17 bp, Homo sapiens
tcgcagccaccctgagg

SEQ ID NO: 1975367 - DNA, 18 bp, Homo sapiens
tcgcagccaccctgagga

SEQ ID NO: 1975368 - DNA, 14 bp, Homo sapiens
tcgcagtcgcagga

SEQ ID NO: 1975369 - DNA, 10 bp, Homo sapiens
tcgccacacc

SEQ ID NO: 1975370 - DNA, 23 bp, Homo sapiens
tcgccacacccggctccccctgc

SEQ ID NO: 1975371 - DNA, 17 bp, Homo sapiens
tcgcccacaagccttac

SEQ ID NO: 1975372 - DNA, 12 bp, Homo sapiens
tcgcccaggaga

SEQ ID NO: 1975373 - DNA, 12 bp, Homo sapiens
tcgccccaccca

SEQ ID NO: 1975374 - DNA, 13 bp, Homo sapiens
tcgccccaggccc

SEQ ID NO: 1975375 - DNA, 15 bp, Homo sapiens
tcgcccccacacccc

SEQ ID NO: 1975376 - DNA, 15 bp, Homo sapiens
tcgcctgggcccagg

SEQ ID NO: 1975377 - DNA, 16 bp, Homo sapiens
tcgcctgggcccaggc

SEQ ID NO: 1975378 - DNA, 16 bp, Homo sapiens
tcgcctgtgggaagag

SEQ ID NO: 1975379 - DNA, 23 bp, Homo sapiens
tcgccttttaggctcaggacgga

SEQ ID NO: 1975380 - DNA, 22 bp, Homo sapiens
tcgcgcgcagcgcgtgcacagc

SEQ ID NO: 1975381 - DNA, 14 bp, Homo sapiens
tcgctcctgtgtct

SEQ ID NO: 1975382 - DNA, 15 bp, Homo sapiens
tcgctctgctggcct

SEQ ID NO: 1975383 - DNA, 23 bp, Homo sapiens
tcgctctgctggcctggccggca

SEQ ID NO: 1975384 - DNA, 18 bp, Homo sapiens
tcgctgccaggacacctg

SEQ ID NO: 1975385 - DNA, 22 bp, Homo sapiens
tcgctgccaggacacctgcccc

SEQ ID NO: 1975386 - DNA, 16 bp, Homo sapiens
tctacagaggccatgg

SEQ ID NO: 1975387 - DNA, 15 bp, Homo sapiens
tctacatattcttta

SEQ ID NO: 1975388 - DNA, 14 bp, Homo sapiens
tctaccatttcaga

SEQ ID NO: 1975389 - DNA, 14 bp, Homo sapiens
tctacccagagcct

SEQ ID NO: 1975390 - DNA, 23 bp, Homo sapiens
tctacccagagccttctcctgcc

SEQ ID NO: 1975391 - DNA, 18 bp, Homo sapiens
tctacctgccctctctca

SEQ ID NO: 1975392 - DNA, 15 bp, Homo sapiens
tctacgtataaatat

SEQ ID NO: 1975393 - DNA, 15 bp, Homo sapiens
tctacgttctccagc

SEQ ID NO: 1975394 - DNA, 18 bp, Homo sapiens
tctacgttctccagccca

SEQ ID NO: 1975395 - DNA, 20 bp, Homo sapiens
tctacgttctccagcccaca

SEQ ID NO: 1975396 - DNA, 15 bp, Homo sapiens
tctactaaaaataca

SEQ ID NO: 1975397 - DNA, 14 bp, Homo sapiens
tctactcatatata

SEQ ID NO: 1975398 - DNA, 18 bp, Homo sapiens
tctactcatatatatcta

SEQ ID NO: 1975399 - DNA, 19 bp, Homo sapiens
tctactccatgcacatagt

SEQ ID NO: 1975400 - DNA, 19 bp, Homo sapiens
tctactcctacctcagcct

SEQ ID NO: 1975401 - DNA, 17 bp, Homo sapiens
tctactgagacatgact

SEQ ID NO: 1975402 - DNA, 19 bp, Homo sapiens
tctactgggaaggctactt

SEQ ID NO: 1975403 - DNA, 20 bp, Homo sapiens
tctactggtcttgtggaatt

SEQ ID NO: 1975404 - DNA, 22 bp, Homo sapiens
tctactttagaatgagagtgtg

SEQ ID NO: 1975405 - DNA, 14 bp, Homo sapiens
tctacttttaaaga

SEQ ID NO: 1975406 - DNA, 20 bp, Homo sapiens
tctagaaagaaaagaccctg

SEQ ID NO: 1975407 - DNA, 13 bp, Homo sapiens
tctagaacacagg

SEQ ID NO: 1975408 - DNA, 20 bp, Homo sapiens
tctagaacacccactggcca

SEQ ID NO: 1975409 - DNA, 13 bp, Homo sapiens
tctagactttctg

SEQ ID NO: 1975410 - DNA, 15 bp, Homo sapiens
tctagactttctgtt

SEQ ID NO: 1975411 - DNA, 13 bp, Homo sapiens
tctagagaagagg

SEQ ID NO: 1975412 - DNA, 16 bp, Homo sapiens
tctagagaagaggctg

SEQ ID NO: 1975413 - DNA, 20 bp, Homo sapiens
tctagagattttcttggcag

SEQ ID NO: 1975414 - DNA, 21 bp, Homo sapiens
tctagagattttcttggcagt

SEQ ID NO: 1975415 - DNA, 12 bp, Homo sapiens
tctagaggcctc

SEQ ID NO: 1975416 - DNA, 16 bp, Homo sapiens
tctagaggcctcagtt

SEQ ID NO: 1975417 - DNA, 16 bp, Homo sapiens
tctagaggcttccttc

SEQ ID NO: 1975418 - DNA, 23 bp, Homo sapiens
tctagattaccccctcattgttt

SEQ ID NO: 1975419 - DNA, 20 bp, Homo sapiens
tctagccgggccatgctttc

SEQ ID NO: 1975420 - DNA, 13 bp, Homo sapiens
tctagctggcagg

SEQ ID NO: 1975421 - DNA, 17 bp, Homo sapiens
tctagctggcaggacac

SEQ ID NO: 1975422 - DNA, 19 bp, Homo sapiens
tctagctgttgagctgttt

SEQ ID NO: 1975423 - DNA, 18 bp, Homo sapiens
tctagcttcatgcctcag

SEQ ID NO: 1975424 - DNA, 19 bp, Homo sapiens
tctagcttcatgcctcagt

SEQ ID NO: 1975425 - DNA, 18 bp, Homo sapiens
tctaggcatcccagggga

SEQ ID NO: 1975426 - DNA, 17 bp, Homo sapiens
tctaggtaggaaatgtg

SEQ ID NO: 1975427 - DNA, 17 bp, Homo sapiens
tctaggtcctggcttct

SEQ ID NO: 1975428 - DNA, 23 bp, Homo sapiens
tctaggttctaaaaattgtgatc

SEQ ID NO: 1975429 - DNA, 16 bp, Homo sapiens
tctagtcctattctat

SEQ ID NO: 1975430 - DNA, 19 bp, Homo sapiens
tctagtcctattctattgc

SEQ ID NO: 1975431 - DNA, 15 bp, Homo sapiens
tctagtgaagatgtt

SEQ ID NO: 1975432 - DNA, 17 bp, Homo sapiens
tctagttagcaggaaat

SEQ ID NO: 1975433 - DNA, 20 bp, Homo sapiens
tctagttctcaatcactgct

SEQ ID NO: 1975434 - DNA, 17 bp, Homo sapiens
tctagttttttttgtaa

SEQ ID NO: 1975435 - DNA, 15 bp, Homo sapiens
tctataatggaaaca

SEQ ID NO: 1975436 - DNA, 15 bp, Homo sapiens
taaaccctatctgtg

SEQ ID NO: 1975437 - DNA, 17 bp, Homo sapiens
taaaccgctaaaagaaa

SEQ ID NO: 1975438 - DNA, 19 bp, Homo sapiens
taaacctggagatgatgat

SEQ ID NO: 1975439 - DNA, 18 bp, Homo sapiens
taaactaccctccagagt

SEQ ID NO: 1975440 - DNA, 21 bp, Homo sapiens
taaactactgtaattaagtgc

SEQ ID NO: 1975441 - DNA, 23 bp, Homo sapiens
taaactactgtaattaagtgcaa

SEQ ID NO: 1975442 - DNA, 16 bp, Homo sapiens
taaactagtttccagt

SEQ ID NO: 1975443 - DNA, 16 bp, Homo sapiens
taaactataaactact

SEQ ID NO: 1975444 - DNA, 18 bp, Homo sapiens
taaactataaactactgt

SEQ ID NO: 1975445 - DNA, 19 bp, Homo sapiens
taaactataaactactgta

SEQ ID NO: 1975446 - DNA, 20 bp, Homo sapiens
taaactataaactactgtaa

SEQ ID NO: 1975447 - DNA, 14 bp, Homo sapiens
taaactatattttc

SEQ ID NO: 1975448 - DNA, 13 bp, Homo sapiens
taaactatcagtt

SEQ ID NO: 1975449 - DNA, 17 bp, Homo sapiens
taaactatcagtttgtc

SEQ ID NO: 1975450 - DNA, 16 bp, Homo sapiens
taaactcaaaatattt

SEQ ID NO: 1975451 - DNA, 21 bp, Homo sapiens
taaactcaaaatatttgtaca

SEQ ID NO: 1975452 - DNA, 15 bp, Homo sapiens
taaactctaaacatt

SEQ ID NO: 1975453 - DNA, 17 bp, Homo sapiens
taaactgaaaaatgtca

SEQ ID NO: 1975454 - DNA, 15 bp, Homo sapiens
taaactgaagaagga

SEQ ID NO: 1975455 - DNA, 23 bp, Homo sapiens
taaactggggagttataaaaata

SEQ ID NO: 1975456 - DNA, 21 bp, Homo sapiens
taaacttagaataaaattgta

SEQ ID NO: 1975457 - DNA, 22 bp, Homo sapiens
taaacttagtgcggacaagttt

SEQ ID NO: 1975458 - DNA, 17 bp, Homo sapiens
taaacttattcctcctt

SEQ ID NO: 1975459 - DNA, 20 bp, Homo sapiens
taaacttcatggtcatgggt

SEQ ID NO: 1975460 - DNA, 18 bp, Homo sapiens
taaactttagagtagcat

SEQ ID NO: 1975461 - DNA, 12 bp, Homo sapiens
taaagaaaactg

SEQ ID NO: 1975462 - DNA, 17 bp, Homo sapiens
taaagaaagtcgaatta

SEQ ID NO: 1975463 - DNA, 21 bp, Homo sapiens
taaagaaagtcgaattaatag

SEQ ID NO: 1975464 - DNA, 19 bp, Homo sapiens
taaagaacaccctatattt

SEQ ID NO: 1975465 - DNA, 19 bp, Homo sapiens
taaagaactccttattttg

SEQ ID NO: 1975466 - DNA, 21 bp, Homo sapiens
taaagaactccttattttgta

SEQ ID NO: 1975467 - DNA, 23 bp, Homo sapiens
taaagaactccttattttgtatt

SEQ ID NO: 1975468 - DNA, 17 bp, Homo sapiens
taaagaagtaaatttgt

SEQ ID NO: 1975469 - DNA, 15 bp, Homo sapiens
taaagaataatatgc

SEQ ID NO: 1975470 - DNA, 16 bp, Homo sapiens
taaagacagctgacag

SEQ ID NO: 1975471 - DNA, 13 bp, Homo sapiens
taaagacttaaga

SEQ ID NO: 1975472 - DNA, 16 bp, Homo sapiens
taaagacttcatgttc

SEQ ID NO: 1975473 - DNA, 23 bp, Homo sapiens
taaagagcatggaaaaatactgc

SEQ ID NO: 1975474 - DNA, 20 bp, Homo sapiens
taaagaggaaaagtgcaatg

SEQ ID NO: 1975475 - DNA, 12 bp, Homo sapiens
taaagagttatt

SEQ ID NO: 1975476 - DNA, 17 bp, Homo sapiens
taaagatatcagagctc

SEQ ID NO: 1975477 - DNA, 13 bp, Homo sapiens
taaagatgatcta

SEQ ID NO: 1975478 - DNA, 14 bp, Homo sapiens
taaagatggctatt

SEQ ID NO: 1975479 - DNA, 22 bp, Homo sapiens
taaagatgtcaaatatctcaga

SEQ ID NO: 1975480 - DNA, 16 bp, Homo sapiens
taaagattttttaata

SEQ ID NO: 1975481 - DNA, 12 bp, Homo sapiens
taaagcaacatt

SEQ ID NO: 1975482 - DNA, 16 bp, Homo sapiens
taaagcctgcttttta

SEQ ID NO: 1975483 - DNA, 20 bp, Homo sapiens
taaagcgtagacatatattt

SEQ ID NO: 1975484 - DNA, 21 bp, Homo sapiens
taaagcgtttgcacagatcaa

SEQ ID NO: 1975485 - DNA, 16 bp, Homo sapiens
taaagctgcctgtagt

SEQ ID NO: 1975486 - DNA, 21 bp, Homo sapiens
taaagctgcctgtagttagga

SEQ ID NO: 1975487 - DNA, 15 bp, Homo sapiens
taaagctggtttaat

SEQ ID NO: 1975488 - DNA, 19 bp, Homo sapiens
taaagctggtttaatgttt

SEQ ID NO: 1975489 - DNA, 19 bp, Homo sapiens
taaagcttgcaacaaaatt

SEQ ID NO: 1975490 - DNA, 20 bp, Homo sapiens
taaaggcctcatctccttta

SEQ ID NO: 1975491 - DNA, 11 bp, Homo sapiens
taaaggcctgg

SEQ ID NO: 1975492 - DNA, 13 bp, Homo sapiens
taaaggcttttgg

SEQ ID NO: 1975493 - DNA, 17 bp, Homo sapiens
taaaggtagatcatctt

SEQ ID NO: 1975494 - DNA, 17 bp, Homo sapiens
taaaggtggtatgtgtg

SEQ ID NO: 1975495 - DNA, 22 bp, Homo sapiens
taaaggtggtatgtgtgtgtat

SEQ ID NO: 1975496 - DNA, 20 bp, Homo sapiens
taaaggttgacaataaatgt

SEQ ID NO: 1975497 - DNA, 15 bp, Homo sapiens
taaagtacctgtagt

SEQ ID NO: 1975498 - DNA, 19 bp, Homo sapiens
taaagtatatatagaatct

SEQ ID NO: 1975499 - DNA, 15 bp, Homo sapiens
taaagtatcatgcat

SEQ ID NO: 1975500 - DNA, 18 bp, Homo sapiens
taaagtctattgtttgtt

SEQ ID NO: 1975501 - DNA, 22 bp, Homo sapiens
taaagtgtaaatcctttttctt

SEQ ID NO: 1975502 - DNA, 18 bp, Homo sapiens
taaagtgtaataatatga

SEQ ID NO: 1975503 - DNA, 20 bp, Homo sapiens
taaagttgaagctaagattt

SEQ ID NO: 1975504 - DNA, 21 bp, Homo sapiens
taaagttgttcacatatatgt

SEQ ID NO: 1975505 - DNA, 22 bp, Homo sapiens
taaagttgttcgccgcgtggaa

SEQ ID NO: 1975506 - DNA, 18 bp, Homo sapiens
taaagttgtttgtgcctt

SEQ ID NO: 1975507 - DNA, 15 bp, Homo sapiens
taaagtttaaaaaat

SEQ ID NO: 1975508 - DNA, 17 bp, Homo sapiens
taaagtttacagtaaat

SEQ ID NO: 1975509 - DNA, 19 bp, Homo sapiens
taaagtttacagtctttct

SEQ ID NO: 1975510 - DNA, 21 bp, Homo sapiens
taaataaaagaaaaaatatct

SEQ ID NO: 1975511 - DNA, 15 bp, Homo sapiens
taaataaagtatcat

SEQ ID NO: 1975512 - DNA, 16 bp, Homo sapiens
taaataaataaaaata

SEQ ID NO: 1975513 - DNA, 13 bp, Homo sapiens
taaataaatagat

SEQ ID NO: 1975514 - DNA, 16 bp, Homo sapiens
taaataaatcattaat

SEQ ID NO: 1975515 - DNA, 22 bp, Homo sapiens
taaataaatgtatcttattcac

SEQ ID NO: 1975516 - DNA, 18 bp, Homo sapiens
taaataaatgtcattaaa

SEQ ID NO: 1975517 - DNA, 14 bp, Homo sapiens
taaataaattcaaa

SEQ ID NO: 1975518 - DNA, 18 bp, Homo sapiens
taaataaattcaaaccat

SEQ ID NO: 1975519 - DNA, 15 bp, Homo sapiens
taaataaattgtttg

SEQ ID NO: 1975520 - DNA, 13 bp, Homo sapiens
gttgagctgtttt

SEQ ID NO: 1975521 - DNA, 18 bp, Homo sapiens
gttgaggggctcctggaa

SEQ ID NO: 1975522 - DNA, 23 bp, Homo sapiens
gttgaggtggaagccctccttcc

SEQ ID NO: 1975523 - DNA, 19 bp, Homo sapiens
gttgagtacagtgaggagg

SEQ ID NO: 1975524 - DNA, 21 bp, Homo sapiens
gttgagtctcctctctgagac

SEQ ID NO: 1975525 - DNA, 21 bp, Homo sapiens
gttgataaattccactggact

SEQ ID NO: 1975526 - DNA, 15 bp, Homo sapiens
gttgattcccagcat

SEQ ID NO: 1975527 - DNA, 14 bp, Homo sapiens
gttgcaaccactgc

SEQ ID NO: 1975528 - DNA, 17 bp, Homo sapiens
gttgcaaggccgctgtt

SEQ ID NO: 1975529 - DNA, 16 bp, Homo sapiens
gttgcaccatctgctt

SEQ ID NO: 1975530 - DNA, 23 bp, Homo sapiens
gttgcacctcaggcagaggatgt

SEQ ID NO: 1975531 - DNA, 18 bp, Homo sapiens
gttgccaactaagccctc

SEQ ID NO: 1975532 - DNA, 15 bp, Homo sapiens
gttgccatgaggcct

SEQ ID NO: 1975533 - DNA, 12 bp, Homo sapiens
gttgcccaggca

SEQ ID NO: 1975534 - DNA, 18 bp, Homo sapiens
gttgcccaggcaggtctt

SEQ ID NO: 1975535 - DNA, 14 bp, Homo sapiens
gttgcccaggctgg

SEQ ID NO: 1975536 - DNA, 15 bp, Homo sapiens
gttgcccaggctggc

SEQ ID NO: 1975537 - DNA, 16 bp, Homo sapiens
gttgcccaggctggcg

SEQ ID NO: 1975538 - DNA, 17 bp, Homo sapiens
gttgcccaggctggcgt

SEQ ID NO: 1975539 - DNA, 21 bp, Homo sapiens
gttgcccaggctggcgtgcag

SEQ ID NO: 1975540 - DNA, 17 bp, Homo sapiens
gttgccccttccccatc

SEQ ID NO: 1975541 - DNA, 16 bp, Homo sapiens
gttgcctaataaacat

SEQ ID NO: 1975542 - DNA, 18 bp, Homo sapiens
gttgcgccactgagacgg

SEQ ID NO: 1975543 - DNA, 16 bp, Homo sapiens
gttgcgggggagctgg

SEQ ID NO: 1975544 - DNA, 17 bp, Homo sapiens
gttgcgggggagctgga

SEQ ID NO: 1975545 - DNA, 19 bp, Homo sapiens
gttgcgggggagctggaaa

SEQ ID NO: 1975546 - DNA, 20 bp, Homo sapiens
gttgcgggggagctggaaat

SEQ ID NO: 1975547 - DNA, 23 bp, Homo sapiens
gttgcgtggactctgcacatgtc

SEQ ID NO: 1975548 - DNA, 22 bp, Homo sapiens
gttgctaagaagcgagcactga

SEQ ID NO: 1975549 - DNA, 14 bp, Homo sapiens
gttgctatttgttg

SEQ ID NO: 1975550 - DNA, 16 bp, Homo sapiens
gttgctcactcaggac

SEQ ID NO: 1975551 - DNA, 22 bp, Homo sapiens
gttgctgattcaagaaacagaa

SEQ ID NO: 1975552 - DNA, 23 bp, Homo sapiens
gttgcttagatgagggtgactgt

SEQ ID NO: 1975553 - DNA, 14 bp, Homo sapiens
gttgcttttctaat

SEQ ID NO: 1975554 - DNA, 18 bp, Homo sapiens
gttggaaatattcatgct

SEQ ID NO: 1975555 - DNA, 18 bp, Homo sapiens
gttggaatcacctggagg

SEQ ID NO: 1975556 - DNA, 17 bp, Homo sapiens
gttggaccagaggaagc

SEQ ID NO: 1975557 - DNA, 16 bp, Homo sapiens
gttggacccgctctgg

SEQ ID NO: 1975558 - DNA, 19 bp, Homo sapiens
gttggagagctagaacctg

SEQ ID NO: 1975559 - DNA, 20 bp, Homo sapiens
gttggagccactcctgtccc

SEQ ID NO: 1975560 - DNA, 21 bp, Homo sapiens
gttggagccactcctgtcccg

SEQ ID NO: 1975561 - DNA, 20 bp, Homo sapiens
gttggatgggaagatggtag

SEQ ID NO: 1975562 - DNA, 20 bp, Homo sapiens
gttggcagagaaggcctctt

SEQ ID NO: 1975563 - DNA, 23 bp, Homo sapiens
gttggccaaagccaaagctaggc

SEQ ID NO: 1975564 - DNA, 13 bp, Homo sapiens
gttggccaggctg

SEQ ID NO: 1975565 - DNA, 14 bp, Homo sapiens
gttggccaggctgg

SEQ ID NO: 1975566 - DNA, 15 bp, Homo sapiens
gttggccaggctggt

SEQ ID NO: 1975567 - DNA, 17 bp, Homo sapiens
gttggccaggctggtct

SEQ ID NO: 1975568 - DNA, 13 bp, Homo sapiens
gttggcccctgcc

SEQ ID NO: 1975569 - DNA, 21 bp, Homo sapiens
gttggcctcgcctgggcccag

SEQ ID NO: 1975570 - DNA, 15 bp, Homo sapiens
gttggctcaggcaga

SEQ ID NO: 1975571 - DNA, 14 bp, Homo sapiens
gttggctggatgaa

SEQ ID NO: 1975572 - DNA, 16 bp, Homo sapiens
gttgggagcactggag

SEQ ID NO: 1975573 - DNA, 15 bp, Homo sapiens
gttgggctggtgtca

SEQ ID NO: 1975574 - DNA, 13 bp, Homo sapiens
gttggggtggggc

SEQ ID NO: 1975575 - DNA, 14 bp, Homo sapiens
gttggggtggggca

SEQ ID NO: 1975576 - DNA, 13 bp, Homo sapiens
gttggtgccactt

SEQ ID NO: 1975577 - DNA, 16 bp, Homo sapiens
gttgtacgtaatgtat

SEQ ID NO: 1975578 - DNA, 15 bp, Homo sapiens
gttgtcaatattaaa

SEQ ID NO: 1975579 - DNA, 16 bp, Homo sapiens
gttgtcaatattaaat

SEQ ID NO: 1975580 - DNA, 23 bp, Homo sapiens
gttgtcaatattaaatacagaca

SEQ ID NO: 1975581 - DNA, 12 bp, Homo sapiens
gttgtccaggaa

SEQ ID NO: 1975582 - DNA, 22 bp, Homo sapiens
gttgtctgaagtcactgcacag

SEQ ID NO: 1975583 - DNA, 23 bp, Homo sapiens
gttgtgactttttagccagtgac

SEQ ID NO: 1975584 - DNA, 19 bp, Homo sapiens
gttgtgagcactctactgc

SEQ ID NO: 1975585 - DNA, 14 bp, Homo sapiens
gttgtggatgctcc

SEQ ID NO: 1975586 - DNA, 12 bp, Homo sapiens
gttgtgggcttt

SEQ ID NO: 1975587 - DNA, 19 bp, Homo sapiens
gttgttaaaactggtttag

SEQ ID NO: 1975588 - DNA, 21 bp, Homo sapiens
gttgttctcctccattgctgt

SEQ ID NO: 1975589 - DNA, 24 bp, Homo sapiens
gttgttgttaatgaaaatgtcaga

SEQ ID NO: 1975590 - DNA, 12 bp, Homo sapiens
gttgttgttctc

SEQ ID NO: 1975591 - DNA, 13 bp, Homo sapiens
gttgtttgtgcct

SEQ ID NO: 1975592 - DNA, 18 bp, Homo sapiens
gttgttttggtgcctgcc

SEQ ID NO: 1975593 - DNA, 23 bp, Homo sapiens
gtttaaaaaaagtatatattcta

SEQ ID NO: 1975594 - DNA, 14 bp, Homo sapiens
gtttaaaaacagga

SEQ ID NO: 1975595 - DNA, 20 bp, Homo sapiens
gtttaaaaacaggaaaaaaa

SEQ ID NO: 1975596 - DNA, 14 bp, Homo sapiens
gtttaaataaagta

SEQ ID NO: 1975597 - DNA, 16 bp, Homo sapiens
gtttaaataaagtatc

SEQ ID NO: 1975598 - DNA, 19 bp, Homo sapiens
gtttaaataaagtatcatg

SEQ ID NO: 1975599 - DNA, 22 bp, Homo sapiens
gtttaaataaagtatcatgcat

SEQ ID NO: 1975600 - DNA, 23 bp, Homo sapiens
gtttaaataaagtatcatgcatt

SEQ ID NO: 1975601 - DNA, 13 bp, Homo sapiens
gtttaaattgtaa

SEQ ID NO: 1975602 - DNA, 12 bp, Homo sapiens
gtttaatattta

SEQ ID NO: 1975603 - DNA, 15 bp, Homo sapiens
gtttaatttaaagcc

SEQ ID NO: 1975604 - DNA, 18 bp, Homo sapiens
gtttacaagtgtatatca

SEQ ID NO: 1975605 - DNA, 19 bp, Homo sapiens
gtttacaagtgtatatcag

SEQ ID NO: 1975606 - DNA, 16 bp, Homo sapiens
gtttacactctttgta

SEQ ID NO: 1975607 - DNA, 13 bp, Homo sapiens
gtttacagaactg

SEQ ID NO: 1975608 - DNA, 13 bp, Homo sapiens
gtttacagtaaat

SEQ ID NO: 1975609 - DNA, 12 bp, Homo sapiens
gtttactgctgt

SEQ ID NO: 1975610 - DNA, 13 bp, Homo sapiens
gtttactgctgtc

SEQ ID NO: 1975611 - DNA, 19 bp, Homo sapiens
gtttactgctgtcattgtc

SEQ ID NO: 1975612 - DNA, 19 bp, Homo sapiens
gtttagaagagcctgactg

SEQ ID NO: 1975613 - DNA, 23 bp, Homo sapiens
gtttagaagtacgtttttgcatt

SEQ ID NO: 1975614 - DNA, 23 bp, Homo sapiens
gtttagatcccatgtcacctcag

SEQ ID NO: 1975615 - DNA, 19 bp, Homo sapiens
gtttaggggaagtatgtgt

SEQ ID NO: 1975616 - DNA, 20 bp, Homo sapiens
gtttatagagggccaagact

SEQ ID NO: 1975617 - DNA, 22 bp, Homo sapiens
gtttatggtattttcgtgcatt

SEQ ID NO: 1975618 - DNA, 13 bp, Homo sapiens
gtttattaacaaa

SEQ ID NO: 1975619 - DNA, 20 bp, Homo sapiens
gtgcccgcctaggagttgag

SEQ ID NO: 1975620 - DNA, 18 bp, Homo sapiens
gtgccctctggatcctgc

SEQ ID NO: 1975621 - DNA, 12 bp, Homo sapiens
gtgccctgcccc

SEQ ID NO: 1975622 - DNA, 12 bp, Homo sapiens
gtgccctgcctt

SEQ ID NO: 1975623 - DNA, 17 bp, Homo sapiens
gtgccgggagaggactc

SEQ ID NO: 1975624 - DNA, 15 bp, Homo sapiens
gtgccgttactctcc

SEQ ID NO: 1975625 - DNA, 16 bp, Homo sapiens
gtgcctaatggagaag

SEQ ID NO: 1975626 - DNA, 20 bp, Homo sapiens
gtgcctcagagcaggctcag

SEQ ID NO: 1975627 - DNA, 19 bp, Homo sapiens
gtgcctcagcctcctaagc

SEQ ID NO: 1975628 - DNA, 13 bp, Homo sapiens
gtgcctcctggcc

SEQ ID NO: 1975629 - DNA, 22 bp, Homo sapiens
gtgcctcgaggcaccggcgctg

SEQ ID NO: 1975630 - DNA, 15 bp, Homo sapiens
gtgcctcgctcccca

SEQ ID NO: 1975631 - DNA, 12 bp, Homo sapiens
gtgcctctgcct

SEQ ID NO: 1975632 - DNA, 13 bp, Homo sapiens
gtgcctctgcctg

SEQ ID NO: 1975633 - DNA, 18 bp, Homo sapiens
gtgcctgccctggaggga

SEQ ID NO: 1975634 - DNA, 14 bp, Homo sapiens
gtgcctgctagagc

SEQ ID NO: 1975635 - DNA, 23 bp, Homo sapiens
gtgcctgctagagcaacccctgt

SEQ ID NO: 1975636 - DNA, 14 bp, Homo sapiens
gtgcctggcaaggc

SEQ ID NO: 1975637 - DNA, 22 bp, Homo sapiens
gtgcctgggtggggctgctcct

SEQ ID NO: 1975638 - DNA, 15 bp, Homo sapiens
gtgcctgtgaggcag

SEQ ID NO: 1975639 - DNA, 13 bp, Homo sapiens
gtgcctgtggggg

SEQ ID NO: 1975640 - DNA, 19 bp, Homo sapiens
gtgccttaaaaggagagaa

SEQ ID NO: 1975641 - DNA, 15 bp, Homo sapiens
gtgccttacctcctg

SEQ ID NO: 1975642 - DNA, 18 bp, Homo sapiens
gtgccttttatagctatt

SEQ ID NO: 1975643 - DNA, 20 bp, Homo sapiens
gtgcgagagaggtgggcagc

SEQ ID NO: 1975644 - DNA, 19 bp, Homo sapiens
gtgcgctcttggtccctgg

SEQ ID NO: 1975645 - DNA, 15 bp, Homo sapiens
gtgcggcaggagcag

SEQ ID NO: 1975646 - DNA, 15 bp, Homo sapiens
gtgcggtggctcacg

SEQ ID NO: 1975647 - DNA, 23 bp, Homo sapiens
gtgcgtctctctttctccctcac

SEQ ID NO: 1975648 - DNA, 13 bp, Homo sapiens
gtgcgtggctgtg

SEQ ID NO: 1975649 - DNA, 15 bp, Homo sapiens
gtgcgtggctgtggc

SEQ ID NO: 1975650 - DNA, 17 bp, Homo sapiens
gtgcgtgttagtgtgtg

SEQ ID NO: 1975651 - DNA, 22 bp, Homo sapiens
gtgctaaatggtcgcccaggag

SEQ ID NO: 1975652 - DNA, 16 bp, Homo sapiens
gtgctaaattttcagt

SEQ ID NO: 1975653 - DNA, 22 bp, Homo sapiens
gtgctacaaaaacacagcaagg

SEQ ID NO: 1975654 - DNA, 16 bp, Homo sapiens
gtgctaggggatgagg

SEQ ID NO: 1975655 - DNA, 17 bp, Homo sapiens
gtgctattctgtgttga

SEQ ID NO: 1975656 - DNA, 18 bp, Homo sapiens
gtgctcacgactcttcct

SEQ ID NO: 1975657 - DNA, 20 bp, Homo sapiens
gtgctcacgactcttcctgc

SEQ ID NO: 1975658 - DNA, 14 bp, Homo sapiens
gtgctcacgctccc

SEQ ID NO: 1975659 - DNA, 21 bp, Homo sapiens
gtgctcacgctcccccgcagt

SEQ ID NO: 1975660 - DNA, 18 bp, Homo sapiens
gtgctcgcccacaaactg

SEQ ID NO: 1975661 - DNA, 18 bp, Homo sapiens
gtgctcgcttctcctcca

SEQ ID NO: 1975662 - DNA, 19 bp, Homo sapiens
gtgctcgcttctcctccag

SEQ ID NO: 1975663 - DNA, 12 bp, Homo sapiens
gtgctcggcagt

SEQ ID NO: 1975664 - DNA, 14 bp, Homo sapiens
gtgctctaggctgc

SEQ ID NO: 1975665 - DNA, 15 bp, Homo sapiens
gtgctctcaccagct

SEQ ID NO: 1975666 - DNA, 16 bp, Homo sapiens
gtgctctggacaggca

SEQ ID NO: 1975667 - DNA, 17 bp, Homo sapiens
gtgctctggacaggcat

SEQ ID NO: 1975668 - DNA, 15 bp, Homo sapiens
gtgctgacggaagcc

SEQ ID NO: 1975669 - DNA, 18 bp, Homo sapiens
gtgctgagcttagccttg

SEQ ID NO: 1975670 - DNA, 12 bp, Homo sapiens
gtgctgaggact

SEQ ID NO: 1975671 - DNA, 23 bp, Homo sapiens
gtgctgagttggtgttgacatgt

SEQ ID NO: 1975672 - DNA, 15 bp, Homo sapiens
gtgctgattcagcct

SEQ ID NO: 1975673 - DNA, 16 bp, Homo sapiens
gtgctgcaggcaaagt

SEQ ID NO: 1975674 - DNA, 12 bp, Homo sapiens
gtgctgccacac

SEQ ID NO: 1975675 - DNA, 21 bp, Homo sapiens
gtgctgccacacttcaggctc

SEQ ID NO: 1975676 - DNA, 19 bp, Homo sapiens
gtgctgccatccaggttca

SEQ ID NO: 1975677 - DNA, 22 bp, Homo sapiens
gtgctgccatccaggttcagct

SEQ ID NO: 1975678 - DNA, 13 bp, Homo sapiens
gtgctgccatgcc

SEQ ID NO: 1975679 - DNA, 14 bp, Homo sapiens
gtgctgccatgcca

SEQ ID NO: 1975680 - DNA, 16 bp, Homo sapiens
gtgctgccatgccact

SEQ ID NO: 1975681 - DNA, 21 bp, Homo sapiens
gtgctgcccgtcttcagccta

SEQ ID NO: 1975682 - DNA, 11 bp, Homo sapiens
gtgctgccctg

SEQ ID NO: 1975683 - DNA, 13 bp, Homo sapiens
gtgctgcttctct

SEQ ID NO: 1975684 - DNA, 16 bp, Homo sapiens
gtgctggagctggctt

SEQ ID NO: 1975685 - DNA, 21 bp, Homo sapiens
gtgctggatattttactacca

SEQ ID NO: 1975686 - DNA, 20 bp, Homo sapiens
gtgctgggattacaggtgta

SEQ ID NO: 1975687 - DNA, 16 bp, Homo sapiens
gtgctgtacccttcca

SEQ ID NO: 1975688 - DNA, 17 bp, Homo sapiens
gtgctgtcctctgaagg

SEQ ID NO: 1975689 - DNA, 14 bp, Homo sapiens
gtgctgtgcctgct

SEQ ID NO: 1975690 - DNA, 16 bp, Homo sapiens
gtgctgtgcctgctag

SEQ ID NO: 1975691 - DNA, 11 bp, Homo sapiens
gtgctgtggcc

SEQ ID NO: 1975692 - DNA, 14 bp, Homo sapiens
gtgctgtggccagg

SEQ ID NO: 1975693 - DNA, 15 bp, Homo sapiens
gtgctgtggccaggg

SEQ ID NO: 1975694 - DNA, 16 bp, Homo sapiens
gtgctgtggcctgggc

SEQ ID NO: 1975695 - DNA, 17 bp, Homo sapiens
gtgctgtgggcagcacc

SEQ ID NO: 1975696 - DNA, 17 bp, Homo sapiens
gtgctgttctggagctg

SEQ ID NO: 1975697 - DNA, 15 bp, Homo sapiens
gtgctgtttgagatg

SEQ ID NO: 1975698 - DNA, 18 bp, Homo sapiens
gtgctgtttgagatgtga

SEQ ID NO: 1975699 - DNA, 19 bp, Homo sapiens
gtgcttaaattatttttat

SEQ ID NO: 1975700 - DNA, 16 bp, Homo sapiens
gtgcttaatgtgaact

SEQ ID NO: 1975701 - DNA, 15 bp, Homo sapiens
gtgcttcaattaata

SEQ ID NO: 1975702 - DNA, 16 bp, Homo sapiens
gtgctttatttatggc

SEQ ID NO: 1975703 - DNA, 20 bp, Homo sapiens
gtgctttcaggtctggggct

SEQ ID NO: 1975704 - DNA, 19 bp, Homo sapiens
gtgcttttcctatttgttt

SEQ ID NO: 1975705 - DNA, 12 bp, Homo sapiens
gtggaaaaatat

SEQ ID NO: 1975706 - DNA, 13 bp, Homo sapiens
gtggaaaaatatt

SEQ ID NO: 1975707 - DNA, 15 bp, Homo sapiens
gtggaaaaatattta

SEQ ID NO: 1975708 - DNA, 14 bp, Homo sapiens
gtggaaagcctctg

SEQ ID NO: 1975709 - DNA, 16 bp, Homo sapiens
gtggaagagcagcctg

SEQ ID NO: 1975710 - DNA, 17 bp, Homo sapiens
gtggaagagcagcctga

SEQ ID NO: 1975711 - DNA, 17 bp, Homo sapiens
gtggaagccctccttcc

SEQ ID NO: 1975712 - DNA, 16 bp, Homo sapiens
gtggaagggggtgtgc

SEQ ID NO: 1975713 - DNA, 13 bp, Homo sapiens
gtggaatataaag

SEQ ID NO: 1975714 - DNA, 15 bp, Homo sapiens
gtggacacagctctt

SEQ ID NO: 1975715 - DNA, 13 bp, Homo sapiens
gtggacacctgcc

SEQ ID NO: 1975716 - DNA, 16 bp, Homo sapiens
gtggacacctgccctg

SEQ ID NO: 1975717 - DNA, 15 bp, Homo sapiens
gtggacagtcctggg

SEQ ID NO: 1975718 - DNA, 18 bp, Homo sapiens
gtggaccaggacaggacc

SEQ ID NO: 1975719 - DNA, 22 bp, Homo sapiens
gtggacccagggatgacatgtc

SEQ ID NO: 1975720 - DNA, 14 bp, Homo sapiens
gtggacctgaagga

SEQ ID NO: 1975721 - DNA, 13 bp, Homo sapiens
gtggaccttcctg

SEQ ID NO: 1975722 - DNA, 17 bp, Homo sapiens
gtggactctgcacatgt

SEQ ID NO: 1975723 - DNA, 14 bp, Homo sapiens
gtggactgcgctgg

SEQ ID NO: 1975724 - DNA, 22 bp, Homo sapiens
gtggagaaataaaaatacctct

SEQ ID NO: 1975725 - DNA, 22 bp, Homo sapiens
gtggagaaattccttgattcac

SEQ ID NO: 1975726 - DNA, 14 bp, Homo sapiens
gtggagagtgagaa

SEQ ID NO: 1975727 - DNA, 23 bp, Homo sapiens
gtggagagtgagaataattgtgt

SEQ ID NO: 1975728 - DNA, 14 bp, Homo sapiens
gtggagagtgttcc

SEQ ID NO: 1975729 - DNA, 18 bp, Homo sapiens
gtggagagtgttcctgtt

SEQ ID NO: 1975730 - DNA, 12 bp, Homo sapiens
gtggaggaaggt

SEQ ID NO: 1975731 - DNA, 16 bp, Homo sapiens
gtggaggagctcagga

SEQ ID NO: 1975732 - DNA, 21 bp, Homo sapiens
gtggaggagctgggcttctgt

SEQ ID NO: 1975733 - DNA, 14 bp, Homo sapiens
gtggaggaggcctg

SEQ ID NO: 1975734 - DNA, 15 bp, Homo sapiens
gtggaggcctgatgc

SEQ ID NO: 1975735 - DNA, 16 bp, Homo sapiens
taacttaatagtattt

SEQ ID NO: 1975736 - DNA, 18 bp, Homo sapiens
taacttcaaatatagaga

SEQ ID NO: 1975737 - DNA, 20 bp, Homo sapiens
taacttcagagaagtcagtt

SEQ ID NO: 1975738 - DNA, 21 bp, Homo sapiens
taacttccttggactcatttt

SEQ ID NO: 1975739 - DNA, 23 bp, Homo sapiens
taacttggagagggacgaagaaa

SEQ ID NO: 1975740 - DNA, 15 bp, Homo sapiens
taacttgtatattcc

SEQ ID NO: 1975741 - DNA, 15 bp, Homo sapiens
taactttatcacatt

SEQ ID NO: 1975742 - DNA, 23 bp, Homo sapiens
taactttcattaaagcatttact

SEQ ID NO: 1975743 - DNA, 16 bp, Homo sapiens
taactttgggcccaga

SEQ ID NO: 1975744 - DNA, 18 bp, Homo sapiens
taacttttgtaagacaaa

SEQ ID NO: 1975745 - DNA, 16 bp, Homo sapiens
taagaaaacaatcaca

SEQ ID NO: 1975746 - DNA, 13 bp, Homo sapiens
taagaaacagagg

SEQ ID NO: 1975747 - DNA, 19 bp, Homo sapiens
taagaaacttttttattta

SEQ ID NO: 1975748 - DNA, 20 bp, Homo sapiens
taagaaacttttttatttaa

SEQ ID NO: 1975749 - DNA, 21 bp, Homo sapiens
taagaaacttttttatttaaa

SEQ ID NO: 1975750 - DNA, 15 bp, Homo sapiens
taagaaagtgcagaa

SEQ ID NO: 1975751 - DNA, 14 bp, Homo sapiens
taagaaccacagaa

SEQ ID NO: 1975752 - DNA, 21 bp, Homo sapiens
taagaagaatgcttaatcaga

SEQ ID NO: 1975753 - DNA, 14 bp, Homo sapiens
taagaagacatgac

SEQ ID NO: 1975754 - DNA, 11 bp, Homo sapiens
taagaagctct

SEQ ID NO: 1975755 - DNA, 16 bp, Homo sapiens
taagaagctctggccc

SEQ ID NO: 1975756 - DNA, 20 bp, Homo sapiens
taagaataggtcattttcta

SEQ ID NO: 1975757 - DNA, 22 bp, Homo sapiens
taagaatgcagattcctgggcc

SEQ ID NO: 1975758 - DNA, 21 bp, Homo sapiens
taagacatgcactatgaggaa

SEQ ID NO: 1975759 - DNA, 16 bp, Homo sapiens
taagaccgtgtcccaa

SEQ ID NO: 1975760 - DNA, 17 bp, Homo sapiens
taagacctccccacccc

SEQ ID NO: 1975761 - DNA, 13 bp, Homo sapiens
taagacgtgaatg

SEQ ID NO: 1975762 - DNA, 19 bp, Homo sapiens
taagacgtgaatgtctcag

SEQ ID NO: 1975763 - DNA, 19 bp, Homo sapiens
taagacttcagtcctggtc

SEQ ID NO: 1975764 - DNA, 14 bp, Homo sapiens
taagacttgacagt

SEQ ID NO: 1975765 - DNA, 13 bp, Homo sapiens
taagagaaagaaa

SEQ ID NO: 1975766 - DNA, 12 bp, Homo sapiens
taagagaaatgg

SEQ ID NO: 1975767 - DNA, 14 bp, Homo sapiens
taagagaagtagaa

SEQ ID NO: 1975768 - DNA, 18 bp, Homo sapiens
taagagaagtagaaatca

SEQ ID NO: 1975769 - DNA, 22 bp, Homo sapiens
taagagaattctaagattgtac

SEQ ID NO: 1975770 - DNA, 18 bp, Homo sapiens
taagagagaaatctgaaa

SEQ ID NO: 1975771 - DNA, 20 bp, Homo sapiens
taagagctagcgctgccgca

SEQ ID NO: 1975772 - DNA, 12 bp, Homo sapiens
taagaggcaggg

SEQ ID NO: 1975773 - DNA, 22 bp, Homo sapiens
taagaggctatttaaaagtata

SEQ ID NO: 1975774 - DNA, 18 bp, Homo sapiens
taagaggctttggcccaa

SEQ ID NO: 1975775 - DNA, 21 bp, Homo sapiens
taagagttagtttctttggga

SEQ ID NO: 1975776 - DNA, 15 bp, Homo sapiens
taagagttgtatgaa

SEQ ID NO: 1975777 - DNA, 13 bp, Homo sapiens
taagataattata

SEQ ID NO: 1975778 - DNA, 17 bp, Homo sapiens
taagatacactcctgct

SEQ ID NO: 1975779 - DNA, 21 bp, Homo sapiens
taagatgagatttgccagcac

SEQ ID NO: 1975780 - DNA, 22 bp, Homo sapiens
taagatggcttatttgtataat

SEQ ID NO: 1975781 - DNA, 13 bp, Homo sapiens
taagattaaagga

SEQ ID NO: 1975782 - DNA, 15 bp, Homo sapiens
taagattaaaggaag

SEQ ID NO: 1975783 - DNA, 18 bp, Homo sapiens
taagattaaaggaaggaa

SEQ ID NO: 1975784 - DNA, 14 bp, Homo sapiens
taagattaaattat

SEQ ID NO: 1975785 - DNA, 16 bp, Homo sapiens
taagattgtacatatg

SEQ ID NO: 1975786 - DNA, 16 bp, Homo sapiens
taagcaaaggaaacca

SEQ ID NO: 1975787 - DNA, 23 bp, Homo sapiens
taagcaaagggagcactgggttg

SEQ ID NO: 1975788 - DNA, 13 bp, Homo sapiens
taagcaaatttca

SEQ ID NO: 1975789 - DNA, 16 bp, Homo sapiens
taagcaaatttcaaaa

SEQ ID NO: 1975790 - DNA, 21 bp, Homo sapiens
taagcaaatttcaaaagacat

SEQ ID NO: 1975791 - DNA, 14 bp, Homo sapiens
taagcagcctttct

SEQ ID NO: 1975792 - DNA, 21 bp, Homo sapiens
taagcaggaaggatggcaagc

SEQ ID NO: 1975793 - DNA, 20 bp, Homo sapiens
taagcatgatcttgttaatg

SEQ ID NO: 1975794 - DNA, 23 bp, Homo sapiens
taagcattcttagactagttgaa

SEQ ID NO: 1975795 - DNA, 15 bp, Homo sapiens
taagcattttactgt

SEQ ID NO: 1975796 - DNA, 18 bp, Homo sapiens
taagccctcgaaccaagg

SEQ ID NO: 1975797 - DNA, 16 bp, Homo sapiens
taagccctgtcgagac

SEQ ID NO: 1975798 - DNA, 16 bp, Homo sapiens
taagcctccctcctcg

SEQ ID NO: 1975799 - DNA, 15 bp, Homo sapiens
taagcctttccataa

SEQ ID NO: 1975800 - DNA, 22 bp, Homo sapiens
taagctcccagggcctgtctca

SEQ ID NO: 1975801 - DNA, 15 bp, Homo sapiens
taagctgcagcttcc

SEQ ID NO: 1975802 - DNA, 18 bp, Homo sapiens
taagctgcagcttcctgt

SEQ ID NO: 1975803 - DNA, 16 bp, Homo sapiens
taagctgctctattgt

SEQ ID NO: 1975804 - DNA, 11 bp, Homo sapiens
taagctgtttc

SEQ ID NO: 1975805 - DNA, 11 bp, Homo sapiens
taagctttatt

SEQ ID NO: 1975806 - DNA, 16 bp, Homo sapiens
taagctttctcctttg

SEQ ID NO: 1975807 - DNA, 17 bp, Homo sapiens
taaggaaaaaaagacaa

SEQ ID NO: 1975808 - DNA, 13 bp, Homo sapiens
taaggaactggaa

SEQ ID NO: 1975809 - DNA, 14 bp, Homo sapiens
taaggaactggaac

SEQ ID NO: 1975810 - DNA, 15 bp, Homo sapiens
tagccgtccatggca

SEQ ID NO: 1975811 - DNA, 16 bp, Homo sapiens
tagccgtccatggcac

SEQ ID NO: 1975812 - DNA, 18 bp, Homo sapiens
tagccgtccatggcacca

SEQ ID NO: 1975813 - DNA, 15 bp, Homo sapiens
tagcctacaaatgtt

SEQ ID NO: 1975814 - DNA, 23 bp, Homo sapiens
tagcctcacttttaatgaacaaa

SEQ ID NO: 1975815 - DNA, 13 bp, Homo sapiens
tagcctgggccag

SEQ ID NO: 1975816 - DNA, 15 bp, Homo sapiens
tagccttctctgttc

SEQ ID NO: 1975817 - DNA, 16 bp, Homo sapiens
tagccttctctgttca

SEQ ID NO: 1975818 - DNA, 20 bp, Homo sapiens
tagccttctctgttcatttc

SEQ ID NO: 1975819 - DNA, 22 bp, Homo sapiens
tagccttctctgttcatttcct

SEQ ID NO: 1975820 - DNA, 22 bp, Homo sapiens
tagccttgcccggattctggga

SEQ ID NO: 1975821 - DNA, 21 bp, Homo sapiens
tagccttgccttttaaaagaa

SEQ ID NO: 1975822 - DNA, 22 bp, Homo sapiens
tagccttgccttttaaaagaaa

SEQ ID NO: 1975823 - DNA, 14 bp, Homo sapiens
tagccttgtgccct

SEQ ID NO: 1975824 - DNA, 18 bp, Homo sapiens
tagccttgtgccctgccc

SEQ ID NO: 1975825 - DNA, 22 bp, Homo sapiens
tagccttgtgccctgcccccat

SEQ ID NO: 1975826 - DNA, 14 bp, Homo sapiens
tagcgagctgctct

SEQ ID NO: 1975827 - DNA, 15 bp, Homo sapiens
tagcgctctcttcca

SEQ ID NO: 1975828 - DNA, 13 bp, Homo sapiens
tagcgttcccaac

SEQ ID NO: 1975829 - DNA, 23 bp, Homo sapiens
tagctaacattttaaataaaaga

SEQ ID NO: 1975830 - DNA, 19 bp, Homo sapiens
tagctaaggaagggaaagg

SEQ ID NO: 1975831 - DNA, 17 bp, Homo sapiens
tagctacactattgcat

SEQ ID NO: 1975832 - DNA, 14 bp, Homo sapiens
tagctagaagtggg

SEQ ID NO: 1975833 - DNA, 14 bp, Homo sapiens
tagctatcagaaga

SEQ ID NO: 1975834 - DNA, 13 bp, Homo sapiens
tagctattactgt

SEQ ID NO: 1975835 - DNA, 14 bp, Homo sapiens
tagctattgcatgt

SEQ ID NO: 1975836 - DNA, 23 bp, Homo sapiens
tagctattgcatgtaaaatgcag

SEQ ID NO: 1975837 - DNA, 19 bp, Homo sapiens
tagctatttttatggaatt

SEQ ID NO: 1975838 - DNA, 20 bp, Homo sapiens
tagctcaggtgtccctgcac

SEQ ID NO: 1975839 - DNA, 20 bp, Homo sapiens
tagctccaccctcaccagga

SEQ ID NO: 1975840 - DNA, 23 bp, Homo sapiens
tagctcccgagctactctcttgc

SEQ ID NO: 1975841 - DNA, 17 bp, Homo sapiens
tagctgacatctcctct

SEQ ID NO: 1975842 - DNA, 18 bp, Homo sapiens
tagctgacatctcctcta

SEQ ID NO: 1975843 - DNA, 14 bp, Homo sapiens
tagctgatgaaact

SEQ ID NO: 1975844 - DNA, 12 bp, Homo sapiens
tagctgcagaac

SEQ ID NO: 1975845 - DNA, 12 bp, Homo sapiens
tagctgctttaa

SEQ ID NO: 1975846 - DNA, 19 bp, Homo sapiens
tagctggaactacaggctc

SEQ ID NO: 1975847 - DNA, 14 bp, Homo sapiens
tagctgggactaca

SEQ ID NO: 1975848 - DNA, 18 bp, Homo sapiens
tagctgggactacaggtg

SEQ ID NO: 1975849 - DNA, 11 bp, Homo sapiens
tagctgtaaat

SEQ ID NO: 1975850 - DNA, 20 bp, Homo sapiens
tagctgtaaatacatgtgtg

SEQ ID NO: 1975851 - DNA, 14 bp, Homo sapiens
tagctgtgacctgc

SEQ ID NO: 1975852 - DNA, 18 bp, Homo sapiens
tagctgtgacctgctgag

SEQ ID NO: 1975853 - DNA, 17 bp, Homo sapiens
tagctgttatttctatt

SEQ ID NO: 1975854 - DNA, 15 bp, Homo sapiens
tagcttaaataaatt

SEQ ID NO: 1975855 - DNA, 16 bp, Homo sapiens
tagcttaaataaattc

SEQ ID NO: 1975856 - DNA, 17 bp, Homo sapiens
tagcttaaataaattca

SEQ ID NO: 1975857 - DNA, 21 bp, Homo sapiens
tagcttacagtcaattttaca

SEQ ID NO: 1975858 - DNA, 20 bp, Homo sapiens
tagcttagacctcagcctgt

SEQ ID NO: 1975859 - DNA, 15 bp, Homo sapiens
tagcttcatgcctca

SEQ ID NO: 1975860 - DNA, 18 bp, Homo sapiens
tagcttcatgcctcagtt

SEQ ID NO: 1975861 - DNA, 20 bp, Homo sapiens
tagcttggaaactggatgag

SEQ ID NO: 1975862 - DNA, 15 bp, Homo sapiens
tagcttgttccctgt

SEQ ID NO: 1975863 - DNA, 16 bp, Homo sapiens
tagctttaacttaaat

SEQ ID NO: 1975864 - DNA, 19 bp, Homo sapiens
tagctttattttttaagta

SEQ ID NO: 1975865 - DNA, 13 bp, Homo sapiens
tagcttttccctt

SEQ ID NO: 1975866 - DNA, 15 bp, Homo sapiens
taggaaaagaaggct

SEQ ID NO: 1975867 - DNA, 14 bp, Homo sapiens
taggaaataaaacc

SEQ ID NO: 1975868 - DNA, 17 bp, Homo sapiens
taggaaataaaaccttt

SEQ ID NO: 1975869 - DNA, 17 bp, Homo sapiens
taggaacagagtatata

SEQ ID NO: 1975870 - DNA, 17 bp, Homo sapiens
taggaagaaaaatgttt

SEQ ID NO: 1975871 - DNA, 23 bp, Homo sapiens
taggaagtgaccgagtctaggaa

SEQ ID NO: 1975872 - DNA, 22 bp, Homo sapiens
taggaatgaccacgggcctcag

SEQ ID NO: 1975873 - DNA, 22 bp, Homo sapiens
taggacctcaggcggggaggag

SEQ ID NO: 1975874 - DNA, 12 bp, Homo sapiens
taggagacagtc

SEQ ID NO: 1975875 - DNA, 14 bp, Homo sapiens
taggagaccaaggc

SEQ ID NO: 1975876 - DNA, 21 bp, Homo sapiens
taggagaccaaggcgggagca

SEQ ID NO: 1975877 - DNA, 19 bp, Homo sapiens
taggagagataccttgaaa

SEQ ID NO: 1975878 - DNA, 20 bp, Homo sapiens
taggagagataccttgaaaa

SEQ ID NO: 1975879 - DNA, 22 bp, Homo sapiens
taggagataccaggttgaaaga

SEQ ID NO: 1975880 - DNA, 22 bp, Homo sapiens
taggaggctgcatgctctggaa

SEQ ID NO: 1975881 - DNA, 14 bp, Homo sapiens
taggagggactgtc

SEQ ID NO: 1975882 - DNA, 21 bp, Homo sapiens
taggagttcgagaccagcctg

SEQ ID NO: 1975883 - DNA, 18 bp, Homo sapiens
taggatctatgcaatttt

SEQ ID NO: 1975884 - DNA, 19 bp, Homo sapiens
taggatctatgcaattttt

SEQ ID NO: 1975885 - DNA, 20 bp, Homo sapiens
taggatctatgcaattttta

SEQ ID NO: 1975886 - DNA, 18 bp, Homo sapiens
taggatgtttttcatgaa

SEQ ID NO: 1975887 - DNA, 14 bp, Homo sapiens
taggattacaggca

SEQ ID NO: 1975888 - DNA, 12 bp, Homo sapiens
taggatttaaca

SEQ ID NO: 1975889 - DNA, 21 bp, Homo sapiens
taggatttaacagtcatttaa

SEQ ID NO: 1975890 - DNA, 22 bp, Homo sapiens
taggatttaacagtcatttaaa

SEQ ID NO: 1975891 - DNA, 21 bp, Homo sapiens
taggatttatttaaaatagca

SEQ ID NO: 1975892 - DNA, 12 bp, Homo sapiens
taggcaagagaa

SEQ ID NO: 1975893 - DNA, 18 bp, Homo sapiens
taggcagacgtggggagg

SEQ ID NO: 1975894 - DNA, 13 bp, Homo sapiens
taggcagagcctt

SEQ ID NO: 1975895 - DNA, 12 bp, Homo sapiens
taggcagcctct

SEQ ID NO: 1975896 - DNA, 12 bp, Homo sapiens
taggcagcctgc

SEQ ID NO: 1975897 - DNA, 19 bp, Homo sapiens
taggcatcccaggggacca

SEQ ID NO: 1975898 - DNA, 14 bp, Homo sapiens
taggcatgcctaat

SEQ ID NO: 1975899 - DNA, 20 bp, Homo sapiens
taggcattatttaatgtttg

SEQ ID NO: 1975900 - DNA, 22 bp, Homo sapiens
taggccaagctgaagtgaagga

SEQ ID NO: 1975901 - DNA, 14 bp, Homo sapiens
taggccactcctcc

SEQ ID NO: 1975902 - DNA, 21 bp, Homo sapiens
taggccatgttaattaaactg

SEQ ID NO: 1975903 - DNA, 22 bp, Homo sapiens
taggccctggatgtgcccacag

SEQ ID NO: 1975904 - DNA, 13 bp, Homo sapiens
taggcccttgtcc

SEQ ID NO: 1975905 - DNA, 18 bp, Homo sapiens
taggcccttgtcctgcca

SEQ ID NO: 1975906 - DNA, 19 bp, Homo sapiens
taggcccttgtcctgccag

SEQ ID NO: 1975907 - DNA, 20 bp, Homo sapiens
taggcccttgtcctgccagc

SEQ ID NO: 1975908 - DNA, 21 bp, Homo sapiens
taggcccttgtcctgccagct

SEQ ID NO: 1975909 - DNA, 12 bp, Homo sapiens
taggcctatcaa

SEQ ID NO: 1975910 - DNA, 13 bp, Homo sapiens
taggcctggccag

SEQ ID NO: 1975911 - DNA, 15 bp, Homo sapiens
taggcctggccagat

SEQ ID NO: 1975912 - DNA, 18 bp, Homo sapiens
taggcctggccagatgca

SEQ ID NO: 1975913 - DNA, 22 bp, Homo sapiens
taggcctgtgaggtaactggga

SEQ ID NO: 1975914 - DNA, 15 bp, Homo sapiens
taggctggagaagct

SEQ ID NO: 1975915 - DNA, 17 bp, Homo sapiens
taggctggagaagctca

SEQ ID NO: 1975916 - DNA, 18 bp, Homo sapiens
taggcttatcaaaatctt

SEQ ID NO: 1975917 - DNA, 14 bp, Homo sapiens
tagggaagcaggga

SEQ ID NO: 1975918 - DNA, 21 bp, Homo sapiens
tagggaagcagggacaccccc

SEQ ID NO: 1975919 - DNA, 13 bp, Homo sapiens
tagggacttaaaa

SEQ ID NO: 1975920 - DNA, 17 bp, Homo sapiens
tagggagaatgcagaga

SEQ ID NO: 1975921 - DNA, 23 bp, Homo sapiens
tagggccagctcacaagcccagg

SEQ ID NO: 1975922 - DNA, 15 bp, Homo sapiens
tagggccaggcaggt

SEQ ID NO: 1975923 - DNA, 14 bp, Homo sapiens
tagggctggaccta

SEQ ID NO: 1975924 - DNA, 20 bp, Homo sapiens
tagggctgtagacttacttt

SEQ ID NO: 1975925 - DNA, 21 bp, Homo sapiens
tataaaatgcaaaataaatgt

SEQ ID NO: 1975926 - DNA, 18 bp, Homo sapiens
tataaacattaaatgtct

SEQ ID NO: 1975927 - DNA, 19 bp, Homo sapiens
tataaacattaaatgtctt

SEQ ID NO: 1975928 - DNA, 15 bp, Homo sapiens
tataaactagatctc

SEQ ID NO: 1975929 - DNA, 19 bp, Homo sapiens
tataaactatcagtttgtc

SEQ ID NO: 1975930 - DNA, 14 bp, Homo sapiens
tataaacttgtgta

SEQ ID NO: 1975931 - DNA, 13 bp, Homo sapiens
tataaactttaga

SEQ ID NO: 1975932 - DNA, 15 bp, Homo sapiens
tataaactttagagt

SEQ ID NO: 1975933 - DNA, 15 bp, Homo sapiens
tataaagataaaata

SEQ ID NO: 1975934 - DNA, 21 bp, Homo sapiens
tataaagataaaatatcctca

SEQ ID NO: 1975935 - DNA, 19 bp, Homo sapiens
tataaataataaagaactc

SEQ ID NO: 1975936 - DNA, 15 bp, Homo sapiens
tataaatatatttaa

SEQ ID NO: 1975937 - DNA, 15 bp, Homo sapiens
tataaatcaatgtca

SEQ ID NO: 1975938 - DNA, 16 bp, Homo sapiens
tataaatcaatgtcac

SEQ ID NO: 1975939 - DNA, 16 bp, Homo sapiens
tataaatgcatgattt

SEQ ID NO: 1975940 - DNA, 17 bp, Homo sapiens
tataaatgcatgatttt

SEQ ID NO: 1975941 - DNA, 23 bp, Homo sapiens
tataaatgtatatacacatatac

SEQ ID NO: 1975942 - DNA, 12 bp, Homo sapiens
tataaatgttta

SEQ ID NO: 1975943 - DNA, 15 bp, Homo sapiens
tataaattaagactt

SEQ ID NO: 1975944 - DNA, 22 bp, Homo sapiens
tataacaaggttcttctaaaat

SEQ ID NO: 1975945 - DNA, 13 bp, Homo sapiens
tataaccccacct

SEQ ID NO: 1975946 - DNA, 23 bp, Homo sapiens
tataaccccaccttgccaagctt

SEQ ID NO: 1975947 - DNA, 15 bp, Homo sapiens
tataaccccagctcc

SEQ ID NO: 1975948 - DNA, 14 bp, Homo sapiens
tataactagtcctt

SEQ ID NO: 1975949 - DNA, 18 bp, Homo sapiens
tataactagtcctttact

SEQ ID NO: 1975950 - DNA, 17 bp, Homo sapiens
tataactcatcataaaa

SEQ ID NO: 1975951 - DNA, 16 bp, Homo sapiens
tataactgaaggagaa

SEQ ID NO: 1975952 - DNA, 19 bp, Homo sapiens
tataacttaaaaaaatgac

SEQ ID NO: 1975953 - DNA, 21 bp, Homo sapiens
tataactttagaaataagaag

SEQ ID NO: 1975954 - DNA, 16 bp, Homo sapiens
tataagaatcatagtg

SEQ ID NO: 1975955 - DNA, 15 bp, Homo sapiens
tataagcaaatttca

SEQ ID NO: 1975956 - DNA, 12 bp, Homo sapiens
tataagcccagc

SEQ ID NO: 1975957 - DNA, 14 bp, Homo sapiens
tataagctgggaaa

SEQ ID NO: 1975958 - DNA, 15 bp, Homo sapiens
tataaggaggaaaac

SEQ ID NO: 1975959 - DNA, 22 bp, Homo sapiens
tataagtgcacacagaaatata

SEQ ID NO: 1975960 - DNA, 18 bp, Homo sapiens
tataataatgttctctgg

SEQ ID NO: 1975961 - DNA, 15 bp, Homo sapiens
tataatactaaagtg

SEQ ID NO: 1975962 - DNA, 20 bp, Homo sapiens
tataatactaaagtgtctat

SEQ ID NO: 1975963 - DNA, 14 bp, Homo sapiens
tataatctatttac

SEQ ID NO: 1975964 - DNA, 17 bp, Homo sapiens
tataatggaagagaaat

SEQ ID NO: 1975965 - DNA, 15 bp, Homo sapiens
tataatggtttactg

SEQ ID NO: 1975966 - DNA, 16 bp, Homo sapiens
tataatggtttactgc

SEQ ID NO: 1975967 - DNA, 18 bp, Homo sapiens
tataatggtttactgctg

SEQ ID NO: 1975968 - DNA, 20 bp, Homo sapiens
tataatggtttactgctgtc

SEQ ID NO: 1975969 - DNA, 18 bp, Homo sapiens
tataatgtggatttccta

SEQ ID NO: 1975970 - DNA, 19 bp, Homo sapiens
tataatgtggatttcctat

SEQ ID NO: 1975971 - DNA, 12 bp, Homo sapiens
tataatgtgtgt

SEQ ID NO: 1975972 - DNA, 14 bp, Homo sapiens
tataatgtgtgtat

SEQ ID NO: 1975973 - DNA, 20 bp, Homo sapiens
tataatgtgtgtatgtgtat

SEQ ID NO: 1975974 - DNA, 17 bp, Homo sapiens
tataattttatgaatgt

SEQ ID NO: 1975975 - DNA, 17 bp, Homo sapiens
tataattttgcagcaga

SEQ ID NO: 1975976 - DNA, 19 bp, Homo sapiens
tataatttttaaagtatat

SEQ ID NO: 1975977 - DNA, 20 bp, Homo sapiens
tataatttttttattactga

SEQ ID NO: 1975978 - DNA, 17 bp, Homo sapiens
tatacaaaataatttaa

SEQ ID NO: 1975979 - DNA, 15 bp, Homo sapiens
tatacaaacatgtgg

SEQ ID NO: 1975980 - DNA, 14 bp, Homo sapiens
tatacaatatataa

SEQ ID NO: 1975981 - DNA, 18 bp, Homo sapiens
tatacaatatataaaaat

SEQ ID NO: 1975982 - DNA, 16 bp, Homo sapiens
tatacaatgttctgtt

SEQ ID NO: 1975983 - DNA, 14 bp, Homo sapiens
tatacacaacattt

SEQ ID NO: 1975984 - DNA, 14 bp, Homo sapiens
tatacacacatata

SEQ ID NO: 1975985 - DNA, 16 bp, Homo sapiens
tatacacacatataca

SEQ ID NO: 1975986 - DNA, 14 bp, Homo sapiens
tatacacatacata

SEQ ID NO: 1975987 - DNA, 21 bp, Homo sapiens
tatacacatacatacacatac

SEQ ID NO: 1975988 - DNA, 22 bp, Homo sapiens
tatacaccattgttccttacct

SEQ ID NO: 1975989 - DNA, 12 bp, Homo sapiens
tatacagaactg

SEQ ID NO: 1975990 - DNA, 17 bp, Homo sapiens
tatacatacctctctct

SEQ ID NO: 1975991 - DNA, 12 bp, Homo sapiens
tatacatatata

SEQ ID NO: 1975992 - DNA, 14 bp, Homo sapiens
tatacatatatata

SEQ ID NO: 1975993 - DNA, 16 bp, Homo sapiens
tatacatatcagaaaa

SEQ ID NO: 1975994 - DNA, 13 bp, Homo sapiens
tatacatatgtag

SEQ ID NO: 1975995 - DNA, 15 bp, Homo sapiens
tatacatatgtagac

SEQ ID NO: 1975996 - DNA, 18 bp, Homo sapiens
tatacatattataaataa

SEQ ID NO: 1975997 - DNA, 14 bp, Homo sapiens
tatacatgtatagt

SEQ ID NO: 1975998 - DNA, 17 bp, Homo sapiens
tatacattctttatctt

SEQ ID NO: 1975999 - DNA, 22 bp, Homo sapiens
tatacattctttatcttgacat

SEQ ID NO: 1976000 - DNA, 21 bp, Homo sapiens
tatacatttcataaggcctgc

SEQ ID NO: 1976001 - DNA, 13 bp, Homo sapiens
tatacatttctgt

SEQ ID NO: 1976002 - DNA, 21 bp, Homo sapiens
tatacattttgttatagaata

SEQ ID NO: 1976003 - DNA, 11 bp, Homo sapiens
ggacagctggc

SEQ ID NO: 1976004 - DNA, 17 bp, Homo sapiens
ggacagctgtgcctcgc

SEQ ID NO: 1976005 - DNA, 11 bp, Homo sapiens
ggacaggcccg

SEQ ID NO: 1976006 - DNA, 22 bp, Homo sapiens
ggacagggcatggccaggtggc

SEQ ID NO: 1976007 - DNA, 16 bp, Homo sapiens
ggacagtgcttcagcc

SEQ ID NO: 1976008 - DNA, 18 bp, Homo sapiens
ggacagtgcttcagcctg

SEQ ID NO: 1976009 - DNA, 19 bp, Homo sapiens
ggacagtgcttcagcctga

SEQ ID NO: 1976010 - DNA, 22 bp, Homo sapiens
ggacagtgcttcagcctgaggc

SEQ ID NO: 1976011 - DNA, 19 bp, Homo sapiens
ggacatcacagcagaatga

SEQ ID NO: 1976012 - DNA, 14 bp, Homo sapiens
ggacatcatgaagc

SEQ ID NO: 1976013 - DNA, 16 bp, Homo sapiens
ggacatggggcataga

SEQ ID NO: 1976014 - DNA, 15 bp, Homo sapiens
ggacattatgtgtgc

SEQ ID NO: 1976015 - DNA, 17 bp, Homo sapiens
ggacattcaaaaacctg

SEQ ID NO: 1976016 - DNA, 16 bp, Homo sapiens
ggacatttccctcctg

SEQ ID NO: 1976017 - DNA, 15 bp, Homo sapiens
ggaccaaattgcttc

SEQ ID NO: 1976018 - DNA, 22 bp, Homo sapiens
ggaccaaccctgtttcctgagt

SEQ ID NO: 1976019 - DNA, 18 bp, Homo sapiens
ggaccaactggcttctgt

SEQ ID NO: 1976020 - DNA, 22 bp, Homo sapiens
ggaccacactttgagaacctgt

SEQ ID NO: 1976021 - DNA, 17 bp, Homo sapiens
ggaccacagtgggtggc

SEQ ID NO: 1976022 - DNA, 13 bp, Homo sapiens
ggaccaccagccc

SEQ ID NO: 1976023 - DNA, 15 bp, Homo sapiens
ggaccaccagcccca

SEQ ID NO: 1976024 - DNA, 17 bp, Homo sapiens
ggaccaccagccccagc

SEQ ID NO: 1976025 - DNA, 21 bp, Homo sapiens
gtcatttgagcagggctcagc

SEQ ID NO: 1976026 - DNA, 22 bp, Homo sapiens
gtcatttgagcagggctcagcg

SEQ ID NO: 1976027 - DNA, 15 bp, Homo sapiens
gtcatttgcaagctg

SEQ ID NO: 1976028 - DNA, 22 bp, Homo sapiens
gtcatttgctgagcatgtactg

SEQ ID NO: 1976029 - DNA, 15 bp, Homo sapiens
gtcattttctattca

SEQ ID NO: 1976030 - DNA, 18 bp, Homo sapiens
gtcattttggtactttgg

SEQ ID NO: 1976031 - DNA, 20 bp, Homo sapiens
gtccaacaactccaggaaaa

SEQ ID NO: 1976032 - DNA, 17 bp, Homo sapiens
gtccaacctaacccctt

SEQ ID NO: 1976033 - DNA, 21 bp, Homo sapiens
gtccaagggccatacttttga

SEQ ID NO: 1976034 - DNA, 20 bp, Homo sapiens
gtccaattatgcactggcca

SEQ ID NO: 1976035 - DNA, 19 bp, Homo sapiens
gtccacaggggcaggcctg

SEQ ID NO: 1976036 - DNA, 20 bp, Homo sapiens
gtccacaggggcaggcctgg

SEQ ID NO: 1976037 - DNA, 16 bp, Homo sapiens
gtccacagtctcccat

SEQ ID NO: 1976038 - DNA, 19 bp, Homo sapiens
gtccacagtctcccattct

SEQ ID NO: 1976039 - DNA, 19 bp, Homo sapiens
gtccacatcttctcagtgt

SEQ ID NO: 1976040 - DNA, 14 bp, Homo sapiens
gtccacccagcaaa

SEQ ID NO: 1976041 - DNA, 12 bp, Homo sapiens
gtccacccagga

SEQ ID NO: 1976042 - DNA, 14 bp, Homo sapiens
gtccacccaggagc

SEQ ID NO: 1976043 - DNA, 19 bp, Homo sapiens
gtccacccaggctgcactg

SEQ ID NO: 1976044 - DNA, 15 bp, Homo sapiens
gtccacctgcctatc

SEQ ID NO: 1976045 - DNA, 19 bp, Homo sapiens
gtccactcagggctgccac

SEQ ID NO: 1976046 - DNA, 18 bp, Homo sapiens
gtccactctcggggccct

SEQ ID NO: 1976047 - DNA, 19 bp, Homo sapiens
gtccactctcggggccctt

SEQ ID NO: 1976048 - DNA, 19 bp, Homo sapiens
gtccagaagaatattcagg

SEQ ID NO: 1976049 - DNA, 19 bp, Homo sapiens
gtccagaataagtgctgtt

SEQ ID NO: 1976050 - DNA, 20 bp, Homo sapiens
gtccagaccattgtcttcca

SEQ ID NO: 1976051 - DNA, 12 bp, Homo sapiens
gtccagcagctg

SEQ ID NO: 1976052 - DNA, 13 bp, Homo sapiens
gtccagccagctc

SEQ ID NO: 1976053 - DNA, 22 bp, Homo sapiens
gtccagctagccaactcctcct

SEQ ID NO: 1976054 - DNA, 23 bp, Homo sapiens
gtccagctagccaactcctcctt

SEQ ID NO: 1976055 - DNA, 13 bp, Homo sapiens
gtccagctcttgg

SEQ ID NO: 1976056 - DNA, 14 bp, Homo sapiens
gtccagcttgctct

SEQ ID NO: 1976057 - DNA, 14 bp, Homo sapiens
gtccaggaaggcag

SEQ ID NO: 1976058 - DNA, 16 bp, Homo sapiens
gtccaggaaggcagct

SEQ ID NO: 1976059 - DNA, 22 bp, Homo sapiens
gtccaggaaggcagctgctctt

SEQ ID NO: 1976060 - DNA, 15 bp, Homo sapiens
gtccaggccactgtg

SEQ ID NO: 1976061 - DNA, 17 bp, Homo sapiens
gtccaggccactgtggc

SEQ ID NO: 1976062 - DNA, 23 bp, Homo sapiens
gtccaggccactgtggccagagc

SEQ ID NO: 1976063 - DNA, 17 bp, Homo sapiens
gtccagggccctgagct

SEQ ID NO: 1976064 - DNA, 17 bp, Homo sapiens
gtccaggtcctggtggg

SEQ ID NO: 1976065 - DNA, 23 bp, Homo sapiens
gtccaggtcctggtggggcagct

SEQ ID NO: 1976066 - DNA, 20 bp, Homo sapiens
gtccagtgcaaccacacacc

SEQ ID NO: 1976067 - DNA, 19 bp, Homo sapiens
gtccatatcagacctctga

SEQ ID NO: 1976068 - DNA, 16 bp, Homo sapiens
gtccatggcaccagcc

SEQ ID NO: 1976069 - DNA, 20 bp, Homo sapiens
gtccatggcaccagccccct

SEQ ID NO: 1976070 - DNA, 22 bp, Homo sapiens
gtccatggcaccagccccctgg

SEQ ID NO: 1976071 - DNA, 14 bp, Homo sapiens
gtccatgtgcttcc

SEQ ID NO: 1976072 - DNA, 21 bp, Homo sapiens
gtcccaagctttgaatacccc

SEQ ID NO: 1976073 - DNA, 14 bp, Homo sapiens
gtcccaaggagctg

SEQ ID NO: 1976074 - DNA, 14 bp, Homo sapiens
gtcccacatccctg

SEQ ID NO: 1976075 - DNA, 21 bp, Homo sapiens
gtcccacatccctgggcctgc

SEQ ID NO: 1976076 - DNA, 16 bp, Homo sapiens
gtcccaccaactctgc

SEQ ID NO: 1976077 - DNA, 17 bp, Homo sapiens
gtcccaccaactctgca

SEQ ID NO: 1976078 - DNA, 19 bp, Homo sapiens
gtcccaccaactctgcact

SEQ ID NO: 1976079 - DNA, 18 bp, Homo sapiens
gtcccaccgggagcctcc

SEQ ID NO: 1976080 - DNA, 14 bp, Homo sapiens
gtcccacctcttct

SEQ ID NO: 1976081 - DNA, 21 bp, Homo sapiens
gtcccacctcttctcttcctg

SEQ ID NO: 1976082 - DNA, 18 bp, Homo sapiens
gtcccaccttggctgcag

SEQ ID NO: 1976083 - DNA, 15 bp, Homo sapiens
gtcccactcagtcca

SEQ ID NO: 1976084 - DNA, 20 bp, Homo sapiens
gtcccagaggttatctgcct

SEQ ID NO: 1976085 - DNA, 22 bp, Homo sapiens
gtcccagaggttatctgcctgg

SEQ ID NO: 1976086 - DNA, 21 bp, Homo sapiens
gtcccagcagaagagggaggc

SEQ ID NO: 1976087 - DNA, 12 bp, Homo sapiens
gtcccagggaag

SEQ ID NO: 1976088 - DNA, 16 bp, Homo sapiens
gtcccatctgctcctc

SEQ ID NO: 1976089 - DNA, 16 bp, Homo sapiens
gtcccatgtgcatgga

SEQ ID NO: 1976090 - DNA, 13 bp, Homo sapiens
gtcccatttcctt

SEQ ID NO: 1976091 - DNA, 18 bp, Homo sapiens
gtcccatttccttggagg

SEQ ID NO: 1976092 - DNA, 13 bp, Homo sapiens
gtccccacagcct

SEQ ID NO: 1976093 - DNA, 12 bp, Homo sapiens
gtccccagccct

SEQ ID NO: 1976094 - DNA, 13 bp, Homo sapiens
gtccccagccctt

SEQ ID NO: 1976095 - DNA, 19 bp, Homo sapiens
gtccccagcccttctgcct

SEQ ID NO: 1976096 - DNA, 20 bp, Homo sapiens
gtccccagcccttctgcctt

SEQ ID NO: 1976097 - DNA, 13 bp, Homo sapiens
gtccccagctggt

SEQ ID NO: 1976098 - DNA, 23 bp, Homo sapiens
gtccccagctggtccagggcctg

SEQ ID NO: 1976099 - DNA, 13 bp, Homo sapiens
gtccccagggccc

SEQ ID NO: 1976100 - DNA, 16 bp, Homo sapiens
gtccccagggcccctc

SEQ ID NO: 1976101 - DNA, 22 bp, Homo sapiens
gtccccagggcccctccctctg

SEQ ID NO: 1976102 - DNA, 20 bp, Homo sapiens
gtccccatcatcccagctgc

SEQ ID NO: 1976103 - DNA, 13 bp, Homo sapiens
gtcccccagccct

SEQ ID NO: 1976104 - DNA, 14 bp, Homo sapiens
gtcccccagccctc

SEQ ID NO: 1976105 - DNA, 19 bp, Homo sapiens
gtcccccagccctcaggcc

SEQ ID NO: 1976106 - DNA, 22 bp, Homo sapiens
gtcccccagccctcaggccagt

SEQ ID NO: 1976107 - DNA, 18 bp, Homo sapiens
gtcccctcactctgtcag

SEQ ID NO: 1976108 - DNA, 19 bp, Homo sapiens
gtcccctcactctgtcagc

SEQ ID NO: 1976109 - DNA, 20 bp, Homo sapiens
gtcccctcactctgtcagcc

SEQ ID NO: 1976110 - DNA, 23 bp, Homo sapiens
gtcccctcactctgtcagccagc

SEQ ID NO: 1976111 - DNA, 13 bp, Homo sapiens
gtcccctctcccc

SEQ ID NO: 1976112 - DNA, 23 bp, Homo sapiens
gtcccctctgtcatcactccctg

SEQ ID NO: 1976113 - DNA, 12 bp, Homo sapiens
gtcccctgcctc

SEQ ID NO: 1976114 - DNA, 19 bp, Homo sapiens
gtcccctgtcccaccaact

SEQ ID NO: 1976115 - DNA, 14 bp, Homo sapiens
gtcccgccttcctc

SEQ ID NO: 1976116 - DNA, 19 bp, Homo sapiens
gtcccgccttcctcctcca

SEQ ID NO: 1976117 - DNA, 23 bp, Homo sapiens
gtcccgcttattctcctccctgt

SEQ ID NO: 1976118 - DNA, 21 bp, Homo sapiens
gtccctacacccctcccctgc

SEQ ID NO: 1976119 - DNA, 13 bp, Homo sapiens
gtccctacccact

SEQ ID NO: 1976120 - DNA, 15 bp, Homo sapiens
gtccctacccactct

SEQ ID NO: 1976121 - DNA, 20 bp, Homo sapiens
gtccctcaaatgacccaaag

SEQ ID NO: 1976122 - DNA, 14 bp, Homo sapiens
gtccctcggagctg

SEQ ID NO: 1976123 - DNA, 16 bp, Homo sapiens
gtccctcgtccacagg

SEQ ID NO: 1976124 - DNA, 21 bp, Homo sapiens
gtccctctcggaaggctggct

SEQ ID NO: 1976125 - DNA, 13 bp, Homo sapiens
gtccctctttgcc

SEQ ID NO: 1976126 - DNA, 16 bp, Homo sapiens
gtccctgcacttgcag

SEQ ID NO: 1976127 - DNA, 19 bp, Homo sapiens
gtccctgcacttgcagact

SEQ ID NO: 1976128 - DNA, 24 bp, Homo sapiens
gtccctgccacactcagtccccca

SEQ ID NO: 1976129 - DNA, 11 bp, Homo sapiens
gtccctgctcc

SEQ ID NO: 1976130 - DNA, 19 bp, Homo sapiens
gtccctgggggaagccctg

SEQ ID NO: 1976131 - DNA, 24 bp, Homo sapiens
gtccctggtccctcgtccacaggg

SEQ ID NO: 1976132 - DNA, 12 bp, Homo sapiens
gtccctgttctc

SEQ ID NO: 1976133 - DNA, 15 bp, Homo sapiens
gtccctgttctcagc

SEQ ID NO: 1976134 - DNA, 17 bp, Homo sapiens
gtccctgttctcagctc

SEQ ID NO: 1976135 - DNA, 21 bp, Homo sapiens
gtccctgttctcagctccgtc

SEQ ID NO: 1976136 - DNA, 16 bp, Homo sapiens
gtcccttgagacctca

SEQ ID NO: 1976137 - DNA, 15 bp, Homo sapiens
gtcccttgctgacat

SEQ ID NO: 1976138 - DNA, 17 bp, Homo sapiens
gtcccttgtttccagct

SEQ ID NO: 1976139 - DNA, 22 bp, Homo sapiens
gtctgtgttgcgtgtcgtgggt

SEQ ID NO: 1976140 - DNA, 16 bp, Homo sapiens
gtctgttaacttaata

SEQ ID NO: 1976141 - DNA, 21 bp, Homo sapiens
gtctgttccccatggccactt

SEQ ID NO: 1976142 - DNA, 22 bp, Homo sapiens
gtctgtttcaatgacctgtatt

SEQ ID NO: 1976143 - DNA, 22 bp, Homo sapiens
gtcttaaaataacttatatcat

SEQ ID NO: 1976144 - DNA, 14 bp, Homo sapiens
gtcttaattaaaag

SEQ ID NO: 1976145 - DNA, 20 bp, Homo sapiens
gtcttagaagtggaccagga

SEQ ID NO: 1976146 - DNA, 23 bp, Homo sapiens
gtcttagaagtggaccaggacag

SEQ ID NO: 1976147 - DNA, 18 bp, Homo sapiens
gtcttataggtttccact

SEQ ID NO: 1976148 - DNA, 15 bp, Homo sapiens
gtcttcagcctagcc

SEQ ID NO: 1976149 - DNA, 16 bp, Homo sapiens
gtcttcatttcattgt

SEQ ID NO: 1976150 - DNA, 17 bp, Homo sapiens
gtcttcatttcattgta

SEQ ID NO: 1976151 - DNA, 18 bp, Homo sapiens
gtcttccaaccccagctg

SEQ ID NO: 1976152 - DNA, 23 bp, Homo sapiens
gtcttccaaccccagctggcctc

SEQ ID NO: 1976153 - DNA, 13 bp, Homo sapiens
gtcttccataatg

SEQ ID NO: 1976154 - DNA, 14 bp, Homo sapiens
gtgaggaagcctaa

SEQ ID NO: 1976155 - DNA, 12 bp, Homo sapiens
gtgaggcagggg

SEQ ID NO: 1976156 - DNA, 17 bp, Homo sapiens
gtgaggcaggggcggag

SEQ ID NO: 1976157 - DNA, 14 bp, Homo sapiens
gtgaggcccagcct

SEQ ID NO: 1976158 - DNA, 14 bp, Homo sapiens
gtgaggcctggcca

SEQ ID NO: 1976159 - DNA, 15 bp, Homo sapiens
gtgaggctgggccag

SEQ ID NO: 1976160 - DNA, 12 bp, Homo sapiens
gtgagggctggg

SEQ ID NO: 1976161 - DNA, 16 bp, Homo sapiens
gtgagggctgggcagc

SEQ ID NO: 1976162 - DNA, 14 bp, Homo sapiens
gtgaggggaaggcc

SEQ ID NO: 1976163 - DNA, 14 bp, Homo sapiens
gtgaggtgctgatg

SEQ ID NO: 1976164 - DNA, 17 bp, Homo sapiens
gtgagtcaccaagccca

SEQ ID NO: 1976165 - DNA, 22 bp, Homo sapiens
gtgagtcgaggacagggaggtg

SEQ ID NO: 1976166 - DNA, 15 bp, Homo sapiens
gtgagtggcagccat

SEQ ID NO: 1976167 - DNA, 22 bp, Homo sapiens
gtgagtgtgtgtgatgggatct

SEQ ID NO: 1976168 - DNA, 20 bp, Homo sapiens
gtgatacaacttcaagtgca

SEQ ID NO: 1976169 - DNA, 14 bp, Homo sapiens
gtgatatatgtatt

SEQ ID NO: 1976170 - DNA, 16 bp, Homo sapiens
gtgatatatgtattta

SEQ ID NO: 1976171 - DNA, 20 bp, Homo sapiens
gtgatatcacctctcttcag

SEQ ID NO: 1976172 - DNA, 17 bp, Homo sapiens
gtgatcaattaaatgta

SEQ ID NO: 1976173 - DNA, 20 bp, Homo sapiens
gtgatcagaaggctggggcc

SEQ ID NO: 1976174 - DNA, 14 bp, Homo sapiens
gtgatgaactttct

SEQ ID NO: 1976175 - DNA, 14 bp, Homo sapiens
gtgatgagggcagc

SEQ ID NO: 1976176 - DNA, 18 bp, Homo sapiens
gtgatgagggcagcagcc

SEQ ID NO: 1976177 - DNA, 19 bp, Homo sapiens
gtgatgagggcagcagcca

SEQ ID NO: 1976178 - DNA, 22 bp, Homo sapiens
gtgatgatcagctgtttgtcat

SEQ ID NO: 1976179 - DNA, 18 bp, Homo sapiens
gtgatgatgaccaagaat

SEQ ID NO: 1976180 - DNA, 23 bp, Homo sapiens
gtgatggagtgtgcgtgtgtgca

SEQ ID NO: 1976181 - DNA, 20 bp, Homo sapiens
gtgatggcgcgggaggcacc

SEQ ID NO: 1976182 - DNA, 21 bp, Homo sapiens
gtgatggggtgggcagggctg

SEQ ID NO: 1976183 - DNA, 20 bp, Homo sapiens
gtgatggtctcacagagcca

SEQ ID NO: 1976184 - DNA, 24 bp, Homo sapiens
gtgatgttgtttgggagagtgcag

SEQ ID NO: 1976185 - DNA, 12 bp, Homo sapiens
gtgatgttttgt

SEQ ID NO: 1976186 - DNA, 14 bp, Homo sapiens
gtgattaacttgct

SEQ ID NO: 1976187 - DNA, 20 bp, Homo sapiens
gtgattccttcaattcaaaa

SEQ ID NO: 1976188 - DNA, 14 bp, Homo sapiens
gtgattctcctgcc

SEQ ID NO: 1976189 - DNA, 16 bp, Homo sapiens
gtgattctcctgcctc

SEQ ID NO: 1976190 - DNA, 18 bp, Homo sapiens
gtgattctcctgcctcag

SEQ ID NO: 1976191 - DNA, 19 bp, Homo sapiens
gtgattctcctgcctcagc

SEQ ID NO: 1976192 - DNA, 13 bp, Homo sapiens
gtgattctgggat

SEQ ID NO: 1976193 - DNA, 14 bp, Homo sapiens
gtgattctgggatg

SEQ ID NO: 1976194 - DNA, 20 bp, Homo sapiens
gtgattgacacacagcactc

SEQ ID NO: 1976195 - DNA, 18 bp, Homo sapiens
gtgatttagaactgtatg

SEQ ID NO: 1976196 - DNA, 20 bp, Homo sapiens
gtgatttggaagagaggcac

SEQ ID NO: 1976197 - DNA, 14 bp, Homo sapiens
gtgattttgtacag

SEQ ID NO: 1976198 - DNA, 17 bp, Homo sapiens
gtgattttgtacagaat

SEQ ID NO: 1976199 - DNA, 17 bp, Homo sapiens
gtgcaaatggaagacaa

SEQ ID NO: 1976200 - DNA, 16 bp, Homo sapiens
gtgcaaattttgcatt

SEQ ID NO: 1976201 - DNA, 13 bp, Homo sapiens
gtgcaagagacag

SEQ ID NO: 1976202 - DNA, 14 bp, Homo sapiens
gtgcaagagacaga

SEQ ID NO: 1976203 - DNA, 18 bp, Homo sapiens
gtgcaagagacagagccc

SEQ ID NO: 1976204 - DNA, 19 bp, Homo sapiens
gtgcaagagacagagcccc

SEQ ID NO: 1976205 - DNA, 18 bp, Homo sapiens
gtgcaagagactctggcc

SEQ ID NO: 1976206 - DNA, 21 bp, Homo sapiens
gtgcaatgcgtgttgtacata

SEQ ID NO: 1976207 - DNA, 22 bp, Homo sapiens
gtgcaatttcccctctgtgtcc

SEQ ID NO: 1976208 - DNA, 23 bp, Homo sapiens
gtgcaatttcccctctgtgtcct

SEQ ID NO: 1976209 - DNA, 15 bp, Homo sapiens
gtgcacaaatattta

SEQ ID NO: 1976210 - DNA, 20 bp, Homo sapiens
gtgcacaaatatttattttc

SEQ ID NO: 1976211 - DNA, 14 bp, Homo sapiens
gtgcacaatgggca

SEQ ID NO: 1976212 - DNA, 12 bp, Homo sapiens
gtgcacacacca

SEQ ID NO: 1976213 - DNA, 21 bp, Homo sapiens
gtgcacacagaaatatatata

SEQ ID NO: 1976214 - DNA, 13 bp, Homo sapiens
gtgcacaggaggg

SEQ ID NO: 1976215 - DNA, 21 bp, Homo sapiens
gtgcacatgcacgtgtgtgca

SEQ ID NO: 1976216 - DNA, 21 bp, Homo sapiens
gtgcaccaccatgccaggcta

SEQ ID NO: 1976217 - DNA, 17 bp, Homo sapiens
gtgcacccactcaccag

SEQ ID NO: 1976218 - DNA, 16 bp, Homo sapiens
gtgcacggcagcttga

SEQ ID NO: 1976219 - DNA, 18 bp, Homo sapiens
gtgcacgtacacacacat

SEQ ID NO: 1976220 - DNA, 17 bp, Homo sapiens
gtgcactggccccaccc

SEQ ID NO: 1976221 - DNA, 15 bp, Homo sapiens
gtgcagatgggctgt

SEQ ID NO: 1976222 - DNA, 12 bp, Homo sapiens
gtgcagcagccc

SEQ ID NO: 1976223 - DNA, 15 bp, Homo sapiens
gtgcagcagcccagc

SEQ ID NO: 1976224 - DNA, 17 bp, Homo sapiens
gtgcagcttctgtcctg

SEQ ID NO: 1976225 - DNA, 17 bp, Homo sapiens
gtgcagggacaaagagg

SEQ ID NO: 1976226 - DNA, 16 bp, Homo sapiens
gtgcagtacacatcag

SEQ ID NO: 1976227 - DNA, 15 bp, Homo sapiens
gtgcagtacaggcaa

SEQ ID NO: 1976228 - DNA, 20 bp, Homo sapiens
gtgcagttgacagcaggtgg

SEQ ID NO: 1976229 - DNA, 15 bp, Homo sapiens
gtgcagttttccagg

SEQ ID NO: 1976230 - DNA, 19 bp, Homo sapiens
gtgcatcccccagcactga

SEQ ID NO: 1976231 - DNA, 14 bp, Homo sapiens
gtgcatctcagccc

SEQ ID NO: 1976232 - DNA, 15 bp, Homo sapiens
gtgcatgaaagagaa

SEQ ID NO: 1976233 - DNA, 15 bp, Homo sapiens
gtgcatgctctctgc

SEQ ID NO: 1976234 - DNA, 23 bp, Homo sapiens
gtgcatgtatgtcttggacactg

SEQ ID NO: 1976235 - DNA, 22 bp, Homo sapiens
gtgcatgtatgtgcacatgtgt

SEQ ID NO: 1976236 - DNA, 22 bp, Homo sapiens
gtgcatttgagagaagccacgc

SEQ ID NO: 1976237 - DNA, 24 bp, Homo sapiens
gtgcatttgagagaagccacgctg

SEQ ID NO: 1976238 - DNA, 23 bp, Homo sapiens
gtgccaacctgatgccccttccc

SEQ ID NO: 1976239 - DNA, 12 bp, Homo sapiens
gtgccacagaga

SEQ ID NO: 1976240 - DNA, 13 bp, Homo sapiens
gtgccacagagaa

SEQ ID NO: 1976241 - DNA, 14 bp, Homo sapiens
gtgccacctgcaag

SEQ ID NO: 1976242 - DNA, 15 bp, Homo sapiens
gtgccactccctgag

SEQ ID NO: 1976243 - DNA, 16 bp, Homo sapiens
gtgccactccctgagc

SEQ ID NO: 1976244 - DNA, 17 bp, Homo sapiens
gtgccactccctgagct

SEQ ID NO: 1976245 - DNA, 18 bp, Homo sapiens
gtgccacttgacattcct

SEQ ID NO: 1976246 - DNA, 15 bp, Homo sapiens
gtgccagagcctggg

SEQ ID NO: 1976247 - DNA, 16 bp, Homo sapiens
gtgccagagcctgggg

SEQ ID NO: 1976248 - DNA, 18 bp, Homo sapiens
gtgccagagcctggggct

SEQ ID NO: 1976249 - DNA, 11 bp, Homo sapiens
gtgccagaggt

SEQ ID NO: 1976250 - DNA, 22 bp, Homo sapiens
gtgccagccgtgatgctcaggc

SEQ ID NO: 1976251 - DNA, 11 bp, Homo sapiens
gtgccagctca

SEQ ID NO: 1976252 - DNA, 16 bp, Homo sapiens
gtgccagggcagcact

SEQ ID NO: 1976253 - DNA, 20 bp, Homo sapiens
gtgccaggtttttggtctga

SEQ ID NO: 1976254 - DNA, 13 bp, Homo sapiens
gtgccatcccaca

SEQ ID NO: 1976255 - DNA, 18 bp, Homo sapiens
gtgccatgtggagtggac

SEQ ID NO: 1976256 - DNA, 15 bp, Homo sapiens
gtgcccacagggacc

SEQ ID NO: 1976257 - DNA, 23 bp, Homo sapiens
gtgcccaccaacatcccattgcc

SEQ ID NO: 1976258 - DNA, 19 bp, Homo sapiens
gtgcccaggggcccacagg

SEQ ID NO: 1976259 - DNA, 16 bp, Homo sapiens
gtgcccatgcaatggc

SEQ ID NO: 1976260 - DNA, 17 bp, Homo sapiens
gctctcccatttcctga

SEQ ID NO: 1976261 - DNA, 16 bp, Homo sapiens
gctctcccctgccctg

SEQ ID NO: 1976262 - DNA, 19 bp, Homo sapiens
gctctcccctgccctgctg

SEQ ID NO: 1976263 - DNA, 18 bp, Homo sapiens
gctctcccgtagtcagcg

SEQ ID NO: 1976264 - DNA, 21 bp, Homo sapiens
gctctccctctggccctgcct

SEQ ID NO: 1976265 - DNA, 22 bp, Homo sapiens
gctctcctcttgccactgcctc

SEQ ID NO: 1976266 - DNA, 20 bp, Homo sapiens
gctctcctgagaggtgctgc

SEQ ID NO: 1976267 - DNA, 23 bp, Homo sapiens
gctctcctgagaggtgctgcagg

SEQ ID NO: 1976268 - DNA, 14 bp, Homo sapiens
gctctcctgctgca

SEQ ID NO: 1976269 - DNA, 23 bp, Homo sapiens
gctctcctggcttcccatcccca

SEQ ID NO: 1976270 - DNA, 22 bp, Homo sapiens
gctctctctacccggcccagag

SEQ ID NO: 1976271 - DNA, 15 bp, Homo sapiens
gctctctgcagccag

SEQ ID NO: 1976272 - DNA, 18 bp, Homo sapiens
gctctctgcagccagccc

SEQ ID NO: 1976273 - DNA, 19 bp, Homo sapiens
gctctctggccttttccta

SEQ ID NO: 1976274 - DNA, 23 bp, Homo sapiens
gctctctgtataaacattaaatg

SEQ ID NO: 1976275 - DNA, 14 bp, Homo sapiens
gctctcttcaggag

SEQ ID NO: 1976276 - DNA, 22 bp, Homo sapiens
gctctcttccagaagatgccct

SEQ ID NO: 1976277 - DNA, 15 bp, Homo sapiens
gctctgaaagccagc

SEQ ID NO: 1976278 - DNA, 17 bp, Homo sapiens
gctctgaaagccagctg

SEQ ID NO: 1976279 - DNA, 17 bp, Homo sapiens
gctctgaaatcttgggc

SEQ ID NO: 1976280 - DNA, 17 bp, Homo sapiens
gctctgagaggccctgg

SEQ ID NO: 1976281 - DNA, 20 bp, Homo sapiens
gctctgagaggccctggatc

SEQ ID NO: 1976282 - DNA, 20 bp, Homo sapiens
gctctgagcaaatgtggctc

SEQ ID NO: 1976283 - DNA, 9 bp, Homo sapiens
gctctgagg

SEQ ID NO: 1976284 - DNA, 23 bp, Homo sapiens
gctctgatcatccactgtgccat

SEQ ID NO: 1976285 - DNA, 11 bp, Homo sapiens
gctctgatgca

SEQ ID NO: 1976286 - DNA, 19 bp, Homo sapiens
gctctgatgcatcagaaag

SEQ ID NO: 1976287 - DNA, 14 bp, Homo sapiens
gctctgcaggcacc

SEQ ID NO: 1976288 - DNA, 18 bp, Homo sapiens
gctctgcaggcaccttag

SEQ ID NO: 1976289 - DNA, 14 bp, Homo sapiens
gctctgcatgtgtg

SEQ ID NO: 1976290 - DNA, 14 bp, Homo sapiens
gctctgccccaagc

SEQ ID NO: 1976291 - DNA, 15 bp, Homo sapiens
gctctgccccaagcc

SEQ ID NO: 1976292 - DNA, 16 bp, Homo sapiens
gctctgccccaagccc

SEQ ID NO: 1976293 - DNA, 12 bp, Homo sapiens
gctctgccccag

SEQ ID NO: 1976294 - DNA, 15 bp, Homo sapiens
gctctgccccagagg

SEQ ID NO: 1976295 - DNA, 20 bp, Homo sapiens
gctctgccccagaggcctct

SEQ ID NO: 1976296 - DNA, 21 bp, Homo sapiens
gctctgccccagaggcctctc

SEQ ID NO: 1976297 - DNA, 15 bp, Homo sapiens
gctctgccctccctg

SEQ ID NO: 1976298 - DNA, 22 bp, Homo sapiens
gctctgccctccctggcctcac

SEQ ID NO: 1976299 - DNA, 18 bp, Homo sapiens
gctctgctggcctggccg

SEQ ID NO: 1976300 - DNA, 19 bp, Homo sapiens
gctctgctggcctggccgg

SEQ ID NO: 1976301 - DNA, 22 bp, Homo sapiens
gctctgctttttccagattctt

SEQ ID NO: 1976302 - DNA, 15 bp, Homo sapiens
gctctggaagagagg

SEQ ID NO: 1976303 - DNA, 15 bp, Homo sapiens
gctctggacaggcat

SEQ ID NO: 1976304 - DNA, 22 bp, Homo sapiens
gctctggaccaaccctgtttcc

SEQ ID NO: 1976305 - DNA, 16 bp, Homo sapiens
gctctggaccagcctg

SEQ ID NO: 1976306 - DNA, 13 bp, Homo sapiens
gctctggccaccc

SEQ ID NO: 1976307 - DNA, 15 bp, Homo sapiens
gctctggccaccctg

SEQ ID NO: 1976308 - DNA, 19 bp, Homo sapiens
gcctgggcctatggagagc

SEQ ID NO: 1976309 - DNA, 20 bp, Homo sapiens
gcctgggcctatggagagcc

SEQ ID NO: 1976310 - DNA, 21 bp, Homo sapiens
gcctgggcctatggagagccc

SEQ ID NO: 1976311 - DNA, 22 bp, Homo sapiens
gcctgggcctatggagagccct

SEQ ID NO: 1976312 - DNA, 12 bp, Homo sapiens
gcctgggcctgc

SEQ ID NO: 1976313 - DNA, 17 bp, Homo sapiens
gcctgggcctgtgcagc

SEQ ID NO: 1976314 - DNA, 19 bp, Homo sapiens
gcctgggcctgtgcagcag

SEQ ID NO: 1976315 - DNA, 23 bp, Homo sapiens
gcctgggcctgtgcagcagccca

SEQ ID NO: 1976316 - DNA, 16 bp, Homo sapiens
gcctggggattgggag

SEQ ID NO: 1976317 - DNA, 22 bp, Homo sapiens
gcctggggctcctttctccagc

SEQ ID NO: 1976318 - DNA, 23 bp, Homo sapiens
gcctgggggcagtgactggcagg

SEQ ID NO: 1976319 - DNA, 15 bp, Homo sapiens
gcctgggggcctggc

SEQ ID NO: 1976320 - DNA, 18 bp, Homo sapiens
gcctgggggcctggctgg

SEQ ID NO: 1976321 - DNA, 20 bp, Homo sapiens
gcctgggggcctggctggct

SEQ ID NO: 1976322 - DNA, 19 bp, Homo sapiens
gcctggggtgacccggcac

SEQ ID NO: 1976323 - DNA, 23 bp, Homo sapiens
gcctgggtgagaatcctgcctct

SEQ ID NO: 1976324 - DNA, 22 bp, Homo sapiens
gcctgggtggggctgctcctcc

SEQ ID NO: 1976325 - DNA, 23 bp, Homo sapiens
gcctgggtggggctgctcctcca

SEQ ID NO: 1976326 - DNA, 17 bp, Homo sapiens
gcctgggttttctaact

SEQ ID NO: 1976327 - DNA, 21 bp, Homo sapiens
gcctgggttttctaactgtaa

SEQ ID NO: 1976328 - DNA, 23 bp, Homo sapiens
gcctgggttttctaactgtaaat

SEQ ID NO: 1976329 - DNA, 15 bp, Homo sapiens
gcctggtggcagctg

SEQ ID NO: 1976330 - DNA, 19 bp, Homo sapiens
gcctggtggcagctgcggt

SEQ ID NO: 1976331 - DNA, 13 bp, Homo sapiens
gcctggtgggcct

SEQ ID NO: 1976332 - DNA, 16 bp, Homo sapiens
gcctgtaatcccagca

SEQ ID NO: 1976333 - DNA, 17 bp, Homo sapiens
gcctgtaatcccagcac

SEQ ID NO: 1976334 - DNA, 20 bp, Homo sapiens
gcctgtaatcccagcacttt

SEQ ID NO: 1976335 - DNA, 17 bp, Homo sapiens
gcctgtaatcccagcta

SEQ ID NO: 1976336 - DNA, 18 bp, Homo sapiens
gcctgtaatcccagctac

SEQ ID NO: 1976337 - DNA, 17 bp, Homo sapiens
gcctgtactaaggagca

SEQ ID NO: 1976338 - DNA, 18 bp, Homo sapiens
gcctgtactgcctgcttg

SEQ ID NO: 1976339 - DNA, 19 bp, Homo sapiens
gcctgtactgcctgcttgg

SEQ ID NO: 1976340 - DNA, 20 bp, Homo sapiens
gcctgtactgcctgcttggg

SEQ ID NO: 1976341 - DNA, 21 bp, Homo sapiens
gcctgtagccccagtgacagc

SEQ ID NO: 1976342 - DNA, 16 bp, Homo sapiens
gcctgtagttaggaaa

SEQ ID NO: 1976343 - DNA, 19 bp, Homo sapiens
gcctgtagttaggaaataa

SEQ ID NO: 1976344 - DNA, 18 bp, Homo sapiens
gcctgtatagacagcact

SEQ ID NO: 1976345 - DNA, 16 bp, Homo sapiens
gcctgtcccccaaggt

SEQ ID NO: 1976346 - DNA, 12 bp, Homo sapiens
gcctgtcctggt

SEQ ID NO: 1976347 - DNA, 20 bp, Homo sapiens
gcctgtctttcagcattcag

SEQ ID NO: 1976348 - DNA, 18 bp, Homo sapiens
gcctgtgaacccaggaca

SEQ ID NO: 1976349 - DNA, 19 bp, Homo sapiens
gcctgtgaacccaggacaa

SEQ ID NO: 1976350 - DNA, 14 bp, Homo sapiens
gcctgtgcagcagc

SEQ ID NO: 1976351 - DNA, 20 bp, Homo sapiens
gcctgtgcagcagcccagct

SEQ ID NO: 1976352 - DNA, 16 bp, Homo sapiens
gccgccatccgggacg

SEQ ID NO: 1976353 - DNA, 17 bp, Homo sapiens
gccgccatccgggacgc

SEQ ID NO: 1976354 - DNA, 19 bp, Homo sapiens
gccgcccaccgtcttgggt

SEQ ID NO: 1976355 - DNA, 13 bp, Homo sapiens
gccgccctgggct

SEQ ID NO: 1976356 - DNA, 22 bp, Homo sapiens
gccgcctccaggagcctacccc

SEQ ID NO: 1976357 - DNA, 12 bp, Homo sapiens
gccgcctcccag

SEQ ID NO: 1976358 - DNA, 14 bp, Homo sapiens
gccgcctcccagcc

SEQ ID NO: 1976359 - DNA, 17 bp, Homo sapiens
gccgctaggagagactg

SEQ ID NO: 1976360 - DNA, 18 bp, Homo sapiens
gccgctaggagagactga

SEQ ID NO: 1976361 - DNA, 15 bp, Homo sapiens
gccgctcctgtctgc

SEQ ID NO: 1976362 - DNA, 21 bp, Homo sapiens
gccgctcctgtctgccagcca

SEQ ID NO: 1976363 - DNA, 15 bp, Homo sapiens
gccgctgccgctgca

SEQ ID NO: 1976364 - DNA, 14 bp, Homo sapiens
gcctcatgccacac

SEQ ID NO: 1976365 - DNA, 17 bp, Homo sapiens
gcctcatgccacacctt

SEQ ID NO: 1976366 - DNA, 18 bp, Homo sapiens
gcctcatgccacaccttc

SEQ ID NO: 1976367 - DNA, 15 bp, Homo sapiens
gcctcatttttttcc

SEQ ID NO: 1976368 - DNA, 19 bp, Homo sapiens
gcctcatttttttccttgc

SEQ ID NO: 1976369 - DNA, 21 bp, Homo sapiens
gcctcatttttttccttgcaa

SEQ ID NO: 1976370 - DNA, 17 bp, Homo sapiens
gcctccaaatgccaact

SEQ ID NO: 1976371 - DNA, 18 bp, Homo sapiens
gcctccacgggggcggca

SEQ ID NO: 1976372 - DNA, 12 bp, Homo sapiens
gcctccagagcc

SEQ ID NO: 1976373 - DNA, 17 bp, Homo sapiens
gcctccagagccagcct

SEQ ID NO: 1976374 - DNA, 18 bp, Homo sapiens
gcctccagagccagcctg

SEQ ID NO: 1976375 - DNA, 12 bp, Homo sapiens
gcctccagcctc

SEQ ID NO: 1976376 - DNA, 23 bp, Homo sapiens
gcctccagcctctcccggctgcc

SEQ ID NO: 1976377 - DNA, 18 bp, Homo sapiens
gcctccaggagcctaccc

SEQ ID NO: 1976378 - DNA, 11 bp, Homo sapiens
gcctccatgct

SEQ ID NO: 1976379 - DNA, 16 bp, Homo sapiens
gcctccatttctggct

SEQ ID NO: 1976380 - DNA, 23 bp, Homo sapiens
gcctccatttctggcttctagtc

SEQ ID NO: 1976381 - DNA, 17 bp, Homo sapiens
gcctcccaaagtgctgg

SEQ ID NO: 1976382 - DNA, 16 bp, Homo sapiens
gcctcccaataaagct

SEQ ID NO: 1976383 - DNA, 17 bp, Homo sapiens
gcctcccaataaagctg

SEQ ID NO: 1976384 - DNA, 13 bp, Homo sapiens
gcctcccagagtg

SEQ ID NO: 1976385 - DNA, 19 bp, Homo sapiens
gcctcccagccccaggggt

SEQ ID NO: 1976386 - DNA, 23 bp, Homo sapiens
gctactcaggaggctgaggcaga

SEQ ID NO: 1976387 - DNA, 13 bp, Homo sapiens
gctactcctgtgc

SEQ ID NO: 1976388 - DNA, 20 bp, Homo sapiens
gctactcgggaggctgaggc

SEQ ID NO: 1976389 - DNA, 19 bp, Homo sapiens
gctactctagtattccaga

SEQ ID NO: 1976390 - DNA, 21 bp, Homo sapiens
gctactctgtccaggccactg

SEQ ID NO: 1976391 - DNA, 19 bp, Homo sapiens
gctactctgtgccagagcc

SEQ ID NO: 1976392 - DNA, 21 bp, Homo sapiens
gctactctgtgccagagcctg

SEQ ID NO: 1976393 - DNA, 22 bp, Homo sapiens
gctactctgtgccagagcctgg

SEQ ID NO: 1976394 - DNA, 23 bp, Homo sapiens
gctactctgtgccagagcctggg

SEQ ID NO: 1976395 - DNA, 20 bp, Homo sapiens
gctactgaatttattgccgc

SEQ ID NO: 1976396 - DNA, 16 bp, Homo sapiens
gctactgatttttgtg

SEQ ID NO: 1976397 - DNA, 12 bp, Homo sapiens
gctactggcagc

SEQ ID NO: 1976398 - DNA, 14 bp, Homo sapiens
gctactggcagctc

SEQ ID NO: 1976399 - DNA, 16 bp, Homo sapiens
gctactggcagctcct

SEQ ID NO: 1976400 - DNA, 19 bp, Homo sapiens
gctactggcagctcctctc

SEQ ID NO: 1976401 - DNA, 19 bp, Homo sapiens
gctactggcattaattatt

SEQ ID NO: 1976402 - DNA, 18 bp, Homo sapiens
gctagaacctagaagggc

SEQ ID NO: 1976403 - DNA, 19 bp, Homo sapiens
gctagaacctggagagcta

SEQ ID NO: 1976404 - DNA, 20 bp, Homo sapiens
gctagaacctggagagctag

SEQ ID NO: 1976405 - DNA, 15 bp, Homo sapiens
gctagaagctggagg

SEQ ID NO: 1976406 - DNA, 21 bp, Homo sapiens
gctagaagtgggccaggacag

SEQ ID NO: 1976407 - DNA, 19 bp, Homo sapiens
gctagaatctggagagcta

SEQ ID NO: 1976408 - DNA, 15 bp, Homo sapiens
gctagacacccattt

SEQ ID NO: 1976409 - DNA, 13 bp, Homo sapiens
gctagagaagggg

SEQ ID NO: 1976410 - DNA, 21 bp, Homo sapiens
gctagagcaacccctgtaccc

SEQ ID NO: 1976411 - DNA, 20 bp, Homo sapiens
gctagcgctgccgcacccca

SEQ ID NO: 1976412 - DNA, 22 bp, Homo sapiens
gctagcgctgccgcaccccaga

SEQ ID NO: 1976413 - DNA, 12 bp, Homo sapiens
gctaggaatgaa

SEQ ID NO: 1976414 - DNA, 18 bp, Homo sapiens
gctaggaatgaaatcctg

SEQ ID NO: 1976415 - DNA, 11 bp, Homo sapiens
gctaggactga

SEQ ID NO: 1976416 - DNA, 12 bp, Homo sapiens
gctaggactgag

SEQ ID NO: 1976417 - DNA, 14 bp, Homo sapiens
gctaggactgagga

SEQ ID NO: 1976418 - DNA, 17 bp, Homo sapiens
gctaggactgaggagtg

SEQ ID NO: 1976419 - DNA, 16 bp, Homo sapiens
gctaggagcaaagcct

SEQ ID NO: 1976420 - DNA, 13 bp, Homo sapiens
gctagtgatttca

SEQ ID NO: 1976421 - DNA, 21 bp, Homo sapiens
gctagtgtgagtggcagccat

SEQ ID NO: 1976422 - DNA, 23 bp, Homo sapiens
gctagtgtgagtggcagccatgc

SEQ ID NO: 1976423 - DNA, 22 bp, Homo sapiens
gctatcaaaataaattgaaata

SEQ ID NO: 1976424 - DNA, 17 bp, Homo sapiens
gctatcctagagaggct

SEQ ID NO: 1976425 - DNA, 21 bp, Homo sapiens
gctatctgcatttataaatgt

SEQ ID NO: 1976426 - DNA, 21 bp, Homo sapiens
gctatctgtcatctctctggg

SEQ ID NO: 1976427 - DNA, 14 bp, Homo sapiens
gctatgacatgcaa

SEQ ID NO: 1976428 - DNA, 23 bp, Homo sapiens
gctatgagggtccccgggagcac

SEQ ID NO: 1976429 - DNA, 20 bp, Homo sapiens
gctatgattatgccactgct

SEQ ID NO: 1976430 - DNA, 15 bp, Homo sapiens
gctatggcaaggggg

SEQ ID NO: 1976431 - DNA, 13 bp, Homo sapiens
gctatggttttct

SEQ ID NO: 1976432 - DNA, 17 bp, Homo sapiens
gctatgttccctccagc

SEQ ID NO: 1976433 - DNA, 15 bp, Homo sapiens
gctattactgtctgg

SEQ ID NO: 1976434 - DNA, 21 bp, Homo sapiens
gctattatgtaacatccagaa

SEQ ID NO: 1976435 - DNA, 18 bp, Homo sapiens
gctattgatgtttccaga

SEQ ID NO: 1976436 - DNA, 20 bp, Homo sapiens
gctattgatgtttccagaaa

SEQ ID NO: 1976437 - DNA, 16 bp, Homo sapiens
gctattgcactccagt

SEQ ID NO: 1976438 - DNA, 12 bp, Homo sapiens
gctattgcatgt

SEQ ID NO: 1976439 - DNA, 15 bp, Homo sapiens
gctattgcatgtaaa

SEQ ID NO: 1976440 - DNA, 21 bp, Homo sapiens
gctattgcatgtaaaatgcag

SEQ ID NO: 1976441 - DNA, 22 bp, Homo sapiens
gctattgtttctttaagaaagt

SEQ ID NO: 1976442 - DNA, 14 bp, Homo sapiens
gcctttgtttctaa

SEQ ID NO: 1976443 - DNA, 14 bp, Homo sapiens
gccttttatagcta

SEQ ID NO: 1976444 - DNA, 19 bp, Homo sapiens
gcgaaaacgttgacccctt

SEQ ID NO: 1976445 - DNA, 21 bp, Homo sapiens
gcgaaaacgttgacccctttc

SEQ ID NO: 1976446 - DNA, 20 bp, Homo sapiens
gcgaaaacttgaatctgtta

SEQ ID NO: 1976447 - DNA, 23 bp, Homo sapiens
gcgaaaggatgtaaacagtgcct

SEQ ID NO: 1976448 - DNA, 15 bp, Homo sapiens
gcgaaccaatatttg

SEQ ID NO: 1976449 - DNA, 15 bp, Homo sapiens
gcgaaggggccctgg

SEQ ID NO: 1976450 - DNA, 17 bp, Homo sapiens
gcgaagtggctctcagg

SEQ ID NO: 1976451 - DNA, 14 bp, Homo sapiens
gcgaataaatgttc

SEQ ID NO: 1976452 - DNA, 21 bp, Homo sapiens
gcgaataaatgttcaaactgt

SEQ ID NO: 1976453 - DNA, 20 bp, Homo sapiens
gcgagagaggtgggcagcag

SEQ ID NO: 1976454 - DNA, 17 bp, Homo sapiens
gcgagatcgctggcaga

SEQ ID NO: 1976455 - DNA, 16 bp, Homo sapiens
gcgagcatttccctcc

SEQ ID NO: 1976456 - DNA, 15 bp, Homo sapiens
gcgagccctggtggc

SEQ ID NO: 1976457 - DNA, 21 bp, Homo sapiens
gcgagctatgatcgcgccact

SEQ ID NO: 1976458 - DNA, 14 bp, Homo sapiens
gcgagctgctctgc

SEQ ID NO: 1976459 - DNA, 15 bp, Homo sapiens
gcgagctgctctgct

SEQ ID NO: 1976460 - DNA, 17 bp, Homo sapiens
gcgaggtcaacagagaa

SEQ ID NO: 1976461 - DNA, 19 bp, Homo sapiens
gcgaggtcaacagagaagg

SEQ ID NO: 1976462 - DNA, 22 bp, Homo sapiens
gcgaggtcaacagagaaggcag

SEQ ID NO: 1976463 - DNA, 23 bp, Homo sapiens
gcgaggtcaacagagaaggcagg

SEQ ID NO: 1976464 - DNA, 13 bp, Homo sapiens
gcgaggtgtaaag

SEQ ID NO: 1976465 - DNA, 14 bp, Homo sapiens
gcgaggtgtaaagt

SEQ ID NO: 1976466 - DNA, 22 bp, Homo sapiens
gcgagtgccaggactccccagg

SEQ ID NO: 1976467 - DNA, 17 bp, Homo sapiens
gcgatcaagtccagagc

SEQ ID NO: 1976468 - DNA, 22 bp, Homo sapiens
gcgatctgggttcactgcaacc

SEQ ID NO: 1976469 - DNA, 18 bp, Homo sapiens
gcgcaacaacaaggaccc

SEQ ID NO: 1976470 - DNA, 12 bp, Homo sapiens
gcgcaagcctgt

SEQ ID NO: 1976471 - DNA, 21 bp, Homo sapiens
gcgcaagcctgtaatcccagc

SEQ ID NO: 1976472 - DNA, 20 bp, Homo sapiens
gcgcacctatcacccaggct

SEQ ID NO: 1976473 - DNA, 12 bp, Homo sapiens
gcgcacctgccc

SEQ ID NO: 1976474 - DNA, 17 bp, Homo sapiens
gcgcacctgccccctgg

SEQ ID NO: 1976475 - DNA, 18 bp, Homo sapiens
gcgcacctgccccctggt

SEQ ID NO: 1976476 - DNA, 22 bp, Homo sapiens
gcgcagccgccgggcaggcctg

SEQ ID NO: 1976477 - DNA, 22 bp, Homo sapiens
gcgcagggaggatgccacagcc

SEQ ID NO: 1976478 - DNA, 16 bp, Homo sapiens
gcgcatctcttcctga

SEQ ID NO: 1976479 - DNA, 17 bp, Homo sapiens
gcgcatctcttcctgat

SEQ ID NO: 1976480 - DNA, 19 bp, Homo sapiens
gcgccactgagacggcaga

SEQ ID NO: 1976481 - DNA, 22 bp, Homo sapiens
gcgccactgagacggcagagac

SEQ ID NO: 1976482 - DNA, 20 bp, Homo sapiens
gcgcccattcgtctgtccca

SEQ ID NO: 1976483 - DNA, 22 bp, Homo sapiens
gcgccccaacccgtggaggctg

SEQ ID NO: 1976484 - DNA, 13 bp, Homo sapiens
gcgccccttcccc

SEQ ID NO: 1976485 - DNA, 13 bp, Homo sapiens
gcgccctgcagac

SEQ ID NO: 1976486 - DNA, 15 bp, Homo sapiens
gcgcctccttccttg

SEQ ID NO: 1976487 - DNA, 20 bp, Homo sapiens
gcgcctgccctccctggggt

SEQ ID NO: 1976488 - DNA, 19 bp, Homo sapiens
gcgcgcagcgcgtgcacag

SEQ ID NO: 1976489 - DNA, 14 bp, Homo sapiens
gcgcgggaggcacc

SEQ ID NO: 1976490 - DNA, 14 bp, Homo sapiens
gcgcgggcggaggc

SEQ ID NO: 1976491 - DNA, 10 bp, Homo sapiens
gcgctcagga

SEQ ID NO: 1976492 - DNA, 16 bp, Homo sapiens
gcgctcaggacccagg

SEQ ID NO: 1976493 - DNA, 21 bp, Homo sapiens
gctgggttggagggtgtccca

SEQ ID NO: 1976494 - DNA, 14 bp, Homo sapiens
gctggtagagcagg

SEQ ID NO: 1976495 - DNA, 13 bp, Homo sapiens
gctggtccagggc

SEQ ID NO: 1976496 - DNA, 20 bp, Homo sapiens
gctggtcgtgaactcctgag

SEQ ID NO: 1976497 - DNA, 15 bp, Homo sapiens
gctggtctaggagct

SEQ ID NO: 1976498 - DNA, 20 bp, Homo sapiens
gctggtctattttgattttg

SEQ ID NO: 1976499 - DNA, 16 bp, Homo sapiens
gctggtctccctccag

SEQ ID NO: 1976500 - DNA, 20 bp, Homo sapiens
gctggtctccctccagctgg

SEQ ID NO: 1976501 - DNA, 12 bp, Homo sapiens
gctggtctttat

SEQ ID NO: 1976502 - DNA, 15 bp, Homo sapiens
gctggtgctgtggcc

SEQ ID NO: 1976503 - DNA, 19 bp, Homo sapiens
gctggtgctgtggccaggg

SEQ ID NO: 1976504 - DNA, 16 bp, Homo sapiens
gctggtgtcacctgaa

SEQ ID NO: 1976505 - DNA, 23 bp, Homo sapiens
gctggttcagggttggcccctgc

SEQ ID NO: 1976506 - DNA, 17 bp, Homo sapiens
gctggttggagagctag

SEQ ID NO: 1976507 - DNA, 14 bp, Homo sapiens
gctgtaaaatcttg

SEQ ID NO: 1976508 - DNA, 16 bp, Homo sapiens
gctgtaactgctgagc

SEQ ID NO: 1976509 - DNA, 21 bp, Homo sapiens
gctgtaactgctgagccactc

SEQ ID NO: 1976510 - DNA, 14 bp, Homo sapiens
gctgtactcagagc

SEQ ID NO: 1976511 - DNA, 17 bp, Homo sapiens
gctgtactcagagcaga

SEQ ID NO: 1976512 - DNA, 15 bp, Homo sapiens
gctgtagccatggct

SEQ ID NO: 1976513 - DNA, 20 bp, Homo sapiens
gctgtagtagccctttctgt

SEQ ID NO: 1976514 - DNA, 21 bp, Homo sapiens
gctgtagtagccctttctgtg

SEQ ID NO: 1976515 - DNA, 13 bp, Homo sapiens
gctgtatctgtaa

SEQ ID NO: 1976516 - DNA, 18 bp, Homo sapiens
gctgtatttgttcagtga

SEQ ID NO: 1976517 - DNA, 20 bp, Homo sapiens
gctgtcatggaaaagcccag

SEQ ID NO: 1976518 - DNA, 21 bp, Homo sapiens
gctgtcatggaaaagcccagt

SEQ ID NO: 1976519 - DNA, 19 bp, Homo sapiens
gctgtcattcaggacccca

SEQ ID NO: 1976520 - DNA, 12 bp, Homo sapiens
gctgtcccctct

SEQ ID NO: 1976521 - DNA, 15 bp, Homo sapiens
gctgtcccctctgtc

SEQ ID NO: 1976522 - DNA, 19 bp, Homo sapiens
gctgtcctctcgagcccag

SEQ ID NO: 1976523 - DNA, 14 bp, Homo sapiens
gctgtcctgctgtg

SEQ ID NO: 1976524 - DNA, 21 bp, Homo sapiens
gctgtcgccccaggccctccc

SEQ ID NO: 1976525 - DNA, 23 bp, Homo sapiens
gctgtcgccccaggccctccctg

SEQ ID NO: 1976526 - DNA, 19 bp, Homo sapiens
gctgtctccataatgccac

SEQ ID NO: 1976527 - DNA, 15 bp, Homo sapiens
gctttttggcacagt

SEQ ID NO: 1976528 - DNA, 16 bp, Homo sapiens
gctttttgtcttttct

SEQ ID NO: 1976529 - DNA, 18 bp, Homo sapiens
gcttttttttgagaatac

SEQ ID NO: 1976530 - DNA, 21 bp, Homo sapiens
ggaaaaacatctgaaagccac

SEQ ID NO: 1976531 - DNA, 19 bp, Homo sapiens
ggaaaaagaaagaaacact

SEQ ID NO: 1976532 - DNA, 14 bp, Homo sapiens
ggaaaaatatttaa

SEQ ID NO: 1976533 - DNA, 15 bp, Homo sapiens
ggaaaaatcttgggc

SEQ ID NO: 1976534 - DNA, 20 bp, Homo sapiens
ggaaaacaaatcactgtatt

SEQ ID NO: 1976535 - DNA, 14 bp, Homo sapiens
ggaaaagaacacta

SEQ ID NO: 1976536 - DNA, 23 bp, Homo sapiens
ggaaaagaatccctgcagcctgg

SEQ ID NO: 1976537 - DNA, 22 bp, Homo sapiens
ggaaaagagcgcatcaggcctg

SEQ ID NO: 1976538 - DNA, 21 bp, Homo sapiens
ggaaaagaggagtttcgaggt

SEQ ID NO: 1976539 - DNA, 13 bp, Homo sapiens
ggaaaagcccagt

SEQ ID NO: 1976540 - DNA, 21 bp, Homo sapiens
ggaaaagcccagtgacctgac

SEQ ID NO: 1976541 - DNA, 20 bp, Homo sapiens
ggaaaagctgctgacagtgt

SEQ ID NO: 1976542 - DNA, 20 bp, Homo sapiens
ggaaaaggcagggagcgagg

SEQ ID NO: 1976543 - DNA, 16 bp, Homo sapiens
ggaaaagtcaacatct

SEQ ID NO: 1976544 - DNA, 22 bp, Homo sapiens
ggaaacaccgagtctctgtata

SEQ ID NO: 1976545 - DNA, 13 bp, Homo sapiens
ggaaacagggcag

SEQ ID NO: 1976546 - DNA, 15 bp, Homo sapiens
ggaaacagggcagtg

SEQ ID NO: 1976547 - DNA, 16 bp, Homo sapiens
ggaaacagggcagtga

SEQ ID NO: 1976548 - DNA, 22 bp, Homo sapiens
ggaaacccaaggaacaagagaa

SEQ ID NO: 1976549 - DNA, 16 bp, Homo sapiens
ggaaaccttgcagcat

SEQ ID NO: 1976550 - DNA, 17 bp, Homo sapiens
ggaaactggatgaggtc

SEQ ID NO: 1976551 - DNA, 13 bp, Homo sapiens
ggaaactggctga

SEQ ID NO: 1976552 - DNA, 16 bp, Homo sapiens
ggaaagaaagaaggaa

SEQ ID NO: 1976553 - DNA, 20 bp, Homo sapiens
ggaaagcaccgcagcatgtg

SEQ ID NO: 1976554 - DNA, 13 bp, Homo sapiens
ggaaagcagtgtg

SEQ ID NO: 1976555 - DNA, 14 bp, Homo sapiens
ggaaagcctctgct

SEQ ID NO: 1976556 - DNA, 23 bp, Homo sapiens
ggaaagctcagctactgattttt

SEQ ID NO: 1976557 - DNA, 20 bp, Homo sapiens
ggaaagctgatgatgtctct

SEQ ID NO: 1976558 - DNA, 15 bp, Homo sapiens
ggaaaggacccaccc

SEQ ID NO: 1976559 - DNA, 15 bp, Homo sapiens
ggaaataaaaccttt

SEQ ID NO: 1976560 - DNA, 16 bp, Homo sapiens
ggaaataaaacctttc

SEQ ID NO: 1976561 - DNA, 18 bp, Homo sapiens
ggaaataaaacctttcaa

SEQ ID NO: 1976562 - DNA, 23 bp, Homo sapiens
ggaaataaacctggagatgatga

SEQ ID NO: 1976563 - DNA, 16 bp, Homo sapiens
ggaaatcaaatatgca

SEQ ID NO: 1976564 - DNA, 19 bp, Homo sapiens
ggaaatcatcgaaaattca

SEQ ID NO: 1976565 - DNA, 15 bp, Homo sapiens
ggaaatctgttttgt

SEQ ID NO: 1976566 - DNA, 13 bp, Homo sapiens
ggaaatggagggt

SEQ ID NO: 1976567 - DNA, 20 bp, Homo sapiens
ggaaattaaaccctgcccca

SEQ ID NO: 1976568 - DNA, 21 bp, Homo sapiens
ggaacactggaaaataaattt

SEQ ID NO: 1976569 - DNA, 15 bp, Homo sapiens
ggaacagacaggaga

SEQ ID NO: 1976570 - DNA, 20 bp, Homo sapiens
ggaacagactggaagcacag

SEQ ID NO: 1976571 - DNA, 13 bp, Homo sapiens
ggaacagagactc

SEQ ID NO: 1976572 - DNA, 21 bp, Homo sapiens
ggaacagagactctggaagcc

SEQ ID NO: 1976573 - DNA, 18 bp, Homo sapiens
ggaacagagtatatatgt

SEQ ID NO: 1976574 - DNA, 23 bp, Homo sapiens
ggaacagtgtttcccataatttt

SEQ ID NO: 1976575 - DNA, 23 bp, Homo sapiens
ggaaccaccgaagaggaagcaag

SEQ ID NO: 1976576 - DNA, 17 bp, Homo sapiens
ggaaccatgaagctgga

SEQ ID NO: 1976577 - DNA, 14 bp, Homo sapiens
ggaacccagccctg

SEQ ID NO: 1976578 - DNA, 18 bp, Homo sapiens
ggaacccttttcctccag

SEQ ID NO: 1976579 - DNA, 23 bp, Homo sapiens
ggaacccttttcctccagacaga

SEQ ID NO: 1976580 - DNA, 17 bp, Homo sapiens
ggaaccgtgtccagcac

SEQ ID NO: 1976581 - DNA, 20 bp, Homo sapiens
ggaaccgtgtccagcacaga

SEQ ID NO: 1976582 - DNA, 18 bp, Homo sapiens
ggaacctagtactctctg

SEQ ID NO: 1976583 - DNA, 22 bp, Homo sapiens
ggaacctagtactctctgctct

SEQ ID NO: 1976584 - DNA, 14 bp, Homo sapiens
ggaacgagcactgg

SEQ ID NO: 1976585 - DNA, 21 bp, Homo sapiens
ggaactagagggatacactga

SEQ ID NO: 1976586 - DNA, 22 bp, Homo sapiens
ggaactcatcctgtgtggggag

SEQ ID NO: 1976587 - DNA, 22 bp, Homo sapiens
ggaactcccagcaacacaagct

SEQ ID NO: 1976588 - DNA, 11 bp, Homo sapiens
ggaactctgac

SEQ ID NO: 1976589 - DNA, 19 bp, Homo sapiens
ggaactctggcttccaggt

SEQ ID NO: 1976590 - DNA, 14 bp, Homo sapiens
ggaactcttaagca

SEQ ID NO: 1976591 - DNA, 12 bp, Homo sapiens
ggaactgaaggg

SEQ ID NO: 1976592 - DNA, 20 bp, Homo sapiens
ggaactgaagggggcggcct

SEQ ID NO: 1976593 - DNA, 15 bp, Homo sapiens
ggaactggagggtga

SEQ ID NO: 1976594 - DNA, 19 bp, Homo sapiens
ggaactggccaagctgagg

SEQ ID NO: 1976595 - DNA, 15 bp, Homo sapiens
ggaactgtggctttg

SEQ ID NO: 1976596 - DNA, 15 bp, Homo sapiens
ggaacttctaatata

SEQ ID NO: 1976597 - DNA, 14 bp, Homo sapiens
ggaacttgaactga

SEQ ID NO: 1976598 - DNA, 16 bp, Homo sapiens
ggaacttgaactgatt

SEQ ID NO: 1976599 - DNA, 21 bp, Homo sapiens
ggaagaaacaggggatcaaag

SEQ ID NO: 1976600 - DNA, 16 bp, Homo sapiens
ggaagaaaccccaagc

SEQ ID NO: 1976601 - DNA, 16 bp, Homo sapiens
ggaagaaattcctgta

SEQ ID NO: 1976602 - DNA, 19 bp, Homo sapiens
ggaagacttgaagcacaga

SEQ ID NO: 1976603 - DNA, 12 bp, Homo sapiens
ggaagagaagga

SEQ ID NO: 1976604 - DNA, 17 bp, Homo sapiens
ggaagagaaggagcaga

SEQ ID NO: 1976605 - DNA, 14 bp, Homo sapiens
ggaagagaggcacc

SEQ ID NO: 1976606 - DNA, 15 bp, Homo sapiens
ggaagagaggcacct

SEQ ID NO: 1976607 - DNA, 14 bp, Homo sapiens
ggaagagcaggcac

SEQ ID NO: 1976608 - DNA, 15 bp, Homo sapiens
ggaagagcaggcaca

SEQ ID NO: 1976609 - DNA, 13 bp, Homo sapiens
ggaagatgaagag

SEQ ID NO: 1976610 - DNA, 22 bp, Homo sapiens
ggaagatgaagagaagctgaga

SEQ ID NO: 1976611 - DNA, 21 bp, Homo sapiens
ggaagatttaccttttctgtt

SEQ ID NO: 1976612 - DNA, 19 bp, Homo sapiens
ggaagcaagacgtcctgga

SEQ ID NO: 1976613 - DNA, 16 bp, Homo sapiens
gcccagtgacctgacc

SEQ ID NO: 1976614 - DNA, 14 bp, Homo sapiens
gcccagtgcttctc

SEQ ID NO: 1976615 - DNA, 23 bp, Homo sapiens
gcccagtgcttctccaacactga

SEQ ID NO: 1976616 - DNA, 22 bp, Homo sapiens
gcccagtggaacagtcaccctt

SEQ ID NO: 1976617 - DNA, 15 bp, Homo sapiens
gcccagttgggtgga

SEQ ID NO: 1976618 - DNA, 22 bp, Homo sapiens
gcccagttgggtggatgcctgg

SEQ ID NO: 1976619 - DNA, 20 bp, Homo sapiens
gcccataatagttagccctc

SEQ ID NO: 1976620 - DNA, 21 bp, Homo sapiens
gcccataatagttagccctca

SEQ ID NO: 1976621 - DNA, 23 bp, Homo sapiens
gcccataatagttagccctcagt

SEQ ID NO: 1976622 - DNA, 15 bp, Homo sapiens
gcccatacccctgcc

SEQ ID NO: 1976623 - DNA, 16 bp, Homo sapiens
gcccataccttctggt

SEQ ID NO: 1976624 - DNA, 23 bp, Homo sapiens
gcccatagaaacatgacactgac

SEQ ID NO: 1976625 - DNA, 14 bp, Homo sapiens
gcccatcaaaatgt

SEQ ID NO: 1976626 - DNA, 17 bp, Homo sapiens
gcccatctcaggtgcca

SEQ ID NO: 1976627 - DNA, 20 bp, Homo sapiens
gcccatctcaggtgccactc

SEQ ID NO: 1976628 - DNA, 16 bp, Homo sapiens
gcccatgtgtcccctc

SEQ ID NO: 1976629 - DNA, 17 bp, Homo sapiens
gcccatgtgtcccctca

SEQ ID NO: 1976630 - DNA, 21 bp, Homo sapiens
gcccattcgtctgtcccagag

SEQ ID NO: 1976631 - DNA, 23 bp, Homo sapiens
gcccattcgtctgtcccagagct

SEQ ID NO: 1976632 - DNA, 18 bp, Homo sapiens
gcccatttcaattctcaa

SEQ ID NO: 1976633 - DNA, 20 bp, Homo sapiens
gccccaaacgggctgccctg

SEQ ID NO: 1976634 - DNA, 12 bp, Homo sapiens
gccccaaatata

SEQ ID NO: 1976635 - DNA, 17 bp, Homo sapiens
gccccaacccgtggagg

SEQ ID NO: 1976636 - DNA, 19 bp, Homo sapiens
gccccaacccgtggaggct

SEQ ID NO: 1976637 - DNA, 21 bp, Homo sapiens
gccccaactattaaagtgcca

SEQ ID NO: 1976638 - DNA, 14 bp, Homo sapiens
gccccaactcctgg

SEQ ID NO: 1976639 - DNA, 14 bp, Homo sapiens
gccccaactccttc

SEQ ID NO: 1976640 - DNA, 18 bp, Homo sapiens
gccccaactccttccagc

SEQ ID NO: 1976641 - DNA, 14 bp, Homo sapiens
gccccaagcagcca

SEQ ID NO: 1976642 - DNA, 17 bp, Homo sapiens
gccccaagcagccagcc

SEQ ID NO: 1976643 - DNA, 19 bp, Homo sapiens
gccccaagcagccagccag

SEQ ID NO: 1976644 - DNA, 22 bp, Homo sapiens
gccccaagcagccagccagtct

SEQ ID NO: 1976645 - DNA, 16 bp, Homo sapiens
gccccaaggctgctca

SEQ ID NO: 1976646 - DNA, 17 bp, Homo sapiens
gccccaaggctgctcag

SEQ ID NO: 1976647 - DNA, 15 bp, Homo sapiens
gccccaaggggccca

SEQ ID NO: 1976648 - DNA, 18 bp, Homo sapiens
gccccaaggggcccacaa

SEQ ID NO: 1976649 - DNA, 19 bp, Homo sapiens
gccccaaggggtttctgtt

SEQ ID NO: 1976650 - DNA, 20 bp, Homo sapiens
gccccacacggaggcatctg

SEQ ID NO: 1976651 - DNA, 17 bp, Homo sapiens
gccccacagcacccagg

SEQ ID NO: 1976652 - DNA, 20 bp, Homo sapiens
gccccacagcacccaggctc

SEQ ID NO: 1976653 - DNA, 11 bp, Homo sapiens
gccccaccacc

SEQ ID NO: 1976654 - DNA, 14 bp, Homo sapiens
gccccaccagccac

SEQ ID NO: 1976655 - DNA, 17 bp, Homo sapiens
gccccaccagccacctc

SEQ ID NO: 1976656 - DNA, 23 bp, Homo sapiens
gccccacccagggctccctcctg

SEQ ID NO: 1976657 - DNA, 21 bp, Homo sapiens
gccccaccctcaaaccctgtg

SEQ ID NO: 1976658 - DNA, 15 bp, Homo sapiens
gccccagaaggcagg

SEQ ID NO: 1976659 - DNA, 13 bp, Homo sapiens
gccccagacacac

SEQ ID NO: 1976660 - DNA, 22 bp, Homo sapiens
gccccagacacaccccccagtc

SEQ ID NO: 1976661 - DNA, 23 bp, Homo sapiens
gccccagacacaccccccagtcg

SEQ ID NO: 1976662 - DNA, 16 bp, Homo sapiens
gccccagagatgggca

SEQ ID NO: 1976663 - DNA, 20 bp, Homo sapiens
gccccagatctgcctgggcc

SEQ ID NO: 1976664 - DNA, 17 bp, Homo sapiens
gccccagcactaaagca

SEQ ID NO: 1976665 - DNA, 12 bp, Homo sapiens
gccccagccccc

SEQ ID NO: 1976666 - DNA, 16 bp, Homo sapiens
gccccaggccctccct

SEQ ID NO: 1976667 - DNA, 12 bp, Homo sapiens
gccccagggccc

SEQ ID NO: 1976668 - DNA, 19 bp, Homo sapiens
gccccaggggtgcctgtgg

SEQ ID NO: 1976669 - DNA, 21 bp, Homo sapiens
gccccaggggtgcctgtgggg

SEQ ID NO: 1976670 - DNA, 14 bp, Homo sapiens
gccccaggtgccac

SEQ ID NO: 1976671 - DNA, 20 bp, Homo sapiens
gccccaggtgccaccaataa

SEQ ID NO: 1976672 - DNA, 22 bp, Homo sapiens
gccccaggtgccaccaataaaa

SEQ ID NO: 1976673 - DNA, 16 bp, Homo sapiens
gccccagtagtcagaa

SEQ ID NO: 1976674 - DNA, 14 bp, Homo sapiens
gccccagtgacagc

SEQ ID NO: 1976675 - DNA, 14 bp, Homo sapiens
gccccagtgcccac

SEQ ID NO: 1976676 - DNA, 21 bp, Homo sapiens
gccccagtgcccacaggatca

SEQ ID NO: 1976677 - DNA, 21 bp, Homo sapiens
gccccataattttttttttcc

SEQ ID NO: 1976678 - DNA, 18 bp, Homo sapiens
gccccatcagaggctggg

SEQ ID NO: 1976679 - DNA, 14 bp, Homo sapiens
gccccatcctgggc

SEQ ID NO: 1976680 - DNA, 15 bp, Homo sapiens
gccccatcctgggcc

SEQ ID NO: 1976681 - DNA, 16 bp, Homo sapiens
gccccatcctgggcct

SEQ ID NO: 1976682 - DNA, 16 bp, Homo sapiens
gccccatctcctccca

SEQ ID NO: 1976683 - DNA, 19 bp, Homo sapiens
gccccatcttggtcctgtc

SEQ ID NO: 1976684 - DNA, 13 bp, Homo sapiens
gccccatgctctg

SEQ ID NO: 1976685 - DNA, 17 bp, Homo sapiens
gccccatgctctgcccc

SEQ ID NO: 1976686 - DNA, 21 bp, Homo sapiens
gccccatgctctgccccaagc

SEQ ID NO: 1976687 - DNA, 15 bp, Homo sapiens
gccccatgtctctca

SEQ ID NO: 1976688 - DNA, 12 bp, Homo sapiens
gcccccaagcct

SEQ ID NO: 1976689 - DNA, 15 bp, Homo sapiens
gcccccaagcctctg

SEQ ID NO: 1976690 - DNA, 11 bp, Homo sapiens
gcccccacagg

SEQ ID NO: 1976691 - DNA, 12 bp, Homo sapiens
gcccccacaggc

SEQ ID NO: 1976692 - DNA, 22 bp, Homo sapiens
gcccccactttcaccagtttct

SEQ ID NO: 1976693 - DNA, 23 bp, Homo sapiens
gcccccactttcctacaaaatgg

SEQ ID NO: 1976694 - DNA, 20 bp, Homo sapiens
gcccccatctccccaggcct

SEQ ID NO: 1976695 - DNA, 19 bp, Homo sapiens
gccccccacacgcgtgtgt

SEQ ID NO: 1976696 - DNA, 16 bp, Homo sapiens
gccccccacctttctc

SEQ ID NO: 1976697 - DNA, 14 bp, Homo sapiens
gccccccacctttg

SEQ ID NO: 1976698 - DNA, 23 bp, Homo sapiens
gccccccacctttgggatcagcc

SEQ ID NO: 1976699 - DNA, 23 bp, Homo sapiens
gccccccccttgaatctgcaggg

SEQ ID NO: 1976700 - DNA, 16 bp, Homo sapiens
gcccccgacagcccag

SEQ ID NO: 1976701 - DNA, 16 bp, Homo sapiens
gcccccgtcttctctc

SEQ ID NO: 1976702 - DNA, 16 bp, Homo sapiens
gccccctggatgtccc

SEQ ID NO: 1976703 - DNA, 21 bp, Homo sapiens
gccccctggatgtcccctgtc

SEQ ID NO: 1976704 - DNA, 16 bp, Homo sapiens
gccccctgtgccagct

SEQ ID NO: 1976705 - DNA, 22 bp, Homo sapiens
gccccctgtgccagctcaggtg

SEQ ID NO: 1976706 - DNA, 14 bp, Homo sapiens
gccccctgtgccct

SEQ ID NO: 1976707 - DNA, 20 bp, Homo sapiens
gccccgactccagccagcgc

SEQ ID NO: 1976708 - DNA, 18 bp, Homo sapiens
gccccgaggccttctctg

SEQ ID NO: 1976709 - DNA, 23 bp, Homo sapiens
gccccgaggccttctctgaagga

SEQ ID NO: 1976710 - DNA, 13 bp, Homo sapiens
gccccgccctctg

SEQ ID NO: 1976711 - DNA, 17 bp, Homo sapiens
gccccgcttccccacag

SEQ ID NO: 1976712 - DNA, 18 bp, Homo sapiens
gccccgcttccccacaga

SEQ ID NO: 1976713 - DNA, 20 bp, Homo sapiens
gccccgcttccccacagaac

SEQ ID NO: 1976714 - DNA, 16 bp, Homo sapiens
gccccgcttgtccagc

SEQ ID NO: 1976715 - DNA, 18 bp, Homo sapiens
gccccgcttgtccagcgc

SEQ ID NO: 1976716 - DNA, 20 bp, Homo sapiens
gccccgcttgtccagcgcct

SEQ ID NO: 1976717 - DNA, 23 bp, Homo sapiens
gccccggacggacgttggttctg

SEQ ID NO: 1976718 - DNA, 17 bp, Homo sapiens
gccccgggcctgcctct

SEQ ID NO: 1976719 - DNA, 18 bp, Homo sapiens
gccccgggcctgcctctg

SEQ ID NO: 1976720 - DNA, 23 bp, Homo sapiens
gccccgggcctgcctctgactca

SEQ ID NO: 1976721 - DNA, 17 bp, Homo sapiens
gccccgggctctggcca

SEQ ID NO: 1976722 - DNA, 18 bp, Homo sapiens
gccccgggctctggccac

SEQ ID NO: 1976723 - DNA, 14 bp, Homo sapiens
gccccggggctggc

SEQ ID NO: 1976724 - DNA, 21 bp, Homo sapiens
gccccgggtccccagctcccc

SEQ ID NO: 1976725 - DNA, 20 bp, Homo sapiens
gccccgggtgcctcagagca

SEQ ID NO: 1976726 - DNA, 13 bp, Homo sapiens
gccccgttccctg

SEQ ID NO: 1976727 - DNA, 16 bp, Homo sapiens
gccccgttccctgtca

SEQ ID NO: 1976728 - DNA, 18 bp, Homo sapiens
gccccgttccctgtcaga

SEQ ID NO: 1976729 - DNA, 15 bp, Homo sapiens
gcccctcacctgggc

SEQ ID NO: 1976730 - DNA, 16 bp, Homo sapiens
gcccctcacctgggcc

SEQ ID NO: 1976731 - DNA, 15 bp, Homo sapiens
gcccctccacgcctc

SEQ ID NO: 1976732 - DNA, 20 bp, Homo sapiens
gcccctccacgcctcctggc

SEQ ID NO: 1976733 - DNA, 23 bp, Homo sapiens
gcccctccacgcctcctggccag

SEQ ID NO: 1976734 - DNA, 16 bp, Homo sapiens
gcccctccccagccct

SEQ ID NO: 1976735 - DNA, 19 bp, Homo sapiens
gcccctccctcctctggcc

SEQ ID NO: 1976736 - DNA, 20 bp, Homo sapiens
gcccctccctcctctggccc

SEQ ID NO: 1976737 - DNA, 17 bp, Homo sapiens
gcccctccctctgcccc

SEQ ID NO: 1976738 - DNA, 20 bp, Homo sapiens
gcccctccctctgccccaag

SEQ ID NO: 1976739 - DNA, 14 bp, Homo sapiens
gcccctcccttcaa

SEQ ID NO: 1976740 - DNA, 15 bp, Homo sapiens
gcccctcctctgcca

SEQ ID NO: 1976741 - DNA, 21 bp, Homo sapiens
gcccctcctctgccacctccc

SEQ ID NO: 1976742 - DNA, 15 bp, Homo sapiens
gcccctcgctgctgc

SEQ ID NO: 1976743 - DNA, 17 bp, Homo sapiens
gcccctcgctgctgcta

SEQ ID NO: 1976744 - DNA, 19 bp, Homo sapiens
gcccctgaggactggagac

SEQ ID NO: 1976745 - DNA, 13 bp, Homo sapiens
gcccctgcacaaa

SEQ ID NO: 1976746 - DNA, 14 bp, Homo sapiens
gcccctgcagttgg

SEQ ID NO: 1976747 - DNA, 17 bp, Homo sapiens
gcccctgcagttggcag

SEQ ID NO: 1976748 - DNA, 17 bp, Homo sapiens
gcccctgccaccctggg

SEQ ID NO: 1976749 - DNA, 12 bp, Homo sapiens
gcccctgcccca

SEQ ID NO: 1976750 - DNA, 17 bp, Homo sapiens
gcccctgcccccaaagg

SEQ ID NO: 1976751 - DNA, 14 bp, Homo sapiens
gcccctgcccggct

SEQ ID NO: 1976752 - DNA, 15 bp, Homo sapiens
gcccctgcccggctg

SEQ ID NO: 1976753 - DNA, 15 bp, Homo sapiens
gcccctgggatggga

SEQ ID NO: 1976754 - DNA, 18 bp, Homo sapiens
gcccctggtaagcagagg

SEQ ID NO: 1976755 - DNA, 19 bp, Homo sapiens
gcccctggtaagcagaggc

SEQ ID NO: 1976756 - DNA, 23 bp, Homo sapiens
gccccttaagggttgaaggcagt

SEQ ID NO: 1976757 - DNA, 23 bp, Homo sapiens
gccccttactatgatctcaggag

SEQ ID NO: 1976758 - DNA, 15 bp, Homo sapiens
gccccttcccatctc

SEQ ID NO: 1976759 - DNA, 21 bp, Homo sapiens
gccccttccccatctccattt

SEQ ID NO: 1976760 - DNA, 12 bp, Homo sapiens
gccccttccccc

SEQ ID NO: 1976761 - DNA, 21 bp, Homo sapiens
gccccttgggcatccacccag

SEQ ID NO: 1976762 - DNA, 12 bp, Homo sapiens
gccccttgggcc

SEQ ID NO: 1976763 - DNA, 15 bp, Homo sapiens
gccccttgggcctcc

SEQ ID NO: 1976764 - DNA, 14 bp, Homo sapiens
gcccgaagcccagt

SEQ ID NO: 1976765 - DNA, 18 bp, Homo sapiens
gcccgaagcccagtttcc

SEQ ID NO: 1976766 - DNA, 13 bp, Homo sapiens
gcccgacagagag

SEQ ID NO: 1976767 - DNA, 14 bp, Homo sapiens
gcccgacagagaga

SEQ ID NO: 1976768 - DNA, 18 bp, Homo sapiens
gcccgacagagagatgaa

SEQ ID NO: 1976769 - DNA, 12 bp, Homo sapiens
gcccgacagcct

SEQ ID NO: 1976770 - DNA, 17 bp, Homo sapiens
gcccgacagcctggcac

SEQ ID NO: 1976771 - DNA, 19 bp, Homo sapiens
gcccgacagcctggcacag

SEQ ID NO: 1976772 - DNA, 16 bp, Homo sapiens
gcccgacaggcatgca

SEQ ID NO: 1976773 - DNA, 15 bp, Homo sapiens
gcccgactagcaggc

SEQ ID NO: 1976774 - DNA, 12 bp, Homo sapiens
gcccgagcagct

SEQ ID NO: 1976775 - DNA, 19 bp, Homo sapiens
gcccgagcagctgagcagg

SEQ ID NO: 1976776 - DNA, 22 bp, Homo sapiens
gcccgagcagctgagcagggcc

SEQ ID NO: 1976777 - DNA, 17 bp, Homo sapiens
gcccgaggaccgggctg

SEQ ID NO: 1976778 - DNA, 21 bp, Homo sapiens
gcccgaggaccgggctggggt

SEQ ID NO: 1976779 - DNA, 13 bp, Homo sapiens
gcccgccagcctc

SEQ ID NO: 1976780 - DNA, 15 bp, Homo sapiens
gcccgccagcctcag

SEQ ID NO: 1976781 - DNA, 17 bp, Homo sapiens
gcccgcccaaggggact

SEQ ID NO: 1976782 - DNA, 14 bp, Homo sapiens
gcccgccctgcccc

SEQ ID NO: 1976783 - DNA, 14 bp, Homo sapiens
gcccgcctctgtcc

SEQ ID NO: 1976784 - DNA, 16 bp, Homo sapiens
gcccggattctgggag

SEQ ID NO: 1976785 - DNA, 17 bp, Homo sapiens
gcccggattctgggagg

SEQ ID NO: 1976786 - DNA, 14 bp, Homo sapiens
gcccggccagggcc

SEQ ID NO: 1976787 - DNA, 12 bp, Homo sapiens
gcccggccccat

SEQ ID NO: 1976788 - DNA, 23 bp, Homo sapiens
gcccggccccatcagaggctggg

SEQ ID NO: 1976789 - DNA, 15 bp, Homo sapiens
gcccggcctgctccc

SEQ ID NO: 1976790 - DNA, 12 bp, Homo sapiens
gcccggctccag

SEQ ID NO: 1976791 - DNA, 15 bp, Homo sapiens
gcccggctccaggct

SEQ ID NO: 1976792 - DNA, 17 bp, Homo sapiens
gcccgtcttcagcctag

SEQ ID NO: 1976793 - DNA, 20 bp, Homo sapiens
gcccgtgaagcagtgcctcg

SEQ ID NO: 1976794 - DNA, 18 bp, Homo sapiens
gcccgtgtcctgccttga

SEQ ID NO: 1976795 - DNA, 16 bp, Homo sapiens
gccctaagatgccttg

SEQ ID NO: 1976796 - DNA, 19 bp, Homo sapiens
gccctacatcttcagctcc

SEQ ID NO: 1976797 - DNA, 15 bp, Homo sapiens
gccctaccagaggga

SEQ ID NO: 1976798 - DNA, 21 bp, Homo sapiens
gccctagagcacactgtagca

SEQ ID NO: 1976799 - DNA, 21 bp, Homo sapiens
gccctagcgctctcttccaga

SEQ ID NO: 1976800 - DNA, 18 bp, Homo sapiens
gccctaggattcctcccc

SEQ ID NO: 1976801 - DNA, 20 bp, Homo sapiens
gccctaggattcctccccca

SEQ ID NO: 1976802 - DNA, 15 bp, Homo sapiens
gccctcaatcccagc

SEQ ID NO: 1976803 - DNA, 14 bp, Homo sapiens
gccctccatgggct

SEQ ID NO: 1976804 - DNA, 23 bp, Homo sapiens
gccctcccccttccccttctgtg

SEQ ID NO: 1976805 - DNA, 20 bp, Homo sapiens
gccctccctgactccctgtg

SEQ ID NO: 1976806 - DNA, 21 bp, Homo sapiens
gccctccctgactccctgtgg

SEQ ID NO: 1976807 - DNA, 20 bp, Homo sapiens
gccctccctggcatgtcaga

SEQ ID NO: 1976808 - DNA, 13 bp, Homo sapiens
gccctccctggcc

SEQ ID NO: 1976809 - DNA, 14 bp, Homo sapiens
gccctccctggcct

SEQ ID NO: 1976810 - DNA, 15 bp, Homo sapiens
gccctccctggcctc

SEQ ID NO: 1976811 - DNA, 13 bp, Homo sapiens
gccctccctgggg

SEQ ID NO: 1976812 - DNA, 16 bp, Homo sapiens
gccctcgaaccaaggc

SEQ ID NO: 1976813 - DNA, 17 bp, Homo sapiens
gccctcgaaccaaggca

SEQ ID NO: 1976814 - DNA, 21 bp, Homo sapiens
gccctcgaaccaaggcagcct

SEQ ID NO: 1976815 - DNA, 22 bp, Homo sapiens
gccctcgaaccaaggcagcctc

SEQ ID NO: 1976816 - DNA, 18 bp, Homo sapiens
gccctctgctccccagtg

SEQ ID NO: 1976817 - DNA, 18 bp, Homo sapiens
gccctgaaggttcctgag

SEQ ID NO: 1976818 - DNA, 17 bp, Homo sapiens
gccctgacccctgcacc

SEQ ID NO: 1976819 - DNA, 12 bp, Homo sapiens
gccctgacctcc

SEQ ID NO: 1976820 - DNA, 15 bp, Homo sapiens
gccctgacctcccag

SEQ ID NO: 1976821 - DNA, 11 bp, Homo sapiens
gccctgagctc

SEQ ID NO: 1976822 - DNA, 16 bp, Homo sapiens
gccctgagctcaggct

SEQ ID NO: 1976823 - DNA, 22 bp, Homo sapiens
gccctgagctcaggctgagccc

SEQ ID NO: 1976824 - DNA, 13 bp, Homo sapiens
gccctgagctcgg

SEQ ID NO: 1976825 - DNA, 15 bp, Homo sapiens
gccctgagctcggtg

SEQ ID NO: 1976826 - DNA, 22 bp, Homo sapiens
gccctgagctcggtggacccag

SEQ ID NO: 1976827 - DNA, 23 bp, Homo sapiens
gccctgagtggatctccaaggac

SEQ ID NO: 1976828 - DNA, 15 bp, Homo sapiens
gccctgcaaaaatat

SEQ ID NO: 1976829 - DNA, 20 bp, Homo sapiens
gccctgcacagatatttcca

SEQ ID NO: 1976830 - DNA, 18 bp, Homo sapiens
gccctgcagaccctgccc

SEQ ID NO: 1976831 - DNA, 13 bp, Homo sapiens
gccctgcagaggg

SEQ ID NO: 1976832 - DNA, 21 bp, Homo sapiens
gccctgcagaggggaaaccag

SEQ ID NO: 1976833 - DNA, 20 bp, Homo sapiens
gccctgcagccaaacagagc

SEQ ID NO: 1976834 - DNA, 21 bp, Homo sapiens
gccctgcagccaaacagagcc

SEQ ID NO: 1976835 - DNA, 14 bp, Homo sapiens
gccctgccaggagg

SEQ ID NO: 1976836 - DNA, 15 bp, Homo sapiens
gccctgccaggaggc

SEQ ID NO: 1976837 - DNA, 17 bp, Homo sapiens
gccctgccaggaggctg

SEQ ID NO: 1976838 - DNA, 21 bp, Homo sapiens
gccctgccaggaggctgcggc

SEQ ID NO: 1976839 - DNA, 22 bp, Homo sapiens
gccctgccaggaggctgcggcc

SEQ ID NO: 1976840 - DNA, 17 bp, Homo sapiens
gccctgccccatcctgg

SEQ ID NO: 1976841 - DNA, 18 bp, Homo sapiens
gccctgccccatcctggg

SEQ ID NO: 1976842 - DNA, 22 bp, Homo sapiens
gccctgccccatcctgggcctt

SEQ ID NO: 1976843 - DNA, 21 bp, Homo sapiens
gccctgcccccatctccccag

SEQ ID NO: 1976844 - DNA, 23 bp, Homo sapiens
gccctgcccccatctccccaggc

SEQ ID NO: 1976845 - DNA, 14 bp, Homo sapiens
gccctgcccctgcc

SEQ ID NO: 1976846 - DNA, 14 bp, Homo sapiens
gcagagaaggcttc

SEQ ID NO: 1976847 - DNA, 17 bp, Homo sapiens
gcagagaaggcttcctc

SEQ ID NO: 1976848 - DNA, 20 bp, Homo sapiens
gcagagaatgaaagggccca

SEQ ID NO: 1976849 - DNA, 22 bp, Homo sapiens
gcagagaatgaaagggcccaga

SEQ ID NO: 1976850 - DNA, 23 bp, Homo sapiens
gcagagaatgaaagggcccagag

SEQ ID NO: 1976851 - DNA, 18 bp, Homo sapiens
gcagagacaataaaacat

SEQ ID NO: 1976852 - DNA, 17 bp, Homo sapiens
gcagagaccccaggatc

SEQ ID NO: 1976853 - DNA, 14 bp, Homo sapiens
gcagagaccttgcg

SEQ ID NO: 1976854 - DNA, 16 bp, Homo sapiens
gcagagacgcaaggga

SEQ ID NO: 1976855 - DNA, 12 bp, Homo sapiens
gcagagagaagc

SEQ ID NO: 1976856 - DNA, 16 bp, Homo sapiens
gcagagagaagcctgt

SEQ ID NO: 1976857 - DNA, 19 bp, Homo sapiens
gcagagaggtggagaactg

SEQ ID NO: 1976858 - DNA, 22 bp, Homo sapiens
gcagagaggtggagaactggga

SEQ ID NO: 1976859 - DNA, 17 bp, Homo sapiens
gcagagcaaatgaggga

SEQ ID NO: 1976860 - DNA, 19 bp, Homo sapiens
gcagagcaaatgagggagg

SEQ ID NO: 1976861 - DNA, 18 bp, Homo sapiens
gcagagccaccagggcac

SEQ ID NO: 1976862 - DNA, 12 bp, Homo sapiens
gcagagccatgg

SEQ ID NO: 1976863 - DNA, 15 bp, Homo sapiens
gcagagccatgggcc

SEQ ID NO: 1976864 - DNA, 16 bp, Homo sapiens
gcagagccatgggcct

SEQ ID NO: 1976865 - DNA, 19 bp, Homo sapiens
gcagagccatgggcctggg

SEQ ID NO: 1976866 - DNA, 20 bp, Homo sapiens
gcagagcggggaggtgcctg

SEQ ID NO: 1976867 - DNA, 19 bp, Homo sapiens
gcagagctgatggagaagg

SEQ ID NO: 1976868 - DNA, 21 bp, Homo sapiens
gcagagctgatggagaaggaa

SEQ ID NO: 1976869 - DNA, 14 bp, Homo sapiens
gcagaggaccacag

SEQ ID NO: 1976870 - DNA, 14 bp, Homo sapiens
gcagaggcagacag

SEQ ID NO: 1976871 - DNA, 19 bp, Homo sapiens
gcagaggcggaaaccttgc

SEQ ID NO: 1976872 - DNA, 23 bp, Homo sapiens
gcagaggcggaaaccttgcagca

SEQ ID NO: 1976873 - DNA, 17 bp, Homo sapiens
gcagagggaatgttccc

SEQ ID NO: 1976874 - DNA, 19 bp, Homo sapiens
gcagagggcagaggctgga

SEQ ID NO: 1976875 - DNA, 13 bp, Homo sapiens
gcagaggggcagc

SEQ ID NO: 1976876 - DNA, 14 bp, Homo sapiens
gcagaggggcagcc

SEQ ID NO: 1976877 - DNA, 16 bp, Homo sapiens
gcagaggggcagccgc

SEQ ID NO: 1976878 - DNA, 17 bp, Homo sapiens
gcagaggggcagccgct

SEQ ID NO: 1976879 - DNA, 21 bp, Homo sapiens
gcagaggggcagccgctagga

SEQ ID NO: 1976880 - DNA, 12 bp, Homo sapiens
gcagaggggctt

SEQ ID NO: 1976881 - DNA, 19 bp, Homo sapiens
gcagaggggctttctggag

SEQ ID NO: 1976882 - DNA, 19 bp, Homo sapiens
gcagaggggtgctgctcct

SEQ ID NO: 1976883 - DNA, 20 bp, Homo sapiens
gcagaggtaaaagtgtgagc

SEQ ID NO: 1976884 - DNA, 18 bp, Homo sapiens
gcagaggtgagcagagga

SEQ ID NO: 1976885 - DNA, 16 bp, Homo sapiens
gcagaggtttcttgaa

SEQ ID NO: 1976886 - DNA, 16 bp, Homo sapiens
gcagagtataggatgg

SEQ ID NO: 1976887 - DNA, 12 bp, Homo sapiens
gcagagtgagga

SEQ ID NO: 1976888 - DNA, 22 bp, Homo sapiens
gcagagtgattcaggggctccc

SEQ ID NO: 1976889 - DNA, 18 bp, Homo sapiens
gcagagtgggctgcctgg

SEQ ID NO: 1976890 - DNA, 16 bp, Homo sapiens
gcagataaagacagct

SEQ ID NO: 1976891 - DNA, 22 bp, Homo sapiens
gcagatacaggaaaagctgctg

SEQ ID NO: 1976892 - DNA, 23 bp, Homo sapiens
gcagatctgaaaggcacactttg

SEQ ID NO: 1976893 - DNA, 13 bp, Homo sapiens
gcagatgtaggag

SEQ ID NO: 1976894 - DNA, 15 bp, Homo sapiens
gcagatgtaggaggg

SEQ ID NO: 1976895 - DNA, 16 bp, Homo sapiens
gcagatgtaggaggga

SEQ ID NO: 1976896 - DNA, 18 bp, Homo sapiens
gcagattcctgggcctgt

SEQ ID NO: 1976897 - DNA, 21 bp, Homo sapiens
gcagattcctgggcctgtccc

SEQ ID NO: 1976898 - DNA, 22 bp, Homo sapiens
gcagattcctgggcctgtcccc

SEQ ID NO: 1976899 - DNA, 23 bp, Homo sapiens
gcagatttagtgaaagctagaga

SEQ ID NO: 1976900 - DNA, 16 bp, Homo sapiens
gcagcaaaaatataaa

SEQ ID NO: 1976901 - DNA, 14 bp, Homo sapiens
gcagcaaagtgtca

SEQ ID NO: 1976902 - DNA, 17 bp, Homo sapiens
gcagcaaggcccgagca

SEQ ID NO: 1976903 - DNA, 20 bp, Homo sapiens
gcagcaccctcccccgcagc

SEQ ID NO: 1976904 - DNA, 15 bp, Homo sapiens
gcagcaccctgcaga

SEQ ID NO: 1976905 - DNA, 17 bp, Homo sapiens
gcagcaccctgcagagc

SEQ ID NO: 1976906 - DNA, 11 bp, Homo sapiens
gcagcacttta

SEQ ID NO: 1976907 - DNA, 19 bp, Homo sapiens
gcagcactttaaccctctc

SEQ ID NO: 1976908 - DNA, 22 bp, Homo sapiens
gcagcagagagccctgggtgac

SEQ ID NO: 1976909 - DNA, 12 bp, Homo sapiens
gcagcagccagc

SEQ ID NO: 1976910 - DNA, 13 bp, Homo sapiens
gcagcagccagcc

SEQ ID NO: 1976911 - DNA, 17 bp, Homo sapiens
gcagcagccagccctgc

SEQ ID NO: 1976912 - DNA, 18 bp, Homo sapiens
gcagcagccagccctgcc

SEQ ID NO: 1976913 - DNA, 23 bp, Homo sapiens
gcagcagccagccctgcctggag

SEQ ID NO: 1976914 - DNA, 22 bp, Homo sapiens
gccacttaccttcaataaagta

SEQ ID NO: 1976915 - DNA, 23 bp, Homo sapiens
gccacttaccttcaataaagtat

SEQ ID NO: 1976916 - DNA, 20 bp, Homo sapiens
gccacttcttaaaggcctgg

SEQ ID NO: 1976917 - DNA, 21 bp, Homo sapiens
gccacttcttaaaggcctgga

SEQ ID NO: 1976918 - DNA, 20 bp, Homo sapiens
gccacttggtttttggctct

SEQ ID NO: 1976919 - DNA, 22 bp, Homo sapiens
gccactttggtacatggccagt

SEQ ID NO: 1976920 - DNA, 12 bp, Homo sapiens
gccagaaataaa

SEQ ID NO: 1976921 - DNA, 17 bp, Homo sapiens
gccagaacctggagggc

SEQ ID NO: 1976922 - DNA, 13 bp, Homo sapiens
gccagaacttcga

SEQ ID NO: 1976923 - DNA, 21 bp, Homo sapiens
gccagaaggagggcagagcca

SEQ ID NO: 1976924 - DNA, 20 bp, Homo sapiens
gccagaatcttcgtcctgcc

SEQ ID NO: 1976925 - DNA, 16 bp, Homo sapiens
gccagacacagataca

SEQ ID NO: 1976926 - DNA, 16 bp, Homo sapiens
gccagacacatggcta

SEQ ID NO: 1976927 - DNA, 14 bp, Homo sapiens
gccagacatgtggt

SEQ ID NO: 1976928 - DNA, 19 bp, Homo sapiens
gccagactggcacagtttt

SEQ ID NO: 1976929 - DNA, 13 bp, Homo sapiens
gccagagaggagc

SEQ ID NO: 1976930 - DNA, 18 bp, Homo sapiens
gccagagaggagcacctg

SEQ ID NO: 1976931 - DNA, 17 bp, Homo sapiens
gccagagcccaagtgcc

SEQ ID NO: 1976932 - DNA, 16 bp, Homo sapiens
gccagagcctggggct

SEQ ID NO: 1976933 - DNA, 16 bp, Homo sapiens
gccagagctggaaggc

SEQ ID NO: 1976934 - DNA, 15 bp, Homo sapiens
gccagagctgggagg

SEQ ID NO: 1976935 - DNA, 18 bp, Homo sapiens
gccagaggacaaggaagt

SEQ ID NO: 1976936 - DNA, 19 bp, Homo sapiens
gccagaggacaaggaagtg

SEQ ID NO: 1976937 - DNA, 18 bp, Homo sapiens
gccagagggagtgacaga

SEQ ID NO: 1976938 - DNA, 15 bp, Homo sapiens
gccagatgcaccagc

SEQ ID NO: 1976939 - DNA, 17 bp, Homo sapiens
gccagatgcaccagccc

SEQ ID NO: 1976940 - DNA, 16 bp, Homo sapiens
gccagattttttaaaa

SEQ ID NO: 1976941 - DNA, 24 bp, Homo sapiens
gccagcacaggggccccagatctg

SEQ ID NO: 1976942 - DNA, 12 bp, Homo sapiens
gccagcaccctc

SEQ ID NO: 1976943 - DNA, 15 bp, Homo sapiens
gccagcaccctctcc

SEQ ID NO: 1976944 - DNA, 21 bp, Homo sapiens
gccagcagaacatgtgggagg

SEQ ID NO: 1976945 - DNA, 20 bp, Homo sapiens
gccagcagccagctctcagc

SEQ ID NO: 1976946 - DNA, 18 bp, Homo sapiens
gccagccagaagcctctg

SEQ ID NO: 1976947 - DNA, 16 bp, Homo sapiens
gccagccagcagccag

SEQ ID NO: 1976948 - DNA, 19 bp, Homo sapiens
gccagccagcagccagctc

SEQ ID NO: 1976949 - DNA, 21 bp, Homo sapiens
gccagccagtcttgcctaggc

SEQ ID NO: 1976950 - DNA, 13 bp, Homo sapiens
gccagcccagccc

SEQ ID NO: 1976951 - DNA, 14 bp, Homo sapiens
gccagcccagccca

SEQ ID NO: 1976952 - DNA, 19 bp, Homo sapiens
gccagccccatcttggtcc

SEQ ID NO: 1976953 - DNA, 15 bp, Homo sapiens
gccagccctccctgt

SEQ ID NO: 1976954 - DNA, 20 bp, Homo sapiens
gccagccctccctgtcctcc

SEQ ID NO: 1976955 - DNA, 13 bp, Homo sapiens
gccagccctgcct

SEQ ID NO: 1976956 - DNA, 14 bp, Homo sapiens
gccagccctgcctg

SEQ ID NO: 1976957 - DNA, 16 bp, Homo sapiens
gccagccctgcctgga

SEQ ID NO: 1976958 - DNA, 17 bp, Homo sapiens
gccagccctgcctggag

SEQ ID NO: 1976959 - DNA, 15 bp, Homo sapiens
gccagccgccctggg

SEQ ID NO: 1976960 - DNA, 16 bp, Homo sapiens
gccagccgccctgggc

SEQ ID NO: 1976961 - DNA, 18 bp, Homo sapiens
gccagccgccctgggctg

SEQ ID NO: 1976962 - DNA, 20 bp, Homo sapiens
gccagccgccctgggctgtc

SEQ ID NO: 1976963 - DNA, 23 bp, Homo sapiens
gccagccggggcgagtggcacgt

SEQ ID NO: 1976964 - DNA, 20 bp, Homo sapiens
gccagccgggtacctcagtt

SEQ ID NO: 1976965 - DNA, 19 bp, Homo sapiens
gccagcctcagctcagcct

SEQ ID NO: 1976966 - DNA, 12 bp, Homo sapiens
gccagcctcagt

SEQ ID NO: 1976967 - DNA, 21 bp, Homo sapiens
gccagcctccccacatatggc

SEQ ID NO: 1976968 - DNA, 14 bp, Homo sapiens
gccagcctggcctc

SEQ ID NO: 1976969 - DNA, 16 bp, Homo sapiens
gccagcctggcctcct

SEQ ID NO: 1976970 - DNA, 22 bp, Homo sapiens
gccagcctggcctcctgcctct

SEQ ID NO: 1976971 - DNA, 20 bp, Homo sapiens
gccagcctgggactcccagt

SEQ ID NO: 1976972 - DNA, 21 bp, Homo sapiens
gccagcctgggactcccagtg

SEQ ID NO: 1976973 - DNA, 17 bp, Homo sapiens
gccagccttgcactgtg

SEQ ID NO: 1976974 - DNA, 23 bp, Homo sapiens
gccagcgcctccctccaccccag

SEQ ID NO: 1976975 - DNA, 17 bp, Homo sapiens
gccagctcctgggcagc

SEQ ID NO: 1976976 - DNA, 19 bp, Homo sapiens
gccagctcctgggcagctt

SEQ ID NO: 1976977 - DNA, 14 bp, Homo sapiens
gccagctgcatcta

SEQ ID NO: 1976978 - DNA, 13 bp, Homo sapiens
gccagctgccttc

SEQ ID NO: 1976979 - DNA, 14 bp, Homo sapiens
gccagctgccttcc

SEQ ID NO: 1976980 - DNA, 22 bp, Homo sapiens
gccagctgccttcctcatcccc

SEQ ID NO: 1976981 - DNA, 16 bp, Homo sapiens
gccagctggtgctgca

SEQ ID NO: 1976982 - DNA, 15 bp, Homo sapiens
gccaggaatctgcca

SEQ ID NO: 1976983 - DNA, 11 bp, Homo sapiens
gccaggacacc

SEQ ID NO: 1976984 - DNA, 19 bp, Homo sapiens
gccaggacacctgccccag

SEQ ID NO: 1976985 - DNA, 13 bp, Homo sapiens
gccaggacagctg

SEQ ID NO: 1976986 - DNA, 15 bp, Homo sapiens
gccaggacagctggc

SEQ ID NO: 1976987 - DNA, 16 bp, Homo sapiens
gccaggacagctggct

SEQ ID NO: 1976988 - DNA, 18 bp, Homo sapiens
gccaggacagctggctgc

SEQ ID NO: 1976989 - DNA, 15 bp, Homo sapiens
gccaggacaggcccg

SEQ ID NO: 1976990 - DNA, 23 bp, Homo sapiens
gccaggaccagtcccagagcagg

SEQ ID NO: 1976991 - DNA, 17 bp, Homo sapiens
gccaggacgaattgaga

SEQ ID NO: 1976992 - DNA, 17 bp, Homo sapiens
gccaggactccccaggc

SEQ ID NO: 1976993 - DNA, 14 bp, Homo sapiens
gccaggagagagat

SEQ ID NO: 1976994 - DNA, 20 bp, Homo sapiens
gccaggagcaaatgtttctg

SEQ ID NO: 1976995 - DNA, 13 bp, Homo sapiens
gccaggagctgga

SEQ ID NO: 1976996 - DNA, 23 bp, Homo sapiens
gccaggagggacaaaggagcctg

SEQ ID NO: 1976997 - DNA, 17 bp, Homo sapiens
gccaggaggtcctcctc

SEQ ID NO: 1976998 - DNA, 19 bp, Homo sapiens
gccaggaggttggtgactg

SEQ ID NO: 1976999 - DNA, 23 bp, Homo sapiens
gccaggaggttggtgactgaaac

SEQ ID NO: 1977000 - DNA, 17 bp, Homo sapiens
gccaggagtctgtgctc

SEQ ID NO: 1977001 - DNA, 19 bp, Homo sapiens
gccaggagtctgtgctctt

SEQ ID NO: 1977002 - DNA, 19 bp, Homo sapiens
gccaggagtttgagaccag

SEQ ID NO: 1977003 - DNA, 17 bp, Homo sapiens
gccaggattcctctctc

SEQ ID NO: 1977004 - DNA, 13 bp, Homo sapiens
gccaggcacctgg

SEQ ID NO: 1977005 - DNA, 21 bp, Homo sapiens
gccaggcacctggcctgctgg

SEQ ID NO: 1977006 - DNA, 14 bp, Homo sapiens
gccaggcaggggtg

SEQ ID NO: 1977007 - DNA, 20 bp, Homo sapiens
gccaggcaggggtgggagag

SEQ ID NO: 1977008 - DNA, 16 bp, Homo sapiens
gccaggccaccaggat

SEQ ID NO: 1977009 - DNA, 13 bp, Homo sapiens
gccaggccagagg

SEQ ID NO: 1977010 - DNA, 16 bp, Homo sapiens
gccaggcccggggctg

SEQ ID NO: 1977011 - DNA, 18 bp, Homo sapiens
gccaggcccggggctggc

SEQ ID NO: 1977012 - DNA, 20 bp, Homo sapiens
gccaggcgttggtgccactt

SEQ ID NO: 1977013 - DNA, 16 bp, Homo sapiens
gccagggccctgcaga

SEQ ID NO: 1977014 - DNA, 14 bp, Homo sapiens
gccagggcctggtg

SEQ ID NO: 1977015 - DNA, 15 bp, Homo sapiens
gccagggtgagagct

SEQ ID NO: 1977016 - DNA, 14 bp, Homo sapiens
gccaggtgcagtgg

SEQ ID NO: 1977017 - DNA, 22 bp, Homo sapiens
gccaggttagcctttgccctgt

SEQ ID NO: 1977018 - DNA, 18 bp, Homo sapiens
gccaggttaggaaggcag

SEQ ID NO: 1977019 - DNA, 18 bp, Homo sapiens
gccaggttatgcctcatg

SEQ ID NO: 1977020 - DNA, 19 bp, Homo sapiens
gccaggttatgcctcatgc

SEQ ID NO: 1977021 - DNA, 12 bp, Homo sapiens
gccagtatttct

SEQ ID NO: 1977022 - DNA, 19 bp, Homo sapiens
gccagtcctagagctcctg

SEQ ID NO: 1977023 - DNA, 23 bp, Homo sapiens
gccagtcctagagctcctgtccc

SEQ ID NO: 1977024 - DNA, 19 bp, Homo sapiens
gccagtcttgcctaggcca

SEQ ID NO: 1977025 - DNA, 20 bp, Homo sapiens
gccagtcttgcctaggccaa

SEQ ID NO: 1977026 - DNA, 13 bp, Homo sapiens
gccagtgactttt

SEQ ID NO: 1977027 - DNA, 16 bp, Homo sapiens
gccagtgccaggacag

SEQ ID NO: 1977028 - DNA, 17 bp, Homo sapiens
gccagtgccaggacagc

SEQ ID NO: 1977029 - DNA, 19 bp, Homo sapiens
gccagtgccaggacagctg

SEQ ID NO: 1977030 - DNA, 22 bp, Homo sapiens
gccagtgccaggacagctggct

SEQ ID NO: 1977031 - DNA, 11 bp, Homo sapiens
gccagtgcctt

SEQ ID NO: 1977032 - DNA, 23 bp, Homo sapiens
gccagtgccttacctcctgccca

SEQ ID NO: 1977033 - DNA, 18 bp, Homo sapiens
gccagtgtaaggcatagg

SEQ ID NO: 1977034 - DNA, 24 bp, Homo sapiens
gccagtgtttagaagagcctgact

SEQ ID NO: 1977035 - DNA, 16 bp, Homo sapiens
gccatagagtttaaca

SEQ ID NO: 1977036 - DNA, 16 bp, Homo sapiens
gccatattcacacctc

SEQ ID NO: 1977037 - DNA, 13 bp, Homo sapiens
gccatcagggtgg

SEQ ID NO: 1977038 - DNA, 19 bp, Homo sapiens
gccatcatgtgcctggaaa

SEQ ID NO: 1977039 - DNA, 20 bp, Homo sapiens
gccatcatgtgcctggaaat

SEQ ID NO: 1977040 - DNA, 18 bp, Homo sapiens
gccatccctgggcccctc

SEQ ID NO: 1977041 - DNA, 19 bp, Homo sapiens
gccatccctgggcccctcc

SEQ ID NO: 1977042 - DNA, 22 bp, Homo sapiens
gccatccttcaccagagcccat

SEQ ID NO: 1977043 - DNA, 21 bp, Homo sapiens
gccatctccaccctgagcctg

SEQ ID NO: 1977044 - DNA, 20 bp, Homo sapiens
gccatgaagtcaccgggatg

SEQ ID NO: 1977045 - DNA, 18 bp, Homo sapiens
gccatgatcgagccactg

SEQ ID NO: 1977046 - DNA, 14 bp, Homo sapiens
gccatgcaattcat

SEQ ID NO: 1977047 - DNA, 14 bp, Homo sapiens
gccatgccactgcc

SEQ ID NO: 1977048 - DNA, 20 bp, Homo sapiens
gccatgccactgccaggcac

SEQ ID NO: 1977049 - DNA, 21 bp, Homo sapiens
gccatgccactgccaggcacc

SEQ ID NO: 1977050 - DNA, 12 bp, Homo sapiens
gccatgcccaga

SEQ ID NO: 1977051 - DNA, 13 bp, Homo sapiens
gccatgcccagag

SEQ ID NO: 1977052 - DNA, 15 bp, Homo sapiens
gccatgcctcatgcc

SEQ ID NO: 1977053 - DNA, 16 bp, Homo sapiens
gccatgcctcatgcca

SEQ ID NO: 1977054 - DNA, 17 bp, Homo sapiens
gccatgcctcatgccac

SEQ ID NO: 1977055 - DNA, 22 bp, Homo sapiens
gccatgcttcttgccccttggg

SEQ ID NO: 1977056 - DNA, 17 bp, Homo sapiens
gccatggaataaaccat

SEQ ID NO: 1977057 - DNA, 18 bp, Homo sapiens
gccatggacagaagaagg

SEQ ID NO: 1977058 - DNA, 19 bp, Homo sapiens
gccatggagttgtgatcat

SEQ ID NO: 1977059 - DNA, 16 bp, Homo sapiens
gccatggcgtgtccct

SEQ ID NO: 1977060 - DNA, 15 bp, Homo sapiens
gccatgggcctcctg

SEQ ID NO: 1977061 - DNA, 16 bp, Homo sapiens
gccatgggcctcctgt

SEQ ID NO: 1977062 - DNA, 13 bp, Homo sapiens
gccatgggcctgg

SEQ ID NO: 1977063 - DNA, 14 bp, Homo sapiens
gccatgggcctggg

SEQ ID NO: 1977064 - DNA, 18 bp, Homo sapiens
gccatgggcctgggcctg

SEQ ID NO: 1977065 - DNA, 20 bp, Homo sapiens
gccatgggcctgggcctgct

SEQ ID NO: 1977066 - DNA, 17 bp, Homo sapiens
gccatggtgacacacag

SEQ ID NO: 1977067 - DNA, 19 bp, Homo sapiens
gccatggtgacacacagca

SEQ ID NO: 1977068 - DNA, 15 bp, Homo sapiens
gccatgtcgcctgcc

SEQ ID NO: 1977069 - DNA, 17 bp, Homo sapiens
gccatgtcgcctgcccc

SEQ ID NO: 1977070 - DNA, 15 bp, Homo sapiens
gccatgtcttgttca

SEQ ID NO: 1977071 - DNA, 20 bp, Homo sapiens
gccatgtttagattccagga

SEQ ID NO: 1977072 - DNA, 12 bp, Homo sapiens
gccattcccact

SEQ ID NO: 1977073 - DNA, 14 bp, Homo sapiens
gccatttcctgtct

SEQ ID NO: 1977074 - DNA, 15 bp, Homo sapiens
gccatttcctgtctg

SEQ ID NO: 1977075 - DNA, 12 bp, Homo sapiens
gccatttctctg

SEQ ID NO: 1977076 - DNA, 14 bp, Homo sapiens
gccatttgtactga

SEQ ID NO: 1977077 - DNA, 12 bp, Homo sapiens
gccattttaata

SEQ ID NO: 1977078 - DNA, 14 bp, Homo sapiens
gccattttaataaa

SEQ ID NO: 1977079 - DNA, 18 bp, Homo sapiens
gccattttaataaaatga

SEQ ID NO: 1977080 - DNA, 14 bp, Homo sapiens
gcccaacctgctct

SEQ ID NO: 1977081 - DNA, 24 bp, Homo sapiens
gcccaacctgctctcctcttgcca

SEQ ID NO: 1977082 - DNA, 22 bp, Homo sapiens
gcccaagaatagatgctgactg

SEQ ID NO: 1977083 - DNA, 17 bp, Homo sapiens
gcccaagaggactgaga

SEQ ID NO: 1977084 - DNA, 21 bp, Homo sapiens
gcccaaggcagtgttcctcac

SEQ ID NO: 1977085 - DNA, 10 bp, Homo sapiens
gcccaaggct

SEQ ID NO: 1977086 - DNA, 13 bp, Homo sapiens
gcccaaggggact

SEQ ID NO: 1977087 - DNA, 15 bp, Homo sapiens
gcccaagtgccatcc

SEQ ID NO: 1977088 - DNA, 22 bp, Homo sapiens
gcccaattcttacaaacatgtg

SEQ ID NO: 1977089 - DNA, 21 bp, Homo sapiens
gcccacaaactgatttctcac

SEQ ID NO: 1977090 - DNA, 15 bp, Homo sapiens
gcccacaaaggggag

SEQ ID NO: 1977091 - DNA, 20 bp, Homo sapiens
gcccacaagccttactcacc

SEQ ID NO: 1977092 - DNA, 22 bp, Homo sapiens
gcccacaagccttactcacctc

SEQ ID NO: 1977093 - DNA, 14 bp, Homo sapiens
gcccacacccctcc

SEQ ID NO: 1977094 - DNA, 18 bp, Homo sapiens
gcccacagagatgcatgc

SEQ ID NO: 1977095 - DNA, 11 bp, Homo sapiens
gcccacagagc

SEQ ID NO: 1977096 - DNA, 18 bp, Homo sapiens
gcccacaggatcagtctg

SEQ ID NO: 1977097 - DNA, 19 bp, Homo sapiens
gcccacagggaaccctgct

SEQ ID NO: 1977098 - DNA, 14 bp, Homo sapiens
gcccacatcccagg

SEQ ID NO: 1977099 - DNA, 16 bp, Homo sapiens
gcccacattggaccca

SEQ ID NO: 1977100 - DNA, 16 bp, Homo sapiens
gcccacctgcacgtga

SEQ ID NO: 1977101 - DNA, 15 bp, Homo sapiens
gcccaccttggctca

SEQ ID NO: 1977102 - DNA, 16 bp, Homo sapiens
gcccaccttggctcaa

SEQ ID NO: 1977103 - DNA, 18 bp, Homo sapiens
gcccaccttggctcaagt

SEQ ID NO: 1977104 - DNA, 16 bp, Homo sapiens
gcccacgctggagtgc

SEQ ID NO: 1977105 - DNA, 17 bp, Homo sapiens
gcccacgctggagtgca

SEQ ID NO: 1977106 - DNA, 18 bp, Homo sapiens
gcccactatggtcatctt

SEQ ID NO: 1977107 - DNA, 16 bp, Homo sapiens
gcccacttcagcccag

SEQ ID NO: 1977108 - DNA, 16 bp, Homo sapiens
gcccacttgaggctgg

SEQ ID NO: 1977109 - DNA, 22 bp, Homo sapiens
gcccacttgaggctggcactcc

SEQ ID NO: 1977110 - DNA, 14 bp, Homo sapiens
gcccagaattgcat

SEQ ID NO: 1977111 - DNA, 18 bp, Homo sapiens
gcccagagaccccttcct

SEQ ID NO: 1977112 - DNA, 19 bp, Homo sapiens
gcccagagatgcctccacc

SEQ ID NO: 1977113 - DNA, 20 bp, Homo sapiens
gcccagagatgcctccaccg

SEQ ID NO: 1977114 - DNA, 22 bp, Homo sapiens
gcccagccattaccatggagac

SEQ ID NO: 1977115 - DNA, 16 bp, Homo sapiens
gcccagcctcctccca

SEQ ID NO: 1977116 - DNA, 18 bp, Homo sapiens
gcccagcctcctcccacc

SEQ ID NO: 1977117 - DNA, 15 bp, Homo sapiens
gcccagcctctgtcc

SEQ ID NO: 1977118 - DNA, 11 bp, Homo sapiens
gcccagcctgt

SEQ ID NO: 1977119 - DNA, 14 bp, Homo sapiens
gcccagctctttgt

SEQ ID NO: 1977120 - DNA, 14 bp, Homo sapiens
gcccagctgtagcc

SEQ ID NO: 1977121 - DNA, 17 bp, Homo sapiens
gcccagcttcctggtgt

SEQ ID NO: 1977122 - DNA, 10 bp, Homo sapiens
gcccaggaga

SEQ ID NO: 1977123 - DNA, 18 bp, Homo sapiens
gcccaggagagccagccc

SEQ ID NO: 1977124 - DNA, 21 bp, Homo sapiens
gcccaggagctgagtcacctc

SEQ ID NO: 1977125 - DNA, 12 bp, Homo sapiens
gcccaggcaggt

SEQ ID NO: 1977126 - DNA, 16 bp, Homo sapiens
gcccaggcaggtcttg

SEQ ID NO: 1977127 - DNA, 13 bp, Homo sapiens
gcccaggcccctg

SEQ ID NO: 1977128 - DNA, 15 bp, Homo sapiens
gcccaggcccctgcc

SEQ ID NO: 1977129 - DNA, 20 bp, Homo sapiens
gcccaggcccctgccaccct

SEQ ID NO: 1977130 - DNA, 22 bp, Homo sapiens
gcccaggcccctgccaccctgg

SEQ ID NO: 1977131 - DNA, 23 bp, Homo sapiens
gcccaggccgttccccttggctt

SEQ ID NO: 1977132 - DNA, 15 bp, Homo sapiens
gcccaggcctccacg

SEQ ID NO: 1977133 - DNA, 13 bp, Homo sapiens
gcccaggctctgg

SEQ ID NO: 1977134 - DNA, 16 bp, Homo sapiens
gcccaggctctgggaa

SEQ ID NO: 1977135 - DNA, 23 bp, Homo sapiens
gcccaggctctgggaaggggtgc

SEQ ID NO: 1977136 - DNA, 14 bp, Homo sapiens
gcccaggctggaga

SEQ ID NO: 1977137 - DNA, 19 bp, Homo sapiens
gcccaggctggagtgcagt

SEQ ID NO: 1977138 - DNA, 20 bp, Homo sapiens
gcccaggctggagtgcagtg

SEQ ID NO: 1977139 - DNA, 16 bp, Homo sapiens
gcccaggctggcgtgc

SEQ ID NO: 1977140 - DNA, 21 bp, Homo sapiens
gcccagggaggccgaagctaa

SEQ ID NO: 1977141 - DNA, 14 bp, Homo sapiens
gcccagggctcagc

SEQ ID NO: 1977142 - DNA, 15 bp, Homo sapiens
gcccagggctcagcc

SEQ ID NO: 1977143 - DNA, 16 bp, Homo sapiens
gcccagggctcagcct

SEQ ID NO: 1977144 - DNA, 17 bp, Homo sapiens
gcccagggctcagcctg

SEQ ID NO: 1977145 - DNA, 16 bp, Homo sapiens
gcccagggtaggggag

SEQ ID NO: 1977146 - DNA, 16 bp, Homo sapiens
gcccagtcattgggtt

SEQ ID NO: 1977147 - DNA, 15 bp, Homo sapiens
ctgctgagagaccca

SEQ ID NO: 1977148 - DNA, 16 bp, Homo sapiens
ctgctgagagacccaa

SEQ ID NO: 1977149 - DNA, 22 bp, Homo sapiens
ctgctgagagacccaaggagga

SEQ ID NO: 1977150 - DNA, 12 bp, Homo sapiens
ctgctgagccac

SEQ ID NO: 1977151 - DNA, 13 bp, Homo sapiens
ctgctgagccact

SEQ ID NO: 1977152 - DNA, 22 bp, Homo sapiens
ctgctgagccactcgcagtcgc

SEQ ID NO: 1977153 - DNA, 18 bp, Homo sapiens
ctgctgagctctgagagg

SEQ ID NO: 1977154 - DNA, 22 bp, Homo sapiens
ctgctgagctctgagaggccct

SEQ ID NO: 1977155 - DNA, 12 bp, Homo sapiens
ctgctgcaaagt

SEQ ID NO: 1977156 - DNA, 18 bp, Homo sapiens
ctgctgcagcatgaaggc

SEQ ID NO: 1977157 - DNA, 20 bp, Homo sapiens
ctgctgcatttgtgtcatct

SEQ ID NO: 1977158 - DNA, 22 bp, Homo sapiens
ctgctgccatggcgtgtccctc

SEQ ID NO: 1977159 - DNA, 22 bp, Homo sapiens
ctgctgcccagcctccaagctc

SEQ ID NO: 1977160 - DNA, 23 bp, Homo sapiens
ctgctgccccgcttccccacaga

SEQ ID NO: 1977161 - DNA, 14 bp, Homo sapiens
ctgctgcccctgca

SEQ ID NO: 1977162 - DNA, 16 bp, Homo sapiens
ctgctgcccctgcagt

SEQ ID NO: 1977163 - DNA, 17 bp, Homo sapiens
ctgctgcccctgcagtt

SEQ ID NO: 1977164 - DNA, 14 bp, Homo sapiens
ctgctgccgcctcc

SEQ ID NO: 1977165 - DNA, 22 bp, Homo sapiens
ctgacctcccagccctatggat

SEQ ID NO: 1977166 - DNA, 19 bp, Homo sapiens
ctgacctcctcctgccctc

SEQ ID NO: 1977167 - DNA, 21 bp, Homo sapiens
ctgacctgaggctcctgtgct

SEQ ID NO: 1977168 - DNA, 13 bp, Homo sapiens
ctgacctgcaggc

SEQ ID NO: 1977169 - DNA, 19 bp, Homo sapiens
ctgaccttggagagacaca

SEQ ID NO: 1977170 - DNA, 20 bp, Homo sapiens
ctgaccttggagagacacag

SEQ ID NO: 1977171 - DNA, 22 bp, Homo sapiens
ctgacgccctgcgttggagcca

SEQ ID NO: 1977172 - DNA, 24 bp, Homo sapiens
ctgacgtcagtagtttgagaccag

SEQ ID NO: 1977173 - DNA, 13 bp, Homo sapiens
ctgactcacaaga

SEQ ID NO: 1977174 - DNA, 13 bp, Homo sapiens
ctgactccagagt

SEQ ID NO: 1977175 - DNA, 14 bp, Homo sapiens
ctgactccagagtc

SEQ ID NO: 1977176 - DNA, 15 bp, Homo sapiens
ctgactccagagtct

SEQ ID NO: 1977177 - DNA, 22 bp, Homo sapiens
ctgactccagagtctgagcccc

SEQ ID NO: 1977178 - DNA, 19 bp, Homo sapiens
ctgactccagtgagctgga

SEQ ID NO: 1977179 - DNA, 20 bp, Homo sapiens
ctgactccagtgagctggaa

SEQ ID NO: 1977180 - DNA, 19 bp, Homo sapiens
ctgactccatatggaggcc

SEQ ID NO: 1977181 - DNA, 15 bp, Homo sapiens
ctgactccatgtgtg

SEQ ID NO: 1977182 - DNA, 14 bp, Homo sapiens
ctgactccctgtgg

SEQ ID NO: 1977183 - DNA, 17 bp, Homo sapiens
ctgactccctgtggggg

SEQ ID NO: 1977184 - DNA, 17 bp, Homo sapiens
ctgactcctctaagcca

SEQ ID NO: 1977185 - DNA, 15 bp, Homo sapiens
ctgactgacacaggc

SEQ ID NO: 1977186 - DNA, 23 bp, Homo sapiens
ctgactgacacaggccagcccca

SEQ ID NO: 1977187 - DNA, 17 bp, Homo sapiens
ctgactgtactcctccc

SEQ ID NO: 1977188 - DNA, 19 bp, Homo sapiens
ctgactgtgttcagtgcct

SEQ ID NO: 1977189 - DNA, 16 bp, Homo sapiens
ctgacttcctctgatt

SEQ ID NO: 1977190 - DNA, 13 bp, Homo sapiens
ctgacttctaagt

SEQ ID NO: 1977191 - DNA, 13 bp, Homo sapiens
ctgacttctccca

SEQ ID NO: 1977192 - DNA, 22 bp, Homo sapiens
ctgacttggggagatggagttc

SEQ ID NO: 1977193 - DNA, 21 bp, Homo sapiens
ctgactttaattgtgtgtctt

SEQ ID NO: 1977194 - DNA, 18 bp, Homo sapiens
ctgactttgctctttctt

SEQ ID NO: 1977195 - DNA, 10 bp, Homo sapiens
ctgagaaaag

SEQ ID NO: 1977196 - DNA, 13 bp, Homo sapiens
ctgagaaaagaac

SEQ ID NO: 1977197 - DNA, 18 bp, Homo sapiens
ctgagaaacccaccagcc

SEQ ID NO: 1977198 - DNA, 13 bp, Homo sapiens
ctgagaaagacta

SEQ ID NO: 1977199 - DNA, 18 bp, Homo sapiens
ctgagaaagactattcaa

SEQ ID NO: 1977200 - DNA, 20 bp, Homo sapiens
ctgagaaagactattcaaac

SEQ ID NO: 1977201 - DNA, 22 bp, Homo sapiens
ctgagaaagactattcaaacag

SEQ ID NO: 1977202 - DNA, 22 bp, Homo sapiens
ctgagaaatgaatgctgagacc

SEQ ID NO: 1977203 - DNA, 11 bp, Homo sapiens
ctgagaagaag

SEQ ID NO: 1977204 - DNA, 17 bp, Homo sapiens
ctgagaaggcgaggaga

SEQ ID NO: 1977205 - DNA, 18 bp, Homo sapiens
ctgagaaggcgaggagag

SEQ ID NO: 1977206 - DNA, 17 bp, Homo sapiens
ctgagaaggtccttaat

SEQ ID NO: 1977207 - DNA, 23 bp, Homo sapiens
ctgagaaggtccttaatgatccg

SEQ ID NO: 1977208 - DNA, 17 bp, Homo sapiens
ctgagaagtgtatatag

SEQ ID NO: 1977209 - DNA, 15 bp, Homo sapiens
ctgagaattccaagg

SEQ ID NO: 1977210 - DNA, 22 bp, Homo sapiens
ctgagaattttctacctgtgtt

SEQ ID NO: 1977211 - DNA, 13 bp, Homo sapiens
ctgagacaggaga

SEQ ID NO: 1977212 - DNA, 14 bp, Homo sapiens
ctgagaccagttgg

SEQ ID NO: 1977213 - DNA, 19 bp, Homo sapiens
ctgagaccagttgggagca

SEQ ID NO: 1977214 - DNA, 23 bp, Homo sapiens
ctgagaccagttgggagcactgg

SEQ ID NO: 1977215 - DNA, 16 bp, Homo sapiens
ctgagaccatttaaca

SEQ ID NO: 1977216 - DNA, 20 bp, Homo sapiens
ctgagactataactgtcatc

SEQ ID NO: 1977217 - DNA, 14 bp, Homo sapiens
ctgagactccagaa

SEQ ID NO: 1977218 - DNA, 20 bp, Homo sapiens
ctgagactccagaatctgct

SEQ ID NO: 1977219 - DNA, 21 bp, Homo sapiens
ctgagactccagaatctgctg

SEQ ID NO: 1977220 - DNA, 22 bp, Homo sapiens
ctgagactccagaatctgctgt

SEQ ID NO: 1977221 - DNA, 16 bp, Homo sapiens
ctgagagcagatggtc

SEQ ID NO: 1977222 - DNA, 14 bp, Homo sapiens
ctgagaggccctgg

SEQ ID NO: 1977223 - DNA, 20 bp, Homo sapiens
ctgagagtctgaaagacaga

SEQ ID NO: 1977224 - DNA, 18 bp, Homo sapiens
ctgagatctccctccagg

SEQ ID NO: 1977225 - DNA, 16 bp, Homo sapiens
ctgagatgtgaacaca

SEQ ID NO: 1977226 - DNA, 17 bp, Homo sapiens
ctgagcaaatgtggctc

SEQ ID NO: 1977227 - DNA, 21 bp, Homo sapiens
ctgagcaaatgtggctcctgg

SEQ ID NO: 1977228 - DNA, 14 bp, Homo sapiens
ctgagcaagagctg

SEQ ID NO: 1977229 - DNA, 16 bp, Homo sapiens
ctgagcaagagctggc

SEQ ID NO: 1977230 - DNA, 20 bp, Homo sapiens
ctgagcaagagctggcaaag

SEQ ID NO: 1977231 - DNA, 16 bp, Homo sapiens
ctgagcaagatcttgt

SEQ ID NO: 1977232 - DNA, 22 bp, Homo sapiens
ctgagcaagatcttgtctccac

SEQ ID NO: 1977233 - DNA, 14 bp, Homo sapiens
ctgagcaccccctc

SEQ ID NO: 1977234 - DNA, 17 bp, Homo sapiens
ctgagcacctgcttcat

SEQ ID NO: 1977235 - DNA, 15 bp, Homo sapiens
ctgagcactgccagg

SEQ ID NO: 1977236 - DNA, 16 bp, Homo sapiens
ctgagcactgccagga

SEQ ID NO: 1977237 - DNA, 22 bp, Homo sapiens
ctgagcactgccaggagggaca

SEQ ID NO: 1977238 - DNA, 19 bp, Homo sapiens
ctgagcaggcccgacagag

SEQ ID NO: 1977239 - DNA, 13 bp, Homo sapiens
ctgagcagggccg

SEQ ID NO: 1977240 - DNA, 17 bp, Homo sapiens
ctgagcagggccgggga

SEQ ID NO: 1977241 - DNA, 16 bp, Homo sapiens
ctgagcataatgctcc

SEQ ID NO: 1977242 - DNA, 22 bp, Homo sapiens
ctgagccaaacacactgtaaat

SEQ ID NO: 1977243 - DNA, 17 bp, Homo sapiens
ctgagccactcgcagtc

SEQ ID NO: 1977244 - DNA, 13 bp, Homo sapiens
ctgagcccagcca

SEQ ID NO: 1977245 - DNA, 20 bp, Homo sapiens
ctgagcccagccacctccca

SEQ ID NO: 1977246 - DNA, 15 bp, Homo sapiens
ctgagcccaggagct

SEQ ID NO: 1977247 - DNA, 23 bp, Homo sapiens
ctgagcccaggagctgagtcacc

SEQ ID NO: 1977248 - DNA, 15 bp, Homo sapiens
ctgagcccaggccgt

SEQ ID NO: 1977249 - DNA, 16 bp, Homo sapiens
ctgagcccaggccgtt

SEQ ID NO: 1977250 - DNA, 19 bp, Homo sapiens
ctgagcccaggccgttccc

SEQ ID NO: 1977251 - DNA, 13 bp, Homo sapiens
ctgagcccaggga

SEQ ID NO: 1977252 - DNA, 14 bp, Homo sapiens
ctgagcccccggct

SEQ ID NO: 1977253 - DNA, 22 bp, Homo sapiens
ctgagcccccggctagtaccct

SEQ ID NO: 1977254 - DNA, 15 bp, Homo sapiens
ctgagccctggcagg

SEQ ID NO: 1977255 - DNA, 19 bp, Homo sapiens
ctgagcctgccgagcaacc

SEQ ID NO: 1977256 - DNA, 19 bp, Homo sapiens
ctgagcctggcccatagaa

SEQ ID NO: 1977257 - DNA, 22 bp, Homo sapiens
ctgagcctggcccatagaaaca

SEQ ID NO: 1977258 - DNA, 19 bp, Homo sapiens
ctgagctagaagctggagg

SEQ ID NO: 1977259 - DNA, 13 bp, Homo sapiens
ctgagctcaagtg

SEQ ID NO: 1977260 - DNA, 17 bp, Homo sapiens
ctgagctcacaaggcag

SEQ ID NO: 1977261 - DNA, 18 bp, Homo sapiens
ctgagctcacaaggcagc

SEQ ID NO: 1977262 - DNA, 13 bp, Homo sapiens
ctgagctcaggct

SEQ ID NO: 1977263 - DNA, 20 bp, Homo sapiens
ctgagctcaggctgagccca

SEQ ID NO: 1977264 - DNA, 21 bp, Homo sapiens
ctgagctcaggctgagcccag

SEQ ID NO: 1977265 - DNA, 20 bp, Homo sapiens
ctgagctcccccttcccagt

SEQ ID NO: 1977266 - DNA, 17 bp, Homo sapiens
ctgagctcggtggaccc

SEQ ID NO: 1977267 - DNA, 18 bp, Homo sapiens
ctgagctcggtggaccca

SEQ ID NO: 1977268 - DNA, 12 bp, Homo sapiens
ctgagctctgag

SEQ ID NO: 1977269 - DNA, 13 bp, Homo sapiens
ctgagctctgaga

SEQ ID NO: 1977270 - DNA, 15 bp, Homo sapiens
ctgagctctgagagg

SEQ ID NO: 1977271 - DNA, 18 bp, Homo sapiens
ctgagctctgagaggccc

SEQ ID NO: 1977272 - DNA, 19 bp, Homo sapiens
ctgagctctgagaggccct

SEQ ID NO: 1977273 - DNA, 17 bp, Homo sapiens
ctaaagctggtttaatg

SEQ ID NO: 1977274 - DNA, 17 bp, Homo sapiens
ctaaaggtagatcatct

SEQ ID NO: 1977275 - DNA, 18 bp, Homo sapiens
ctaaagtctctgctgcta

SEQ ID NO: 1977276 - DNA, 19 bp, Homo sapiens
ctaaagtttacagtaaata

SEQ ID NO: 1977277 - DNA, 21 bp, Homo sapiens
ctaaagtttacagtaaataaa

SEQ ID NO: 1977278 - DNA, 19 bp, Homo sapiens
ctaaatacctcaatcagtc

SEQ ID NO: 1977279 - DNA, 14 bp, Homo sapiens
ctaaatactgtaca

SEQ ID NO: 1977280 - DNA, 11 bp, Homo sapiens
ctaaatatatg

SEQ ID NO: 1977281 - DNA, 14 bp, Homo sapiens
ctaaatatatgtct

SEQ ID NO: 1977282 - DNA, 15 bp, Homo sapiens
ctaaatccaaagaaa

SEQ ID NO: 1977283 - DNA, 15 bp, Homo sapiens
ctaaatcttccttgt

SEQ ID NO: 1977284 - DNA, 19 bp, Homo sapiens
ctaaatcttccttgtgagg

SEQ ID NO: 1977285 - DNA, 13 bp, Homo sapiens
ctaaatgaagtgc

SEQ ID NO: 1977286 - DNA, 12 bp, Homo sapiens
ctaaatgacctc

SEQ ID NO: 1977287 - DNA, 15 bp, Homo sapiens
ctaaatgacctcagc

SEQ ID NO: 1977288 - DNA, 17 bp, Homo sapiens
ctaaatgacctcagcaa

SEQ ID NO: 1977289 - DNA, 18 bp, Homo sapiens
ctaaatgacctcagcaaa

SEQ ID NO: 1977290 - DNA, 15 bp, Homo sapiens
ctaaatgagctcctg

SEQ ID NO: 1977291 - DNA, 20 bp, Homo sapiens
ctaaatgcaaacactgtgta

SEQ ID NO: 1977292 - DNA, 21 bp, Homo sapiens
ctaaatgcaaacactgtgtat

SEQ ID NO: 1977293 - DNA, 13 bp, Homo sapiens
ctaaatgctggtc

SEQ ID NO: 1977294 - DNA, 19 bp, Homo sapiens
ctaaattacaattgtcatt

SEQ ID NO: 1977295 - DNA, 12 bp, Homo sapiens
ctaaattgtata

SEQ ID NO: 1977296 - DNA, 14 bp, Homo sapiens
ctaaattgtataca

SEQ ID NO: 1977297 - DNA, 16 bp, Homo sapiens
ctaacactcagaagcc

SEQ ID NO: 1977298 - DNA, 20 bp, Homo sapiens
ctaacactcagaagcctggg

SEQ ID NO: 1977299 - DNA, 22 bp, Homo sapiens
ctaacactcagaagcctggggg

SEQ ID NO: 1977300 - DNA, 14 bp, Homo sapiens
ctaacagggaaggc

SEQ ID NO: 1977301 - DNA, 15 bp, Homo sapiens
ctaacagggaaggca

SEQ ID NO: 1977302 - DNA, 22 bp, Homo sapiens
ctaacatataatgttgttattt

SEQ ID NO: 1977303 - DNA, 17 bp, Homo sapiens
ctaaccacgctggacct

SEQ ID NO: 1977304 - DNA, 17 bp, Homo sapiens
ctaaccccaacgcacag

SEQ ID NO: 1977305 - DNA, 21 bp, Homo sapiens
ctaacccccagcccacagagc

SEQ ID NO: 1977306 - DNA, 20 bp, Homo sapiens
ctaacccccagtgccacaga

SEQ ID NO: 1977307 - DNA, 21 bp, Homo sapiens
ctaacccccagtgccacagag

SEQ ID NO: 1977308 - DNA, 23 bp, Homo sapiens
ctaacccccagtgccacagagaa

SEQ ID NO: 1977309 - DNA, 14 bp, Homo sapiens
ctaacccctttcct

SEQ ID NO: 1977310 - DNA, 17 bp, Homo sapiens
ctaacccttaaaaatgc

SEQ ID NO: 1977311 - DNA, 13 bp, Homo sapiens
ctaacctggctta

SEQ ID NO: 1977312 - DNA, 14 bp, Homo sapiens
ctaacctggcttat

SEQ ID NO: 1977313 - DNA, 23 bp, Homo sapiens
ctaacctgtagaacacccctgtg

SEQ ID NO: 1977314 - DNA, 14 bp, Homo sapiens
ctaacgcctgagcc

SEQ ID NO: 1977315 - DNA, 15 bp, Homo sapiens
ctaacgcctgagccc

SEQ ID NO: 1977316 - DNA, 19 bp, Homo sapiens
ctaacgcctgagcccaggg

SEQ ID NO: 1977317 - DNA, 20 bp, Homo sapiens
ctaacgcctgagcccaggga

SEQ ID NO: 1977318 - DNA, 21 bp, Homo sapiens
ctaacgcctgagcccagggag

SEQ ID NO: 1977319 - DNA, 21 bp, Homo sapiens
ctaacgggggtgcggcaggag

SEQ ID NO: 1977320 - DNA, 23 bp, Homo sapiens
ctaacgggggtgcggcaggagca

SEQ ID NO: 1977321 - DNA, 21 bp, Homo sapiens
ctaactacaaggacaatgcct

SEQ ID NO: 1977322 - DNA, 20 bp, Homo sapiens
ctaactccagtctcctgaca

SEQ ID NO: 1977323 - DNA, 17 bp, Homo sapiens
ctaactgtaaatcactt

SEQ ID NO: 1977324 - DNA, 22 bp, Homo sapiens
ctaactgtaaatcacttgtaaa

SEQ ID NO: 1977325 - DNA, 23 bp, Homo sapiens
ctaactgtaaatcacttgtaaat

SEQ ID NO: 1977326 - DNA, 14 bp, Homo sapiens
ctaactgtatgtgt

SEQ ID NO: 1977327 - DNA, 16 bp, Homo sapiens
ctaagaagtccccagg

SEQ ID NO: 1977328 - DNA, 13 bp, Homo sapiens
ctaagagaagtag

SEQ ID NO: 1977329 - DNA, 15 bp, Homo sapiens
ctaagagaagtagaa

SEQ ID NO: 1977330 - DNA, 19 bp, Homo sapiens
ctaagagctagcgctgccg

SEQ ID NO: 1977331 - DNA, 20 bp, Homo sapiens
ctaagatgagatttgccagc

SEQ ID NO: 1977332 - DNA, 22 bp, Homo sapiens
ctaagatgagatttgccagcac

SEQ ID NO: 1977333 - DNA, 24 bp, Homo sapiens
ctaagatgagatttgccagcacag

SEQ ID NO: 1977334 - DNA, 14 bp, Homo sapiens
ctaagattgtacat

SEQ ID NO: 1977335 - DNA, 15 bp, Homo sapiens
ctaagcagctgggac

SEQ ID NO: 1977336 - DNA, 18 bp, Homo sapiens
ctaagcagtgcttgtaaa

SEQ ID NO: 1977337 - DNA, 20 bp, Homo sapiens
ctaagccctcgaaccaaggc

SEQ ID NO: 1977338 - DNA, 14 bp, Homo sapiens
ctaagcctcctttt

SEQ ID NO: 1977339 - DNA, 11 bp, Homo sapiens
ctaagcctgtt

SEQ ID NO: 1977340 - DNA, 13 bp, Homo sapiens
ctaagcctgttgc

SEQ ID NO: 1977341 - DNA, 17 bp, Homo sapiens
ctaagcctttccataag

SEQ ID NO: 1977342 - DNA, 17 bp, Homo sapiens
ctaagctaggaatgaaa

SEQ ID NO: 1977343 - DNA, 13 bp, Homo sapiens
ctaagctgcagct

SEQ ID NO: 1977344 - DNA, 17 bp, Homo sapiens
ctaagctgcagcttcct

SEQ ID NO: 1977345 - DNA, 15 bp, Homo sapiens
ctaagctggagctct

SEQ ID NO: 1977346 - DNA, 19 bp, Homo sapiens
ctaagctggagctcttgga

SEQ ID NO: 1977347 - DNA, 13 bp, Homo sapiens
ctaaggacacact

SEQ ID NO: 1977348 - DNA, 23 bp, Homo sapiens
ctaaggagtgtagcaactacagt

SEQ ID NO: 1977349 - DNA, 12 bp, Homo sapiens
ctaaggatctct

SEQ ID NO: 1977350 - DNA, 17 bp, Homo sapiens
ctaaggatctctcagga

SEQ ID NO: 1977351 - DNA, 20 bp, Homo sapiens
ctaaggatctctcaggagca

SEQ ID NO: 1977352 - DNA, 16 bp, Homo sapiens
ctaaggtgtgctctga

SEQ ID NO: 1977353 - DNA, 14 bp, Homo sapiens
ctaagtaaaaccac

SEQ ID NO: 1977354 - DNA, 16 bp, Homo sapiens
ctaagtagaataaaga

SEQ ID NO: 1977355 - DNA, 19 bp, Homo sapiens
ctaagtaggggcagtgatg

SEQ ID NO: 1977356 - DNA, 19 bp, Homo sapiens
ctaagtgggaagtgaagcc

SEQ ID NO: 1977357 - DNA, 22 bp, Homo sapiens
ctaagtgggaagtgaagcccct

SEQ ID NO: 1977358 - DNA, 20 bp, Homo sapiens
ctaagtggggtgcatccccc

SEQ ID NO: 1977359 - DNA, 16 bp, Homo sapiens
ctaagtgttgaagaag

SEQ ID NO: 1977360 - DNA, 17 bp, Homo sapiens
ctaagttaatttaaagt

SEQ ID NO: 1977361 - DNA, 20 bp, Homo sapiens
ctaagttatagtatatctgg

SEQ ID NO: 1977362 - DNA, 20 bp, Homo sapiens
ctaagttcatgtttgtaaat

SEQ ID NO: 1977363 - DNA, 17 bp, Homo sapiens
ctaagttctaagttcat

SEQ ID NO: 1977364 - DNA, 18 bp, Homo sapiens
ctaagtttagaagcgctc

SEQ ID NO: 1977365 - DNA, 10 bp, Homo sapiens
ctaataaaac

SEQ ID NO: 1977366 - DNA, 13 bp, Homo sapiens
ctaataaaagcat

SEQ ID NO: 1977367 - DNA, 11 bp, Homo sapiens
ctaataaagag

SEQ ID NO: 1977368 - DNA, 15 bp, Homo sapiens
ctaataaagagactg

SEQ ID NO: 1977369 - DNA, 16 bp, Homo sapiens
ctaatacctctgtgtg

SEQ ID NO: 1977370 - DNA, 19 bp, Homo sapiens
ctaatagaaccaagaattc

SEQ ID NO: 1977371 - DNA, 13 bp, Homo sapiens
ctaatagaactca

SEQ ID NO: 1977372 - DNA, 11 bp, Homo sapiens
ctaatatattt

SEQ ID NO: 1977373 - DNA, 16 bp, Homo sapiens
ctaatattaaaaatat

SEQ ID NO: 1977374 - DNA, 19 bp, Homo sapiens
ctaatcaagagtgagtgaa

SEQ ID NO: 1977375 - DNA, 20 bp, Homo sapiens
ctaatcagcattctcactcc

SEQ ID NO: 1977376 - DNA, 21 bp, Homo sapiens
ctaatcagcattctcactcct

SEQ ID NO: 1977377 - DNA, 22 bp, Homo sapiens
ctctgttgcccaggctggagtg

SEQ ID NO: 1977378 - DNA, 22 bp, Homo sapiens
ctctgtttataaaaacaaaaac

SEQ ID NO: 1977379 - DNA, 16 bp, Homo sapiens
ctctgtttctccttct

SEQ ID NO: 1977380 - DNA, 16 bp, Homo sapiens
ctcttacgctctctgt

SEQ ID NO: 1977381 - DNA, 17 bp, Homo sapiens
ctcttagggaaaccaat

SEQ ID NO: 1977382 - DNA, 15 bp, Homo sapiens
ctcttagtgcccgcc

SEQ ID NO: 1977383 - DNA, 20 bp, Homo sapiens
ctcttatagaatatttatta

SEQ ID NO: 1977384 - DNA, 21 bp, Homo sapiens
ctcttatagaatatttattac

SEQ ID NO: 1977385 - DNA, 12 bp, Homo sapiens
ctcttatgaaat

SEQ ID NO: 1977386 - DNA, 14 bp, Homo sapiens
ctcttatgaaatgg

SEQ ID NO: 1977387 - DNA, 15 bp, Homo sapiens
ctcttattgcccacg

SEQ ID NO: 1977388 - DNA, 19 bp, Homo sapiens
ctcttattgcccacgctgg

SEQ ID NO: 1977389 - DNA, 16 bp, Homo sapiens
ctcttcaactgaccag

SEQ ID NO: 1977390 - DNA, 20 bp, Homo sapiens
ctcttcaactgaccagcctc

SEQ ID NO: 1977391 - DNA, 16 bp, Homo sapiens
ctcttcaccccccact

SEQ ID NO: 1977392 - DNA, 18 bp, Homo sapiens
ctcttcaccccccactca

SEQ ID NO: 1977393 - DNA, 17 bp, Homo sapiens
ctgaacggggagaaaag

SEQ ID NO: 1977394 - DNA, 18 bp, Homo sapiens
ctgaactcaagctgcgtt

SEQ ID NO: 1977395 - DNA, 12 bp, Homo sapiens
ctgaactgagcc

SEQ ID NO: 1977396 - DNA, 15 bp, Homo sapiens
ctgaactgagcctag

SEQ ID NO: 1977397 - DNA, 22 bp, Homo sapiens
ctgaacttcaggataataaagt

SEQ ID NO: 1977398 - DNA, 12 bp, Homo sapiens
ctgaagaaggat

SEQ ID NO: 1977399 - DNA, 15 bp, Homo sapiens
ctgaagaatcaagag

SEQ ID NO: 1977400 - DNA, 22 bp, Homo sapiens
ctgaagacaaaccactgtacat

SEQ ID NO: 1977401 - DNA, 14 bp, Homo sapiens
ctgaagacctacca

SEQ ID NO: 1977402 - DNA, 18 bp, Homo sapiens
ctgaagaggcaagagaca

SEQ ID NO: 1977403 - DNA, 20 bp, Homo sapiens
ctgaagatttcagaggctgc

SEQ ID NO: 1977404 - DNA, 15 bp, Homo sapiens
ctgaagccagatcca

SEQ ID NO: 1977405 - DNA, 14 bp, Homo sapiens
ctgaagccattgtc

SEQ ID NO: 1977406 - DNA, 15 bp, Homo sapiens
ctgaagcccatgctt

SEQ ID NO: 1977407 - DNA, 17 bp, Homo sapiens
ctgaagcctatttattt

SEQ ID NO: 1977408 - DNA, 17 bp, Homo sapiens
ctgaagcctctgccctg

SEQ ID NO: 1977409 - DNA, 23 bp, Homo sapiens
ctgaagcctctgccctgcctccc

SEQ ID NO: 1977410 - DNA, 19 bp, Homo sapiens
ctgaagctattgatgtttc

SEQ ID NO: 1977411 - DNA, 18 bp, Homo sapiens
ctgaaggaatagccagag

SEQ ID NO: 1977412 - DNA, 23 bp, Homo sapiens
ctgaaggaatagccagagaggag

SEQ ID NO: 1977413 - DNA, 19 bp, Homo sapiens
ctgaaggacattgcggaca

SEQ ID NO: 1977414 - DNA, 20 bp, Homo sapiens
ctgaaggacattgcggacag

SEQ ID NO: 1977415 - DNA, 21 bp, Homo sapiens
ctgaaggacattgcggacagc

SEQ ID NO: 1977416 - DNA, 12 bp, Homo sapiens
ctgaaggagaag

SEQ ID NO: 1977417 - DNA, 12 bp, Homo sapiens
ctgaaggagatt

SEQ ID NO: 1977418 - DNA, 18 bp, Homo sapiens
ctgaaggagattttcctt

SEQ ID NO: 1977419 - DNA, 14 bp, Homo sapiens
ctgaaggggcacac

SEQ ID NO: 1977420 - DNA, 18 bp, Homo sapiens
ctgaagggtgacatccca

SEQ ID NO: 1977421 - DNA, 20 bp, Homo sapiens
ctgaagggtgacatcccagg

SEQ ID NO: 1977422 - DNA, 21 bp, Homo sapiens
ctgaagggtgacatcccagga

SEQ ID NO: 1977423 - DNA, 19 bp, Homo sapiens
ctgaagtcacacagtgagt

SEQ ID NO: 1977424 - DNA, 15 bp, Homo sapiens
ctgaagtcactgcac

SEQ ID NO: 1977425 - DNA, 16 bp, Homo sapiens
ctgaagtcactgcaca

SEQ ID NO: 1977426 - DNA, 15 bp, Homo sapiens
ctgaagtgaaggaga

SEQ ID NO: 1977427 - DNA, 19 bp, Homo sapiens
ctgaagttcagccaccctg

SEQ ID NO: 1977428 - DNA, 14 bp, Homo sapiens
ctgaagttctgagc

SEQ ID NO: 1977429 - DNA, 15 bp, Homo sapiens
ctgaataacatttgt

SEQ ID NO: 1977430 - DNA, 13 bp, Homo sapiens
ctgaataatttct

SEQ ID NO: 1977431 - DNA, 15 bp, Homo sapiens
ctgaataatttctta

SEQ ID NO: 1977432 - DNA, 17 bp, Homo sapiens
ctgaatacccttttctg

SEQ ID NO: 1977433 - DNA, 21 bp, Homo sapiens
ctgaatataacaacctttaaa

SEQ ID NO: 1977434 - DNA, 15 bp, Homo sapiens
ctgaatattaatccc

SEQ ID NO: 1977435 - DNA, 22 bp, Homo sapiens
ctgaatccatcaggacttggga

SEQ ID NO: 1977436 - DNA, 17 bp, Homo sapiens
ctgaatgctctgtgcga

SEQ ID NO: 1977437 - DNA, 15 bp, Homo sapiens
ctgaatggtccaggg

SEQ ID NO: 1977438 - DNA, 11 bp, Homo sapiens
ctgaatgtatt

SEQ ID NO: 1977439 - DNA, 13 bp, Homo sapiens
ctgaatgtgccta

SEQ ID NO: 1977440 - DNA, 22 bp, Homo sapiens
ctgaatgtgcctaatggagaag

SEQ ID NO: 1977441 - DNA, 23 bp, Homo sapiens
ctgaatgtgcctaatggagaaga

SEQ ID NO: 1977442 - DNA, 18 bp, Homo sapiens
ctgaatgtttattccttg

SEQ ID NO: 1977443 - DNA, 18 bp, Homo sapiens
ctgaattaagttattgat

SEQ ID NO: 1977444 - DNA, 22 bp, Homo sapiens
ctgaatttcaggcattttgttc

SEQ ID NO: 1977445 - DNA, 21 bp, Homo sapiens
ctgaatttggcctgcactaat

SEQ ID NO: 1977446 - DNA, 14 bp, Homo sapiens
ctgaatttgggcct

SEQ ID NO: 1977447 - DNA, 12 bp, Homo sapiens
ctgaatttttaa

SEQ ID NO: 1977448 - DNA, 22 bp, Homo sapiens
ctgaatttttaaacaagtattt

SEQ ID NO: 1977449 - DNA, 22 bp, Homo sapiens
ctgacaacatttctatagccaa

SEQ ID NO: 1977450 - DNA, 16 bp, Homo sapiens
ctgacaacctgtgcag

SEQ ID NO: 1977451 - DNA, 20 bp, Homo sapiens
ctgacaagaagctcccagat

SEQ ID NO: 1977452 - DNA, 13 bp, Homo sapiens
ctgacaagggctg

SEQ ID NO: 1977453 - DNA, 20 bp, Homo sapiens
ctgacaagggctgacctgcc

SEQ ID NO: 1977454 - DNA, 22 bp, Homo sapiens
ctgacaagggctgacctgcctc

SEQ ID NO: 1977455 - DNA, 16 bp, Homo sapiens
ctgacaatggcagcta

SEQ ID NO: 1977456 - DNA, 17 bp, Homo sapiens
ctgacaatggcagctag

SEQ ID NO: 1977457 - DNA, 23 bp, Homo sapiens
ctgacaatggcagctagactgga

SEQ ID NO: 1977458 - DNA, 13 bp, Homo sapiens
ctgacacacagct

SEQ ID NO: 1977459 - DNA, 16 bp, Homo sapiens
ctgacacacagctctg

SEQ ID NO: 1977460 - DNA, 21 bp, Homo sapiens
ctgacacaggaaaccaacacc

SEQ ID NO: 1977461 - DNA, 17 bp, Homo sapiens
ctgacacaggccagccc

SEQ ID NO: 1977462 - DNA, 19 bp, Homo sapiens
ctgacacaggccagcccca

SEQ ID NO: 1977463 - DNA, 15 bp, Homo sapiens
ctgacacccatgtaa

SEQ ID NO: 1977464 - DNA, 18 bp, Homo sapiens
ctgacaccgtccctcagt

SEQ ID NO: 1977465 - DNA, 17 bp, Homo sapiens
ctgacacctaccatgct

SEQ ID NO: 1977466 - DNA, 12 bp, Homo sapiens
ctgacacctcac

SEQ ID NO: 1977467 - DNA, 14 bp, Homo sapiens
ctgacacctcactg

SEQ ID NO: 1977468 - DNA, 20 bp, Homo sapiens
ctgacactaccttatcaggc

SEQ ID NO: 1977469 - DNA, 14 bp, Homo sapiens
ctgacagacacagg

SEQ ID NO: 1977470 - DNA, 18 bp, Homo sapiens
ctgacagacacaggcccg

SEQ ID NO: 1977471 - DNA, 21 bp, Homo sapiens
ctgacagacacaggcccggct

SEQ ID NO: 1977472 - DNA, 12 bp, Homo sapiens
ctgacagaggag

SEQ ID NO: 1977473 - DNA, 12 bp, Homo sapiens
ctgacaggatgt

SEQ ID NO: 1977474 - DNA, 18 bp, Homo sapiens
ctgacaggatgtggcact

SEQ ID NO: 1977475 - DNA, 16 bp, Homo sapiens
ctgacaggcaatgctg

SEQ ID NO: 1977476 - DNA, 17 bp, Homo sapiens
ctgacaggcaatgctgg

SEQ ID NO: 1977477 - DNA, 20 bp, Homo sapiens
ctgacaggcaatgctggctg

SEQ ID NO: 1977478 - DNA, 20 bp, Homo sapiens
ctgacaggttcccagcagct

SEQ ID NO: 1977479 - DNA, 15 bp, Homo sapiens
ctgacattctgattc

SEQ ID NO: 1977480 - DNA, 17 bp, Homo sapiens
ctgacattgttggccaa

SEQ ID NO: 1977481 - DNA, 22 bp, Homo sapiens
ctgacattgttggccaaagcca

SEQ ID NO: 1977482 - DNA, 19 bp, Homo sapiens
ctgacatttctaacatatg

SEQ ID NO: 1977483 - DNA, 13 bp, Homo sapiens
ctgaccaacaggc

SEQ ID NO: 1977484 - DNA, 15 bp, Homo sapiens
ctgaccaacaggctg

SEQ ID NO: 1977485 - DNA, 18 bp, Homo sapiens
ctgaccaacaggctgttc

SEQ ID NO: 1977486 - DNA, 16 bp, Homo sapiens
ctgaccaacatggaga

SEQ ID NO: 1977487 - DNA, 14 bp, Homo sapiens
ctgaccaagagaga

SEQ ID NO: 1977488 - DNA, 17 bp, Homo sapiens
ctgaccaagagagaaag

SEQ ID NO: 1977489 - DNA, 23 bp, Homo sapiens
ctgaccagcctccatgctgcctc

SEQ ID NO: 1977490 - DNA, 18 bp, Homo sapiens
ctgaccatttcaggggtc

SEQ ID NO: 1977491 - DNA, 13 bp, Homo sapiens
ctgacccactgct

SEQ ID NO: 1977492 - DNA, 20 bp, Homo sapiens
ctgacccagagtggagtctg

SEQ ID NO: 1977493 - DNA, 22 bp, Homo sapiens
ctgacccagagtggagtctgag

SEQ ID NO: 1977494 - DNA, 12 bp, Homo sapiens
ctgacccagtcc

SEQ ID NO: 1977495 - DNA, 23 bp, Homo sapiens
ctgaccccaaagagcctggagaa

SEQ ID NO: 1977496 - DNA, 14 bp, Homo sapiens
ctgtggagagaaag

SEQ ID NO: 1977497 - DNA, 17 bp, Homo sapiens
ctgtggagagtgagaat

SEQ ID NO: 1977498 - DNA, 13 bp, Homo sapiens
ctgtggaggcctg

SEQ ID NO: 1977499 - DNA, 17 bp, Homo sapiens
ctgtggattccagcatt

SEQ ID NO: 1977500 - DNA, 16 bp, Homo sapiens
ctgtggcagaaaagag

SEQ ID NO: 1977501 - DNA, 12 bp, Homo sapiens
ctgtggccagag

SEQ ID NO: 1977502 - DNA, 13 bp, Homo sapiens
ctgtggccagagc

SEQ ID NO: 1977503 - DNA, 23 bp, Homo sapiens
ctgtggccagagctggaaggcag

SEQ ID NO: 1977504 - DNA, 22 bp, Homo sapiens
ctgtggccagcttgttatttat

SEQ ID NO: 1977505 - DNA, 12 bp, Homo sapiens
ctgtggcctcac

SEQ ID NO: 1977506 - DNA, 16 bp, Homo sapiens
ctgtggcctcacttcc

SEQ ID NO: 1977507 - DNA, 21 bp, Homo sapiens
ctgtggcctcacttccctggg

SEQ ID NO: 1977508 - DNA, 17 bp, Homo sapiens
ctgtggcctgtgtccag

SEQ ID NO: 1977509 - DNA, 20 bp, Homo sapiens
ctgtggcctgtgtccagcag

SEQ ID NO: 1977510 - DNA, 13 bp, Homo sapiens
ctgtggctcctgc

SEQ ID NO: 1977511 - DNA, 16 bp, Homo sapiens
ctgtggctcctgcctt

SEQ ID NO: 1977512 - DNA, 17 bp, Homo sapiens
ctgtggctgctagcact

SEQ ID NO: 1977513 - DNA, 20 bp, Homo sapiens
ctgtggcttcccatgtcttt

SEQ ID NO: 1977514 - DNA, 23 bp, Homo sapiens
ctgtgggaagagaagggaagcct

SEQ ID NO: 1977515 - DNA, 16 bp, Homo sapiens
ctgtgggagagcgaag

SEQ ID NO: 1977516 - DNA, 14 bp, Homo sapiens
ctgtgggagcctgc

SEQ ID NO: 1977517 - DNA, 12 bp, Homo sapiens
ctgtgggcagca

SEQ ID NO: 1977518 - DNA, 13 bp, Homo sapiens
ctgtgggcagcac

SEQ ID NO: 1977519 - DNA, 15 bp, Homo sapiens
ctgtgggcagcaccc

SEQ ID NO: 1977520 - DNA, 15 bp, Homo sapiens
ctgtgggcttggcct

SEQ ID NO: 1977521 - DNA, 18 bp, Homo sapiens
ctgtgggcttggccttgt

SEQ ID NO: 1977522 - DNA, 19 bp, Homo sapiens
ctgtggggccttggttccc

SEQ ID NO: 1977523 - DNA, 17 bp, Homo sapiens
ctgtgggggaggtccct

SEQ ID NO: 1977524 - DNA, 20 bp, Homo sapiens
ctgtgggggaggtccctgcc

SEQ ID NO: 1977525 - DNA, 14 bp, Homo sapiens
ctgtgggggtggcc

SEQ ID NO: 1977526 - DNA, 19 bp, Homo sapiens
ctgtgggtgctaagggtaa

SEQ ID NO: 1977527 - DNA, 23 bp, Homo sapiens
ctgtggtagtactcctgcaaaat

SEQ ID NO: 1977528 - DNA, 13 bp, Homo sapiens
ctgtggtgacagg

SEQ ID NO: 1977529 - DNA, 16 bp, Homo sapiens
ctgtggtgacaggccc

SEQ ID NO: 1977530 - DNA, 15 bp, Homo sapiens
ctgtggtgactgaac

SEQ ID NO: 1977531 - DNA, 22 bp, Homo sapiens
ctgtggtgactgaacgagggat

SEQ ID NO: 1977532 - DNA, 19 bp, Homo sapiens
ctgtggtggctgtctctgt

SEQ ID NO: 1977533 - DNA, 20 bp, Homo sapiens
ctgtggtggctgtctctgtc

SEQ ID NO: 1977534 - DNA, 20 bp, Homo sapiens
ctgtggttcctaagcctgtt

SEQ ID NO: 1977535 - DNA, 23 bp, Homo sapiens
ctgtgtaacctccacagtagcat

SEQ ID NO: 1977536 - DNA, 20 bp, Homo sapiens
ctgtgtacccactcctcact

SEQ ID NO: 1977537 - DNA, 21 bp, Homo sapiens
ctgtgtacgacaaagcatcat

SEQ ID NO: 1977538 - DNA, 15 bp, Homo sapiens
ctgtgtactctttat

SEQ ID NO: 1977539 - DNA, 17 bp, Homo sapiens
ctgtgtagctctgtcca

SEQ ID NO: 1977540 - DNA, 18 bp, Homo sapiens
ctgtgtagctctgtccac

SEQ ID NO: 1977541 - DNA, 18 bp, Homo sapiens
ctgtgtagctgtgacctg

SEQ ID NO: 1977542 - DNA, 14 bp, Homo sapiens
ctgtgtccagcagc

SEQ ID NO: 1977543 - DNA, 15 bp, Homo sapiens
ctgtgtccagcagct

SEQ ID NO: 1977544 - DNA, 18 bp, Homo sapiens
ctgtgtccagcagctgcg

SEQ ID NO: 1977545 - DNA, 23 bp, Homo sapiens
ctgtgtcccccccagtgcaggga

SEQ ID NO: 1977546 - DNA, 14 bp, Homo sapiens
ctgtgtcctctccc

SEQ ID NO: 1977547 - DNA, 16 bp, Homo sapiens
ctgtgtccttccctgc

SEQ ID NO: 1977548 - DNA, 16 bp, Homo sapiens
ctgtgtcgtagccaag

SEQ ID NO: 1977549 - DNA, 21 bp, Homo sapiens
ctgtgtcttgcaatggcagcc

SEQ ID NO: 1977550 - DNA, 14 bp, Homo sapiens
ctgtgtgaagaaat

SEQ ID NO: 1977551 - DNA, 18 bp, Homo sapiens
ctgtgtgaagttacacaa

SEQ ID NO: 1977552 - DNA, 12 bp, Homo sapiens
ctgtgtgagcat

SEQ ID NO: 1977553 - DNA, 20 bp, Homo sapiens
ctgtgtgagcatctctgtgt

SEQ ID NO: 1977554 - DNA, 15 bp, Homo sapiens
ctgtgtgagttgagt

SEQ ID NO: 1977555 - DNA, 16 bp, Homo sapiens
ctgtgtgatgaacttt

SEQ ID NO: 1977556 - DNA, 21 bp, Homo sapiens
ctgtgtgcaccttaccaactt

SEQ ID NO: 1977557 - DNA, 14 bp, Homo sapiens
ctgtgtgggctgca

SEQ ID NO: 1977558 - DNA, 15 bp, Homo sapiens
ctgtgtggggaggca

SEQ ID NO: 1977559 - DNA, 20 bp, Homo sapiens
ctgtgtggggaggcagctcc

SEQ ID NO: 1977560 - DNA, 18 bp, Homo sapiens
ctggctgttggctggggg

SEQ ID NO: 1977561 - DNA, 15 bp, Homo sapiens
ctggcttccaggtat

SEQ ID NO: 1977562 - DNA, 16 bp, Homo sapiens
ctggcttccaggtatc

SEQ ID NO: 1977563 - DNA, 22 bp, Homo sapiens
ctggcttccaggtatctccagg

SEQ ID NO: 1977564 - DNA, 20 bp, Homo sapiens
ctggcttcccatccccagcg

SEQ ID NO: 1977565 - DNA, 18 bp, Homo sapiens
ctggcttccttctctcaa

SEQ ID NO: 1977566 - DNA, 13 bp, Homo sapiens
ctggcttctagat

SEQ ID NO: 1977567 - DNA, 22 bp, Homo sapiens
ctggcttctagtctggtgttct

SEQ ID NO: 1977568 - DNA, 12 bp, Homo sapiens
ctggcttctgtg

SEQ ID NO: 1977569 - DNA, 14 bp, Homo sapiens
ctggcttgctccag

SEQ ID NO: 1977570 - DNA, 19 bp, Homo sapiens
ctggcttgctccagggtct

SEQ ID NO: 1977571 - DNA, 17 bp, Homo sapiens
ctggcttgtaactccac

SEQ ID NO: 1977572 - DNA, 23 bp, Homo sapiens
ctggctttgacatgaaaagatag

SEQ ID NO: 1977573 - DNA, 23 bp, Homo sapiens
ctggctttgccaagcttgtgaga

SEQ ID NO: 1977574 - DNA, 18 bp, Homo sapiens
ctggctttgtctctagcc

SEQ ID NO: 1977575 - DNA, 22 bp, Homo sapiens
ctggcttttcactgctggctgc

SEQ ID NO: 1977576 - DNA, 23 bp, Homo sapiens
ctgggaaaaaagttttgatgaaa

SEQ ID NO: 1977577 - DNA, 20 bp, Homo sapiens
ctgggaaaggaaaaccaggg

SEQ ID NO: 1977578 - DNA, 21 bp, Homo sapiens
ctgggaaaggacccacccatc

SEQ ID NO: 1977579 - DNA, 16 bp, Homo sapiens
ctgggaaataagagag

SEQ ID NO: 1977580 - DNA, 17 bp, Homo sapiens
ctgggaaccatgaagct

SEQ ID NO: 1977581 - DNA, 20 bp, Homo sapiens
ctgggaaccatgaagctgga

SEQ ID NO: 1977582 - DNA, 18 bp, Homo sapiens
ctgggaacccgactgtga

SEQ ID NO: 1977583 - DNA, 19 bp, Homo sapiens
ctgggaacccgactgtgaa

SEQ ID NO: 1977584 - DNA, 22 bp, Homo sapiens
ctgggaacccgactgtgaaagt

SEQ ID NO: 1977585 - DNA, 22 bp, Homo sapiens
ctgggaagctgtactcagagca

SEQ ID NO: 1977586 - DNA, 16 bp, Homo sapiens
ctgggaaggctacttc

SEQ ID NO: 1977587 - DNA, 12 bp, Homo sapiens
ctgggaaggggt

SEQ ID NO: 1977588 - DNA, 19 bp, Homo sapiens
ctgggaaggggtgccctct

SEQ ID NO: 1977589 - DNA, 13 bp, Homo sapiens
ctgggacacagtt

SEQ ID NO: 1977590 - DNA, 18 bp, Homo sapiens
ctgggaccaggcaccagg

SEQ ID NO: 1977591 - DNA, 14 bp, Homo sapiens
ctgggaccagggca

SEQ ID NO: 1977592 - DNA, 12 bp, Homo sapiens
ctgggacccagc

SEQ ID NO: 1977593 - DNA, 23 bp, Homo sapiens
ctgggacccagctactctgtcca

SEQ ID NO: 1977594 - DNA, 16 bp, Homo sapiens
ctgggaccccagctag

SEQ ID NO: 1977595 - DNA, 20 bp, Homo sapiens
ctgggaccctttccttcctt

SEQ ID NO: 1977596 - DNA, 20 bp, Homo sapiens
ctgggaccgctacaccactc

SEQ ID NO: 1977597 - DNA, 15 bp, Homo sapiens
ctgggactacaggca

SEQ ID NO: 1977598 - DNA, 13 bp, Homo sapiens
ctgggactcccag

SEQ ID NO: 1977599 - DNA, 14 bp, Homo sapiens
ctgggactggccag

SEQ ID NO: 1977600 - DNA, 12 bp, Homo sapiens
ctgggagaacct

SEQ ID NO: 1977601 - DNA, 14 bp, Homo sapiens
ctgggagaacctca

SEQ ID NO: 1977602 - DNA, 14 bp, Homo sapiens
ctgggagctctgca

SEQ ID NO: 1977603 - DNA, 18 bp, Homo sapiens
ctgggaggaacctgaacc

SEQ ID NO: 1977604 - DNA, 13 bp, Homo sapiens
ctgggaggaagca

SEQ ID NO: 1977605 - DNA, 15 bp, Homo sapiens
ctgggaggaagcagg

SEQ ID NO: 1977606 - DNA, 21 bp, Homo sapiens
ctgggaggaagcaggttgagg

SEQ ID NO: 1977607 - DNA, 16 bp, Homo sapiens
ctgggaggctggtctc

SEQ ID NO: 1977608 - DNA, 12 bp, Homo sapiens
ctgggagtgagc

SEQ ID NO: 1977609 - DNA, 16 bp, Homo sapiens
ctgggagtgagctggt

SEQ ID NO: 1977610 - DNA, 15 bp, Homo sapiens
ctgggagtgttctgt

SEQ ID NO: 1977611 - DNA, 21 bp, Homo sapiens
ctgggatgagccgctgtgagc

SEQ ID NO: 1977612 - DNA, 16 bp, Homo sapiens
ctgggatgggaccagg

SEQ ID NO: 1977613 - DNA, 16 bp, Homo sapiens
ctgggatgtagaactt

SEQ ID NO: 1977614 - DNA, 17 bp, Homo sapiens
ctgggattacaggtgtg

SEQ ID NO: 1977615 - DNA, 23 bp, Homo sapiens
ctgggattcaggaaaaggcctgg

SEQ ID NO: 1977616 - DNA, 17 bp, Homo sapiens
ctgggattcccaccaag

SEQ ID NO: 1977617 - DNA, 23 bp, Homo sapiens
ctgggatttcttcgctgctctag

SEQ ID NO: 1977618 - DNA, 20 bp, Homo sapiens
ctgggcaatgaaaccaaagc

SEQ ID NO: 1977619 - DNA, 19 bp, Homo sapiens
ctgggcaatgatggcaatt

SEQ ID NO: 1977620 - DNA, 18 bp, Homo sapiens
ctgggcaccacaggctgc

SEQ ID NO: 1977621 - DNA, 17 bp, Homo sapiens
ctgggcacctctagtgc

SEQ ID NO: 1977622 - DNA, 21 bp, Homo sapiens
ctgggcagtcgtaagggttgc

SEQ ID NO: 1977623 - DNA, 22 bp, Homo sapiens
ctgggccaaaagggcagccagg

SEQ ID NO: 1977624 - DNA, 19 bp, Homo sapiens
ctgggccaactcacctgag

SEQ ID NO: 1977625 - DNA, 15 bp, Homo sapiens
ctgggccaagttcct

SEQ ID NO: 1977626 - DNA, 13 bp, Homo sapiens
ctgggccagcctc

SEQ ID NO: 1977627 - DNA, 14 bp, Homo sapiens
ctgggccagcctca

SEQ ID NO: 1977628 - DNA, 17 bp, Homo sapiens
ctgggccagcctcagct

SEQ ID NO: 1977629 - DNA, 18 bp, Homo sapiens
ctgggccagcctcagctc

SEQ ID NO: 1977630 - DNA, 19 bp, Homo sapiens
ctgggccagcctcagctca

SEQ ID NO: 1977631 - DNA, 22 bp, Homo sapiens
ctgggccagcctcagctcagcc

SEQ ID NO: 1977632 - DNA, 23 bp, Homo sapiens
ctgggccagcctcagctcagcct

SEQ ID NO: 1977633 - DNA, 18 bp, Homo sapiens
ctgggcccacagagatgc

SEQ ID NO: 1977634 - DNA, 15 bp, Homo sapiens
ctgggcccaggctct

SEQ ID NO: 1977635 - DNA, 20 bp, Homo sapiens
ctgggcccaggctctgggaa

SEQ ID NO: 1977636 - DNA, 21 bp, Homo sapiens
ctgggcccaggctctgggaag

SEQ ID NO: 1977637 - DNA, 16 bp, Homo sapiens
ctgggccccaccacct

SEQ ID NO: 1977638 - DNA, 22 bp, Homo sapiens
ctgggcccccactttcaccagt

SEQ ID NO: 1977639 - DNA, 19 bp, Homo sapiens
ctgggcccctccacgcctc

SEQ ID NO: 1977640 - DNA, 22 bp, Homo sapiens
ctgggcccctccacgcctcctg

SEQ ID NO: 1977641 - DNA, 15 bp, Homo sapiens
ctgggccctggggcc

SEQ ID NO: 1977642 - DNA, 16 bp, Homo sapiens
ctggtccttccaggcc

SEQ ID NO: 1977643 - DNA, 17 bp, Homo sapiens
ctggtccttccaggccc

SEQ ID NO: 1977644 - DNA, 19 bp, Homo sapiens
ctggtcgtgaactcctgag

SEQ ID NO: 1977645 - DNA, 21 bp, Homo sapiens
ctggtcgtgaactcctgagct

SEQ ID NO: 1977646 - DNA, 14 bp, Homo sapiens
ctggtctccctcca

SEQ ID NO: 1977647 - DNA, 19 bp, Homo sapiens
ctggtctcgaactcctgac

SEQ ID NO: 1977648 - DNA, 20 bp, Homo sapiens
ctggtctgatgacttgctta

SEQ ID NO: 1977649 - DNA, 13 bp, Homo sapiens
ctggtctgccctg

SEQ ID NO: 1977650 - DNA, 15 bp, Homo sapiens
ctggtctgccctggg

SEQ ID NO: 1977651 - DNA, 20 bp, Homo sapiens
ctggtctgtgctgccctgct

SEQ ID NO: 1977652 - DNA, 15 bp, Homo sapiens
ctggtcttcactgcc

SEQ ID NO: 1977653 - DNA, 16 bp, Homo sapiens
ctggtcttcactgcca

SEQ ID NO: 1977654 - DNA, 14 bp, Homo sapiens
ctggtgaggcccag

SEQ ID NO: 1977655 - DNA, 18 bp, Homo sapiens
ctggtgaggcccagcctg

SEQ ID NO: 1977656 - DNA, 21 bp, Homo sapiens
ctggtgatcacgtggtcacgg

SEQ ID NO: 1977657 - DNA, 16 bp, Homo sapiens
ctggtgcactggcccc

SEQ ID NO: 1977658 - DNA, 22 bp, Homo sapiens
ctggtgcctatttattcattca

SEQ ID NO: 1977659 - DNA, 21 bp, Homo sapiens
ctggtgctataggctggagaa

SEQ ID NO: 1977660 - DNA, 15 bp, Homo sapiens
ctggtgctgcaagga

SEQ ID NO: 1977661 - DNA, 12 bp, Homo sapiens
ctggtgctgcca

SEQ ID NO: 1977662 - DNA, 20 bp, Homo sapiens
ctggtgctgccacacttcag

SEQ ID NO: 1977663 - DNA, 22 bp, Homo sapiens
ctggtgctgccacacttcaggc

SEQ ID NO: 1977664 - DNA, 18 bp, Homo sapiens
ctggtgctgtggccaggg

SEQ ID NO: 1977665 - DNA, 12 bp, Homo sapiens
ctggtggacagt

SEQ ID NO: 1977666 - DNA, 15 bp, Homo sapiens
ctggtggacagtcct

SEQ ID NO: 1977667 - DNA, 16 bp, Homo sapiens
ctggtggaccacaggc

SEQ ID NO: 1977668 - DNA, 20 bp, Homo sapiens
ctggtggaccacaggcatct

SEQ ID NO: 1977669 - DNA, 13 bp, Homo sapiens
ctggtggcagctg

SEQ ID NO: 1977670 - DNA, 14 bp, Homo sapiens
ctggtggcagtggg

SEQ ID NO: 1977671 - DNA, 19 bp, Homo sapiens
ctggtggccatgtcgcctg

SEQ ID NO: 1977672 - DNA, 22 bp, Homo sapiens
ctggtggcccgacagcctggca

SEQ ID NO: 1977673 - DNA, 14 bp, Homo sapiens
ctggtggggcagct

SEQ ID NO: 1977674 - DNA, 14 bp, Homo sapiens
ctggtggtgctttt

SEQ ID NO: 1977675 - DNA, 15 bp, Homo sapiens
ctggtgtcaggcagg

SEQ ID NO: 1977676 - DNA, 20 bp, Homo sapiens
ctggtgtcattgctgtagga

SEQ ID NO: 1977677 - DNA, 19 bp, Homo sapiens
ctggttaattccataaccc

SEQ ID NO: 1977678 - DNA, 14 bp, Homo sapiens
ctggttactctggt

SEQ ID NO: 1977679 - DNA, 19 bp, Homo sapiens
ctggttgctacattttcag

SEQ ID NO: 1977680 - DNA, 20 bp, Homo sapiens
ctggtttagcacaatttata

SEQ ID NO: 1977681 - DNA, 20 bp, Homo sapiens
cttcgctgccaggacacctg

SEQ ID NO: 1977682 - DNA, 20 bp, Homo sapiens
cttcgctgctagagaagggg

SEQ ID NO: 1977683 - DNA, 19 bp, Homo sapiens
cttcggggaactcctggaa

SEQ ID NO: 1977684 - DNA, 21 bp, Homo sapiens
cttcggtgtttaaagtcaaca

SEQ ID NO: 1977685 - DNA, 14 bp, Homo sapiens
cttcggtttctgag

SEQ ID NO: 1977686 - DNA, 18 bp, Homo sapiens
cttctaaatgcccagttc

SEQ ID NO: 1977687 - DNA, 14 bp, Homo sapiens
cttctaacctcagc

SEQ ID NO: 1977688 - DNA, 22 bp, Homo sapiens
cttctaacctcagccaaacaca

SEQ ID NO: 1977689 - DNA, 13 bp, Homo sapiens
cttctaagtaaaa

SEQ ID NO: 1977690 - DNA, 12 bp, Homo sapiens
cttctaatatat

SEQ ID NO: 1977691 - DNA, 15 bp, Homo sapiens
cttctaatatatttt

SEQ ID NO: 1977692 - DNA, 18 bp, Homo sapiens
cttctaatatatttttat

SEQ ID NO: 1977693 - DNA, 20 bp, Homo sapiens
cttctaatatatttttatat

SEQ ID NO: 1977694 - DNA, 16 bp, Homo sapiens
cttctacaaccagagc

SEQ ID NO: 1977695 - DNA, 20 bp, Homo sapiens
cttctacaaccagagccccc

SEQ ID NO: 1977696 - DNA, 18 bp, Homo sapiens
cttctactgagccttcag

SEQ ID NO: 1977697 - DNA, 13 bp, Homo sapiens
cttctacttttaa

SEQ ID NO: 1977698 - DNA, 15 bp, Homo sapiens
cttctagatctggaa

SEQ ID NO: 1977699 - DNA, 13 bp, Homo sapiens
cttctaggaagct

SEQ ID NO: 1977700 - DNA, 23 bp, Homo sapiens
cttctaggagtcaactggctggc

SEQ ID NO: 1977701 - DNA, 15 bp, Homo sapiens
cttctatcccaggag

SEQ ID NO: 1977702 - DNA, 20 bp, Homo sapiens
cttctatttaaaaaataaaa

SEQ ID NO: 1977703 - DNA, 21 bp, Homo sapiens
cttctatttaaaaaataaaaa

SEQ ID NO: 1977704 - DNA, 14 bp, Homo sapiens
cttctattttgtaa

SEQ ID NO: 1977705 - DNA, 16 bp, Homo sapiens
cttctattttgtaaac

SEQ ID NO: 1977706 - DNA, 20 bp, Homo sapiens
cttctcagccccgggcctgc

SEQ ID NO: 1977707 - DNA, 21 bp, Homo sapiens
cttctcattccaacagtgagt

SEQ ID NO: 1977708 - DNA, 21 bp, Homo sapiens
cttctccaacaagttgcctcc

SEQ ID NO: 1977709 - DNA, 18 bp, Homo sapiens
cttctccaacactgaagt

SEQ ID NO: 1977710 - DNA, 15 bp, Homo sapiens
cttctccaccctgct

SEQ ID NO: 1977711 - DNA, 16 bp, Homo sapiens
cttctccaccctgctc

SEQ ID NO: 1977712 - DNA, 12 bp, Homo sapiens
cttctccaggct

SEQ ID NO: 1977713 - DNA, 13 bp, Homo sapiens
cttctccaggctg

SEQ ID NO: 1977714 - DNA, 14 bp, Homo sapiens
cttctccatctggc

SEQ ID NO: 1977715 - DNA, 14 bp, Homo sapiens
cttctcccatctag

SEQ ID NO: 1977716 - DNA, 14 bp, Homo sapiens
cttctccctggctg

SEQ ID NO: 1977717 - DNA, 14 bp, Homo sapiens
cttctccttggagg

SEQ ID NO: 1977718 - DNA, 15 bp, Homo sapiens
cttctccttggagga

SEQ ID NO: 1977719 - DNA, 17 bp, Homo sapiens
cttctcctttcacaacc

SEQ ID NO: 1977720 - DNA, 13 bp, Homo sapiens
cttctctcaaagg

SEQ ID NO: 1977721 - DNA, 20 bp, Homo sapiens
cttctctcaaagggaagctg

SEQ ID NO: 1977722 - DNA, 20 bp, Homo sapiens
cttctctccaggctgtttct

SEQ ID NO: 1977723 - DNA, 21 bp, Homo sapiens
cttctctccaggctgtttctt

SEQ ID NO: 1977724 - DNA, 13 bp, Homo sapiens
cttctctgaagga

SEQ ID NO: 1977725 - DNA, 20 bp, Homo sapiens
cttctcttgggaactccact

SEQ ID NO: 1977726 - DNA, 13 bp, Homo sapiens
cttctctttgcct

SEQ ID NO: 1977727 - DNA, 19 bp, Homo sapiens
cttctctttgtccccaaat

SEQ ID NO: 1977728 - DNA, 17 bp, Homo sapiens
cttctgaaacttcataa

SEQ ID NO: 1977729 - DNA, 15 bp, Homo sapiens
cttggtgtccacctg

SEQ ID NO: 1977730 - DNA, 19 bp, Homo sapiens
cttggtgtccacctggccc

SEQ ID NO: 1977731 - DNA, 15 bp, Homo sapiens
cttggtgtcgtttcc

SEQ ID NO: 1977732 - DNA, 19 bp, Homo sapiens
cttggtgtgaccctctgaa

SEQ ID NO: 1977733 - DNA, 21 bp, Homo sapiens
cttggttggctggcagctgag

SEQ ID NO: 1977734 - DNA, 22 bp, Homo sapiens
cttggttggctggcagctgaga

SEQ ID NO: 1977735 - DNA, 16 bp, Homo sapiens
cttggtttggggagaa

SEQ ID NO: 1977736 - DNA, 12 bp, Homo sapiens
cttgtaaataaa

SEQ ID NO: 1977737 - DNA, 13 bp, Homo sapiens
cttgtaaataaat

SEQ ID NO: 1977738 - DNA, 15 bp, Homo sapiens
cttgtaaatacacca

SEQ ID NO: 1977739 - DNA, 18 bp, Homo sapiens
cttgtaaatagctcaggt

SEQ ID NO: 1977740 - DNA, 13 bp, Homo sapiens
cttgtaattctaa

SEQ ID NO: 1977741 - DNA, 15 bp, Homo sapiens
cttgtaattctaaat

SEQ ID NO: 1977742 - DNA, 22 bp, Homo sapiens
cttgtacatgtgtagcctgtgc

SEQ ID NO: 1977743 - DNA, 13 bp, Homo sapiens
cttgtaccccatc

SEQ ID NO: 1977744 - DNA, 17 bp, Homo sapiens
cttgtagaccactgtcc

SEQ ID NO: 1977745 - DNA, 16 bp, Homo sapiens
cttgtagccagccggg

SEQ ID NO: 1977746 - DNA, 15 bp, Homo sapiens
cttgtataaatgtat

SEQ ID NO: 1977747 - DNA, 18 bp, Homo sapiens
cttgtataaatgtatata

SEQ ID NO: 1977748 - DNA, 19 bp, Homo sapiens
cttgtataaatgtatatac

SEQ ID NO: 1977749 - DNA, 16 bp, Homo sapiens
cttgtatagtgtaaaa

SEQ ID NO: 1977750 - DNA, 13 bp, Homo sapiens
cttgtatattcca

SEQ ID NO: 1977751 - DNA, 13 bp, Homo sapiens
cttgtatctgaag

SEQ ID NO: 1977752 - DNA, 15 bp, Homo sapiens
cttgtattttccata

SEQ ID NO: 1977753 - DNA, 20 bp, Homo sapiens
cttgtcactagcagctgcag

SEQ ID NO: 1977754 - DNA, 21 bp, Homo sapiens
cttgtcactatgctatttctg

SEQ ID NO: 1977755 - DNA, 23 bp, Homo sapiens
cttgtcactggtagaccaaaata

SEQ ID NO: 1977756 - DNA, 22 bp, Homo sapiens
cttgtcagaattggcctcagtg

SEQ ID NO: 1977757 - DNA, 14 bp, Homo sapiens
cttgtcatgtgaca

SEQ ID NO: 1977758 - DNA, 18 bp, Homo sapiens
cttgtccagcgcctagtg

SEQ ID NO: 1977759 - DNA, 16 bp, Homo sapiens
cttgtccctgcccaga

SEQ ID NO: 1977760 - DNA, 13 bp, Homo sapiens
cttgtcctctccc

SEQ ID NO: 1977761 - DNA, 13 bp, Homo sapiens
cttgtcctgccag

SEQ ID NO: 1977762 - DNA, 14 bp, Homo sapiens
cttgtcctgccagc

SEQ ID NO: 1977763 - DNA, 15 bp, Homo sapiens
cttgtcctgccagct

SEQ ID NO: 1977764 - DNA, 16 bp, Homo sapiens
cttgtcctgccagctg

SEQ ID NO: 1977765 - DNA, 22 bp, Homo sapiens
cttgtcctgccagctgccttcc

SEQ ID NO: 1977766 - DNA, 22 bp, Homo sapiens
cttgtcctgctctcttcaggag

SEQ ID NO: 1977767 - DNA, 14 bp, Homo sapiens
cttgtctctgggct

SEQ ID NO: 1977768 - DNA, 13 bp, Homo sapiens
cttgtctgaggcc

SEQ ID NO: 1977769 - DNA, 16 bp, Homo sapiens
cttgtctgaggcctca

SEQ ID NO: 1977770 - DNA, 12 bp, Homo sapiens
cttgtgactgaa

SEQ ID NO: 1977771 - DNA, 14 bp, Homo sapiens
cttgtgactgaagg

SEQ ID NO: 1977772 - DNA, 18 bp, Homo sapiens
cttgtgactgaaggggca

SEQ ID NO: 1977773 - DNA, 22 bp, Homo sapiens
cttgtgaggattatgggtcctg

SEQ ID NO: 1977774 - DNA, 19 bp, Homo sapiens
cttgtgattctgggatgga

SEQ ID NO: 1977775 - DNA, 19 bp, Homo sapiens
cttgtgcatgtttacttta

SEQ ID NO: 1977776 - DNA, 11 bp, Homo sapiens
cttgtgccata

SEQ ID NO: 1977777 - DNA, 14 bp, Homo sapiens
cttgtgcctcagcc

SEQ ID NO: 1977778 - DNA, 16 bp, Homo sapiens
cttgtgctcacgctcc

SEQ ID NO: 1977779 - DNA, 17 bp, Homo sapiens
cttgtgctcacgctccc

SEQ ID NO: 1977780 - DNA, 23 bp, Homo sapiens
cttgtgctgagaatagtgtctga

SEQ ID NO: 1977781 - DNA, 20 bp, Homo sapiens
cttgtgctgatcgtgctaaa

SEQ ID NO: 1977782 - DNA, 23 bp, Homo sapiens
cttgtgcttggtggggctcgtgg

SEQ ID NO: 1977783 - DNA, 24 bp, Homo sapiens
cttgtgcttggtggggctcgtggc

SEQ ID NO: 1977784 - DNA, 20 bp, Homo sapiens
cttgtgcttttcctatttgt

SEQ ID NO: 1977785 - DNA, 18 bp, Homo sapiens
cttgtggaattgggagct

SEQ ID NO: 1977786 - DNA, 14 bp, Homo sapiens
cttgtggacacagc

SEQ ID NO: 1977787 - DNA, 15 bp, Homo sapiens
cttgtggacacagct

SEQ ID NO: 1977788 - DNA, 20 bp, Homo sapiens
cttgtgtactgataaaatac

SEQ ID NO: 1977789 - DNA, 17 bp, Homo sapiens
cttgtgtctctgtgctt

SEQ ID NO: 1977790 - DNA, 18 bp, Homo sapiens
cttgtgtctctgtgcttt

SEQ ID NO: 1977791 - DNA, 22 bp, Homo sapiens
cttgtgtttttaactcaatatt

SEQ ID NO: 1977792 - DNA, 22 bp, Homo sapiens
cttgttacctttcccatgctga

SEQ ID NO: 1977793 - DNA, 14 bp, Homo sapiens
cttgttgtcaagta

SEQ ID NO: 1977794 - DNA, 16 bp, Homo sapiens
cttgtttcttgttcat

SEQ ID NO: 1977795 - DNA, 14 bp, Homo sapiens
cttgtttgttttct

SEQ ID NO: 1977796 - DNA, 18 bp, Homo sapiens
cttgttttcttgccaatg

SEQ ID NO: 1977797 - DNA, 21 bp, Homo sapiens
cttgtttttgctactaattat

SEQ ID NO: 1977798 - DNA, 20 bp, Homo sapiens
cttgttttttttttccactt

SEQ ID NO: 1977799 - DNA, 16 bp, Homo sapiens
ctttaaaaagcagtcc

SEQ ID NO: 1977800 - DNA, 15 bp, Homo sapiens
ctttaaaataaaata

SEQ ID NO: 1977801 - DNA, 13 bp, Homo sapiens
ctttaaagactta

SEQ ID NO: 1977802 - DNA, 16 bp, Homo sapiens
ctttaaagacttaaga

SEQ ID NO: 1977803 - DNA, 13 bp, Homo sapiens
ctttaaagtaaag

SEQ ID NO: 1977804 - DNA, 23 bp, Homo sapiens
ctttaaagtacctgtagtgagaa

SEQ ID NO: 1977805 - DNA, 20 bp, Homo sapiens
ctttaaagtatgtcttgttt

SEQ ID NO: 1977806 - DNA, 17 bp, Homo sapiens
ctttgaataaagtctga

SEQ ID NO: 1977807 - DNA, 17 bp, Homo sapiens
ctttgaatacccccaga

SEQ ID NO: 1977808 - DNA, 23 bp, Homo sapiens
ctttgaatacccccagagacctt

SEQ ID NO: 1977809 - DNA, 16 bp, Homo sapiens
ctttgaatgctttttg

SEQ ID NO: 1977810 - DNA, 20 bp, Homo sapiens
ctttgaatggtcttctgcca

SEQ ID NO: 1977811 - DNA, 15 bp, Homo sapiens
ctttgacatgaaaag

SEQ ID NO: 1977812 - DNA, 16 bp, Homo sapiens
ctttgacatgaaaaga

SEQ ID NO: 1977813 - DNA, 23 bp, Homo sapiens
ctttgacatttccttctttgtct

SEQ ID NO: 1977814 - DNA, 20 bp, Homo sapiens
ctttgacgggaggcctcagt

SEQ ID NO: 1977815 - DNA, 21 bp, Homo sapiens
ctttgacgggaggcctcagtt

SEQ ID NO: 1977816 - DNA, 22 bp, Homo sapiens
ctttgacgggaggcctcagttc

SEQ ID NO: 1977817 - DNA, 14 bp, Homo sapiens
ctttgactcacctg

SEQ ID NO: 1977818 - DNA, 16 bp, Homo sapiens
ctttgactcacctgtt

SEQ ID NO: 1977819 - DNA, 14 bp, Homo sapiens
ctttgagaaagaaa

SEQ ID NO: 1977820 - DNA, 21 bp, Homo sapiens
ctttgagaaaggattaagata

SEQ ID NO: 1977821 - DNA, 13 bp, Homo sapiens
ctttgagtaccaa

SEQ ID NO: 1977822 - DNA, 13 bp, Homo sapiens
ctttgagtgatcc

SEQ ID NO: 1977823 - DNA, 13 bp, Homo sapiens
ctttgagttatag

SEQ ID NO: 1977824 - DNA, 22 bp, Homo sapiens
ctttgatattttcaacgcagcc

SEQ ID NO: 1977825 - DNA, 16 bp, Homo sapiens
ctttgatctctgctta

SEQ ID NO: 1977826 - DNA, 20 bp, Homo sapiens
ctttgatgcatttccacact

SEQ ID NO: 1977827 - DNA, 18 bp, Homo sapiens
ctttgatgtcatatggaa

SEQ ID NO: 1977828 - DNA, 14 bp, Homo sapiens
ctttgattcagaca

SEQ ID NO: 1977829 - DNA, 15 bp, Homo sapiens
ctttgcaaagttaca

SEQ ID NO: 1977830 - DNA, 16 bp, Homo sapiens
ctttgcacatgtgacc

SEQ ID NO: 1977831 - DNA, 13 bp, Homo sapiens
ctttgcactgagg

SEQ ID NO: 1977832 - DNA, 14 bp, Homo sapiens
ctttgcactgaggg

SEQ ID NO: 1977833 - DNA, 20 bp, Homo sapiens
ctttgcagacaggcaagcac

SEQ ID NO: 1977834 - DNA, 16 bp, Homo sapiens
ctttgcaggctctggg

SEQ ID NO: 1977835 - DNA, 18 bp, Homo sapiens
ctttgcaggctctgggct

SEQ ID NO: 1977836 - DNA, 19 bp, Homo sapiens
ctttgcaggctctgggctc

SEQ ID NO: 1977837 - DNA, 18 bp, Homo sapiens
ctttgccagaaagcataa

SEQ ID NO: 1977838 - DNA, 22 bp, Homo sapiens
gaacagccaaatgcatggtgca

SEQ ID NO: 1977839 - DNA, 18 bp, Homo sapiens
gaacagccgctcctgtct

SEQ ID NO: 1977840 - DNA, 18 bp, Homo sapiens
gaacagtcacccttctgg

SEQ ID NO: 1977841 - DNA, 14 bp, Homo sapiens
gaacagtgtttccc

SEQ ID NO: 1977842 - DNA, 16 bp, Homo sapiens
gaacagtgtttcccat

SEQ ID NO: 1977843 - DNA, 17 bp, Homo sapiens
gaacagtgtttcccata

SEQ ID NO: 1977844 - DNA, 14 bp, Homo sapiens
gaacagtttgtaca

SEQ ID NO: 1977845 - DNA, 15 bp, Homo sapiens
gaacataaagcaaat

SEQ ID NO: 1977846 - DNA, 22 bp, Homo sapiens
gaacataaagcaaatagacaca

SEQ ID NO: 1977847 - DNA, 23 bp, Homo sapiens
gaacatccaaggagaaacagaga

SEQ ID NO: 1977848 - DNA, 16 bp, Homo sapiens
gaacatgcacatttat

SEQ ID NO: 1977849 - DNA, 14 bp, Homo sapiens
gaacatttctagaa

SEQ ID NO: 1977850 - DNA, 21 bp, Homo sapiens
gaaccaaagagactggagcat

SEQ ID NO: 1977851 - DNA, 15 bp, Homo sapiens
gaaccaacactaaca

SEQ ID NO: 1977852 - DNA, 14 bp, Homo sapiens
gaaccaagcttcag

SEQ ID NO: 1977853 - DNA, 18 bp, Homo sapiens
gaaccaagcttcagagcc

SEQ ID NO: 1977854 - DNA, 20 bp, Homo sapiens
gaaccaagcttcagagccta

SEQ ID NO: 1977855 - DNA, 22 bp, Homo sapiens
gaaccaagcttcagagcctagc

SEQ ID NO: 1977856 - DNA, 23 bp, Homo sapiens
gaaccaagcttcagagcctagcc

SEQ ID NO: 1977857 - DNA, 14 bp, Homo sapiens
gaaccaaggcagcc

SEQ ID NO: 1977858 - DNA, 16 bp, Homo sapiens
gaaccaaggcagcctc

SEQ ID NO: 1977859 - DNA, 17 bp, Homo sapiens
gaaccaaggcagcctcc

SEQ ID NO: 1977860 - DNA, 22 bp, Homo sapiens
gaaccaaggcagcctccagagc

SEQ ID NO: 1977861 - DNA, 23 bp, Homo sapiens
gaaccaaggcagcctccagagcc

SEQ ID NO: 1977862 - DNA, 22 bp, Homo sapiens
gaaccacagcggaggagctccg

SEQ ID NO: 1977863 - DNA, 22 bp, Homo sapiens
gaaccaccacacccagcccact

SEQ ID NO: 1977864 - DNA, 23 bp, Homo sapiens
gaaccaccacacccagcccactt

SEQ ID NO: 1977865 - DNA, 12 bp, Homo sapiens
gaaccagagggt

SEQ ID NO: 1977866 - DNA, 18 bp, Homo sapiens
gaaccagggagaccgagc

SEQ ID NO: 1977867 - DNA, 16 bp, Homo sapiens
gaaccagggaggagag

SEQ ID NO: 1977868 - DNA, 17 bp, Homo sapiens
gaaccagggaggagagg

SEQ ID NO: 1977869 - DNA, 16 bp, Homo sapiens
gaacccaagtccaagc

SEQ ID NO: 1977870 - DNA, 15 bp, Homo sapiens
gaacccacctgctga

SEQ ID NO: 1977871 - DNA, 16 bp, Homo sapiens
gaacccaggacaagca

SEQ ID NO: 1977872 - DNA, 15 bp, Homo sapiens
gaaccccatgggctt

SEQ ID NO: 1977873 - DNA, 17 bp, Homo sapiens
gaaccccatgggcttgg

SEQ ID NO: 1977874 - DNA, 19 bp, Homo sapiens
gaaccccatgggcttggac

SEQ ID NO: 1977875 - DNA, 13 bp, Homo sapiens
gaaccccgcagcc

SEQ ID NO: 1977876 - DNA, 16 bp, Homo sapiens
gaaccccgcagcccgt

SEQ ID NO: 1977877 - DNA, 13 bp, Homo sapiens
gaacccctcccct

SEQ ID NO: 1977878 - DNA, 10 bp, Homo sapiens
gaacccctgt

SEQ ID NO: 1977879 - DNA, 16 bp, Homo sapiens
gaacccgactgtgaaa

SEQ ID NO: 1977880 - DNA, 17 bp, Homo sapiens
gaacccttgtgcttggt

SEQ ID NO: 1977881 - DNA, 15 bp, Homo sapiens
gaaccgtgtccagca

SEQ ID NO: 1977882 - DNA, 15 bp, Homo sapiens
gaacctaattgaaat

SEQ ID NO: 1977883 - DNA, 14 bp, Homo sapiens
gaacctcaaactgg

SEQ ID NO: 1977884 - DNA, 11 bp, Homo sapiens
gaacctcacct

SEQ ID NO: 1977885 - DNA, 11 bp, Homo sapiens
gaacctcaggc

SEQ ID NO: 1977886 - DNA, 15 bp, Homo sapiens
gaacctcagtttcct

SEQ ID NO: 1977887 - DNA, 15 bp, Homo sapiens
gaacctggagagcta

SEQ ID NO: 1977888 - DNA, 15 bp, Homo sapiens
gaacctggagggcta

SEQ ID NO: 1977889 - DNA, 16 bp, Homo sapiens
gaacctggaggggcta

SEQ ID NO: 1977890 - DNA, 11 bp, Homo sapiens
gaacctggcct

SEQ ID NO: 1977891 - DNA, 15 bp, Homo sapiens
gaacctgtagagcta

SEQ ID NO: 1977892 - DNA, 20 bp, Homo sapiens
gaaccttaacctctctaagc

SEQ ID NO: 1977893 - DNA, 21 bp, Homo sapiens
gaaccttaacctctctaagcc

SEQ ID NO: 1977894 - DNA, 21 bp, Homo sapiens
gaaccttggtaaattgtaaac

SEQ ID NO: 1977895 - DNA, 21 bp, Homo sapiens
gaacgatatgtagcagaaagg

SEQ ID NO: 1977896 - DNA, 13 bp, Homo sapiens
gaacgctcttagc

SEQ ID NO: 1977897 - DNA, 15 bp, Homo sapiens
gaacggaagggttgg

SEQ ID NO: 1977898 - DNA, 22 bp, Homo sapiens
gaacggcatgtgaattctgtga

SEQ ID NO: 1977899 - DNA, 15 bp, Homo sapiens
gaacggggagaaaag

SEQ ID NO: 1977900 - DNA, 15 bp, Homo sapiens
gaactaataaaagca

SEQ ID NO: 1977901 - DNA, 20 bp, Homo sapiens
gaactaggatagatgtgatt

SEQ ID NO: 1977902 - DNA, 15 bp, Homo sapiens
gaactatgaactaca

SEQ ID NO: 1977903 - DNA, 22 bp, Homo sapiens
gaactattggagggtgggagag

SEQ ID NO: 1977904 - DNA, 13 bp, Homo sapiens
gaactcaagctgc

SEQ ID NO: 1977905 - DNA, 23 bp, Homo sapiens
gaactcaatgtgcaagttgtact

SEQ ID NO: 1977906 - DNA, 16 bp, Homo sapiens
gaactcagctgtctgt

SEQ ID NO: 1977907 - DNA, 20 bp, Homo sapiens
gaactcagctgtctgtggct

SEQ ID NO: 1977908 - DNA, 11 bp, Homo sapiens
gaactcatcct

SEQ ID NO: 1977909 - DNA, 12 bp, Homo sapiens
gaactccactct

SEQ ID NO: 1977910 - DNA, 17 bp, Homo sapiens
gaactcccagcaacaca

SEQ ID NO: 1977911 - DNA, 15 bp, Homo sapiens
gaactcctggcctca

SEQ ID NO: 1977912 - DNA, 22 bp, Homo sapiens
gaactccttgattttagccttc

SEQ ID NO: 1977913 - DNA, 20 bp, Homo sapiens
gaactctaccctggtaggaa

SEQ ID NO: 1977914 - DNA, 16 bp, Homo sapiens
gaactctccaaatatt

SEQ ID NO: 1977915 - DNA, 17 bp, Homo sapiens
gaactctgacaagggct

SEQ ID NO: 1977916 - DNA, 18 bp, Homo sapiens
gaactgcacgttctatat

SEQ ID NO: 1977917 - DNA, 20 bp, Homo sapiens
gaactgcagtatggccatgg

SEQ ID NO: 1977918 - DNA, 17 bp, Homo sapiens
gaactgcctctttcctg

SEQ ID NO: 1977919 - DNA, 15 bp, Homo sapiens
gaactggaacacaca

SEQ ID NO: 1977920 - DNA, 15 bp, Homo sapiens
gaactggccaagctg

SEQ ID NO: 1977921 - DNA, 16 bp, Homo sapiens
gaactggccaagctga

SEQ ID NO: 1977922 - DNA, 22 bp, Homo sapiens
gaactgggtacttgtggacaca

SEQ ID NO: 1977923 - DNA, 13 bp, Homo sapiens
gaactgtgacagg

SEQ ID NO: 1977924 - DNA, 15 bp, Homo sapiens
gaactgtgacaggaa

SEQ ID NO: 1977925 - DNA, 18 bp, Homo sapiens
gaactgtgacaggaagcc

SEQ ID NO: 1977926 - DNA, 22 bp, Homo sapiens
gaactgtgatggggtgggcagg

SEQ ID NO: 1977927 - DNA, 16 bp, Homo sapiens
gaactgttctggcctc

SEQ ID NO: 1977928 - DNA, 18 bp, Homo sapiens
gaacttaaataaatgtca

SEQ ID NO: 1977929 - DNA, 15 bp, Homo sapiens
gaacttgattttaaa

SEQ ID NO: 1977930 - DNA, 19 bp, Homo sapiens
gaacttggaaagaaatgcc

SEQ ID NO: 1977931 - DNA, 17 bp, Homo sapiens
gaactttccaaaaccta

SEQ ID NO: 1977932 - DNA, 13 bp, Homo sapiens
gaagaaaaaatac

SEQ ID NO: 1977933 - DNA, 14 bp, Homo sapiens
gaagaaaaatgttt

SEQ ID NO: 1977934 - DNA, 17 bp, Homo sapiens
gaaggagactcacctct

SEQ ID NO: 1977935 - DNA, 19 bp, Homo sapiens
gaaggaggagggcgcccat

SEQ ID NO: 1977936 - DNA, 15 bp, Homo sapiens
gaaggaggcagactg

SEQ ID NO: 1977937 - DNA, 14 bp, Homo sapiens
gaaggagggcagag

SEQ ID NO: 1977938 - DNA, 16 bp, Homo sapiens
gaaggagggcagagcc

SEQ ID NO: 1977939 - DNA, 17 bp, Homo sapiens
gaaggaggtgagggatg

SEQ ID NO: 1977940 - DNA, 18 bp, Homo sapiens
gaaggatggcatctccat

SEQ ID NO: 1977941 - DNA, 15 bp, Homo sapiens
gaaggcaaatataag

SEQ ID NO: 1977942 - DNA, 13 bp, Homo sapiens
gaaggcagctgct

SEQ ID NO: 1977943 - DNA, 15 bp, Homo sapiens
gaaggcagctgctct

SEQ ID NO: 1977944 - DNA, 13 bp, Homo sapiens
gaaggcaggcagg

SEQ ID NO: 1977945 - DNA, 22 bp, Homo sapiens
gacagactgcaagaggctcctg

SEQ ID NO: 1977946 - DNA, 18 bp, Homo sapiens
gacagagaaatgtgaagg

SEQ ID NO: 1977947 - DNA, 15 bp, Homo sapiens
gacagagacacctgc

SEQ ID NO: 1977948 - DNA, 18 bp, Homo sapiens
gacagagacccagatctc

SEQ ID NO: 1977949 - DNA, 13 bp, Homo sapiens
gacagagagatga

SEQ ID NO: 1977950 - DNA, 20 bp, Homo sapiens
gacagagaggagttgccagg

SEQ ID NO: 1977951 - DNA, 18 bp, Homo sapiens
gacagagcccccaagcct

SEQ ID NO: 1977952 - DNA, 19 bp, Homo sapiens
gacagagccgcaaatcaac

SEQ ID NO: 1977953 - DNA, 17 bp, Homo sapiens
gacagaggcagccccat

SEQ ID NO: 1977954 - DNA, 20 bp, Homo sapiens
gacagagtgagactctgtct

SEQ ID NO: 1977955 - DNA, 17 bp, Homo sapiens
gacagatgtcagccgag

SEQ ID NO: 1977956 - DNA, 17 bp, Homo sapiens
gacagcacttggctcct

SEQ ID NO: 1977957 - DNA, 13 bp, Homo sapiens
gacagcagctcag

SEQ ID NO: 1977958 - DNA, 16 bp, Homo sapiens
gacagcaggtgggaaa

SEQ ID NO: 1977959 - DNA, 19 bp, Homo sapiens
gacagccacggccaggcca

SEQ ID NO: 1977960 - DNA, 12 bp, Homo sapiens
gacagccagagc

SEQ ID NO: 1977961 - DNA, 19 bp, Homo sapiens
gacagcctggcacagggca

SEQ ID NO: 1977962 - DNA, 22 bp, Homo sapiens
gacagcctgtggcggtgcctgg

SEQ ID NO: 1977963 - DNA, 23 bp, Homo sapiens
gacagcctgtggcggtgcctggg

SEQ ID NO: 1977964 - DNA, 19 bp, Homo sapiens
gacagcgaactagaagaaa

SEQ ID NO: 1977965 - DNA, 14 bp, Homo sapiens
gacagctccttctg

SEQ ID NO: 1977966 - DNA, 13 bp, Homo sapiens
gacagctggctgc

SEQ ID NO: 1977967 - DNA, 22 bp, Homo sapiens
gacagctggctgctgacaggat

SEQ ID NO: 1977968 - DNA, 13 bp, Homo sapiens
gacagctgtgcct

SEQ ID NO: 1977969 - DNA, 17 bp, Homo sapiens
gacagctgtgcctcgct

SEQ ID NO: 1977970 - DNA, 20 bp, Homo sapiens
gacagctttcccctcatttt

SEQ ID NO: 1977971 - DNA, 15 bp, Homo sapiens
gacaggaaagccctc

SEQ ID NO: 1977972 - DNA, 19 bp, Homo sapiens
gacaggaaagccctccccc

SEQ ID NO: 1977973 - DNA, 23 bp, Homo sapiens
gacaggacagtgcttcagcctga

SEQ ID NO: 1977974 - DNA, 13 bp, Homo sapiens
gacaggacctgac

SEQ ID NO: 1977975 - DNA, 22 bp, Homo sapiens
gacaggactaacactcagaagc

SEQ ID NO: 1977976 - DNA, 23 bp, Homo sapiens
gacaggactaacactcagaagcc

SEQ ID NO: 1977977 - DNA, 24 bp, Homo sapiens
gacaggagaaatgcatccattcct

SEQ ID NO: 1977978 - DNA, 16 bp, Homo sapiens
gacaggatgtggcact

SEQ ID NO: 1977979 - DNA, 18 bp, Homo sapiens
gacaggcaagcacctcct

SEQ ID NO: 1977980 - DNA, 23 bp, Homo sapiens
gacaggcaatgctggctgttggc

SEQ ID NO: 1977981 - DNA, 21 bp, Homo sapiens
gacaggcatgttctctgagga

SEQ ID NO: 1977982 - DNA, 11 bp, Homo sapiens
gacaggcccaa

SEQ ID NO: 1977983 - DNA, 13 bp, Homo sapiens
gacagggacccac

SEQ ID NO: 1977984 - DNA, 16 bp, Homo sapiens
gacagggaggtgaccc

SEQ ID NO: 1977985 - DNA, 15 bp, Homo sapiens
gacagggatgccaac

SEQ ID NO: 1977986 - DNA, 24 bp, Homo sapiens
gacagggcacaccgggcactcaga

SEQ ID NO: 1977987 - DNA, 17 bp, Homo sapiens
gacagggcttggggagc

SEQ ID NO: 1977988 - DNA, 20 bp, Homo sapiens
gacagggttttgccatgttg

SEQ ID NO: 1977989 - DNA, 15 bp, Homo sapiens
gacaggtctagactt

SEQ ID NO: 1977990 - DNA, 20 bp, Homo sapiens
gacaggtctagactttctca

SEQ ID NO: 1977991 - DNA, 17 bp, Homo sapiens
gacaggttcccagcagc

SEQ ID NO: 1977992 - DNA, 20 bp, Homo sapiens
gacaggttcccagcagctgg

SEQ ID NO: 1977993 - DNA, 22 bp, Homo sapiens
gacaggttcccagcagctgggc

SEQ ID NO: 1977994 - DNA, 16 bp, Homo sapiens
gacagtatatttgaaa

SEQ ID NO: 1977995 - DNA, 19 bp, Homo sapiens
gacagtatatttgaaactg

SEQ ID NO: 1977996 - DNA, 16 bp, Homo sapiens
gacagtattctcagtg

SEQ ID NO: 1977997 - DNA, 18 bp, Homo sapiens
gacagtcccttgctgaca

SEQ ID NO: 1977998 - DNA, 23 bp, Homo sapiens
gacagtcctgggagaacctcagg

SEQ ID NO: 1977999 - DNA, 13 bp, Homo sapiens
gacagtcttgtgc

SEQ ID NO: 1978000 - DNA, 15 bp, Homo sapiens
gacagtcttgtgctt

SEQ ID NO: 1978001 - DNA, 20 bp, Homo sapiens
gacagtgaattgacccatgt

SEQ ID NO: 1978002 - DNA, 15 bp, Homo sapiens
gacagtgatctccat

SEQ ID NO: 1978003 - DNA, 21 bp, Homo sapiens
gacagtgctctaggctgcccc

SEQ ID NO: 1978004 - DNA, 14 bp, Homo sapiens
gacagtgctgccct

SEQ ID NO: 1978005 - DNA, 17 bp, Homo sapiens
gacagtgctgccctgcg

SEQ ID NO: 1978006 - DNA, 16 bp, Homo sapiens
gacagtgcttcagcct

SEQ ID NO: 1978007 - DNA, 18 bp, Homo sapiens
gacagtgcttcagcctga

SEQ ID NO: 1978008 - DNA, 19 bp, Homo sapiens
gacagtgcttcagcctgag

SEQ ID NO: 1978009 - DNA, 17 bp, Homo sapiens
gacagttactcttcagt

SEQ ID NO: 1978010 - DNA, 14 bp, Homo sapiens
gacagttcaagaaa

SEQ ID NO: 1978011 - DNA, 17 bp, Homo sapiens
gacataaagttgataaa

SEQ ID NO: 1978012 - DNA, 12 bp, Homo sapiens
gacatacgaaac

SEQ ID NO: 1978013 - DNA, 17 bp, Homo sapiens
gacatacgaaacacaaa

SEQ ID NO: 1978014 - DNA, 18 bp, Homo sapiens
gacatataccttctcaaa

SEQ ID NO: 1978015 - DNA, 17 bp, Homo sapiens
gacatatatattaaaat

SEQ ID NO: 1978016 - DNA, 15 bp, Homo sapiens
gacatcacagcagaa

SEQ ID NO: 1978017 - DNA, 15 bp, Homo sapiens
gacatcacttgtaca

SEQ ID NO: 1978018 - DNA, 13 bp, Homo sapiens
gacatccaggagg

SEQ ID NO: 1978019 - DNA, 20 bp, Homo sapiens
gacatcttcaaagcttgaag

SEQ ID NO: 1978020 - DNA, 21 bp, Homo sapiens
gacatcttcaaagcttgaaga

SEQ ID NO: 1978021 - DNA, 21 bp, Homo sapiens
gacatgatactgatgccatgt

SEQ ID NO: 1978022 - DNA, 16 bp, Homo sapiens
gacatgcagctctgat

SEQ ID NO: 1978023 - DNA, 13 bp, Homo sapiens
gacatgccaccct

SEQ ID NO: 1978024 - DNA, 24 bp, Homo sapiens
gacatgccaccctctccatgccca

SEQ ID NO: 1978025 - DNA, 15 bp, Homo sapiens
gacatggagagagac

SEQ ID NO: 1978026 - DNA, 17 bp, Homo sapiens
gacatggggcatagaaa

SEQ ID NO: 1978027 - DNA, 14 bp, Homo sapiens
gacatgtggtggga

SEQ ID NO: 1978028 - DNA, 22 bp, Homo sapiens
gacatgtggtgggacagggacc

SEQ ID NO: 1978029 - DNA, 18 bp, Homo sapiens
gacatgttatatattttt

SEQ ID NO: 1978030 - DNA, 13 bp, Homo sapiens
gacatgtttcaca

SEQ ID NO: 1978031 - DNA, 15 bp, Homo sapiens
gacattaaacctgga

SEQ ID NO: 1978032 - DNA, 22 bp, Homo sapiens
gacattaactcattagactgga

SEQ ID NO: 1978033 - DNA, 16 bp, Homo sapiens
gacattatgtgtgcat

SEQ ID NO: 1978034 - DNA, 20 bp, Homo sapiens
gacattatgtgtgcatgtgt

SEQ ID NO: 1978035 - DNA, 21 bp, Homo sapiens
gacattatgtgtgcatgtgtg

SEQ ID NO: 1978036 - DNA, 23 bp, Homo sapiens
gacattctgattcgaatgacact

SEQ ID NO: 1978037 - DNA, 20 bp, Homo sapiens
gacattgcctccacctctcc

SEQ ID NO: 1978038 - DNA, 14 bp, Homo sapiens
gacattgcggacag

SEQ ID NO: 1978039 - DNA, 19 bp, Homo sapiens
gacattgttggccaaagcc

SEQ ID NO: 1978040 - DNA, 11 bp, Homo sapiens
gacatttccct

SEQ ID NO: 1978041 - DNA, 22 bp, Homo sapiens
gacatttccctcctgggagaga

SEQ ID NO: 1978042 - DNA, 18 bp, Homo sapiens
gacatttctaacatatgt

SEQ ID NO: 1978043 - DNA, 19 bp, Homo sapiens
gacatttctaacatatgta

SEQ ID NO: 1978044 - DNA, 14 bp, Homo sapiens
gacattttcaataa

SEQ ID NO: 1978045 - DNA, 17 bp, Homo sapiens
gacattttctctttaaa

SEQ ID NO: 1978046 - DNA, 21 bp, Homo sapiens
gacattttctctttaaaagaa

SEQ ID NO: 1978047 - DNA, 15 bp, Homo sapiens
gacattttcttcaga

SEQ ID NO: 1978048 - DNA, 14 bp, Homo sapiens
gaccaaaagttaca

SEQ ID NO: 1978049 - DNA, 15 bp, Homo sapiens
gaccaaattgcttct

SEQ ID NO: 1978050 - DNA, 16 bp, Homo sapiens
gaccaacatggagaaa

SEQ ID NO: 1978051 - DNA, 15 bp, Homo sapiens
gaccaactggcttct

SEQ ID NO: 1978052 - DNA, 20 bp, Homo sapiens
gaccaagaaaaagaaaaaaa

SEQ ID NO: 1978053 - DNA, 10 bp, Homo sapiens
gaccaagaat

SEQ ID NO: 1978054 - DNA, 23 bp, Homo sapiens
gaccaagatgggcacatgaggag

SEQ ID NO: 1978055 - DNA, 16 bp, Homo sapiens
gactagcaggcatgcc

SEQ ID NO: 1978056 - DNA, 14 bp, Homo sapiens
gactataaacatta

SEQ ID NO: 1978057 - DNA, 15 bp, Homo sapiens
gactataaacattaa

SEQ ID NO: 1978058 - DNA, 16 bp, Homo sapiens
gactataaacattaaa

SEQ ID NO: 1978059 - DNA, 19 bp, Homo sapiens
gactataaagcagtagaca

SEQ ID NO: 1978060 - DNA, 12 bp, Homo sapiens
gactatatacat

SEQ ID NO: 1978061 - DNA, 13 bp, Homo sapiens
gactatatacatg

SEQ ID NO: 1978062 - DNA, 16 bp, Homo sapiens
gactatatagagatgt

SEQ ID NO: 1978063 - DNA, 19 bp, Homo sapiens
gactatatagagatgtttt

SEQ ID NO: 1978064 - DNA, 14 bp, Homo sapiens
gactatcacataca

SEQ ID NO: 1978065 - DNA, 20 bp, Homo sapiens
gactatcacatacaatttgc

SEQ ID NO: 1978066 - DNA, 19 bp, Homo sapiens
gactatcttactatttcac

SEQ ID NO: 1978067 - DNA, 15 bp, Homo sapiens
gactatgaaaagcta

SEQ ID NO: 1978068 - DNA, 12 bp, Homo sapiens
gactatggagcc

SEQ ID NO: 1978069 - DNA, 19 bp, Homo sapiens
gactatgtgtcatgatttc

SEQ ID NO: 1978070 - DNA, 16 bp, Homo sapiens
gactatttaacttgag

SEQ ID NO: 1978071 - DNA, 14 bp, Homo sapiens
gactatttccacca

SEQ ID NO: 1978072 - DNA, 18 bp, Homo sapiens
gactcaagggtccagaag

SEQ ID NO: 1978073 - DNA, 18 bp, Homo sapiens
gactcaagtttttacaaa

SEQ ID NO: 1978074 - DNA, 12 bp, Homo sapiens
gagcaaaataat

SEQ ID NO: 1978075 - DNA, 12 bp, Homo sapiens
gagcaaagcctg

SEQ ID NO: 1978076 - DNA, 13 bp, Homo sapiens
gagcaaagcctgt

SEQ ID NO: 1978077 - DNA, 23 bp, Homo sapiens
gagcaaagcctgttcatggcaga

SEQ ID NO: 1978078 - DNA, 16 bp, Homo sapiens
gagcaaatgagggagg

SEQ ID NO: 1978079 - DNA, 13 bp, Homo sapiens
gagcaacccctgt

SEQ ID NO: 1978080 - DNA, 23 bp, Homo sapiens
gagcaagaaggaaggaggcagac

SEQ ID NO: 1978081 - DNA, 12 bp, Homo sapiens
gagcaagactct

SEQ ID NO: 1978082 - DNA, 15 bp, Homo sapiens
gagcaagagaacatt

SEQ ID NO: 1978083 - DNA, 16 bp, Homo sapiens
gagcaagagagggcaa

SEQ ID NO: 1978084 - DNA, 12 bp, Homo sapiens
gagcaagagctg

SEQ ID NO: 1978085 - DNA, 20 bp, Homo sapiens
gagcaaggacaacctgcccc

SEQ ID NO: 1978086 - DNA, 17 bp, Homo sapiens
gagcaattcatttcact

SEQ ID NO: 1978087 - DNA, 23 bp, Homo sapiens
gagcacaagttccagctggtctt

SEQ ID NO: 1978088 - DNA, 16 bp, Homo sapiens
gagcacacggccctgc

SEQ ID NO: 1978089 - DNA, 17 bp, Homo sapiens
gagcacacggccctgcc

SEQ ID NO: 1978090 - DNA, 15 bp, Homo sapiens
gagcacactgtagca

SEQ ID NO: 1978091 - DNA, 20 bp, Homo sapiens
gagcacagaggggctagggg

SEQ ID NO: 1978092 - DNA, 16 bp, Homo sapiens
gagcacagccctggga

SEQ ID NO: 1978093 - DNA, 21 bp, Homo sapiens
gagcacattcttaaaggaaaa

SEQ ID NO: 1978094 - DNA, 15 bp, Homo sapiens
gagcaccaggcacga

SEQ ID NO: 1978095 - DNA, 23 bp, Homo sapiens
gagcaccaggcacgaacccacct

SEQ ID NO: 1978096 - DNA, 13 bp, Homo sapiens
gagcacctgaacc

SEQ ID NO: 1978097 - DNA, 23 bp, Homo sapiens
gagcacctgaaccccatgggctt

SEQ ID NO: 1978098 - DNA, 23 bp, Homo sapiens
gagcacctgcttcatgctcagcc

SEQ ID NO: 1978099 - DNA, 23 bp, Homo sapiens
gagcaccttaatattattggggt

SEQ ID NO: 1978100 - DNA, 21 bp, Homo sapiens
gagcactaaggtgtgctctga

SEQ ID NO: 1978101 - DNA, 18 bp, Homo sapiens
ctgtgaggcaggggcgga

SEQ ID NO: 1978102 - DNA, 15 bp, Homo sapiens
ctgtgaggcccctgg

SEQ ID NO: 1978103 - DNA, 16 bp, Homo sapiens
ctgtgaggtgctgatg

SEQ ID NO: 1978104 - DNA, 17 bp, Homo sapiens
ctgtgaggtgctgatga

SEQ ID NO: 1978105 - DNA, 16 bp, Homo sapiens
ctgtgatggggtgggc

SEQ ID NO: 1978106 - DNA, 21 bp, Homo sapiens
ctgtgatggggtgggcagggc

SEQ ID NO: 1978107 - DNA, 22 bp, Homo sapiens
ctgtgatggggtgggcagggct

SEQ ID NO: 1978108 - DNA, 23 bp, Homo sapiens
ctgtgatggggtgggcagggctg

SEQ ID NO: 1978109 - DNA, 17 bp, Homo sapiens
ctgtgattaacttgctt

SEQ ID NO: 1978110 - DNA, 18 bp, Homo sapiens
ctgtgattaacttgctta

SEQ ID NO: 1978111 - DNA, 20 bp, Homo sapiens
ctgtgcaccttacattccta

SEQ ID NO: 1978112 - DNA, 16 bp, Homo sapiens
ctgtgcactagcctgt

SEQ ID NO: 1978113 - DNA, 21 bp, Homo sapiens
ctgtgcactagcctgtgatta

SEQ ID NO: 1978114 - DNA, 13 bp, Homo sapiens
ctgtgccagagcc

SEQ ID NO: 1978115 - DNA, 16 bp, Homo sapiens
ctgtgccagagcctgg

SEQ ID NO: 1978116 - DNA, 19 bp, Homo sapiens
ctgtgccagagcctggggc

SEQ ID NO: 1978117 - DNA, 16 bp, Homo sapiens
ctgtgccatgtgccag

SEQ ID NO: 1978118 - DNA, 22 bp, Homo sapiens
ctgtgcccacatcccaggcttc

SEQ ID NO: 1978119 - DNA, 23 bp, Homo sapiens
ctgtgcccacatcccaggcttca

SEQ ID NO: 1978120 - DNA, 17 bp, Homo sapiens
ctgtgcccacgtgtgca

SEQ ID NO: 1978121 - DNA, 12 bp, Homo sapiens
ctgtgcccctca

SEQ ID NO: 1978122 - DNA, 19 bp, Homo sapiens
ctgtgcccctcagagaggc

SEQ ID NO: 1978123 - DNA, 20 bp, Homo sapiens
ctgtgccctctggattctct

SEQ ID NO: 1978124 - DNA, 14 bp, Homo sapiens
ctgtgccctgcctt

SEQ ID NO: 1978125 - DNA, 16 bp, Homo sapiens
ctgtgccctgccttca

SEQ ID NO: 1978126 - DNA, 16 bp, Homo sapiens
ctgtgcctcctcaccc

SEQ ID NO: 1978127 - DNA, 11 bp, Homo sapiens
ctgtgcctctg

SEQ ID NO: 1978128 - DNA, 13 bp, Homo sapiens
ctgtgcctgctag

SEQ ID NO: 1978129 - DNA, 17 bp, Homo sapiens
ctgtgcctgctagagca

SEQ ID NO: 1978130 - DNA, 19 bp, Homo sapiens
ctgtgcctgctagagcaac

SEQ ID NO: 1978131 - DNA, 10 bp, Homo sapiens
ctgtgcctta

SEQ ID NO: 1978132 - DNA, 11 bp, Homo sapiens
ctgtgccttac

SEQ ID NO: 1978133 - DNA, 12 bp, Homo sapiens
ctgtgcctttgg

SEQ ID NO: 1978134 - DNA, 17 bp, Homo sapiens
ctgtgctactttgcctt

SEQ ID NO: 1978135 - DNA, 16 bp, Homo sapiens
ctgtgctctcaccagc

SEQ ID NO: 1978136 - DNA, 15 bp, Homo sapiens
ctgtgctctggacag

SEQ ID NO: 1978137 - DNA, 20 bp, Homo sapiens
ctgtgctctggaggctgcag

SEQ ID NO: 1978138 - DNA, 21 bp, Homo sapiens
ctgtgctcttttggtggggag

SEQ ID NO: 1978139 - DNA, 14 bp, Homo sapiens
ctgtgctgtgcctg

SEQ ID NO: 1978140 - DNA, 17 bp, Homo sapiens
ctgtgcttacagtgact

SEQ ID NO: 1978141 - DNA, 19 bp, Homo sapiens
ctgtgcttacagtgactgt

SEQ ID NO: 1978142 - DNA, 18 bp, Homo sapiens
ctgtgcttcaattaataa

SEQ ID NO: 1978143 - DNA, 15 bp, Homo sapiens
ctgtgcttctctttg

SEQ ID NO: 1978144 - DNA, 18 bp, Homo sapiens
ctgtgctttgactcacct

SEQ ID NO: 1978145 - DNA, 21 bp, Homo sapiens
ctgtgctttgactcacctgtt

SEQ ID NO: 1978146 - DNA, 19 bp, Homo sapiens
gaggtagagtttgaaggag

SEQ ID NO: 1978147 - DNA, 16 bp, Homo sapiens
gaggtagcgagctgct

SEQ ID NO: 1978148 - DNA, 19 bp, Homo sapiens
gaggtagcgagctgctctg

SEQ ID NO: 1978149 - DNA, 20 bp, Homo sapiens
gaggtagctcccagcactca

SEQ ID NO: 1978150 - DNA, 21 bp, Homo sapiens
gaggtaggtggatcacctgag

SEQ ID NO: 1978151 - DNA, 22 bp, Homo sapiens
gaggtcaacagagaaggcagga

SEQ ID NO: 1978152 - DNA, 14 bp, Homo sapiens
gaggtcactgggtt

SEQ ID NO: 1978153 - DNA, 13 bp, Homo sapiens
gaggtccagaccc

SEQ ID NO: 1978154 - DNA, 13 bp, Homo sapiens
gaggtcctgagca

SEQ ID NO: 1978155 - DNA, 22 bp, Homo sapiens
gaggtcctgagcactgccagga

SEQ ID NO: 1978156 - DNA, 14 bp, Homo sapiens
gaggtctgaaatgg

SEQ ID NO: 1978157 - DNA, 12 bp, Homo sapiens
gaggtctgagcc

SEQ ID NO: 1978158 - DNA, 14 bp, Homo sapiens
gaggtctgagccct

SEQ ID NO: 1978159 - DNA, 15 bp, Homo sapiens
gaggtctgagccctg

SEQ ID NO: 1978160 - DNA, 15 bp, Homo sapiens
gaggtgaccccaggg

SEQ ID NO: 1978161 - DNA, 23 bp, Homo sapiens
gaggtgaccccaggtttctatgt

SEQ ID NO: 1978162 - DNA, 12 bp, Homo sapiens
gaggtgagcaga

SEQ ID NO: 1978163 - DNA, 18 bp, Homo sapiens
gaggtgcctgagctgggg

SEQ ID NO: 1978164 - DNA, 15 bp, Homo sapiens
gaggtggaagccctc

SEQ ID NO: 1978165 - DNA, 13 bp, Homo sapiens
gaggtggagaact

SEQ ID NO: 1978166 - DNA, 20 bp, Homo sapiens
gaggtggaggttgcagtgag

SEQ ID NO: 1978167 - DNA, 19 bp, Homo sapiens
gaggtggattcctgggcaa

SEQ ID NO: 1978168 - DNA, 22 bp, Homo sapiens
gaggtggattcctgggcaagaa

SEQ ID NO: 1978169 - DNA, 19 bp, Homo sapiens
gaggtggccagagctggga

SEQ ID NO: 1978170 - DNA, 12 bp, Homo sapiens
gaggtgggcagc

SEQ ID NO: 1978171 - DNA, 14 bp, Homo sapiens
gaggtgggcagcag

SEQ ID NO: 1978172 - DNA, 14 bp, Homo sapiens
gaggtgggcagctg

SEQ ID NO: 1978173 - DNA, 16 bp, Homo sapiens
gaggtgggcagctggg

SEQ ID NO: 1978174 - DNA, 17 bp, Homo sapiens
gaggtgggcagctgggc

SEQ ID NO: 1978175 - DNA, 18 bp, Homo sapiens
gaggtgggcagctgggcc

SEQ ID NO: 1978176 - DNA, 15 bp, Homo sapiens
gaggtggtggaggag

SEQ ID NO: 1978177 - DNA, 18 bp, Homo sapiens
gaggtgtcaccctgcaga

SEQ ID NO: 1978178 - DNA, 19 bp, Homo sapiens
gaggtgtcaccctgcagag

SEQ ID NO: 1978179 - DNA, 21 bp, Homo sapiens
gaggttaaggtgggtccagga

SEQ ID NO: 1978180 - DNA, 22 bp, Homo sapiens
gaggttaggagttcgagaccag

SEQ ID NO: 1978181 - DNA, 16 bp, Homo sapiens
gaggttatctgcctgg

SEQ ID NO: 1978182 - DNA, 14 bp, Homo sapiens
gaggttctggggag

SEQ ID NO: 1978183 - DNA, 15 bp, Homo sapiens
gaggttctggggagg

SEQ ID NO: 1978184 - DNA, 20 bp, Homo sapiens
gaggttgccccttccccatc

SEQ ID NO: 1978185 - DNA, 18 bp, Homo sapiens
gaggttttattctgactt

SEQ ID NO: 1978186 - DNA, 16 bp, Homo sapiens
gagtaagatattattt

SEQ ID NO: 1978187 - DNA, 21 bp, Homo sapiens
gagtactagaatttgtatttt

SEQ ID NO: 1978188 - DNA, 22 bp, Homo sapiens
gagtagcaagttctagagaaga

SEQ ID NO: 1978189 - DNA, 18 bp, Homo sapiens
gagtagccgagagcctgc

SEQ ID NO: 1978190 - DNA, 21 bp, Homo sapiens
gagtagccgagagcctgctcc

SEQ ID NO: 1978191 - DNA, 12 bp, Homo sapiens
gagtagctgaga

SEQ ID NO: 1978192 - DNA, 14 bp, Homo sapiens
gagtagctgagagg

SEQ ID NO: 1978193 - DNA, 19 bp, Homo sapiens
gagtagctgagaggaagat

SEQ ID NO: 1978194 - DNA, 13 bp, Homo sapiens
gagtagctgagct

SEQ ID NO: 1978195 - DNA, 14 bp, Homo sapiens
gagtagctgagctc

SEQ ID NO: 1978196 - DNA, 12 bp, Homo sapiens
gagtagctggga

SEQ ID NO: 1978197 - DNA, 14 bp, Homo sapiens
gagtagctgggact

SEQ ID NO: 1978198 - DNA, 13 bp, Homo sapiens
gagtatactaaaa

SEQ ID NO: 1978199 - DNA, 12 bp, Homo sapiens
gagtatatatgt

SEQ ID NO: 1978200 - DNA, 17 bp, Homo sapiens
gagtatatatgtacagt

SEQ ID NO: 1978201 - DNA, 23 bp, Homo sapiens
gagtatctcggacctttcagctg

SEQ ID NO: 1978202 - DNA, 22 bp, Homo sapiens
gagtatgttaagctctttatga

SEQ ID NO: 1978203 - DNA, 20 bp, Homo sapiens
gagtcaaaagcctgggtgag

SEQ ID NO: 1978204 - DNA, 22 bp, Homo sapiens
gagtcaaaatttcaaaagtgat

SEQ ID NO: 1978205 - DNA, 19 bp, Homo sapiens
gagtcaatcccctcattca

SEQ ID NO: 1978206 - DNA, 14 bp, Homo sapiens
gagtcaccaggaat

SEQ ID NO: 1978207 - DNA, 13 bp, Homo sapiens
gagtcacctcctc

SEQ ID NO: 1978208 - DNA, 23 bp, Homo sapiens
gagtcacctcctccactcactcc

SEQ ID NO: 1978209 - DNA, 17 bp, Homo sapiens
gagtcacctgcaagccc

SEQ ID NO: 1978210 - DNA, 21 bp, Homo sapiens
gagtcacctgcaagccccagg

SEQ ID NO: 1978211 - DNA, 16 bp, Homo sapiens
gagtcagaggagaaga

SEQ ID NO: 1978212 - DNA, 18 bp, Homo sapiens
gagtcagtctctctctcc

SEQ ID NO: 1978213 - DNA, 16 bp, Homo sapiens
gagtcattaccacgcc

SEQ ID NO: 1978214 - DNA, 15 bp, Homo sapiens
gagtcccaaggaaag

SEQ ID NO: 1978215 - DNA, 16 bp, Homo sapiens
gagtcccaccttggct

SEQ ID NO: 1978216 - DNA, 22 bp, Homo sapiens
gagtccctccatgcaaaagtgg

SEQ ID NO: 1978217 - DNA, 12 bp, Homo sapiens
gagtcctctgga

SEQ ID NO: 1978218 - DNA, 17 bp, Homo sapiens
gagtcctgtctctgcct

SEQ ID NO: 1978219 - DNA, 18 bp, Homo sapiens
gagtcctgtctctgcctg

SEQ ID NO: 1978220 - DNA, 14 bp, Homo sapiens
gagtcgaggacagg

SEQ ID NO: 1978221 - DNA, 16 bp, Homo sapiens
gagtcgaggacaggga

SEQ ID NO: 1978222 - DNA, 17 bp, Homo sapiens
gagtcgaggacagggag

SEQ ID NO: 1978223 - DNA, 19 bp, Homo sapiens
gagtcgtcatcacttttca

SEQ ID NO: 1978224 - DNA, 15 bp, Homo sapiens
gagtctacctcttca

SEQ ID NO: 1978225 - DNA, 19 bp, Homo sapiens
gagtctacctgagcattca

SEQ ID NO: 1978226 - DNA, 19 bp, Homo sapiens
gagtctcactgttgcccag

SEQ ID NO: 1978227 - DNA, 23 bp, Homo sapiens
gagtctcactgttgcccaggctg

SEQ ID NO: 1978228 - DNA, 20 bp, Homo sapiens
gagtctccagtggttgctgt

SEQ ID NO: 1978229 - DNA, 17 bp, Homo sapiens
gagtctcctctctgaga

SEQ ID NO: 1978230 - DNA, 16 bp, Homo sapiens
gagtctcttctccact

SEQ ID NO: 1978231 - DNA, 18 bp, Homo sapiens
gagtctcttctccactgg

SEQ ID NO: 1978232 - DNA, 12 bp, Homo sapiens
gagtctgagccc

SEQ ID NO: 1978233 - DNA, 12 bp, Homo sapiens
gagtctgtctca

SEQ ID NO: 1978234 - DNA, 14 bp, Homo sapiens
gagtctgtgctctt

SEQ ID NO: 1978235 - DNA, 21 bp, Homo sapiens
gagtcttggcctgcctcccag

SEQ ID NO: 1978236 - DNA, 23 bp, Homo sapiens
gagtcttggcctgcctcccagcc

SEQ ID NO: 1978237 - DNA, 18 bp, Homo sapiens
gagtgaaagggctatggc

SEQ ID NO: 1978238 - DNA, 22 bp, Homo sapiens
gagtgaaagggctatggcaagg

SEQ ID NO: 1978239 - DNA, 15 bp, Homo sapiens
gagtgaaccatcatt

SEQ ID NO: 1978240 - DNA, 18 bp, Homo sapiens
gagtgacagaggcagccc

SEQ ID NO: 1978241 - DNA, 20 bp, Homo sapiens
gagtgacagaggcagcccca

SEQ ID NO: 1978242 - DNA, 20 bp, Homo sapiens
gagtgacgggagcctcctct

SEQ ID NO: 1978243 - DNA, 18 bp, Homo sapiens
gagtgacggtcccacact

SEQ ID NO: 1978244 - DNA, 18 bp, Homo sapiens
gagtgactcgagggttgg

SEQ ID NO: 1978245 - DNA, 21 bp, Homo sapiens
gagtgagaataattgtgtaca

SEQ ID NO: 1978246 - DNA, 13 bp, Homo sapiens
gagtgagaccctg

SEQ ID NO: 1978247 - DNA, 12 bp, Homo sapiens
gagtgagctggt

SEQ ID NO: 1978248 - DNA, 13 bp, Homo sapiens
gagtgcagagaaa

SEQ ID NO: 1978249 - DNA, 16 bp, Homo sapiens
gagtgcagagaaagaa

SEQ ID NO: 1978250 - DNA, 19 bp, Homo sapiens
gagtgcaggcctgctcagg

SEQ ID NO: 1978251 - DNA, 11 bp, Homo sapiens
gagtgcagtga

SEQ ID NO: 1978252 - DNA, 17 bp, Homo sapiens
gagtggaatgcagggaa

SEQ ID NO: 1978253 - DNA, 21 bp, Homo sapiens
gagtggaatgcagggaagagg

SEQ ID NO: 1978254 - DNA, 19 bp, Homo sapiens
gagtggagcaaatgcttaa

SEQ ID NO: 1978255 - DNA, 15 bp, Homo sapiens
gagtggagtctgagt

SEQ ID NO: 1978256 - DNA, 23 bp, Homo sapiens
gagtggagtctgagtctgagtcc

SEQ ID NO: 1978257 - DNA, 19 bp, Homo sapiens
gagtggatctccaaggacc

SEQ ID NO: 1978258 - DNA, 18 bp, Homo sapiens
gagtggatggatggacag

SEQ ID NO: 1978259 - DNA, 16 bp, Homo sapiens
gagtggcagccatgcc

SEQ ID NO: 1978260 - DNA, 20 bp, Homo sapiens
gagtggcagctgtcccctct

SEQ ID NO: 1978261 - DNA, 18 bp, Homo sapiens
gatttcctacagaaatac

SEQ ID NO: 1978262 - DNA, 22 bp, Homo sapiens
gatttcctacagaaatactgct

SEQ ID NO: 1978263 - DNA, 20 bp, Homo sapiens
gatttcctattttaaaacca

SEQ ID NO: 1978264 - DNA, 22 bp, Homo sapiens
gatttcctccatggtggaaggg

SEQ ID NO: 1978265 - DNA, 18 bp, Homo sapiens
gatttctaggtaggaaat

SEQ ID NO: 1978266 - DNA, 17 bp, Homo sapiens
gatttcttcgctgctct

SEQ ID NO: 1978267 - DNA, 24 bp, Homo sapiens
gatttcttcgctgctctagctggc

SEQ ID NO: 1978268 - DNA, 14 bp, Homo sapiens
gatttcttttaaag

SEQ ID NO: 1978269 - DNA, 13 bp, Homo sapiens
gatttggaagaga

SEQ ID NO: 1978270 - DNA, 14 bp, Homo sapiens
gatttgtactgaaa

SEQ ID NO: 1978271 - DNA, 15 bp, Homo sapiens
gatttgtatttatat

SEQ ID NO: 1978272 - DNA, 16 bp, Homo sapiens
gatttgtatttatatt

SEQ ID NO: 1978273 - DNA, 22 bp, Homo sapiens
gatttgtatttatattagagtg

SEQ ID NO: 1978274 - DNA, 14 bp, Homo sapiens
gatttgtcccaggt

SEQ ID NO: 1978275 - DNA, 19 bp, Homo sapiens
gatttgttaatgatagcta

SEQ ID NO: 1978276 - DNA, 23 bp, Homo sapiens
gattttaaaaacatgagaaatgt

SEQ ID NO: 1978277 - DNA, 21 bp, Homo sapiens
gattttacagagaatctgaag

SEQ ID NO: 1978278 - DNA, 21 bp, Homo sapiens
gattttatacatagtcacaaa

SEQ ID NO: 1978279 - DNA, 15 bp, Homo sapiens
gattttatttgacaa

SEQ ID NO: 1978280 - DNA, 19 bp, Homo sapiens
gattttcaaagctttttcc

SEQ ID NO: 1978281 - DNA, 18 bp, Homo sapiens
gattttcatcaatttaaa

SEQ ID NO: 1978282 - DNA, 14 bp, Homo sapiens
gattttcatgttct

SEQ ID NO: 1978283 - DNA, 12 bp, Homo sapiens
gattttctagac

SEQ ID NO: 1978284 - DNA, 12 bp, Homo sapiens
gattttgtacag

SEQ ID NO: 1978285 - DNA, 14 bp, Homo sapiens
gatttttacacatg

SEQ ID NO: 1978286 - DNA, 12 bp, Homo sapiens
gattttttggat

SEQ ID NO: 1978287 - DNA, 16 bp, Homo sapiens
gatttttttgttgttg

SEQ ID NO: 1978288 - DNA, 13 bp, Homo sapiens
gcaaaaaagaaaa

SEQ ID NO: 1978289 - DNA, 11 bp, Homo sapiens
gcaaaagaaga

SEQ ID NO: 1978290 - DNA, 13 bp, Homo sapiens
gcaaaataatttt

SEQ ID NO: 1978291 - DNA, 16 bp, Homo sapiens
gcaaacactgtgtatt

SEQ ID NO: 1978292 - DNA, 16 bp, Homo sapiens
gcaaacatttcttaaa

SEQ ID NO: 1978293 - DNA, 22 bp, Homo sapiens
gcaaacatttcttaaaatgttt

SEQ ID NO: 1978294 - DNA, 22 bp, Homo sapiens
gcaaacctcagtcatattctta

SEQ ID NO: 1978295 - DNA, 14 bp, Homo sapiens
gcaaagaattgact

SEQ ID NO: 1978296 - DNA, 22 bp, Homo sapiens
gcaaagcaccagcttctccagg

SEQ ID NO: 1978297 - DNA, 23 bp, Homo sapiens
gcaaagcactgacttctaagtaa

SEQ ID NO: 1978298 - DNA, 12 bp, Homo sapiens
gcaaagcctgtt

SEQ ID NO: 1978299 - DNA, 17 bp, Homo sapiens
gcaaaggagtagaaaga

SEQ ID NO: 1978300 - DNA, 15 bp, Homo sapiens
gcaaagggctgaaag

SEQ ID NO: 1978301 - DNA, 15 bp, Homo sapiens
gcaaagtctaaagtt

SEQ ID NO: 1978302 - DNA, 21 bp, Homo sapiens
gcaaagtctaaagtttacagt

SEQ ID NO: 1978303 - DNA, 22 bp, Homo sapiens
gcaaagtctaaagtttacagta

SEQ ID NO: 1978304 - DNA, 22 bp, Homo sapiens
gcaaagtgaagttgcttcttct

SEQ ID NO: 1978305 - DNA, 14 bp, Homo sapiens
gcaaagtgccctca

SEQ ID NO: 1978306 - DNA, 18 bp, Homo sapiens
gcaaagttacagatgcac

SEQ ID NO: 1978307 - DNA, 20 bp, Homo sapiens
gcaaatactccaagcttcaa

SEQ ID NO: 1978308 - DNA, 21 bp, Homo sapiens
gcaaatggatggggataagaa

SEQ ID NO: 1978309 - DNA, 13 bp, Homo sapiens
gcaaattagtaat

SEQ ID NO: 1978310 - DNA, 12 bp, Homo sapiens
gcaaatttcaaa

SEQ ID NO: 1978311 - DNA, 15 bp, Homo sapiens
gcaaattttgcattt

SEQ ID NO: 1978312 - DNA, 15 bp, Homo sapiens
gcaacaaaatcaatt

SEQ ID NO: 1978313 - DNA, 16 bp, Homo sapiens
gcaacaaatatttata

SEQ ID NO: 1978314 - DNA, 22 bp, Homo sapiens
gcaacaatacatgctgctaatt

SEQ ID NO: 1978315 - DNA, 17 bp, Homo sapiens
gcaacacaagctggaag

SEQ ID NO: 1978316 - DNA, 19 bp, Homo sapiens
gcaacacctccttgctttg

SEQ ID NO: 1978317 - DNA, 20 bp, Homo sapiens
gcaacacctccttgctttgc

SEQ ID NO: 1978318 - DNA, 16 bp, Homo sapiens
gcaacacgtggaggtg

SEQ ID NO: 1978319 - DNA, 16 bp, Homo sapiens
gcaacagagcaagact

SEQ ID NO: 1978320 - DNA, 14 bp, Homo sapiens
gcaacagagtgaga

SEQ ID NO: 1978321 - DNA, 19 bp, Homo sapiens
gcaacagagtgagaccctg

SEQ ID NO: 1978322 - DNA, 16 bp, Homo sapiens
gcaacaggaatctcag

SEQ ID NO: 1978323 - DNA, 19 bp, Homo sapiens
gcaacaggaatctcagaga

SEQ ID NO: 1978324 - DNA, 21 bp, Homo sapiens
gcaacatctcgagccccctgg

SEQ ID NO: 1978325 - DNA, 16 bp, Homo sapiens
gcaacatttccgaaga

SEQ ID NO: 1978326 - DNA, 23 bp, Homo sapiens
gcaacattttatttaagaataaa

SEQ ID NO: 1978327 - DNA, 24 bp, Homo sapiens
gcaaccccagttctgctcctctcc

SEQ ID NO: 1978328 - DNA, 21 bp, Homo sapiens
gcaacccctgtacccagctcc

SEQ ID NO: 1978329 - DNA, 13 bp, Homo sapiens
gcaacccttgctg

SEQ ID NO: 1978330 - DNA, 20 bp, Homo sapiens
gcaaccgtggcccttcctgg

SEQ ID NO: 1978331 - DNA, 21 bp, Homo sapiens
gcaaccgtggcccttcctgga

SEQ ID NO: 1978332 - DNA, 15 bp, Homo sapiens
gcaacctcactatgg

SEQ ID NO: 1978333 - DNA, 19 bp, Homo sapiens
gcaacctcagtaatttaga

SEQ ID NO: 1978334 - DNA, 15 bp, Homo sapiens
gcaacctcttcctcc

SEQ ID NO: 1978335 - DNA, 17 bp, Homo sapiens
gcaacctcttcctcctg

SEQ ID NO: 1978336 - DNA, 18 bp, Homo sapiens
gcaacctcttcctcctgg

SEQ ID NO: 1978337 - DNA, 14 bp, Homo sapiens
gcaactagccaagg

SEQ ID NO: 1978338 - DNA, 17 bp, Homo sapiens
gcaactcccacgactgt

SEQ ID NO: 1978339 - DNA, 18 bp, Homo sapiens
gcaactgagtctgcggga

SEQ ID NO: 1978340 - DNA, 15 bp, Homo sapiens
gcaacttgaaattat

SEQ ID NO: 1978341 - DNA, 19 bp, Homo sapiens
gcaacttgaaattatatct

SEQ ID NO: 1978342 - DNA, 15 bp, Homo sapiens
gcaacttgcttctaa

SEQ ID NO: 1978343 - DNA, 11 bp, Homo sapiens
gcaagaaagcc

SEQ ID NO: 1978344 - DNA, 16 bp, Homo sapiens
gcaagaaggcaaaaat

SEQ ID NO: 1978345 - DNA, 19 bp, Homo sapiens
gcaagactccgtctcaaaa

SEQ ID NO: 1978346 - DNA, 21 bp, Homo sapiens
gcaagacttctctttgcctca

SEQ ID NO: 1978347 - DNA, 19 bp, Homo sapiens
gcaagagaattgcttgaac

SEQ ID NO: 1978348 - DNA, 16 bp, Homo sapiens
gcaagagacagaatga

SEQ ID NO: 1978349 - DNA, 16 bp, Homo sapiens
gcaagagacagagccc

SEQ ID NO: 1978350 - DNA, 20 bp, Homo sapiens
gcaagagacagagcccccaa

SEQ ID NO: 1978351 - DNA, 16 bp, Homo sapiens
gcaagatttaacacta

SEQ ID NO: 1978352 - DNA, 20 bp, Homo sapiens
gcaagcacctcctgcctcga

SEQ ID NO: 1978353 - DNA, 21 bp, Homo sapiens
gcaagccactatgtccagcta

SEQ ID NO: 1978354 - DNA, 13 bp, Homo sapiens
gcaagccccaggg

SEQ ID NO: 1978355 - DNA, 16 bp, Homo sapiens
gcaagccccagggcct

SEQ ID NO: 1978356 - DNA, 19 bp, Homo sapiens
gcaagccccagggcctggg

SEQ ID NO: 1978357 - DNA, 21 bp, Homo sapiens
gcaagccccagggcctggggg

SEQ ID NO: 1978358 - DNA, 18 bp, Homo sapiens
gcaagcccctcagccctt

SEQ ID NO: 1978359 - DNA, 20 bp, Homo sapiens
gcaagcctgtaatcccagct

SEQ ID NO: 1978360 - DNA, 17 bp, Homo sapiens
gcaagcgcagggaggat

SEQ ID NO: 1978361 - DNA, 19 bp, Homo sapiens
gcaagctagaacctggagg

SEQ ID NO: 1978362 - DNA, 17 bp, Homo sapiens
gcaaggcccgagcagct

SEQ ID NO: 1978363 - DNA, 22 bp, Homo sapiens
gcaaggcccgagcagctgagca

SEQ ID NO: 1978364 - DNA, 24 bp, Homo sapiens
gcaaggcccgagcagctgagcagg

SEQ ID NO: 1978365 - DNA, 13 bp, Homo sapiens
gcaaggccctgtc

SEQ ID NO: 1978366 - DNA, 18 bp, Homo sapiens
gcaaggccctgtcccagc

SEQ ID NO: 1978367 - DNA, 14 bp, Homo sapiens
gcaagggcatcagg

SEQ ID NO: 1978368 - DNA, 15 bp, Homo sapiens
gcaagggcatcaggc

SEQ ID NO: 1978369 - DNA, 18 bp, Homo sapiens
gcaagggcatcaggcact

SEQ ID NO: 1978370 - DNA, 19 bp, Homo sapiens
gcaagggctccagcatcca

SEQ ID NO: 1978371 - DNA, 20 bp, Homo sapiens
gcaagggctccagcatccag

SEQ ID NO: 1978372 - DNA, 13 bp, Homo sapiens
gcaaggggctcag

SEQ ID NO: 1978373 - DNA, 22 bp, Homo sapiens
gcaaggggctcagcaaggtgtg

SEQ ID NO: 1978374 - DNA, 15 bp, Homo sapiens
gcaagggggcggggc

SEQ ID NO: 1978375 - DNA, 22 bp, Homo sapiens
gcaagggggtgtcatctgagga

SEQ ID NO: 1978376 - DNA, 15 bp, Homo sapiens
gcaagtcatacttag

SEQ ID NO: 1978377 - DNA, 23 bp, Homo sapiens
gcacctgctggaaaccacacttc

SEQ ID NO: 1978378 - DNA, 12 bp, Homo sapiens
gcacctggcctg

SEQ ID NO: 1978379 - DNA, 16 bp, Homo sapiens
gcacctggcctgctgg

SEQ ID NO: 1978380 - DNA, 17 bp, Homo sapiens
gcacctggcctgctggg

SEQ ID NO: 1978381 - DNA, 17 bp, Homo sapiens
gcacctgggccctgggg

SEQ ID NO: 1978382 - DNA, 20 bp, Homo sapiens
gcacctgggccctggggcct

SEQ ID NO: 1978383 - DNA, 21 bp, Homo sapiens
gcacctgtaatcccagctact

SEQ ID NO: 1978384 - DNA, 15 bp, Homo sapiens
gcacctgtcccagaa

SEQ ID NO: 1978385 - DNA, 19 bp, Homo sapiens
gcacctgtcccagaaaaag

SEQ ID NO: 1978386 - DNA, 22 bp, Homo sapiens
gcacctgtcccagaaaaagcat

SEQ ID NO: 1978387 - DNA, 18 bp, Homo sapiens
gcaccttacattcctaga

SEQ ID NO: 1978388 - DNA, 18 bp, Homo sapiens
gcaccttaccaactttct

SEQ ID NO: 1978389 - DNA, 20 bp, Homo sapiens
gcaccttaccaactttctgt

SEQ ID NO: 1978390 - DNA, 13 bp, Homo sapiens
gcaccttagtggc

SEQ ID NO: 1978391 - DNA, 20 bp, Homo sapiens
gcaccttgtgtctgtacacg

SEQ ID NO: 1978392 - DNA, 18 bp, Homo sapiens
gcacctttctagttgaaa

SEQ ID NO: 1978393 - DNA, 16 bp, Homo sapiens
gcacgaacccacctgc

SEQ ID NO: 1978394 - DNA, 19 bp, Homo sapiens
gcacgaacccacctgctga

SEQ ID NO: 1978395 - DNA, 18 bp, Homo sapiens
gcacgcaacccttgctgc

SEQ ID NO: 1978396 - DNA, 21 bp, Homo sapiens
gcacgcaacccttgctgctgc

SEQ ID NO: 1978397 - DNA, 16 bp, Homo sapiens
gcacgcctgcccagcc

SEQ ID NO: 1978398 - DNA, 17 bp, Homo sapiens
gcacgcctgcccagcct

SEQ ID NO: 1978399 - DNA, 20 bp, Homo sapiens
gcacgcggagtgagtttttt

SEQ ID NO: 1978400 - DNA, 14 bp, Homo sapiens
gcacggcagcttga

SEQ ID NO: 1978401 - DNA, 20 bp, Homo sapiens
gcacggcagcttgagcctgt

SEQ ID NO: 1978402 - DNA, 14 bp, Homo sapiens
gcacgtcccatgtg

SEQ ID NO: 1978403 - DNA, 17 bp, Homo sapiens
gcacgtcttgctatttg

SEQ ID NO: 1978404 - DNA, 22 bp, Homo sapiens
gcactaaaaagtggctaattca

SEQ ID NO: 1978405 - DNA, 17 bp, Homo sapiens
gcactaaggtgtgctct

SEQ ID NO: 1978406 - DNA, 19 bp, Homo sapiens
gcactaaggtgtgctctga

SEQ ID NO: 1978407 - DNA, 22 bp, Homo sapiens
gcactagcattttcttgaacca

SEQ ID NO: 1978408 - DNA, 14 bp, Homo sapiens
gcactagcctgtga

SEQ ID NO: 1978409 - DNA, 19 bp, Homo sapiens
gcactcaaccaacctcccc

SEQ ID NO: 1978410 - DNA, 20 bp, Homo sapiens
gcactcaaccaacctccccg

SEQ ID NO: 1978411 - DNA, 23 bp, Homo sapiens
gcactcacccatgtgccaaggtg

SEQ ID NO: 1978412 - DNA, 22 bp, Homo sapiens
gcactcagtctagtgaagatgt

SEQ ID NO: 1978413 - DNA, 23 bp, Homo sapiens
gcactcagtctagtgaagatgtt

SEQ ID NO: 1978414 - DNA, 14 bp, Homo sapiens
gcactcagtgaggc

SEQ ID NO: 1978415 - DNA, 14 bp, Homo sapiens
gcactccagcctgg

SEQ ID NO: 1978416 - DNA, 14 bp, Homo sapiens
gcactccatggcca

SEQ ID NO: 1978417 - DNA, 16 bp, Homo sapiens
gcactccatggccacc

SEQ ID NO: 1978418 - DNA, 23 bp, Homo sapiens
gcactccctaaccaaatgctgtc

SEQ ID NO: 1978419 - DNA, 16 bp, Homo sapiens
gcactcctctgtctct

SEQ ID NO: 1978420 - DNA, 18 bp, Homo sapiens
gcactcctctgtctctgc

SEQ ID NO: 1978421 - DNA, 21 bp, Homo sapiens
gcactcctctgtctctgctct

SEQ ID NO: 1978422 - DNA, 19 bp, Homo sapiens
gcactctctaaatcttcct

SEQ ID NO: 1978423 - DNA, 24 bp, Homo sapiens
gcactctctaaatcttccttgtga

SEQ ID NO: 1978424 - DNA, 12 bp, Homo sapiens
gcactgacaaga

SEQ ID NO: 1978425 - DNA, 16 bp, Homo sapiens
gcactgacccttccag

SEQ ID NO: 1978426 - DNA, 20 bp, Homo sapiens
gcactgacccttccagacat

SEQ ID NO: 1978427 - DNA, 21 bp, Homo sapiens
gcactgacccttccagacata

SEQ ID NO: 1978428 - DNA, 20 bp, Homo sapiens
gcactgactgggaccaggca

SEQ ID NO: 1978429 - DNA, 15 bp, Homo sapiens
gcactgacttctaag

SEQ ID NO: 1978430 - DNA, 14 bp, Homo sapiens
gcactgagggccac

SEQ ID NO: 1978431 - DNA, 15 bp, Homo sapiens
gcactgatttcacaa

SEQ ID NO: 1978432 - DNA, 21 bp, Homo sapiens
gcactgcagatagccagacac

SEQ ID NO: 1978433 - DNA, 23 bp, Homo sapiens
gcactgcagatagccagacacat

SEQ ID NO: 1978434 - DNA, 13 bp, Homo sapiens
gcactgccaggag

SEQ ID NO: 1978435 - DNA, 21 bp, Homo sapiens
gcactgctaggcgagtgccag

SEQ ID NO: 1978436 - DNA, 23 bp, Homo sapiens
gcactgctaggcgagtgccagga

SEQ ID NO: 1978437 - DNA, 15 bp, Homo sapiens
gataagaaccacaga

SEQ ID NO: 1978438 - DNA, 19 bp, Homo sapiens
gataagaataggtcatttt

SEQ ID NO: 1978439 - DNA, 13 bp, Homo sapiens
gataagtggaaaa

SEQ ID NO: 1978440 - DNA, 13 bp, Homo sapiens
gataatgaacaga

SEQ ID NO: 1978441 - DNA, 14 bp, Homo sapiens
gataatgaacagaa

SEQ ID NO: 1978442 - DNA, 19 bp, Homo sapiens
gataatgctgttgcctcat

SEQ ID NO: 1978443 - DNA, 16 bp, Homo sapiens
gataatgtcaaaatca

SEQ ID NO: 1978444 - DNA, 12 bp, Homo sapiens
gatacaaaatgc

SEQ ID NO: 1978445 - DNA, 20 bp, Homo sapiens
gatacaacttcaagtgcatg

SEQ ID NO: 1978446 - DNA, 15 bp, Homo sapiens
gatacagaatgaatc

SEQ ID NO: 1978447 - DNA, 20 bp, Homo sapiens
gatacaggaaaagctgctga

SEQ ID NO: 1978448 - DNA, 21 bp, Homo sapiens
gatacaggaaaagctgctgac

SEQ ID NO: 1978449 - DNA, 19 bp, Homo sapiens
gatacagtccctaaagaaa

SEQ ID NO: 1978450 - DNA, 22 bp, Homo sapiens
gatacatagatggaccagtaga

SEQ ID NO: 1978451 - DNA, 13 bp, Homo sapiens
gatacatggggaa

SEQ ID NO: 1978452 - DNA, 12 bp, Homo sapiens
gatacattccct

SEQ ID NO: 1978453 - DNA, 22 bp, Homo sapiens
gatacattccctatcaaaacat

SEQ ID NO: 1978454 - DNA, 23 bp, Homo sapiens
gatacattccctatcaaaacata

SEQ ID NO: 1978455 - DNA, 17 bp, Homo sapiens
gataccaggttgaaaga

SEQ ID NO: 1978456 - DNA, 16 bp, Homo sapiens
gataccttgaaaaagt

SEQ ID NO: 1978457 - DNA, 14 bp, Homo sapiens
gatactggaagttt

SEQ ID NO: 1978458 - DNA, 13 bp, Homo sapiens
gatactgggtaca

SEQ ID NO: 1978459 - DNA, 15 bp, Homo sapiens
gatacttcaggtgct

SEQ ID NO: 1978460 - DNA, 20 bp, Homo sapiens
gatagatgtgattcctgcat

SEQ ID NO: 1978461 - DNA, 21 bp, Homo sapiens
gatagatgtgattcctgcatt

SEQ ID NO: 1978462 - DNA, 23 bp, Homo sapiens
gatagcatttttgatttatgcat

SEQ ID NO: 1978463 - DNA, 16 bp, Homo sapiens
gatagctaacatttta

SEQ ID NO: 1978464 - DNA, 18 bp, Homo sapiens
gatagctaacattttaaa

SEQ ID NO: 1978465 - DNA, 20 bp, Homo sapiens
gatagctaacattttaaata

SEQ ID NO: 1978466 - DNA, 23 bp, Homo sapiens
gatagggaagagagaaacattta

SEQ ID NO: 1978467 - DNA, 18 bp, Homo sapiens
gatagtagcatacattta

SEQ ID NO: 1978468 - DNA, 16 bp, Homo sapiens
gatagtattgtgcata

SEQ ID NO: 1978469 - DNA, 15 bp, Homo sapiens
gatataaatggctgg

SEQ ID NO: 1978470 - DNA, 21 bp, Homo sapiens
gatatacaaatatatttaatt

SEQ ID NO: 1978471 - DNA, 15 bp, Homo sapiens
gatatagaaagctgt

SEQ ID NO: 1978472 - DNA, 12 bp, Homo sapiens
gatatatctgaa

SEQ ID NO: 1978473 - DNA, 14 bp, Homo sapiens
gatatatctgaaaa

SEQ ID NO: 1978474 - DNA, 16 bp, Homo sapiens
gatatatctgaaaact

SEQ ID NO: 1978475 - DNA, 12 bp, Homo sapiens
gatatatgtatt

SEQ ID NO: 1978476 - DNA, 12 bp, Homo sapiens
gatatcacctct

SEQ ID NO: 1978477 - DNA, 18 bp, Homo sapiens
gatatcagagctgggaaa

SEQ ID NO: 1978478 - DNA, 14 bp, Homo sapiens
gatatcataaaagt

SEQ ID NO: 1978479 - DNA, 21 bp, Homo sapiens
gatatccctgatcctaactga

SEQ ID NO: 1978480 - DNA, 23 bp, Homo sapiens
gatatctgaacacatactagaaa

SEQ ID NO: 1978481 - DNA, 14 bp, Homo sapiens
gatatgcaaaagct

SEQ ID NO: 1978482 - DNA, 20 bp, Homo sapiens
gatatgggactgagcctggc

SEQ ID NO: 1978483 - DNA, 22 bp, Homo sapiens
gatatgggactgagcctggccc

SEQ ID NO: 1978484 - DNA, 18 bp, Homo sapiens
gatatgtaaaacatttat

SEQ ID NO: 1978485 - DNA, 19 bp, Homo sapiens
gatatgtaaacataattct

SEQ ID NO: 1978486 - DNA, 22 bp, Homo sapiens
gatcaaccccttcgctcctgtg

SEQ ID NO: 1978487 - DNA, 13 bp, Homo sapiens
gatcacagaggct

SEQ ID NO: 1978488 - DNA, 13 bp, Homo sapiens
gatcacagggccc

SEQ ID NO: 1978489 - DNA, 22 bp, Homo sapiens
gatcacagtggcgagaggagag

SEQ ID NO: 1978490 - DNA, 14 bp, Homo sapiens
gatcacctgaggtc

SEQ ID NO: 1978491 - DNA, 14 bp, Homo sapiens
gatcacctgaggtt

SEQ ID NO: 1978492 - DNA, 14 bp, Homo sapiens
gatcacgccactgc

SEQ ID NO: 1978493 - DNA, 15 bp, Homo sapiens
gatcacgccactgca

SEQ ID NO: 1978494 - DNA, 15 bp, Homo sapiens
gatcacggctcactg

SEQ ID NO: 1978495 - DNA, 16 bp, Homo sapiens
gatcagaccataatgt

SEQ ID NO: 1978496 - DNA, 15 bp, Homo sapiens
gatcaggaagagaag

SEQ ID NO: 1978497 - DNA, 16 bp, Homo sapiens
gatcaggaagagaagg

SEQ ID NO: 1978498 - DNA, 18 bp, Homo sapiens
gatcataggtatttcaaa

SEQ ID NO: 1978499 - DNA, 23 bp, Homo sapiens
gatcatcccatctaagctgcagc

SEQ ID NO: 1978500 - DNA, 19 bp, Homo sapiens
gatcattacatggctgtgg

SEQ ID NO: 1978501 - DNA, 14 bp, Homo sapiens
gatccaaacagaaa

SEQ ID NO: 1978502 - DNA, 19 bp, Homo sapiens
gatccaagctggtcccact

SEQ ID NO: 1978503 - DNA, 16 bp, Homo sapiens
gatccacacacagagg

SEQ ID NO: 1978504 - DNA, 19 bp, Homo sapiens
gatccacacacagaggaag

SEQ ID NO: 1978505 - DNA, 21 bp, Homo sapiens
gatccacccacctcagcctcc

SEQ ID NO: 1978506 - DNA, 19 bp, Homo sapiens
ccaggaggttggtgactga

SEQ ID NO: 1978507 - DNA, 13 bp, Homo sapiens
ccaggagtctgtg

SEQ ID NO: 1978508 - DNA, 15 bp, Homo sapiens
ccaggagtctgtgct

SEQ ID NO: 1978509 - DNA, 16 bp, Homo sapiens
ccaggagtctgtgctc

SEQ ID NO: 1978510 - DNA, 18 bp, Homo sapiens
ccaggagtctgtgctctt

SEQ ID NO: 1978511 - DNA, 20 bp, Homo sapiens
ccaggagttcgaggctgcag

SEQ ID NO: 1978512 - DNA, 19 bp, Homo sapiens
ccaggagttgacgcatcct

SEQ ID NO: 1978513 - DNA, 23 bp, Homo sapiens
ccaggagttgacgcatcctgcag

SEQ ID NO: 1978514 - DNA, 22 bp, Homo sapiens
ccaggagtttgagacaagccct

SEQ ID NO: 1978515 - DNA, 17 bp, Homo sapiens
ccaggagtttgagacca

SEQ ID NO: 1978516 - DNA, 18 bp, Homo sapiens
ccaggagtttgagaccag

SEQ ID NO: 1978517 - DNA, 17 bp, Homo sapiens
ccaggagtttgaggctg

SEQ ID NO: 1978518 - DNA, 22 bp, Homo sapiens
ccaggagtttgaggctgcagcg

SEQ ID NO: 1978519 - DNA, 21 bp, Homo sapiens
ccaggatccctcccagatcct

SEQ ID NO: 1978520 - DNA, 16 bp, Homo sapiens
ccaggatcctgcagga

SEQ ID NO: 1978521 - DNA, 17 bp, Homo sapiens
ccaggatcctgcaggaa

SEQ ID NO: 1978522 - DNA, 16 bp, Homo sapiens
ccaggatgaaggcgtg

SEQ ID NO: 1978523 - DNA, 20 bp, Homo sapiens
ccaggatggtgcaggatggc

SEQ ID NO: 1978524 - DNA, 16 bp, Homo sapiens
ccaggattgaagagca

SEQ ID NO: 1978525 - DNA, 15 bp, Homo sapiens
ccaggcaccaggcag

SEQ ID NO: 1978526 - DNA, 21 bp, Homo sapiens
ccaggcaccccctggagagaa

SEQ ID NO: 1978527 - DNA, 22 bp, Homo sapiens
ccaggcacccttctttcctctt

SEQ ID NO: 1978528 - DNA, 13 bp, Homo sapiens
ccaggcacctggc

SEQ ID NO: 1978529 - DNA, 16 bp, Homo sapiens
ccaggcacctggcctg

SEQ ID NO: 1978530 - DNA, 17 bp, Homo sapiens
ccaggcacctggcctgc

SEQ ID NO: 1978531 - DNA, 22 bp, Homo sapiens
ccaggcacctggcctgctggga

SEQ ID NO: 1978532 - DNA, 19 bp, Homo sapiens
ccaggcacgaacccacctg

SEQ ID NO: 1978533 - DNA, 22 bp, Homo sapiens
ccaggcacgaacccacctgctg

SEQ ID NO: 1978534 - DNA, 18 bp, Homo sapiens
ccaggcactgctgcccag

SEQ ID NO: 1978535 - DNA, 18 bp, Homo sapiens
ccaggcaggggtgggaga

SEQ ID NO: 1978536 - DNA, 14 bp, Homo sapiens
ccaggcaggtcttg

SEQ ID NO: 1978537 - DNA, 16 bp, Homo sapiens
ccaggcatcccatccc

SEQ ID NO: 1978538 - DNA, 17 bp, Homo sapiens
ccaggcatcccatccct

SEQ ID NO: 1978539 - DNA, 13 bp, Homo sapiens
ccaggcatgctgg

SEQ ID NO: 1978540 - DNA, 17 bp, Homo sapiens
ccaggcatgctggcctc

SEQ ID NO: 1978541 - DNA, 21 bp, Homo sapiens
ccaggccactgtggccagagc

SEQ ID NO: 1978542 - DNA, 22 bp, Homo sapiens
ccaggccactgtggccagagct

SEQ ID NO: 1978543 - DNA, 16 bp, Homo sapiens
ccaggccccatgacct

SEQ ID NO: 1978544 - DNA, 22 bp, Homo sapiens
ccaggccccatgacctccagct

SEQ ID NO: 1978545 - DNA, 12 bp, Homo sapiens
ccaggcccctga

SEQ ID NO: 1978546 - DNA, 15 bp, Homo sapiens
ccaggcccctgagga

SEQ ID NO: 1978547 - DNA, 17 bp, Homo sapiens
ccaggcccctgaggact

SEQ ID NO: 1978548 - DNA, 22 bp, Homo sapiens
ccaggcccctgaggactggaga

SEQ ID NO: 1978549 - DNA, 20 bp, Homo sapiens
ccaggcccggggctggcggc

SEQ ID NO: 1978550 - DNA, 15 bp, Homo sapiens
ccaggccctccatgg

SEQ ID NO: 1978551 - DNA, 17 bp, Homo sapiens
ccaggccctccatgggc

SEQ ID NO: 1978552 - DNA, 21 bp, Homo sapiens
ccaggccctccatgggctagt

SEQ ID NO: 1978553 - DNA, 23 bp, Homo sapiens
ccaggccgggcttgggccctgca

SEQ ID NO: 1978554 - DNA, 20 bp, Homo sapiens
ccaggccgttccccttggct

SEQ ID NO: 1978555 - DNA, 20 bp, Homo sapiens
ccaggcctccagcctctccc

SEQ ID NO: 1978556 - DNA, 16 bp, Homo sapiens
ccaggcgttggtgcca

SEQ ID NO: 1978557 - DNA, 20 bp, Homo sapiens
ccaggcgttggtgccacttc

SEQ ID NO: 1978558 - DNA, 24 bp, Homo sapiens
ccaggctaatttttttgtatttta

SEQ ID NO: 1978559 - DNA, 15 bp, Homo sapiens
ccaggctccatgggg

SEQ ID NO: 1978560 - DNA, 20 bp, Homo sapiens
ccaggctcctttagcgccca

SEQ ID NO: 1978561 - DNA, 17 bp, Homo sapiens
ccaggctctgcctggag

SEQ ID NO: 1978562 - DNA, 12 bp, Homo sapiens
ccaggctctggg

SEQ ID NO: 1978563 - DNA, 14 bp, Homo sapiens
ccaggctctgggaa

SEQ ID NO: 1978564 - DNA, 16 bp, Homo sapiens
ccaggctctgggaagg

SEQ ID NO: 1978565 - DNA, 12 bp, Homo sapiens
ccaggctcttcc

SEQ ID NO: 1978566 - DNA, 17 bp, Homo sapiens
ccaggctcttcctggac

SEQ ID NO: 1978567 - DNA, 13 bp, Homo sapiens
ccaggctgaagag

SEQ ID NO: 1978568 - DNA, 15 bp, Homo sapiens
ccaggctgaggtcct

SEQ ID NO: 1978569 - DNA, 16 bp, Homo sapiens
ccaggctgcactgcag

SEQ ID NO: 1978570 - DNA, 19 bp, Homo sapiens
ccaggctggtctcaaactc

SEQ ID NO: 1978571 - DNA, 23 bp, Homo sapiens
ccaggcttgtcactagcagctgc

SEQ ID NO: 1978572 - DNA, 22 bp, Homo sapiens
ccagggatgggggatgggccag

SEQ ID NO: 1978573 - DNA, 10 bp, Homo sapiens
ccagggcaca

SEQ ID NO: 1978574 - DNA, 13 bp, Homo sapiens
ccagggcacagga

SEQ ID NO: 1978575 - DNA, 15 bp, Homo sapiens
ccagggcacaggagc

SEQ ID NO: 1978576 - DNA, 17 bp, Homo sapiens
ccagggcacaggagcta

SEQ ID NO: 1978577 - DNA, 19 bp, Homo sapiens
ccagggcatattaaaggct

SEQ ID NO: 1978578 - DNA, 21 bp, Homo sapiens
ccagggcatccgcagcccagg

SEQ ID NO: 1978579 - DNA, 22 bp, Homo sapiens
ccagggccacgtgccaggcccg

SEQ ID NO: 1978580 - DNA, 16 bp, Homo sapiens
ccagggccagggccct

SEQ ID NO: 1978581 - DNA, 16 bp, Homo sapiens
ccagggcccccacagg

SEQ ID NO: 1978582 - DNA, 17 bp, Homo sapiens
ccagggcccccacaggc

SEQ ID NO: 1978583 - DNA, 18 bp, Homo sapiens
ccagggcccccacaggcc

SEQ ID NO: 1978584 - DNA, 17 bp, Homo sapiens
ccagggcccctccctct

SEQ ID NO: 1978585 - DNA, 18 bp, Homo sapiens
ccagggccctgagctcgg

SEQ ID NO: 1978586 - DNA, 15 bp, Homo sapiens
ccagggcctgggaaa

SEQ ID NO: 1978587 - DNA, 13 bp, Homo sapiens
ccagggcctggtg

SEQ ID NO: 1978588 - DNA, 19 bp, Homo sapiens
ccagggcgggagtgggggc

SEQ ID NO: 1978589 - DNA, 12 bp, Homo sapiens
ccagggctcagc

SEQ ID NO: 1978590 - DNA, 13 bp, Homo sapiens
ccagggctcagcc

SEQ ID NO: 1978591 - DNA, 14 bp, Homo sapiens
ccagggctcagcct

SEQ ID NO: 1978592 - DNA, 17 bp, Homo sapiens
ccagggctccctcctgg

SEQ ID NO: 1978593 - DNA, 18 bp, Homo sapiens
ccagggctccctcctgga

SEQ ID NO: 1978594 - DNA, 20 bp, Homo sapiens
ccagggctcgggcgctgtgg

SEQ ID NO: 1978595 - DNA, 22 bp, Homo sapiens
ccagggctcgggcgctgtggct

SEQ ID NO: 1978596 - DNA, 23 bp, Homo sapiens
ccagggctcgggcgctgtggctc

SEQ ID NO: 1978597 - DNA, 21 bp, Homo sapiens
ccaggggagagggtctggaga

SEQ ID NO: 1978598 - DNA, 22 bp, Homo sapiens
ccaggggctgctcatcacccag

SEQ ID NO: 1978599 - DNA, 17 bp, Homo sapiens
ccagggtccgcaccagc

SEQ ID NO: 1978600 - DNA, 20 bp, Homo sapiens
ccagggtccgcaccagctgc

SEQ ID NO: 1978601 - DNA, 21 bp, Homo sapiens
ccagggtccgcaccagctgct

SEQ ID NO: 1978602 - DNA, 23 bp, Homo sapiens
ccagggtccgcaccagctgctct

SEQ ID NO: 1978603 - DNA, 24 bp, Homo sapiens
ccagggtccgcaccagctgctctg

SEQ ID NO: 1978604 - DNA, 14 bp, Homo sapiens
ccagggtcttgggc

SEQ ID NO: 1978605 - DNA, 17 bp, Homo sapiens
ccagggtcttgggctac

SEQ ID NO: 1978606 - DNA, 19 bp, Homo sapiens
ccagggtcttgggctactg

SEQ ID NO: 1978607 - DNA, 21 bp, Homo sapiens
ccagggtcttgggctactggc

SEQ ID NO: 1978608 - DNA, 23 bp, Homo sapiens
ccagggtcttgggctactggcag

SEQ ID NO: 1978609 - DNA, 15 bp, Homo sapiens
ccagggtgagagctg

SEQ ID NO: 1978610 - DNA, 16 bp, Homo sapiens
ccagggtgagagctgc

SEQ ID NO: 1978611 - DNA, 22 bp, Homo sapiens
ccagggtgagagctgctctgga

SEQ ID NO: 1978612 - DNA, 23 bp, Homo sapiens
ccagggtgagagctgctctggaa

SEQ ID NO: 1978613 - DNA, 15 bp, Homo sapiens
ccaggtatctccagg

SEQ ID NO: 1978614 - DNA, 16 bp, Homo sapiens
ccaggtatctccagga

SEQ ID NO: 1978615 - DNA, 14 bp, Homo sapiens
ccaggtcctctgat

SEQ ID NO: 1978616 - DNA, 12 bp, Homo sapiens
ccaggtcctggt

SEQ ID NO: 1978617 - DNA, 16 bp, Homo sapiens
ccaggtctctccactg

SEQ ID NO: 1978618 - DNA, 12 bp, Homo sapiens
ccaggtgagctg

SEQ ID NO: 1978619 - DNA, 22 bp, Homo sapiens
ccaggtgcagtggctcacgcct

SEQ ID NO: 1978620 - DNA, 18 bp, Homo sapiens
ccaggtgccaccaataaa

SEQ ID NO: 1978621 - DNA, 19 bp, Homo sapiens
ccaggtgccaccaataaaa

SEQ ID NO: 1978622 - DNA, 17 bp, Homo sapiens
ccaggtgccagttatgg

SEQ ID NO: 1978623 - DNA, 16 bp, Homo sapiens
ccaggtggctgaccca

SEQ ID NO: 1978624 - DNA, 19 bp, Homo sapiens
ccaggtggctgacccagtc

SEQ ID NO: 1978625 - DNA, 22 bp, Homo sapiens
ccaggtgggagagacactccca

SEQ ID NO: 1978626 - DNA, 23 bp, Homo sapiens
ccaggtgtggctgtcaggacacc

SEQ ID NO: 1978627 - DNA, 21 bp, Homo sapiens
ccaggttagcctttgccctgt

SEQ ID NO: 1978628 - DNA, 24 bp, Homo sapiens
ccaggttagcctttgccctgtcac

SEQ ID NO: 1978629 - DNA, 15 bp, Homo sapiens
ccaggttcagcttgt

SEQ ID NO: 1978630 - DNA, 17 bp, Homo sapiens
ccaggttggcctggtgg

SEQ ID NO: 1978631 - DNA, 20 bp, Homo sapiens
ccagtaaaaaaaaaaaatgg

SEQ ID NO: 1978632 - DNA, 15 bp, Homo sapiens
ccagtaagatgataa

SEQ ID NO: 1978633 - DNA, 22 bp, Homo sapiens
ccagtacagagaaattctgtgg

SEQ ID NO: 1978634 - DNA, 14 bp, Homo sapiens
ccagtacttctaag

SEQ ID NO: 1978635 - DNA, 12 bp, Homo sapiens
ccagtattcttg

SEQ ID NO: 1978636 - DNA, 18 bp, Homo sapiens
ccagtccccctgccccag

SEQ ID NO: 1978637 - DNA, 23 bp, Homo sapiens
ccagtccctgggggaagccctgg

SEQ ID NO: 1978638 - DNA, 20 bp, Homo sapiens
ccagtccgccaaacactcca

SEQ ID NO: 1978639 - DNA, 18 bp, Homo sapiens
ccagtcctagagctcctg

SEQ ID NO: 1978640 - DNA, 15 bp, Homo sapiens
ccagtcgagccctgc

SEQ ID NO: 1978641 - DNA, 16 bp, Homo sapiens
ccagtcgagccctgca

SEQ ID NO: 1978642 - DNA, 20 bp, Homo sapiens
ccagtcgagccctgcagcca

SEQ ID NO: 1978643 - DNA, 14 bp, Homo sapiens
ccagtctaaaaata

SEQ ID NO: 1978644 - DNA, 19 bp, Homo sapiens
ccagtctacgttctccagc

SEQ ID NO: 1978645 - DNA, 15 bp, Homo sapiens
ccagtgaaccaaaga

SEQ ID NO: 1978646 - DNA, 17 bp, Homo sapiens
ccagtgaaggagccacg

SEQ ID NO: 1978647 - DNA, 12 bp, Homo sapiens
ccagtgacagct

SEQ ID NO: 1978648 - DNA, 14 bp, Homo sapiens
ccagtgacagctag

SEQ ID NO: 1978649 - DNA, 13 bp, Homo sapiens
ccagtgacctgac

SEQ ID NO: 1978650 - DNA, 14 bp, Homo sapiens
ccagtgacctgacc

SEQ ID NO: 1978651 - DNA, 20 bp, Homo sapiens
ccagtgacctgctgggtaaa

SEQ ID NO: 1978652 - DNA, 22 bp, Homo sapiens
ccagtgacctgctgggtaaact

SEQ ID NO: 1978653 - DNA, 20 bp, Homo sapiens
ccagtgagggctgggcccac

SEQ ID NO: 1978654 - DNA, 18 bp, Homo sapiens
ccagtgatgtgctggagc

SEQ ID NO: 1978655 - DNA, 22 bp, Homo sapiens
ccagtgatgtgctggagctggc

SEQ ID NO: 1978656 - DNA, 12 bp, Homo sapiens
ccagtgccacag

SEQ ID NO: 1978657 - DNA, 16 bp, Homo sapiens
ccagtgccacagagaa

SEQ ID NO: 1978658 - DNA, 16 bp, Homo sapiens
ccagtgccaggacagc

SEQ ID NO: 1978659 - DNA, 18 bp, Homo sapiens
ccagtgccaggacagctg

SEQ ID NO: 1978660 - DNA, 20 bp, Homo sapiens
ccagtgccaggacagctggc

SEQ ID NO: 1978661 - DNA, 23 bp, Homo sapiens
ccagtgcccacaggatcagtctg

SEQ ID NO: 1978662 - DNA, 18 bp, Homo sapiens
ccagtgccgcctgtgccc

SEQ ID NO: 1978663 - DNA, 20 bp, Homo sapiens
ccagtgccgcctgtgcccac

SEQ ID NO: 1978664 - DNA, 17 bp, Homo sapiens
ccagtgctacctctctc

SEQ ID NO: 1978665 - DNA, 22 bp, Homo sapiens
ccagtgcttctccaacactgaa

SEQ ID NO: 1978666 - DNA, 20 bp, Homo sapiens
ccagtggaacagtcaccctt

SEQ ID NO: 1978667 - DNA, 12 bp, Homo sapiens
ccagtgggacag

SEQ ID NO: 1978668 - DNA, 23 bp, Homo sapiens
ccagtgggaggtgagaccacctc

SEQ ID NO: 1978669 - DNA, 14 bp, Homo sapiens
ccagtggttgctgt

SEQ ID NO: 1978670 - DNA, 16 bp, Homo sapiens
ccagtgtaaggcatag

SEQ ID NO: 1978671 - DNA, 21 bp, Homo sapiens
ccagtgtactgctttcaactt

SEQ ID NO: 1978672 - DNA, 22 bp, Homo sapiens
ccagtgtcccctccactgtcac

SEQ ID NO: 1978673 - DNA, 20 bp, Homo sapiens
ccagtgtgcacccctcccca

SEQ ID NO: 1978674 - DNA, 21 bp, Homo sapiens
ccagtgttggctgtgtgacag

SEQ ID NO: 1978675 - DNA, 17 bp, Homo sapiens
ccagtgtttagaagagc

SEQ ID NO: 1978676 - DNA, 22 bp, Homo sapiens
ccagttaaggaccgtggccctg

SEQ ID NO: 1978677 - DNA, 21 bp, Homo sapiens
ccagttatggctataggtgct

SEQ ID NO: 1978678 - DNA, 17 bp, Homo sapiens
ccagttatgtgaatgat

SEQ ID NO: 1978679 - DNA, 21 bp, Homo sapiens
ccagttcatctatggcagtcc

SEQ ID NO: 1978680 - DNA, 14 bp, Homo sapiens
ccagttctgctcct

SEQ ID NO: 1978681 - DNA, 15 bp, Homo sapiens
ccagttctgctcctc

SEQ ID NO: 1978682 - DNA, 20 bp, Homo sapiens
ccagttctgctcctctccag

SEQ ID NO: 1978683 - DNA, 21 bp, Homo sapiens
ccagttctgctcctctccagg

SEQ ID NO: 1978684 - DNA, 15 bp, Homo sapiens
ccagttgcaataaaa

SEQ ID NO: 1978685 - DNA, 18 bp, Homo sapiens
ccagttgggagcactgga

SEQ ID NO: 1978686 - DNA, 20 bp, Homo sapiens
ccagttgggagcactggagt

SEQ ID NO: 1978687 - DNA, 17 bp, Homo sapiens
ccagttgggtggatgcc

SEQ ID NO: 1978688 - DNA, 20 bp, Homo sapiens
ccagttgggtggatgcctgg

SEQ ID NO: 1978689 - DNA, 13 bp, Homo sapiens
ccagtttcccacc

SEQ ID NO: 1978690 - DNA, 20 bp, Homo sapiens
ccagtttccccatggggctg

SEQ ID NO: 1978691 - DNA, 13 bp, Homo sapiens
ccagtttcccttc

SEQ ID NO: 1978692 - DNA, 16 bp, Homo sapiens
ccagtttctgcggcct

SEQ ID NO: 1978693 - DNA, 14 bp, Homo sapiens
ccagtttgcagaaa

SEQ ID NO: 1978694 - DNA, 13 bp, Homo sapiens
ccagtttgctttg

SEQ ID NO: 1978695 - DNA, 17 bp, Homo sapiens
ccataaagcaagctcaa

SEQ ID NO: 1978696 - DNA, 17 bp, Homo sapiens
ccataagcctccattta

SEQ ID NO: 1978697 - DNA, 18 bp, Homo sapiens
ccataatagttagccctc

SEQ ID NO: 1978698 - DNA, 14 bp, Homo sapiens
ccataatctggact

SEQ ID NO: 1978699 - DNA, 12 bp, Homo sapiens
ccataatgccac

SEQ ID NO: 1978700 - DNA, 21 bp, Homo sapiens
ccataattttcttcatgcaat

SEQ ID NO: 1978701 - DNA, 23 bp, Homo sapiens
ccataattttcttcatgcaatga

SEQ ID NO: 1978702 - DNA, 17 bp, Homo sapiens
ccatacacatccccagc

SEQ ID NO: 1978703 - DNA, 14 bp, Homo sapiens
ccataccatcactg

SEQ ID NO: 1978704 - DNA, 17 bp, Homo sapiens
ccataccatcactgagt

SEQ ID NO: 1978705 - DNA, 14 bp, Homo sapiens
ccatacccctgcct

SEQ ID NO: 1978706 - DNA, 17 bp, Homo sapiens
ccatacccctgcctggg

SEQ ID NO: 1978707 - DNA, 18 bp, Homo sapiens
ccatacccctgcctgggt

SEQ ID NO: 1978708 - DNA, 14 bp, Homo sapiens
ccatactcatttct

SEQ ID NO: 1978709 - DNA, 16 bp, Homo sapiens
ccatagaaacatgaca

SEQ ID NO: 1978710 - DNA, 13 bp, Homo sapiens
ccatagagtttaa

SEQ ID NO: 1978711 - DNA, 15 bp, Homo sapiens
ccatagatcttctga

SEQ ID NO: 1978712 - DNA, 21 bp, Homo sapiens
ccatagatcttctgaaatgaa

SEQ ID NO: 1978713 - DNA, 17 bp, Homo sapiens
ccatagcgctggctcag

SEQ ID NO: 1978714 - DNA, 15 bp, Homo sapiens
ccatagcttccatga

SEQ ID NO: 1978715 - DNA, 15 bp, Homo sapiens
ccataggtagaatgt

SEQ ID NO: 1978716 - DNA, 15 bp, Homo sapiens
ccatatcagacctct

SEQ ID NO: 1978717 - DNA, 17 bp, Homo sapiens
ccatatcagacctctga

SEQ ID NO: 1978718 - DNA, 18 bp, Homo sapiens
ccatatcagacctctgat

SEQ ID NO: 1978719 - DNA, 19 bp, Homo sapiens
ccatatcagacctctgatc

SEQ ID NO: 1978720 - DNA, 19 bp, Homo sapiens
ccatatctccttcccctac

SEQ ID NO: 1978721 - DNA, 19 bp, Homo sapiens
ccatatgtctgcttctgtc

SEQ ID NO: 1978722 - DNA, 23 bp, Homo sapiens
ccatattctgttggccagtgtga

SEQ ID NO: 1978723 - DNA, 23 bp, Homo sapiens
ccatattttcacaggtgtggtgt

SEQ ID NO: 1978724 - DNA, 17 bp, Homo sapiens
ccatcaatggaaacagg

SEQ ID NO: 1978725 - DNA, 19 bp, Homo sapiens
ccatcaatggaaacagggc

SEQ ID NO: 1978726 - DNA, 14 bp, Homo sapiens
ccatcactggagca

SEQ ID NO: 1978727 - DNA, 12 bp, Homo sapiens
ccatcagctccc

SEQ ID NO: 1978728 - DNA, 15 bp, Homo sapiens
ccatcaggacttggg

SEQ ID NO: 1978729 - DNA, 21 bp, Homo sapiens
ccatcatacgcatggtcctgg

SEQ ID NO: 1978730 - DNA, 21 bp, Homo sapiens
ccatcatatcctttgccccaa

SEQ ID NO: 1978731 - DNA, 20 bp, Homo sapiens
ccatcatatgacatgccacc

SEQ ID NO: 1978732 - DNA, 15 bp, Homo sapiens
ccatcatcccagctg

SEQ ID NO: 1978733 - DNA, 18 bp, Homo sapiens
ccatcatgtgcctggaaa

SEQ ID NO: 1978734 - DNA, 12 bp, Homo sapiens
ccatcccacatt

SEQ ID NO: 1978735 - DNA, 14 bp, Homo sapiens
ccatcccccactgc

SEQ ID NO: 1978736 - DNA, 15 bp, Homo sapiens
ccatcccctggactg

SEQ ID NO: 1978737 - DNA, 20 bp, Homo sapiens
ccatcccctttcctccccac

SEQ ID NO: 1978738 - DNA, 21 bp, Homo sapiens
ccatgtttggttgtaaatgct

SEQ ID NO: 1978739 - DNA, 19 bp, Homo sapiens
ccattacaactagatcaag

SEQ ID NO: 1978740 - DNA, 15 bp, Homo sapiens
ccattacatgtttaa

SEQ ID NO: 1978741 - DNA, 16 bp, Homo sapiens
ccattaggcatgccta

SEQ ID NO: 1978742 - DNA, 18 bp, Homo sapiens
ccattcacatttgatgta

SEQ ID NO: 1978743 - DNA, 18 bp, Homo sapiens
ccattcatctctaacata

SEQ ID NO: 1978744 - DNA, 23 bp, Homo sapiens
ccattcatctctaacatatgata

SEQ ID NO: 1978745 - DNA, 21 bp, Homo sapiens
ccattctcatatgtagccctc

SEQ ID NO: 1978746 - DNA, 19 bp, Homo sapiens
ccattctctctcctgtcca

SEQ ID NO: 1978747 - DNA, 20 bp, Homo sapiens
ccattctctctcctgtccaa

SEQ ID NO: 1978748 - DNA, 15 bp, Homo sapiens
ccattgacctcagct

SEQ ID NO: 1978749 - DNA, 18 bp, Homo sapiens
ccattgacctcagctgca

SEQ ID NO: 1978750 - DNA, 17 bp, Homo sapiens
ccattgtcttccaaccc

SEQ ID NO: 1978751 - DNA, 21 bp, Homo sapiens
ccattgtcttccaaccccagc

SEQ ID NO: 1978752 - DNA, 13 bp, Homo sapiens
ccatttaaagctt

SEQ ID NO: 1978753 - DNA, 12 bp, Homo sapiens
ccatttcaaatg

SEQ ID NO: 1978754 - DNA, 17 bp, Homo sapiens
ccatttcaactccagaa

SEQ ID NO: 1978755 - DNA, 17 bp, Homo sapiens
ccatttcaattctcaaa

SEQ ID NO: 1978756 - DNA, 17 bp, Homo sapiens
ccatttcatctatttct

SEQ ID NO: 1978757 - DNA, 18 bp, Homo sapiens
ccatttccttggaggcca

SEQ ID NO: 1978758 - DNA, 17 bp, Homo sapiens
ccatttctatttattta

SEQ ID NO: 1978759 - DNA, 19 bp, Homo sapiens
ccatttctcaatcagtgca

SEQ ID NO: 1978760 - DNA, 16 bp, Homo sapiens
ccatttcttcctcact

SEQ ID NO: 1978761 - DNA, 16 bp, Homo sapiens
ccatttgctttttcac

SEQ ID NO: 1978762 - DNA, 17 bp, Homo sapiens
ccattttgcaaaatttc

SEQ ID NO: 1978763 - DNA, 21 bp, Homo sapiens
ccattttgcaaaatttccagt

SEQ ID NO: 1978764 - DNA, 16 bp, Homo sapiens
ccatttttactaaagc

SEQ ID NO: 1978765 - DNA, 18 bp, Homo sapiens
ccatttttactaaagcag

SEQ ID NO: 1978766 - DNA, 23 bp, Homo sapiens
ccatttttactaaagcagtgttt

SEQ ID NO: 1978767 - DNA, 15 bp, Homo sapiens
ccatttttgagccaa

SEQ ID NO: 1978768 - DNA, 21 bp, Homo sapiens
cccaaaacctttccccagaca

SEQ ID NO: 1978769 - DNA, 23 bp, Homo sapiens
cccaaaacctttccccagacaca

SEQ ID NO: 1978770 - DNA, 21 bp, Homo sapiens
cccaaagcccagctctttgtt

SEQ ID NO: 1978771 - DNA, 13 bp, Homo sapiens
cccaaagtgctgg

SEQ ID NO: 1978772 - DNA, 16 bp, Homo sapiens
cccaaagtgctgggat

SEQ ID NO: 1978773 - DNA, 21 bp, Homo sapiens
cccaaatcccacagggccaga

SEQ ID NO: 1978774 - DNA, 21 bp, Homo sapiens
cccaacccccaccgaagagcc

SEQ ID NO: 1978775 - DNA, 19 bp, Homo sapiens
cccaacccgtggaggctgc

SEQ ID NO: 1978776 - DNA, 20 bp, Homo sapiens
cccaacccgtggaggctgct

SEQ ID NO: 1978777 - DNA, 21 bp, Homo sapiens
cccaacccgtggaggctgctc

SEQ ID NO: 1978778 - DNA, 17 bp, Homo sapiens
cccaacctaagattgtg

SEQ ID NO: 1978779 - DNA, 18 bp, Homo sapiens
cccaacctcaatgccctg

SEQ ID NO: 1978780 - DNA, 19 bp, Homo sapiens
cccaacctcaatgccctgc

SEQ ID NO: 1978781 - DNA, 14 bp, Homo sapiens
cccaacctgctctc

SEQ ID NO: 1978782 - DNA, 15 bp, Homo sapiens
cccaacctttccctc

SEQ ID NO: 1978783 - DNA, 13 bp, Homo sapiens
cccaactgctctg

SEQ ID NO: 1978784 - DNA, 17 bp, Homo sapiens
cccaagagatgaagagt

SEQ ID NO: 1978785 - DNA, 14 bp, Homo sapiens
cccaagaggactga

SEQ ID NO: 1978786 - DNA, 14 bp, Homo sapiens
cccaagaggtctga

SEQ ID NO: 1978787 - DNA, 18 bp, Homo sapiens
cccaagaggtctgagccc

SEQ ID NO: 1978788 - DNA, 20 bp, Homo sapiens
cccaagaggtctgagccctg

SEQ ID NO: 1978789 - DNA, 16 bp, Homo sapiens
cccaagcagccagcca

SEQ ID NO: 1978790 - DNA, 19 bp, Homo sapiens
cccaagcagccgcagcgca

SEQ ID NO: 1978791 - DNA, 22 bp, Homo sapiens
cccaagccatggtgacacacag

SEQ ID NO: 1978792 - DNA, 20 bp, Homo sapiens
cccaagcctctgccccaagg

SEQ ID NO: 1978793 - DNA, 23 bp, Homo sapiens
cccaagcctctgccccaaggggc

SEQ ID NO: 1978794 - DNA, 12 bp, Homo sapiens
cccaaggagctg

SEQ ID NO: 1978795 - DNA, 14 bp, Homo sapiens
cccaaggaggaaaa

SEQ ID NO: 1978796 - DNA, 22 bp, Homo sapiens
cccaaggaggaaaaacagacaa

SEQ ID NO: 1978797 - DNA, 20 bp, Homo sapiens
cccaaggcagtgttcctcac

SEQ ID NO: 1978798 - DNA, 18 bp, Homo sapiens
cccaaggttactcagcag

SEQ ID NO: 1978799 - DNA, 23 bp, Homo sapiens
cccaaggttactcagcagcagag

SEQ ID NO: 1978800 - DNA, 22 bp, Homo sapiens
cccaagtagtagtgtcttccta

SEQ ID NO: 1978801 - DNA, 19 bp, Homo sapiens
cccaagtatacaataaagt

SEQ ID NO: 1978802 - DNA, 15 bp, Homo sapiens
cccaagtgccagtct

SEQ ID NO: 1978803 - DNA, 18 bp, Homo sapiens
cccaagtgccagtcttgt

SEQ ID NO: 1978804 - DNA, 14 bp, Homo sapiens
cccaagtgggggca

SEQ ID NO: 1978805 - DNA, 11 bp, Homo sapiens
cccaataaaag

SEQ ID NO: 1978806 - DNA, 19 bp, Homo sapiens
cccaataaaagtgactctc

SEQ ID NO: 1978807 - DNA, 15 bp, Homo sapiens
cccaataaagctgga

SEQ ID NO: 1978808 - DNA, 16 bp, Homo sapiens
cccaataaagctggac

SEQ ID NO: 1978809 - DNA, 17 bp, Homo sapiens
cccaatgctcctggagg

SEQ ID NO: 1978810 - DNA, 14 bp, Homo sapiens
cccaatgctttggg

SEQ ID NO: 1978811 - DNA, 22 bp, Homo sapiens
cccaatgctttgggaggccaag

SEQ ID NO: 1978812 - DNA, 13 bp, Homo sapiens
cccacaaagggga

SEQ ID NO: 1978813 - DNA, 14 bp, Homo sapiens
cccacaaaggggag

SEQ ID NO: 1978814 - DNA, 17 bp, Homo sapiens
cccacaaaggggagaag

SEQ ID NO: 1978815 - DNA, 22 bp, Homo sapiens
cccacaaataatgaacagcaga

SEQ ID NO: 1978816 - DNA, 22 bp, Homo sapiens
cccacaagccttactcacctct

SEQ ID NO: 1978817 - DNA, 20 bp, Homo sapiens
cccacacatgtttacagaac

SEQ ID NO: 1978818 - DNA, 16 bp, Homo sapiens
cccacacctccctact

SEQ ID NO: 1978819 - DNA, 21 bp, Homo sapiens
cccacacgtgctcgcagcctg

SEQ ID NO: 1978820 - DNA, 18 bp, Homo sapiens
cccacactcccccagact

SEQ ID NO: 1978821 - DNA, 12 bp, Homo sapiens
cccacagaactg

SEQ ID NO: 1978822 - DNA, 15 bp, Homo sapiens
cccacagaactgctt

SEQ ID NO: 1978823 - DNA, 18 bp, Homo sapiens
cccacagacagatcccat

SEQ ID NO: 1978824 - DNA, 13 bp, Homo sapiens
cccacagagcctg

SEQ ID NO: 1978825 - DNA, 18 bp, Homo sapiens
cccacagcacccaggctc

SEQ ID NO: 1978826 - DNA, 17 bp, Homo sapiens
cccacaggatcagtctg

SEQ ID NO: 1978827 - DNA, 16 bp, Homo sapiens
cccacaggcccttcct

SEQ ID NO: 1978828 - DNA, 21 bp, Homo sapiens
cccacagtcctcacagcctct

SEQ ID NO: 1978829 - DNA, 14 bp, Homo sapiens
cccacatccctggg

SEQ ID NO: 1978830 - DNA, 19 bp, Homo sapiens
cccacatccctgggcctgc

SEQ ID NO: 1978831 - DNA, 24 bp, Homo sapiens
cccacatccctgggcctgctgctg

SEQ ID NO: 1978832 - DNA, 19 bp, Homo sapiens
cccacatgtgacacatatg

SEQ ID NO: 1978833 - DNA, 14 bp, Homo sapiens
cccacattggaccc

SEQ ID NO: 1978834 - DNA, 19 bp, Homo sapiens
cccacatttacctcgaggc

SEQ ID NO: 1978835 - DNA, 16 bp, Homo sapiens
cccaccaaactgcaca

SEQ ID NO: 1978836 - DNA, 16 bp, Homo sapiens
cccaccaactctgcac

SEQ ID NO: 1978837 - DNA, 17 bp, Homo sapiens
cccaccaactctgcact

SEQ ID NO: 1978838 - DNA, 19 bp, Homo sapiens
cccaccacctaggccactc

SEQ ID NO: 1978839 - DNA, 20 bp, Homo sapiens
cccaccacctaggccactcc

SEQ ID NO: 1978840 - DNA, 20 bp, Homo sapiens
cccaccacgtgctcaatcat

SEQ ID NO: 1978841 - DNA, 15 bp, Homo sapiens
cccaccagccacctc

SEQ ID NO: 1978842 - DNA, 17 bp, Homo sapiens
cccaccagccacctctt

SEQ ID NO: 1978843 - DNA, 20 bp, Homo sapiens
cccaccagcctaagaagctc

SEQ ID NO: 1978844 - DNA, 18 bp, Homo sapiens
cccaccatcatgtctggc

SEQ ID NO: 1978845 - DNA, 14 bp, Homo sapiens
cccacccacatgtg

SEQ ID NO: 1978846 - DNA, 23 bp, Homo sapiens
cccacccagggctccctcctgga

SEQ ID NO: 1978847 - DNA, 12 bp, Homo sapiens
cccacccagtcc

SEQ ID NO: 1978848 - DNA, 14 bp, Homo sapiens
cccacccatcttcc

SEQ ID NO: 1978849 - DNA, 15 bp, Homo sapiens
cccacccatcttcct

SEQ ID NO: 1978850 - DNA, 22 bp, Homo sapiens
cccaccctcgtggacacctgcc

SEQ ID NO: 1978851 - DNA, 16 bp, Homo sapiens
cccaccgaagagccct

SEQ ID NO: 1978852 - DNA, 19 bp, Homo sapiens
cccaccgaagagccctgag

SEQ ID NO: 1978853 - DNA, 23 bp, Homo sapiens
cccaccgggccactccttcctgc

SEQ ID NO: 1978854 - DNA, 14 bp, Homo sapiens
cccacctcagcctc

SEQ ID NO: 1978855 - DNA, 21 bp, Homo sapiens
cccacctcagcctcccagagt

SEQ ID NO: 1978856 - DNA, 23 bp, Homo sapiens
cccacctcatgcctggcccccct

SEQ ID NO: 1978857 - DNA, 13 bp, Homo sapiens
cccacctccaccc

SEQ ID NO: 1978858 - DNA, 16 bp, Homo sapiens
cccacctccgccccag

SEQ ID NO: 1978859 - DNA, 17 bp, Homo sapiens
cccacctcttccttccg

SEQ ID NO: 1978860 - DNA, 13 bp, Homo sapiens
cccacctgctgag

SEQ ID NO: 1978861 - DNA, 13 bp, Homo sapiens
cccacctgggacc

SEQ ID NO: 1978862 - DNA, 19 bp, Homo sapiens
cccaccttcaattcctggg

SEQ ID NO: 1978863 - DNA, 20 bp, Homo sapiens
cccaccttcaattcctgggc

SEQ ID NO: 1978864 - DNA, 14 bp, Homo sapiens
cccaccttccccag

SEQ ID NO: 1978865 - DNA, 15 bp, Homo sapiens
cccaccttccccaga

SEQ ID NO: 1978866 - DNA, 14 bp, Homo sapiens
cccaccttggctgc

SEQ ID NO: 1978867 - DNA, 15 bp, Homo sapiens
cccaccttggctgca

SEQ ID NO: 1978868 - DNA, 18 bp, Homo sapiens
cccacctttaagtcctct

SEQ ID NO: 1978869 - DNA, 15 bp, Homo sapiens
cccacctttctcgct

SEQ ID NO: 1978870 - DNA, 20 bp, Homo sapiens
cccacgactgttgtacaagc

SEQ ID NO: 1978871 - DNA, 15 bp, Homo sapiens
cccacgagtcacctg

SEQ ID NO: 1978872 - DNA, 20 bp, Homo sapiens
cccacgagtcacctgcaagc

SEQ ID NO: 1978873 - DNA, 14 bp, Homo sapiens
cccacgctggagtg

SEQ ID NO: 1978874 - DNA, 16 bp, Homo sapiens
cccacgtgtgcagact

SEQ ID NO: 1978875 - DNA, 22 bp, Homo sapiens
cccactaagctttctcctttga

SEQ ID NO: 1978876 - DNA, 18 bp, Homo sapiens
cccactccagccctgtcc

SEQ ID NO: 1978877 - DNA, 22 bp, Homo sapiens
cccactccctggctctcagaag

SEQ ID NO: 1978878 - DNA, 18 bp, Homo sapiens
cccactcctcactgcccc

SEQ ID NO: 1978879 - DNA, 19 bp, Homo sapiens
cccactctcattccccagg

SEQ ID NO: 1978880 - DNA, 19 bp, Homo sapiens
cccactctgctctgatgca

SEQ ID NO: 1978881 - DNA, 19 bp, Homo sapiens
cccactgcaggccccgctt

SEQ ID NO: 1978882 - DNA, 12 bp, Homo sapiens
cccactggccag

SEQ ID NO: 1978883 - DNA, 13 bp, Homo sapiens
cccactggccagt

SEQ ID NO: 1978884 - DNA, 16 bp, Homo sapiens
cccactggccagtcct

SEQ ID NO: 1978885 - DNA, 22 bp, Homo sapiens
cccactggccagtcctagagct

SEQ ID NO: 1978886 - DNA, 23 bp, Homo sapiens
cccacttagccgtccatggcacc

SEQ ID NO: 1978887 - DNA, 14 bp, Homo sapiens
cccacttccattcc

SEQ ID NO: 1978888 - DNA, 19 bp, Homo sapiens
cccacttgggagcttgtat

SEQ ID NO: 1978889 - DNA, 21 bp, Homo sapiens
cccagaaattccttcccactc

SEQ ID NO: 1978890 - DNA, 23 bp, Homo sapiens
cccagaaggcagggaaaggctct

SEQ ID NO: 1978891 - DNA, 13 bp, Homo sapiens
cccagaagggagt

SEQ ID NO: 1978892 - DNA, 15 bp, Homo sapiens
cccagaagggagttg

SEQ ID NO: 1978893 - DNA, 21 bp, Homo sapiens
cccagaagggagttgctcact

SEQ ID NO: 1978894 - DNA, 23 bp, Homo sapiens
cccagaagggagttgctcactca

SEQ ID NO: 1978895 - DNA, 11 bp, Homo sapiens
cccagacacat

SEQ ID NO: 1978896 - DNA, 18 bp, Homo sapiens
cccagacttctctttctt

SEQ ID NO: 1978897 - DNA, 20 bp, Homo sapiens
cccagagaatcagggcaggc

SEQ ID NO: 1978898 - DNA, 17 bp, Homo sapiens
cccagagaccccttcct

SEQ ID NO: 1978899 - DNA, 21 bp, Homo sapiens
cccagagaccccttcctttcc

SEQ ID NO: 1978900 - DNA, 18 bp, Homo sapiens
cccagagatgcctccacc

SEQ ID NO: 1978901 - DNA, 19 bp, Homo sapiens
cccagagatgcctccaccg

SEQ ID NO: 1978902 - DNA, 22 bp, Homo sapiens
cccagagcattacgtgagccag

SEQ ID NO: 1978903 - DNA, 16 bp, Homo sapiens
cccagagccccactcc

SEQ ID NO: 1978904 - DNA, 23 bp, Homo sapiens
cccagagccttctcctgcctaca

SEQ ID NO: 1978905 - DNA, 18 bp, Homo sapiens
cccagagcttattggcca

SEQ ID NO: 1978906 - DNA, 19 bp, Homo sapiens
cccagagcttattggccac

SEQ ID NO: 1978907 - DNA, 20 bp, Homo sapiens
cccagagcttattggccact

SEQ ID NO: 1978908 - DNA, 22 bp, Homo sapiens
cccagagcttattggccactgg

SEQ ID NO: 1978909 - DNA, 18 bp, Homo sapiens
cccagagcttcccaggat

SEQ ID NO: 1978910 - DNA, 17 bp, Homo sapiens
cccagagggccaagaga

SEQ ID NO: 1978911 - DNA, 15 bp, Homo sapiens
cccagagggcccagg

SEQ ID NO: 1978912 - DNA, 22 bp, Homo sapiens
cccagagggcccaggcaggcca

SEQ ID NO: 1978913 - DNA, 19 bp, Homo sapiens
cccagagggtagggcagca

SEQ ID NO: 1978914 - DNA, 17 bp, Homo sapiens
cccagaggttatctgcc

SEQ ID NO: 1978915 - DNA, 13 bp, Homo sapiens
cccagagtcagag

SEQ ID NO: 1978916 - DNA, 21 bp, Homo sapiens
cccagagtggagtctgagtct

SEQ ID NO: 1978917 - DNA, 15 bp, Homo sapiens
cccagatctgcctgg

SEQ ID NO: 1978918 - DNA, 22 bp, Homo sapiens
cccagatctgcctgggcctgtg

SEQ ID NO: 1978919 - DNA, 14 bp, Homo sapiens
cccagatgctgggg

SEQ ID NO: 1978920 - DNA, 21 bp, Homo sapiens
cccagattgcaacaggctggg

SEQ ID NO: 1978921 - DNA, 23 bp, Homo sapiens
cccagattgcaacaggctgggct

SEQ ID NO: 1978922 - DNA, 22 bp, Homo sapiens
cccagcactcctctgtctctgc

SEQ ID NO: 1978923 - DNA, 23 bp, Homo sapiens
cccagcactcctctgtctctgct

SEQ ID NO: 1978924 - DNA, 14 bp, Homo sapiens
cccagcactgtgaa

SEQ ID NO: 1978925 - DNA, 22 bp, Homo sapiens
cccagcagccctaaggatctct

SEQ ID NO: 1978926 - DNA, 15 bp, Homo sapiens
cccagcagctgggcc

SEQ ID NO: 1978927 - DNA, 19 bp, Homo sapiens
cccagcagctgggccggcc

SEQ ID NO: 1978928 - DNA, 16 bp, Homo sapiens
cccagcaggaagccag

SEQ ID NO: 1978929 - DNA, 20 bp, Homo sapiens
cccagcaggaagccaggctg

SEQ ID NO: 1978930 - DNA, 19 bp, Homo sapiens
cccagcagggcctcaaagt

SEQ ID NO: 1978931 - DNA, 18 bp, Homo sapiens
cccagccacctcccaagg

SEQ ID NO: 1978932 - DNA, 13 bp, Homo sapiens
cccagccagaagt

SEQ ID NO: 1978933 - DNA, 14 bp, Homo sapiens
cccagccatggtga

SEQ ID NO: 1978934 - DNA, 10 bp, Homo sapiens
cccagccatt

SEQ ID NO: 1978935 - DNA, 12 bp, Homo sapiens
cccagcccacag

SEQ ID NO: 1978936 - DNA, 14 bp, Homo sapiens
cccagcccacttct

SEQ ID NO: 1978937 - DNA, 19 bp, Homo sapiens
cccagcccacttctgccat

SEQ ID NO: 1978938 - DNA, 13 bp, Homo sapiens
cccagcccagctg

SEQ ID NO: 1978939 - DNA, 22 bp, Homo sapiens
cccagcccattctctctcctgt

SEQ ID NO: 1978940 - DNA, 21 bp, Homo sapiens
cccagccccctaagagagcac

SEQ ID NO: 1978941 - DNA, 16 bp, Homo sapiens
cccagccccgactcca

SEQ ID NO: 1978942 - DNA, 17 bp, Homo sapiens
cccagccctatggatgt

SEQ ID NO: 1978943 - DNA, 13 bp, Homo sapiens
cccagccctcagg

SEQ ID NO: 1978944 - DNA, 15 bp, Homo sapiens
cccagccctcaggcc

SEQ ID NO: 1978945 - DNA, 17 bp, Homo sapiens
cccagccctcaggccag

SEQ ID NO: 1978946 - DNA, 18 bp, Homo sapiens
cccagccctcaggccagt

SEQ ID NO: 1978947 - DNA, 19 bp, Homo sapiens
cccagccctcaggccagtg

SEQ ID NO: 1978948 - DNA, 20 bp, Homo sapiens
cccagccctccccgcagtgg

SEQ ID NO: 1978949 - DNA, 16 bp, Homo sapiens
cccagccctgccagga

SEQ ID NO: 1978950 - DNA, 14 bp, Homo sapiens
cccagccctggctc

SEQ ID NO: 1978951 - DNA, 16 bp, Homo sapiens
cccagccctggctctg

SEQ ID NO: 1978952 - DNA, 18 bp, Homo sapiens
cccagccctggctctgca

SEQ ID NO: 1978953 - DNA, 15 bp, Homo sapiens
cccagcccttctgcc

SEQ ID NO: 1978954 - DNA, 15 bp, Homo sapiens
cccagcctagcccac

SEQ ID NO: 1978955 - DNA, 18 bp, Homo sapiens
cccagcctccaagctcca

SEQ ID NO: 1978956 - DNA, 20 bp, Homo sapiens
cccagcctccaagctccatc

SEQ ID NO: 1978957 - DNA, 17 bp, Homo sapiens
cccagcctctgtccctc

SEQ ID NO: 1978958 - DNA, 21 bp, Homo sapiens
ccatcccctttcctccccacc

SEQ ID NO: 1978959 - DNA, 17 bp, Homo sapiens
ccatccctgggcccctc

SEQ ID NO: 1978960 - DNA, 18 bp, Homo sapiens
ccatccctgggcccctcc

SEQ ID NO: 1978961 - DNA, 13 bp, Homo sapiens
ccatccggctcct

SEQ ID NO: 1978962 - DNA, 15 bp, Homo sapiens
ccatccggctcctgt

SEQ ID NO: 1978963 - DNA, 18 bp, Homo sapiens
ccatccgggacgcttcca

SEQ ID NO: 1978964 - DNA, 20 bp, Homo sapiens
ccatccgggacgcttccaga

SEQ ID NO: 1978965 - DNA, 16 bp, Homo sapiens
ccatcctgcagcctcc

SEQ ID NO: 1978966 - DNA, 16 bp, Homo sapiens
ccatcctggcccctcc

SEQ ID NO: 1978967 - DNA, 12 bp, Homo sapiens
ccatcctgggcc

SEQ ID NO: 1978968 - DNA, 19 bp, Homo sapiens
ccatcctgggccttacctc

SEQ ID NO: 1978969 - DNA, 20 bp, Homo sapiens
ccatccttcaccagagccca

SEQ ID NO: 1978970 - DNA, 17 bp, Homo sapiens
ccatctaagctgcagct

SEQ ID NO: 1978971 - DNA, 21 bp, Homo sapiens
ccatctaagctgcagcttcct

SEQ ID NO: 1978972 - DNA, 17 bp, Homo sapiens
ccatctcaggtgccact

SEQ ID NO: 1978973 - DNA, 19 bp, Homo sapiens
ccatctccatttcacacag

SEQ ID NO: 1978974 - DNA, 14 bp, Homo sapiens
ccatctccccaggc

SEQ ID NO: 1978975 - DNA, 16 bp, Homo sapiens
ccatctccccaggcct

SEQ ID NO: 1978976 - DNA, 17 bp, Homo sapiens
ccatctccccaggcctc

SEQ ID NO: 1978977 - DNA, 18 bp, Homo sapiens
ccatctccccaggcctcc

SEQ ID NO: 1978978 - DNA, 23 bp, Homo sapiens
ccatctccccaggcctccagcct

SEQ ID NO: 1978979 - DNA, 18 bp, Homo sapiens
ccatctcctcccatggcc

SEQ ID NO: 1978980 - DNA, 17 bp, Homo sapiens
ccatctcctttcaggga

SEQ ID NO: 1978981 - DNA, 14 bp, Homo sapiens
ccatctctcttccc

SEQ ID NO: 1978982 - DNA, 18 bp, Homo sapiens
ccatctctgattttcaaa

SEQ ID NO: 1978983 - DNA, 13 bp, Homo sapiens
ccatctcttccta

SEQ ID NO: 1978984 - DNA, 19 bp, Homo sapiens
ccatctgcttggttggctg

SEQ ID NO: 1978985 - DNA, 23 bp, Homo sapiens
ccatctgggtccttgcacccctc

SEQ ID NO: 1978986 - DNA, 21 bp, Homo sapiens
ccatctgtcttgccagccaga

SEQ ID NO: 1978987 - DNA, 14 bp, Homo sapiens
ccatcttcctgctg

SEQ ID NO: 1978988 - DNA, 15 bp, Homo sapiens
ccatcttcctgctgc

SEQ ID NO: 1978989 - DNA, 14 bp, Homo sapiens
ccatctttctttgg

SEQ ID NO: 1978990 - DNA, 17 bp, Homo sapiens
ccatgaagacaggacag

SEQ ID NO: 1978991 - DNA, 12 bp, Homo sapiens
ccatgaagctgg

SEQ ID NO: 1978992 - DNA, 18 bp, Homo sapiens
ccatgaagctggaagcac

SEQ ID NO: 1978993 - DNA, 21 bp, Homo sapiens
ccatgaagctggaagcactgc

SEQ ID NO: 1978994 - DNA, 16 bp, Homo sapiens
ccatgaatcaaagaca

SEQ ID NO: 1978995 - DNA, 16 bp, Homo sapiens
ccatgaccagaaacag

SEQ ID NO: 1978996 - DNA, 15 bp, Homo sapiens
ccatgacctccagct

SEQ ID NO: 1978997 - DNA, 17 bp, Homo sapiens
ccatgagaagagggcct

SEQ ID NO: 1978998 - DNA, 23 bp, Homo sapiens
ccatgagcctcagcatcctggca

SEQ ID NO: 1978999 - DNA, 20 bp, Homo sapiens
ccatgaggagttgctgtttg

SEQ ID NO: 1979000 - DNA, 21 bp, Homo sapiens
ccatgatcgagccactgcact

SEQ ID NO: 1979001 - DNA, 19 bp, Homo sapiens
ccatgatgccgctcttctg

SEQ ID NO: 1979002 - DNA, 22 bp, Homo sapiens
ccatgatggtgctgacctctgg

SEQ ID NO: 1979003 - DNA, 12 bp, Homo sapiens
ccatgattttac

SEQ ID NO: 1979004 - DNA, 17 bp, Homo sapiens
ccatgcaattcatccca

SEQ ID NO: 1979005 - DNA, 21 bp, Homo sapiens
ccatgcacacaaacacctcct

SEQ ID NO: 1979006 - DNA, 11 bp, Homo sapiens
ccatgcagcct

SEQ ID NO: 1979007 - DNA, 23 bp, Homo sapiens
ccatgcagcttcatcaattttta

SEQ ID NO: 1979008 - DNA, 23 bp, Homo sapiens
ccatgccactgccaggcacctgg

SEQ ID NO: 1979009 - DNA, 14 bp, Homo sapiens
ccatgcccaaccta

SEQ ID NO: 1979010 - DNA, 17 bp, Homo sapiens
ccatgcctacagataat

SEQ ID NO: 1979011 - DNA, 20 bp, Homo sapiens
ccatgcctcatgccacacct

SEQ ID NO: 1979012 - DNA, 14 bp, Homo sapiens
ccatgcctgagggt

SEQ ID NO: 1979013 - DNA, 19 bp, Homo sapiens
ccatgcgctgctcaacctc

SEQ ID NO: 1979014 - DNA, 23 bp, Homo sapiens
ccatgcgctgctcaacctctctc

SEQ ID NO: 1979015 - DNA, 17 bp, Homo sapiens
ccatgctcaaccactgt

SEQ ID NO: 1979016 - DNA, 14 bp, Homo sapiens
ccatgctctgcccc

SEQ ID NO: 1979017 - DNA, 19 bp, Homo sapiens
ccatgctctgccccaagcc

SEQ ID NO: 1979018 - DNA, 14 bp, Homo sapiens
ccatgctgaattat

SEQ ID NO: 1979019 - DNA, 18 bp, Homo sapiens
ccatgctgaattattttg

SEQ ID NO: 1979020 - DNA, 14 bp, Homo sapiens
ccatgctgcctcca

SEQ ID NO: 1979021 - DNA, 21 bp, Homo sapiens
ccatgctgctttttggcacag

SEQ ID NO: 1979022 - DNA, 19 bp, Homo sapiens
ccatgctggcggcgcagag

SEQ ID NO: 1979023 - DNA, 15 bp, Homo sapiens
ccatgcttcttgccc

SEQ ID NO: 1979024 - DNA, 12 bp, Homo sapiens
ccatgctttcct

SEQ ID NO: 1979025 - DNA, 18 bp, Homo sapiens
ccatgctttccttttctt

SEQ ID NO: 1979026 - DNA, 17 bp, Homo sapiens
ccatggagacaagaagg

SEQ ID NO: 1979027 - DNA, 13 bp, Homo sapiens
ccatggaggaggt

SEQ ID NO: 1979028 - DNA, 12 bp, Homo sapiens
ccatggaggcag

SEQ ID NO: 1979029 - DNA, 14 bp, Homo sapiens
ccatggcaccagcc

SEQ ID NO: 1979030 - DNA, 15 bp, Homo sapiens
ccatggcaccagccc

SEQ ID NO: 1979031 - DNA, 18 bp, Homo sapiens
ccatggcaccagccccct

SEQ ID NO: 1979032 - DNA, 19 bp, Homo sapiens
ccatggcaccagccccctg

SEQ ID NO: 1979033 - DNA, 14 bp, Homo sapiens
ccatggccaccccg

SEQ ID NO: 1979034 - DNA, 21 bp, Homo sapiens
ccatggccaccccgtgccacc

SEQ ID NO: 1979035 - DNA, 12 bp, Homo sapiens
ccatggccttcc

SEQ ID NO: 1979036 - DNA, 19 bp, Homo sapiens
ccatggcgtgtccctctcg

SEQ ID NO: 1979037 - DNA, 14 bp, Homo sapiens
ccatggctcaggca

SEQ ID NO: 1979038 - DNA, 21 bp, Homo sapiens
ccatgggaaatgtcaacaagt

SEQ ID NO: 1979039 - DNA, 22 bp, Homo sapiens
ccatgggagctggttagaaatg

SEQ ID NO: 1979040 - DNA, 11 bp, Homo sapiens
ccatgggcctg

SEQ ID NO: 1979041 - DNA, 15 bp, Homo sapiens
ccatgggcctgctgc

SEQ ID NO: 1979042 - DNA, 13 bp, Homo sapiens
ccatgggcctggg

SEQ ID NO: 1979043 - DNA, 22 bp, Homo sapiens
ccatgggcttggacttcctggg

SEQ ID NO: 1979044 - DNA, 17 bp, Homo sapiens
ccatggggaagtgctcc

SEQ ID NO: 1979045 - DNA, 20 bp, Homo sapiens
ccatggggaagtgctcccca

SEQ ID NO: 1979046 - DNA, 22 bp, Homo sapiens
ccatggggaagtgctccccaca

SEQ ID NO: 1979047 - DNA, 23 bp, Homo sapiens
ccatggggaagtgctccccacac

SEQ ID NO: 1979048 - DNA, 23 bp, Homo sapiens
ccatgtaacaaccagagatgact

SEQ ID NO: 1979049 - DNA, 16 bp, Homo sapiens
ccatgtacatgaagaa

SEQ ID NO: 1979050 - DNA, 18 bp, Homo sapiens
ccatgtaccagtgtactg

SEQ ID NO: 1979051 - DNA, 23 bp, Homo sapiens
ccatgtaccagtgtactgctttc

SEQ ID NO: 1979052 - DNA, 23 bp, Homo sapiens
ccatgtagttttaacagaaccag

SEQ ID NO: 1979053 - DNA, 15 bp, Homo sapiens
ccatgtatctacctc

SEQ ID NO: 1979054 - DNA, 23 bp, Homo sapiens
ccatgtatttatctctatttaat

SEQ ID NO: 1979055 - DNA, 13 bp, Homo sapiens
ccatgtcacctca

SEQ ID NO: 1979056 - DNA, 17 bp, Homo sapiens
ccatgtcacctcagctg

SEQ ID NO: 1979057 - DNA, 23 bp, Homo sapiens
ccatgtccaagtccaacctgcct

SEQ ID NO: 1979058 - DNA, 16 bp, Homo sapiens
ccatgtcgcctctgca

SEQ ID NO: 1979059 - DNA, 17 bp, Homo sapiens
ccatgtcgcctctgcat

SEQ ID NO: 1979060 - DNA, 18 bp, Homo sapiens
ccatgtcgcctgccccca

SEQ ID NO: 1979061 - DNA, 23 bp, Homo sapiens
ccatgtcgcctgcccccagcact

SEQ ID NO: 1979062 - DNA, 21 bp, Homo sapiens
ccatgtctttctccaaagtta

SEQ ID NO: 1979063 - DNA, 21 bp, Homo sapiens
ccatgtgaaaaggcaaaaagc

SEQ ID NO: 1979064 - DNA, 16 bp, Homo sapiens
ccatgtggccccaggt

SEQ ID NO: 1979065 - DNA, 18 bp, Homo sapiens
ccatgtggccccaggtgc

SEQ ID NO: 1979066 - DNA, 20 bp, Homo sapiens
ccatgtggccccaggtgcca

SEQ ID NO: 1979067 - DNA, 13 bp, Homo sapiens
ccatgtggctgaa

SEQ ID NO: 1979068 - DNA, 18 bp, Homo sapiens
ccatgtgtcccctcactc

SEQ ID NO: 1979069 - DNA, 12 bp, Homo sapiens
ccatgtgtgctg

SEQ ID NO: 1979070 - DNA, 19 bp, Homo sapiens
ccatgttatgtgactatct

SEQ ID NO: 1979071 - DNA, 12 bp, Homo sapiens
ccatgttccctt

SEQ ID NO: 1979072 - DNA, 14 bp, Homo sapiens
ccatgttggccagg

SEQ ID NO: 1979073 - DNA, 23 bp, Homo sapiens
ccatgtttaaactttgtgccttt

SEQ ID NO: 1979074 - DNA, 18 bp, Homo sapiens
cccagctaatctgtaggg

SEQ ID NO: 1979075 - DNA, 19 bp, Homo sapiens
cccagctaatctgtagggc

SEQ ID NO: 1979076 - DNA, 20 bp, Homo sapiens
cccagctaatctgtagggct

SEQ ID NO: 1979077 - DNA, 14 bp, Homo sapiens
cccagctaattttt

SEQ ID NO: 1979078 - DNA, 14 bp, Homo sapiens
cccagctacacctg

SEQ ID NO: 1979079 - DNA, 14 bp, Homo sapiens
cccagctacattcc

SEQ ID NO: 1979080 - DNA, 24 bp, Homo sapiens
cccagctacattcctcagctgcca

SEQ ID NO: 1979081 - DNA, 23 bp, Homo sapiens
cccagctactcagaagcctgagg

SEQ ID NO: 1979082 - DNA, 18 bp, Homo sapiens
cccagctactctgtccag

SEQ ID NO: 1979083 - DNA, 20 bp, Homo sapiens
cccagctactctgtccaggc

SEQ ID NO: 1979084 - DNA, 21 bp, Homo sapiens
cccagctactctgtccaggcc

SEQ ID NO: 1979085 - DNA, 19 bp, Homo sapiens
cccagctatggccccaggg

SEQ ID NO: 1979086 - DNA, 9 bp, Homo sapiens
cccagctcc

SEQ ID NO: 1979087 - DNA, 12 bp, Homo sapiens
cccagctcccca

SEQ ID NO: 1979088 - DNA, 14 bp, Homo sapiens
cccagctccccagg

SEQ ID NO: 1979089 - DNA, 18 bp, Homo sapiens
cccagctccccaggactc

SEQ ID NO: 1979090 - DNA, 15 bp, Homo sapiens
cccagctccctagga

SEQ ID NO: 1979091 - DNA, 20 bp, Homo sapiens
cccagctccttttgtcccca

SEQ ID NO: 1979092 - DNA, 22 bp, Homo sapiens
cccagctccttttgtccccagg

SEQ ID NO: 1979093 - DNA, 23 bp, Homo sapiens
cccagctccttttgtccccaggg

SEQ ID NO: 1979094 - DNA, 12 bp, Homo sapiens
cccagctctccc

SEQ ID NO: 1979095 - DNA, 18 bp, Homo sapiens
cccagctctccctctggc

SEQ ID NO: 1979096 - DNA, 22 bp, Homo sapiens
cccagctctttgttcagttgac

SEQ ID NO: 1979097 - DNA, 23 bp, Homo sapiens
cccagctctttgttcagttgact

SEQ ID NO: 1979098 - DNA, 13 bp, Homo sapiens
cccagctgaggct

SEQ ID NO: 1979099 - DNA, 22 bp, Homo sapiens
cccagctgcacctgccagcctg

SEQ ID NO: 1979100 - DNA, 13 bp, Homo sapiens
cccagctggcctc

SEQ ID NO: 1979101 - DNA, 14 bp, Homo sapiens
cccagctggcctct

SEQ ID NO: 1979102 - DNA, 21 bp, Homo sapiens
cccagctgtagccatggctca

SEQ ID NO: 1979103 - DNA, 12 bp, Homo sapiens
cccagcttcctg

SEQ ID NO: 1979104 - DNA, 16 bp, Homo sapiens
cccagcttcctggtgt

SEQ ID NO: 1979105 - DNA, 17 bp, Homo sapiens
cccagctttatctgtca

SEQ ID NO: 1979106 - DNA, 15 bp, Homo sapiens
cccaggaactgggcc

SEQ ID NO: 1979107 - DNA, 22 bp, Homo sapiens
cccaggaatgccaaggagacat

SEQ ID NO: 1979108 - DNA, 16 bp, Homo sapiens
cccaggacaagcatgg

SEQ ID NO: 1979109 - DNA, 19 bp, Homo sapiens
cccaggacgccactcattt

SEQ ID NO: 1979110 - DNA, 23 bp, Homo sapiens
cccaggacgccactcatttcatc

SEQ ID NO: 1979111 - DNA, 16 bp, Homo sapiens
cccaggactcaccctc

SEQ ID NO: 1979112 - DNA, 18 bp, Homo sapiens
cccaggagagccagccct

SEQ ID NO: 1979113 - DNA, 18 bp, Homo sapiens
cccaggagctgagtcacc

SEQ ID NO: 1979114 - DNA, 19 bp, Homo sapiens
cccaggagctgagtcacct

SEQ ID NO: 1979115 - DNA, 20 bp, Homo sapiens
cccaggaggcggaggttgca

SEQ ID NO: 1979116 - DNA, 13 bp, Homo sapiens
cccaggaggggcc

SEQ ID NO: 1979117 - DNA, 18 bp, Homo sapiens
cccaggaggggcctctga

SEQ ID NO: 1979118 - DNA, 23 bp, Homo sapiens
cccaggaggtggaggttgcagtg

SEQ ID NO: 1979119 - DNA, 22 bp, Homo sapiens
cccaggagtggaggaggcctgg

SEQ ID NO: 1979120 - DNA, 24 bp, Homo sapiens
cccaggagttcgaggctgcagtca

SEQ ID NO: 1979121 - DNA, 20 bp, Homo sapiens
cccaggagtttgagacaagc

SEQ ID NO: 1979122 - DNA, 23 bp, Homo sapiens
cccaggagtttgagacaagccct

SEQ ID NO: 1979123 - DNA, 23 bp, Homo sapiens
cccaggagtttgaggctgcagcg

SEQ ID NO: 1979124 - DNA, 18 bp, Homo sapiens
cccaggagtttgtgtgtc

SEQ ID NO: 1979125 - DNA, 11 bp, Homo sapiens
cccaggcaggt

SEQ ID NO: 1979126 - DNA, 23 bp, Homo sapiens
cccaggcaggtcttgaactcctg

SEQ ID NO: 1979127 - DNA, 16 bp, Homo sapiens
cccaggcatcccatcc

SEQ ID NO: 1979128 - DNA, 19 bp, Homo sapiens
cccaggcatcccatccctt

SEQ ID NO: 1979129 - DNA, 14 bp, Homo sapiens
cccaggccccatga

SEQ ID NO: 1979130 - DNA, 22 bp, Homo sapiens
cccaggccccatgacctccagc

SEQ ID NO: 1979131 - DNA, 13 bp, Homo sapiens
cccaggccctcca

SEQ ID NO: 1979132 - DNA, 15 bp, Homo sapiens
cccaggccgcctgcc

SEQ ID NO: 1979133 - DNA, 17 bp, Homo sapiens
cccaggccgcctgccat

SEQ ID NO: 1979134 - DNA, 14 bp, Homo sapiens
cccaggccgttccc

SEQ ID NO: 1979135 - DNA, 17 bp, Homo sapiens
cccaggcctccagcctc

SEQ ID NO: 1979136 - DNA, 22 bp, Homo sapiens
cccaggcctccagcctctcccg

SEQ ID NO: 1979137 - DNA, 18 bp, Homo sapiens
cccaggcgccccttcccc

SEQ ID NO: 1979138 - DNA, 19 bp, Homo sapiens
cccaggctccatggggaag

SEQ ID NO: 1979139 - DNA, 20 bp, Homo sapiens
cccaggctctggagccagag

SEQ ID NO: 1979140 - DNA, 13 bp, Homo sapiens
cccaggctctggg

SEQ ID NO: 1979141 - DNA, 18 bp, Homo sapiens
cccaggctctgggaaggg

SEQ ID NO: 1979142 - DNA, 14 bp, Homo sapiens
cccaggctgaagag

SEQ ID NO: 1979143 - DNA, 16 bp, Homo sapiens
cccaggctgcactgca

SEQ ID NO: 1979144 - DNA, 18 bp, Homo sapiens
cccaggctgcactgcagt

SEQ ID NO: 1979145 - DNA, 19 bp, Homo sapiens
cccaggctggcgtgcagtg

SEQ ID NO: 1979146 - DNA, 23 bp, Homo sapiens
cccagggacaaaacactgtgtcc

SEQ ID NO: 1979147 - DNA, 20 bp, Homo sapiens
cccagggagcaatgggaggg

SEQ ID NO: 1979148 - DNA, 21 bp, Homo sapiens
cccagggagcaatgggagggg

SEQ ID NO: 1979149 - DNA, 12 bp, Homo sapiens
cccagggcaggg

SEQ ID NO: 1979150 - DNA, 20 bp, Homo sapiens
cccagggccagggccctgca

SEQ ID NO: 1979151 - DNA, 22 bp, Homo sapiens
cccagggccagggccctgcaga

SEQ ID NO: 1979152 - DNA, 16 bp, Homo sapiens
cccagggcccccacag

SEQ ID NO: 1979153 - DNA, 20 bp, Homo sapiens
cccagggcccccacaggccc

SEQ ID NO: 1979154 - DNA, 13 bp, Homo sapiens
cccagggcccctc

SEQ ID NO: 1979155 - DNA, 21 bp, Homo sapiens
cccagggcccctccctctgcc

SEQ ID NO: 1979156 - DNA, 12 bp, Homo sapiens
cccagggcctgg

SEQ ID NO: 1979157 - DNA, 23 bp, Homo sapiens
cccagggcctgggggcagtgact

SEQ ID NO: 1979158 - DNA, 14 bp, Homo sapiens
cccagggctcagcc

SEQ ID NO: 1979159 - DNA, 20 bp, Homo sapiens
cccagggctcagcctggtgg

SEQ ID NO: 1979160 - DNA, 21 bp, Homo sapiens
cccagggctccctcctggagc

SEQ ID NO: 1979161 - DNA, 22 bp, Homo sapiens
cccagggctccctcctggagca

SEQ ID NO: 1979162 - DNA, 17 bp, Homo sapiens
cccaggggaccacacct

SEQ ID NO: 1979163 - DNA, 21 bp, Homo sapiens
cccaggggagagggtctggag

SEQ ID NO: 1979164 - DNA, 18 bp, Homo sapiens
cccaggggctccacctgt

SEQ ID NO: 1979165 - DNA, 13 bp, Homo sapiens
cccaggtcctcac

SEQ ID NO: 1979166 - DNA, 20 bp, Homo sapiens
cccaggtcctctgataccca

SEQ ID NO: 1979167 - DNA, 21 bp, Homo sapiens
cccaggtgccaccaataaaaa

SEQ ID NO: 1979168 - DNA, 13 bp, Homo sapiens
cccaggtgccagt

SEQ ID NO: 1979169 - DNA, 20 bp, Homo sapiens
cccaggttggcctggtggcc

SEQ ID NO: 1979170 - DNA, 13 bp, Homo sapiens
cccagtagtcaga

SEQ ID NO: 1979171 - DNA, 23 bp, Homo sapiens
cccagtccccgtgccccgcctcc

SEQ ID NO: 1979172 - DNA, 13 bp, Homo sapiens
cccagtccctggg

SEQ ID NO: 1979173 - DNA, 14 bp, Homo sapiens
cccagtccctgggg

SEQ ID NO: 1979174 - DNA, 13 bp, Homo sapiens
cccagtccgccaa

SEQ ID NO: 1979175 - DNA, 21 bp, Homo sapiens
cccagtccgccaaacactcca

SEQ ID NO: 1979176 - DNA, 13 bp, Homo sapiens
cccagtcgagccc

SEQ ID NO: 1979177 - DNA, 18 bp, Homo sapiens
cccagtcgagccctgcag

SEQ ID NO: 1979178 - DNA, 22 bp, Homo sapiens
ccctcattccaccttcccatgc

SEQ ID NO: 1979179 - DNA, 12 bp, Homo sapiens
ccctcattcccc

SEQ ID NO: 1979180 - DNA, 13 bp, Homo sapiens
ccctcattcccct

SEQ ID NO: 1979181 - DNA, 13 bp, Homo sapiens
ccctccaccccag

SEQ ID NO: 1979182 - DNA, 21 bp, Homo sapiens
ccctccaccgcagaaggaagg

SEQ ID NO: 1979183 - DNA, 17 bp, Homo sapiens
ccctccacgcctcctgg

SEQ ID NO: 1979184 - DNA, 18 bp, Homo sapiens
ccctccacgcctcctggc

SEQ ID NO: 1979185 - DNA, 20 bp, Homo sapiens
ccctccacgcctcctggcca

SEQ ID NO: 1979186 - DNA, 16 bp, Homo sapiens
ccctccagaccctgcc

SEQ ID NO: 1979187 - DNA, 19 bp, Homo sapiens
ccctccagaccctgcctga

SEQ ID NO: 1979188 - DNA, 21 bp, Homo sapiens
ccctccagagacaggaaagaa

SEQ ID NO: 1979189 - DNA, 23 bp, Homo sapiens
ccctccagctggaattgctgctc

SEQ ID NO: 1979190 - DNA, 23 bp, Homo sapiens
ccctcccaacagagctgggctac

SEQ ID NO: 1979191 - DNA, 18 bp, Homo sapiens
ccctcccaacctcaatgc

SEQ ID NO: 1979192 - DNA, 23 bp, Homo sapiens
ccctcccaacctcaatgccctgc

SEQ ID NO: 1979193 - DNA, 16 bp, Homo sapiens
ccctcccaccatgcgc

SEQ ID NO: 1979194 - DNA, 20 bp, Homo sapiens
ccctcccacccccagccccg

SEQ ID NO: 1979195 - DNA, 21 bp, Homo sapiens
ccctccccaaacccatcagac

SEQ ID NO: 1979196 - DNA, 19 bp, Homo sapiens
ccctccccacacctcccta

SEQ ID NO: 1979197 - DNA, 21 bp, Homo sapiens
ccctccccacacctccctact

SEQ ID NO: 1979198 - DNA, 17 bp, Homo sapiens
ccctccccacagtcctc

SEQ ID NO: 1979199 - DNA, 18 bp, Homo sapiens
ccctccccacagtcctca

SEQ ID NO: 1979200 - DNA, 15 bp, Homo sapiens
ccctccccagccctt

SEQ ID NO: 1979201 - DNA, 14 bp, Homo sapiens
ccctccccagggga

SEQ ID NO: 1979202 - DNA, 16 bp, Homo sapiens
ccctccccatcccatg

SEQ ID NO: 1979203 - DNA, 18 bp, Homo sapiens
ccctccccattcacagag

SEQ ID NO: 1979204 - DNA, 21 bp, Homo sapiens
ccctccccattcacagagcct

SEQ ID NO: 1979205 - DNA, 18 bp, Homo sapiens
ccctccccattcagacac

SEQ ID NO: 1979206 - DNA, 15 bp, Homo sapiens
ccctcccccctgtaa

SEQ ID NO: 1979207 - DNA, 17 bp, Homo sapiens
ccctccccgcacccccc

SEQ ID NO: 1979208 - DNA, 16 bp, Homo sapiens
ccctcccctgccctag

SEQ ID NO: 1979209 - DNA, 21 bp, Homo sapiens
ccctccctgactccctgtggg

SEQ ID NO: 1979210 - DNA, 14 bp, Homo sapiens
ccctccctggcatg

SEQ ID NO: 1979211 - DNA, 13 bp, Homo sapiens
ccctccctgtcct

SEQ ID NO: 1979212 - DNA, 13 bp, Homo sapiens
ccctccgagccgc

SEQ ID NO: 1979213 - DNA, 13 bp, Homo sapiens
ccctcctaaccta

SEQ ID NO: 1979214 - DNA, 14 bp, Homo sapiens
ccctcctcaccccg

SEQ ID NO: 1979215 - DNA, 22 bp, Homo sapiens
ccctcctccccttcctgcaccc

SEQ ID NO: 1979216 - DNA, 19 bp, Homo sapiens
ccctcctctggcccagcct

SEQ ID NO: 1979217 - DNA, 17 bp, Homo sapiens
ccctcctggagcatccc

SEQ ID NO: 1979218 - DNA, 11 bp, Homo sapiens
ccctccttccc

SEQ ID NO: 1979219 - DNA, 19 bp, Homo sapiens
ccctccttgctctgcaggc

SEQ ID NO: 1979220 - DNA, 14 bp, Homo sapiens
ccctcgcagcaggt

SEQ ID NO: 1979221 - DNA, 15 bp, Homo sapiens
ccctcgcagcaggtg

SEQ ID NO: 1979222 - DNA, 13 bp, Homo sapiens
ccctcgctgctgc

SEQ ID NO: 1979223 - DNA, 14 bp, Homo sapiens
ccctcgctgctgct

SEQ ID NO: 1979224 - DNA, 21 bp, Homo sapiens
ccctcgctgctgctactaccc

SEQ ID NO: 1979225 - DNA, 17 bp, Homo sapiens
ccctcgctgtcctgctg

SEQ ID NO: 1979226 - DNA, 23 bp, Homo sapiens
ccctcggaagccgtctgactcca

SEQ ID NO: 1979227 - DNA, 13 bp, Homo sapiens
ccctcggagaaga

SEQ ID NO: 1979228 - DNA, 15 bp, Homo sapiens
ccctcgtccacaggg

SEQ ID NO: 1979229 - DNA, 19 bp, Homo sapiens
ccctcgtccacaggggcag

SEQ ID NO: 1979230 - DNA, 23 bp, Homo sapiens
ccctcgtccacaggggcaggcct

SEQ ID NO: 1979231 - DNA, 14 bp, Homo sapiens
ccctcgtcctgtcc

SEQ ID NO: 1979232 - DNA, 18 bp, Homo sapiens
ccctcgtggacacctgcc

SEQ ID NO: 1979233 - DNA, 19 bp, Homo sapiens
ccctcgtggacacctgccc

SEQ ID NO: 1979234 - DNA, 22 bp, Homo sapiens
ccctcgtggacacctgccctgc

SEQ ID NO: 1979235 - DNA, 23 bp, Homo sapiens
ccctcgtggacacctgccctgcc

SEQ ID NO: 1979236 - DNA, 16 bp, Homo sapiens
ccctctcacccgggac

SEQ ID NO: 1979237 - DNA, 17 bp, Homo sapiens
ccctctcccccgcccaa

SEQ ID NO: 1979238 - DNA, 13 bp, Homo sapiens
ccctctcctgcct

SEQ ID NO: 1979239 - DNA, 17 bp, Homo sapiens
ccctctcctgcctactc

SEQ ID NO: 1979240 - DNA, 12 bp, Homo sapiens
ccctctcttgcc

SEQ ID NO: 1979241 - DNA, 21 bp, Homo sapiens
ccctctgccccaagcagccag

SEQ ID NO: 1979242 - DNA, 22 bp, Homo sapiens
ccctctgccccaagcagccagc

SEQ ID NO: 1979243 - DNA, 20 bp, Homo sapiens
ccctctgggcagctgtcatg

SEQ ID NO: 1979244 - DNA, 23 bp, Homo sapiens
ccctctgtcatcactccctggat

SEQ ID NO: 1979245 - DNA, 18 bp, Homo sapiens
ccctctgttgccaggcta

SEQ ID NO: 1979246 - DNA, 12 bp, Homo sapiens
ccctcttccttc

SEQ ID NO: 1979247 - DNA, 22 bp, Homo sapiens
ccctcttgacccatctccccct

SEQ ID NO: 1979248 - DNA, 23 bp, Homo sapiens
ccctcttgaggtggtgccttctc

SEQ ID NO: 1979249 - DNA, 14 bp, Homo sapiens
ccctgaaaacccag

SEQ ID NO: 1979250 - DNA, 16 bp, Homo sapiens
ccctgaaaacccagag

SEQ ID NO: 1979251 - DNA, 18 bp, Homo sapiens
ccctgaaaacccagagag

SEQ ID NO: 1979252 - DNA, 15 bp, Homo sapiens
ccctgaacatctgtg

SEQ ID NO: 1979253 - DNA, 16 bp, Homo sapiens
ccctgaacatctgtgt

SEQ ID NO: 1979254 - DNA, 13 bp, Homo sapiens
ccctgaaccatcc

SEQ ID NO: 1979255 - DNA, 18 bp, Homo sapiens
ccctgaacctcagtttcc

SEQ ID NO: 1979256 - DNA, 19 bp, Homo sapiens
ccctgaacctcagtttcct

SEQ ID NO: 1979257 - DNA, 21 bp, Homo sapiens
ccctgaacctcagtttcctca

SEQ ID NO: 1979258 - DNA, 19 bp, Homo sapiens
ccctgaaggttcctgagga

SEQ ID NO: 1979259 - DNA, 14 bp, Homo sapiens
ccctgacctcccag

SEQ ID NO: 1979260 - DNA, 15 bp, Homo sapiens
ccctgacctcccagc

SEQ ID NO: 1979261 - DNA, 20 bp, Homo sapiens
ccctgacctcccagccctat

SEQ ID NO: 1979262 - DNA, 18 bp, Homo sapiens
ccctgactctctgtgacc

SEQ ID NO: 1979263 - DNA, 14 bp, Homo sapiens
ccctgactggtgct

SEQ ID NO: 1979264 - DNA, 15 bp, Homo sapiens
ccctgagaaacccac

SEQ ID NO: 1979265 - DNA, 19 bp, Homo sapiens
ccctgagaaacccaccagc

SEQ ID NO: 1979266 - DNA, 20 bp, Homo sapiens
ccctgagaaacccaccagcc

SEQ ID NO: 1979267 - DNA, 18 bp, Homo sapiens
ccctgagatcagagtcct

SEQ ID NO: 1979268 - DNA, 12 bp, Homo sapiens
ccctgagcctga

SEQ ID NO: 1979269 - DNA, 15 bp, Homo sapiens
ccctgagcctgacct

SEQ ID NO: 1979270 - DNA, 19 bp, Homo sapiens
ccctgagcctgacctttct

SEQ ID NO: 1979271 - DNA, 11 bp, Homo sapiens
ccctgagctca

SEQ ID NO: 1979272 - DNA, 22 bp, Homo sapiens
ccctgagctcaggctgagccca

SEQ ID NO: 1979273 - DNA, 12 bp, Homo sapiens
ccctgaggactg

SEQ ID NO: 1979274 - DNA, 13 bp, Homo sapiens
ccctgaggactgg

SEQ ID NO: 1979275 - DNA, 16 bp, Homo sapiens
ccctgaggactggaga

SEQ ID NO: 1979276 - DNA, 18 bp, Homo sapiens
ccctgaggactggagacc

SEQ ID NO: 1979277 - DNA, 13 bp, Homo sapiens
ccctgaggagtct

SEQ ID NO: 1979278 - DNA, 14 bp, Homo sapiens
ccctgaggagtctg

SEQ ID NO: 1979279 - DNA, 15 bp, Homo sapiens
ccctgaggagtctga

SEQ ID NO: 1979280 - DNA, 16 bp, Homo sapiens
ccctgaggagtctgag

SEQ ID NO: 1979281 - DNA, 18 bp, Homo sapiens
ccctgaggagtctgaggt

SEQ ID NO: 1979282 - DNA, 19 bp, Homo sapiens
ccctgaggagtctgaggtc

SEQ ID NO: 1979283 - DNA, 23 bp, Homo sapiens
ccctgaggtcacctggaatcaga

SEQ ID NO: 1979284 - DNA, 17 bp, Homo sapiens
ccctgagtcaccaggaa

SEQ ID NO: 1979285 - DNA, 19 bp, Homo sapiens
ccctgagtggatctccaag

SEQ ID NO: 1979286 - DNA, 23 bp, Homo sapiens
ccctgagtggatctccaaggacc

SEQ ID NO: 1979287 - DNA, 19 bp, Homo sapiens
ccctgataacaacctggag

SEQ ID NO: 1979288 - DNA, 19 bp, Homo sapiens
ccctgcacagatatttcca

SEQ ID NO: 1979289 - DNA, 12 bp, Homo sapiens
ccctgcaccctg

SEQ ID NO: 1979290 - DNA, 22 bp, Homo sapiens
  misc_feature (13)..(13): n is a, c, g or t
ccctgcacctgcnttgtccctg

SEQ ID NO: 1979291 - DNA, 19 bp, Homo sapiens
ccctgcacttgcagactct

SEQ ID NO: 1979292 - DNA, 13 bp, Homo sapiens
ccctgcagaccct

SEQ ID NO: 1979293 - DNA, 23 bp, Homo sapiens
ccctgtgggggtggccatccctg

SEQ ID NO: 1979294 - DNA, 14 bp, Homo sapiens
ccctgttcactcta

SEQ ID NO: 1979295 - DNA, 13 bp, Homo sapiens
ccctgttctcagc

SEQ ID NO: 1979296 - DNA, 16 bp, Homo sapiens
ccctgttctcagctcc

SEQ ID NO: 1979297 - DNA, 18 bp, Homo sapiens
ccctgtttaatatttaaa

SEQ ID NO: 1979298 - DNA, 19 bp, Homo sapiens
ccctgtttaatatttaaac

SEQ ID NO: 1979299 - DNA, 14 bp, Homo sapiens
ccctgttttatact

SEQ ID NO: 1979300 - DNA, 15 bp, Homo sapiens
ccctgttttccacac

SEQ ID NO: 1979301 - DNA, 17 bp, Homo sapiens
ccctgttttccacacca

SEQ ID NO: 1979302 - DNA, 19 bp, Homo sapiens
ccctgttttccacaccatc

SEQ ID NO: 1979303 - DNA, 23 bp, Homo sapiens
cccttagagattgccccagagcc

SEQ ID NO: 1979304 - DNA, 14 bp, Homo sapiens
cccttagcagggaa

SEQ ID NO: 1979305 - DNA, 23 bp, Homo sapiens
cccttagcagggaaacagctaat

SEQ ID NO: 1979306 - DNA, 12 bp, Homo sapiens
cccttagctctc

SEQ ID NO: 1979307 - DNA, 16 bp, Homo sapiens
cccttaggcattattt

SEQ ID NO: 1979308 - DNA, 22 bp, Homo sapiens
cccttatcttttataatgtctt

SEQ ID NO: 1979309 - DNA, 12 bp, Homo sapiens
cccttattttca

SEQ ID NO: 1979310 - DNA, 12 bp, Homo sapiens
cccttccagaca

SEQ ID NO: 1979311 - DNA, 13 bp, Homo sapiens
cccttccagacat

SEQ ID NO: 1979312 - DNA, 20 bp, Homo sapiens
cccttcccaatcagcactga

SEQ ID NO: 1979313 - DNA, 18 bp, Homo sapiens
cccttcccatctcttcct

SEQ ID NO: 1979314 - DNA, 19 bp, Homo sapiens
cccttccccttctgtgtca

SEQ ID NO: 1979315 - DNA, 12 bp, Homo sapiens
cccttccctgct

SEQ ID NO: 1979316 - DNA, 14 bp, Homo sapiens
cccttcctccccag

SEQ ID NO: 1979317 - DNA, 21 bp, Homo sapiens
cccttcctccctattaaccta

SEQ ID NO: 1979318 - DNA, 16 bp, Homo sapiens
cccttcctctccactg

SEQ ID NO: 1979319 - DNA, 17 bp, Homo sapiens
cccttcctgaccctccg

SEQ ID NO: 1979320 - DNA, 11 bp, Homo sapiens
cccttcctgga

SEQ ID NO: 1979321 - DNA, 13 bp, Homo sapiens
cccttcctggaca

SEQ ID NO: 1979322 - DNA, 19 bp, Homo sapiens
cccttcctggacagctgtg

SEQ ID NO: 1979323 - DNA, 18 bp, Homo sapiens
cccttcctggcctcactg

SEQ ID NO: 1979324 - DNA, 21 bp, Homo sapiens
cccttcctggcctcactggct

SEQ ID NO: 1979325 - DNA, 22 bp, Homo sapiens
cccttcctggcctcactggctg

SEQ ID NO: 1979326 - DNA, 24 bp, Homo sapiens
cccttcctggcctcactggctggg

SEQ ID NO: 1979327 - DNA, 19 bp, Homo sapiens
cccttcctttcctctgcag

SEQ ID NO: 1979328 - DNA, 14 bp, Homo sapiens
cccttcgctcctgt

SEQ ID NO: 1979329 - DNA, 18 bp, Homo sapiens
cccttcgctcctgtgtct

SEQ ID NO: 1979330 - DNA, 13 bp, Homo sapiens
cccttcgctgcca

SEQ ID NO: 1979331 - DNA, 15 bp, Homo sapiens
cccttcgctgccagg

SEQ ID NO: 1979332 - DNA, 20 bp, Homo sapiens
cccttcgctgccaggacacc

SEQ ID NO: 1979333 - DNA, 22 bp, Homo sapiens
cccttcgctgccaggacacctg

SEQ ID NO: 1979334 - DNA, 13 bp, Homo sapiens
cccttctctcctt

SEQ ID NO: 1979335 - DNA, 17 bp, Homo sapiens
cccttctgtgtcacagt

SEQ ID NO: 1979336 - DNA, 15 bp, Homo sapiens
cccttctttaaatca

SEQ ID NO: 1979337 - DNA, 18 bp, Homo sapiens
cccttctttaaatcaaaa

SEQ ID NO: 1979338 - DNA, 19 bp, Homo sapiens
cccttctttttcttctttt

SEQ ID NO: 1979339 - DNA, 21 bp, Homo sapiens
cccttgaagaggggaggggcc

SEQ ID NO: 1979340 - DNA, 15 bp, Homo sapiens
cccttgaccattggc

SEQ ID NO: 1979341 - DNA, 14 bp, Homo sapiens
cccttgagacctca

SEQ ID NO: 1979342 - DNA, 23 bp, Homo sapiens
cccttgcacagcccacacatgaa

SEQ ID NO: 1979343 - DNA, 22 bp, Homo sapiens
cccttgcactaaagtatgtaaa

SEQ ID NO: 1979344 - DNA, 19 bp, Homo sapiens
cccttgcccagggctcagc

SEQ ID NO: 1979345 - DNA, 18 bp, Homo sapiens
cccttgcccccatccctc

SEQ ID NO: 1979346 - DNA, 16 bp, Homo sapiens
cccttgccctgacctc

SEQ ID NO: 1979347 - DNA, 20 bp, Homo sapiens
cccttgccctgacctcccag

SEQ ID NO: 1979348 - DNA, 17 bp, Homo sapiens
cccttgcccttgccctg

SEQ ID NO: 1979349 - DNA, 22 bp, Homo sapiens
cccttgctcagtgcctcctggc

SEQ ID NO: 1979350 - DNA, 13 bp, Homo sapiens
cccttgctgctgc

SEQ ID NO: 1979351 - DNA, 16 bp, Homo sapiens
cccttggacttgagga

SEQ ID NO: 1979352 - DNA, 22 bp, Homo sapiens
cccttggcgggcagcccagcct

SEQ ID NO: 1979353 - DNA, 23 bp, Homo sapiens
cccttggcgggcagcccagcctc

SEQ ID NO: 1979354 - DNA, 22 bp, Homo sapiens
cccttggctgtgaggcccctgg

SEQ ID NO: 1979355 - DNA, 23 bp, Homo sapiens
cccttggctgtgaggcccctgga

SEQ ID NO: 1979356 - DNA, 15 bp, Homo sapiens
cccttgggcatccac

SEQ ID NO: 1979357 - DNA, 15 bp, Homo sapiens
cccttggggcctggc

SEQ ID NO: 1979358 - DNA, 18 bp, Homo sapiens
cccttggggcctggcttg

SEQ ID NO: 1979359 - DNA, 20 bp, Homo sapiens
cccttggggtaagccagagc

SEQ ID NO: 1979360 - DNA, 23 bp, Homo sapiens
cccttgtacctatggctgcctgc

SEQ ID NO: 1979361 - DNA, 16 bp, Homo sapiens
cccttgtcctctcccg

SEQ ID NO: 1979362 - DNA, 21 bp, Homo sapiens
cccttgtcctgccagctgcct

SEQ ID NO: 1979363 - DNA, 21 bp, Homo sapiens
ccctttcccccaccccagagt

SEQ ID NO: 1979364 - DNA, 13 bp, Homo sapiens
ccctttcctgcgg

SEQ ID NO: 1979365 - DNA, 14 bp, Homo sapiens
ccctttctggctct

SEQ ID NO: 1979366 - DNA, 16 bp, Homo sapiens
ccctttgggaggctga

SEQ ID NO: 1979367 - DNA, 23 bp, Homo sapiens
cccttttacagctcttggcattt

SEQ ID NO: 1979368 - DNA, 23 bp, Homo sapiens
cccttttcaagttgagaacaaaa

SEQ ID NO: 1979369 - DNA, 14 bp, Homo sapiens
cccttttcctccag

SEQ ID NO: 1979370 - DNA, 22 bp, Homo sapiens
cccttttctttttcccttgaac

SEQ ID NO: 1979371 - DNA, 15 bp, Homo sapiens
cccttttgcctggct

SEQ ID NO: 1979372 - DNA, 23 bp, Homo sapiens
ccgaagaccttctgaagatctca

SEQ ID NO: 1979373 - DNA, 16 bp, Homo sapiens
ccgaagcccaggctga

SEQ ID NO: 1979374 - DNA, 19 bp, Homo sapiens
ccgaatttagtcacaccat

SEQ ID NO: 1979375 - DNA, 14 bp, Homo sapiens
ccgacactgctgca

SEQ ID NO: 1979376 - DNA, 17 bp, Homo sapiens
ccgacagagagatgaag

SEQ ID NO: 1979377 - DNA, 12 bp, Homo sapiens
ccgacagcctgg

SEQ ID NO: 1979378 - DNA, 15 bp, Homo sapiens
ccgacagcctggcac

SEQ ID NO: 1979379 - DNA, 17 bp, Homo sapiens
ccgaccagacaccttga

SEQ ID NO: 1979380 - DNA, 12 bp, Homo sapiens
ccgacctcagcc

SEQ ID NO: 1979381 - DNA, 13 bp, Homo sapiens
ccgacctcgtcct

SEQ ID NO: 1979382 - DNA, 19 bp, Homo sapiens
ccgacctcgtcctccccct

SEQ ID NO: 1979383 - DNA, 12 bp, Homo sapiens
ccgactcaggga

SEQ ID NO: 1979384 - DNA, 13 bp, Homo sapiens
ccgactcaggtcc

SEQ ID NO: 1979385 - DNA, 12 bp, Homo sapiens
ccgactccagcc

SEQ ID NO: 1979386 - DNA, 11 bp, Homo sapiens
ccgagaaaagg

SEQ ID NO: 1979387 - DNA, 12 bp, Homo sapiens
ccgagaacaaca

SEQ ID NO: 1979388 - DNA, 16 bp, Homo sapiens
ccgagagtagccgaga

SEQ ID NO: 1979389 - DNA, 20 bp, Homo sapiens
ccgagagtagccgagagcct

SEQ ID NO: 1979390 - DNA, 21 bp, Homo sapiens
ccgagagtagccgagagcctg

SEQ ID NO: 1979391 - DNA, 18 bp, Homo sapiens
ccgagcaaagtctaaagt

SEQ ID NO: 1979392 - DNA, 12 bp, Homo sapiens
ccgagcagctga

SEQ ID NO: 1979393 - DNA, 16 bp, Homo sapiens
ccgagcagctgagcag

SEQ ID NO: 1979394 - DNA, 20 bp, Homo sapiens
ccgagcagctgagcagggcc

SEQ ID NO: 1979395 - DNA, 19 bp, Homo sapiens
ccgagcgctttctggaaaa

SEQ ID NO: 1979396 - DNA, 16 bp, Homo sapiens
ccgagctactctcttg

SEQ ID NO: 1979397 - DNA, 22 bp, Homo sapiens
ccgagctactctcttgccagca

SEQ ID NO: 1979398 - DNA, 14 bp, Homo sapiens
ccgaggcagggtca

SEQ ID NO: 1979399 - DNA, 15 bp, Homo sapiens
ccgagggcctgacag

SEQ ID NO: 1979400 - DNA, 16 bp, Homo sapiens
ccgagggcctgacagg

SEQ ID NO: 1979401 - DNA, 16 bp, Homo sapiens
ccgagtagctgggact

SEQ ID NO: 1979402 - DNA, 13 bp, Homo sapiens
cctctgccacctc

SEQ ID NO: 1979403 - DNA, 14 bp, Homo sapiens
cctctgccatgccc

SEQ ID NO: 1979404 - DNA, 18 bp, Homo sapiens
cctctgccatgcccagag

SEQ ID NO: 1979405 - DNA, 15 bp, Homo sapiens
cctctgccccaagca

SEQ ID NO: 1979406 - DNA, 18 bp, Homo sapiens
cctctgccccaagcagcc

SEQ ID NO: 1979407 - DNA, 19 bp, Homo sapiens
cctctgccccaagcagcca

SEQ ID NO: 1979408 - DNA, 20 bp, Homo sapiens
cctctgccccaagcagccag

SEQ ID NO: 1979409 - DNA, 22 bp, Homo sapiens
cctctgccccaagcagccagcc

SEQ ID NO: 1979410 - DNA, 23 bp, Homo sapiens
cctctgccccaagcagccagcca

SEQ ID NO: 1979411 - DNA, 16 bp, Homo sapiens
cctctgccccaagggg

SEQ ID NO: 1979412 - DNA, 22 bp, Homo sapiens
cctctgccccaaggggcccaca

SEQ ID NO: 1979413 - DNA, 15 bp, Homo sapiens
cctctgcccgcagag

SEQ ID NO: 1979414 - DNA, 16 bp, Homo sapiens
cctctgcccgcagagc

SEQ ID NO: 1979415 - DNA, 13 bp, Homo sapiens
cctctgccctgta

SEQ ID NO: 1979416 - DNA, 12 bp, Homo sapiens
cctctgcctcaa

SEQ ID NO: 1979417 - DNA, 13 bp, Homo sapiens
cctctgcctcaat

SEQ ID NO: 1979418 - DNA, 20 bp, Homo sapiens
cctctgcctctgacacacag

SEQ ID NO: 1979419 - DNA, 20 bp, Homo sapiens
cctctgcctgtgcacggcca

SEQ ID NO: 1979420 - DNA, 16 bp, Homo sapiens
cctctgcgtcccccag

SEQ ID NO: 1979421 - DNA, 19 bp, Homo sapiens
cctctgcgtcccccagccc

SEQ ID NO: 1979422 - DNA, 21 bp, Homo sapiens
cctctgctctgaggcttccag

SEQ ID NO: 1979423 - DNA, 13 bp, Homo sapiens
cctctggatccct

SEQ ID NO: 1979424 - DNA, 19 bp, Homo sapiens
cctctggatcctgctgtgg

SEQ ID NO: 1979425 - DNA, 20 bp, Homo sapiens
cctctggatcctgctgtggc

SEQ ID NO: 1979426 - DNA, 16 bp, Homo sapiens
cctctggatggcacca

SEQ ID NO: 1979427 - DNA, 16 bp, Homo sapiens
cctctggggttcatct

SEQ ID NO: 1979428 - DNA, 19 bp, Homo sapiens
cctctggggttcatctagg

SEQ ID NO: 1979429 - DNA, 17 bp, Homo sapiens
cctctgtccaggcactg

SEQ ID NO: 1979430 - DNA, 14 bp, Homo sapiens
cctctgtccagggc

SEQ ID NO: 1979431 - DNA, 18 bp, Homo sapiens
cctctgtccagggccctg

SEQ ID NO: 1979432 - DNA, 20 bp, Homo sapiens
cctctgtccagggccctgag

SEQ ID NO: 1979433 - DNA, 16 bp, Homo sapiens
cctctgtccctctttg

SEQ ID NO: 1979434 - DNA, 18 bp, Homo sapiens
cctctgtctcgagcgccc

SEQ ID NO: 1979435 - DNA, 22 bp, Homo sapiens
cctctgtctctgctcttgcctg

SEQ ID NO: 1979436 - DNA, 19 bp, Homo sapiens
cctctgtgtcctctcccct

SEQ ID NO: 1979437 - DNA, 13 bp, Homo sapiens
cctctgtgtcctt

SEQ ID NO: 1979438 - DNA, 20 bp, Homo sapiens
cctctgtgtccttccctgca

SEQ ID NO: 1979439 - DNA, 19 bp, Homo sapiens
cctctgtgtgctcctcctt

SEQ ID NO: 1979440 - DNA, 18 bp, Homo sapiens
cctcttaaaaaataaaaa

SEQ ID NO: 1979441 - DNA, 23 bp, Homo sapiens
cctcttaaagctgcctgtagtta

SEQ ID NO: 1979442 - DNA, 18 bp, Homo sapiens
cctcttaccgtagcctcc

SEQ ID NO: 1979443 - DNA, 19 bp, Homo sapiens
cctcttaccgtagcctccg

SEQ ID NO: 1979444 - DNA, 19 bp, Homo sapiens
cctcttagtgattgtgtct

SEQ ID NO: 1979445 - DNA, 15 bp, Homo sapiens
cctcttccccttgcc

SEQ ID NO: 1979446 - DNA, 16 bp, Homo sapiens
cctcttcctccctcat

SEQ ID NO: 1979447 - DNA, 14 bp, Homo sapiens
cctcttctaactca

SEQ ID NO: 1979448 - DNA, 16 bp, Homo sapiens
cctcttctcttcctgt

SEQ ID NO: 1979449 - DNA, 14 bp, Homo sapiens
cctcttctgccagc

SEQ ID NO: 1979450 - DNA, 15 bp, Homo sapiens
cctcttgcaggctga

SEQ ID NO: 1979451 - DNA, 14 bp, Homo sapiens
cctcttgccactgc

SEQ ID NO: 1979452 - DNA, 22 bp, Homo sapiens
cctcttgccactgcctcttcct

SEQ ID NO: 1979453 - DNA, 17 bp, Homo sapiens
cctcttgcctctctcag

SEQ ID NO: 1979454 - DNA, 18 bp, Homo sapiens
cctcttgcctctctcagg

SEQ ID NO: 1979455 - DNA, 13 bp, Homo sapiens
cctcttgtgctca

SEQ ID NO: 1979456 - DNA, 15 bp, Homo sapiens
cctcttgttgcagag

SEQ ID NO: 1979457 - DNA, 22 bp, Homo sapiens
cctctttactcccttcctggcc

SEQ ID NO: 1979458 - DNA, 21 bp, Homo sapiens
cctctttccccacctcttcct

SEQ ID NO: 1979459 - DNA, 18 bp, Homo sapiens
cctcttttccctctctag

SEQ ID NO: 1979460 - DNA, 15 bp, Homo sapiens
cctcttttggccttg

SEQ ID NO: 1979461 - DNA, 12 bp, Homo sapiens
cctgaaaaactg

SEQ ID NO: 1979462 - DNA, 17 bp, Homo sapiens
cctgaaaacccagagag

SEQ ID NO: 1979463 - DNA, 19 bp, Homo sapiens
cctgaaaacgaaggggccc

SEQ ID NO: 1979464 - DNA, 22 bp, Homo sapiens
cctgaaaaggtttatgaaaaag

SEQ ID NO: 1979465 - DNA, 13 bp, Homo sapiens
cctgaaaattgta

SEQ ID NO: 1979466 - DNA, 16 bp, Homo sapiens
cctgaacaagaattgg

SEQ ID NO: 1979467 - DNA, 21 bp, Homo sapiens
cctgaacaagaattggaagct

SEQ ID NO: 1979468 - DNA, 14 bp, Homo sapiens
cctgaaccacagcg

SEQ ID NO: 1979469 - DNA, 16 bp, Homo sapiens
cctgaaccccatgggc

SEQ ID NO: 1979470 - DNA, 18 bp, Homo sapiens
cctgaaccccatgggctt

SEQ ID NO: 1979471 - DNA, 15 bp, Homo sapiens
cctgaacctcagttt

SEQ ID NO: 1979472 - DNA, 16 bp, Homo sapiens
cctgaacctcagtttc

SEQ ID NO: 1979473 - DNA, 17 bp, Homo sapiens
cctgaacctcagtttcc

SEQ ID NO: 1979474 - DNA, 18 bp, Homo sapiens
cctgaagacttacttatt

SEQ ID NO: 1979475 - DNA, 18 bp, Homo sapiens
cctgaagatttcagaggc

SEQ ID NO: 1979476 - DNA, 13 bp, Homo sapiens
cctgaagcctctg

SEQ ID NO: 1979477 - DNA, 17 bp, Homo sapiens
cctgaagcctctgccct

SEQ ID NO: 1979478 - DNA, 23 bp, Homo sapiens
cctgaagcctctgccctgcctcc

SEQ ID NO: 1979479 - DNA, 15 bp, Homo sapiens
cctgaagtcacacag

SEQ ID NO: 1979480 - DNA, 22 bp, Homo sapiens
cctgaatggttccatgcctgag

SEQ ID NO: 1979481 - DNA, 23 bp, Homo sapiens
cctgaatggttccatgcctgagg

SEQ ID NO: 1979482 - DNA, 15 bp, Homo sapiens
cctgaattattccaa

SEQ ID NO: 1979483 - DNA, 21 bp, Homo sapiens
cctgaattttgttgctgtttt

SEQ ID NO: 1979484 - DNA, 20 bp, Homo sapiens
cctgacaagcactgctaggc

SEQ ID NO: 1979485 - DNA, 16 bp, Homo sapiens
cctgacaatggcagct

SEQ ID NO: 1979486 - DNA, 18 bp, Homo sapiens
cctgacaatggcagctag

SEQ ID NO: 1979487 - DNA, 23 bp, Homo sapiens
cctgacattaagacacacctctg

SEQ ID NO: 1979488 - DNA, 20 bp, Homo sapiens
cctgaccaacagttccttca

SEQ ID NO: 1979489 - DNA, 20 bp, Homo sapiens
cctgaccacgctttctagct

SEQ ID NO: 1979490 - DNA, 18 bp, Homo sapiens
cctgaccctccctacctg

SEQ ID NO: 1979491 - DNA, 21 bp, Homo sapiens
cctgaccctcctccactccac

SEQ ID NO: 1979492 - DNA, 14 bp, Homo sapiens
cctgaccggcacct

SEQ ID NO: 1979493 - DNA, 18 bp, Homo sapiens
cctgaccggcacctgcga

SEQ ID NO: 1979494 - DNA, 15 bp, Homo sapiens
cctgacctcccagcc

SEQ ID NO: 1979495 - DNA, 15 bp, Homo sapiens
cctgacctgaggctc

SEQ ID NO: 1979496 - DNA, 14 bp, Homo sapiens
cctgacgccctgcg

SEQ ID NO: 1979497 - DNA, 19 bp, Homo sapiens
cctgacggacgtcctgctg

SEQ ID NO: 1979498 - DNA, 19 bp, Homo sapiens
cctgactccagtgagctgg

SEQ ID NO: 1979499 - DNA, 15 bp, Homo sapiens
cctgactcctctaag

SEQ ID NO: 1979500 - DNA, 13 bp, Homo sapiens
cctgactctctgt

SEQ ID NO: 1979501 - DNA, 18 bp, Homo sapiens
cctgactctctgtgacct

SEQ ID NO: 1979502 - DNA, 19 bp, Homo sapiens
cctgactgacacaggccag

SEQ ID NO: 1979503 - DNA, 23 bp, Homo sapiens
cctgactggtgctataggctgga

SEQ ID NO: 1979504 - DNA, 23 bp, Homo sapiens
cctgacttggggagatggagttc

SEQ ID NO: 1979505 - DNA, 19 bp, Homo sapiens
cctgagaaggcgaggagag

SEQ ID NO: 1979506 - DNA, 20 bp, Homo sapiens
cctgagacctcgccggcctt

SEQ ID NO: 1979507 - DNA, 16 bp, Homo sapiens
cctgagagctcacagt

SEQ ID NO: 1979508 - DNA, 15 bp, Homo sapiens
cctgagatcagagtc

SEQ ID NO: 1979509 - DNA, 19 bp, Homo sapiens
cctgagcactgccaggagg

SEQ ID NO: 1979510 - DNA, 12 bp, Homo sapiens
cctgagcattca

SEQ ID NO: 1979511 - DNA, 17 bp, Homo sapiens
cctgagcattcaggcag

SEQ ID NO: 1979512 - DNA, 15 bp, Homo sapiens
cctgagcccagggag

SEQ ID NO: 1979513 - DNA, 14 bp, Homo sapiens
cctgagcctgacct

SEQ ID NO: 1979514 - DNA, 21 bp, Homo sapiens
cctgagcctgccgagcaaccg

SEQ ID NO: 1979515 - DNA, 11 bp, Homo sapiens
cctgagctaga

SEQ ID NO: 1979516 - DNA, 16 bp, Homo sapiens
cctgagctcaggctga

SEQ ID NO: 1979517 - DNA, 23 bp, Homo sapiens
cctgagctcaggctgagcccagc

SEQ ID NO: 1979518 - DNA, 15 bp, Homo sapiens
cctgcccctcgcctt

SEQ ID NO: 1979519 - DNA, 19 bp, Homo sapiens
cctgcccctcttcccggga

SEQ ID NO: 1979520 - DNA, 17 bp, Homo sapiens
cctgcccctgccccaac

SEQ ID NO: 1979521 - DNA, 16 bp, Homo sapiens
cctgcccggctgcgga

SEQ ID NO: 1979522 - DNA, 15 bp, Homo sapiens
cctgccctgccacct

SEQ ID NO: 1979523 - DNA, 21 bp, Homo sapiens
cctgccctgccacctgtctgt

SEQ ID NO: 1979524 - DNA, 16 bp, Homo sapiens
cctgccctgccctgcc

SEQ ID NO: 1979525 - DNA, 21 bp, Homo sapiens
cctgcccttgtttggggcagg

SEQ ID NO: 1979526 - DNA, 22 bp, Homo sapiens
cctgccgagcaaccgtggccct

SEQ ID NO: 1979527 - DNA, 21 bp, Homo sapiens
cctgcctacattccctggcct

SEQ ID NO: 1979528 - DNA, 18 bp, Homo sapiens
cctgcctatccatcctgc

SEQ ID NO: 1979529 - DNA, 11 bp, Homo sapiens
cctgcctcagc

SEQ ID NO: 1979530 - DNA, 14 bp, Homo sapiens
cctgcctcagcctc

SEQ ID NO: 1979531 - DNA, 23 bp, Homo sapiens
cctgcctcgaactggctgcaaag

SEQ ID NO: 1979532 - DNA, 18 bp, Homo sapiens
cctgcctctctgctccag

SEQ ID NO: 1979533 - DNA, 20 bp, Homo sapiens
cctgcctctctgctccagag

SEQ ID NO: 1979534 - DNA, 10 bp, Homo sapiens
cctgcctctg

SEQ ID NO: 1979535 - DNA, 23 bp, Homo sapiens
cctgcctctgccatgcccagaga

SEQ ID NO: 1979536 - DNA, 13 bp, Homo sapiens
cctgcctgagccc

SEQ ID NO: 1979537 - DNA, 22 bp, Homo sapiens
cctgcctgataccctgcttggt

SEQ ID NO: 1979538 - DNA, 14 bp, Homo sapiens
cctgcctggaggac

SEQ ID NO: 1979539 - DNA, 17 bp, Homo sapiens
cctgcctggaggacctg

SEQ ID NO: 1979540 - DNA, 19 bp, Homo sapiens
cctgcctgggttttctaac

SEQ ID NO: 1979541 - DNA, 19 bp, Homo sapiens
cctgccttgaagccactga

SEQ ID NO: 1979542 - DNA, 23 bp, Homo sapiens
cctgccttgaagccactgaagct

SEQ ID NO: 1979543 - DNA, 21 bp, Homo sapiens
cctgcctttgaaattccccca

SEQ ID NO: 1979544 - DNA, 18 bp, Homo sapiens
cctgcgattttgcctgtg

SEQ ID NO: 1979545 - DNA, 20 bp, Homo sapiens
cctgcggagaccctgagtcc

SEQ ID NO: 1979546 - DNA, 18 bp, Homo sapiens
cctgcggagccggcacct

SEQ ID NO: 1979547 - DNA, 20 bp, Homo sapiens
cctgcggctgctgtgtgcct

SEQ ID NO: 1979548 - DNA, 21 bp, Homo sapiens
cctgcgggcttttccccggtc

SEQ ID NO: 1979549 - DNA, 21 bp, Homo sapiens
cctgcgtcctgacgccctgcg

SEQ ID NO: 1979550 - DNA, 22 bp, Homo sapiens
cctgcgtgccgggagaggactc

SEQ ID NO: 1979551 - DNA, 23 bp, Homo sapiens
cctgcgttggagccactcctgtc

SEQ ID NO: 1979552 - DNA, 16 bp, Homo sapiens
  misc_feature (6)..(6): n is a, c, g or t
cctgcnttgtccctgg

SEQ ID NO: 1979553 - DNA, 17 bp, Homo sapiens
cctgctaattccccaga

SEQ ID NO: 1979554 - DNA, 17 bp, Homo sapiens
cctgctaccaaggccca

SEQ ID NO: 1979555 - DNA, 20 bp, Homo sapiens
cctgctactcctgtgctctg

SEQ ID NO: 1979556 - DNA, 23 bp, Homo sapiens
cctgctagagcaacccctgtacc

SEQ ID NO: 1979557 - DNA, 17 bp, Homo sapiens
cctgctagctgtagaaa

SEQ ID NO: 1979558 - DNA, 14 bp, Homo sapiens
cctgctcccccacc

SEQ ID NO: 1979559 - DNA, 18 bp, Homo sapiens
cctgctcccccaccccct

SEQ ID NO: 1979560 - DNA, 16 bp, Homo sapiens
cctgctctcttcagga

SEQ ID NO: 1979561 - DNA, 22 bp, Homo sapiens
cctgctgaaacacctcccaggg

SEQ ID NO: 1979562 - DNA, 13 bp, Homo sapiens
cctgctgagctct

SEQ ID NO: 1979563 - DNA, 16 bp, Homo sapiens
cctgctgagctctgag

SEQ ID NO: 1979564 - DNA, 22 bp, Homo sapiens
cctgctgagctctgagaggccc

SEQ ID NO: 1979565 - DNA, 24 bp, Homo sapiens
cctgctgagctctgagaggccctg

SEQ ID NO: 1979566 - DNA, 15 bp, Homo sapiens
cctgctgcagcatga

SEQ ID NO: 1979567 - DNA, 22 bp, Homo sapiens
cctgctgccgcctcccagcctg

SEQ ID NO: 1979568 - DNA, 23 bp, Homo sapiens
cctgctgccgcctcccagcctgg

SEQ ID NO: 1979569 - DNA, 18 bp, Homo sapiens
cctgctgcggccagcctg

SEQ ID NO: 1979570 - DNA, 18 bp, Homo sapiens
cctgctgcgtcagaccag

SEQ ID NO: 1979571 - DNA, 22 bp, Homo sapiens
cctgctgcgtcagaccagtact

SEQ ID NO: 1979572 - DNA, 18 bp, Homo sapiens
cctgctgctgacctgatc

SEQ ID NO: 1979573 - DNA, 14 bp, Homo sapiens
cctgctgctgagaa

SEQ ID NO: 1979574 - DNA, 15 bp, Homo sapiens
cctgctgctgagaac

SEQ ID NO: 1979575 - DNA, 16 bp, Homo sapiens
cctgctgctgagaacc

SEQ ID NO: 1979576 - DNA, 21 bp, Homo sapiens
cctgctgctgagaacctggcc

SEQ ID NO: 1979577 - DNA, 24 bp, Homo sapiens
cctgctgctgagaacctggccttc

SEQ ID NO: 1979578 - DNA, 20 bp, Homo sapiens
cctgctgctgtaactgctga

SEQ ID NO: 1979579 - DNA, 20 bp, Homo sapiens
cctgctgctgtgtttttgct

SEQ ID NO: 1979580 - DNA, 22 bp, Homo sapiens
cctgctggaaaccacacttctt

SEQ ID NO: 1979581 - DNA, 12 bp, Homo sapiens
cctgctggcacc

SEQ ID NO: 1979582 - DNA, 14 bp, Homo sapiens
cctgctggcacctc

SEQ ID NO: 1979583 - DNA, 19 bp, Homo sapiens
cctgctgggaaccccgcag

SEQ ID NO: 1979584 - DNA, 12 bp, Homo sapiens
cctgctgggctc

SEQ ID NO: 1979585 - DNA, 17 bp, Homo sapiens
cctgctgggctctccac

SEQ ID NO: 1979586 - DNA, 18 bp, Homo sapiens
cctgctgggctctccacc

SEQ ID NO: 1979587 - DNA, 22 bp, Homo sapiens
cctgctgggctctccacctcag

SEQ ID NO: 1979588 - DNA, 13 bp, Homo sapiens
cctgctggttcag

SEQ ID NO: 1979589 - DNA, 16 bp, Homo sapiens
cctgctgtggcctcac

SEQ ID NO: 1979590 - DNA, 18 bp, Homo sapiens
cctgctgtggcctcactt

SEQ ID NO: 1979591 - DNA, 20 bp, Homo sapiens
cctgctgtggcctcacttcc

SEQ ID NO: 1979592 - DNA, 12 bp, Homo sapiens
cctgctgtggga

SEQ ID NO: 1979593 - DNA, 15 bp, Homo sapiens
cctgcttacctgacg

SEQ ID NO: 1979594 - DNA, 14 bp, Homo sapiens
cctgcttcatgctc

SEQ ID NO: 1979595 - DNA, 16 bp, Homo sapiens
cctgcttcatgctcag

SEQ ID NO: 1979596 - DNA, 17 bp, Homo sapiens
cctgcttcatgctcagc

SEQ ID NO: 1979597 - DNA, 21 bp, Homo sapiens
cctgcttcctaggccccagag

SEQ ID NO: 1979598 - DNA, 22 bp, Homo sapiens
cctgcttcctaggccccagagc

SEQ ID NO: 1979599 - DNA, 15 bp, Homo sapiens
cctgcttctcagccc

SEQ ID NO: 1979600 - DNA, 15 bp, Homo sapiens
cctgcttctctgggg

SEQ ID NO: 1979601 - DNA, 14 bp, Homo sapiens
cctgcttctgaact

SEQ ID NO: 1979602 - DNA, 15 bp, Homo sapiens
cctgcttctgaactc

SEQ ID NO: 1979603 - DNA, 15 bp, Homo sapiens
cctgctttctcctgg

SEQ ID NO: 1979604 - DNA, 19 bp, Homo sapiens
cctgctttgggctgccctg

SEQ ID NO: 1979605 - DNA, 15 bp, Homo sapiens
cctgcttttccagga

SEQ ID NO: 1979606 - DNA, 18 bp, Homo sapiens
cctgcttttccaggatcc

SEQ ID NO: 1979607 - DNA, 23 bp, Homo sapiens
cctgcttttccaggatcctgcag

SEQ ID NO: 1979608 - DNA, 19 bp, Homo sapiens
cctggaaaggggagttgag

SEQ ID NO: 1979609 - DNA, 15 bp, Homo sapiens
cctggaaccagggag

SEQ ID NO: 1979610 - DNA, 16 bp, Homo sapiens
cctggaaccagggagg

SEQ ID NO: 1979611 - DNA, 21 bp, Homo sapiens
cctggaaccagggaggagagg

SEQ ID NO: 1979612 - DNA, 12 bp, Homo sapiens
cctggaagggct

SEQ ID NO: 1979613 - DNA, 16 bp, Homo sapiens
cctggaatgaagcatg

SEQ ID NO: 1979614 - DNA, 23 bp, Homo sapiens
cctggaattcagcaccctgggtg

SEQ ID NO: 1979615 - DNA, 16 bp, Homo sapiens
cctggacagctgtgcc

SEQ ID NO: 1979616 - DNA, 20 bp, Homo sapiens
cctggaccaccagccccagc

SEQ ID NO: 1979617 - DNA, 17 bp, Homo sapiens
cctggactgggaggtag

SEQ ID NO: 1979618 - DNA, 18 bp, Homo sapiens
cctggactgggaggtaga

SEQ ID NO: 1979619 - DNA, 23 bp, Homo sapiens
cctggactttggttctctccagg

SEQ ID NO: 1979620 - DNA, 12 bp, Homo sapiens
cctggagaacta

SEQ ID NO: 1979621 - DNA, 14 bp, Homo sapiens
cctggagagccaga

SEQ ID NO: 1979622 - DNA, 13 bp, Homo sapiens
cctggagaggggc

SEQ ID NO: 1979623 - DNA, 14 bp, Homo sapiens
cctggagaggggcc

SEQ ID NO: 1979624 - DNA, 15 bp, Homo sapiens
cctggagatgatgat

SEQ ID NO: 1979625 - DNA, 16 bp, Homo sapiens
cctggagatgatgatg

SEQ ID NO: 1979626 - DNA, 17 bp, Homo sapiens
cctggagcatcccaggc

SEQ ID NO: 1979627 - DNA, 19 bp, Homo sapiens
cctggagcggctctcctga

SEQ ID NO: 1979628 - DNA, 12 bp, Homo sapiens
cctggaggacct

SEQ ID NO: 1979629 - DNA, 13 bp, Homo sapiens
cctggaggacctg

SEQ ID NO: 1979630 - DNA, 20 bp, Homo sapiens
cctggaggacctgagcctgc

SEQ ID NO: 1979631 - DNA, 21 bp, Homo sapiens
cctggaggacctgagcctgcc

SEQ ID NO: 1979632 - DNA, 19 bp, Homo sapiens
cctggaggatccctccatc

SEQ ID NO: 1979633 - DNA, 12 bp, Homo sapiens
cctggagggcta

SEQ ID NO: 1979634 - DNA, 21 bp, Homo sapiens
cctggagggctagaacctaga

SEQ ID NO: 1979635 - DNA, 18 bp, Homo sapiens
cctggagggctagaactg

SEQ ID NO: 1979636 - DNA, 22 bp, Homo sapiens
cctggaggggctagaacctaga

SEQ ID NO: 1979637 - DNA, 17 bp, Homo sapiens
cctggatcagaacagga

SEQ ID NO: 1979638 - DNA, 20 bp, Homo sapiens
cctggatgggcattgggctg

SEQ ID NO: 1979639 - DNA, 20 bp, Homo sapiens
cctggatgtcccctgtccca

SEQ ID NO: 1979640 - DNA, 23 bp, Homo sapiens
cctggatgtcccctgtcccacca

SEQ ID NO: 1979641 - DNA, 21 bp, Homo sapiens
cctggcaagctagaacctgga

SEQ ID NO: 1979642 - DNA, 18 bp, Homo sapiens
cctggcacaggactgatt

SEQ ID NO: 1979643 - DNA, 18 bp, Homo sapiens
cctggcacagggcagtgg

SEQ ID NO: 1979644 - DNA, 19 bp, Homo sapiens
cctggcacccggcccctgc

SEQ ID NO: 1979645 - DNA, 22 bp, Homo sapiens
cctggcacggtggctcaggcct

SEQ ID NO: 1979646 - DNA, 19 bp, Homo sapiens
cctggcagccgtgccttca

SEQ ID NO: 1979647 - DNA, 22 bp, Homo sapiens
cctggcaggatgaccctgcgaa

SEQ ID NO: 1979648 - DNA, 19 bp, Homo sapiens
cctggcaggttagaaccta

SEQ ID NO: 1979649 - DNA, 17 bp, Homo sapiens
cctggcatgacactcta

SEQ ID NO: 1979650 - DNA, 19 bp, Homo sapiens
cctggcatggtgctttcag

SEQ ID NO: 1979651 - DNA, 16 bp, Homo sapiens
cctggcatgtcagagc

SEQ ID NO: 1979652 - DNA, 13 bp, Homo sapiens
cctggccagacgc

SEQ ID NO: 1979653 - DNA, 20 bp, Homo sapiens
cctggccagatgcaccagcc

SEQ ID NO: 1979654 - DNA, 12 bp, Homo sapiens
cctggccaggca

SEQ ID NO: 1979655 - DNA, 13 bp, Homo sapiens
cctggccaggcac

SEQ ID NO: 1979656 - DNA, 20 bp, Homo sapiens
cctggccattttcttgcctg

SEQ ID NO: 1979657 - DNA, 21 bp, Homo sapiens
cctggccattttcttgcctga

SEQ ID NO: 1979658 - DNA, 19 bp, Homo sapiens
cctggcccagagctggaac

SEQ ID NO: 1979659 - DNA, 13 bp, Homo sapiens
cctggcccataga

SEQ ID NO: 1979660 - DNA, 12 bp, Homo sapiens
cctggccccagc

SEQ ID NO: 1979661 - DNA, 17 bp, Homo sapiens
cctggccccagccccca

SEQ ID NO: 1979662 - DNA, 14 bp, Homo sapiens
cctggccccatgtc

SEQ ID NO: 1979663 - DNA, 17 bp, Homo sapiens
cctggccccatgtctct

SEQ ID NO: 1979664 - DNA, 18 bp, Homo sapiens
cctggccccatgtctctc

SEQ ID NO: 1979665 - DNA, 17 bp, Homo sapiens
cctggcccccctccagg

SEQ ID NO: 1979666 - DNA, 18 bp, Homo sapiens
cctggcccccctccaggc

SEQ ID NO: 1979667 - DNA, 19 bp, Homo sapiens
cctggccccgggctctggc

SEQ ID NO: 1979668 - DNA, 23 bp, Homo sapiens
cctggccccgggctctggccacc

SEQ ID NO: 1979669 - DNA, 12 bp, Homo sapiens
cctggcccctcc

SEQ ID NO: 1979670 - DNA, 15 bp, Homo sapiens
cctggcccgcccctc

SEQ ID NO: 1979671 - DNA, 12 bp, Homo sapiens
cctggccctgcc

SEQ ID NO: 1979672 - DNA, 21 bp, Homo sapiens
cctggccggcaaccccagttc

SEQ ID NO: 1979673 - DNA, 22 bp, Homo sapiens
cctggccggcaaccccagttct

SEQ ID NO: 1979674 - DNA, 23 bp, Homo sapiens
cctggccggcaaccccagttctg

SEQ ID NO: 1979675 - DNA, 14 bp, Homo sapiens
cctggccggctcca

SEQ ID NO: 1979676 - DNA, 15 bp, Homo sapiens
cctggccggctccag

SEQ ID NO: 1979677 - DNA, 16 bp, Homo sapiens
cctggccggctccagt

SEQ ID NO: 1979678 - DNA, 17 bp, Homo sapiens
cctggcctcaagcaatc

SEQ ID NO: 1979679 - DNA, 22 bp, Homo sapiens
cctggcctcaagtgattctcct

SEQ ID NO: 1979680 - DNA, 21 bp, Homo sapiens
cctggcctcacgcccagcctc

SEQ ID NO: 1979681 - DNA, 15 bp, Homo sapiens
cctggcctcactggc

SEQ ID NO: 1979682 - DNA, 17 bp, Homo sapiens
cctggcctcactggctg

SEQ ID NO: 1979683 - DNA, 19 bp, Homo sapiens
cctggcctcactggctggg

SEQ ID NO: 1979684 - DNA, 23 bp, Homo sapiens
cctggcctcactggctggggcag

SEQ ID NO: 1979685 - DNA, 16 bp, Homo sapiens
cctggcctgagctggg

SEQ ID NO: 1979686 - DNA, 18 bp, Homo sapiens
cctggcctgctgggaacc

SEQ ID NO: 1979687 - DNA, 16 bp, Homo sapiens
cctggcctggcacaca

SEQ ID NO: 1979688 - DNA, 13 bp, Homo sapiens
cctggcctggctc

SEQ ID NO: 1979689 - DNA, 14 bp, Homo sapiens
cctggcctggctcc

SEQ ID NO: 1979690 - DNA, 17 bp, Homo sapiens
cctggcctggctctcct

SEQ ID NO: 1979691 - DNA, 20 bp, Homo sapiens
cctggccttgtcaggaccca

SEQ ID NO: 1979692 - DNA, 19 bp, Homo sapiens
cctggcgcccctgcccccc

SEQ ID NO: 1979693 - DNA, 21 bp, Homo sapiens
cctggcggggcaggaggcctg

SEQ ID NO: 1979694 - DNA, 12 bp, Homo sapiens
cctggctataca

SEQ ID NO: 1979695 - DNA, 17 bp, Homo sapiens
cctggctcaccttgtgc

SEQ ID NO: 1979696 - DNA, 13 bp, Homo sapiens
cctggctccccac

SEQ ID NO: 1979697 - DNA, 18 bp, Homo sapiens
cctggctccccacgagtc

SEQ ID NO: 1979698 - DNA, 15 bp, Homo sapiens
cctggctctcctgta

SEQ ID NO: 1979699 - DNA, 12 bp, Homo sapiens
cctggctcttct

SEQ ID NO: 1979700 - DNA, 18 bp, Homo sapiens
cctggctgacccctggcc

SEQ ID NO: 1979701 - DNA, 14 bp, Homo sapiens
cctggctgccaggc

SEQ ID NO: 1979702 - DNA, 18 bp, Homo sapiens
cctggctggctgagggca

SEQ ID NO: 1979703 - DNA, 19 bp, Homo sapiens
cctggctggctgagggcag

SEQ ID NO: 1979704 - DNA, 20 bp, Homo sapiens
cctggctggctgagggcagt

SEQ ID NO: 1979705 - DNA, 15 bp, Homo sapiens
cctggctgtggaggc

SEQ ID NO: 1979706 - DNA, 17 bp, Homo sapiens
cctggctgtggaggcct

SEQ ID NO: 1979707 - DNA, 15 bp, Homo sapiens
cctggcttcccatcc

SEQ ID NO: 1979708 - DNA, 21 bp, Homo sapiens
cctggcttcccatccccagcg

SEQ ID NO: 1979709 - DNA, 16 bp, Homo sapiens
cctggcttctggagcc

SEQ ID NO: 1979710 - DNA, 23 bp, Homo sapiens
cctggcttctggagcccttgggt

SEQ ID NO: 1979711 - DNA, 18 bp, Homo sapiens
cctggcttgctccagggt

SEQ ID NO: 1979712 - DNA, 22 bp, Homo sapiens
cctggcttgtaactccaccaac

SEQ ID NO: 1979713 - DNA, 18 bp, Homo sapiens
cctggctttgacatgaaa

SEQ ID NO: 1979714 - DNA, 14 bp, Homo sapiens
cctgggaaaacaga

SEQ ID NO: 1979715 - DNA, 17 bp, Homo sapiens
cctgggaaaacagagga

SEQ ID NO: 1979716 - DNA, 13 bp, Homo sapiens
cctgggaaaggaa

SEQ ID NO: 1979717 - DNA, 22 bp, Homo sapiens
cctgggaaaggaaaaccaggga

SEQ ID NO: 1979718 - DNA, 15 bp, Homo sapiens
cctgggaaaggaccc

SEQ ID NO: 1979719 - DNA, 16 bp, Homo sapiens
cctgggaaaggaccca

SEQ ID NO: 1979720 - DNA, 18 bp, Homo sapiens
cctgggaactcatcctgt

SEQ ID NO: 1979721 - DNA, 23 bp, Homo sapiens
cctgggacccagctactctgtcc

SEQ ID NO: 1979722 - DNA, 23 bp, Homo sapiens
cctgggaccgctacaccactctg

SEQ ID NO: 1979723 - DNA, 14 bp, Homo sapiens
cctgggactcccag

SEQ ID NO: 1979724 - DNA, 18 bp, Homo sapiens
cctgggactcccagtgaa

SEQ ID NO: 1979725 - DNA, 17 bp, Homo sapiens
cctgggagaacctcagg

SEQ ID NO: 1979726 - DNA, 19 bp, Homo sapiens
cctgggagaacctcaggct

SEQ ID NO: 1979727 - DNA, 15 bp, Homo sapiens
cctgggcacccacct

SEQ ID NO: 1979728 - DNA, 22 bp, Homo sapiens
cctgggcacccacctccacccc

SEQ ID NO: 1979729 - DNA, 13 bp, Homo sapiens
cctgggccaaaag

SEQ ID NO: 1979730 - DNA, 13 bp, Homo sapiens
cctgggcccaggc

SEQ ID NO: 1979731 - DNA, 17 bp, Homo sapiens
cctgggcccaggctctg

SEQ ID NO: 1979732 - DNA, 22 bp, Homo sapiens
cctgggcccaggctctgggaag

SEQ ID NO: 1979733 - DNA, 13 bp, Homo sapiens
cctgggccccacc

SEQ ID NO: 1979734 - DNA, 14 bp, Homo sapiens
cctgggccccacca

SEQ ID NO: 1979735 - DNA, 21 bp, Homo sapiens
cctgggccccaccacctaggc

SEQ ID NO: 1979736 - DNA, 23 bp, Homo sapiens
cctgggccccaccacctaggcca

SEQ ID NO: 1979737 - DNA, 21 bp, Homo sapiens
cctgggcccctccacgcctcc

SEQ ID NO: 1979738 - DNA, 22 bp, Homo sapiens
cctgggcccctccacgcctcct

SEQ ID NO: 1979739 - DNA, 23 bp, Homo sapiens
cctgggcccctccacgcctcctg

SEQ ID NO: 1979740 - DNA, 23 bp, Homo sapiens
cctgggcccgctttgcctgcttg

SEQ ID NO: 1979741 - DNA, 15 bp, Homo sapiens
cctgggccctggggc

SEQ ID NO: 1979742 - DNA, 22 bp, Homo sapiens
cctgggcctatggagagccctg

SEQ ID NO: 1979743 - DNA, 23 bp, Homo sapiens
cctgggcctatggagagccctgg

SEQ ID NO: 1979744 - DNA, 12 bp, Homo sapiens
cctgggcctgct

SEQ ID NO: 1979745 - DNA, 19 bp, Homo sapiens
cctgggcctgctgctgaga

SEQ ID NO: 1979746 - DNA, 21 bp, Homo sapiens
cctgggcctgcttttccagga

SEQ ID NO: 1979747 - DNA, 14 bp, Homo sapiens
cctgggcctgtccc

SEQ ID NO: 1979748 - DNA, 13 bp, Homo sapiens
cctgggcctgtgc

SEQ ID NO: 1979749 - DNA, 16 bp, Homo sapiens
cctgggcctgtgcagc

SEQ ID NO: 1979750 - DNA, 18 bp, Homo sapiens
cctgagctcggtggaccc

SEQ ID NO: 1979751 - DNA, 21 bp, Homo sapiens
cctgagctggggcctggagag

SEQ ID NO: 1979752 - DNA, 23 bp, Homo sapiens
cctgagctggggcctggagaggg

SEQ ID NO: 1979753 - DNA, 16 bp, Homo sapiens
cctgagctttggggac

SEQ ID NO: 1979754 - DNA, 18 bp, Homo sapiens
cctgagctttggggacag

SEQ ID NO: 1979755 - DNA, 13 bp, Homo sapiens
cctgaggagtctg

SEQ ID NO: 1979756 - DNA, 22 bp, Homo sapiens
cctgaggagtctgaggtcctga

SEQ ID NO: 1979757 - DNA, 23 bp, Homo sapiens
cctgaggcatgagaatcacttga

SEQ ID NO: 1979758 - DNA, 16 bp, Homo sapiens
cctgaggctcaagagg

SEQ ID NO: 1979759 - DNA, 12 bp, Homo sapiens
cctgaggctcct

SEQ ID NO: 1979760 - DNA, 17 bp, Homo sapiens
cctgaggctcctgtgct

SEQ ID NO: 1979761 - DNA, 13 bp, Homo sapiens
cctgagggtcccc

SEQ ID NO: 1979762 - DNA, 19 bp, Homo sapiens
cctgagggtccccacctgg

SEQ ID NO: 1979763 - DNA, 13 bp, Homo sapiens
cctgagggtggag

SEQ ID NO: 1979764 - DNA, 14 bp, Homo sapiens
cctgaggtcacctg

SEQ ID NO: 1979765 - DNA, 23 bp, Homo sapiens
cctgagtaccttctacaggcccg

SEQ ID NO: 1979766 - DNA, 18 bp, Homo sapiens
cctgagtcaactggagca

SEQ ID NO: 1979767 - DNA, 19 bp, Homo sapiens
cctgagtcaactggagcaa

SEQ ID NO: 1979768 - DNA, 22 bp, Homo sapiens
cctgagtcaactggagcaagaa

SEQ ID NO: 1979769 - DNA, 15 bp, Homo sapiens
cctgagtcaccagga

SEQ ID NO: 1979770 - DNA, 18 bp, Homo sapiens
cctgagtctcctgtgccc

SEQ ID NO: 1979771 - DNA, 19 bp, Homo sapiens
cctgagtgctttaccttta

SEQ ID NO: 1979772 - DNA, 18 bp, Homo sapiens
cctgagtggatctccaag

SEQ ID NO: 1979773 - DNA, 17 bp, Homo sapiens
cctgataacaacctgga

SEQ ID NO: 1979774 - DNA, 19 bp, Homo sapiens
cctgataagcttcaaagct

SEQ ID NO: 1979775 - DNA, 17 bp, Homo sapiens
cctgataataattgatc

SEQ ID NO: 1979776 - DNA, 20 bp, Homo sapiens
cctgatcaagtcaccggagc

SEQ ID NO: 1979777 - DNA, 14 bp, Homo sapiens
cctgatcacctctg

SEQ ID NO: 1979778 - DNA, 23 bp, Homo sapiens
cctgatcacctctggctttgtct

SEQ ID NO: 1979779 - DNA, 18 bp, Homo sapiens
cctgatcatggtcagctc

SEQ ID NO: 1979780 - DNA, 22 bp, Homo sapiens
cctgatcatggtcagctcacac

SEQ ID NO: 1979781 - DNA, 13 bp, Homo sapiens
cctgatgcccctt

SEQ ID NO: 1979782 - DNA, 16 bp, Homo sapiens
cctgatgccccttccc

SEQ ID NO: 1979783 - DNA, 22 bp, Homo sapiens
cctgatgctgccccgttccctg

SEQ ID NO: 1979784 - DNA, 23 bp, Homo sapiens
cctgatgctgccccgttccctgt

SEQ ID NO: 1979785 - DNA, 14 bp, Homo sapiens
cctgatggccaaga

SEQ ID NO: 1979786 - DNA, 17 bp, Homo sapiens
cctgatggccaagagca

SEQ ID NO: 1979787 - DNA, 16 bp, Homo sapiens
cctgatgttaaaattc

SEQ ID NO: 1979788 - DNA, 14 bp, Homo sapiens
cctgatttcaggga

SEQ ID NO: 1979789 - DNA, 15 bp, Homo sapiens
cctgattttgtagtt

SEQ ID NO: 1979790 - DNA, 15 bp, Homo sapiens
cctgcaaaaatataa

SEQ ID NO: 1979791 - DNA, 14 bp, Homo sapiens
cctgcaagccccag

SEQ ID NO: 1979792 - DNA, 15 bp, Homo sapiens
cctgcaagccccagg

SEQ ID NO: 1979793 - DNA, 21 bp, Homo sapiens
cctgcaagccccagggcctgg

SEQ ID NO: 1979794 - DNA, 23 bp, Homo sapiens
cctgcaagccccagggcctgggg

SEQ ID NO: 1979795 - DNA, 16 bp, Homo sapiens
cctgcaagtgcccgcc

SEQ ID NO: 1979796 - DNA, 16 bp, Homo sapiens
cctgcaatctccaggg

SEQ ID NO: 1979797 - DNA, 18 bp, Homo sapiens
cctgcaatctccagggct

SEQ ID NO: 1979798 - DNA, 21 bp, Homo sapiens
cctgcaatctccagggctgcc

SEQ ID NO: 1979799 - DNA, 23 bp, Homo sapiens
cctgcaatctccagggctgcccc

SEQ ID NO: 1979800 - DNA, 16 bp, Homo sapiens
cctgcaattctacagt

SEQ ID NO: 1979801 - DNA, 12 bp, Homo sapiens
cctgcacagttt

SEQ ID NO: 1979802 - DNA, 21 bp, Homo sapiens
cctgcaccagcccttccctgc

SEQ ID NO: 1979803 - DNA, 13 bp, Homo sapiens
cctgcacccgtac

SEQ ID NO: 1979804 - DNA, 15 bp, Homo sapiens
cctgcacccgtaccc

SEQ ID NO: 1979805 - DNA, 15 bp, Homo sapiens
cctgcaccctggaaa

SEQ ID NO: 1979806 - DNA, 21 bp, Homo sapiens
cctgcaccctggaaaggggag

SEQ ID NO: 1979807 - DNA, 15 bp, Homo sapiens
cctgcacccttcctc

SEQ ID NO: 1979808 - DNA, 19 bp, Homo sapiens
cctgcacctccccccactg

SEQ ID NO: 1979809 - DNA, 12 bp, Homo sapiens
cctgcactccag

SEQ ID NO: 1979810 - DNA, 13 bp, Homo sapiens
cctgcactccaga

SEQ ID NO: 1979811 - DNA, 15 bp, Homo sapiens
cctgcactccagaat

SEQ ID NO: 1979812 - DNA, 13 bp, Homo sapiens
cctgcagaccctg

SEQ ID NO: 1979813 - DNA, 16 bp, Homo sapiens
cctgcagaccctgccc

SEQ ID NO: 1979814 - DNA, 15 bp, Homo sapiens
cctgcagactcactg

SEQ ID NO: 1979815 - DNA, 20 bp, Homo sapiens
cctgcagccaaacagagcct

SEQ ID NO: 1979816 - DNA, 21 bp, Homo sapiens
cctgcagccaaacagagcctt

SEQ ID NO: 1979817 - DNA, 15 bp, Homo sapiens
cctgcagcctcctcc

SEQ ID NO: 1979818 - DNA, 20 bp, Homo sapiens
cctgcagcttgtagccagcc

SEQ ID NO: 1979819 - DNA, 21 bp, Homo sapiens
cctgcagcttgtagccagccg

SEQ ID NO: 1979820 - DNA, 16 bp, Homo sapiens
cctgcaggccaagagc

SEQ ID NO: 1979821 - DNA, 15 bp, Homo sapiens
cctgcagttcctgag

SEQ ID NO: 1979822 - DNA, 17 bp, Homo sapiens
cctgcatccggagaatt

SEQ ID NO: 1979823 - DNA, 14 bp, Homo sapiens
cctgcatttctgag

SEQ ID NO: 1979824 - DNA, 12 bp, Homo sapiens
cctgccaagcca

SEQ ID NO: 1979825 - DNA, 15 bp, Homo sapiens
cctgccacactcagt

SEQ ID NO: 1979826 - DNA, 13 bp, Homo sapiens
cctgccaccctgg

SEQ ID NO: 1979827 - DNA, 22 bp, Homo sapiens
cctgccaccctggggagaaagt

SEQ ID NO: 1979828 - DNA, 21 bp, Homo sapiens
cctgccaccgccagaggacaa

SEQ ID NO: 1979829 - DNA, 14 bp, Homo sapiens
cctgccacctgtct

SEQ ID NO: 1979830 - DNA, 16 bp, Homo sapiens
cctgccacctgtctgt

SEQ ID NO: 1979831 - DNA, 13 bp, Homo sapiens
cctgccagccatc

SEQ ID NO: 1979832 - DNA, 17 bp, Homo sapiens
cctgccagccatcacaa

SEQ ID NO: 1979833 - DNA, 19 bp, Homo sapiens
cctgccagccatcacaagg

SEQ ID NO: 1979834 - DNA, 15 bp, Homo sapiens
cctgccagcctggct

SEQ ID NO: 1979835 - DNA, 21 bp, Homo sapiens
cctgccagcctggcttctgga

SEQ ID NO: 1979836 - DNA, 12 bp, Homo sapiens
cctgccagctgc

SEQ ID NO: 1979837 - DNA, 17 bp, Homo sapiens
cctgccagctgccttcc

SEQ ID NO: 1979838 - DNA, 13 bp, Homo sapiens
cctgccagggccc

SEQ ID NO: 1979839 - DNA, 15 bp, Homo sapiens
cctgccagggcccct

SEQ ID NO: 1979840 - DNA, 17 bp, Homo sapiens
cctgccagggctcgggc

SEQ ID NO: 1979841 - DNA, 13 bp, Homo sapiens
cctgccagtgcct

SEQ ID NO: 1979842 - DNA, 14 bp, Homo sapiens
cctgccagtgcctt

SEQ ID NO: 1979843 - DNA, 19 bp, Homo sapiens
cctgccataccgctgggga

SEQ ID NO: 1979844 - DNA, 15 bp, Homo sapiens
cctgcccagcctcgc

SEQ ID NO: 1979845 - DNA, 23 bp, Homo sapiens
cctgcccaggagagccagccctc

SEQ ID NO: 1979846 - DNA, 14 bp, Homo sapiens
cctgcccaggcccc

SEQ ID NO: 1979847 - DNA, 14 bp, Homo sapiens
cctgcccatacccc

SEQ ID NO: 1979848 - DNA, 14 bp, Homo sapiens
cctgccccaactcc

SEQ ID NO: 1979849 - DNA, 13 bp, Homo sapiens
cctgccccagcgc

SEQ ID NO: 1979850 - DNA, 15 bp, Homo sapiens
cctgccccagcgcgg

SEQ ID NO: 1979851 - DNA, 13 bp, Homo sapiens
cctgccccatcct

SEQ ID NO: 1979852 - DNA, 15 bp, Homo sapiens
cctgccccatcctgg

SEQ ID NO: 1979853 - DNA, 18 bp, Homo sapiens
cctgccccatcctgggcc

SEQ ID NO: 1979854 - DNA, 19 bp, Homo sapiens
cctgccccatcctgggcct

SEQ ID NO: 1979855 - DNA, 14 bp, Homo sapiens
cctgcccccaaagg

SEQ ID NO: 1979856 - DNA, 17 bp, Homo sapiens
cctgcccccagcactcc

SEQ ID NO: 1979857 - DNA, 13 bp, Homo sapiens
cctgcccccatct

SEQ ID NO: 1979858 - DNA, 21 bp, Homo sapiens
cctgcccccatctccccaggc

SEQ ID NO: 1979859 - DNA, 23 bp, Homo sapiens
cctgcccccatctccccaggcct

SEQ ID NO: 1979860 - DNA, 19 bp, Homo sapiens
cctgcccccgacagcccag

SEQ ID NO: 1979861 - DNA, 12 bp, Homo sapiens
cctgccccctgg

SEQ ID NO: 1979862 - DNA, 15 bp, Homo sapiens
cctgccccctggtgg

SEQ ID NO: 1979863 - DNA, 22 bp, Homo sapiens
cctgccccgcccagctgcacct

SEQ ID NO: 1979864 - DNA, 14 bp, Homo sapiens
cctgcccctccctt

SEQ ID NO: 1979865 - DNA, 15 bp, Homo sapiens
cctgcccctcccttc

SEQ ID NO: 1979866 - DNA, 18 bp, Homo sapiens
cctgcccctcccttcaac

SEQ ID NO: 1979867 - DNA, 22 bp, Homo sapiens
cgtcctgctggcacctcagaca

SEQ ID NO: 1979868 - DNA, 18 bp, Homo sapiens
cgtcctggaatgaagcat

SEQ ID NO: 1979869 - DNA, 16 bp, Homo sapiens
cgtcctgtcccagagg

SEQ ID NO: 1979870 - DNA, 22 bp, Homo sapiens
cgtccttactcctgtgggagcc

SEQ ID NO: 1979871 - DNA, 21 bp, Homo sapiens
cgtcgctggacaacccagaac

SEQ ID NO: 1979872 - DNA, 19 bp, Homo sapiens
cgtctccctaaaataaaaa

SEQ ID NO: 1979873 - DNA, 23 bp, Homo sapiens
cgtctccctaaaataaaaaccag

SEQ ID NO: 1979874 - DNA, 15 bp, Homo sapiens
cgtctcctttgacat

SEQ ID NO: 1979875 - DNA, 13 bp, Homo sapiens
cgtctgacaggca

SEQ ID NO: 1979876 - DNA, 14 bp, Homo sapiens
cgtctgacaggcaa

SEQ ID NO: 1979877 - DNA, 21 bp, Homo sapiens
cgtctgacaggcaatgctggc

SEQ ID NO: 1979878 - DNA, 15 bp, Homo sapiens
cgtctgactccagag

SEQ ID NO: 1979879 - DNA, 12 bp, Homo sapiens
cgtctgccaggc

SEQ ID NO: 1979880 - DNA, 14 bp, Homo sapiens
cgtctgccaggccc

SEQ ID NO: 1979881 - DNA, 16 bp, Homo sapiens
cgtctgccccaccctc

SEQ ID NO: 1979882 - DNA, 18 bp, Homo sapiens
cgtctgccccaccctcaa

SEQ ID NO: 1979883 - DNA, 17 bp, Homo sapiens
cgtctggggttcagccc

SEQ ID NO: 1979884 - DNA, 23 bp, Homo sapiens
cgtcttagaagtggaccaggaca

SEQ ID NO: 1979885 - DNA, 19 bp, Homo sapiens
cgtcttctgtatactgtgg

SEQ ID NO: 1979886 - DNA, 23 bp, Homo sapiens
cgtcttgggtcgccctaccctca

SEQ ID NO: 1979887 - DNA, 12 bp, Homo sapiens
cgtcttgtattt

SEQ ID NO: 1979888 - DNA, 14 bp, Homo sapiens
cgtgaactcctgag

SEQ ID NO: 1979889 - DNA, 18 bp, Homo sapiens
cgtgaactgcgtgccagt

SEQ ID NO: 1979890 - DNA, 13 bp, Homo sapiens
cgtgaagcagtgc

SEQ ID NO: 1979891 - DNA, 15 bp, Homo sapiens
cgtgaagcagtgcct

SEQ ID NO: 1979892 - DNA, 16 bp, Homo sapiens
cgtgaagcagtgcctc

SEQ ID NO: 1979893 - DNA, 17 bp, Homo sapiens
cgtgaagcagtgcctcg

SEQ ID NO: 1979894 - DNA, 17 bp, Homo sapiens
cgtgaagggcaccgaga

SEQ ID NO: 1979895 - DNA, 20 bp, Homo sapiens
cgtgacccttcagggccaga

SEQ ID NO: 1979896 - DNA, 15 bp, Homo sapiens
cgtgactcacccaag

SEQ ID NO: 1979897 - DNA, 17 bp, Homo sapiens
cgtgactgccccaactc

SEQ ID NO: 1979898 - DNA, 20 bp, Homo sapiens
cgtgactgccccaactcctg

SEQ ID NO: 1979899 - DNA, 23 bp, Homo sapiens
cgtgactgccccaactcctggaa

SEQ ID NO: 1979900 - DNA, 18 bp, Homo sapiens
cgtgagagaatctgcctg

SEQ ID NO: 1979901 - DNA, 12 bp, Homo sapiens
cgtgagccaggt

SEQ ID NO: 1979902 - DNA, 13 bp, Homo sapiens
cgtgagccaggta

SEQ ID NO: 1979903 - DNA, 22 bp, Homo sapiens
cgtgagctatgattatgccact

SEQ ID NO: 1979904 - DNA, 19 bp, Homo sapiens
cgtgagtgaaccatcatta

SEQ ID NO: 1979905 - DNA, 20 bp, Homo sapiens
cgtgatttggaagagaggca

SEQ ID NO: 1979906 - DNA, 16 bp, Homo sapiens
cgtgcaaggggctcag

SEQ ID NO: 1979907 - DNA, 15 bp, Homo sapiens
cgtgcatttgtgagc

SEQ ID NO: 1979908 - DNA, 15 bp, Homo sapiens
cgtgccaagtccagg

SEQ ID NO: 1979909 - DNA, 23 bp, Homo sapiens
cgtgccacccgtaggcagcctct

SEQ ID NO: 1979910 - DNA, 16 bp, Homo sapiens
cgtgccagtgtcccca

SEQ ID NO: 1979911 - DNA, 19 bp, Homo sapiens
cgtgcccaggggcccacag

SEQ ID NO: 1979912 - DNA, 17 bp, Homo sapiens
cgtgccccgcctccccg

SEQ ID NO: 1979913 - DNA, 19 bp, Homo sapiens
cgtgccgttactctccaac

SEQ ID NO: 1979914 - DNA, 16 bp, Homo sapiens
cgtgctcgcagcctgg

SEQ ID NO: 1979915 - DNA, 19 bp, Homo sapiens
cgtgctcttctgttctcaa

SEQ ID NO: 1979916 - DNA, 22 bp, Homo sapiens
cgtgctgggcttgtagaccact

SEQ ID NO: 1979917 - DNA, 15 bp, Homo sapiens
cgtgctttatttatg

SEQ ID NO: 1979918 - DNA, 19 bp, Homo sapiens
cgtgctttatttatggctt

SEQ ID NO: 1979919 - DNA, 14 bp, Homo sapiens
cgtggacacctgcc

SEQ ID NO: 1979920 - DNA, 15 bp, Homo sapiens
cgtggacacctgccc

SEQ ID NO: 1979921 - DNA, 18 bp, Homo sapiens
cgtggacacctgccctgc

SEQ ID NO: 1979922 - DNA, 19 bp, Homo sapiens
cgtggacacctgccctgcc

SEQ ID NO: 1979923 - DNA, 14 bp, Homo sapiens
cgtggaccttcctg

SEQ ID NO: 1979924 - DNA, 17 bp, Homo sapiens
cgtggagcagaatcagt

SEQ ID NO: 1979925 - DNA, 15 bp, Homo sapiens
cgtggaggctgctcg

SEQ ID NO: 1979926 - DNA, 17 bp, Homo sapiens
cgtggagggtaggggag

SEQ ID NO: 1979927 - DNA, 20 bp, Homo sapiens
cgtggaggtgaagtccctgt

SEQ ID NO: 1979928 - DNA, 15 bp, Homo sapiens
cgtggcaaatataaa

SEQ ID NO: 1979929 - DNA, 17 bp, Homo sapiens
cgtggcaaatataaaac

SEQ ID NO: 1979930 - DNA, 18 bp, Homo sapiens
cgtggcaaatataaaact

SEQ ID NO: 1979931 - DNA, 20 bp, Homo sapiens
cgtggcagataatcagcctc

SEQ ID NO: 1979932 - DNA, 16 bp, Homo sapiens
cgtggcccttcctgga

SEQ ID NO: 1979933 - DNA, 22 bp, Homo sapiens
cgtggcccttcctggacagctg

SEQ ID NO: 1979934 - DNA, 20 bp, Homo sapiens
cgtggccttgttctgtcacc

SEQ ID NO: 1979935 - DNA, 13 bp, Homo sapiens
cgtggctgcaaaa

SEQ ID NO: 1979936 - DNA, 12 bp, Homo sapiens
cgtggctgtggc

SEQ ID NO: 1979937 - DNA, 14 bp, Homo sapiens
cgtggtccagctct

SEQ ID NO: 1979938 - DNA, 15 bp, Homo sapiens
cgtggtccagctctt

SEQ ID NO: 1979939 - DNA, 17 bp, Homo sapiens
cgtggtctttgaataaa

SEQ ID NO: 1979940 - DNA, 18 bp, Homo sapiens
cgtggtctttgaataaag

SEQ ID NO: 1979941 - DNA, 20 bp, Homo sapiens
cgtggtctttgaataaagtc

SEQ ID NO: 1979942 - DNA, 21 bp, Homo sapiens
cgtggtgatcaattaaatgta

SEQ ID NO: 1979943 - DNA, 15 bp, Homo sapiens
cgtgtccagcacaga

SEQ ID NO: 1979944 - DNA, 18 bp, Homo sapiens
cgtgtcccaaggagctga

SEQ ID NO: 1979945 - DNA, 23 bp, Homo sapiens
cgtgtctctcccaccccggcctc

SEQ ID NO: 1979946 - DNA, 14 bp, Homo sapiens
cgtgtctctgagga

SEQ ID NO: 1979947 - DNA, 17 bp, Homo sapiens
cgtgtcttcaattaaaa

SEQ ID NO: 1979948 - DNA, 19 bp, Homo sapiens
cgtgttaggaggctgcatg

SEQ ID NO: 1979949 - DNA, 13 bp, Homo sapiens
cgttatatattgt

SEQ ID NO: 1979950 - DNA, 18 bp, Homo sapiens
cgttccaggagcacacgg

SEQ ID NO: 1979951 - DNA, 20 bp, Homo sapiens
cgttccaggagcacacggcc

SEQ ID NO: 1979952 - DNA, 22 bp, Homo sapiens
cgttccaggagcacacggccct

SEQ ID NO: 1979953 - DNA, 14 bp, Homo sapiens
cgttccccttggct

SEQ ID NO: 1979954 - DNA, 18 bp, Homo sapiens
cgttccccttggcttcct

SEQ ID NO: 1979955 - DNA, 18 bp, Homo sapiens
cgttctccagcccacacc

SEQ ID NO: 1979956 - DNA, 12 bp, Homo sapiens
cgttctgctgcc

SEQ ID NO: 1979957 - DNA, 16 bp, Homo sapiens
cgttctgctgcccctg

SEQ ID NO: 1979958 - DNA, 17 bp, Homo sapiens
cgttgacccctttcccc

SEQ ID NO: 1979959 - DNA, 12 bp, Homo sapiens
cgttggagccac

SEQ ID NO: 1979960 - DNA, 13 bp, Homo sapiens
cgttggagccact

SEQ ID NO: 1979961 - DNA, 20 bp, Homo sapiens
cgttggagccactcctgtcc

SEQ ID NO: 1979962 - DNA, 21 bp, Homo sapiens
cgtttagtttctagaggcctc

SEQ ID NO: 1979963 - DNA, 13 bp, Homo sapiens
cgtttattgctta

SEQ ID NO: 1979964 - DNA, 11 bp, Homo sapiens
cgtttccatca

SEQ ID NO: 1979965 - DNA, 13 bp, Homo sapiens
cgtttttgtgctg

SEQ ID NO: 1979966 - DNA, 18 bp, Homo sapiens
cgtttttgtgctgtgggc

SEQ ID NO: 1979967 - DNA, 22 bp, Homo sapiens
ctaaaaaacataaatttcttta

SEQ ID NO: 1979968 - DNA, 15 bp, Homo sapiens
ctaaaaagtggctaa

SEQ ID NO: 1979969 - DNA, 11 bp, Homo sapiens
ctaaaaataaa

SEQ ID NO: 1979970 - DNA, 13 bp, Homo sapiens
ctaaaaataagct

SEQ ID NO: 1979971 - DNA, 13 bp, Homo sapiens
ctaaaaatgcaac

SEQ ID NO: 1979972 - DNA, 22 bp, Homo sapiens
ctaaaacctgagctagaagctg

SEQ ID NO: 1979973 - DNA, 20 bp, Homo sapiens
ctaaaagaatattcagagaa

SEQ ID NO: 1979974 - DNA, 15 bp, Homo sapiens
ctaaaagaatttaaa

SEQ ID NO: 1979975 - DNA, 13 bp, Homo sapiens
ctaaaagtaaaca

SEQ ID NO: 1979976 - DNA, 15 bp, Homo sapiens
ctaaaagtaaacatt

SEQ ID NO: 1979977 - DNA, 19 bp, Homo sapiens
ctaaaatagccacttacct

SEQ ID NO: 1979978 - DNA, 14 bp, Homo sapiens
ctaaaatatttatt

SEQ ID NO: 1979979 - DNA, 15 bp, Homo sapiens
ctaaaatatttattt

SEQ ID NO: 1979980 - DNA, 19 bp, Homo sapiens
cctgggggccagctggtgc

SEQ ID NO: 1979981 - DNA, 12 bp, Homo sapiens
cctgggggcctg

SEQ ID NO: 1979982 - DNA, 15 bp, Homo sapiens
cctgggggcctggct

SEQ ID NO: 1979983 - DNA, 14 bp, Homo sapiens
cctgggggtggcag

SEQ ID NO: 1979984 - DNA, 18 bp, Homo sapiens
cctgggggtggcaggcac

SEQ ID NO: 1979985 - DNA, 22 bp, Homo sapiens
cctgggggttctttcttcctct

SEQ ID NO: 1979986 - DNA, 23 bp, Homo sapiens
cctgggggttctttcttcctctg

SEQ ID NO: 1979987 - DNA, 15 bp, Homo sapiens
cctggggtgacccgg

SEQ ID NO: 1979988 - DNA, 22 bp, Homo sapiens
cctgggtgagaatcctgcctct

SEQ ID NO: 1979989 - DNA, 15 bp, Homo sapiens
cctgggtggctactc

SEQ ID NO: 1979990 - DNA, 19 bp, Homo sapiens
cctgggtggggctgctcct

SEQ ID NO: 1979991 - DNA, 21 bp, Homo sapiens
cctgggtggggctgctcctcc

SEQ ID NO: 1979992 - DNA, 22 bp, Homo sapiens
cctgggtggggctgctcctcca

SEQ ID NO: 1979993 - DNA, 19 bp, Homo sapiens
cctgggttttctaactgta

SEQ ID NO: 1979994 - DNA, 21 bp, Homo sapiens
cctgggttttctaactgtaaa

SEQ ID NO: 1979995 - DNA, 15 bp, Homo sapiens
cctggtaggaaagca

SEQ ID NO: 1979996 - DNA, 21 bp, Homo sapiens
cctggtcacaggactctgcct

SEQ ID NO: 1979997 - DNA, 21 bp, Homo sapiens
cctggtccctcgtccacaggg

SEQ ID NO: 1979998 - DNA, 16 bp, Homo sapiens
cctggtcctagacata

SEQ ID NO: 1979999 - DNA, 18 bp, Homo sapiens
cctggtccttccaggccc

SEQ ID NO: 1980000 - DNA, 12 bp, Homo sapiens
cctggtctcctc

SEQ ID NO: 1980001 - DNA, 14 bp, Homo sapiens
cctggtctgccctg

SEQ ID NO: 1980002 - DNA, 15 bp, Homo sapiens
cctggtctgccctgg

SEQ ID NO: 1980003 - DNA, 23 bp, Homo sapiens
cctggtctgctcaggaattgaag

SEQ ID NO: 1980004 - DNA, 18 bp, Homo sapiens
cctggtctgtgctgccct

SEQ ID NO: 1980005 - DNA, 17 bp, Homo sapiens
cctggtgaggcccagcc

SEQ ID NO: 1980006 - DNA, 22 bp, Homo sapiens
cctggtgattctgatgcagcct

SEQ ID NO: 1980007 - DNA, 15 bp, Homo sapiens
cctggtgcagaggtg

SEQ ID NO: 1980008 - DNA, 21 bp, Homo sapiens
cctggtgcagaggtgagcaga

SEQ ID NO: 1980009 - DNA, 20 bp, Homo sapiens
cctggtgcttctcctctcct

SEQ ID NO: 1980010 - DNA, 13 bp, Homo sapiens
cctggtggcacca

SEQ ID NO: 1980011 - DNA, 15 bp, Homo sapiens
cctggtggcaccaga

SEQ ID NO: 1980012 - DNA, 18 bp, Homo sapiens
cctggtggcagctgcggt

SEQ ID NO: 1980013 - DNA, 16 bp, Homo sapiens
cctggtggggcagctc

SEQ ID NO: 1980014 - DNA, 19 bp, Homo sapiens
cctggtggggcagctcctc

SEQ ID NO: 1980015 - DNA, 23 bp, Homo sapiens
cctggtggggcagctcctctgtc

SEQ ID NO: 1980016 - DNA, 20 bp, Homo sapiens
cctggttgacccaaaaatgt

SEQ ID NO: 1980017 - DNA, 22 bp, Homo sapiens
cctggttggccgtggtccagct

SEQ ID NO: 1980018 - DNA, 18 bp, Homo sapiens
cctgtaaagggtcagggt

SEQ ID NO: 1980019 - DNA, 21 bp, Homo sapiens
cctgtaaatagttttaaatat

SEQ ID NO: 1980020 - DNA, 20 bp, Homo sapiens
cctgtaacacaagccacaga

SEQ ID NO: 1980021 - DNA, 22 bp, Homo sapiens
cctgtaacacaagccacagaag

SEQ ID NO: 1980022 - DNA, 16 bp, Homo sapiens
cctgtaatcccagcac

SEQ ID NO: 1980023 - DNA, 16 bp, Homo sapiens
cctgtaatcccagcta

SEQ ID NO: 1980024 - DNA, 22 bp, Homo sapiens
cctgtaatcccagctacacctg

SEQ ID NO: 1980025 - DNA, 23 bp, Homo sapiens
cctgtaatcccagctactcagga

SEQ ID NO: 1980026 - DNA, 15 bp, Homo sapiens
cctgtactcaggagg

SEQ ID NO: 1980027 - DNA, 14 bp, Homo sapiens
cctgtactgcctgc

SEQ ID NO: 1980028 - DNA, 14 bp, Homo sapiens
cctgtagagctaga

SEQ ID NO: 1980029 - DNA, 21 bp, Homo sapiens
cctgtagcagtgagaaaaagc

SEQ ID NO: 1980030 - DNA, 15 bp, Homo sapiens
cctgtagcatcttct

SEQ ID NO: 1980031 - DNA, 18 bp, Homo sapiens
cctgtagcatcttctgga

SEQ ID NO: 1980032 - DNA, 13 bp, Homo sapiens
cctgtagctctgc

SEQ ID NO: 1980033 - DNA, 14 bp, Homo sapiens
cctgtagctctgcc

SEQ ID NO: 1980034 - DNA, 13 bp, Homo sapiens
cctgtagtcccag

SEQ ID NO: 1980035 - DNA, 13 bp, Homo sapiens
cctgtagtgagaa

SEQ ID NO: 1980036 - DNA, 14 bp, Homo sapiens
cctgtagtgagaaa

SEQ ID NO: 1980037 - DNA, 23 bp, Homo sapiens
cctgtagtgccccctctaacccc

SEQ ID NO: 1980038 - DNA, 16 bp, Homo sapiens
cctgtagttaggaaat

SEQ ID NO: 1980039 - DNA, 21 bp, Homo sapiens
cctgtagttaggaaataaaac

SEQ ID NO: 1980040 - DNA, 22 bp, Homo sapiens
cctgtagttaggaaataaaacc

SEQ ID NO: 1980041 - DNA, 20 bp, Homo sapiens
cctgtagttgcgtggactct

SEQ ID NO: 1980042 - DNA, 21 bp, Homo sapiens
cctgtagttgcgtggactctg

SEQ ID NO: 1980043 - DNA, 22 bp, Homo sapiens
cctgtatagttaggatagcatt

SEQ ID NO: 1980044 - DNA, 17 bp, Homo sapiens
cctgtatataatactaa

SEQ ID NO: 1980045 - DNA, 16 bp, Homo sapiens
cctgtatttgttccca

SEQ ID NO: 1980046 - DNA, 21 bp, Homo sapiens
cctgtatttgttcccaagagc

SEQ ID NO: 1980047 - DNA, 14 bp, Homo sapiens
cctgtcaccaagct

SEQ ID NO: 1980048 - DNA, 13 bp, Homo sapiens
cctgtcaccctgg

SEQ ID NO: 1980049 - DNA, 15 bp, Homo sapiens
cctgtcaccctggcc

SEQ ID NO: 1980050 - DNA, 18 bp, Homo sapiens
cctgtcaccctggcccca

SEQ ID NO: 1980051 - DNA, 13 bp, Homo sapiens
cctgtcagagatc

SEQ ID NO: 1980052 - DNA, 16 bp, Homo sapiens
cctgtcagaggctaag

SEQ ID NO: 1980053 - DNA, 23 bp, Homo sapiens
cctgtccactctcggggcccttg

SEQ ID NO: 1980054 - DNA, 14 bp, Homo sapiens
cctgtccataaagt

SEQ ID NO: 1980055 - DNA, 16 bp, Homo sapiens
cctgtccataaagtaa

SEQ ID NO: 1980056 - DNA, 13 bp, Homo sapiens
cctgtcccacctc

SEQ ID NO: 1980057 - DNA, 14 bp, Homo sapiens
cctgtcccacctct

SEQ ID NO: 1980058 - DNA, 12 bp, Homo sapiens
cctgtcccagca

SEQ ID NO: 1980059 - DNA, 15 bp, Homo sapiens
cctgtcccagcagaa

SEQ ID NO: 1980060 - DNA, 19 bp, Homo sapiens
cctgtcccctgaaaaactg

SEQ ID NO: 1980061 - DNA, 20 bp, Homo sapiens
cctgtcccctgaaaaactga

SEQ ID NO: 1980062 - DNA, 16 bp, Homo sapiens
cctgtccctacccact

SEQ ID NO: 1980063 - DNA, 20 bp, Homo sapiens
cctgtccctacccactcttt

SEQ ID NO: 1980064 - DNA, 14 bp, Homo sapiens
cctgtcccttcttg

SEQ ID NO: 1980065 - DNA, 17 bp, Homo sapiens
cctgtcctcccatcccc

SEQ ID NO: 1980066 - DNA, 21 bp, Homo sapiens
cctgtcctcccatcccctgga

SEQ ID NO: 1980067 - DNA, 22 bp, Homo sapiens
cctgtcctcccatcccctggac

SEQ ID NO: 1980068 - DNA, 23 bp, Homo sapiens
cctgtcctcctcggatcaccgag

SEQ ID NO: 1980069 - DNA, 17 bp, Homo sapiens
cctgtcctttgttatta

SEQ ID NO: 1980070 - DNA, 17 bp, Homo sapiens
cctgtcgagacacttgc

SEQ ID NO: 1980071 - DNA, 14 bp, Homo sapiens
cctgtctccctggg

SEQ ID NO: 1980072 - DNA, 13 bp, Homo sapiens
cctgtctcctttc

SEQ ID NO: 1980073 - DNA, 21 bp, Homo sapiens
cctgtctctagccactttggt

SEQ ID NO: 1980074 - DNA, 14 bp, Homo sapiens
cctgtctgccagcc

SEQ ID NO: 1980075 - DNA, 15 bp, Homo sapiens
cctgtctgccagcca

SEQ ID NO: 1980076 - DNA, 19 bp, Homo sapiens
cctgtctgccagccagcag

SEQ ID NO: 1980077 - DNA, 20 bp, Homo sapiens
cctgtctgccagccagcagc

SEQ ID NO: 1980078 - DNA, 22 bp, Homo sapiens
cctgtcttatggcgttgcaggc

SEQ ID NO: 1980079 - DNA, 22 bp, Homo sapiens
cctgtgaaagactcaatgagct

SEQ ID NO: 1980080 - DNA, 17 bp, Homo sapiens
cctgtgaacccaggaca

SEQ ID NO: 1980081 - DNA, 20 bp, Homo sapiens
cctgtgaataaaaaccctgt

SEQ ID NO: 1980082 - DNA, 14 bp, Homo sapiens
cctgtgacaaaatt

SEQ ID NO: 1980083 - DNA, 15 bp, Homo sapiens
cctgtgactatggct

SEQ ID NO: 1980084 - DNA, 13 bp, Homo sapiens
cctgtgaggcagg

SEQ ID NO: 1980085 - DNA, 23 bp, Homo sapiens
cctgtgcaaattttaaaaaggaa

SEQ ID NO: 1980086 - DNA, 15 bp, Homo sapiens
cctgtgcagcagccc

SEQ ID NO: 1980087 - DNA, 16 bp, Homo sapiens
cctgtgcagcagccca

SEQ ID NO: 1980088 - DNA, 19 bp, Homo sapiens
cctgtgcagcagcccagct

SEQ ID NO: 1980089 - DNA, 14 bp, Homo sapiens
cctgtgcagtcccg

SEQ ID NO: 1980090 - DNA, 13 bp, Homo sapiens
cctgtgccacctg

SEQ ID NO: 1980091 - DNA, 11 bp, Homo sapiens
cctgtgccagc

SEQ ID NO: 1980092 - DNA, 14 bp, Homo sapiens
cctgtgccagctca

SEQ ID NO: 1980093 - DNA, 15 bp, Homo sapiens
cctgtgccagctcag

SEQ ID NO: 1980094 - DNA, 13 bp, Homo sapiens
ccttgtgtttctg

SEQ ID NO: 1980095 - DNA, 13 bp, Homo sapiens
cctttaaaaaagc

SEQ ID NO: 1980096 - DNA, 17 bp, Homo sapiens
cctttacctaccacctt

SEQ ID NO: 1980097 - DNA, 15 bp, Homo sapiens
cctttacttgacctc

SEQ ID NO: 1980098 - DNA, 16 bp, Homo sapiens
cctttaggcagcctgc

SEQ ID NO: 1980099 - DNA, 21 bp, Homo sapiens
cctttatgagtcagtctctct

SEQ ID NO: 1980100 - DNA, 16 bp, Homo sapiens
cctttattaatgaact

SEQ ID NO: 1980101 - DNA, 17 bp, Homo sapiens
cctttattaatgaactg

SEQ ID NO: 1980102 - DNA, 23 bp, Homo sapiens
cctttattaatgaactgtgacag

SEQ ID NO: 1980103 - DNA, 17 bp, Homo sapiens
cctttcaaggaaagtga

SEQ ID NO: 1980104 - DNA, 11 bp, Homo sapiens
cctttccataa

SEQ ID NO: 1980105 - DNA, 17 bp, Homo sapiens
cctttcccatgctgaat

SEQ ID NO: 1980106 - DNA, 20 bp, Homo sapiens
cctttcccatgctgaattat

SEQ ID NO: 1980107 - DNA, 20 bp, Homo sapiens
cctttcccccaccccagagt

SEQ ID NO: 1980108 - DNA, 12 bp, Homo sapiens
cctttccttcct

SEQ ID NO: 1980109 - DNA, 13 bp, Homo sapiens
cctttccttcctt

SEQ ID NO: 1980110 - DNA, 17 bp, Homo sapiens
cctttctccagccagca

SEQ ID NO: 1980111 - DNA, 22 bp, Homo sapiens
cctttctccagccagcaatgat

SEQ ID NO: 1980112 - DNA, 16 bp, Homo sapiens
cctttctctggctcca

SEQ ID NO: 1980113 - DNA, 17 bp, Homo sapiens
cctttctctggctccag

SEQ ID NO: 1980114 - DNA, 18 bp, Homo sapiens
cctttctctggctccaga

SEQ ID NO: 1980115 - DNA, 12 bp, Homo sapiens
cctttctggacc

SEQ ID NO: 1980116 - DNA, 14 bp, Homo sapiens
cctttctggaccag

SEQ ID NO: 1980117 - DNA, 14 bp, Homo sapiens
cctttctggctctc

SEQ ID NO: 1980118 - DNA, 16 bp, Homo sapiens
cctttgaatcctctct

SEQ ID NO: 1980119 - DNA, 14 bp, Homo sapiens
cctttgagaaagaa

SEQ ID NO: 1980120 - DNA, 18 bp, Homo sapiens
cctttgagaatgtgattc

SEQ ID NO: 1980121 - DNA, 22 bp, Homo sapiens
cctttgagggcagtggggagca

SEQ ID NO: 1980122 - DNA, 13 bp, Homo sapiens
cctttgcactgag

SEQ ID NO: 1980123 - DNA, 19 bp, Homo sapiens
cctttgcactgagggccac

SEQ ID NO: 1980124 - DNA, 15 bp, Homo sapiens
cctttgcaggcccag

SEQ ID NO: 1980125 - DNA, 18 bp, Homo sapiens
cctttgcaggcccagcag

SEQ ID NO: 1980126 - DNA, 20 bp, Homo sapiens
cctttgcattccatgatttt

SEQ ID NO: 1980127 - DNA, 15 bp, Homo sapiens
cctttgccctgtcac

SEQ ID NO: 1980128 - DNA, 19 bp, Homo sapiens
cctttgggaggctgaggcg

SEQ ID NO: 1980129 - DNA, 15 bp, Homo sapiens
cctttgggtactact

SEQ ID NO: 1980130 - DNA, 22 bp, Homo sapiens
cctttgggtactactgctgcaa

SEQ ID NO: 1980131 - DNA, 19 bp, Homo sapiens
cctttgtcatcattgtata

SEQ ID NO: 1980132 - DNA, 23 bp, Homo sapiens
cctttgtcatcattgtatatatg

SEQ ID NO: 1980133 - DNA, 18 bp, Homo sapiens
cctttgtcatctttcttc

SEQ ID NO: 1980134 - DNA, 12 bp, Homo sapiens
cctttgtgtaat

SEQ ID NO: 1980135 - DNA, 20 bp, Homo sapiens
cctttgttttgcactgacaa

SEQ ID NO: 1980136 - DNA, 19 bp, Homo sapiens
cctttgtttttatgaagaa

SEQ ID NO: 1980137 - DNA, 13 bp, Homo sapiens
ccttttacagctc

SEQ ID NO: 1980138 - DNA, 16 bp, Homo sapiens
ccttttatagctatta

SEQ ID NO: 1980139 - DNA, 23 bp, Homo sapiens
ccttttcccaaaatgttgaaata

SEQ ID NO: 1980140 - DNA, 14 bp, Homo sapiens
ccttttctctccca

SEQ ID NO: 1980141 - DNA, 12 bp, Homo sapiens
ccttttcttcct

SEQ ID NO: 1980142 - DNA, 14 bp, Homo sapiens
ccttttctttttcc

SEQ ID NO: 1980143 - DNA, 20 bp, Homo sapiens
ccttttctttttcccttgaa

SEQ ID NO: 1980144 - DNA, 23 bp, Homo sapiens
ccttttgaagtagtttgtataac

SEQ ID NO: 1980145 - DNA, 13 bp, Homo sapiens
ccttttgctgctg

SEQ ID NO: 1980146 - DNA, 12 bp, Homo sapiens
ccttttggcact

SEQ ID NO: 1980147 - DNA, 15 bp, Homo sapiens
ccttttgtccccagg

SEQ ID NO: 1980148 - DNA, 19 bp, Homo sapiens
ccttttgtccccagggccc

SEQ ID NO: 1980149 - DNA, 11 bp, Homo sapiens
ccttttgtgta

SEQ ID NO: 1980150 - DNA, 16 bp, Homo sapiens
cctttttctacctttt

SEQ ID NO: 1980151 - DNA, 16 bp, Homo sapiens
cctttttctttataaa

SEQ ID NO: 1980152 - DNA, 22 bp, Homo sapiens
cctttttgacttttccaagccc

SEQ ID NO: 1980153 - DNA, 15 bp, Homo sapiens
ccttttttcacagcc

SEQ ID NO: 1980154 - DNA, 21 bp, Homo sapiens
cgaaaacgttgacccctttcc

SEQ ID NO: 1980155 - DNA, 22 bp, Homo sapiens
cgaaaacgttgacccctttccc

SEQ ID NO: 1980156 - DNA, 23 bp, Homo sapiens
cgaaaacgttgacccctttcccc

SEQ ID NO: 1980157 - DNA, 18 bp, Homo sapiens
cgaaaattcatttcacat

SEQ ID NO: 1980158 - DNA, 18 bp, Homo sapiens
cgaaacaacttgtgttct

SEQ ID NO: 1980159 - DNA, 10 bp, Homo sapiens
cgaaagctga

SEQ ID NO: 1980160 - DNA, 23 bp, Homo sapiens
cgaaagggacttggaagctccgc

SEQ ID NO: 1980161 - DNA, 14 bp, Homo sapiens
cgaaatgttatttt

SEQ ID NO: 1980162 - DNA, 22 bp, Homo sapiens
cgaaatgttattttttaattat

SEQ ID NO: 1980163 - DNA, 21 bp, Homo sapiens
cgaacatgcctgattttaaaa

SEQ ID NO: 1980164 - DNA, 16 bp, Homo sapiens
cgaaccaaggcagcct

SEQ ID NO: 1980165 - DNA, 14 bp, Homo sapiens
cgaaccaatatttg

SEQ ID NO: 1980166 - DNA, 23 bp, Homo sapiens
cgaacccacctgctgagagaccc

SEQ ID NO: 1980167 - DNA, 20 bp, Homo sapiens
cgaacccctcccctcccccc

SEQ ID NO: 1980168 - DNA, 14 bp, Homo sapiens
cgaactggctgcaa

SEQ ID NO: 1980169 - DNA, 13 bp, Homo sapiens
cgaactgtcctgg

SEQ ID NO: 1980170 - DNA, 13 bp, Homo sapiens
cgaagacacagac

SEQ ID NO: 1980171 - DNA, 12 bp, Homo sapiens
cgaagagccctg

SEQ ID NO: 1980172 - DNA, 16 bp, Homo sapiens
cgaagagccctgagct

SEQ ID NO: 1980173 - DNA, 17 bp, Homo sapiens
cgaagagccctgagctc

SEQ ID NO: 1980174 - DNA, 22 bp, Homo sapiens
cgaagagggaatggatggggag

SEQ ID NO: 1980175 - DNA, 13 bp, Homo sapiens
cgaagcagagagg

SEQ ID NO: 1980176 - DNA, 15 bp, Homo sapiens
cgaagcccttccagt

SEQ ID NO: 1980177 - DNA, 18 bp, Homo sapiens
cgaagcccttccagtggt

SEQ ID NO: 1980178 - DNA, 22 bp, Homo sapiens
cgaagcccttccagtggtacca

SEQ ID NO: 1980179 - DNA, 11 bp, Homo sapiens
cgaagtggctc

SEQ ID NO: 1980180 - DNA, 12 bp, Homo sapiens
cgaataaatgtt

SEQ ID NO: 1980181 - DNA, 13 bp, Homo sapiens
cgaataaatgttc

SEQ ID NO: 1980182 - DNA, 15 bp, Homo sapiens
cgaataaatgttcaa

SEQ ID NO: 1980183 - DNA, 16 bp, Homo sapiens
cgaatagctgggacta

SEQ ID NO: 1980184 - DNA, 14 bp, Homo sapiens
cgaatctacagaac

SEQ ID NO: 1980185 - DNA, 12 bp, Homo sapiens
cgaatgacactg

SEQ ID NO: 1980186 - DNA, 16 bp, Homo sapiens
cgaatgacactgttca

SEQ ID NO: 1980187 - DNA, 22 bp, Homo sapiens
cgaattaatagcttttattgta

SEQ ID NO: 1980188 - DNA, 23 bp, Homo sapiens
cgaattttattttacagagcttg

SEQ ID NO: 1980189 - DNA, 20 bp, Homo sapiens
cgacaaagggaaggctgctg

SEQ ID NO: 1980190 - DNA, 13 bp, Homo sapiens
cgacactgctgca

SEQ ID NO: 1980191 - DNA, 19 bp, Homo sapiens
cgacaggcatgcaccagtg

SEQ ID NO: 1980192 - DNA, 17 bp, Homo sapiens
cgaccacttttcagttc

SEQ ID NO: 1980193 - DNA, 23 bp, Homo sapiens
cgaccagacaccttgacagggca

SEQ ID NO: 1980194 - DNA, 15 bp, Homo sapiens
cgaccagagccccac

SEQ ID NO: 1980195 - DNA, 15 bp, Homo sapiens
cgaccatgtgtagat

SEQ ID NO: 1980196 - DNA, 13 bp, Homo sapiens
cgaccccatctca

SEQ ID NO: 1980197 - DNA, 13 bp, Homo sapiens
cgacccctcagtg

SEQ ID NO: 1980198 - DNA, 16 bp, Homo sapiens
cgacccctcagtgctc

SEQ ID NO: 1980199 - DNA, 14 bp, Homo sapiens
cgacctcagccttc

SEQ ID NO: 1980200 - DNA, 13 bp, Homo sapiens
cgactagcaggca

SEQ ID NO: 1980201 - DNA, 14 bp, Homo sapiens
cgactcagggacct

SEQ ID NO: 1980202 - DNA, 14 bp, Homo sapiens
cgactccagccagc

SEQ ID NO: 1980203 - DNA, 17 bp, Homo sapiens
cgactccagccagcgcc

SEQ ID NO: 1980204 - DNA, 13 bp, Homo sapiens
cgactcttcctgc

SEQ ID NO: 1980205 - DNA, 15 bp, Homo sapiens
cgactcttcctgcaa

SEQ ID NO: 1980206 - DNA, 18 bp, Homo sapiens
cgactcttcctgcaaagg

SEQ ID NO: 1980207 - DNA, 14 bp, Homo sapiens
cgactgcaacagga

SEQ ID NO: 1980208 - DNA, 13 bp, Homo sapiens
cgacttcctctcc

SEQ ID NO: 1980209 - DNA, 22 bp, Homo sapiens
cgacttcctctccagccttctc

SEQ ID NO: 1980210 - DNA, 12 bp, Homo sapiens
cgggccacagag

SEQ ID NO: 1980211 - DNA, 14 bp, Homo sapiens
cgggccacagagaa

SEQ ID NO: 1980212 - DNA, 20 bp, Homo sapiens
cgggccactccttcctgccc

SEQ ID NO: 1980213 - DNA, 13 bp, Homo sapiens
cgggcctcagttt

SEQ ID NO: 1980214 - DNA, 16 bp, Homo sapiens
cgggcctcttccctca

SEQ ID NO: 1980215 - DNA, 13 bp, Homo sapiens
cgggcctgcctct

SEQ ID NO: 1980216 - DNA, 23 bp, Homo sapiens
cgggcgcctgtagtcccagccac

SEQ ID NO: 1980217 - DNA, 19 bp, Homo sapiens
cgggcgctgtggctcctgc

SEQ ID NO: 1980218 - DNA, 15 bp, Homo sapiens
cgggctctggccacc

SEQ ID NO: 1980219 - DNA, 16 bp, Homo sapiens
cgggctctggccaccc

SEQ ID NO: 1980220 - DNA, 23 bp, Homo sapiens
cgggctctggccaccctggcccg

SEQ ID NO: 1980221 - DNA, 22 bp, Homo sapiens
cgggctgcccttcgctgccagg

SEQ ID NO: 1980222 - DNA, 17 bp, Homo sapiens
cgggcttgggccctgca

SEQ ID NO: 1980223 - DNA, 18 bp, Homo sapiens
cgggcttgggccctgcac

SEQ ID NO: 1980224 - DNA, 17 bp, Homo sapiens
cggggaactggccaagc

SEQ ID NO: 1980225 - DNA, 22 bp, Homo sapiens
cggggaggtgcctgagctgggg

SEQ ID NO: 1980226 - DNA, 15 bp, Homo sapiens
cggggcagagccacc

SEQ ID NO: 1980227 - DNA, 17 bp, Homo sapiens
cggggcaggaggcctgg

SEQ ID NO: 1980228 - DNA, 17 bp, Homo sapiens
cggggcatgctggggca

SEQ ID NO: 1980229 - DNA, 18 bp, Homo sapiens
cggggcccttggggcctg

SEQ ID NO: 1980230 - DNA, 22 bp, Homo sapiens
cggggcccttggggcctggctt

SEQ ID NO: 1980231 - DNA, 18 bp, Homo sapiens
cggggcgacccctcagtg

SEQ ID NO: 1980232 - DNA, 11 bp, Homo sapiens
cggggctggca

SEQ ID NO: 1980233 - DNA, 19 bp, Homo sapiens
cggggctggcaagcaggga

SEQ ID NO: 1980234 - DNA, 14 bp, Homo sapiens
cggggcttctgggt

SEQ ID NO: 1980235 - DNA, 19 bp, Homo sapiens
cggggcttctgggtggctc

SEQ ID NO: 1980236 - DNA, 21 bp, Homo sapiens
cggggcttctgggtggctcct

SEQ ID NO: 1980237 - DNA, 18 bp, Homo sapiens
cgggggagctggaaataa

SEQ ID NO: 1980238 - DNA, 14 bp, Homo sapiens
cgggggaggaaggg

SEQ ID NO: 1980239 - DNA, 21 bp, Homo sapiens
cgggggccagacacagataca

SEQ ID NO: 1980240 - DNA, 18 bp, Homo sapiens
cggggtgcacaggagggg

SEQ ID NO: 1980241 - DNA, 14 bp, Homo sapiens
cgggtacctcagtt

SEQ ID NO: 1980242 - DNA, 23 bp, Homo sapiens
cgggtggaaaagaatccctgcag

SEQ ID NO: 1980243 - DNA, 14 bp, Homo sapiens
cgggtgggcctggc

SEQ ID NO: 1980244 - DNA, 19 bp, Homo sapiens
cgggtgggcctggcctgag

SEQ ID NO: 1980245 - DNA, 17 bp, Homo sapiens
cgggtgtgcctgccctg

SEQ ID NO: 1980246 - DNA, 16 bp, Homo sapiens
cgggtgtggcctcagc

SEQ ID NO: 1980247 - DNA, 17 bp, Homo sapiens
cgggtgtggcctcagcc

SEQ ID NO: 1980248 - DNA, 18 bp, Homo sapiens
cgggtgtggcctcagccc

SEQ ID NO: 1980249 - DNA, 19 bp, Homo sapiens
cgggtgtggcctcagccct

SEQ ID NO: 1980250 - DNA, 22 bp, Homo sapiens
cgggtgtggcctcagccctcag

SEQ ID NO: 1980251 - DNA, 16 bp, Homo sapiens
cgggttgtgtgtctgt

SEQ ID NO: 1980252 - DNA, 22 bp, Homo sapiens
cggtcaaaatattttttaaagt

SEQ ID NO: 1980253 - DNA, 14 bp, Homo sapiens
cggtcatgtgtgca

SEQ ID NO: 1980254 - DNA, 17 bp, Homo sapiens
cggtcatgtgtgcatgt

SEQ ID NO: 1980255 - DNA, 14 bp, Homo sapiens
cggtccacccagga

SEQ ID NO: 1980256 - DNA, 20 bp, Homo sapiens
cggtccacccaggagccccg

SEQ ID NO: 1980257 - DNA, 19 bp, Homo sapiens
cggtcccttgagacctcag

SEQ ID NO: 1980258 - DNA, 20 bp, Homo sapiens
cggtcctttaggcagcctgc

SEQ ID NO: 1980259 - DNA, 21 bp, Homo sapiens
cggtcctttaggcagcctgcc

SEQ ID NO: 1980260 - DNA, 22 bp, Homo sapiens
cggtcctttaggcagcctgccg

SEQ ID NO: 1980261 - DNA, 22 bp, Homo sapiens
cggtcgggttttattgtttaaa

SEQ ID NO: 1980262 - DNA, 21 bp, Homo sapiens
cggtgagaggggaacagactg

SEQ ID NO: 1980263 - DNA, 14 bp, Homo sapiens
cggtgaggccgggc

SEQ ID NO: 1980264 - DNA, 19 bp, Homo sapiens
cggtgcctgggtggggctg

SEQ ID NO: 1980265 - DNA, 18 bp, Homo sapiens
cggtgcgtggctgtggca

SEQ ID NO: 1980266 - DNA, 24 bp, Homo sapiens
cggtgcgtggctgtggcacagact

SEQ ID NO: 1980267 - DNA, 13 bp, Homo sapiens
cggtgctctggcg

SEQ ID NO: 1980268 - DNA, 16 bp, Homo sapiens
cggtggacccagacac

SEQ ID NO: 1980269 - DNA, 12 bp, Homo sapiens
cggtggccatgc

SEQ ID NO: 1980270 - DNA, 13 bp, Homo sapiens
cggtggccatgct

SEQ ID NO: 1980271 - DNA, 11 bp, Homo sapiens
cggtggctcac

SEQ ID NO: 1980272 - DNA, 22 bp, Homo sapiens
cggtggctcacgcctgtaatcc

SEQ ID NO: 1980273 - DNA, 20 bp, Homo sapiens
cggtggctcttgcctgtaat

SEQ ID NO: 1980274 - DNA, 16 bp, Homo sapiens
cggtgggacagcccca

SEQ ID NO: 1980275 - DNA, 20 bp, Homo sapiens
cggtgggacagccccagggc

SEQ ID NO: 1980276 - DNA, 16 bp, Homo sapiens
cggtggtgccagaggt

SEQ ID NO: 1980277 - DNA, 14 bp, Homo sapiens
cggtgtaaaaccat

SEQ ID NO: 1980278 - DNA, 17 bp, Homo sapiens
cggtgtgcctgcagccc

SEQ ID NO: 1980279 - DNA, 14 bp, Homo sapiens
cggtgttgcagaga

SEQ ID NO: 1980280 - DNA, 16 bp, Homo sapiens
cggttaacttgtatat

SEQ ID NO: 1980281 - DNA, 18 bp, Homo sapiens
cggttccacgtccccctg

SEQ ID NO: 1980282 - DNA, 19 bp, Homo sapiens
cggttccacgtccccctgg

SEQ ID NO: 1980283 - DNA, 19 bp, Homo sapiens
cggttgcttctggctcctc

SEQ ID NO: 1980284 - DNA, 15 bp, Homo sapiens
cggtttccaggaaga

SEQ ID NO: 1980285 - DNA, 15 bp, Homo sapiens
cgtaaccacggaaaa

SEQ ID NO: 1980286 - DNA, 17 bp, Homo sapiens
cgtaagatggcttattt

SEQ ID NO: 1980287 - DNA, 21 bp, Homo sapiens
cgtaatgcttagagaatgttc

SEQ ID NO: 1980288 - DNA, 16 bp, Homo sapiens
cgtaatgggcctgccc

SEQ ID NO: 1980289 - DNA, 14 bp, Homo sapiens
cgtaattttattat

SEQ ID NO: 1980290 - DNA, 17 bp, Homo sapiens
cgtacattcaatgttta

SEQ ID NO: 1980291 - DNA, 12 bp, Homo sapiens
cgtaccagccag

SEQ ID NO: 1980292 - DNA, 13 bp, Homo sapiens
cgtaccagccagg

SEQ ID NO: 1980293 - DNA, 14 bp, Homo sapiens
cgtaccagccagga

SEQ ID NO: 1980294 - DNA, 20 bp, Homo sapiens
cgtacccccgtggtctttga

SEQ ID NO: 1980295 - DNA, 14 bp, Homo sapiens
cgtacttaactgtg

SEQ ID NO: 1980296 - DNA, 19 bp, Homo sapiens
cgtagagcctggaagggaa

SEQ ID NO: 1980297 - DNA, 20 bp, Homo sapiens
cgtagccaaggtgggctgag

SEQ ID NO: 1980298 - DNA, 14 bp, Homo sapiens
cgtaggcagcctct

SEQ ID NO: 1980299 - DNA, 21 bp, Homo sapiens
cgtaggcagcctctctgctat

SEQ ID NO: 1980300 - DNA, 18 bp, Homo sapiens
cgtatcatttctaatttt

SEQ ID NO: 1980301 - DNA, 21 bp, Homo sapiens
cgtatctttaaaaagcagtcc

SEQ ID NO: 1980302 - DNA, 23 bp, Homo sapiens
cgtatgtcggcacgtcccatgtg

SEQ ID NO: 1980303 - DNA, 15 bp, Homo sapiens
cgtatttaatagcaa

SEQ ID NO: 1980304 - DNA, 16 bp, Homo sapiens
cgtatttatatttgga

SEQ ID NO: 1980305 - DNA, 14 bp, Homo sapiens
cgtcaccacctctc

SEQ ID NO: 1980306 - DNA, 12 bp, Homo sapiens
cgtcatctcagg

SEQ ID NO: 1980307 - DNA, 19 bp, Homo sapiens
cgtcatctgcggggcttct

SEQ ID NO: 1980308 - DNA, 20 bp, Homo sapiens
cgtcatctgcggggcttctg

SEQ ID NO: 1980309 - DNA, 19 bp, Homo sapiens
cgtccacaggggcaggcct

SEQ ID NO: 1980310 - DNA, 21 bp, Homo sapiens
cgtccacaggggcaggcctgg

SEQ ID NO: 1980311 - DNA, 23 bp, Homo sapiens
cgtccacaggggcaggcctggga

SEQ ID NO: 1980312 - DNA, 13 bp, Homo sapiens
cgtccacccaggc

SEQ ID NO: 1980313 - DNA, 16 bp, Homo sapiens
cgtccacccaggctgc

SEQ ID NO: 1980314 - DNA, 18 bp, Homo sapiens
cgtccatggcaccagccc

SEQ ID NO: 1980315 - DNA, 23 bp, Homo sapiens
cgtcccccagccctcaggccagt

SEQ ID NO: 1980316 - DNA, 22 bp, Homo sapiens
cgtccccccccaacctttccct

SEQ ID NO: 1980317 - DNA, 15 bp, Homo sapiens
cgtccctagcagtga

SEQ ID NO: 1980318 - DNA, 14 bp, Homo sapiens
cgtccctgcccaga

SEQ ID NO: 1980319 - DNA, 20 bp, Homo sapiens
cgtcccttggaaagttcagc

SEQ ID NO: 1980320 - DNA, 17 bp, Homo sapiens
cgtcctgacgccctgcg

SEQ ID NO: 1980321 - DNA, 14 bp, Homo sapiens
cgtcctgcagagga

SEQ ID NO: 1980322 - DNA, 22 bp, Homo sapiens
ccagaggttttaggaaacctgg

SEQ ID NO: 1980323 - DNA, 16 bp, Homo sapiens
ccagagtctgagcccc

SEQ ID NO: 1980324 - DNA, 17 bp, Homo sapiens
ccagagtctgagccccc

SEQ ID NO: 1980325 - DNA, 18 bp, Homo sapiens
ccagagtctgagcccccg

SEQ ID NO: 1980326 - DNA, 23 bp, Homo sapiens
ccagagtctgagcccccggctag

SEQ ID NO: 1980327 - DNA, 21 bp, Homo sapiens
ccagagtgaaagggctatggc

SEQ ID NO: 1980328 - DNA, 18 bp, Homo sapiens
ccagagtgtgcagactga

SEQ ID NO: 1980329 - DNA, 18 bp, Homo sapiens
ccagagtgtgggaaggga

SEQ ID NO: 1980330 - DNA, 19 bp, Homo sapiens
ccagagttccacaaatcta

SEQ ID NO: 1980331 - DNA, 18 bp, Homo sapiens
ccagatcaccagcccggc

SEQ ID NO: 1980332 - DNA, 21 bp, Homo sapiens
ccagatcaccagcccggcctg

SEQ ID NO: 1980333 - DNA, 17 bp, Homo sapiens
ccagatcctcacaacca

SEQ ID NO: 1980334 - DNA, 17 bp, Homo sapiens
ccagatcctctgctgac

SEQ ID NO: 1980335 - DNA, 16 bp, Homo sapiens
ccagatctgcctgggc

SEQ ID NO: 1980336 - DNA, 19 bp, Homo sapiens
ccagatctgcctgggcctg

SEQ ID NO: 1980337 - DNA, 21 bp, Homo sapiens
ccagatctgcctgggcctgtg

SEQ ID NO: 1980338 - DNA, 24 bp, Homo sapiens
ccagatctgcctgggcctgtgcag

SEQ ID NO: 1980339 - DNA, 14 bp, Homo sapiens
ccagatgcaacctc

SEQ ID NO: 1980340 - DNA, 17 bp, Homo sapiens
ccagatgcaacctcact

SEQ ID NO: 1980341 - DNA, 14 bp, Homo sapiens
ccagatgcaccagc

SEQ ID NO: 1980342 - DNA, 23 bp, Homo sapiens
ccagatgcaccagcccttagcag

SEQ ID NO: 1980343 - DNA, 12 bp, Homo sapiens
ccagatgctggg

SEQ ID NO: 1980344 - DNA, 14 bp, Homo sapiens
ccagatgctgggga

SEQ ID NO: 1980345 - DNA, 20 bp, Homo sapiens
ccagattgcaacaggctggg

SEQ ID NO: 1980346 - DNA, 18 bp, Homo sapiens
ccagcaaaccaggactct

SEQ ID NO: 1980347 - DNA, 13 bp, Homo sapiens
ccagcaacatctc

SEQ ID NO: 1980348 - DNA, 19 bp, Homo sapiens
ccagcaacatctcgagccc

SEQ ID NO: 1980349 - DNA, 23 bp, Homo sapiens
ccagcaacatctcgagccccctg

SEQ ID NO: 1980350 - DNA, 16 bp, Homo sapiens
ccagcaagtgagagct

SEQ ID NO: 1980351 - DNA, 17 bp, Homo sapiens
ccagcaagtttcacctt

SEQ ID NO: 1980352 - DNA, 12 bp, Homo sapiens
ccagcacagaag

SEQ ID NO: 1980353 - DNA, 18 bp, Homo sapiens
ccagcacaggggccccag

SEQ ID NO: 1980354 - DNA, 22 bp, Homo sapiens
ccagcacaggggccccagatct

SEQ ID NO: 1980355 - DNA, 12 bp, Homo sapiens
ccagcaccctct

SEQ ID NO: 1980356 - DNA, 18 bp, Homo sapiens
ccagcaccctctcctggg

SEQ ID NO: 1980357 - DNA, 19 bp, Homo sapiens
ccagcaccctctcctgggg

SEQ ID NO: 1980358 - DNA, 17 bp, Homo sapiens
ccagcactaaagcagtg

SEQ ID NO: 1980359 - DNA, 24 bp, Homo sapiens
ccagcactaaagcagtggacacca

SEQ ID NO: 1980360 - DNA, 22 bp, Homo sapiens
ccagcactaaggccgtgtctct

SEQ ID NO: 1980361 - DNA, 17 bp, Homo sapiens
ccagcactcctctgtct

SEQ ID NO: 1980362 - DNA, 20 bp, Homo sapiens
ccagcactcctctgtctctg

SEQ ID NO: 1980363 - DNA, 10 bp, Homo sapiens
ccagcactga

SEQ ID NO: 1980364 - DNA, 14 bp, Homo sapiens
ccagcactgtgaag

SEQ ID NO: 1980365 - DNA, 18 bp, Homo sapiens
ccagcactgtgaagaccc

SEQ ID NO: 1980366 - DNA, 15 bp, Homo sapiens
ccagcagaagaggga

SEQ ID NO: 1980367 - DNA, 16 bp, Homo sapiens
ccagcagaagagggag

SEQ ID NO: 1980368 - DNA, 16 bp, Homo sapiens
ccagcagacttgagtc

SEQ ID NO: 1980369 - DNA, 12 bp, Homo sapiens
ccagcagcccta

SEQ ID NO: 1980370 - DNA, 21 bp, Homo sapiens
ccagcagccctaaggatctct

SEQ ID NO: 1980371 - DNA, 18 bp, Homo sapiens
ccagcagctgcgggtctg

SEQ ID NO: 1980372 - DNA, 22 bp, Homo sapiens
ccagcagctgggccggccagcc

SEQ ID NO: 1980373 - DNA, 20 bp, Homo sapiens
ccagcaggaagccaggctga

SEQ ID NO: 1980374 - DNA, 20 bp, Homo sapiens
ccagcaggccagggactcag

SEQ ID NO: 1980375 - DNA, 17 bp, Homo sapiens
ccagcatccagcctgtg

SEQ ID NO: 1980376 - DNA, 17 bp, Homo sapiens
ccagcattttactactt

SEQ ID NO: 1980377 - DNA, 13 bp, Homo sapiens
ccagccacacaga

SEQ ID NO: 1980378 - DNA, 22 bp, Homo sapiens
ccagccacacagagcctgcctc

SEQ ID NO: 1980379 - DNA, 23 bp, Homo sapiens
ccagccacctcttgggcatgctc

SEQ ID NO: 1980380 - DNA, 22 bp, Homo sapiens
ccagccagcaatgatgtccaga

SEQ ID NO: 1980381 - DNA, 23 bp, Homo sapiens
ccagccagcagccagctctcagc

SEQ ID NO: 1980382 - DNA, 12 bp, Homo sapiens
ccagccagcgcc

SEQ ID NO: 1980383 - DNA, 13 bp, Homo sapiens
ccagccagcgcct

SEQ ID NO: 1980384 - DNA, 15 bp, Homo sapiens
ccagccagcgcctcc

SEQ ID NO: 1980385 - DNA, 17 bp, Homo sapiens
ccagccagcgcctccct

SEQ ID NO: 1980386 - DNA, 18 bp, Homo sapiens
ccagccaggatcccaagc

SEQ ID NO: 1980387 - DNA, 23 bp, Homo sapiens
ccagccaggatcccaagcgtccc

SEQ ID NO: 1980388 - DNA, 16 bp, Homo sapiens
ccagccagtcttgcct

SEQ ID NO: 1980389 - DNA, 22 bp, Homo sapiens
ccagccagtcttgcctaggcca

SEQ ID NO: 1980390 - DNA, 19 bp, Homo sapiens
ccagccattaccatggaga

SEQ ID NO: 1980391 - DNA, 21 bp, Homo sapiens
ccagccattaccatggagaca

SEQ ID NO: 1980392 - DNA, 14 bp, Homo sapiens
ccagcccacagagc

SEQ ID NO: 1980393 - DNA, 18 bp, Homo sapiens
ccagcccacagagcctga

SEQ ID NO: 1980394 - DNA, 16 bp, Homo sapiens
ccagcccacttctgcc

SEQ ID NO: 1980395 - DNA, 16 bp, Homo sapiens
ccagcccagcccagct

SEQ ID NO: 1980396 - DNA, 21 bp, Homo sapiens
ccagcccattttgaggccaga

SEQ ID NO: 1980397 - DNA, 22 bp, Homo sapiens
ccagccccagcaagagcacaag

SEQ ID NO: 1980398 - DNA, 12 bp, Homo sapiens
ccagccccaggg

SEQ ID NO: 1980399 - DNA, 15 bp, Homo sapiens
ccagccccagtgccc

SEQ ID NO: 1980400 - DNA, 17 bp, Homo sapiens
ccagccccagtgcccac

SEQ ID NO: 1980401 - DNA, 11 bp, Homo sapiens
ccagccccatc

SEQ ID NO: 1980402 - DNA, 13 bp, Homo sapiens
ccagccccctgga

SEQ ID NO: 1980403 - DNA, 23 bp, Homo sapiens
ccagccccctggatgggcattgg

SEQ ID NO: 1980404 - DNA, 17 bp, Homo sapiens
ccagcccctcctcccct

SEQ ID NO: 1980405 - DNA, 20 bp, Homo sapiens
ccagcccctcctccccttcc

SEQ ID NO: 1980406 - DNA, 23 bp, Homo sapiens
ccagcccctcctccccttcctgc

SEQ ID NO: 1980407 - DNA, 20 bp, Homo sapiens
ccagcccggcctgctcccag

SEQ ID NO: 1980408 - DNA, 12 bp, Homo sapiens
ccagccctcagg

SEQ ID NO: 1980409 - DNA, 13 bp, Homo sapiens
ccagccctcaggc

SEQ ID NO: 1980410 - DNA, 19 bp, Homo sapiens
ccagccctcaggccagtgc

SEQ ID NO: 1980411 - DNA, 17 bp, Homo sapiens
ccagccctccctgtcct

SEQ ID NO: 1980412 - DNA, 21 bp, Homo sapiens
ccagccctgccaggaggctgc

SEQ ID NO: 1980413 - DNA, 16 bp, Homo sapiens
ccagccctgcctggag

SEQ ID NO: 1980414 - DNA, 21 bp, Homo sapiens
ccagccctgcctggaggacct

SEQ ID NO: 1980415 - DNA, 22 bp, Homo sapiens
ccagccctgcctggaggacctg

SEQ ID NO: 1980416 - DNA, 17 bp, Homo sapiens
ccagccctggctctgca

SEQ ID NO: 1980417 - DNA, 14 bp, Homo sapiens
ccagccgccctggg

SEQ ID NO: 1980418 - DNA, 19 bp, Homo sapiens
ccagccgggtacctcagtt

SEQ ID NO: 1980419 - DNA, 23 bp, Homo sapiens
ccagccgggtacctcagtttctc

SEQ ID NO: 1980420 - DNA, 14 bp, Homo sapiens
ccagccggtgcctg

SEQ ID NO: 1980421 - DNA, 16 bp, Homo sapiens
ccagccggtgcctggc

SEQ ID NO: 1980422 - DNA, 21 bp, Homo sapiens
ccagcctaagaagctctggcc

SEQ ID NO: 1980423 - DNA, 12 bp, Homo sapiens
ccagcctaccct

SEQ ID NO: 1980424 - DNA, 10 bp, Homo sapiens
ccagcctcag

SEQ ID NO: 1980425 - DNA, 16 bp, Homo sapiens
ccagcctcagctcagc

SEQ ID NO: 1980426 - DNA, 18 bp, Homo sapiens
ccagcctcagctcagcct

SEQ ID NO: 1980427 - DNA, 19 bp, Homo sapiens
ccagcctcagctcagcctc

SEQ ID NO: 1980428 - DNA, 15 bp, Homo sapiens
ccagcctcagtgcca

SEQ ID NO: 1980429 - DNA, 18 bp, Homo sapiens
ccagcctcagtgccactt

SEQ ID NO: 1980430 - DNA, 19 bp, Homo sapiens
ccagcctcagtgccacttg

SEQ ID NO: 1980431 - DNA, 16 bp, Homo sapiens
ccagcctccatgctgc

SEQ ID NO: 1980432 - DNA, 14 bp, Homo sapiens
ccagcctcctccca

SEQ ID NO: 1980433 - DNA, 22 bp, Homo sapiens
ccagcctctcccggctgcctgc

SEQ ID NO: 1980434 - DNA, 12 bp, Homo sapiens
ccagcctctgtc

SEQ ID NO: 1980435 - DNA, 20 bp, Homo sapiens
ccagcctggcctcctgcctc

SEQ ID NO: 1980436 - DNA, 18 bp, Homo sapiens
ccagcctggcttctggag

SEQ ID NO: 1980437 - DNA, 21 bp, Homo sapiens
ccagcctggcttctggagccc

SEQ ID NO: 1980438 - DNA, 14 bp, Homo sapiens
ccagcctgggactc

SEQ ID NO: 1980439 - DNA, 12 bp, Homo sapiens
ccagcctgggcc

SEQ ID NO: 1980440 - DNA, 17 bp, Homo sapiens
ccagcctgggcctatgg

SEQ ID NO: 1980441 - DNA, 16 bp, Homo sapiens
ccagcctgggcgacag

SEQ ID NO: 1980442 - DNA, 14 bp, Homo sapiens
ccagcgagccctgg

SEQ ID NO: 1980443 - DNA, 22 bp, Homo sapiens
ccagcgattccctctcccaggc

SEQ ID NO: 1980444 - DNA, 22 bp, Homo sapiens
ccagcgcctagtggggtctccc

SEQ ID NO: 1980445 - DNA, 23 bp, Homo sapiens
ccagcgcctccctccaccccagg

SEQ ID NO: 1980446 - DNA, 21 bp, Homo sapiens
ccagcgcctgccctccctggg

SEQ ID NO: 1980447 - DNA, 20 bp, Homo sapiens
ccagcgcggcttggccgcca

SEQ ID NO: 1980448 - DNA, 23 bp, Homo sapiens
ccagctaactccagtctcctgac

SEQ ID NO: 1980449 - DNA, 13 bp, Homo sapiens
ccagctacattcc

SEQ ID NO: 1980450 - DNA, 14 bp, Homo sapiens
ccagctacattcct

SEQ ID NO: 1980451 - DNA, 14 bp, Homo sapiens
ccagctactcagaa

SEQ ID NO: 1980452 - DNA, 19 bp, Homo sapiens
ccagctactcaggaggctg

SEQ ID NO: 1980453 - DNA, 20 bp, Homo sapiens
ccagctactcgggaggctga

SEQ ID NO: 1980454 - DNA, 21 bp, Homo sapiens
ccagctactctgtccaggcca

SEQ ID NO: 1980455 - DNA, 22 bp, Homo sapiens
ccagctactctgtccaggccac

SEQ ID NO: 1980456 - DNA, 23 bp, Homo sapiens
ccagctactctgtccaggccact

SEQ ID NO: 1980457 - DNA, 20 bp, Homo sapiens
ccagctacttgggaggctga

SEQ ID NO: 1980458 - DNA, 20 bp, Homo sapiens
ccagctagccaactcctcct

SEQ ID NO: 1980459 - DNA, 15 bp, Homo sapiens
ccagctagggctgga

SEQ ID NO: 1980460 - DNA, 20 bp, Homo sapiens
ccagctagggctggactctg

SEQ ID NO: 1980461 - DNA, 20 bp, Homo sapiens
ccagctagtgacccacatgc

SEQ ID NO: 1980462 - DNA, 14 bp, Homo sapiens
ccagctatctgtca

SEQ ID NO: 1980463 - DNA, 21 bp, Homo sapiens
ccagctatctgtcatctctct

SEQ ID NO: 1980464 - DNA, 16 bp, Homo sapiens
ccagctatggccccag

SEQ ID NO: 1980465 - DNA, 19 bp, Homo sapiens
ccagctatggccccagggt

SEQ ID NO: 1980466 - DNA, 18 bp, Homo sapiens
ccagctcacaagcccagg

SEQ ID NO: 1980467 - DNA, 22 bp, Homo sapiens
ccagctcagtcccatcagagag

SEQ ID NO: 1980468 - DNA, 12 bp, Homo sapiens
ccagctccccag

SEQ ID NO: 1980469 - DNA, 14 bp, Homo sapiens
ccagctccctagga

SEQ ID NO: 1980470 - DNA, 15 bp, Homo sapiens
ccagctcctgggcag

SEQ ID NO: 1980471 - DNA, 18 bp, Homo sapiens
ccagctcctgggcagctt

SEQ ID NO: 1980472 - DNA, 21 bp, Homo sapiens
ccagctcctgggcagcttgag

SEQ ID NO: 1980473 - DNA, 12 bp, Homo sapiens
ccagctctcagc

SEQ ID NO: 1980474 - DNA, 16 bp, Homo sapiens
ccagctctccctctgg

SEQ ID NO: 1980475 - DNA, 18 bp, Homo sapiens
ccagctctccctctggcc

SEQ ID NO: 1980476 - DNA, 23 bp, Homo sapiens
ccagctctccctctggccctgcc

SEQ ID NO: 1980477 - DNA, 14 bp, Homo sapiens
ccagctctctctac

SEQ ID NO: 1980478 - DNA, 16 bp, Homo sapiens
ccagctctgtggcctg

SEQ ID NO: 1980479 - DNA, 19 bp, Homo sapiens
ccagctctgtggcctgtgt

SEQ ID NO: 1980480 - DNA, 11 bp, Homo sapiens
ccagctcttgg

SEQ ID NO: 1980481 - DNA, 19 bp, Homo sapiens
ccagctcttggcccctgtg

SEQ ID NO: 1980482 - DNA, 20 bp, Homo sapiens
ccagctctttgttcagttga

SEQ ID NO: 1980483 - DNA, 19 bp, Homo sapiens
ccagctgcacctgccagcc

SEQ ID NO: 1980484 - DNA, 22 bp, Homo sapiens
ccagctgcacctgccagcctgg

SEQ ID NO: 1980485 - DNA, 23 bp, Homo sapiens
ccagctgcacctgccagcctggc

SEQ ID NO: 1980486 - DNA, 12 bp, Homo sapiens
ccagctgcagat

SEQ ID NO: 1980487 - DNA, 23 bp, Homo sapiens
ccagctgcagatgccacacctgc

SEQ ID NO: 1980488 - DNA, 11 bp, Homo sapiens
ccagctgcctt

SEQ ID NO: 1980489 - DNA, 13 bp, Homo sapiens
ccagctgccttcc

SEQ ID NO: 1980490 - DNA, 19 bp, Homo sapiens
ccagctgccttcctcatcc

SEQ ID NO: 1980491 - DNA, 10 bp, Homo sapiens
ccagctgcta

SEQ ID NO: 1980492 - DNA, 15 bp, Homo sapiens
ccagctgctctgccc

SEQ ID NO: 1980493 - DNA, 16 bp, Homo sapiens
ccagctggcctctaga

SEQ ID NO: 1980494 - DNA, 21 bp, Homo sapiens
ccagctggtcttttgggagtg

SEQ ID NO: 1980495 - DNA, 20 bp, Homo sapiens
ccagctggtgctgcaaggaa

SEQ ID NO: 1980496 - DNA, 20 bp, Homo sapiens
ccagctgtagccatggctca

SEQ ID NO: 1980497 - DNA, 24 bp, Homo sapiens
ccagctgtagccatggctcaggca

SEQ ID NO: 1980498 - DNA, 15 bp, Homo sapiens
ccagctgtcgcatct

SEQ ID NO: 1980499 - DNA, 20 bp, Homo sapiens
ccagctgtgctctggacagg

SEQ ID NO: 1980500 - DNA, 19 bp, Homo sapiens
ccagcttcccctcgctgtc

SEQ ID NO: 1980501 - DNA, 23 bp, Homo sapiens
ccagcttcccctcgctgtcctgc

SEQ ID NO: 1980502 - DNA, 17 bp, Homo sapiens
ccagcttctccaggctc

SEQ ID NO: 1980503 - DNA, 18 bp, Homo sapiens
ccagcttctccaggctct

SEQ ID NO: 1980504 - DNA, 15 bp, Homo sapiens
ccagcttgttattta

SEQ ID NO: 1980505 - DNA, 17 bp, Homo sapiens
ccaggaaggcagctgct

SEQ ID NO: 1980506 - DNA, 19 bp, Homo sapiens
ccaggaaggcagctgctct

SEQ ID NO: 1980507 - DNA, 20 bp, Homo sapiens
ccaggaaggcagctgctctt

SEQ ID NO: 1980508 - DNA, 18 bp, Homo sapiens
ccaggaaggtagcccagc

SEQ ID NO: 1980509 - DNA, 20 bp, Homo sapiens
ccaggaatgttaaagtcagt

SEQ ID NO: 1980510 - DNA, 15 bp, Homo sapiens
ccaggacacctgccc

SEQ ID NO: 1980511 - DNA, 20 bp, Homo sapiens
ccaggacacctgccccagcg

SEQ ID NO: 1980512 - DNA, 21 bp, Homo sapiens
ccaggacacctgccccagcgc

SEQ ID NO: 1980513 - DNA, 17 bp, Homo sapiens
ccaggacagctggctgc

SEQ ID NO: 1980514 - DNA, 21 bp, Homo sapiens
ccaggacagctggctgctgac

SEQ ID NO: 1980515 - DNA, 13 bp, Homo sapiens
ccaggacaggccc

SEQ ID NO: 1980516 - DNA, 16 bp, Homo sapiens
ccaggacgaattgaga

SEQ ID NO: 1980517 - DNA, 20 bp, Homo sapiens
ccaggacgccactcatttca

SEQ ID NO: 1980518 - DNA, 21 bp, Homo sapiens
ccaggacgccactcatttcat

SEQ ID NO: 1980519 - DNA, 18 bp, Homo sapiens
ccaggactatagcccagg

SEQ ID NO: 1980520 - DNA, 15 bp, Homo sapiens
ccaggactccccagg

SEQ ID NO: 1980521 - DNA, 21 bp, Homo sapiens
ccaggactccccaggccaggc

SEQ ID NO: 1980522 - DNA, 15 bp, Homo sapiens
ccaggagaagaaaga

SEQ ID NO: 1980523 - DNA, 19 bp, Homo sapiens
ccaggagcaaatgtttctg

SEQ ID NO: 1980524 - DNA, 23 bp, Homo sapiens
ccaggagcaaatgtttctgcagt

SEQ ID NO: 1980525 - DNA, 21 bp, Homo sapiens
ccaggagcacacggccctgcc

SEQ ID NO: 1980526 - DNA, 20 bp, Homo sapiens
ccaggagccccgaggccttc

SEQ ID NO: 1980527 - DNA, 17 bp, Homo sapiens
ccaggagctgagtcacc

SEQ ID NO: 1980528 - DNA, 15 bp, Homo sapiens
ccaggagctggagga

SEQ ID NO: 1980529 - DNA, 14 bp, Homo sapiens
ccaggaggctgcgg

SEQ ID NO: 1980530 - DNA, 15 bp, Homo sapiens
ccaggaggctgcggc

SEQ ID NO: 1980531 - DNA, 24 bp, Homo sapiens
ccaggagggacaaaggagcctgtg

SEQ ID NO: 1980532 - DNA, 17 bp, Homo sapiens
ccaggaggggcctctga

SEQ ID NO: 1980533 - DNA, 18 bp, Homo sapiens
ccaggaggtcctcctctc

SEQ ID NO: 1980534 - DNA, 17 bp, Homo sapiens
ccactgccaggcacctg

SEQ ID NO: 1980535 - DNA, 18 bp, Homo sapiens
ccactgccaggcacctgg

SEQ ID NO: 1980536 - DNA, 24 bp, Homo sapiens
ccactgccaggcacctggcctgct

SEQ ID NO: 1980537 - DNA, 14 bp, Homo sapiens
ccactgctctcagc

SEQ ID NO: 1980538 - DNA, 18 bp, Homo sapiens
ccactgctctcagcctcc

SEQ ID NO: 1980539 - DNA, 11 bp, Homo sapiens
ccactgctctg

SEQ ID NO: 1980540 - DNA, 23 bp, Homo sapiens
ccactggactgggttttgtctct

SEQ ID NO: 1980541 - DNA, 21 bp, Homo sapiens
ccactggacttgagcttggca

SEQ ID NO: 1980542 - DNA, 22 bp, Homo sapiens
ccactggacttgagcttggcag

SEQ ID NO: 1980543 - DNA, 13 bp, Homo sapiens
ccactggccagtc

SEQ ID NO: 1980544 - DNA, 20 bp, Homo sapiens
ccactggccagtcctagagc

SEQ ID NO: 1980545 - DNA, 24 bp, Homo sapiens
ccactggccagtcctagagctcct

SEQ ID NO: 1980546 - DNA, 15 bp, Homo sapiens
ccactgggtctcact

SEQ ID NO: 1980547 - DNA, 15 bp, Homo sapiens
ccactggtttctcag

SEQ ID NO: 1980548 - DNA, 18 bp, Homo sapiens
ccactgtaaaatgaaatt

SEQ ID NO: 1980549 - DNA, 14 bp, Homo sapiens
ccactgtcaccctc

SEQ ID NO: 1980550 - DNA, 22 bp, Homo sapiens
ccactgtccgcctctgcccgca

SEQ ID NO: 1980551 - DNA, 23 bp, Homo sapiens
ccactgtccgcctctgcccgcag

SEQ ID NO: 1980552 - DNA, 14 bp, Homo sapiens
ccactgtcctggct

SEQ ID NO: 1980553 - DNA, 16 bp, Homo sapiens
ccactgtcttgcctgc

SEQ ID NO: 1980554 - DNA, 17 bp, Homo sapiens
ccactgtcttgcctgcc

SEQ ID NO: 1980555 - DNA, 15 bp, Homo sapiens
ccactgtgccatgtg

SEQ ID NO: 1980556 - DNA, 17 bp, Homo sapiens
ccactgtgctgaattct

SEQ ID NO: 1980557 - DNA, 12 bp, Homo sapiens
ccactgtgctta

SEQ ID NO: 1980558 - DNA, 18 bp, Homo sapiens
ccactgtgcttacagtga

SEQ ID NO: 1980559 - DNA, 12 bp, Homo sapiens
ccactgtggcca

SEQ ID NO: 1980560 - DNA, 19 bp, Homo sapiens
ccaaggactttccagtgag

SEQ ID NO: 1980561 - DNA, 18 bp, Homo sapiens
ccaaggagaaacagagac

SEQ ID NO: 1980562 - DNA, 19 bp, Homo sapiens
ccaaggagaaacagagaca

SEQ ID NO: 1980563 - DNA, 13 bp, Homo sapiens
ccaaggaggaaaa

SEQ ID NO: 1980564 - DNA, 15 bp, Homo sapiens
ccaaggcagcctcca

SEQ ID NO: 1980565 - DNA, 16 bp, Homo sapiens
ccaaggcagcctccag

SEQ ID NO: 1980566 - DNA, 21 bp, Homo sapiens
ccaaggcagcctccagagcca

SEQ ID NO: 1980567 - DNA, 11 bp, Homo sapiens
ccaaggcaggt

SEQ ID NO: 1980568 - DNA, 19 bp, Homo sapiens
ccaaggcctttttcataaa

SEQ ID NO: 1980569 - DNA, 13 bp, Homo sapiens
ccaaggctgctca

SEQ ID NO: 1980570 - DNA, 16 bp, Homo sapiens
ccaaggctgctcagag

SEQ ID NO: 1980571 - DNA, 14 bp, Homo sapiens
ccaagggacaaccc

SEQ ID NO: 1980572 - DNA, 16 bp, Homo sapiens
ccaagggacaacccca

SEQ ID NO: 1980573 - DNA, 22 bp, Homo sapiens
ccaagggcggggctatgccttg

SEQ ID NO: 1980574 - DNA, 17 bp, Homo sapiens
ccaaggggacttgtgcc

SEQ ID NO: 1980575 - DNA, 18 bp, Homo sapiens
ccaaggggacttgtgcca

SEQ ID NO: 1980576 - DNA, 21 bp, Homo sapiens
ccaaggggcccacaaagggga

SEQ ID NO: 1980577 - DNA, 23 bp, Homo sapiens
ccaagggttcagagactcagggc

SEQ ID NO: 1980578 - DNA, 18 bp, Homo sapiens
ccaaggtgggctgagccc

SEQ ID NO: 1980579 - DNA, 20 bp, Homo sapiens
ccaaggttactcagcagcag

SEQ ID NO: 1980580 - DNA, 18 bp, Homo sapiens
ccaagtcaacactcttct

SEQ ID NO: 1980581 - DNA, 21 bp, Homo sapiens
ccaagtcaacactcttcttga

SEQ ID NO: 1980582 - DNA, 18 bp, Homo sapiens
ccaagtccaacctgcctg

SEQ ID NO: 1980583 - DNA, 18 bp, Homo sapiens
ccaagtccaggtcctggt

SEQ ID NO: 1980584 - DNA, 22 bp, Homo sapiens
ccaagtcttcagcgagaccctt

SEQ ID NO: 1980585 - DNA, 16 bp, Homo sapiens
ccaagtgccagtcttg

SEQ ID NO: 1980586 - DNA, 13 bp, Homo sapiens
ccaagtggctccc

SEQ ID NO: 1980587 - DNA, 17 bp, Homo sapiens
ccaagttacttgaaaaa

SEQ ID NO: 1980588 - DNA, 17 bp, Homo sapiens
ccaagttatattgaata

SEQ ID NO: 1980589 - DNA, 14 bp, Homo sapiens
ccaataaaaatcct

SEQ ID NO: 1980590 - DNA, 11 bp, Homo sapiens
ccaataaaagt

SEQ ID NO: 1980591 - DNA, 13 bp, Homo sapiens
ccaataaaagtga

SEQ ID NO: 1980592 - DNA, 13 bp, Homo sapiens
ccaataaagctgg

SEQ ID NO: 1980593 - DNA, 20 bp, Homo sapiens
ccaataaatcaactccagct

SEQ ID NO: 1980594 - DNA, 19 bp, Homo sapiens
ccaataacttcagagaagt

SEQ ID NO: 1980595 - DNA, 20 bp, Homo sapiens
ccaataacttcagagaagtc

SEQ ID NO: 1980596 - DNA, 23 bp, Homo sapiens
ccaatacatggtgtatagcacca

SEQ ID NO: 1980597 - DNA, 19 bp, Homo sapiens
ccaatactactgtaaatgt

SEQ ID NO: 1980598 - DNA, 12 bp, Homo sapiens
ccaatattataa

SEQ ID NO: 1980599 - DNA, 14 bp, Homo sapiens
ccaatcagcactga

SEQ ID NO: 1980600 - DNA, 16 bp, Homo sapiens
ccaatcagcactgaaa

SEQ ID NO: 1980601 - DNA, 19 bp, Homo sapiens
ccaatccaggtgggagaga

SEQ ID NO: 1980602 - DNA, 14 bp, Homo sapiens
ccaatcctggcagg

SEQ ID NO: 1980603 - DNA, 11 bp, Homo sapiens
ccaatctctgt

SEQ ID NO: 1980604 - DNA, 16 bp, Homo sapiens
ccaatctctgtgactc

SEQ ID NO: 1980605 - DNA, 23 bp, Homo sapiens
ccaatgaaatacacaagtaaaca

SEQ ID NO: 1980606 - DNA, 19 bp, Homo sapiens
ccaatgaggtctgaaatgg

SEQ ID NO: 1980607 - DNA, 20 bp, Homo sapiens
ccaatgattcataacaatgt

SEQ ID NO: 1980608 - DNA, 18 bp, Homo sapiens
ccaatgcctataaaatgc

SEQ ID NO: 1980609 - DNA, 20 bp, Homo sapiens
ccaattaaaatatatataaa

SEQ ID NO: 1980610 - DNA, 16 bp, Homo sapiens
ccaattatgcactggc

SEQ ID NO: 1980611 - DNA, 19 bp, Homo sapiens
ccaattatgcactggccac

SEQ ID NO: 1980612 - DNA, 15 bp, Homo sapiens
ccaattatgtgacaa

SEQ ID NO: 1980613 - DNA, 21 bp, Homo sapiens
ccaattcaggactggctcacc

SEQ ID NO: 1980614 - DNA, 22 bp, Homo sapiens
ccaattgcctcttgcaggctga

SEQ ID NO: 1980615 - DNA, 19 bp, Homo sapiens
ccaattgtacattccctgc

SEQ ID NO: 1980616 - DNA, 13 bp, Homo sapiens
ccacaaaaattga

SEQ ID NO: 1980617 - DNA, 16 bp, Homo sapiens
ccacaaagccgtgcct

SEQ ID NO: 1980618 - DNA, 19 bp, Homo sapiens
ccacaaagccgtgcctttc

SEQ ID NO: 1980619 - DNA, 13 bp, Homo sapiens
ccacaaaggggag

SEQ ID NO: 1980620 - DNA, 12 bp, Homo sapiens
ccacaactgaca

SEQ ID NO: 1980621 - DNA, 14 bp, Homo sapiens
ccacaactgacaca

SEQ ID NO: 1980622 - DNA, 15 bp, Homo sapiens
ccacaactgacacag

SEQ ID NO: 1980623 - DNA, 16 bp, Homo sapiens
ccacaactgacacagg

SEQ ID NO: 1980624 - DNA, 17 bp, Homo sapiens
ccacaagattcccagag

SEQ ID NO: 1980625 - DNA, 18 bp, Homo sapiens
ccacaagattcccagaga

SEQ ID NO: 1980626 - DNA, 19 bp, Homo sapiens
ccacaatggagtgggagat

SEQ ID NO: 1980627 - DNA, 13 bp, Homo sapiens
ccacacaaaatgt

SEQ ID NO: 1980628 - DNA, 14 bp, Homo sapiens
ccacacaaaatgtc

SEQ ID NO: 1980629 - DNA, 12 bp, Homo sapiens
ccacacacagag

SEQ ID NO: 1980630 - DNA, 17 bp, Homo sapiens
ccacacacagaggaaga

SEQ ID NO: 1980631 - DNA, 22 bp, Homo sapiens
ccacacacgcaggaactcccag

SEQ ID NO: 1980632 - DNA, 14 bp, Homo sapiens
ccacacagagcctg

SEQ ID NO: 1980633 - DNA, 20 bp, Homo sapiens
ccacaccacagcaagccggc

SEQ ID NO: 1980634 - DNA, 20 bp, Homo sapiens
ccacacccagcccacttctg

SEQ ID NO: 1980635 - DNA, 22 bp, Homo sapiens
ccacaccccagcgcctgtgctg

SEQ ID NO: 1980636 - DNA, 14 bp, Homo sapiens
ccacacccctccaa

SEQ ID NO: 1980637 - DNA, 20 bp, Homo sapiens
ccacacccggctccccctgc

SEQ ID NO: 1980638 - DNA, 21 bp, Homo sapiens
ccacacccggctccccctgct

SEQ ID NO: 1980639 - DNA, 15 bp, Homo sapiens
ccacacgtgctcgca

SEQ ID NO: 1980640 - DNA, 22 bp, Homo sapiens
ccacacgtgctcgcagcctggc

SEQ ID NO: 1980641 - DNA, 14 bp, Homo sapiens
ccacactcagtccc

SEQ ID NO: 1980642 - DNA, 19 bp, Homo sapiens
ccacactccccgcctgtcc

SEQ ID NO: 1980643 - DNA, 15 bp, Homo sapiens
ccacactgaatctcc

SEQ ID NO: 1980644 - DNA, 13 bp, Homo sapiens
ccacactggtgac

SEQ ID NO: 1980645 - DNA, 12 bp, Homo sapiens
ccacactgtcag

SEQ ID NO: 1980646 - DNA, 17 bp, Homo sapiens
ccacactgtcagagctg

SEQ ID NO: 1980647 - DNA, 16 bp, Homo sapiens
ccacacttcaggctct

SEQ ID NO: 1980648 - DNA, 18 bp, Homo sapiens
ccacacttctcaggacac

SEQ ID NO: 1980649 - DNA, 22 bp, Homo sapiens
ccacacttctcaggacacaggc

SEQ ID NO: 1980650 - DNA, 23 bp, Homo sapiens
ccacacttctcaggacacaggcc

SEQ ID NO: 1980651 - DNA, 24 bp, Homo sapiens
ccacacttctcaggacacaggcct

SEQ ID NO: 1980652 - DNA, 21 bp, Homo sapiens
ccacacttcttgaaacagcct

SEQ ID NO: 1980653 - DNA, 23 bp, Homo sapiens
ccacacttcttgaaacagcctgg

SEQ ID NO: 1980654 - DNA, 21 bp, Homo sapiens
ccacagaagccaggagcaaat

SEQ ID NO: 1980655 - DNA, 22 bp, Homo sapiens
ccacagaagccaggagcaaatg

SEQ ID NO: 1980656 - DNA, 16 bp, Homo sapiens
ccacagacagatccca

SEQ ID NO: 1980657 - DNA, 14 bp, Homo sapiens
ccacagaccacctg

SEQ ID NO: 1980658 - DNA, 21 bp, Homo sapiens
ccacagaccacctgcttctga

SEQ ID NO: 1980659 - DNA, 14 bp, Homo sapiens
ccacagagatgcat

SEQ ID NO: 1980660 - DNA, 16 bp, Homo sapiens
ccacagataactgaaa

SEQ ID NO: 1980661 - DNA, 16 bp, Homo sapiens
ccacagcacccaggct

SEQ ID NO: 1980662 - DNA, 12 bp, Homo sapiens
ccacagcagttg

SEQ ID NO: 1980663 - DNA, 18 bp, Homo sapiens
ccacagcagttgaaaaga

SEQ ID NO: 1980664 - DNA, 18 bp, Homo sapiens
ccacagcattcctccatc

SEQ ID NO: 1980665 - DNA, 14 bp, Homo sapiens
ccacagccaacaaa

SEQ ID NO: 1980666 - DNA, 15 bp, Homo sapiens
ccacagccccacagc

SEQ ID NO: 1980667 - DNA, 12 bp, Homo sapiens
ccacagccgcag

SEQ ID NO: 1980668 - DNA, 15 bp, Homo sapiens
ccacagcggaggaga

SEQ ID NO: 1980669 - DNA, 22 bp, Homo sapiens
ccacagcggaggagaccagctc

SEQ ID NO: 1980670 - DNA, 19 bp, Homo sapiens
ccacagctcccaccccacc

SEQ ID NO: 1980671 - DNA, 14 bp, Homo sapiens
ccacaggagggaga

SEQ ID NO: 1980672 - DNA, 19 bp, Homo sapiens
ccacaggcatctacacagc

SEQ ID NO: 1980673 - DNA, 15 bp, Homo sapiens
ccacaggcccttggg

SEQ ID NO: 1980674 - DNA, 14 bp, Homo sapiens
ccacagggctaaga

SEQ ID NO: 1980675 - DNA, 22 bp, Homo sapiens
ccacctgtctgtctgtctgtcc

SEQ ID NO: 1980676 - DNA, 22 bp, Homo sapiens
ccacctgttaaaatgtacactg

SEQ ID NO: 1980677 - DNA, 11 bp, Homo sapiens
ccaccttccca

SEQ ID NO: 1980678 - DNA, 13 bp, Homo sapiens
ccaccttcccagc

SEQ ID NO: 1980679 - DNA, 14 bp, Homo sapiens
ccaccttcccagct

SEQ ID NO: 1980680 - DNA, 22 bp, Homo sapiens
ccaccttccccagactcagctc

SEQ ID NO: 1980681 - DNA, 11 bp, Homo sapiens
ccaccttccct

SEQ ID NO: 1980682 - DNA, 17 bp, Homo sapiens
ccaccttggactcctcc

SEQ ID NO: 1980683 - DNA, 18 bp, Homo sapiens
ccaccttggactcctccc

SEQ ID NO: 1980684 - DNA, 23 bp, Homo sapiens
ccaccttggactcctcccacaat

SEQ ID NO: 1980685 - DNA, 14 bp, Homo sapiens
ccaccttggctcaa

SEQ ID NO: 1980686 - DNA, 16 bp, Homo sapiens
ccaccttggctcaagt

SEQ ID NO: 1980687 - DNA, 18 bp, Homo sapiens
ccaccttggctgcaggga

SEQ ID NO: 1980688 - DNA, 20 bp, Homo sapiens
ccacgaagctgtgaactcag

SEQ ID NO: 1980689 - DNA, 22 bp, Homo sapiens
ccacgaatttggtgtggctgta

SEQ ID NO: 1980690 - DNA, 23 bp, Homo sapiens
ccacgagtcacctgcaagcccca

SEQ ID NO: 1980691 - DNA, 16 bp, Homo sapiens
ccacgcctcctggcca

SEQ ID NO: 1980692 - DNA, 13 bp, Homo sapiens
ccacgctggagtg

SEQ ID NO: 1980693 - DNA, 16 bp, Homo sapiens
ccacgctggagtgcag

SEQ ID NO: 1980694 - DNA, 12 bp, Homo sapiens
ccacgctgtcct

SEQ ID NO: 1980695 - DNA, 19 bp, Homo sapiens
ccacggacgtttccatcag

SEQ ID NO: 1980696 - DNA, 20 bp, Homo sapiens
ccacggacgtttccatcagg

SEQ ID NO: 1980697 - DNA, 15 bp, Homo sapiens
ccacggcacctgggc

SEQ ID NO: 1980698 - DNA, 13 bp, Homo sapiens
ccacggccaccct

SEQ ID NO: 1980699 - DNA, 14 bp, Homo sapiens
ccacggccaggcca

SEQ ID NO: 1980700 - DNA, 12 bp, Homo sapiens
ccacggccttgt

SEQ ID NO: 1980701 - DNA, 18 bp, Homo sapiens
ccacgggcctcagtttcc

SEQ ID NO: 1980702 - DNA, 13 bp, Homo sapiens
ccacggggagggg

SEQ ID NO: 1980703 - DNA, 16 bp, Homo sapiens
ccacggggagggggac

SEQ ID NO: 1980704 - DNA, 14 bp, Homo sapiens
ccacgtctgccagg

SEQ ID NO: 1980705 - DNA, 16 bp, Homo sapiens
ccacgtctgccaggcc

SEQ ID NO: 1980706 - DNA, 22 bp, Homo sapiens
ccacgtgagagaatctgcctgt

SEQ ID NO: 1980707 - DNA, 23 bp, Homo sapiens
ccacgtgagagaatctgcctgtg

SEQ ID NO: 1980708 - DNA, 15 bp, Homo sapiens
ccacgtgccaggccc

SEQ ID NO: 1980709 - DNA, 17 bp, Homo sapiens
ccacgtgtgcagactgt

SEQ ID NO: 1980710 - DNA, 15 bp, Homo sapiens
ccacgttaagtccaa

SEQ ID NO: 1980711 - DNA, 14 bp, Homo sapiens
ccacgttctatata

SEQ ID NO: 1980712 - DNA, 17 bp, Homo sapiens
ccactaagctttctcct

SEQ ID NO: 1980713 - DNA, 21 bp, Homo sapiens
ccactaagctttctcctttga

SEQ ID NO: 1980714 - DNA, 19 bp, Homo sapiens
ccactacactccagcctga

SEQ ID NO: 1980715 - DNA, 21 bp, Homo sapiens
ccactacactccagcctgagc

SEQ ID NO: 1980716 - DNA, 20 bp, Homo sapiens
ccactaccttctgacctccc

SEQ ID NO: 1980717 - DNA, 22 bp, Homo sapiens
ccactacggaatagttggctag

SEQ ID NO: 1980718 - DNA, 23 bp, Homo sapiens
ccactacggaatagttggctagg

SEQ ID NO: 1980719 - DNA, 21 bp, Homo sapiens
ccactactgtgtagactcctg

SEQ ID NO: 1980720 - DNA, 23 bp, Homo sapiens
ccactactgtgtagactcctgct

SEQ ID NO: 1980721 - DNA, 23 bp, Homo sapiens
ccactagagctgagagtctgaaa

SEQ ID NO: 1980722 - DNA, 16 bp, Homo sapiens
ccactaggactctgag

SEQ ID NO: 1980723 - DNA, 20 bp, Homo sapiens
ccactcaaattaatctttct

SEQ ID NO: 1980724 - DNA, 20 bp, Homo sapiens
ccactcaatgacatcatgtt

SEQ ID NO: 1980725 - DNA, 16 bp, Homo sapiens
ccactcaccagtgtcc

SEQ ID NO: 1980726 - DNA, 13 bp, Homo sapiens
ccactcaggccaa

SEQ ID NO: 1980727 - DNA, 14 bp, Homo sapiens
ccactcatttcatc

SEQ ID NO: 1980728 - DNA, 20 bp, Homo sapiens
ccactccacctccacccact

SEQ ID NO: 1980729 - DNA, 22 bp, Homo sapiens
ccactccagacccctggctttt

SEQ ID NO: 1980730 - DNA, 13 bp, Homo sapiens
ccactccctgagc

SEQ ID NO: 1980731 - DNA, 17 bp, Homo sapiens
ccactcctatggaaaag

SEQ ID NO: 1980732 - DNA, 13 bp, Homo sapiens
ccactcctcactg

SEQ ID NO: 1980733 - DNA, 12 bp, Homo sapiens
ccactcctccaa

SEQ ID NO: 1980734 - DNA, 14 bp, Homo sapiens
ccactcctgtcccg

SEQ ID NO: 1980735 - DNA, 13 bp, Homo sapiens
ccactccttcctg

SEQ ID NO: 1980736 - DNA, 14 bp, Homo sapiens
ccactccttcctgc

SEQ ID NO: 1980737 - DNA, 16 bp, Homo sapiens
ccactccttcctgccc

SEQ ID NO: 1980738 - DNA, 20 bp, Homo sapiens
ccactcgggaggctgagaca

SEQ ID NO: 1980739 - DNA, 14 bp, Homo sapiens
ccactctcattccc

SEQ ID NO: 1980740 - DNA, 16 bp, Homo sapiens
ccactctcattcccca

SEQ ID NO: 1980741 - DNA, 17 bp, Homo sapiens
ccactctcattccccag

SEQ ID NO: 1980742 - DNA, 19 bp, Homo sapiens
ccactctcattccccaggt

SEQ ID NO: 1980743 - DNA, 15 bp, Homo sapiens
ccactctcccctccc

SEQ ID NO: 1980744 - DNA, 16 bp, Homo sapiens
ccactctcccctccct

SEQ ID NO: 1980745 - DNA, 13 bp, Homo sapiens
ccactctcggggc

SEQ ID NO: 1980746 - DNA, 21 bp, Homo sapiens
ccactctgaataccaagtgtg

SEQ ID NO: 1980747 - DNA, 15 bp, Homo sapiens
ccactctgctctgat

SEQ ID NO: 1980748 - DNA, 18 bp, Homo sapiens
ccactctggcagccacac

SEQ ID NO: 1980749 - DNA, 21 bp, Homo sapiens
ccactctttgctacaataaat

SEQ ID NO: 1980750 - DNA, 23 bp, Homo sapiens
ccactctttgctacaataaatgc

SEQ ID NO: 1980751 - DNA, 22 bp, Homo sapiens
ccactgaaaacatttcaaagct

SEQ ID NO: 1980752 - DNA, 15 bp, Homo sapiens
ccactgaagctggga

SEQ ID NO: 1980753 - DNA, 13 bp, Homo sapiens
ccactgacctcac

SEQ ID NO: 1980754 - DNA, 18 bp, Homo sapiens
ccactgacctcaccggca

SEQ ID NO: 1980755 - DNA, 14 bp, Homo sapiens
ccactgcactccag

SEQ ID NO: 1980756 - DNA, 18 bp, Homo sapiens
ccactgcactccagcctg

SEQ ID NO: 1980757 - DNA, 14 bp, Homo sapiens
ccactgcagagatg

SEQ ID NO: 1980758 - DNA, 17 bp, Homo sapiens
ccactgccacaccctcc

SEQ ID NO: 1980759 - DNA, 14 bp, Homo sapiens
ccactgccagcagc

SEQ ID NO: 1980760 - DNA, 13 bp, Homo sapiens
ccactgccaggca

SEQ ID NO: 1980761 - DNA, 17 bp, Homo sapiens
catgtggccccaggtgc

SEQ ID NO: 1980762 - DNA, 18 bp, Homo sapiens
catgtggccccaggtgcc

SEQ ID NO: 1980763 - DNA, 11 bp, Homo sapiens
catgtggctga

SEQ ID NO: 1980764 - DNA, 16 bp, Homo sapiens
catgtgggaggaagaa

SEQ ID NO: 1980765 - DNA, 14 bp, Homo sapiens
catgtggggaagca

SEQ ID NO: 1980766 - DNA, 23 bp, Homo sapiens
catgtggtatgtagcccggccag

SEQ ID NO: 1980767 - DNA, 21 bp, Homo sapiens
catgtggtgggacagggaccc

SEQ ID NO: 1980768 - DNA, 22 bp, Homo sapiens
catgtggttaatgccatggaca

SEQ ID NO: 1980769 - DNA, 20 bp, Homo sapiens
catgtggtttatagagggcc

SEQ ID NO: 1980770 - DNA, 18 bp, Homo sapiens
catgtgtagcctgtgcat

SEQ ID NO: 1980771 - DNA, 14 bp, Homo sapiens
catgtgtcccctca

SEQ ID NO: 1980772 - DNA, 16 bp, Homo sapiens
catgtgtcccctcact

SEQ ID NO: 1980773 - DNA, 15 bp, Homo sapiens
catgtgtctgtgtgg

SEQ ID NO: 1980774 - DNA, 13 bp, Homo sapiens
catgtgtgcatgt

SEQ ID NO: 1980775 - DNA, 13 bp, Homo sapiens
catgtgtgcctgt

SEQ ID NO: 1980776 - DNA, 14 bp, Homo sapiens
catgtgtgcctgtg

SEQ ID NO: 1980777 - DNA, 16 bp, Homo sapiens
catgtgtgcctgtggc

SEQ ID NO: 1980778 - DNA, 17 bp, Homo sapiens
catgtgtgcctgtggca

SEQ ID NO: 1980779 - DNA, 16 bp, Homo sapiens
catgtgtgctgtgctg

SEQ ID NO: 1980780 - DNA, 17 bp, Homo sapiens
catgtgtggatgtgtaa

SEQ ID NO: 1980781 - DNA, 18 bp, Homo sapiens
catgtgtggatgtgtaaa

SEQ ID NO: 1980782 - DNA, 15 bp, Homo sapiens
catgtgtgtatatat

SEQ ID NO: 1980783 - DNA, 17 bp, Homo sapiens
catgtgtgtatatatgt

SEQ ID NO: 1980784 - DNA, 18 bp, Homo sapiens
catgtgtgtatatatgtg

SEQ ID NO: 1980785 - DNA, 19 bp, Homo sapiens
catgtgtgtatatatgtgt

SEQ ID NO: 1980786 - DNA, 20 bp, Homo sapiens
catgtgtgtatatatgtgta

SEQ ID NO: 1980787 - DNA, 15 bp, Homo sapiens
catgtgtgtgtctgt

SEQ ID NO: 1980788 - DNA, 17 bp, Homo sapiens
catgttaattaaactga

SEQ ID NO: 1980789 - DNA, 19 bp, Homo sapiens
catgttaattaaactgaag

SEQ ID NO: 1980790 - DNA, 20 bp, Homo sapiens
catgttaccaaagcaatatt

SEQ ID NO: 1980791 - DNA, 17 bp, Homo sapiens
catgttacctcctataa

SEQ ID NO: 1980792 - DNA, 19 bp, Homo sapiens
catgttaggaaaatttcac

SEQ ID NO: 1980793 - DNA, 15 bp, Homo sapiens
catgttctctgagga

SEQ ID NO: 1980794 - DNA, 21 bp, Homo sapiens
catgttggatagtcagctgta

SEQ ID NO: 1980795 - DNA, 12 bp, Homo sapiens
catgttggccag

SEQ ID NO: 1980796 - DNA, 15 bp, Homo sapiens
catgttggccaggct

SEQ ID NO: 1980797 - DNA, 22 bp, Homo sapiens
catgttggtcaaaagctggatt

SEQ ID NO: 1980798 - DNA, 20 bp, Homo sapiens
catgtttaaactttgtgcct

SEQ ID NO: 1980799 - DNA, 15 bp, Homo sapiens
catgtttacagaact

SEQ ID NO: 1980800 - DNA, 13 bp, Homo sapiens
catgtttacttta

SEQ ID NO: 1980801 - DNA, 20 bp, Homo sapiens
catgtttgagctcagacccc

SEQ ID NO: 1980802 - DNA, 13 bp, Homo sapiens
catgtttgtaaat

SEQ ID NO: 1980803 - DNA, 15 bp, Homo sapiens
catgttttgtgacta

SEQ ID NO: 1980804 - DNA, 23 bp, Homo sapiens
catgtttttgttttctttgaatg

SEQ ID NO: 1980805 - DNA, 22 bp, Homo sapiens
cattaaaaatgcatatacttta

SEQ ID NO: 1980806 - DNA, 18 bp, Homo sapiens
cattaaaagaagactgga

SEQ ID NO: 1980807 - DNA, 16 bp, Homo sapiens
cattaaacactgtaat

SEQ ID NO: 1980808 - DNA, 18 bp, Homo sapiens
cattaaacactgtaatct

SEQ ID NO: 1980809 - DNA, 18 bp, Homo sapiens
cattaaagcatttacttt

SEQ ID NO: 1980810 - DNA, 20 bp, Homo sapiens
cattaaattggaattttctt

SEQ ID NO: 1980811 - DNA, 20 bp, Homo sapiens
cattaaattttctatgctta

SEQ ID NO: 1980812 - DNA, 17 bp, Homo sapiens
cattaatatttgctgac

SEQ ID NO: 1980813 - DNA, 19 bp, Homo sapiens
cattacagtttggaagtgt

SEQ ID NO: 1980814 - DNA, 14 bp, Homo sapiens
catacccttcttta

SEQ ID NO: 1980815 - DNA, 21 bp, Homo sapiens
catacccttctttaaatcaaa

SEQ ID NO: 1980816 - DNA, 22 bp, Homo sapiens
catacctctctctatatataca

SEQ ID NO: 1980817 - DNA, 13 bp, Homo sapiens
catacctctgacc

SEQ ID NO: 1980818 - DNA, 22 bp, Homo sapiens
cataccttggactgactaccag

SEQ ID NO: 1980819 - DNA, 15 bp, Homo sapiens
catacttaagcaaaa

SEQ ID NO: 1980820 - DNA, 19 bp, Homo sapiens
catagaaacatgacactga

SEQ ID NO: 1980821 - DNA, 22 bp, Homo sapiens
catagaaactgaggagtagctg

SEQ ID NO: 1980822 - DNA, 24 bp, Homo sapiens
catagagatatgcacacacagatg

SEQ ID NO: 1980823 - DNA, 15 bp, Homo sapiens
catagagtttaacac

SEQ ID NO: 1980824 - DNA, 13 bp, Homo sapiens
catagatagtgct

SEQ ID NO: 1980825 - DNA, 20 bp, Homo sapiens
catagatggaccagtagaca

SEQ ID NO: 1980826 - DNA, 23 bp, Homo sapiens
catagatggaccagtagacaact

SEQ ID NO: 1980827 - DNA, 18 bp, Homo sapiens
catagattaatggcactg

SEQ ID NO: 1980828 - DNA, 20 bp, Homo sapiens
catagcaagacacatcccta

SEQ ID NO: 1980829 - DNA, 23 bp, Homo sapiens
catagcaagattgcttaaaatag

SEQ ID NO: 1980830 - DNA, 23 bp, Homo sapiens
catagcagagaatgaaagggccc

SEQ ID NO: 1980831 - DNA, 16 bp, Homo sapiens
catagcagattttaat

SEQ ID NO: 1980832 - DNA, 21 bp, Homo sapiens
catagcatagctagagattgg

SEQ ID NO: 1980833 - DNA, 19 bp, Homo sapiens
catagcgctggctcaggaa

SEQ ID NO: 1980834 - DNA, 13 bp, Homo sapiens
catagcttccatg

SEQ ID NO: 1980835 - DNA, 18 bp, Homo sapiens
cataggaaaagtacattt

SEQ ID NO: 1980836 - DNA, 22 bp, Homo sapiens
cataggaaaagtacatttaata

SEQ ID NO: 1980837 - DNA, 19 bp, Homo sapiens
cataggcggtcatgtgtgc

SEQ ID NO: 1980838 - DNA, 16 bp, Homo sapiens
cataggtatttcaaaa

SEQ ID NO: 1980839 - DNA, 17 bp, Homo sapiens
catagtatggtggctgg

SEQ ID NO: 1980840 - DNA, 19 bp, Homo sapiens
catagtatggtggctgggt

SEQ ID NO: 1980841 - DNA, 20 bp, Homo sapiens
catagtatggtggctgggtt

SEQ ID NO: 1980842 - DNA, 13 bp, Homo sapiens
catagtcacatgg

SEQ ID NO: 1980843 - DNA, 19 bp, Homo sapiens
catagtgatggttcccctg

SEQ ID NO: 1980844 - DNA, 22 bp, Homo sapiens
catagttatttacttgaaagat

SEQ ID NO: 1980845 - DNA, 16 bp, Homo sapiens
catatacatatatata

SEQ ID NO: 1980846 - DNA, 15 bp, Homo sapiens
catatacctataatg

SEQ ID NO: 1980847 - DNA, 17 bp, Homo sapiens
catatacctataatgtg

SEQ ID NO: 1980848 - DNA, 19 bp, Homo sapiens
catatacctataatgtgtg

SEQ ID NO: 1980849 - DNA, 20 bp, Homo sapiens
catatacctataatgtgtgt

SEQ ID NO: 1980850 - DNA, 22 bp, Homo sapiens
catatacctataatgtgtgtat

SEQ ID NO: 1980851 - DNA, 18 bp, Homo sapiens
catatatatatacacata

SEQ ID NO: 1980852 - DNA, 14 bp, Homo sapiens
catatatatctgat

SEQ ID NO: 1980853 - DNA, 13 bp, Homo sapiens
catatatcttatg

SEQ ID NO: 1980854 - DNA, 16 bp, Homo sapiens
catatatcttatgtta

SEQ ID NO: 1980855 - DNA, 17 bp, Homo sapiens
catatatgaggacttgt

SEQ ID NO: 1980856 - DNA, 18 bp, Homo sapiens
catatatgtatatgtata

SEQ ID NO: 1980857 - DNA, 19 bp, Homo sapiens
catatattcatgtaataaa

SEQ ID NO: 1980858 - DNA, 13 bp, Homo sapiens
catatatttatga

SEQ ID NO: 1980859 - DNA, 13 bp, Homo sapiens
catatcaattcaa

SEQ ID NO: 1980860 - DNA, 15 bp, Homo sapiens
catatcaattcaaca

SEQ ID NO: 1980861 - DNA, 12 bp, Homo sapiens
catatcagaaaa

SEQ ID NO: 1980862 - DNA, 13 bp, Homo sapiens
catatcagaaaag

SEQ ID NO: 1980863 - DNA, 19 bp, Homo sapiens
catatcagaaaagtagaat

SEQ ID NO: 1980864 - DNA, 22 bp, Homo sapiens
catatcagaaaagtagaattat

SEQ ID NO: 1980865 - DNA, 15 bp, Homo sapiens
catatcagacctctg

SEQ ID NO: 1980866 - DNA, 21 bp, Homo sapiens
catatcggaggtggtggagga

SEQ ID NO: 1980867 - DNA, 15 bp, Homo sapiens
catatcttcctcatc

SEQ ID NO: 1980868 - DNA, 16 bp, Homo sapiens
catatcttcctcatca

SEQ ID NO: 1980869 - DNA, 11 bp, Homo sapiens
catatgaaaaa

SEQ ID NO: 1980870 - DNA, 19 bp, Homo sapiens
catatgcaccttgtgtctg

SEQ ID NO: 1980871 - DNA, 23 bp, Homo sapiens
catatgcaccttgtgtctgtaca

SEQ ID NO: 1980872 - DNA, 21 bp, Homo sapiens
catatgcctacttgtaatttc

SEQ ID NO: 1980873 - DNA, 15 bp, Homo sapiens
catatggaggcctga

SEQ ID NO: 1980874 - DNA, 14 bp, Homo sapiens
catatgggtgctgg

SEQ ID NO: 1980875 - DNA, 13 bp, Homo sapiens
catatgtaaaata

SEQ ID NO: 1980876 - DNA, 15 bp, Homo sapiens
catatgtaccatgta

SEQ ID NO: 1980877 - DNA, 22 bp, Homo sapiens
catccttcaccagagcccatgc

SEQ ID NO: 1980878 - DNA, 14 bp, Homo sapiens
catccttcccatga

SEQ ID NO: 1980879 - DNA, 17 bp, Homo sapiens
catccttggcctggcgc

SEQ ID NO: 1980880 - DNA, 21 bp, Homo sapiens
catcgattcaaactgctccaa

SEQ ID NO: 1980881 - DNA, 17 bp, Homo sapiens
catcggaggctgggccc

SEQ ID NO: 1980882 - DNA, 21 bp, Homo sapiens
catcggaggctgggcccctgg

SEQ ID NO: 1980883 - DNA, 13 bp, Homo sapiens
catcgggctgagg

SEQ ID NO: 1980884 - DNA, 15 bp, Homo sapiens
catcgtccttcctct

SEQ ID NO: 1980885 - DNA, 13 bp, Homo sapiens
catcgtgaccctt

SEQ ID NO: 1980886 - DNA, 14 bp, Homo sapiens
catctaagctgcag

SEQ ID NO: 1980887 - DNA, 15 bp, Homo sapiens
catctaagctgcagc

SEQ ID NO: 1980888 - DNA, 15 bp, Homo sapiens
catctacacagcctg

SEQ ID NO: 1980889 - DNA, 23 bp, Homo sapiens
catctagagattttcttggcagt

SEQ ID NO: 1980890 - DNA, 19 bp, Homo sapiens
catctagaggcttccttca

SEQ ID NO: 1980891 - DNA, 16 bp, Homo sapiens
catctatggagggcag

SEQ ID NO: 1980892 - DNA, 22 bp, Homo sapiens
catctatggcagtccagccagc

SEQ ID NO: 1980893 - DNA, 19 bp, Homo sapiens
catctattataaaaccatg

SEQ ID NO: 1980894 - DNA, 20 bp, Homo sapiens
catctattataaaaccatgt

SEQ ID NO: 1980895 - DNA, 21 bp, Homo sapiens
catctattctttgtaccatct

SEQ ID NO: 1980896 - DNA, 22 bp, Homo sapiens
catctattctttgtaccatctg

SEQ ID NO: 1980897 - DNA, 14 bp, Homo sapiens
catctatttctgag

SEQ ID NO: 1980898 - DNA, 18 bp, Homo sapiens
catctcaggcctccctca

SEQ ID NO: 1980899 - DNA, 13 bp, Homo sapiens
catctcagggtcc

SEQ ID NO: 1980900 - DNA, 19 bp, Homo sapiens
catctcagggtccagaccc

SEQ ID NO: 1980901 - DNA, 13 bp, Homo sapiens
catctcaggtgcc

SEQ ID NO: 1980902 - DNA, 19 bp, Homo sapiens
catctcaggtgccactccc

SEQ ID NO: 1980903 - DNA, 21 bp, Homo sapiens
catctcagtgaagaatacttc

SEQ ID NO: 1980904 - DNA, 18 bp, Homo sapiens
catctcatttaagggaaa

SEQ ID NO: 1980905 - DNA, 21 bp, Homo sapiens
catctcatttaagggaaaaat

SEQ ID NO: 1980906 - DNA, 20 bp, Homo sapiens
catctcatttaatcctccct

SEQ ID NO: 1980907 - DNA, 16 bp, Homo sapiens
catctccaccctgagc

SEQ ID NO: 1980908 - DNA, 18 bp, Homo sapiens
catctccaccctgagcct

SEQ ID NO: 1980909 - DNA, 19 bp, Homo sapiens
catctccaccctgagcctg

SEQ ID NO: 1980910 - DNA, 14 bp, Homo sapiens
catctccactccag

SEQ ID NO: 1980911 - DNA, 16 bp, Homo sapiens
catctccagcatcctg

SEQ ID NO: 1980912 - DNA, 22 bp, Homo sapiens
catctccagcatcctgcttcct

SEQ ID NO: 1980913 - DNA, 21 bp, Homo sapiens
catctccatgtagaataaatg

SEQ ID NO: 1980914 - DNA, 13 bp, Homo sapiens
catctccatttca

SEQ ID NO: 1980915 - DNA, 18 bp, Homo sapiens
catctccatttcacacag

SEQ ID NO: 1980916 - DNA, 14 bp, Homo sapiens
catctccccaggcc

SEQ ID NO: 1980917 - DNA, 21 bp, Homo sapiens
catctccccaggcctccagcc

SEQ ID NO: 1980918 - DNA, 15 bp, Homo sapiens
catctcctctatcac

SEQ ID NO: 1980919 - DNA, 15 bp, Homo sapiens
catctcgagccccct

SEQ ID NO: 1980920 - DNA, 22 bp, Homo sapiens
catctctctactcctacctcag

SEQ ID NO: 1980921 - DNA, 23 bp, Homo sapiens
catctctctactcctacctcagc

SEQ ID NO: 1980922 - DNA, 20 bp, Homo sapiens
catctctctggggccctggg

SEQ ID NO: 1980923 - DNA, 16 bp, Homo sapiens
catctgaaagccacgt

SEQ ID NO: 1980924 - DNA, 19 bp, Homo sapiens
catctgaaccactttgcct

SEQ ID NO: 1980925 - DNA, 12 bp, Homo sapiens
catctgactcac

SEQ ID NO: 1980926 - DNA, 18 bp, Homo sapiens
catctgactcacaagaag

SEQ ID NO: 1980927 - DNA, 16 bp, Homo sapiens
catctgcggggcttct

SEQ ID NO: 1980928 - DNA, 12 bp, Homo sapiens
catctgctaata

SEQ ID NO: 1980929 - DNA, 15 bp, Homo sapiens
catctgggaggctgg

SEQ ID NO: 1980930 - DNA, 17 bp, Homo sapiens
catctgtcttgccagcc

SEQ ID NO: 1980931 - DNA, 20 bp, Homo sapiens
catctgtcttgccagccaga

SEQ ID NO: 1980932 - DNA, 20 bp, Homo sapiens
catctgtgtaacctccacag

SEQ ID NO: 1980933 - DNA, 14 bp, Homo sapiens
catctgtgtctctg

SEQ ID NO: 1980934 - DNA, 12 bp, Homo sapiens
catctgttgttt

SEQ ID NO: 1980935 - DNA, 20 bp, Homo sapiens
catctgttgttttgttttaa

SEQ ID NO: 1980936 - DNA, 20 bp, Homo sapiens
catcttatttacttgtagaa

SEQ ID NO: 1980937 - DNA, 18 bp, Homo sapiens
catcttcagctcccatag

SEQ ID NO: 1980938 - DNA, 14 bp, Homo sapiens
catcttcctgctgc

SEQ ID NO: 1980939 - DNA, 14 bp, Homo sapiens
catcttctcagtgt

SEQ ID NO: 1980940 - DNA, 22 bp, Homo sapiens
catcttctggagtctccagtgg

SEQ ID NO: 1980941 - DNA, 14 bp, Homo sapiens
catcttctggcttg

SEQ ID NO: 1980942 - DNA, 15 bp, Homo sapiens
catcttgaatatttg

SEQ ID NO: 1980943 - DNA, 17 bp, Homo sapiens
catcttgaatatttgct

SEQ ID NO: 1980944 - DNA, 17 bp, Homo sapiens
catcttgacatgtaatg

SEQ ID NO: 1980945 - DNA, 20 bp, Homo sapiens
catcttgccccctcatctca

SEQ ID NO: 1980946 - DNA, 16 bp, Homo sapiens
catcttgctctgctga

SEQ ID NO: 1980947 - DNA, 14 bp, Homo sapiens
catcttggtcctgt

SEQ ID NO: 1980948 - DNA, 22 bp, Homo sapiens
catcttggtcctgtcaccctgg

SEQ ID NO: 1980949 - DNA, 13 bp, Homo sapiens
catctttaagtat

SEQ ID NO: 1980950 - DNA, 20 bp, Homo sapiens
catctttcctccaaactcct

SEQ ID NO: 1980951 - DNA, 21 bp, Homo sapiens
catctttcctccaaactcctg

SEQ ID NO: 1980952 - DNA, 13 bp, Homo sapiens
catctttcctgtc

SEQ ID NO: 1980953 - DNA, 22 bp, Homo sapiens
catgaaaaacacggcagctgta

SEQ ID NO: 1980954 - DNA, 16 bp, Homo sapiens
catgaaaactatttta

SEQ ID NO: 1980955 - DNA, 13 bp, Homo sapiens
catgaaaatgcaa

SEQ ID NO: 1980956 - DNA, 15 bp, Homo sapiens
catgaaaatgcaaca

SEQ ID NO: 1980957 - DNA, 19 bp, Homo sapiens
catgaaaattatctccctt

SEQ ID NO: 1980958 - DNA, 13 bp, Homo sapiens
catgaaacagaaa

SEQ ID NO: 1980959 - DNA, 19 bp, Homo sapiens
catgaaagagaaagactga

SEQ ID NO: 1980960 - DNA, 22 bp, Homo sapiens
catgaaatatagatcagttata

SEQ ID NO: 1980961 - DNA, 19 bp, Homo sapiens
catgaaccatccttcccat

SEQ ID NO: 1980962 - DNA, 12 bp, Homo sapiens
catgaagctgga

SEQ ID NO: 1980963 - DNA, 19 bp, Homo sapiens
catgaagtcgttgtgaggg

SEQ ID NO: 1980964 - DNA, 20 bp, Homo sapiens
catgaagtgtgtttccttca

SEQ ID NO: 1980965 - DNA, 22 bp, Homo sapiens
catgaatatttcaaaataaact

SEQ ID NO: 1980966 - DNA, 12 bp, Homo sapiens
catgacactgac

SEQ ID NO: 1980967 - DNA, 14 bp, Homo sapiens
catgacagccagag

SEQ ID NO: 1980968 - DNA, 19 bp, Homo sapiens
catgacagccagagcctgt

SEQ ID NO: 1980969 - DNA, 17 bp, Homo sapiens
catgacatgttatatat

SEQ ID NO: 1980970 - DNA, 17 bp, Homo sapiens
catgacatttctaagtg

SEQ ID NO: 1980971 - DNA, 12 bp, Homo sapiens
catgaccagcaa

SEQ ID NO: 1980972 - DNA, 19 bp, Homo sapiens
catgaccagttctggccag

SEQ ID NO: 1980973 - DNA, 16 bp, Homo sapiens
catgaccatcctgtcc

SEQ ID NO: 1980974 - DNA, 15 bp, Homo sapiens
catgacttttccatg

SEQ ID NO: 1980975 - DNA, 12 bp, Homo sapiens
catgagaaatgt

SEQ ID NO: 1980976 - DNA, 18 bp, Homo sapiens
catgagaagagggcctgt

SEQ ID NO: 1980977 - DNA, 12 bp, Homo sapiens
catgagaatcta

SEQ ID NO: 1980978 - DNA, 19 bp, Homo sapiens
catgagaccactgttatca

SEQ ID NO: 1980979 - DNA, 21 bp, Homo sapiens
catgagcctcagcatcctggc

SEQ ID NO: 1980980 - DNA, 20 bp, Homo sapiens
catgaggacatgatggagcg

SEQ ID NO: 1980981 - DNA, 21 bp, Homo sapiens
catgaggacatgatggagcgc

SEQ ID NO: 1980982 - DNA, 22 bp, Homo sapiens
catgaggacatgatggagcgca

SEQ ID NO: 1980983 - DNA, 13 bp, Homo sapiens
catgaggagggtg

SEQ ID NO: 1980984 - DNA, 24 bp, Homo sapiens
catgaggcaatgtcaggaacagaa

SEQ ID NO: 1980985 - DNA, 15 bp, Homo sapiens
catgaggcctttccc

SEQ ID NO: 1980986 - DNA, 20 bp, Homo sapiens
catgaggcctttccccagtg

SEQ ID NO: 1980987 - DNA, 18 bp, Homo sapiens
catgagggatcacagggc

SEQ ID NO: 1980988 - DNA, 15 bp, Homo sapiens
catgagtggatggat

SEQ ID NO: 1980989 - DNA, 15 bp, Homo sapiens
catgatattttcaga

SEQ ID NO: 1980990 - DNA, 20 bp, Homo sapiens
catgatcgagccactgcact

SEQ ID NO: 1980991 - DNA, 17 bp, Homo sapiens
catgatctccctgccgc

SEQ ID NO: 1980992 - DNA, 14 bp, Homo sapiens
cagggcaaatgaca

SEQ ID NO: 1980993 - DNA, 17 bp, Homo sapiens
cagggcaatcaatgttc

SEQ ID NO: 1980994 - DNA, 17 bp, Homo sapiens
cagggcaatcttgtcca

SEQ ID NO: 1980995 - DNA, 14 bp, Homo sapiens
cagggcacaccggg

SEQ ID NO: 1980996 - DNA, 12 bp, Homo sapiens
cagggcacagga

SEQ ID NO: 1980997 - DNA, 15 bp, Homo sapiens
cagggcacaggagct

SEQ ID NO: 1980998 - DNA, 20 bp, Homo sapiens
cagggcacaggagctacctg

SEQ ID NO: 1980999 - DNA, 12 bp, Homo sapiens
cagggcagagcc

SEQ ID NO: 1981000 - DNA, 12 bp, Homo sapiens
cagggcagaggg

SEQ ID NO: 1981001 - DNA, 16 bp, Homo sapiens
cagggcagtgacaagt

SEQ ID NO: 1981002 - DNA, 22 bp, Homo sapiens
cagggcagtgacaagtggaggg

SEQ ID NO: 1981003 - DNA, 17 bp, Homo sapiens
cagggcatcccatgggg

SEQ ID NO: 1981004 - DNA, 19 bp, Homo sapiens
cagggcatccgcagcccag

SEQ ID NO: 1981005 - DNA, 18 bp, Homo sapiens
cagggccacgtgccaggc

SEQ ID NO: 1981006 - DNA, 19 bp, Homo sapiens
cagggccagaaggagggca

SEQ ID NO: 1981007 - DNA, 23 bp, Homo sapiens
cagggccagaaggagggcagagc

SEQ ID NO: 1981008 - DNA, 22 bp, Homo sapiens
cagggcccctccctctgcccca

SEQ ID NO: 1981009 - DNA, 21 bp, Homo sapiens
cagggccctaacgggggtgcg

SEQ ID NO: 1981010 - DNA, 15 bp, Homo sapiens
cagggccctgcagag

SEQ ID NO: 1981011 - DNA, 12 bp, Homo sapiens
cagggccgggga

SEQ ID NO: 1981012 - DNA, 13 bp, Homo sapiens
cagggcctggggg

SEQ ID NO: 1981013 - DNA, 21 bp, Homo sapiens
cagggcctgggggcagtgact

SEQ ID NO: 1981014 - DNA, 23 bp, Homo sapiens
cagggcctgggggcagtgactgg

SEQ ID NO: 1981015 - DNA, 12 bp, Homo sapiens
cagggcctggtg

SEQ ID NO: 1981016 - DNA, 22 bp, Homo sapiens
cagggcctggtgtgaggctggg

SEQ ID NO: 1981017 - DNA, 13 bp, Homo sapiens
cagggccttgccc

SEQ ID NO: 1981018 - DNA, 17 bp, Homo sapiens
cagggctaccctccccc

SEQ ID NO: 1981019 - DNA, 12 bp, Homo sapiens
cagggctcagcc

SEQ ID NO: 1981020 - DNA, 13 bp, Homo sapiens
cagggctcagcct

SEQ ID NO: 1981021 - DNA, 16 bp, Homo sapiens
cagggctcagcctggt

SEQ ID NO: 1981022 - DNA, 23 bp, Homo sapiens
cagggctccctcctggagcatcc

SEQ ID NO: 1981023 - DNA, 15 bp, Homo sapiens
cagggctcgggcgct

SEQ ID NO: 1981024 - DNA, 18 bp, Homo sapiens
cagggctcgggcgctgtg

SEQ ID NO: 1981025 - DNA, 19 bp, Homo sapiens
cagggctctcctggcttcc

SEQ ID NO: 1981026 - DNA, 15 bp, Homo sapiens
cagggctctgcccca

SEQ ID NO: 1981027 - DNA, 14 bp, Homo sapiens
cagggctgccacta

SEQ ID NO: 1981028 - DNA, 15 bp, Homo sapiens
cagggctgcccctgt

SEQ ID NO: 1981029 - DNA, 23 bp, Homo sapiens
cagggctgcccctgtaggttgct

SEQ ID NO: 1981030 - DNA, 22 bp, Homo sapiens
cagggctggaaaagtcacacag

SEQ ID NO: 1981031 - DNA, 17 bp, Homo sapiens
cagggctgggagaactt

SEQ ID NO: 1981032 - DNA, 21 bp, Homo sapiens
cagggcttggggagcaggtct

SEQ ID NO: 1981033 - DNA, 23 bp, Homo sapiens
cagggcttggggagcaggtctct

SEQ ID NO: 1981034 - DNA, 15 bp, Homo sapiens
caggggaccacacct

SEQ ID NO: 1981035 - DNA, 14 bp, Homo sapiens
caggggatcaaagt

SEQ ID NO: 1981036 - DNA, 15 bp, Homo sapiens
caggggatcaaagtt

SEQ ID NO: 1981037 - DNA, 20 bp, Homo sapiens
caggggcaaagaactgcccc

SEQ ID NO: 1981038 - DNA, 15 bp, Homo sapiens
caggggcaggcctgg

SEQ ID NO: 1981039 - DNA, 16 bp, Homo sapiens
caggggcaggcctggg

SEQ ID NO: 1981040 - DNA, 14 bp, Homo sapiens
caggggccccagat

SEQ ID NO: 1981041 - DNA, 15 bp, Homo sapiens
caggggccccagatc

SEQ ID NO: 1981042 - DNA, 17 bp, Homo sapiens
caggggccccagatctg

SEQ ID NO: 1981043 - DNA, 24 bp, Homo sapiens
caggggccccagatctgcctgggc

SEQ ID NO: 1981044 - DNA, 17 bp, Homo sapiens
caggggcctcaggggag

SEQ ID NO: 1981045 - DNA, 18 bp, Homo sapiens
caggggcctcaggggagc

SEQ ID NO: 1981046 - DNA, 15 bp, Homo sapiens
caggggcggggcagg

SEQ ID NO: 1981047 - DNA, 19 bp, Homo sapiens
caggggggttgtgaggcct

SEQ ID NO: 1981048 - DNA, 21 bp, Homo sapiens
caggggtatatttagaccctg

SEQ ID NO: 1981049 - DNA, 16 bp, Homo sapiens
caggggtctccctgga

SEQ ID NO: 1981050 - DNA, 14 bp, Homo sapiens
caggggtctgagcc

SEQ ID NO: 1981051 - DNA, 16 bp, Homo sapiens
caggggtgggagagcc

SEQ ID NO: 1981052 - DNA, 17 bp, Homo sapiens
caggggtgggagagcca

SEQ ID NO: 1981053 - DNA, 15 bp, Homo sapiens
cagggtaggggaggg

SEQ ID NO: 1981054 - DNA, 18 bp, Homo sapiens
cagggtccagaccctgaa

SEQ ID NO: 1981055 - DNA, 18 bp, Homo sapiens
cagggtccgcaccagctg

SEQ ID NO: 1981056 - DNA, 21 bp, Homo sapiens
cagggtctcactatgttgccc

SEQ ID NO: 1981057 - DNA, 23 bp, Homo sapiens
cagggtctcactatgttgcccag

SEQ ID NO: 1981058 - DNA, 18 bp, Homo sapiens
cagggtctcactctgtcg

SEQ ID NO: 1981059 - DNA, 22 bp, Homo sapiens
cagggtcttgggctactggcag

SEQ ID NO: 1981060 - DNA, 17 bp, Homo sapiens
cagggtgaatcagatgg

SEQ ID NO: 1981061 - DNA, 22 bp, Homo sapiens
cagggtgaggtgcttgccccca

SEQ ID NO: 1981062 - DNA, 22 bp, Homo sapiens
cagggtggccccctgtgccagc

SEQ ID NO: 1981063 - DNA, 23 bp, Homo sapiens
cagggtgggccactctcccctcc

SEQ ID NO: 1981064 - DNA, 14 bp, Homo sapiens
cagggtgggggagg

SEQ ID NO: 1981065 - DNA, 20 bp, Homo sapiens
cagggtgtgagcgccacatc

SEQ ID NO: 1981066 - DNA, 21 bp, Homo sapiens
cagggttggcccctgcccggc

SEQ ID NO: 1981067 - DNA, 17 bp, Homo sapiens
cagggtttacccagtgg

SEQ ID NO: 1981068 - DNA, 19 bp, Homo sapiens
cagggtttacccagtggga

SEQ ID NO: 1981069 - DNA, 16 bp, Homo sapiens
cagggttttgccatgt

SEQ ID NO: 1981070 - DNA, 20 bp, Homo sapiens
cagcttgtggcaagtgaatt

SEQ ID NO: 1981071 - DNA, 17 bp, Homo sapiens
cagcttgttatttataa

SEQ ID NO: 1981072 - DNA, 21 bp, Homo sapiens
cagctttacatgcaatttatt

SEQ ID NO: 1981073 - DNA, 15 bp, Homo sapiens
cagctttcagagcca

SEQ ID NO: 1981074 - DNA, 14 bp, Homo sapiens
cagctttcctgtat

SEQ ID NO: 1981075 - DNA, 13 bp, Homo sapiens
cagctttttgtct

SEQ ID NO: 1981076 - DNA, 22 bp, Homo sapiens
caggaaaacaaatcactgtatt

SEQ ID NO: 1981077 - DNA, 15 bp, Homo sapiens
caggaaaactgtttt

SEQ ID NO: 1981078 - DNA, 16 bp, Homo sapiens
caggaaaagctgctga

SEQ ID NO: 1981079 - DNA, 19 bp, Homo sapiens
caggaaaagctgctgacag

SEQ ID NO: 1981080 - DNA, 13 bp, Homo sapiens
caggaaaaggcct

SEQ ID NO: 1981081 - DNA, 16 bp, Homo sapiens
caggaaaaggcctggg

SEQ ID NO: 1981082 - DNA, 19 bp, Homo sapiens
caggaaaaggcctggggtg

SEQ ID NO: 1981083 - DNA, 16 bp, Homo sapiens
caggaaaatcctctgg

SEQ ID NO: 1981084 - DNA, 18 bp, Homo sapiens
caggaaaccaacacccaa

SEQ ID NO: 1981085 - DNA, 11 bp, Homo sapiens
caggaaagaat

SEQ ID NO: 1981086 - DNA, 17 bp, Homo sapiens
caggaaagccctccccc

SEQ ID NO: 1981087 - DNA, 19 bp, Homo sapiens
caggaaagccctccccctt

SEQ ID NO: 1981088 - DNA, 23 bp, Homo sapiens
caggaaagccctcccccttcccc

SEQ ID NO: 1981089 - DNA, 19 bp, Homo sapiens
caggaaatcaaatatgcaa

SEQ ID NO: 1981090 - DNA, 22 bp, Homo sapiens
caggaacacccgactcctcaaa

SEQ ID NO: 1981091 - DNA, 12 bp, Homo sapiens
caggaacagaag

SEQ ID NO: 1981092 - DNA, 14 bp, Homo sapiens
caggaacagagact

SEQ ID NO: 1981093 - DNA, 19 bp, Homo sapiens
caggaacagagactctgga

SEQ ID NO: 1981094 - DNA, 20 bp, Homo sapiens
caggaacctgtactgggtta

SEQ ID NO: 1981095 - DNA, 15 bp, Homo sapiens
caggaacgagcactg

SEQ ID NO: 1981096 - DNA, 17 bp, Homo sapiens
caggaacgagcactggc

SEQ ID NO: 1981097 - DNA, 20 bp, Homo sapiens
caggaacgagcactggccag

SEQ ID NO: 1981098 - DNA, 15 bp, Homo sapiens
caggaactcccagca

SEQ ID NO: 1981099 - DNA, 16 bp, Homo sapiens
caggaagaaaccccaa

SEQ ID NO: 1981100 - DNA, 23 bp, Homo sapiens
caggaagaaaccccaagcagcat

SEQ ID NO: 1981101 - DNA, 17 bp, Homo sapiens
caggaagagaaggagca

SEQ ID NO: 1981102 - DNA, 13 bp, Homo sapiens
caggaagagagag

SEQ ID NO: 1981103 - DNA, 21 bp, Homo sapiens
caggaagagagagagagaggt

SEQ ID NO: 1981104 - DNA, 19 bp, Homo sapiens
caggaagccaggctgagtg

SEQ ID NO: 1981105 - DNA, 16 bp, Homo sapiens
caggaagcccaaggca

SEQ ID NO: 1981106 - DNA, 12 bp, Homo sapiens
caggaaggcagc

SEQ ID NO: 1981107 - DNA, 13 bp, Homo sapiens
caggaaggcagct

SEQ ID NO: 1981108 - DNA, 21 bp, Homo sapiens
caggaagggggtccacccagc

SEQ ID NO: 1981109 - DNA, 23 bp, Homo sapiens
caggaagggggtccacccagcaa

SEQ ID NO: 1981110 - DNA, 17 bp, Homo sapiens
caggaaggtagcccagc

SEQ ID NO: 1981111 - DNA, 20 bp, Homo sapiens
caggaaggtagcccagcact

SEQ ID NO: 1981112 - DNA, 21 bp, Homo sapiens
caggaaggtagcccagcactg

SEQ ID NO: 1981113 - DNA, 12 bp, Homo sapiens
caggaataaggc

SEQ ID NO: 1981114 - DNA, 14 bp, Homo sapiens
caggaatctcagag

SEQ ID NO: 1981115 - DNA, 17 bp, Homo sapiens
caggaatgtgtggcaga

SEQ ID NO: 1981116 - DNA, 15 bp, Homo sapiens
caggaattgaagatg

SEQ ID NO: 1981117 - DNA, 13 bp, Homo sapiens
caggacacaggcc

SEQ ID NO: 1981118 - DNA, 14 bp, Homo sapiens
caggacacaggcct

SEQ ID NO: 1981119 - DNA, 16 bp, Homo sapiens
caggacacaggcctgt

SEQ ID NO: 1981120 - DNA, 22 bp, Homo sapiens
caggacacatcccggcctcttc

SEQ ID NO: 1981121 - DNA, 14 bp, Homo sapiens
caggacaccagcct

SEQ ID NO: 1981122 - DNA, 18 bp, Homo sapiens
caggacacctgccccagc

SEQ ID NO: 1981123 - DNA, 15 bp, Homo sapiens
caggacacctggccg

SEQ ID NO: 1981124 - DNA, 12 bp, Homo sapiens
caggacagctgg

SEQ ID NO: 1981125 - DNA, 14 bp, Homo sapiens
caggacagctggct

SEQ ID NO: 1981126 - DNA, 15 bp, Homo sapiens
caggacagctggctg

SEQ ID NO: 1981127 - DNA, 19 bp, Homo sapiens
caggacagctggctgctga

SEQ ID NO: 1981128 - DNA, 20 bp, Homo sapiens
caggacagctggctgctgac

SEQ ID NO: 1981129 - DNA, 21 bp, Homo sapiens
caggacagctggctgctgaca

SEQ ID NO: 1981130 - DNA, 13 bp, Homo sapiens
caggacaggagac

SEQ ID NO: 1981131 - DNA, 12 bp, Homo sapiens
caggacaggccc

SEQ ID NO: 1981132 - DNA, 20 bp, Homo sapiens
caggacagtgcttcagcctg

SEQ ID NO: 1981133 - DNA, 16 bp, Homo sapiens
caggacatgatactga

SEQ ID NO: 1981134 - DNA, 18 bp, Homo sapiens
caggaccagtcccagagc

SEQ ID NO: 1981135 - DNA, 19 bp, Homo sapiens
caggaccagtcccagagca

SEQ ID NO: 1981136 - DNA, 17 bp, Homo sapiens
caggacccaggccctcc

SEQ ID NO: 1981137 - DNA, 24 bp, Homo sapiens
caggacccaggccctccatgggct

SEQ ID NO: 1981138 - DNA, 20 bp, Homo sapiens
caggacctctggacctcagg

SEQ ID NO: 1981139 - DNA, 17 bp, Homo sapiens
caggactatagcccagg

SEQ ID NO: 1981140 - DNA, 21 bp, Homo sapiens
caggactatagcccaggtcct

SEQ ID NO: 1981141 - DNA, 14 bp, Homo sapiens
caggactcaccctc

SEQ ID NO: 1981142 - DNA, 16 bp, Homo sapiens
caggactcaccctcat

SEQ ID NO: 1981143 - DNA, 20 bp, Homo sapiens
caggactccccaggccaggc

SEQ ID NO: 1981144 - DNA, 12 bp, Homo sapiens
caggactctgcc

SEQ ID NO: 1981145 - DNA, 21 bp, Homo sapiens
caggactctgccccttctgtt

SEQ ID NO: 1981146 - DNA, 15 bp, Homo sapiens
caggactctgcctcc

SEQ ID NO: 1981147 - DNA, 21 bp, Homo sapiens
caggactgaattgtccccagt

SEQ ID NO: 1981148 - DNA, 14 bp, Homo sapiens
caggactggctcac

SEQ ID NO: 1981149 - DNA, 16 bp, Homo sapiens
caggactggctcaccc

SEQ ID NO: 1981150 - DNA, 14 bp, Homo sapiens
caggactgtgactc

SEQ ID NO: 1981151 - DNA, 20 bp, Homo sapiens
caggacttaacggctccagg

SEQ ID NO: 1981152 - DNA, 23 bp, Homo sapiens
caggacttaacggctccaggatt

SEQ ID NO: 1981153 - DNA, 23 bp, Homo sapiens
caggacttggtctgatttcagga

SEQ ID NO: 1981154 - DNA, 23 bp, Homo sapiens
caggagaaatgcatccattcctc

SEQ ID NO: 1981155 - DNA, 18 bp, Homo sapiens
caggagaatcaataaaaa

SEQ ID NO: 1981156 - DNA, 12 bp, Homo sapiens
caggagacaaga

SEQ ID NO: 1981157 - DNA, 12 bp, Homo sapiens
caggagacatcc

SEQ ID NO: 1981158 - DNA, 19 bp, Homo sapiens
caggagagagttgaaccta

SEQ ID NO: 1981159 - DNA, 16 bp, Homo sapiens
caggagagccagccct

SEQ ID NO: 1981160 - DNA, 17 bp, Homo sapiens
caggagagccagccctc

SEQ ID NO: 1981161 - DNA, 20 bp, Homo sapiens
caggagcacacggccctgcc

SEQ ID NO: 1981162 - DNA, 15 bp, Homo sapiens
caggagcacaggcag

SEQ ID NO: 1981163 - DNA, 17 bp, Homo sapiens
caggagcacaggcagct

SEQ ID NO: 1981164 - DNA, 21 bp, Homo sapiens
caggagcagacagagaaatgt

SEQ ID NO: 1981165 - DNA, 14 bp, Homo sapiens
caggagcaggaaca

SEQ ID NO: 1981166 - DNA, 16 bp, Homo sapiens
caggagcaggaacaga

SEQ ID NO: 1981167 - DNA, 19 bp, Homo sapiens
caggagcaggaacagagac

SEQ ID NO: 1981168 - DNA, 19 bp, Homo sapiens
cagccagccgccctgggct

SEQ ID NO: 1981169 - DNA, 17 bp, Homo sapiens
cagccagcgcctccctc

SEQ ID NO: 1981170 - DNA, 18 bp, Homo sapiens
cagccagcgcctccctcc

SEQ ID NO: 1981171 - DNA, 20 bp, Homo sapiens
cagccagcgcctccctccac

SEQ ID NO: 1981172 - DNA, 12 bp, Homo sapiens
cagccagctctc

SEQ ID NO: 1981173 - DNA, 16 bp, Homo sapiens
cagccagctctcagcc

SEQ ID NO: 1981174 - DNA, 21 bp, Homo sapiens
cagccagctctcagccaacga

SEQ ID NO: 1981175 - DNA, 11 bp, Homo sapiens
cagccagggcc

SEQ ID NO: 1981176 - DNA, 14 bp, Homo sapiens
cagccaggggctgc

SEQ ID NO: 1981177 - DNA, 23 bp, Homo sapiens
cagccaggttagcctttgccctg

SEQ ID NO: 1981178 - DNA, 16 bp, Homo sapiens
cagccagtcttgccta

SEQ ID NO: 1981179 - DNA, 18 bp, Homo sapiens
cagccagtcttgcctagg

SEQ ID NO: 1981180 - DNA, 21 bp, Homo sapiens
cagccatcaagagactgagtc

SEQ ID NO: 1981181 - DNA, 22 bp, Homo sapiens
cagccatcacaaggggaacgca

SEQ ID NO: 1981182 - DNA, 16 bp, Homo sapiens
cagccatgaagtcacc

SEQ ID NO: 1981183 - DNA, 11 bp, Homo sapiens
cagccatgcct

SEQ ID NO: 1981184 - DNA, 14 bp, Homo sapiens
cagccatgcctcat

SEQ ID NO: 1981185 - DNA, 16 bp, Homo sapiens
cagccatgcctcatgc

SEQ ID NO: 1981186 - DNA, 17 bp, Homo sapiens
cagccatgcctcatgcc

SEQ ID NO: 1981187 - DNA, 20 bp, Homo sapiens
cagccattaccatggagaca

SEQ ID NO: 1981188 - DNA, 17 bp, Homo sapiens
cagcccaaagaaggaaa

SEQ ID NO: 1981189 - DNA, 17 bp, Homo sapiens
cagcccaacagaaggaa

SEQ ID NO: 1981190 - DNA, 21 bp, Homo sapiens
cagcccaagaggactgagact

SEQ ID NO: 1981191 - DNA, 22 bp, Homo sapiens
cagcccaagggcggggctatgc

SEQ ID NO: 1981192 - DNA, 16 bp, Homo sapiens
cagcccacacccctcc

SEQ ID NO: 1981193 - DNA, 14 bp, Homo sapiens
cagcccacagagcc

SEQ ID NO: 1981194 - DNA, 17 bp, Homo sapiens
cagcccacagagcctga

SEQ ID NO: 1981195 - DNA, 15 bp, Homo sapiens
cagcccagcctctgt

SEQ ID NO: 1981196 - DNA, 16 bp, Homo sapiens
cagcccagcttcctgg

SEQ ID NO: 1981197 - DNA, 15 bp, Homo sapiens
cagcccaggtcctcc

SEQ ID NO: 1981198 - DNA, 22 bp, Homo sapiens
cagcccattctctctcctgtcc

SEQ ID NO: 1981199 - DNA, 19 bp, Homo sapiens
cagccccacagcacccagg

SEQ ID NO: 1981200 - DNA, 20 bp, Homo sapiens
cagccccacagcacccaggc

SEQ ID NO: 1981201 - DNA, 17 bp, Homo sapiens
cagccccagtgcccaca

SEQ ID NO: 1981202 - DNA, 17 bp, Homo sapiens
cagccccatcttggtcc

SEQ ID NO: 1981203 - DNA, 22 bp, Homo sapiens
cagccccatcttggtcctgtca

SEQ ID NO: 1981204 - DNA, 17 bp, Homo sapiens
cagccccattctgcctg

SEQ ID NO: 1981205 - DNA, 22 bp, Homo sapiens
cagcccccactttcctacaaaa

SEQ ID NO: 1981206 - DNA, 14 bp, Homo sapiens
cagccccccagcac

SEQ ID NO: 1981207 - DNA, 22 bp, Homo sapiens
cagccccctggatgggcattgg

SEQ ID NO: 1981208 - DNA, 20 bp, Homo sapiens
cagccccgactccagccagc

SEQ ID NO: 1981209 - DNA, 21 bp, Homo sapiens
cagccccgactccagccagcg

SEQ ID NO: 1981210 - DNA, 16 bp, Homo sapiens
cagccccgcgcctcct

SEQ ID NO: 1981211 - DNA, 16 bp, Homo sapiens
cagccccgggcctgcc

SEQ ID NO: 1981212 - DNA, 20 bp, Homo sapiens
cagccccgggcctgcctctg

SEQ ID NO: 1981213 - DNA, 13 bp, Homo sapiens
cagcccctcctcc

SEQ ID NO: 1981214 - DNA, 13 bp, Homo sapiens
cagcccctcctct

SEQ ID NO: 1981215 - DNA, 14 bp, Homo sapiens
cagcccctcctctg

SEQ ID NO: 1981216 - DNA, 16 bp, Homo sapiens
cagcccctcctctgcc

SEQ ID NO: 1981217 - DNA, 17 bp, Homo sapiens
cagcccctcctctgcca

SEQ ID NO: 1981218 - DNA, 19 bp, Homo sapiens
cagcccctcctctgccacc

SEQ ID NO: 1981219 - DNA, 23 bp, Homo sapiens
cagcccctcctctgccacctccc

SEQ ID NO: 1981220 - DNA, 12 bp, Homo sapiens
cagcccggcctg

SEQ ID NO: 1981221 - DNA, 20 bp, Homo sapiens
cagcccggcctgctcccagc

SEQ ID NO: 1981222 - DNA, 21 bp, Homo sapiens
cagcccggcgccaccatcctg

SEQ ID NO: 1981223 - DNA, 21 bp, Homo sapiens
cagcccgggtgtgcctgccct

SEQ ID NO: 1981224 - DNA, 22 bp, Homo sapiens
cagcccgggtgtgcctgccctg

SEQ ID NO: 1981225 - DNA, 17 bp, Homo sapiens
cagccctaaggatctct

SEQ ID NO: 1981226 - DNA, 21 bp, Homo sapiens
cagccctacatcttcagctcc

SEQ ID NO: 1981227 - DNA, 12 bp, Homo sapiens
cagccctcaggc

SEQ ID NO: 1981228 - DNA, 20 bp, Homo sapiens
cagccctcaggccagtgcca

SEQ ID NO: 1981229 - DNA, 22 bp, Homo sapiens
cagccctcaggccagtgccagg

SEQ ID NO: 1981230 - DNA, 23 bp, Homo sapiens
cagccctcaggccagtgccagga

SEQ ID NO: 1981231 - DNA, 16 bp, Homo sapiens
cagccctccctgcccc

SEQ ID NO: 1981232 - DNA, 15 bp, Homo sapiens
cagccctccctgtcc

SEQ ID NO: 1981233 - DNA, 18 bp, Homo sapiens
cagccctccctgtcctcc

SEQ ID NO: 1981234 - DNA, 19 bp, Homo sapiens
cagccctccctgtcctcct

SEQ ID NO: 1981235 - DNA, 22 bp, Homo sapiens
cagccctccctgtcctcctcgg

SEQ ID NO: 1981236 - DNA, 12 bp, Homo sapiens
cagccctcctca

SEQ ID NO: 1981237 - DNA, 14 bp, Homo sapiens
cagccctcctcacc

SEQ ID NO: 1981238 - DNA, 14 bp, Homo sapiens
cagccctgccagga

SEQ ID NO: 1981239 - DNA, 15 bp, Homo sapiens
cagccctgccaggag

SEQ ID NO: 1981240 - DNA, 16 bp, Homo sapiens
cagccctgccaggagg

SEQ ID NO: 1981241 - DNA, 13 bp, Homo sapiens
cagccctgcctgg

SEQ ID NO: 1981242 - DNA, 14 bp, Homo sapiens
cagccctgcctgga

SEQ ID NO: 1981243 - DNA, 16 bp, Homo sapiens
cagccctgcctggagg

SEQ ID NO: 1981244 - DNA, 20 bp, Homo sapiens
cagccctgcctggaggacct

SEQ ID NO: 1981245 - DNA, 21 bp, Homo sapiens
cagccctgcctggaggacctg

SEQ ID NO: 1981246 - DNA, 22 bp, Homo sapiens
cagccctgctttgggctgccct

SEQ ID NO: 1981247 - DNA, 23 bp, Homo sapiens
cagccctgctttgggctgccctg

SEQ ID NO: 1981248 - DNA, 15 bp, Homo sapiens
cagccctggctctgc

SEQ ID NO: 1981249 - DNA, 12 bp, Homo sapiens
cagccctgggag

SEQ ID NO: 1981250 - DNA, 18 bp, Homo sapiens
cagccctgggccccacca

SEQ ID NO: 1981251 - DNA, 20 bp, Homo sapiens
cagccctgggccccaccacc

SEQ ID NO: 1981252 - DNA, 21 bp, Homo sapiens
cagccctgggccccaccacct

SEQ ID NO: 1981253 - DNA, 17 bp, Homo sapiens
cagccctgggggccagc

SEQ ID NO: 1981254 - DNA, 18 bp, Homo sapiens
cagccctgggggccagct

SEQ ID NO: 1981255 - DNA, 21 bp, Homo sapiens
cagccctgggggccagctggt

SEQ ID NO: 1981256 - DNA, 23 bp, Homo sapiens
cagccctggggtatgagctgcca

SEQ ID NO: 1981257 - DNA, 23 bp, Homo sapiens
cagccctgtcccctgaaaaactg

SEQ ID NO: 1981258 - DNA, 16 bp, Homo sapiens
cagcccttccctgctt

SEQ ID NO: 1981259 - DNA, 17 bp, Homo sapiens
cagcccttccctgcttt

SEQ ID NO: 1981260 - DNA, 22 bp, Homo sapiens
cagcccttccctgctttgagga

SEQ ID NO: 1981261 - DNA, 14 bp, Homo sapiens
cagcccttcctcct

SEQ ID NO: 1981262 - DNA, 15 bp, Homo sapiens
cagcccttcctcctg

SEQ ID NO: 1981263 - DNA, 20 bp, Homo sapiens
cagccctttgggaggctgag

SEQ ID NO: 1981264 - DNA, 23 bp, Homo sapiens
cagccctttgggaggctgaggcg

SEQ ID NO: 1981265 - DNA, 18 bp, Homo sapiens
cagccgagccgggcctgg

SEQ ID NO: 1981266 - DNA, 19 bp, Homo sapiens
cagccgagccgggcctggg

SEQ ID NO: 1981267 - DNA, 15 bp, Homo sapiens
cagccgccctgggct

SEQ ID NO: 1981268 - DNA, 14 bp, Homo sapiens
cagccgctaggaga

SEQ ID NO: 1981269 - DNA, 17 bp, Homo sapiens
cagccgctaggagagac

SEQ ID NO: 1981270 - DNA, 17 bp, Homo sapiens
cagccgctcctgtctgc

SEQ ID NO: 1981271 - DNA, 21 bp, Homo sapiens
cagccgctcctgtctgccagc

SEQ ID NO: 1981272 - DNA, 21 bp, Homo sapiens
cagccggcgtggcaaatataa

SEQ ID NO: 1981273 - DNA, 17 bp, Homo sapiens
cagccggggcgagtggc

SEQ ID NO: 1981274 - DNA, 20 bp, Homo sapiens
cagccggggcgagtggcacg

SEQ ID NO: 1981275 - DNA, 17 bp, Homo sapiens
cagccgggtacctcagt

SEQ ID NO: 1981276 - DNA, 19 bp, Homo sapiens
cagccgggtacctcagttt

SEQ ID NO: 1981277 - DNA, 19 bp, Homo sapiens
cagccggtacctgggaagg

SEQ ID NO: 1981278 - DNA, 16 bp, Homo sapiens
cagccgtgatgctcag

SEQ ID NO: 1981279 - DNA, 19 bp, Homo sapiens
cagccgtgatgctcaggct

SEQ ID NO: 1981280 - DNA, 23 bp, Homo sapiens
cagcctacccttgtaccccatcc

SEQ ID NO: 1981281 - DNA, 17 bp, Homo sapiens
cagcctagccgacctca

SEQ ID NO: 1981282 - DNA, 20 bp, Homo sapiens
cagcctagccgacctcagcc

SEQ ID NO: 1981283 - DNA, 12 bp, Homo sapiens
cagcctcacaga

SEQ ID NO: 1981284 - DNA, 13 bp, Homo sapiens
cagcctcagaggc

SEQ ID NO: 1981285 - DNA, 16 bp, Homo sapiens
cagcctcagctcagcc

SEQ ID NO: 1981286 - DNA, 14 bp, Homo sapiens
cagcctccaagctc

SEQ ID NO: 1981287 - DNA, 16 bp, Homo sapiens
cagcctccagagccag

SEQ ID NO: 1981288 - DNA, 21 bp, Homo sapiens
cagcctccagagccagcctgg

SEQ ID NO: 1981289 - DNA, 14 bp, Homo sapiens
cagcctccatgctg

SEQ ID NO: 1981290 - DNA, 18 bp, Homo sapiens
cagcctcccaaccccagg

SEQ ID NO: 1981291 - DNA, 20 bp, Homo sapiens
cagcctcccaaccccagggc

SEQ ID NO: 1981292 - DNA, 12 bp, Homo sapiens
cagcctcccaga

SEQ ID NO: 1981293 - DNA, 14 bp, Homo sapiens
cagcctcccagagt

SEQ ID NO: 1981294 - DNA, 12 bp, Homo sapiens
cagcctccccca

SEQ ID NO: 1981295 - DNA, 14 bp, Homo sapiens
cagcctcccccaca

SEQ ID NO: 1981296 - DNA, 18 bp, Homo sapiens
cagcctccccccgctggg

SEQ ID NO: 1981297 - DNA, 16 bp, Homo sapiens
cagcctccccctgctg

SEQ ID NO: 1981298 - DNA, 18 bp, Homo sapiens
cagcctccccctgctgct

SEQ ID NO: 1981299 - DNA, 20 bp, Homo sapiens
cagcctcccgaatagctggg

SEQ ID NO: 1981300 - DNA, 21 bp, Homo sapiens
cagcctcccgaatagctggga

SEQ ID NO: 1981301 - DNA, 23 bp, Homo sapiens
cagcctcccgaatagctgggact

SEQ ID NO: 1981302 - DNA, 13 bp, Homo sapiens
cagcctccctctg

SEQ ID NO: 1981303 - DNA, 15 bp, Homo sapiens
cagcctccctctgac

SEQ ID NO: 1981304 - DNA, 22 bp, Homo sapiens
cagcctccctctgacctgcagg

SEQ ID NO: 1981305 - DNA, 13 bp, Homo sapiens
cagcctcctcctg

SEQ ID NO: 1981306 - DNA, 15 bp, Homo sapiens
cagcctcctcctgac

SEQ ID NO: 1981307 - DNA, 14 bp, Homo sapiens
cagcctcctgggca

SEQ ID NO: 1981308 - DNA, 23 bp, Homo sapiens
cagcctctccaggcaccatctcc

SEQ ID NO: 1981309 - DNA, 12 bp, Homo sapiens
cagcctctctgc

SEQ ID NO: 1981310 - DNA, 15 bp, Homo sapiens
cagcctctctgctat

SEQ ID NO: 1981311 - DNA, 21 bp, Homo sapiens
cagcctctgtccctctttgcc

SEQ ID NO: 1981312 - DNA, 23 bp, Homo sapiens
cagcctctgtccctctttgcctg

SEQ ID NO: 1981313 - DNA, 20 bp, Homo sapiens
cagcctcttaaagctgcctg

SEQ ID NO: 1981314 - DNA, 18 bp, Homo sapiens
cagcctgaggctgagact

SEQ ID NO: 1981315 - DNA, 10 bp, Homo sapiens
cagcctgagt

SEQ ID NO: 1981316 - DNA, 14 bp, Homo sapiens
cagcctgagtctcc

SEQ ID NO: 1981317 - DNA, 15 bp, Homo sapiens
cagcctgagtctcct

SEQ ID NO: 1981318 - DNA, 17 bp, Homo sapiens
cagcctgagtctcctgt

SEQ ID NO: 1981319 - DNA, 22 bp, Homo sapiens
cagcctgagtctcctgtgccca

SEQ ID NO: 1981320 - DNA, 18 bp, Homo sapiens
cagcctgcagactcactg

SEQ ID NO: 1981321 - DNA, 19 bp, Homo sapiens
cagcctgctaattccccag

SEQ ID NO: 1981322 - DNA, 22 bp, Homo sapiens
cagcctgctccttcccaggagt

SEQ ID NO: 1981323 - DNA, 13 bp, Homo sapiens
cagcctggcacag

SEQ ID NO: 1981324 - DNA, 21 bp, Homo sapiens
cagcctggcacagggcagtgg

SEQ ID NO: 1981325 - DNA, 13 bp, Homo sapiens
cagcctggcctcc

SEQ ID NO: 1981326 - DNA, 15 bp, Homo sapiens
cagcctggcctcctg

SEQ ID NO: 1981327 - DNA, 15 bp, Homo sapiens
cagcctggcggggca

SEQ ID NO: 1981328 - DNA, 16 bp, Homo sapiens
cagcctggcttctgga

SEQ ID NO: 1981329 - DNA, 17 bp, Homo sapiens
cagcctggcttctggag

SEQ ID NO: 1981330 - DNA, 19 bp, Homo sapiens
cagcctggcttctggagcc

SEQ ID NO: 1981331 - DNA, 20 bp, Homo sapiens
cagcctggcttctggagccc

SEQ ID NO: 1981332 - DNA, 21 bp, Homo sapiens
cagcctggcttctggagccct

SEQ ID NO: 1981333 - DNA, 17 bp, Homo sapiens
cagcctgggaccagggc

SEQ ID NO: 1981334 - DNA, 19 bp, Homo sapiens
cagcctgggaccagggcat

SEQ ID NO: 1981335 - DNA, 20 bp, Homo sapiens
cagcctgggaccagggcata

SEQ ID NO: 1981336 - DNA, 17 bp, Homo sapiens
cagcctgggactcccag

SEQ ID NO: 1981337 - DNA, 19 bp, Homo sapiens
cagcctgggcaacagagca

SEQ ID NO: 1981338 - DNA, 12 bp, Homo sapiens
cagcctgggcct

SEQ ID NO: 1981339 - DNA, 17 bp, Homo sapiens
cagcctgggcctatgga

SEQ ID NO: 1981340 - DNA, 21 bp, Homo sapiens
cagcctgggcctatggagagc

SEQ ID NO: 1981341 - DNA, 22 bp, Homo sapiens
cagcctgggcctatggagagcc

SEQ ID NO: 1981342 - DNA, 23 bp, Homo sapiens
cagcctgggcctatggagagccc

SEQ ID NO: 1981343 - DNA, 16 bp, Homo sapiens
cagcctggtgggcctc

SEQ ID NO: 1981344 - DNA, 17 bp, Homo sapiens
cagcctggtgggcctcc

SEQ ID NO: 1981345 - DNA, 23 bp, Homo sapiens
cagcctggtgggcctcctctgtc

SEQ ID NO: 1981346 - DNA, 19 bp, Homo sapiens
cagcctggtttagcctgga

SEQ ID NO: 1981347 - DNA, 16 bp, Homo sapiens
cagcctgtcctggtac

SEQ ID NO: 1981348 - DNA, 19 bp, Homo sapiens
cagcctgtggcggtgcctg

SEQ ID NO: 1981349 - DNA, 21 bp, Homo sapiens
cagccttccccttgcccaggg

SEQ ID NO: 1981350 - DNA, 20 bp, Homo sapiens
cagcgagaggcagagaaaga

SEQ ID NO: 1981351 - DNA, 17 bp, Homo sapiens
cagcgagccctggtggc

SEQ ID NO: 1981352 - DNA, 21 bp, Homo sapiens
cagcgagccctggtggcagtg

SEQ ID NO: 1981353 - DNA, 20 bp, Homo sapiens
cagcgattccctctcccagg

SEQ ID NO: 1981354 - DNA, 23 bp, Homo sapiens
cagcgcagccgccgggcaggcct

SEQ ID NO: 1981355 - DNA, 15 bp, Homo sapiens
cagcgcctccctcca

SEQ ID NO: 1981356 - DNA, 20 bp, Homo sapiens
cagcgcctccctccacccca

SEQ ID NO: 1981357 - DNA, 15 bp, Homo sapiens
cagcgcctgccctcc

SEQ ID NO: 1981358 - DNA, 20 bp, Homo sapiens
cagcgcctgccctccctggg

SEQ ID NO: 1981359 - DNA, 23 bp, Homo sapiens
cagcgcctgccctccctggggtc

SEQ ID NO: 1981360 - DNA, 15 bp, Homo sapiens
cagcgcgtgcacagc

SEQ ID NO: 1981361 - DNA, 21 bp, Homo sapiens
cagcgcgtgcacagcgcgggc

SEQ ID NO: 1981362 - DNA, 16 bp, Homo sapiens
cagcggcccctgcatc

SEQ ID NO: 1981363 - DNA, 20 bp, Homo sapiens
cagcggcccctgcatcccct

SEQ ID NO: 1981364 - DNA, 14 bp, Homo sapiens
cagcggctgggtgg

SEQ ID NO: 1981365 - DNA, 15 bp, Homo sapiens
cagcggggacagctc

SEQ ID NO: 1981366 - DNA, 18 bp, Homo sapiens
cagcggggacagctcctt

SEQ ID NO: 1981367 - DNA, 19 bp, Homo sapiens
cagcggggacagctccttc

SEQ ID NO: 1981368 - DNA, 14 bp, Homo sapiens
cagcgtggccttgt

SEQ ID NO: 1981369 - DNA, 15 bp, Homo sapiens
cagcgtggccttgtt

SEQ ID NO: 1981370 - DNA, 18 bp, Homo sapiens
cagctaaagcccaacctc

SEQ ID NO: 1981371 - DNA, 18 bp, Homo sapiens
cagctaagctaggaatga

SEQ ID NO: 1981372 - DNA, 17 bp, Homo sapiens
cagctaatctgtagggc

SEQ ID NO: 1981373 - DNA, 15 bp, Homo sapiens
cagctaatgggacac

SEQ ID NO: 1981374 - DNA, 16 bp, Homo sapiens
cagctaatgggacact

SEQ ID NO: 1981375 - DNA, 18 bp, Homo sapiens
cagctacacctgaggctg

SEQ ID NO: 1981376 - DNA, 12 bp, Homo sapiens
cagctacattcc

SEQ ID NO: 1981377 - DNA, 13 bp, Homo sapiens
cagctacattcct

SEQ ID NO: 1981378 - DNA, 15 bp, Homo sapiens
cagctacattcctca

SEQ ID NO: 1981379 - DNA, 20 bp, Homo sapiens
cagctactcaagaggctgag

SEQ ID NO: 1981380 - DNA, 14 bp, Homo sapiens
cagctactcagaag

SEQ ID NO: 1981381 - DNA, 15 bp, Homo sapiens
cagctactcagaagc

SEQ ID NO: 1981382 - DNA, 22 bp, Homo sapiens
cagctactcagaagcctgaggc

SEQ ID NO: 1981383 - DNA, 15 bp, Homo sapiens
cagctactctgtcca

SEQ ID NO: 1981384 - DNA, 16 bp, Homo sapiens
cagctactctgtccag

SEQ ID NO: 1981385 - DNA, 23 bp, Homo sapiens
cagctactctgtccaggccactg

SEQ ID NO: 1981386 - DNA, 15 bp, Homo sapiens
cagctagactggagt

SEQ ID NO: 1981387 - DNA, 18 bp, Homo sapiens
cagctagactggagtgag

SEQ ID NO: 1981388 - DNA, 22 bp, Homo sapiens
cagctagccaactcctccttgc

SEQ ID NO: 1981389 - DNA, 23 bp, Homo sapiens
aatgcattataggatcatttgtt

SEQ ID NO: 1981390 - DNA, 17 bp, Homo sapiens
aatgcattgtcttgtgg

SEQ ID NO: 1981391 - DNA, 17 bp, Homo sapiens
aatgcattttcaagata

SEQ ID NO: 1981392 - DNA, 19 bp, Homo sapiens
aatgccacacattgtgctt

SEQ ID NO: 1981393 - DNA, 13 bp, Homo sapiens
aatgcccagttca

SEQ ID NO: 1981394 - DNA, 18 bp, Homo sapiens
aatgcccgtaatgcttag

SEQ ID NO: 1981395 - DNA, 14 bp, Homo sapiens
aatgccctctctga

SEQ ID NO: 1981396 - DNA, 12 bp, Homo sapiens
aatgccctgcca

SEQ ID NO: 1981397 - DNA, 16 bp, Homo sapiens
aatgcctaataaacaa

SEQ ID NO: 1981398 - DNA, 12 bp, Homo sapiens
aatgcctcctcc

SEQ ID NO: 1981399 - DNA, 14 bp, Homo sapiens
aatgcctcctccct

SEQ ID NO: 1981400 - DNA, 14 bp, Homo sapiens
aatgcgtaattaaa

SEQ ID NO: 1981401 - DNA, 23 bp, Homo sapiens
aatgcgtgttgtacatacagagg

SEQ ID NO: 1981402 - DNA, 12 bp, Homo sapiens
aatgctaaatgc

SEQ ID NO: 1981403 - DNA, 15 bp, Homo sapiens
aatgctattgaaatt

SEQ ID NO: 1981404 - DNA, 19 bp, Homo sapiens
aatgctattgaaattactg

SEQ ID NO: 1981405 - DNA, 12 bp, Homo sapiens
aatgctcctgga

SEQ ID NO: 1981406 - DNA, 16 bp, Homo sapiens
aatgctcgtgtgattt

SEQ ID NO: 1981407 - DNA, 13 bp, Homo sapiens
aatgctctccttt

SEQ ID NO: 1981408 - DNA, 14 bp, Homo sapiens
aatgctctcctttc

SEQ ID NO: 1981409 - DNA, 20 bp, Homo sapiens
aatgctgtagaatgcttggc

SEQ ID NO: 1981410 - DNA, 12 bp, Homo sapiens
aatgctttcctc

SEQ ID NO: 1981411 - DNA, 13 bp, Homo sapiens
aatgctttctgaa

SEQ ID NO: 1981412 - DNA, 15 bp, Homo sapiens
aatggaaaagagaga

SEQ ID NO: 1981413 - DNA, 22 bp, Homo sapiens
aatggaaacagggcagtgacaa

SEQ ID NO: 1981414 - DNA, 22 bp, Homo sapiens
aatggaaatcatcgaaaattca

SEQ ID NO: 1981415 - DNA, 14 bp, Homo sapiens
aatggaactgaccc

SEQ ID NO: 1981416 - DNA, 14 bp, Homo sapiens
aatggaagagaaat

SEQ ID NO: 1981417 - DNA, 19 bp, Homo sapiens
aatggaatcagcttttaat

SEQ ID NO: 1981418 - DNA, 13 bp, Homo sapiens
aatggactcatgg

SEQ ID NO: 1981419 - DNA, 14 bp, Homo sapiens
aatggacttcaaat

SEQ ID NO: 1981420 - DNA, 14 bp, Homo sapiens
aatggagggagcca

SEQ ID NO: 1981421 - DNA, 14 bp, Homo sapiens
aatggagtgggaga

SEQ ID NO: 1981422 - DNA, 15 bp, Homo sapiens
aatggagtgggagat

SEQ ID NO: 1981423 - DNA, 19 bp, Homo sapiens
aatggatttttaaattata

SEQ ID NO: 1981424 - DNA, 23 bp, Homo sapiens
aatggcaaagcggttgcttctgg

SEQ ID NO: 1981425 - DNA, 16 bp, Homo sapiens
aatggcaagttttgat

SEQ ID NO: 1981426 - DNA, 12 bp, Homo sapiens
aatggcactgat

SEQ ID NO: 1981427 - DNA, 19 bp, Homo sapiens
aatggcagcagttccatga

SEQ ID NO: 1981428 - DNA, 21 bp, Homo sapiens
aatggccctagaactgtgcct

SEQ ID NO: 1981429 - DNA, 14 bp, Homo sapiens
aatggcctgccttg

SEQ ID NO: 1981430 - DNA, 14 bp, Homo sapiens
aatggctatgtttt

SEQ ID NO: 1981431 - DNA, 19 bp, Homo sapiens
aatggctctgtgaaatcag

SEQ ID NO: 1981432 - DNA, 21 bp, Homo sapiens
aatggctctgtgaaatcagaa

SEQ ID NO: 1981433 - DNA, 18 bp, Homo sapiens
aatggctgataattttaa

SEQ ID NO: 1981434 - DNA, 13 bp, Homo sapiens
aatggctgtaaac

SEQ ID NO: 1981435 - DNA, 16 bp, Homo sapiens
aatggctgtaaactat

SEQ ID NO: 1981436 - DNA, 18 bp, Homo sapiens
aatgggagatggtcagtg

SEQ ID NO: 1981437 - DNA, 13 bp, Homo sapiens
aatgggtgatatg

SEQ ID NO: 1981438 - DNA, 13 bp, Homo sapiens
aatgggtttactc

SEQ ID NO: 1981439 - DNA, 14 bp, Homo sapiens
aatggtccagggtt

SEQ ID NO: 1981440 - DNA, 14 bp, Homo sapiens
aatggtcccttctt

SEQ ID NO: 1981441 - DNA, 15 bp, Homo sapiens
aatggtcgcccagga

SEQ ID NO: 1981442 - DNA, 19 bp, Homo sapiens
aatggtgggaaccctcccc

SEQ ID NO: 1981443 - DNA, 14 bp, Homo sapiens
aatggtgtgggaga

SEQ ID NO: 1981444 - DNA, 15 bp, Homo sapiens
aatggtttactgctg

SEQ ID NO: 1981445 - DNA, 17 bp, Homo sapiens
aatggtttactgctgtc

SEQ ID NO: 1981446 - DNA, 20 bp, Homo sapiens
aatggtttactgctgtcatt

SEQ ID NO: 1981447 - DNA, 18 bp, Homo sapiens
aatggtttttatttctcg

SEQ ID NO: 1981448 - DNA, 19 bp, Homo sapiens
aatgtaaagcttgtctgat

SEQ ID NO: 1981449 - DNA, 21 bp, Homo sapiens
aatgtaaatattttaaagaat

SEQ ID NO: 1981450 - DNA, 15 bp, Homo sapiens
aatgtaacttttgta

SEQ ID NO: 1981451 - DNA, 20 bp, Homo sapiens
aatgtaagggaaactgccag

SEQ ID NO: 1981452 - DNA, 19 bp, Homo sapiens
aatgtaagggtctgttgta

SEQ ID NO: 1981453 - DNA, 20 bp, Homo sapiens
aatgtaagggtctgttgtaa

SEQ ID NO: 1981454 - DNA, 16 bp, Homo sapiens
aatgtaattgaataaa

SEQ ID NO: 1981455 - DNA, 16 bp, Homo sapiens
aatgtacagagtggcc

SEQ ID NO: 1981456 - DNA, 12 bp, Homo sapiens
aatgtactgaga

SEQ ID NO: 1981457 - DNA, 21 bp, Homo sapiens
aatgtagctggtttcctcatt

SEQ ID NO: 1981458 - DNA, 22 bp, Homo sapiens
aatgtagtgaagggatgtatca

SEQ ID NO: 1981459 - DNA, 14 bp, Homo sapiens
aatgtagtggagag

SEQ ID NO: 1981460 - DNA, 18 bp, Homo sapiens
aatgtatatacacatata

SEQ ID NO: 1981461 - DNA, 21 bp, Homo sapiens
aatgtatatacacatatacct

SEQ ID NO: 1981462 - DNA, 14 bp, Homo sapiens
aatgtatcctgata

SEQ ID NO: 1981463 - DNA, 13 bp, Homo sapiens
aatgtatcttatt

SEQ ID NO: 1981464 - DNA, 18 bp, Homo sapiens
aatgtatcttattcacat

SEQ ID NO: 1981465 - DNA, 14 bp, Homo sapiens
aatgtatcttattt

SEQ ID NO: 1981466 - DNA, 16 bp, Homo sapiens
aatgtatcttatttat

SEQ ID NO: 1981467 - DNA, 21 bp, Homo sapiens
aatgtatcttatttatatatg

SEQ ID NO: 1981468 - DNA, 18 bp, Homo sapiens
aatgtatgtgaaagtgta

SEQ ID NO: 1981469 - DNA, 17 bp, Homo sapiens
aatgtatttatatgtta

SEQ ID NO: 1981470 - DNA, 17 bp, Homo sapiens
aatgtcacacttgtttc

SEQ ID NO: 1981471 - DNA, 19 bp, Homo sapiens
aatgtcacacttgtttctt

SEQ ID NO: 1981472 - DNA, 15 bp, Homo sapiens
aatgtcacaggcagg

SEQ ID NO: 1981473 - DNA, 15 bp, Homo sapiens
aatgtcaccaccttc

SEQ ID NO: 1981474 - DNA, 18 bp, Homo sapiens
aatgtcaccaccttccca

SEQ ID NO: 1981475 - DNA, 23 bp, Homo sapiens
aatgtcaccaccttcccagctct

SEQ ID NO: 1981476 - DNA, 17 bp, Homo sapiens
aatgtcacttaaaggct

SEQ ID NO: 1981477 - DNA, 14 bp, Homo sapiens
aatgtcagaaactc

SEQ ID NO: 1981478 - DNA, 23 bp, Homo sapiens
aatgtcagagctatgttccctcc

SEQ ID NO: 1981479 - DNA, 18 bp, Homo sapiens
aatgtcaggaacagaagg

SEQ ID NO: 1981480 - DNA, 17 bp, Homo sapiens
aatgtcattatgtagaa

SEQ ID NO: 1981481 - DNA, 16 bp, Homo sapiens
aatgtctatagagaaa

SEQ ID NO: 1981482 - DNA, 14 bp, Homo sapiens
aatgtctcttcctc

SEQ ID NO: 1981483 - DNA, 20 bp, Homo sapiens
aatgtctcttcctctgttct

SEQ ID NO: 1981484 - DNA, 17 bp, Homo sapiens
aatgtctgttaacttaa

SEQ ID NO: 1981485 - DNA, 17 bp, Homo sapiens
aatgtcttcatttcatt

SEQ ID NO: 1981486 - DNA, 18 bp, Homo sapiens
aatgtctttgttggaaaa

SEQ ID NO: 1981487 - DNA, 13 bp, Homo sapiens
aatgtgaactgtg

SEQ ID NO: 1981488 - DNA, 14 bp, Homo sapiens
aatgtgattctaat

SEQ ID NO: 1981489 - DNA, 20 bp, Homo sapiens
aatgtgatttacgctcattg

SEQ ID NO: 1981490 - DNA, 15 bp, Homo sapiens
aatgtgcaaattttg

SEQ ID NO: 1981491 - DNA, 14 bp, Homo sapiens
aatgtgcatttctt

SEQ ID NO: 1981492 - DNA, 20 bp, Homo sapiens
aatgtgcctaatggagaaga

SEQ ID NO: 1981493 - DNA, 14 bp, Homo sapiens
cagagacaggtggc

SEQ ID NO: 1981494 - DNA, 19 bp, Homo sapiens
cagagacccagatctcatg

SEQ ID NO: 1981495 - DNA, 21 bp, Homo sapiens
cagagacccagatctcatgga

SEQ ID NO: 1981496 - DNA, 16 bp, Homo sapiens
cagagaccccttcctt

SEQ ID NO: 1981497 - DNA, 20 bp, Homo sapiens
cagagaccccttcctttcct

SEQ ID NO: 1981498 - DNA, 22 bp, Homo sapiens
cagagaccccttcctttcctct

SEQ ID NO: 1981499 - DNA, 14 bp, Homo sapiens
cagagaccttttct

SEQ ID NO: 1981500 - DNA, 20 bp, Homo sapiens
cagagaccttttctctccca

SEQ ID NO: 1981501 - DNA, 21 bp, Homo sapiens
cagagactctggaagcccccc

SEQ ID NO: 1981502 - DNA, 22 bp, Homo sapiens
cagagactctggaagcccccca

SEQ ID NO: 1981503 - DNA, 18 bp, Homo sapiens
cagagacttggggaccag

SEQ ID NO: 1981504 - DNA, 12 bp, Homo sapiens
cagagagaagcc

SEQ ID NO: 1981505 - DNA, 14 bp, Homo sapiens
cagagagaagcctg

SEQ ID NO: 1981506 - DNA, 16 bp, Homo sapiens
cagagagacagaccgg

SEQ ID NO: 1981507 - DNA, 13 bp, Homo sapiens
cagagagagactg

SEQ ID NO: 1981508 - DNA, 22 bp, Homo sapiens
cagagagaggggagaagcctgg

SEQ ID NO: 1981509 - DNA, 12 bp, Homo sapiens
cagagagagtgt

SEQ ID NO: 1981510 - DNA, 15 bp, Homo sapiens
cagagaggaatcaga

SEQ ID NO: 1981511 - DNA, 21 bp, Homo sapiens
cagagaggagcacctgaaccc

SEQ ID NO: 1981512 - DNA, 18 bp, Homo sapiens
cagagaggagttgccagg

SEQ ID NO: 1981513 - DNA, 13 bp, Homo sapiens
cagagaggccttt

SEQ ID NO: 1981514 - DNA, 20 bp, Homo sapiens
cagagaggccttttggaatg

SEQ ID NO: 1981515 - DNA, 23 bp, Homo sapiens
cagagagggcccagctgtagcca

SEQ ID NO: 1981516 - DNA, 17 bp, Homo sapiens
cagagaggggacatttc

SEQ ID NO: 1981517 - DNA, 19 bp, Homo sapiens
cagagaggggacatttccc

SEQ ID NO: 1981518 - DNA, 17 bp, Homo sapiens
cagagagggtggtgacc

SEQ ID NO: 1981519 - DNA, 20 bp, Homo sapiens
cagagagggtggtgacctct

SEQ ID NO: 1981520 - DNA, 22 bp, Homo sapiens
cagagagggtggtgacctctgc

SEQ ID NO: 1981521 - DNA, 23 bp, Homo sapiens
cagagagggtggtgacctctgcc

SEQ ID NO: 1981522 - DNA, 13 bp, Homo sapiens
cagagagtggctc

SEQ ID NO: 1981523 - DNA, 21 bp, Homo sapiens
cagagatgcatgcgcaggctc

SEQ ID NO: 1981524 - DNA, 19 bp, Homo sapiens
cagagatgcctccaccgct

SEQ ID NO: 1981525 - DNA, 22 bp, Homo sapiens
cagagatggtaatctacagctc

SEQ ID NO: 1981526 - DNA, 15 bp, Homo sapiens
cagagattgcttctc

SEQ ID NO: 1981527 - DNA, 16 bp, Homo sapiens
cagagattgcttctca

SEQ ID NO: 1981528 - DNA, 16 bp, Homo sapiens
cagagcaaaataattt

SEQ ID NO: 1981529 - DNA, 20 bp, Homo sapiens
cagagcaagactccgtctca

SEQ ID NO: 1981530 - DNA, 20 bp, Homo sapiens
cagagcaagatcctgtcttt

SEQ ID NO: 1981531 - DNA, 23 bp, Homo sapiens
cagagcacacaggtacagcaaca

SEQ ID NO: 1981532 - DNA, 13 bp, Homo sapiens
cagagcactgctc

SEQ ID NO: 1981533 - DNA, 19 bp, Homo sapiens
cagagcagagcaaatgagg

SEQ ID NO: 1981534 - DNA, 12 bp, Homo sapiens
cagagcaggctc

SEQ ID NO: 1981535 - DNA, 13 bp, Homo sapiens
cagagcaggctca

SEQ ID NO: 1981536 - DNA, 12 bp, Homo sapiens
cagagccagcct

SEQ ID NO: 1981537 - DNA, 15 bp, Homo sapiens
cagagccaggctctg

SEQ ID NO: 1981538 - DNA, 19 bp, Homo sapiens
cagagccaggctctgcctg

SEQ ID NO: 1981539 - DNA, 14 bp, Homo sapiens
cagagccagtgaag

SEQ ID NO: 1981540 - DNA, 15 bp, Homo sapiens
cagagccatgggcct

SEQ ID NO: 1981541 - DNA, 18 bp, Homo sapiens
cagagccatgggcctggg

SEQ ID NO: 1981542 - DNA, 17 bp, Homo sapiens
cagagcccaagtgccat

SEQ ID NO: 1981543 - DNA, 22 bp, Homo sapiens
cagagcccaagtgccatcccac

SEQ ID NO: 1981544 - DNA, 17 bp, Homo sapiens
cagagcccaccttggct

SEQ ID NO: 1981545 - DNA, 19 bp, Homo sapiens
cagagcccaccttggctca

SEQ ID NO: 1981546 - DNA, 19 bp, Homo sapiens
cagagcccatgctcaacca

SEQ ID NO: 1981547 - DNA, 18 bp, Homo sapiens
cagagccccactcccggc

SEQ ID NO: 1981548 - DNA, 21 bp, Homo sapiens
cagagcccccaagcctctgcc

SEQ ID NO: 1981549 - DNA, 20 bp, Homo sapiens
cagagcccccaaggactctg

SEQ ID NO: 1981550 - DNA, 15 bp, Homo sapiens
cagagccccccacaa

SEQ ID NO: 1981551 - DNA, 14 bp, Homo sapiens
cagagcccctccct

SEQ ID NO: 1981552 - DNA, 15 bp, Homo sapiens
cagagcctaagaaaa

SEQ ID NO: 1981553 - DNA, 16 bp, Homo sapiens
cagagcctagccacct

SEQ ID NO: 1981554 - DNA, 20 bp, Homo sapiens
cagagcctagccacctccca

SEQ ID NO: 1981555 - DNA, 21 bp, Homo sapiens
cagagcctagccacctcccac

SEQ ID NO: 1981556 - DNA, 24 bp, Homo sapiens
cagagcctgcctcagctgctcgca

SEQ ID NO: 1981557 - DNA, 14 bp, Homo sapiens
cagagcctggggca

SEQ ID NO: 1981558 - DNA, 14 bp, Homo sapiens
cagagccttcacaa

SEQ ID NO: 1981559 - DNA, 21 bp, Homo sapiens
cagagccttcacaaccagcca

SEQ ID NO: 1981560 - DNA, 15 bp, Homo sapiens
cagagccttctcctg

SEQ ID NO: 1981561 - DNA, 19 bp, Homo sapiens
cagagcctttggatgacca

SEQ ID NO: 1981562 - DNA, 20 bp, Homo sapiens
cagagcctttggatgaccag

SEQ ID NO: 1981563 - DNA, 20 bp, Homo sapiens
cagagcgagactccgtctca

SEQ ID NO: 1981564 - DNA, 12 bp, Homo sapiens
cagagcgggcct

SEQ ID NO: 1981565 - DNA, 14 bp, Homo sapiens
cagagcgggcctct

SEQ ID NO: 1981566 - DNA, 17 bp, Homo sapiens
cagagcgggcctcttcc

SEQ ID NO: 1981567 - DNA, 19 bp, Homo sapiens
cagagcgggcctcttccct

SEQ ID NO: 1981568 - DNA, 21 bp, Homo sapiens
cagagcgggcctcttccctca

SEQ ID NO: 1981569 - DNA, 22 bp, Homo sapiens
cagagcgggcctcttccctcag

SEQ ID NO: 1981570 - DNA, 23 bp, Homo sapiens
cagagcgggcctcttccctcagt

SEQ ID NO: 1981571 - DNA, 14 bp, Homo sapiens
cagagcggggaggt

SEQ ID NO: 1981572 - DNA, 16 bp, Homo sapiens
cagagctatggtgagg

SEQ ID NO: 1981573 - DNA, 15 bp, Homo sapiens
cagagctcccttcct

SEQ ID NO: 1981574 - DNA, 20 bp, Homo sapiens
cagagctcttcaagctgtcc

SEQ ID NO: 1981575 - DNA, 21 bp, Homo sapiens
cagagctgatggagaaggaag

SEQ ID NO: 1981576 - DNA, 23 bp, Homo sapiens
cagagctggaaggcagggcagag

SEQ ID NO: 1981577 - DNA, 23 bp, Homo sapiens
cagagctggcgactgcagctgca

SEQ ID NO: 1981578 - DNA, 17 bp, Homo sapiens
cagagctggctgtcttc

SEQ ID NO: 1981579 - DNA, 14 bp, Homo sapiens
cagagctgggaggc

SEQ ID NO: 1981580 - DNA, 23 bp, Homo sapiens
cagagctgggaggcatggccctg

SEQ ID NO: 1981581 - DNA, 11 bp, Homo sapiens
cagagctgggc

SEQ ID NO: 1981582 - DNA, 22 bp, Homo sapiens
cagagctgtggactttgttcac

SEQ ID NO: 1981583 - DNA, 18 bp, Homo sapiens
cagagctgttggcctcgc

SEQ ID NO: 1981584 - DNA, 19 bp, Homo sapiens
cagagctgttggcctcgcc

SEQ ID NO: 1981585 - DNA, 20 bp, Homo sapiens
cagagctgttggcctcgcct

SEQ ID NO: 1981586 - DNA, 23 bp, Homo sapiens
cagagctgttggcctcgcctggg

SEQ ID NO: 1981587 - DNA, 20 bp, Homo sapiens
cagagcttattggccactgg

SEQ ID NO: 1981588 - DNA, 12 bp, Homo sapiens
cagaggaagagc

SEQ ID NO: 1981589 - DNA, 16 bp, Homo sapiens
cagaggacaaggaagt

SEQ ID NO: 1981590 - DNA, 18 bp, Homo sapiens
cagaggacaaggaagtgg

SEQ ID NO: 1981591 - DNA, 12 bp, Homo sapiens
cagaggaccaca

SEQ ID NO: 1981592 - DNA, 15 bp, Homo sapiens
cagaggaccacagtg

SEQ ID NO: 1981593 - DNA, 21 bp, Homo sapiens
cagaggaccacagtgggtggc

SEQ ID NO: 1981594 - DNA, 21 bp, Homo sapiens
cagaggaggcagaataagaaa

SEQ ID NO: 1981595 - DNA, 21 bp, Homo sapiens
cagaggagtccagggcgggag

SEQ ID NO: 1981596 - DNA, 15 bp, Homo sapiens
cagaggcagccccat

SEQ ID NO: 1981597 - DNA, 19 bp, Homo sapiens
cagaggcagccccattctg

SEQ ID NO: 1981598 - DNA, 18 bp, Homo sapiens
cagaggcaggagtggcag

SEQ ID NO: 1981599 - DNA, 16 bp, Homo sapiens
cagaggccatgggcct

SEQ ID NO: 1981600 - DNA, 19 bp, Homo sapiens
cagaggccatgggcctcct

SEQ ID NO: 1981601 - DNA, 13 bp, Homo sapiens
cagaggcccagga

SEQ ID NO: 1981602 - DNA, 19 bp, Homo sapiens
cagaggcggaaaccttgca

SEQ ID NO: 1981603 - DNA, 12 bp, Homo sapiens
aaaaaaaatata

SEQ ID NO: 1981604 - DNA, 13 bp, Homo sapiens
aaaaaaaattgca

SEQ ID NO: 1981605 - DNA, 12 bp, Homo sapiens
aaaaaaatgact

SEQ ID NO: 1981606 - DNA, 12 bp, Homo sapiens
aaaaaaattgca

SEQ ID NO: 1981607 - DNA, 15 bp, Homo sapiens
aaaaaacagaggcca

SEQ ID NO: 1981608 - DNA, 12 bp, Homo sapiens
aaaaaagaaatg

SEQ ID NO: 1981609 - DNA, 18 bp, Homo sapiens
aaaaaagttttgatgaaa

SEQ ID NO: 1981610 - DNA, 20 bp, Homo sapiens
aaaaaatacaccacgaattt

SEQ ID NO: 1981611 - DNA, 13 bp, Homo sapiens
aaaaaatacagta

SEQ ID NO: 1981612 - DNA, 11 bp, Homo sapiens
aaaaaattaag

SEQ ID NO: 1981613 - DNA, 22 bp, Homo sapiens
aaaaaattagaaattggctgga

SEQ ID NO: 1981614 - DNA, 16 bp, Homo sapiens
aaaaaatttccagtga

SEQ ID NO: 1981615 - DNA, 14 bp, Homo sapiens
aaaaacacaaaagt

SEQ ID NO: 1981616 - DNA, 18 bp, Homo sapiens
aaaaacacagcaagggtg

SEQ ID NO: 1981617 - DNA, 12 bp, Homo sapiens
aaaaacactagt

SEQ ID NO: 1981618 - DNA, 14 bp, Homo sapiens
aaaaacagaggcca

SEQ ID NO: 1981619 - DNA, 19 bp, Homo sapiens
aaaaacagcctcacagaag

SEQ ID NO: 1981620 - DNA, 13 bp, Homo sapiens
aaaaacaggaaaa

SEQ ID NO: 1981621 - DNA, 17 bp, Homo sapiens
aaaaacatttgtacatt

SEQ ID NO: 1981622 - DNA, 19 bp, Homo sapiens
aaaaaccaatcattttaag

SEQ ID NO: 1981623 - DNA, 15 bp, Homo sapiens
aaaaaccagaatcat

SEQ ID NO: 1981624 - DNA, 20 bp, Homo sapiens
aaaaaccagaatcataattt

SEQ ID NO: 1981625 - DNA, 19 bp, Homo sapiens
aaaaacccagcaacagaaa

SEQ ID NO: 1981626 - DNA, 17 bp, Homo sapiens
aaaaactaaaaactaga

SEQ ID NO: 1981627 - DNA, 12 bp, Homo sapiens
aaaaactgaatg

SEQ ID NO: 1981628 - DNA, 22 bp, Homo sapiens
aaaaactgatcaaaaataaact

SEQ ID NO: 1981629 - DNA, 18 bp, Homo sapiens
aaaaacttgtactatgtt

SEQ ID NO: 1981630 - DNA, 22 bp, Homo sapiens
aaaaacttgtactatgttaata

SEQ ID NO: 1981631 - DNA, 14 bp, Homo sapiens
aaaaagaagaatct

SEQ ID NO: 1981632 - DNA, 14 bp, Homo sapiens
aaaaagcagtcctc

SEQ ID NO: 1981633 - DNA, 16 bp, Homo sapiens
aaaaagcagtcctctt

SEQ ID NO: 1981634 - DNA, 18 bp, Homo sapiens
aaaaagcgaaaaaatcag

SEQ ID NO: 1981635 - DNA, 18 bp, Homo sapiens
aaaaagctcatattttgt

SEQ ID NO: 1981636 - DNA, 22 bp, Homo sapiens
aaaaaggaccaactggcttctg

SEQ ID NO: 1981637 - DNA, 17 bp, Homo sapiens
aaaaaggctagtttatt

SEQ ID NO: 1981638 - DNA, 22 bp, Homo sapiens
aaaaaggctagtttattttgtt

SEQ ID NO: 1981639 - DNA, 22 bp, Homo sapiens
aaaaaggtgtgtcaaagatttt

SEQ ID NO: 1981640 - DNA, 13 bp, Homo sapiens
aaaaagtattttt

SEQ ID NO: 1981641 - DNA, 20 bp, Homo sapiens
aaaaagtcagactgctggga

SEQ ID NO: 1981642 - DNA, 13 bp, Homo sapiens
aaaaagtgtttat

SEQ ID NO: 1981643 - DNA, 17 bp, Homo sapiens
aaaaagtttgccagaag

SEQ ID NO: 1981644 - DNA, 13 bp, Homo sapiens
aaaaagttttgat

SEQ ID NO: 1981645 - DNA, 18 bp, Homo sapiens
aaaaataaaaacataaaa

SEQ ID NO: 1981646 - DNA, 12 bp, Homo sapiens
aaaaataaaatg

SEQ ID NO: 1981647 - DNA, 12 bp, Homo sapiens
aaaaataaacta

SEQ ID NO: 1981648 - DNA, 13 bp, Homo sapiens
aaaaataaatata

SEQ ID NO: 1981649 - DNA, 14 bp, Homo sapiens
aaaaataagaagaa

SEQ ID NO: 1981650 - DNA, 15 bp, Homo sapiens
aaaaatacttgagct

SEQ ID NO: 1981651 - DNA, 15 bp, Homo sapiens
aaaaatattttctga

SEQ ID NO: 1981652 - DNA, 17 bp, Homo sapiens
aaaaatcataaactgtg

SEQ ID NO: 1981653 - DNA, 16 bp, Homo sapiens
aaaaatccagaaagaa

SEQ ID NO: 1981654 - DNA, 13 bp, Homo sapiens
aaaaatcttgggc

SEQ ID NO: 1981655 - DNA, 16 bp, Homo sapiens
aaaaatcttgggcaag

SEQ ID NO: 1981656 - DNA, 20 bp, Homo sapiens
aaaaatgactaaaaatatta

SEQ ID NO: 1981657 - DNA, 20 bp, Homo sapiens
aaaaatgatttcagtagcac

SEQ ID NO: 1981658 - DNA, 23 bp, Homo sapiens
aaaaatggaaacatttattcctt

SEQ ID NO: 1981659 - DNA, 13 bp, Homo sapiens
aaaaatggtaatt

SEQ ID NO: 1981660 - DNA, 22 bp, Homo sapiens
aaaaatgtcttgggtaggcggg

SEQ ID NO: 1981661 - DNA, 13 bp, Homo sapiens
aaaaattgaagag

SEQ ID NO: 1981662 - DNA, 19 bp, Homo sapiens
aaaaattgaagagagatat

SEQ ID NO: 1981663 - DNA, 17 bp, Homo sapiens
aaaaattgcacaatttg

SEQ ID NO: 1981664 - DNA, 15 bp, Homo sapiens
aaacattaaacactg

SEQ ID NO: 1981665 - DNA, 15 bp, Homo sapiens
aaacattaaatgtct

SEQ ID NO: 1981666 - DNA, 23 bp, Homo sapiens
aaacattcacacagggctctttg

SEQ ID NO: 1981667 - DNA, 21 bp, Homo sapiens
aaacattcatccagttgcaat

SEQ ID NO: 1981668 - DNA, 24 bp, Homo sapiens
aaacattcatccagttgcaataaa

SEQ ID NO: 1981669 - DNA, 23 bp, Homo sapiens
aaacatttacaataaatattctg

SEQ ID NO: 1981670 - DNA, 14 bp, Homo sapiens
aaacatttattttg

SEQ ID NO: 1981671 - DNA, 17 bp, Homo sapiens
aaacatttattttgaca

SEQ ID NO: 1981672 - DNA, 18 bp, Homo sapiens
aaacatttgtacattcct

SEQ ID NO: 1981673 - DNA, 21 bp, Homo sapiens
aaacattttgtggtcattaag

SEQ ID NO: 1981674 - DNA, 17 bp, Homo sapiens
aaaccaaaggacattat

SEQ ID NO: 1981675 - DNA, 14 bp, Homo sapiens
aaaccaagatagat

SEQ ID NO: 1981676 - DNA, 23 bp, Homo sapiens
aaaccaccagtgcccaaagtctg

SEQ ID NO: 1981677 - DNA, 14 bp, Homo sapiens
aaaccactgtacat

SEQ ID NO: 1981678 - DNA, 17 bp, Homo sapiens
aaaccagaatcataatt

SEQ ID NO: 1981679 - DNA, 14 bp, Homo sapiens
aaaccagcagaaaa

SEQ ID NO: 1981680 - DNA, 17 bp, Homo sapiens
aaaccagcagaaaagtg

SEQ ID NO: 1981681 - DNA, 12 bp, Homo sapiens
aaaccagctgct

SEQ ID NO: 1981682 - DNA, 13 bp, Homo sapiens
aaaccagctgcta

SEQ ID NO: 1981683 - DNA, 15 bp, Homo sapiens
aaaccagggtgcatg

SEQ ID NO: 1981684 - DNA, 21 bp, Homo sapiens
aaaccagttaagaatggaaga

SEQ ID NO: 1981685 - DNA, 20 bp, Homo sapiens
aaaccagtttagatttcaag

SEQ ID NO: 1981686 - DNA, 13 bp, Homo sapiens
aaaccataaactt

SEQ ID NO: 1981687 - DNA, 16 bp, Homo sapiens
aaaccatgcagcttca

SEQ ID NO: 1981688 - DNA, 19 bp, Homo sapiens
aaaccatgcagcttcatca

SEQ ID NO: 1981689 - DNA, 20 bp, Homo sapiens
aaaccattatgaagaagaga

SEQ ID NO: 1981690 - DNA, 15 bp, Homo sapiens
aaaccatttaattca

SEQ ID NO: 1981691 - DNA, 16 bp, Homo sapiens
aaaccatttaattcat

SEQ ID NO: 1981692 - DNA, 14 bp, Homo sapiens
aaacccaaggaaca

SEQ ID NO: 1981693 - DNA, 14 bp, Homo sapiens
aaacccaccagcct

SEQ ID NO: 1981694 - DNA, 23 bp, Homo sapiens
aaacccaccagcctaagaagctc

SEQ ID NO: 1981695 - DNA, 11 bp, Homo sapiens
aaacccagaga

SEQ ID NO: 1981696 - DNA, 15 bp, Homo sapiens
aaaccccaagcagca

SEQ ID NO: 1981697 - DNA, 23 bp, Homo sapiens
aaaccccatttgctttcttttct

SEQ ID NO: 1981698 - DNA, 17 bp, Homo sapiens
aaacccccgctccagat

SEQ ID NO: 1981699 - DNA, 18 bp, Homo sapiens
aaaccgctaaaagaaact

SEQ ID NO: 1981700 - DNA, 19 bp, Homo sapiens
aaaccgtaattttattatt

SEQ ID NO: 1981701 - DNA, 20 bp, Homo sapiens
aaacctaaggcaacatttcc

SEQ ID NO: 1981702 - DNA, 18 bp, Homo sapiens
aaacctagaacttcaaaa

SEQ ID NO: 1981703 - DNA, 22 bp, Homo sapiens
aaacctcatgacagccagagcc

SEQ ID NO: 1981704 - DNA, 15 bp, Homo sapiens
aaacctctatatgtt

SEQ ID NO: 1981705 - DNA, 15 bp, Homo sapiens
aaacctggagatgat

SEQ ID NO: 1981706 - DNA, 18 bp, Homo sapiens
aaacctgtccataaagta

SEQ ID NO: 1981707 - DNA, 16 bp, Homo sapiens
aaaccttattgtacct

SEQ ID NO: 1981708 - DNA, 12 bp, Homo sapiens
aaaccttgcagc

SEQ ID NO: 1981709 - DNA, 14 bp, Homo sapiens
aaaccttgcagcat

SEQ ID NO: 1981710 - DNA, 15 bp, Homo sapiens
aaaccttgcagcatt

SEQ ID NO: 1981711 - DNA, 17 bp, Homo sapiens
aaacctttcaaatttca

SEQ ID NO: 1981712 - DNA, 22 bp, Homo sapiens
aaaccttttcatgcctttagat

SEQ ID NO: 1981713 - DNA, 20 bp, Homo sapiens
aaacgaacccactgtgctta

SEQ ID NO: 1981714 - DNA, 18 bp, Homo sapiens
aaacgactccgagaacaa

SEQ ID NO: 1981715 - DNA, 19 bp, Homo sapiens
aaacgagtcaatcccctca

SEQ ID NO: 1981716 - DNA, 15 bp, Homo sapiens
aaacgatcgctgtga

SEQ ID NO: 1981717 - DNA, 16 bp, Homo sapiens
aaacgatcgctgtgaa

SEQ ID NO: 1981718 - DNA, 16 bp, Homo sapiens
aaacgcacctccatcc

SEQ ID NO: 1981719 - DNA, 20 bp, Homo sapiens
aaacgcctcttttccctctc

SEQ ID NO: 1981720 - DNA, 22 bp, Homo sapiens
aaagcccttccatgtcgcctct

SEQ ID NO: 1981721 - DNA, 17 bp, Homo sapiens
aaagcctatttttcaaa

SEQ ID NO: 1981722 - DNA, 16 bp, Homo sapiens
aaagcgaaaaaatcag

SEQ ID NO: 1981723 - DNA, 20 bp, Homo sapiens
aaagctacctgtggtgatgt

SEQ ID NO: 1981724 - DNA, 20 bp, Homo sapiens
aaagctactgaatttattgc

SEQ ID NO: 1981725 - DNA, 13 bp, Homo sapiens
aaagctcaagatg

SEQ ID NO: 1981726 - DNA, 21 bp, Homo sapiens
aaagctcaagatgacagctct

SEQ ID NO: 1981727 - DNA, 21 bp, Homo sapiens
aaagctctctttggaatgaac

SEQ ID NO: 1981728 - DNA, 22 bp, Homo sapiens
aaagctctctttggaatgaaca

SEQ ID NO: 1981729 - DNA, 23 bp, Homo sapiens
aaagctgatgatgtctcttgtag

SEQ ID NO: 1981730 - DNA, 21 bp, Homo sapiens
aaagctgcctgtagttaggaa

SEQ ID NO: 1981731 - DNA, 23 bp, Homo sapiens
aaagctgcctgtagttaggaaat

SEQ ID NO: 1981732 - DNA, 18 bp, Homo sapiens
aaagctggacaagaagct

SEQ ID NO: 1981733 - DNA, 21 bp, Homo sapiens
aaagctggacaagaagctgct

SEQ ID NO: 1981734 - DNA, 23 bp, Homo sapiens
aaagctgtggccagcttgttatt

SEQ ID NO: 1981735 - DNA, 16 bp, Homo sapiens
aaagcttaaaactttg

SEQ ID NO: 1981736 - DNA, 13 bp, Homo sapiens
aaagcttattaaa

SEQ ID NO: 1981737 - DNA, 16 bp, Homo sapiens
aaagctttctgacaag

SEQ ID NO: 1981738 - DNA, 20 bp, Homo sapiens
aaagctttctgacaagataa

SEQ ID NO: 1981739 - DNA, 19 bp, Homo sapiens
aaaggaacacccggaaaga

SEQ ID NO: 1981740 - DNA, 13 bp, Homo sapiens
aaaggaaggaaaa

SEQ ID NO: 1981741 - DNA, 14 bp, Homo sapiens
aaaggaagtctagg

SEQ ID NO: 1981742 - DNA, 15 bp, Homo sapiens
aaaggacattatgtg

SEQ ID NO: 1981743 - DNA, 18 bp, Homo sapiens
aaaggacattatgtgtgc

SEQ ID NO: 1981744 - DNA, 22 bp, Homo sapiens
aaaggactaacataaaatctgt

SEQ ID NO: 1981745 - DNA, 16 bp, Homo sapiens
aaaggagagaagaaag

SEQ ID NO: 1981746 - DNA, 23 bp, Homo sapiens
aaaggagcctgtgaacccaggac

SEQ ID NO: 1981747 - DNA, 16 bp, Homo sapiens
aaaggaggcatgcctc

SEQ ID NO: 1981748 - DNA, 18 bp, Homo sapiens
aaaggaggcatgcctctg

SEQ ID NO: 1981749 - DNA, 17 bp, Homo sapiens
aaaggatgaaagtctga

SEQ ID NO: 1981750 - DNA, 21 bp, Homo sapiens
aaaggattaagatacactcct

SEQ ID NO: 1981751 - DNA, 17 bp, Homo sapiens
aaaggcaccatctaata

SEQ ID NO: 1981752 - DNA, 21 bp, Homo sapiens
aaaggcataagaccctaagcc

SEQ ID NO: 1981753 - DNA, 16 bp, Homo sapiens
aaaggcctcatctcct

SEQ ID NO: 1981754 - DNA, 10 bp, Homo sapiens
aaaggcctgg

SEQ ID NO: 1981755 - DNA, 11 bp, Homo sapiens
aaaggcctgga

SEQ ID NO: 1981756 - DNA, 12 bp, Homo sapiens
aaaggcctgggg

SEQ ID NO: 1981757 - DNA, 21 bp, Homo sapiens
aaaggcgcagtgcttctctac

SEQ ID NO: 1981758 - DNA, 19 bp, Homo sapiens
aaaggctagtttattttgt

SEQ ID NO: 1981759 - DNA, 19 bp, Homo sapiens
aaaggctcagtctcaggag

SEQ ID NO: 1981760 - DNA, 14 bp, Homo sapiens
aaagggaaactatt

SEQ ID NO: 1981761 - DNA, 18 bp, Homo sapiens
aaagggaaggctgctgtg

SEQ ID NO: 1981762 - DNA, 22 bp, Homo sapiens
aaagggagggctctgaggcgcc

SEQ ID NO: 1981763 - DNA, 13 bp, Homo sapiens
aaagggcaataaa

SEQ ID NO: 1981764 - DNA, 18 bp, Homo sapiens
aaagggcagccaggggct

SEQ ID NO: 1981765 - DNA, 20 bp, Homo sapiens
aaagggcagccaggggctgc

SEQ ID NO: 1981766 - DNA, 17 bp, Homo sapiens
aaagggctatggcaagg

SEQ ID NO: 1981767 - DNA, 22 bp, Homo sapiens
aaaggggagaagggccagccct

SEQ ID NO: 1981768 - DNA, 19 bp, Homo sapiens
aaaggggagttgagtcaca

SEQ ID NO: 1981769 - DNA, 13 bp, Homo sapiens
aaaggggctgctg

SEQ ID NO: 1981770 - DNA, 14 bp, Homo sapiens
aaaggggctgctgg

SEQ ID NO: 1981771 - DNA, 19 bp, Homo sapiens
aaagggtcaacggccctgt

SEQ ID NO: 1981772 - DNA, 15 bp, Homo sapiens
aaaggtagagatgtg

SEQ ID NO: 1981773 - DNA, 18 bp, Homo sapiens
aaaggtagatcatcttga

SEQ ID NO: 1981774 - DNA, 21 bp, Homo sapiens
aaaggtagcttacctgacaca

SEQ ID NO: 1981775 - DNA, 21 bp, Homo sapiens
aaaggtgcctgtgaggcaggg

SEQ ID NO: 1981776 - DNA, 14 bp, Homo sapiens
aaaggttcttcatc

SEQ ID NO: 1981777 - DNA, 19 bp, Homo sapiens
aaaggtttatgaaaaagaa

SEQ ID NO: 1981778 - DNA, 22 bp, Homo sapiens
aaaggtttatgaaaaagaagaa

SEQ ID NO: 1981779 - DNA, 21 bp, Homo sapiens
aaaggtttcaagacttgatac

SEQ ID NO: 1981780 - DNA, 22 bp, Homo sapiens
aaaggtttcatgtagattttag

SEQ ID NO: 1981781 - DNA, 14 bp, Homo sapiens
aaaggttttcctct

SEQ ID NO: 1981782 - DNA, 15 bp, Homo sapiens
aaagtaacaaggtgt

SEQ ID NO: 1981783 - DNA, 13 bp, Homo sapiens
aaaatatgtctcg

SEQ ID NO: 1981784 - DNA, 16 bp, Homo sapiens
aaaatattataactta

SEQ ID NO: 1981785 - DNA, 15 bp, Homo sapiens
aaaatattcctgcat

SEQ ID NO: 1981786 - DNA, 14 bp, Homo sapiens
aaaatattctccat

SEQ ID NO: 1981787 - DNA, 17 bp, Homo sapiens
aaaatattttataattt

SEQ ID NO: 1981788 - DNA, 18 bp, Homo sapiens
aaaatattttataatttt

SEQ ID NO: 1981789 - DNA, 16 bp, Homo sapiens
aaaatattttctgaat

SEQ ID NO: 1981790 - DNA, 18 bp, Homo sapiens
aaaatcaaaacaaaaaaa

SEQ ID NO: 1981791 - DNA, 19 bp, Homo sapiens
aaaatcactatctttctga

SEQ ID NO: 1981792 - DNA, 21 bp, Homo sapiens
aaaatcactatctttctgata

SEQ ID NO: 1981793 - DNA, 18 bp, Homo sapiens
aaaatcatgaatatttca

SEQ ID NO: 1981794 - DNA, 12 bp, Homo sapiens
aaaatcatgaga

SEQ ID NO: 1981795 - DNA, 18 bp, Homo sapiens
aaaatcatgtacatttct

SEQ ID NO: 1981796 - DNA, 21 bp, Homo sapiens
aaaatcatttctgcatcagct

SEQ ID NO: 1981797 - DNA, 22 bp, Homo sapiens
aaaatctagatcaattaattct

SEQ ID NO: 1981798 - DNA, 14 bp, Homo sapiens
aaaatctagttttt

SEQ ID NO: 1981799 - DNA, 21 bp, Homo sapiens
aaaatctgatttaatgttttc

SEQ ID NO: 1981800 - DNA, 13 bp, Homo sapiens
aaaatctggaaat

SEQ ID NO: 1981801 - DNA, 19 bp, Homo sapiens
aaaatctgtttgatccctg

SEQ ID NO: 1981802 - DNA, 18 bp, Homo sapiens
aaaatcttggcacagaaa

SEQ ID NO: 1981803 - DNA, 12 bp, Homo sapiens
aaaatcttgggc

SEQ ID NO: 1981804 - DNA, 23 bp, Homo sapiens
aaaatctttttttaataatttca

SEQ ID NO: 1981805 - DNA, 13 bp, Homo sapiens
aaaatgacagatg

SEQ ID NO: 1981806 - DNA, 18 bp, Homo sapiens
aaaatgacagatgttgaa

SEQ ID NO: 1981807 - DNA, 18 bp, Homo sapiens
aaaatgaggttcaactgt

SEQ ID NO: 1981808 - DNA, 16 bp, Homo sapiens
aaaatgattgtaaaat

SEQ ID NO: 1981809 - DNA, 15 bp, Homo sapiens
aaaatgcaaaataaa

SEQ ID NO: 1981810 - DNA, 14 bp, Homo sapiens
aaaatgcactgtga

SEQ ID NO: 1981811 - DNA, 17 bp, Homo sapiens
aaaatgcagtccagaat

SEQ ID NO: 1981812 - DNA, 22 bp, Homo sapiens
aaaatgctgaggtaataattat

SEQ ID NO: 1981813 - DNA, 14 bp, Homo sapiens
aaaatgcttctgtt

SEQ ID NO: 1981814 - DNA, 19 bp, Homo sapiens
aaaatgcttctgttgtaat

SEQ ID NO: 1981815 - DNA, 12 bp, Homo sapiens
aaaatggaaaga

SEQ ID NO: 1981816 - DNA, 12 bp, Homo sapiens
aaaatgtacact

SEQ ID NO: 1981817 - DNA, 17 bp, Homo sapiens
aaaatgtcacacttgtt

SEQ ID NO: 1981818 - DNA, 16 bp, Homo sapiens
aaaatgtgacccagat

SEQ ID NO: 1981819 - DNA, 17 bp, Homo sapiens
aaaatgtgtcagcatgc

SEQ ID NO: 1981820 - DNA, 12 bp, Homo sapiens
aaaatgttcatc

SEQ ID NO: 1981821 - DNA, 18 bp, Homo sapiens
aaaatgttcccttgacca

SEQ ID NO: 1981822 - DNA, 15 bp, Homo sapiens
aaaatgttctatatg

SEQ ID NO: 1981823 - DNA, 18 bp, Homo sapiens
aaaatgtttcattttcat

SEQ ID NO: 1981824 - DNA, 20 bp, Homo sapiens
aaaattagaaattggctgga

SEQ ID NO: 1981825 - DNA, 19 bp, Homo sapiens
aaaattaggatttcatgat

SEQ ID NO: 1981826 - DNA, 12 bp, Homo sapiens
aaaattataaga

SEQ ID NO: 1981827 - DNA, 15 bp, Homo sapiens
aaaattataagaaga

SEQ ID NO: 1981828 - DNA, 19 bp, Homo sapiens
aaaattattttaaacaaaa

SEQ ID NO: 1981829 - DNA, 18 bp, Homo sapiens
aaaattcaaaaagtgttt

SEQ ID NO: 1981830 - DNA, 13 bp, Homo sapiens
aaaattcagtgga

SEQ ID NO: 1981831 - DNA, 21 bp, Homo sapiens
aaaattccatcccatcatctt

SEQ ID NO: 1981832 - DNA, 21 bp, Homo sapiens
aaaattgaatgcaaaccatag

SEQ ID NO: 1981833 - DNA, 11 bp, Homo sapiens
aaaattgcaca

SEQ ID NO: 1981834 - DNA, 14 bp, Homo sapiens
aaaattgcacaatt

SEQ ID NO: 1981835 - DNA, 16 bp, Homo sapiens
aaaattgcacaatttg

SEQ ID NO: 1981836 - DNA, 17 bp, Homo sapiens
aaaattgcacaatttga

SEQ ID NO: 1981837 - DNA, 19 bp, Homo sapiens
aaaattgctagtgatttca

SEQ ID NO: 1981838 - DNA, 13 bp, Homo sapiens
aaaattgtgatca

SEQ ID NO: 1981839 - DNA, 20 bp, Homo sapiens
aaaatttcaacaagtagcta

SEQ ID NO: 1981840 - DNA, 13 bp, Homo sapiens
aaaatttcacatt

SEQ ID NO: 1981841 - DNA, 13 bp, Homo sapiens
aaaatttgtttaa

SEQ ID NO: 1981842 - DNA, 15 bp, Homo sapiens
aaaattttataagca

SEQ ID NO: 1981843 - DNA, 14 bp, Homo sapiens
aaaattttatagct

SEQ ID NO: 1981844 - DNA, 12 bp, Homo sapiens
aaaattttcaaa

SEQ ID NO: 1981845 - DNA, 18 bp, Homo sapiens
aaacaaaaacaaaaccag

SEQ ID NO: 1981846 - DNA, 13 bp, Homo sapiens
aaacaaaaacact

SEQ ID NO: 1981847 - DNA, 14 bp, Homo sapiens
aaacaaaaagacag

SEQ ID NO: 1981848 - DNA, 12 bp, Homo sapiens
aaacaaaacaac

SEQ ID NO: 1981849 - DNA, 14 bp, Homo sapiens
aaacaaaagagaga

SEQ ID NO: 1981850 - DNA, 16 bp, Homo sapiens
aaacaaaagagagaat

SEQ ID NO: 1981851 - DNA, 15 bp, Homo sapiens
aaacaaataatcaca

SEQ ID NO: 1981852 - DNA, 16 bp, Homo sapiens
aaacaagaaagaaacg

SEQ ID NO: 1981853 - DNA, 22 bp, Homo sapiens
aaacaagtatttgttaatttag

SEQ ID NO: 1981854 - DNA, 18 bp, Homo sapiens
aaacaattattgtacact

SEQ ID NO: 1981855 - DNA, 20 bp, Homo sapiens
aaacacaaaagttagctgag

SEQ ID NO: 1981856 - DNA, 19 bp, Homo sapiens
aaacacacaggccatttca

SEQ ID NO: 1981857 - DNA, 13 bp, Homo sapiens
aaacacactgtaa

SEQ ID NO: 1981858 - DNA, 14 bp, Homo sapiens
aaacacactgtaaa

SEQ ID NO: 1981859 - DNA, 18 bp, Homo sapiens
aaacacatctttcctgtc

SEQ ID NO: 1981860 - DNA, 17 bp, Homo sapiens
aaacacattgagtttaa

SEQ ID NO: 1981861 - DNA, 19 bp, Homo sapiens
aaacaccaacataaaaatg

SEQ ID NO: 1981862 - DNA, 17 bp, Homo sapiens
aaacacctccccagccc

SEQ ID NO: 1981863 - DNA, 11 bp, Homo sapiens
aaacacctcct

SEQ ID NO: 1981864 - DNA, 12 bp, Homo sapiens
aaacactgtaat

SEQ ID NO: 1981865 - DNA, 21 bp, Homo sapiens
aaacacttctcatcatattgt

SEQ ID NO: 1981866 - DNA, 12 bp, Homo sapiens
aaacagaaggag

SEQ ID NO: 1981867 - DNA, 13 bp, Homo sapiens
aaacagaaggaga

SEQ ID NO: 1981868 - DNA, 13 bp, Homo sapiens
aaacagactattt

SEQ ID NO: 1981869 - DNA, 13 bp, Homo sapiens
aaacagagagaga

SEQ ID NO: 1981870 - DNA, 16 bp, Homo sapiens
aaacagagatgtgata

SEQ ID NO: 1981871 - DNA, 14 bp, Homo sapiens
aaacagataccata

SEQ ID NO: 1981872 - DNA, 19 bp, Homo sapiens
aaacagatgataaatattt

SEQ ID NO: 1981873 - DNA, 20 bp, Homo sapiens
aaacagatgataaatattta

SEQ ID NO: 1981874 - DNA, 11 bp, Homo sapiens
aaacaggacca

SEQ ID NO: 1981875 - DNA, 21 bp, Homo sapiens
aaacaggacttaaaatgacat

SEQ ID NO: 1981876 - DNA, 17 bp, Homo sapiens
aaacaggagacaggaag

SEQ ID NO: 1981877 - DNA, 17 bp, Homo sapiens
aaacagggacaaagaaa

SEQ ID NO: 1981878 - DNA, 18 bp, Homo sapiens
aaacagggacaaagaaat

SEQ ID NO: 1981879 - DNA, 23 bp, Homo sapiens
aaacagggagcccctaggaaagc

SEQ ID NO: 1981880 - DNA, 19 bp, Homo sapiens
aaacaggggatcaaagttc

SEQ ID NO: 1981881 - DNA, 20 bp, Homo sapiens
aaacagtctcaggaaatcaa

SEQ ID NO: 1981882 - DNA, 12 bp, Homo sapiens
aaacagtgcctg

SEQ ID NO: 1981883 - DNA, 23 bp, Homo sapiens
aaacagttaactttcagaagaga

SEQ ID NO: 1981884 - DNA, 24 bp, Homo sapiens
aaacataaaatatacaaacatgtg

SEQ ID NO: 1981885 - DNA, 18 bp, Homo sapiens
aaacataatataagaatc

SEQ ID NO: 1981886 - DNA, 21 bp, Homo sapiens
aaacataattcttgtatatta

SEQ ID NO: 1981887 - DNA, 21 bp, Homo sapiens
aaacataccctttatctctgt

SEQ ID NO: 1981888 - DNA, 14 bp, Homo sapiens
aaacatagatagtg

SEQ ID NO: 1981889 - DNA, 18 bp, Homo sapiens
aaacatagatagtgcttt

SEQ ID NO: 1981890 - DNA, 21 bp, Homo sapiens
aaacatatcaattcaacacat

SEQ ID NO: 1981891 - DNA, 13 bp, Homo sapiens
aaacatgaattat

SEQ ID NO: 1981892 - DNA, 17 bp, Homo sapiens
aaacatgacactgacct

SEQ ID NO: 1981893 - DNA, 13 bp, Homo sapiens
aaacatgagaaat

SEQ ID NO: 1981894 - DNA, 15 bp, Homo sapiens
aaacatgagaaatgt

SEQ ID NO: 1981895 - DNA, 18 bp, Homo sapiens
aaacatgagaaatgtgaa

SEQ ID NO: 1981896 - DNA, 19 bp, Homo sapiens
aaacatgagaaatgtgaac

SEQ ID NO: 1981897 - DNA, 24 bp, Homo sapiens
aaacatgctaaatagttctatcag

SEQ ID NO: 1981898 - DNA, 21 bp, Homo sapiens
aaacatggtagaattggagag

SEQ ID NO: 1981899 - DNA, 14 bp, Homo sapiens
aaacattaaaagaa

SEQ ID NO: 1981900 - DNA, 21 bp, Homo sapiens
aaacattaaaagaagactgga

SEQ ID NO: 1981901 - DNA, 15 bp, Homo sapiens
acactgaatcatgtt

SEQ ID NO: 1981902 - DNA, 18 bp, Homo sapiens
acactgcaagagccttgg

SEQ ID NO: 1981903 - DNA, 11 bp, Homo sapiens
acactgctgca

SEQ ID NO: 1981904 - DNA, 23 bp, Homo sapiens
acactgcttgtgtttttaactca

SEQ ID NO: 1981905 - DNA, 11 bp, Homo sapiens
acactggatat

SEQ ID NO: 1981906 - DNA, 16 bp, Homo sapiens
acactgtaaacccctg

SEQ ID NO: 1981907 - DNA, 14 bp, Homo sapiens
acactgtcagagct

SEQ ID NO: 1981908 - DNA, 15 bp, Homo sapiens
acactgtcagagctg

SEQ ID NO: 1981909 - DNA, 18 bp, Homo sapiens
acactgttactccacagc

SEQ ID NO: 1981910 - DNA, 19 bp, Homo sapiens
acacttatggggacagcat

SEQ ID NO: 1981911 - DNA, 19 bp, Homo sapiens
acacttcaggctcttctcc

SEQ ID NO: 1981912 - DNA, 16 bp, Homo sapiens
acacttcatggaccaa

SEQ ID NO: 1981913 - DNA, 21 bp, Homo sapiens
acacttcatggaccaagaatg

SEQ ID NO: 1981914 - DNA, 20 bp, Homo sapiens
acacttctcaggacacaggc

SEQ ID NO: 1981915 - DNA, 19 bp, Homo sapiens
acacttcttgaaacagcct

SEQ ID NO: 1981916 - DNA, 20 bp, Homo sapiens
acacttcttgaaacagcctg

SEQ ID NO: 1981917 - DNA, 18 bp, Homo sapiens
acacttgccttcttcacc

SEQ ID NO: 1981918 - DNA, 18 bp, Homo sapiens
acacttggagcccgtgca

SEQ ID NO: 1981919 - DNA, 17 bp, Homo sapiens
acacttgtataaatgta

SEQ ID NO: 1981920 - DNA, 16 bp, Homo sapiens
acacttgtttcttgtt

SEQ ID NO: 1981921 - DNA, 12 bp, Homo sapiens
acagaaacaaaa

SEQ ID NO: 1981922 - DNA, 17 bp, Homo sapiens
acagaaacagagagaga

SEQ ID NO: 1981923 - DNA, 17 bp, Homo sapiens
acagaaatactgctctg

SEQ ID NO: 1981924 - DNA, 14 bp, Homo sapiens
acagaaatatatat

SEQ ID NO: 1981925 - DNA, 13 bp, Homo sapiens
acagaacactaaa

SEQ ID NO: 1981926 - DNA, 19 bp, Homo sapiens
acagaaccagagggttgta

SEQ ID NO: 1981927 - DNA, 20 bp, Homo sapiens
acagaactgaacgtcctgca

SEQ ID NO: 1981928 - DNA, 23 bp, Homo sapiens
acagaactgctaaatactgtaca

SEQ ID NO: 1981929 - DNA, 20 bp, Homo sapiens
acagaactgcttactagccc

SEQ ID NO: 1981930 - DNA, 13 bp, Homo sapiens
acagaagccagga

SEQ ID NO: 1981931 - DNA, 16 bp, Homo sapiens
acagaagccaggagca

SEQ ID NO: 1981932 - DNA, 13 bp, Homo sapiens
acagaagcttcca

SEQ ID NO: 1981933 - DNA, 18 bp, Homo sapiens
acagaaggagatgggtga

SEQ ID NO: 1981934 - DNA, 18 bp, Homo sapiens
acagaagtcatgaagccc

SEQ ID NO: 1981935 - DNA, 13 bp, Homo sapiens
acagaatgatgga

SEQ ID NO: 1981936 - DNA, 16 bp, Homo sapiens
acagaatgctgtttta

SEQ ID NO: 1981937 - DNA, 21 bp, Homo sapiens
acagacacacaaaatgtcaca

SEQ ID NO: 1981938 - DNA, 13 bp, Homo sapiens
acagacacaggcc

SEQ ID NO: 1981939 - DNA, 14 bp, Homo sapiens
acagacacaggccc

SEQ ID NO: 1981940 - DNA, 17 bp, Homo sapiens
acagacacaggcccggc

SEQ ID NO: 1981941 - DNA, 11 bp, Homo sapiens
acagacaggag

SEQ ID NO: 1981942 - DNA, 21 bp, Homo sapiens
acagacaggagaaatgcatcc

SEQ ID NO: 1981943 - DNA, 19 bp, Homo sapiens
acagacattttcaataatg

SEQ ID NO: 1981944 - DNA, 15 bp, Homo sapiens
acagacccacacatg

SEQ ID NO: 1981945 - DNA, 23 bp, Homo sapiens
acagacgattaacacaccacact

SEQ ID NO: 1981946 - DNA, 19 bp, Homo sapiens
acagacgtctcaagactga

SEQ ID NO: 1981947 - DNA, 17 bp, Homo sapiens
acagactatttaacttg

SEQ ID NO: 1981948 - DNA, 21 bp, Homo sapiens
acagactggaagcacagcttc

SEQ ID NO: 1981949 - DNA, 22 bp, Homo sapiens
acagactggaagcacagcttca

SEQ ID NO: 1981950 - DNA, 17 bp, Homo sapiens
acagacttctccagacc

SEQ ID NO: 1981951 - DNA, 18 bp, Homo sapiens
acagacttctggaaggct

SEQ ID NO: 1981952 - DNA, 17 bp, Homo sapiens
acagagaaagagagaga

SEQ ID NO: 1981953 - DNA, 17 bp, Homo sapiens
acagagacagaaacaga

SEQ ID NO: 1981954 - DNA, 15 bp, Homo sapiens
acagagacaggccca

SEQ ID NO: 1981955 - DNA, 15 bp, Homo sapiens
acagagagagactga

SEQ ID NO: 1981956 - DNA, 16 bp, Homo sapiens
acagagatatgcacac

SEQ ID NO: 1981957 - DNA, 23 bp, Homo sapiens
acagagatgcatgcgcaggctca

SEQ ID NO: 1981958 - DNA, 23 bp, Homo sapiens
acagagatggaggccgagccaat

SEQ ID NO: 1981959 - DNA, 15 bp, Homo sapiens
acagagcaagactct

SEQ ID NO: 1981960 - DNA, 22 bp, Homo sapiens
acagagcactaggttcaattcc

SEQ ID NO: 1981961 - DNA, 19 bp, Homo sapiens
acagagcccccaagcctct

SEQ ID NO: 1981962 - DNA, 23 bp, Homo sapiens
acagagcccccaagcctctgccc

SEQ ID NO: 1981963 - DNA, 17 bp, Homo sapiens
acagagccgcaaatcaa

SEQ ID NO: 1981964 - DNA, 13 bp, Homo sapiens
acagagcctgcct

SEQ ID NO: 1981965 - DNA, 13 bp, Homo sapiens
acagagcgggcct

SEQ ID NO: 1981966 - DNA, 14 bp, Homo sapiens
acagagcgggcctc

SEQ ID NO: 1981967 - DNA, 10 bp, Homo sapiens
acagagctgg

SEQ ID NO: 1981968 - DNA, 14 bp, Homo sapiens
acagagctgggatg

SEQ ID NO: 1981969 - DNA, 18 bp, Homo sapiens
acagagctgggatgtttc

SEQ ID NO: 1981970 - DNA, 14 bp, Homo sapiens
acagaggaagagca

SEQ ID NO: 1981971 - DNA, 16 bp, Homo sapiens
acagaggaagagcagg

SEQ ID NO: 1981972 - DNA, 20 bp, Homo sapiens
acagaggagggcgtgactca

SEQ ID NO: 1981973 - DNA, 13 bp, Homo sapiens
acagaggtaacta

SEQ ID NO: 1981974 - DNA, 21 bp, Homo sapiens
acagagtaaatagcattctct

SEQ ID NO: 1981975 - DNA, 16 bp, Homo sapiens
acagagtatatatgta

SEQ ID NO: 1981976 - DNA, 14 bp, Homo sapiens
acagagtctcactg

SEQ ID NO: 1981977 - DNA, 19 bp, Homo sapiens
acagagtgagactctgtct

SEQ ID NO: 1981978 - DNA, 18 bp, Homo sapiens
acagagttttcactctta

SEQ ID NO: 1981979 - DNA, 20 bp, Homo sapiens
acagagttttcactcttatt

SEQ ID NO: 1981980 - DNA, 17 bp, Homo sapiens
acagataatttattttg

SEQ ID NO: 1981981 - DNA, 17 bp, Homo sapiens
acagatacatagatgga

SEQ ID NO: 1981982 - DNA, 22 bp, Homo sapiens
acagatactggaagttttgcat

SEQ ID NO: 1981983 - DNA, 14 bp, Homo sapiens
acagatatgcacac

SEQ ID NO: 1981984 - DNA, 21 bp, Homo sapiens
acagatatgcacacacatgga

SEQ ID NO: 1981985 - DNA, 14 bp, Homo sapiens
acagatgcacccca

SEQ ID NO: 1981986 - DNA, 16 bp, Homo sapiens
acagatgggcaaatta

SEQ ID NO: 1981987 - DNA, 20 bp, Homo sapiens
acagatgggtattaaacttg

SEQ ID NO: 1981988 - DNA, 19 bp, Homo sapiens
acagatggtcacacagaga

SEQ ID NO: 1981989 - DNA, 22 bp, Homo sapiens
acagatgtgggctttgatttcc

SEQ ID NO: 1981990 - DNA, 22 bp, Homo sapiens
acagattctagccaaactattc

SEQ ID NO: 1981991 - DNA, 18 bp, Homo sapiens
acagcaaaactccatctc

SEQ ID NO: 1981992 - DNA, 23 bp, Homo sapiens
acagcaacaggaatctcagagac

SEQ ID NO: 1981993 - DNA, 20 bp, Homo sapiens
acagcaagatgaattttatc

SEQ ID NO: 1981994 - DNA, 18 bp, Homo sapiens
acagcaagggtgatggga

SEQ ID NO: 1981995 - DNA, 15 bp, Homo sapiens
acagcaattggctcc

SEQ ID NO: 1981996 - DNA, 15 bp, Homo sapiens
acagcacccaggctc

SEQ ID NO: 1981997 - DNA, 17 bp, Homo sapiens
acagcacccaggctcca

SEQ ID NO: 1981998 - DNA, 18 bp, Homo sapiens
acagcacccaggctccat

SEQ ID NO: 1981999 - DNA, 14 bp, Homo sapiens
acagcagaatgaag

SEQ ID NO: 1982000 - DNA, 18 bp, Homo sapiens
acagcagactcagctctg

SEQ ID NO: 1982001 - DNA, 19 bp, Homo sapiens
acagcagccccccagcact

SEQ ID NO: 1982002 - DNA, 19 bp, Homo sapiens
acagcagtatgaatgatgt

SEQ ID NO: 1982003 - DNA, 16 bp, Homo sapiens
acagcagtgtcatcag

SEQ ID NO: 1982004 - DNA, 13 bp, Homo sapiens
acagcagtgttcc

SEQ ID NO: 1982005 - DNA, 21 bp, Homo sapiens
acagcataccttggactgact

SEQ ID NO: 1982006 - DNA, 21 bp, Homo sapiens
acagcatctgcctctattcaa

SEQ ID NO: 1982007 - DNA, 12 bp, Homo sapiens
acagccagagcc

SEQ ID NO: 1982008 - DNA, 15 bp, Homo sapiens
acagccagagcctgt

SEQ ID NO: 1982009 - DNA, 19 bp, Homo sapiens
acagcccaagaggactgag

SEQ ID NO: 1982010 - DNA, 14 bp, Homo sapiens
acagcccagcctag

SEQ ID NO: 1982011 - DNA, 15 bp, Homo sapiens
acagcccagcctagc

SEQ ID NO: 1982012 - DNA, 14 bp, Homo sapiens
acagcccattttat

SEQ ID NO: 1982013 - DNA, 13 bp, Homo sapiens
acagccccacagc

SEQ ID NO: 1982014 - DNA, 19 bp, Homo sapiens
acagccccacagcacccag

SEQ ID NO: 1982015 - DNA, 11 bp, Homo sapiens
acagccccagg

SEQ ID NO: 1982016 - DNA, 16 bp, Homo sapiens
acagccccagggccct

SEQ ID NO: 1982017 - DNA, 13 bp, Homo sapiens
acagccctgggag

SEQ ID NO: 1982018 - DNA, 14 bp, Homo sapiens
acacagaaatatat

SEQ ID NO: 1982019 - DNA, 21 bp, Homo sapiens
acacagcagtatgaatgatgt

SEQ ID NO: 1982020 - DNA, 16 bp, Homo sapiens
acacagccattataaa

SEQ ID NO: 1982021 - DNA, 13 bp, Homo sapiens
acacagcccaaga

SEQ ID NO: 1982022 - DNA, 15 bp, Homo sapiens
acacagcctggactt

SEQ ID NO: 1982023 - DNA, 14 bp, Homo sapiens
acacagctcttctc

SEQ ID NO: 1982024 - DNA, 20 bp, Homo sapiens
acacagctcttctccaggct

SEQ ID NO: 1982025 - DNA, 21 bp, Homo sapiens
acacagctcttctccaggctg

SEQ ID NO: 1982026 - DNA, 19 bp, Homo sapiens
acacaggcaactgaggcag

SEQ ID NO: 1982027 - DNA, 18 bp, Homo sapiens
acacaggcatttcctggg

SEQ ID NO: 1982028 - DNA, 17 bp, Homo sapiens
acacaggcccggctcca

SEQ ID NO: 1982029 - DNA, 19 bp, Homo sapiens
acacaggcccggctccagg

SEQ ID NO: 1982030 - DNA, 21 bp, Homo sapiens
acacaggcccggctccaggct

SEQ ID NO: 1982031 - DNA, 12 bp, Homo sapiens
acacaggcctgt

SEQ ID NO: 1982032 - DNA, 14 bp, Homo sapiens
acacagggctcttt

SEQ ID NO: 1982033 - DNA, 16 bp, Homo sapiens
acacagggctctttga

SEQ ID NO: 1982034 - DNA, 19 bp, Homo sapiens
acacagtattacttctgct

SEQ ID NO: 1982035 - DNA, 19 bp, Homo sapiens
acacagtgggaactctgac

SEQ ID NO: 1982036 - DNA, 22 bp, Homo sapiens
acacagttgctgtcataagaat

SEQ ID NO: 1982037 - DNA, 14 bp, Homo sapiens
acacagttttgaaa

SEQ ID NO: 1982038 - DNA, 16 bp, Homo sapiens
acacatacatacacat

SEQ ID NO: 1982039 - DNA, 18 bp, Homo sapiens
acacatacatacacatac

SEQ ID NO: 1982040 - DNA, 14 bp, Homo sapiens
acacatacatacat

SEQ ID NO: 1982041 - DNA, 18 bp, Homo sapiens
acacatacatacatacat

SEQ ID NO: 1982042 - DNA, 14 bp, Homo sapiens
acacatacatcctg

SEQ ID NO: 1982043 - DNA, 12 bp, Homo sapiens
acacatatacat

SEQ ID NO: 1982044 - DNA, 13 bp, Homo sapiens
acacatatacata

SEQ ID NO: 1982045 - DNA, 16 bp, Homo sapiens
acacatatatgtatat

SEQ ID NO: 1982046 - DNA, 15 bp, Homo sapiens
acacatcagcttgcc

SEQ ID NO: 1982047 - DNA, 22 bp, Homo sapiens
acacatcagcttgccctgttaa

SEQ ID NO: 1982048 - DNA, 22 bp, Homo sapiens
acacatcccggcctcttccacc

SEQ ID NO: 1982049 - DNA, 19 bp, Homo sapiens
acacatccctaatgtgtgc

SEQ ID NO: 1982050 - DNA, 20 bp, Homo sapiens
acacatccctaatgtgtgcc

SEQ ID NO: 1982051 - DNA, 21 bp, Homo sapiens
acacatggacacagacccaca

SEQ ID NO: 1982052 - DNA, 16 bp, Homo sapiens
acacattacttgcaca

SEQ ID NO: 1982053 - DNA, 20 bp, Homo sapiens
acacattatcgggagcagtg

SEQ ID NO: 1982054 - DNA, 23 bp, Homo sapiens
acacattctcacaattgtaaagt

SEQ ID NO: 1982055 - DNA, 14 bp, Homo sapiens
acacattttctcct

SEQ ID NO: 1982056 - DNA, 23 bp, Homo sapiens
acacattttctcctaggagaagc

SEQ ID NO: 1982057 - DNA, 14 bp, Homo sapiens
acaccaaataaata

SEQ ID NO: 1982058 - DNA, 17 bp, Homo sapiens
acaccaacataaaaatg

SEQ ID NO: 1982059 - DNA, 18 bp, Homo sapiens
acaccaacataaaaatga

SEQ ID NO: 1982060 - DNA, 20 bp, Homo sapiens
acaccactctggcagccaca

SEQ ID NO: 1982061 - DNA, 16 bp, Homo sapiens
acaccactgccctgcc

SEQ ID NO: 1982062 - DNA, 18 bp, Homo sapiens
acaccactgccctgcctg

SEQ ID NO: 1982063 - DNA, 19 bp, Homo sapiens
acaccactgccctgcctgc

SEQ ID NO: 1982064 - DNA, 21 bp, Homo sapiens
acaccactgccctgcctgccc

SEQ ID NO: 1982065 - DNA, 12 bp, Homo sapiens
acaccagagccc

SEQ ID NO: 1982066 - DNA, 19 bp, Homo sapiens
acaccatcaccctctgggc

SEQ ID NO: 1982067 - DNA, 23 bp, Homo sapiens
acaccatgtttgagctcagaccc

SEQ ID NO: 1982068 - DNA, 16 bp, Homo sapiens
acaccattgttcctta

SEQ ID NO: 1982069 - DNA, 19 bp, Homo sapiens
acacccaaagaggtattta

SEQ ID NO: 1982070 - DNA, 20 bp, Homo sapiens
acacccaaagaggtatttat

SEQ ID NO: 1982071 - DNA, 22 bp, Homo sapiens
acacccaaagcatggactaacc

SEQ ID NO: 1982072 - DNA, 15 bp, Homo sapiens
acacccaagagggct

SEQ ID NO: 1982073 - DNA, 17 bp, Homo sapiens
acacccaagagggctgc

SEQ ID NO: 1982074 - DNA, 16 bp, Homo sapiens
acacccaagtccaggc

SEQ ID NO: 1982075 - DNA, 13 bp, Homo sapiens
acacccagcccac

SEQ ID NO: 1982076 - DNA, 20 bp, Homo sapiens
acacccagcccacttctgcc

SEQ ID NO: 1982077 - DNA, 14 bp, Homo sapiens
acacccatgtaaat

SEQ ID NO: 1982078 - DNA, 16 bp, Homo sapiens
acacccatgtaaatgt

SEQ ID NO: 1982079 - DNA, 13 bp, Homo sapiens
acaccccaaggga

SEQ ID NO: 1982080 - DNA, 19 bp, Homo sapiens
acaccccatctctcttccc

SEQ ID NO: 1982081 - DNA, 20 bp, Homo sapiens
acaccccttatccaggactc

SEQ ID NO: 1982082 - DNA, 16 bp, Homo sapiens
acacccttggacttga

SEQ ID NO: 1982083 - DNA, 18 bp, Homo sapiens
acacctaccatgctgctt

SEQ ID NO: 1982084 - DNA, 15 bp, Homo sapiens
acacctcaaatacat

SEQ ID NO: 1982085 - DNA, 18 bp, Homo sapiens
acacctcactgaggaagg

SEQ ID NO: 1982086 - DNA, 12 bp, Homo sapiens
acacctcccagg

SEQ ID NO: 1982087 - DNA, 22 bp, Homo sapiens
acacctccctactcccctgggc

SEQ ID NO: 1982088 - DNA, 13 bp, Homo sapiens
acacctccctgaa

SEQ ID NO: 1982089 - DNA, 22 bp, Homo sapiens
acacctcctagcaagacctgtt

SEQ ID NO: 1982090 - DNA, 23 bp, Homo sapiens
acacctccttcctcagtcctgga

SEQ ID NO: 1982091 - DNA, 12 bp, Homo sapiens
acacctgacaca

SEQ ID NO: 1982092 - DNA, 17 bp, Homo sapiens
acacctgagccagcctg

SEQ ID NO: 1982093 - DNA, 11 bp, Homo sapiens
acacctgcacc

SEQ ID NO: 1982094 - DNA, 16 bp, Homo sapiens
acacctgcacctcccc

SEQ ID NO: 1982095 - DNA, 13 bp, Homo sapiens
acacctgccccag

SEQ ID NO: 1982096 - DNA, 22 bp, Homo sapiens
acacctgccccagcgcggcttg

SEQ ID NO: 1982097 - DNA, 13 bp, Homo sapiens
acacctgccctgc

SEQ ID NO: 1982098 - DNA, 20 bp, Homo sapiens
acacctgccctgccctgcca

SEQ ID NO: 1982099 - DNA, 22 bp, Homo sapiens
acacctgccctgccctgccacc

SEQ ID NO: 1982100 - DNA, 19 bp, Homo sapiens
acacctggccgcctccagg

SEQ ID NO: 1982101 - DNA, 15 bp, Homo sapiens
aattcttgtatatta

SEQ ID NO: 1982102 - DNA, 20 bp, Homo sapiens
aattcttgtatattatggaa

SEQ ID NO: 1982103 - DNA, 20 bp, Homo sapiens
aattctttatttctgtcatt

SEQ ID NO: 1982104 - DNA, 22 bp, Homo sapiens
aattctttttcaaaaattacac

SEQ ID NO: 1982105 - DNA, 22 bp, Homo sapiens
aattgaaaggaaatgtttgagt

SEQ ID NO: 1982106 - DNA, 12 bp, Homo sapiens
aattgaaatata

SEQ ID NO: 1982107 - DNA, 17 bp, Homo sapiens
aattgaagagagatata

SEQ ID NO: 1982108 - DNA, 23 bp, Homo sapiens
aattgaagagagatatatctgaa

SEQ ID NO: 1982109 - DNA, 20 bp, Homo sapiens
aattgaagagatttcaacat

SEQ ID NO: 1982110 - DNA, 21 bp, Homo sapiens
aattgaagagatttcaacata

SEQ ID NO: 1982111 - DNA, 23 bp, Homo sapiens
aattgaagatgtaaggaattgaa

SEQ ID NO: 1982112 - DNA, 20 bp, Homo sapiens
aattgaaggagaaaatgcat

SEQ ID NO: 1982113 - DNA, 15 bp, Homo sapiens
aattgaatggaagca

SEQ ID NO: 1982114 - DNA, 18 bp, Homo sapiens
aattgagctgcagaaacg

SEQ ID NO: 1982115 - DNA, 21 bp, Homo sapiens
aattgagtctcttttttattc

SEQ ID NO: 1982116 - DNA, 19 bp, Homo sapiens
aattgatacttcaggtgct

SEQ ID NO: 1982117 - DNA, 22 bp, Homo sapiens
aattgattattctgattccact

SEQ ID NO: 1982118 - DNA, 23 bp, Homo sapiens
aattgattattctgattccactt

SEQ ID NO: 1982119 - DNA, 21 bp, Homo sapiens
aattgattcaagattggacat

SEQ ID NO: 1982120 - DNA, 15 bp, Homo sapiens
aattgatttcaagac

SEQ ID NO: 1982121 - DNA, 13 bp, Homo sapiens
aattgcacaattt

SEQ ID NO: 1982122 - DNA, 15 bp, Homo sapiens
aattgcacaatttga

SEQ ID NO: 1982123 - DNA, 19 bp, Homo sapiens
aattgcacaatttgagcaa

SEQ ID NO: 1982124 - DNA, 21 bp, Homo sapiens
aattgcacaatttgagcaatt

SEQ ID NO: 1982125 - DNA, 14 bp, Homo sapiens
aattgcacttttaa

SEQ ID NO: 1982126 - DNA, 14 bp, Homo sapiens
aattgccaaagctg

SEQ ID NO: 1982127 - DNA, 19 bp, Homo sapiens
aattgcctgcagagagaag

SEQ ID NO: 1982128 - DNA, 20 bp, Homo sapiens
aattgctattttatttgtat

SEQ ID NO: 1982129 - DNA, 12 bp, Homo sapiens
aattgctccttg

SEQ ID NO: 1982130 - DNA, 19 bp, Homo sapiens
aattgcttaaaagacattt

SEQ ID NO: 1982131 - DNA, 20 bp, Homo sapiens
aattgcttacatttttacaa

SEQ ID NO: 1982132 - DNA, 20 bp, Homo sapiens
aattgcttttgttgtgactt

SEQ ID NO: 1982133 - DNA, 22 bp, Homo sapiens
aattgcttttgttgtgactttt

SEQ ID NO: 1982134 - DNA, 20 bp, Homo sapiens
aattggagtatctaaagcca

SEQ ID NO: 1982135 - DNA, 21 bp, Homo sapiens
aattgggagcttgggaatgga

SEQ ID NO: 1982136 - DNA, 19 bp, Homo sapiens
aattgggattttaaaaaca

SEQ ID NO: 1982137 - DNA, 17 bp, Homo sapiens
aattggtgataagtgga

SEQ ID NO: 1982138 - DNA, 19 bp, Homo sapiens
aattggtgataagtggaaa

SEQ ID NO: 1982139 - DNA, 21 bp, Homo sapiens
aattgtaaaattgtatagaga

SEQ ID NO: 1982140 - DNA, 15 bp, Homo sapiens
aattgtaaattttag

SEQ ID NO: 1982141 - DNA, 16 bp, Homo sapiens
aattgtagatggaaat

SEQ ID NO: 1982142 - DNA, 20 bp, Homo sapiens
aattgtatacattttgttat

SEQ ID NO: 1982143 - DNA, 13 bp, Homo sapiens
aattgtatagaga

SEQ ID NO: 1982144 - DNA, 13 bp, Homo sapiens
aattgtattttat

SEQ ID NO: 1982145 - DNA, 13 bp, Homo sapiens
aattgtccccagt

SEQ ID NO: 1982146 - DNA, 17 bp, Homo sapiens
aattgtccctgtttcaa

SEQ ID NO: 1982147 - DNA, 21 bp, Homo sapiens
aattgtgatgttttgttcaaa

SEQ ID NO: 1982148 - DNA, 13 bp, Homo sapiens
aattgtgtacaaa

SEQ ID NO: 1982149 - DNA, 13 bp, Homo sapiens
aattgtgtttaga

SEQ ID NO: 1982150 - DNA, 17 bp, Homo sapiens
aattgttcctgatgtgc

SEQ ID NO: 1982151 - DNA, 19 bp, Homo sapiens
aattgtttggcttcctcct

SEQ ID NO: 1982152 - DNA, 13 bp, Homo sapiens
aatttaaaaaata

SEQ ID NO: 1982153 - DNA, 16 bp, Homo sapiens
aatttaaaaataaagc

SEQ ID NO: 1982154 - DNA, 22 bp, Homo sapiens
aatttaaaatcattcaatatct

SEQ ID NO: 1982155 - DNA, 13 bp, Homo sapiens
aatttaaaccagc

SEQ ID NO: 1982156 - DNA, 14 bp, Homo sapiens
aatttaaaccagca

SEQ ID NO: 1982157 - DNA, 22 bp, Homo sapiens
aatttaaactataagcaagaag

SEQ ID NO: 1982158 - DNA, 12 bp, Homo sapiens
aatttaaagcaa

SEQ ID NO: 1982159 - DNA, 15 bp, Homo sapiens
aatttaaagccacaa

SEQ ID NO: 1982160 - DNA, 20 bp, Homo sapiens
aatttaaattctttttcaaa

SEQ ID NO: 1982161 - DNA, 14 bp, Homo sapiens
aatttaactaattt

SEQ ID NO: 1982162 - DNA, 19 bp, Homo sapiens
aatttaataaaaacttcag

SEQ ID NO: 1982163 - DNA, 14 bp, Homo sapiens
aatttaatatagct

SEQ ID NO: 1982164 - DNA, 15 bp, Homo sapiens
aatttaattaatcga

SEQ ID NO: 1982165 - DNA, 21 bp, Homo sapiens
aatttaattaggggttgctaa

SEQ ID NO: 1982166 - DNA, 15 bp, Homo sapiens
aatttaattcttatt

SEQ ID NO: 1982167 - DNA, 14 bp, Homo sapiens
aatttacatggcaa

SEQ ID NO: 1982168 - DNA, 14 bp, Homo sapiens
aatttagaaaacat

SEQ ID NO: 1982169 - DNA, 21 bp, Homo sapiens
aatttagaaaacattcatcca

SEQ ID NO: 1982170 - DNA, 16 bp, Homo sapiens
aatttagaaaacttta

SEQ ID NO: 1982171 - DNA, 17 bp, Homo sapiens
aatttagaaatcatttt

SEQ ID NO: 1982172 - DNA, 21 bp, Homo sapiens
aatttataaaattagaaagca

SEQ ID NO: 1982173 - DNA, 15 bp, Homo sapiens
aatttatacaaaata

SEQ ID NO: 1982174 - DNA, 18 bp, Homo sapiens
aatttatacaaaataatt

SEQ ID NO: 1982175 - DNA, 19 bp, Homo sapiens
aatttatacaaaataattt

SEQ ID NO: 1982176 - DNA, 16 bp, Homo sapiens
aatttatattgtaaat

SEQ ID NO: 1982177 - DNA, 14 bp, Homo sapiens
aatttatctgaata

SEQ ID NO: 1982178 - DNA, 16 bp, Homo sapiens
aatttatgagtttttg

SEQ ID NO: 1982179 - DNA, 19 bp, Homo sapiens
aatttattacttgttgcaa

SEQ ID NO: 1982180 - DNA, 17 bp, Homo sapiens
aatttatttcatccagt

SEQ ID NO: 1982181 - DNA, 12 bp, Homo sapiens
aatttattttgt

SEQ ID NO: 1982182 - DNA, 19 bp, Homo sapiens
aatttcaaaagtgatctgt

SEQ ID NO: 1982183 - DNA, 19 bp, Homo sapiens
aatttcaaccagcattcat

SEQ ID NO: 1982184 - DNA, 14 bp, Homo sapiens
aatttcacattaat

SEQ ID NO: 1982185 - DNA, 21 bp, Homo sapiens
aatttcaggcattttgttcta

SEQ ID NO: 1982186 - DNA, 17 bp, Homo sapiens
aatttccagtacctttg

SEQ ID NO: 1982187 - DNA, 22 bp, Homo sapiens
aatttctaaaaaacagaggcca

SEQ ID NO: 1982188 - DNA, 17 bp, Homo sapiens
aatttgagaattattcc

SEQ ID NO: 1982189 - DNA, 14 bp, Homo sapiens
aatttgagcaattc

SEQ ID NO: 1982190 - DNA, 19 bp, Homo sapiens
aatttgagcaattcatttc

SEQ ID NO: 1982191 - DNA, 21 bp, Homo sapiens
aatttgagcaattcatttcac

SEQ ID NO: 1982192 - DNA, 17 bp, Homo sapiens
aatttgatacaaaatgc

SEQ ID NO: 1982193 - DNA, 21 bp, Homo sapiens
aatttgatacatatgtgaata

SEQ ID NO: 1982194 - DNA, 21 bp, Homo sapiens
aatttgcactgttacttttta

SEQ ID NO: 1982195 - DNA, 21 bp, Homo sapiens
acaaccacctaatcaggctga

SEQ ID NO: 1982196 - DNA, 18 bp, Homo sapiens
acaaccagccacacagag

SEQ ID NO: 1982197 - DNA, 11 bp, Homo sapiens
acaacccagaa

SEQ ID NO: 1982198 - DNA, 17 bp, Homo sapiens
acaaccctgttttatac

SEQ ID NO: 1982199 - DNA, 15 bp, Homo sapiens
acaacctgcccctcc

SEQ ID NO: 1982200 - DNA, 16 bp, Homo sapiens
acaacctgcccctccc

SEQ ID NO: 1982201 - DNA, 14 bp, Homo sapiens
acaacctttgtgta

SEQ ID NO: 1982202 - DNA, 14 bp, Homo sapiens
acaactaatcaaga

SEQ ID NO: 1982203 - DNA, 14 bp, Homo sapiens
acaactaggacctc

SEQ ID NO: 1982204 - DNA, 16 bp, Homo sapiens
acaactaggcttcagc

SEQ ID NO: 1982205 - DNA, 21 bp, Homo sapiens
acaactccctgaacctcagtt

SEQ ID NO: 1982206 - DNA, 12 bp, Homo sapiens
acaactgacaca

SEQ ID NO: 1982207 - DNA, 14 bp, Homo sapiens
acaactgacacagg

SEQ ID NO: 1982208 - DNA, 13 bp, Homo sapiens
acaagaaagaaac

SEQ ID NO: 1982209 - DNA, 15 bp, Homo sapiens
acaagaaatccctgt

SEQ ID NO: 1982210 - DNA, 11 bp, Homo sapiens
acaagaacaac

SEQ ID NO: 1982211 - DNA, 15 bp, Homo sapiens
acaagaagcattttg

SEQ ID NO: 1982212 - DNA, 20 bp, Homo sapiens
acaagaagccacagacctag

SEQ ID NO: 1982213 - DNA, 23 bp, Homo sapiens
acaagagccatgtaccagtgtac

SEQ ID NO: 1982214 - DNA, 15 bp, Homo sapiens
acaagagctgctgtc

SEQ ID NO: 1982215 - DNA, 16 bp, Homo sapiens
acaagaggaagagaga

SEQ ID NO: 1982216 - DNA, 20 bp, Homo sapiens
acaagaggaagagagagacc

SEQ ID NO: 1982217 - DNA, 18 bp, Homo sapiens
acaagataaaggaagtca

SEQ ID NO: 1982218 - DNA, 16 bp, Homo sapiens
acaagatctttcagga

SEQ ID NO: 1982219 - DNA, 22 bp, Homo sapiens
acaagatggaaaataaattata

SEQ ID NO: 1982220 - DNA, 17 bp, Homo sapiens
acaagcaacataaaaca

SEQ ID NO: 1982221 - DNA, 16 bp, Homo sapiens
aatatatataaatata

SEQ ID NO: 1982222 - DNA, 14 bp, Homo sapiens
aatatatatacata

SEQ ID NO: 1982223 - DNA, 13 bp, Homo sapiens
aatatatggtctg

SEQ ID NO: 1982224 - DNA, 13 bp, Homo sapiens
aatatattataat

SEQ ID NO: 1982225 - DNA, 16 bp, Homo sapiens
aatatattataatctt

SEQ ID NO: 1982226 - DNA, 15 bp, Homo sapiens
aatatatttaagata

SEQ ID NO: 1982227 - DNA, 20 bp, Homo sapiens
aatatatttaagataattat

SEQ ID NO: 1982228 - DNA, 15 bp, Homo sapiens
aatatatttcagata

SEQ ID NO: 1982229 - DNA, 18 bp, Homo sapiens
aatatccactgcaatact

SEQ ID NO: 1982230 - DNA, 18 bp, Homo sapiens
aatatcctaaacatcatt

SEQ ID NO: 1982231 - DNA, 18 bp, Homo sapiens
aatatctaataaaaagtc

SEQ ID NO: 1982232 - DNA, 21 bp, Homo sapiens
aatatctgagaagtgtatata

SEQ ID NO: 1982233 - DNA, 20 bp, Homo sapiens
aatatctgtgaggtgctgat

SEQ ID NO: 1982234 - DNA, 21 bp, Homo sapiens
aatatcttgctggattaatgt

SEQ ID NO: 1982235 - DNA, 14 bp, Homo sapiens
aatatgaaatgata

SEQ ID NO: 1982236 - DNA, 16 bp, Homo sapiens
aatatgaaatgataaa

SEQ ID NO: 1982237 - DNA, 11 bp, Homo sapiens
aatatgaacaa

SEQ ID NO: 1982238 - DNA, 14 bp, Homo sapiens
aatatgaacaaact

SEQ ID NO: 1982239 - DNA, 13 bp, Homo sapiens
aatatgaacaaag

SEQ ID NO: 1982240 - DNA, 16 bp, Homo sapiens
aatatgacagctgtcc

SEQ ID NO: 1982241 - DNA, 17 bp, Homo sapiens
aatatgatattgcatat

SEQ ID NO: 1982242 - DNA, 16 bp, Homo sapiens
aatatgatgttaaaaa

SEQ ID NO: 1982243 - DNA, 12 bp, Homo sapiens
aatatgatttta

SEQ ID NO: 1982244 - DNA, 22 bp, Homo sapiens
aatatgattttttaaaagaaat

SEQ ID NO: 1982245 - DNA, 23 bp, Homo sapiens
aatatgattttttaaaagaaatt

SEQ ID NO: 1982246 - DNA, 24 bp, Homo sapiens
aatatgcaaagcactgacttctaa

SEQ ID NO: 1982247 - DNA, 11 bp, Homo sapiens
aatatgcttac

SEQ ID NO: 1982248 - DNA, 18 bp, Homo sapiens
aatatggaaccttccctc

SEQ ID NO: 1982249 - DNA, 20 bp, Homo sapiens
aatatggaacttctaatata

SEQ ID NO: 1982250 - DNA, 14 bp, Homo sapiens
aatatgtattgtaa

SEQ ID NO: 1982251 - DNA, 15 bp, Homo sapiens
aatatgtattgtaaa

SEQ ID NO: 1982252 - DNA, 20 bp, Homo sapiens
aatatgtctgccacagagag

SEQ ID NO: 1982253 - DNA, 14 bp, Homo sapiens
aatatgttcaatgc

SEQ ID NO: 1982254 - DNA, 13 bp, Homo sapiens
aatatgttcatta

SEQ ID NO: 1982255 - DNA, 18 bp, Homo sapiens
aatatgttgagtgttcat

SEQ ID NO: 1982256 - DNA, 22 bp, Homo sapiens
aatatgttgagtgttcatttta

SEQ ID NO: 1982257 - DNA, 22 bp, Homo sapiens
aatatgtttgtgccttaaaagg

SEQ ID NO: 1982258 - DNA, 13 bp, Homo sapiens
aatattaaataca

SEQ ID NO: 1982259 - DNA, 14 bp, Homo sapiens
aatattaaatacag

SEQ ID NO: 1982260 - DNA, 20 bp, Homo sapiens
aatattaaatacagacacta

SEQ ID NO: 1982261 - DNA, 22 bp, Homo sapiens
aatattaaatacagacactaag

SEQ ID NO: 1982262 - DNA, 13 bp, Homo sapiens
aatattcaaatgt

SEQ ID NO: 1982263 - DNA, 14 bp, Homo sapiens
aatattcaataaag

SEQ ID NO: 1982264 - DNA, 12 bp, Homo sapiens
aatattcctgaa

SEQ ID NO: 1982265 - DNA, 15 bp, Homo sapiens
aatattcctgaatga

SEQ ID NO: 1982266 - DNA, 15 bp, Homo sapiens
aatattgaataagta

SEQ ID NO: 1982267 - DNA, 12 bp, Homo sapiens
aatatttaaaca

SEQ ID NO: 1982268 - DNA, 14 bp, Homo sapiens
aatatttaaacagc

SEQ ID NO: 1982269 - DNA, 19 bp, Homo sapiens
aatatttaaacagcagtgt

SEQ ID NO: 1982270 - DNA, 16 bp, Homo sapiens
aatatttaagtatata

SEQ ID NO: 1982271 - DNA, 17 bp, Homo sapiens
aatatttaagtatatag

SEQ ID NO: 1982272 - DNA, 23 bp, Homo sapiens
aatatttaagtttgttgctgtca

SEQ ID NO: 1982273 - DNA, 15 bp, Homo sapiens
aatatttacatatga

SEQ ID NO: 1982274 - DNA, 18 bp, Homo sapiens
aatatttaggcaagagaa

SEQ ID NO: 1982275 - DNA, 21 bp, Homo sapiens
aatatttatgcttaaaatatg

SEQ ID NO: 1982276 - DNA, 19 bp, Homo sapiens
aatatttatgtctatttaa

SEQ ID NO: 1982277 - DNA, 23 bp, Homo sapiens
aatatttatgtctatttaagcct

SEQ ID NO: 1982278 - DNA, 14 bp, Homo sapiens
aatatttattacct

SEQ ID NO: 1982279 - DNA, 21 bp, Homo sapiens
aatatttggtctctatttcat

SEQ ID NO: 1982280 - DNA, 15 bp, Homo sapiens
aatattttaaagaat

SEQ ID NO: 1982281 - DNA, 17 bp, Homo sapiens
aatattttagccttaaa

SEQ ID NO: 1982282 - DNA, 10 bp, Homo sapiens
aatattttgt

SEQ ID NO: 1982283 - DNA, 15 bp, Homo sapiens
aatattttgtatttt

SEQ ID NO: 1982284 - DNA, 22 bp, Homo sapiens
aatatttttagctctgttcttt

SEQ ID NO: 1982285 - DNA, 14 bp, Homo sapiens
aatcaaaaattgaa

SEQ ID NO: 1982286 - DNA, 12 bp, Homo sapiens
aatcaaaagctg

SEQ ID NO: 1982287 - DNA, 13 bp, Homo sapiens
aatcaaagcaagg

SEQ ID NO: 1982288 - DNA, 20 bp, Homo sapiens
aatcaagaatattcaaatgt

SEQ ID NO: 1982289 - DNA, 13 bp, Homo sapiens
aatcaataaaaat

SEQ ID NO: 1982290 - DNA, 20 bp, Homo sapiens
aatcaatctatcaattacag

SEQ ID NO: 1982291 - DNA, 15 bp, Homo sapiens
aatcaatttcccaga

SEQ ID NO: 1982292 - DNA, 17 bp, Homo sapiens
aatcaatttcccagaag

SEQ ID NO: 1982293 - DNA, 15 bp, Homo sapiens
aatcacaagcaataa

SEQ ID NO: 1982294 - DNA, 16 bp, Homo sapiens
aatcacctggagggct

SEQ ID NO: 1982295 - DNA, 15 bp, Homo sapiens
aatcacgctttttga

SEQ ID NO: 1982296 - DNA, 16 bp, Homo sapiens
aatcacgctttttgaa

SEQ ID NO: 1982297 - DNA, 18 bp, Homo sapiens
aatcacgctttttgaaaa

SEQ ID NO: 1982298 - DNA, 17 bp, Homo sapiens
aatcactatctttctga

SEQ ID NO: 1982299 - DNA, 15 bp, Homo sapiens
aatcacttgtaaata

SEQ ID NO: 1982300 - DNA, 19 bp, Homo sapiens
aatcacttgtaaataaata

SEQ ID NO: 1982301 - DNA, 14 bp, Homo sapiens
aatcagatagatat

SEQ ID NO: 1982302 - DNA, 16 bp, Homo sapiens
aatcagcactgaaaat

SEQ ID NO: 1982303 - DNA, 15 bp, Homo sapiens
aatcagcgccctgga

SEQ ID NO: 1982304 - DNA, 24 bp, Homo sapiens
aatcagtctcagaatgtcattttg

SEQ ID NO: 1982305 - DNA, 18 bp, Homo sapiens
aatcagttatattcttta

SEQ ID NO: 1982306 - DNA, 21 bp, Homo sapiens
aatcagttatattctttaaat

SEQ ID NO: 1982307 - DNA, 22 bp, Homo sapiens
aatcagttatattctttaaatt

SEQ ID NO: 1982308 - DNA, 15 bp, Homo sapiens
aatcatagtgccata

SEQ ID NO: 1982309 - DNA, 18 bp, Homo sapiens
aatcatataataaatgta

SEQ ID NO: 1982310 - DNA, 23 bp, Homo sapiens
aatcatcaccacaccgtgagcag

SEQ ID NO: 1982311 - DNA, 17 bp, Homo sapiens
aatcatcgaaaattcat

SEQ ID NO: 1982312 - DNA, 18 bp, Homo sapiens
aatcatgagtcagacatt

SEQ ID NO: 1982313 - DNA, 23 bp, Homo sapiens
aatcatgatctgactttaattgt

SEQ ID NO: 1982314 - DNA, 14 bp, Homo sapiens
aatcattcaatatc

SEQ ID NO: 1982315 - DNA, 18 bp, Homo sapiens
aatcattcaatatctgac

SEQ ID NO: 1982316 - DNA, 14 bp, Homo sapiens
aatcattgctttga

SEQ ID NO: 1982317 - DNA, 21 bp, Homo sapiens
aatcattgctttgaagcagtt

SEQ ID NO: 1982318 - DNA, 13 bp, Homo sapiens
aatcattgtagaa

SEQ ID NO: 1982319 - DNA, 16 bp, Homo sapiens
aatcatttaaatatta

SEQ ID NO: 1982320 - DNA, 13 bp, Homo sapiens
aatcattttgcaa

SEQ ID NO: 1982321 - DNA, 10 bp, Homo sapiens
aatccaaaga

SEQ ID NO: 1982322 - DNA, 18 bp, Homo sapiens
aatccacaagccattttt

SEQ ID NO: 1982323 - DNA, 12 bp, Homo sapiens
aatccacccatc

SEQ ID NO: 1982324 - DNA, 14 bp, Homo sapiens
aatccactctcagg

SEQ ID NO: 1982325 - DNA, 15 bp, Homo sapiens
aatccactctcagga

SEQ ID NO: 1982326 - DNA, 19 bp, Homo sapiens
aatccagacccggctgcgt

SEQ ID NO: 1982327 - DNA, 22 bp, Homo sapiens
aatccaggtctcgggtccgatt

SEQ ID NO: 1982328 - DNA, 14 bp, Homo sapiens
aatcccaaaagtca

SEQ ID NO: 1982329 - DNA, 16 bp, Homo sapiens
aatccccccttcagaa

SEQ ID NO: 1982330 - DNA, 19 bp, Homo sapiens
aatcccctcattcaggaaa

SEQ ID NO: 1982331 - DNA, 14 bp, Homo sapiens
aatccctgtttaat

SEQ ID NO: 1982332 - DNA, 17 bp, Homo sapiens
aatccctgtttaatatt

SEQ ID NO: 1982333 - DNA, 22 bp, Homo sapiens
aagtgctgtacccttccacctc

SEQ ID NO: 1982334 - DNA, 14 bp, Homo sapiens
aagtggaaaaaaga

SEQ ID NO: 1982335 - DNA, 19 bp, Homo sapiens
aagtggctaattcaattta

SEQ ID NO: 1982336 - DNA, 14 bp, Homo sapiens
aagtggctgctgac

SEQ ID NO: 1982337 - DNA, 15 bp, Homo sapiens
aacctgctctcctct

SEQ ID NO: 1982338 - DNA, 20 bp, Homo sapiens
aacctgctctcctcttgcca

SEQ ID NO: 1982339 - DNA, 10 bp, Homo sapiens
aacctggaga

SEQ ID NO: 1982340 - DNA, 19 bp, Homo sapiens
aacctggagggctagaacc

SEQ ID NO: 1982341 - DNA, 22 bp, Homo sapiens
aacctggagggctggaatctgg

SEQ ID NO: 1982342 - DNA, 21 bp, Homo sapiens
aacctggcatggtgctttcag

SEQ ID NO: 1982343 - DNA, 22 bp, Homo sapiens
aacctgggaggcggagagtaca

SEQ ID NO: 1982344 - DNA, 14 bp, Homo sapiens
aacctgtactgggt

SEQ ID NO: 1982345 - DNA, 16 bp, Homo sapiens
aacctgtccataaagt

SEQ ID NO: 1982346 - DNA, 21 bp, Homo sapiens
aacctgtccataaagtaattt

SEQ ID NO: 1982347 - DNA, 22 bp, Homo sapiens
aacctgtgcagtcccgtggagg

SEQ ID NO: 1982348 - DNA, 13 bp, Homo sapiens
aaccttccctcca

SEQ ID NO: 1982349 - DNA, 23 bp, Homo sapiens
aaccttgtctctatgccagctca

SEQ ID NO: 1982350 - DNA, 20 bp, Homo sapiens
aacctttaaagtaaaggcct

SEQ ID NO: 1982351 - DNA, 15 bp, Homo sapiens
aacctttccctcacc

SEQ ID NO: 1982352 - DNA, 18 bp, Homo sapiens
aacctttccctcaccccc

SEQ ID NO: 1982353 - DNA, 19 bp, Homo sapiens
aacctttccctcaccccct

SEQ ID NO: 1982354 - DNA, 18 bp, Homo sapiens
aacctttccgctgtcgcc

SEQ ID NO: 1982355 - DNA, 23 bp, Homo sapiens
aacctttccgctgtcgccccagg

SEQ ID NO: 1982356 - DNA, 18 bp, Homo sapiens
aacctttcttcaccaaat

SEQ ID NO: 1982357 - DNA, 15 bp, Homo sapiens
aacctttgtgtaata

SEQ ID NO: 1982358 - DNA, 17 bp, Homo sapiens
aacctttgtgtaataaa

SEQ ID NO: 1982359 - DNA, 15 bp, Homo sapiens
aacgaagataaatca

SEQ ID NO: 1982360 - DNA, 11 bp, Homo sapiens
aacgaatgaag

SEQ ID NO: 1982361 - DNA, 18 bp, Homo sapiens
aacgactgggcactgcca

SEQ ID NO: 1982362 - DNA, 16 bp, Homo sapiens
aacgagcactggccag

SEQ ID NO: 1982363 - DNA, 12 bp, Homo sapiens
aacgatttagaa

SEQ ID NO: 1982364 - DNA, 21 bp, Homo sapiens
aacgcacgcaacccttgctgc

SEQ ID NO: 1982365 - DNA, 21 bp, Homo sapiens
aacgcagaggcggaaaccttg

SEQ ID NO: 1982366 - DNA, 11 bp, Homo sapiens
aacgcagccct

SEQ ID NO: 1982367 - DNA, 12 bp, Homo sapiens
aacgcagccctg

SEQ ID NO: 1982368 - DNA, 16 bp, Homo sapiens
aacgcagccctgcttt

SEQ ID NO: 1982369 - DNA, 22 bp, Homo sapiens
aacgcctcttttccctctctag

SEQ ID NO: 1982370 - DNA, 12 bp, Homo sapiens
aacgcctgagcc

SEQ ID NO: 1982371 - DNA, 18 bp, Homo sapiens
aacgcctgagcccaggga

SEQ ID NO: 1982372 - DNA, 14 bp, Homo sapiens
aacggaagaagaga

SEQ ID NO: 1982373 - DNA, 19 bp, Homo sapiens
aacgggaaagaatataaag

SEQ ID NO: 1982374 - DNA, 17 bp, Homo sapiens
aacgtaaccacggaaaa

SEQ ID NO: 1982375 - DNA, 21 bp, Homo sapiens
aacgtaatgattatatgacaa

SEQ ID NO: 1982376 - DNA, 22 bp, Homo sapiens
aacgtacttaactgtgtgaaga

SEQ ID NO: 1982377 - DNA, 15 bp, Homo sapiens
aacgtgatgatcagc

SEQ ID NO: 1982378 - DNA, 20 bp, Homo sapiens
aacgtgatgatcagctgttt

SEQ ID NO: 1982379 - DNA, 15 bp, Homo sapiens
aacgttaaaagacag

SEQ ID NO: 1982380 - DNA, 14 bp, Homo sapiens
aacgttgctcccca

SEQ ID NO: 1982381 - DNA, 20 bp, Homo sapiens
aacgttttgaactaataaaa

SEQ ID NO: 1982382 - DNA, 23 bp, Homo sapiens
aactaagcagtccctgagaccat

SEQ ID NO: 1982383 - DNA, 13 bp, Homo sapiens
aactaagccctcg

SEQ ID NO: 1982384 - DNA, 21 bp, Homo sapiens
aactaagttttttacttccac

SEQ ID NO: 1982385 - DNA, 15 bp, Homo sapiens
aactaataaaagcat

SEQ ID NO: 1982386 - DNA, 14 bp, Homo sapiens
aactaatcaagagt

SEQ ID NO: 1982387 - DNA, 16 bp, Homo sapiens
aactaatcaagagtga

SEQ ID NO: 1982388 - DNA, 21 bp, Homo sapiens
aactaatcaagagtgagtgaa

SEQ ID NO: 1982389 - DNA, 12 bp, Homo sapiens
aactaatttaaa

SEQ ID NO: 1982390 - DNA, 19 bp, Homo sapiens
aactacgcttgctcatttt

SEQ ID NO: 1982391 - DNA, 16 bp, Homo sapiens
aactagaacctggagg

SEQ ID NO: 1982392 - DNA, 21 bp, Homo sapiens
aactagaagaaagggcaagaa

SEQ ID NO: 1982393 - DNA, 17 bp, Homo sapiens
aactagaatttattcaa

SEQ ID NO: 1982394 - DNA, 22 bp, Homo sapiens
aactagaatttattcaattcct

SEQ ID NO: 1982395 - DNA, 21 bp, Homo sapiens
aactagaggtgagaaatttaa

SEQ ID NO: 1982396 - DNA, 17 bp, Homo sapiens
aactagatcaaggagcc

SEQ ID NO: 1982397 - DNA, 15 bp, Homo sapiens
aactagatctcctgt

SEQ ID NO: 1982398 - DNA, 16 bp, Homo sapiens
aactagatctcctgta

SEQ ID NO: 1982399 - DNA, 19 bp, Homo sapiens
aactagatctcctgtaatt

SEQ ID NO: 1982400 - DNA, 21 bp, Homo sapiens
aactagatctcctgtaatttt

SEQ ID NO: 1982401 - DNA, 18 bp, Homo sapiens
aactagcttggaaactgg

SEQ ID NO: 1982402 - DNA, 13 bp, Homo sapiens
aactaggacctca

SEQ ID NO: 1982403 - DNA, 16 bp, Homo sapiens
aactaggccatttgta

SEQ ID NO: 1982404 - DNA, 23 bp, Homo sapiens
aactagtaatgggccaattaaaa

SEQ ID NO: 1982405 - DNA, 13 bp, Homo sapiens
aactagtttccag

SEQ ID NO: 1982406 - DNA, 18 bp, Homo sapiens
aactagtttccagtggat

SEQ ID NO: 1982407 - DNA, 18 bp, Homo sapiens
aactataaactactgtaa

SEQ ID NO: 1982408 - DNA, 13 bp, Homo sapiens
aactatattttct

SEQ ID NO: 1982409 - DNA, 16 bp, Homo sapiens
aactatcaatatttaa

SEQ ID NO: 1982410 - DNA, 18 bp, Homo sapiens
aactatcaatatttaagt

SEQ ID NO: 1982411 - DNA, 22 bp, Homo sapiens
aactatcaatatttaagtttgt

SEQ ID NO: 1982412 - DNA, 15 bp, Homo sapiens
aactatccaattaaa

SEQ ID NO: 1982413 - DNA, 11 bp, Homo sapiens
aactatcttgg

SEQ ID NO: 1982414 - DNA, 18 bp, Homo sapiens
aactatcttggtgaattt

SEQ ID NO: 1982415 - DNA, 17 bp, Homo sapiens
aactatggttcccaata

SEQ ID NO: 1982416 - DNA, 13 bp, Homo sapiens
aactattgaattg

SEQ ID NO: 1982417 - DNA, 16 bp, Homo sapiens
aactatttctacacag

SEQ ID NO: 1982418 - DNA, 21 bp, Homo sapiens
aactattttaaagctgacttt

SEQ ID NO: 1982419 - DNA, 21 bp, Homo sapiens
aactcaccatgtaaaagagtc

SEQ ID NO: 1982420 - DNA, 15 bp, Homo sapiens
aactcagagcccctc

SEQ ID NO: 1982421 - DNA, 18 bp, Homo sapiens
aactcagttttaactaga

SEQ ID NO: 1982422 - DNA, 15 bp, Homo sapiens
aactcatcataaaat

SEQ ID NO: 1982423 - DNA, 23 bp, Homo sapiens
aactcatcctgtgtggggaggca

SEQ ID NO: 1982424 - DNA, 15 bp, Homo sapiens
aactcattagactgg

SEQ ID NO: 1982425 - DNA, 21 bp, Homo sapiens
aactcatttttgttttcatta

SEQ ID NO: 1982426 - DNA, 20 bp, Homo sapiens
aactgagccaaacacactgt

SEQ ID NO: 1982427 - DNA, 12 bp, Homo sapiens
aactgagcctag

SEQ ID NO: 1982428 - DNA, 16 bp, Homo sapiens
aactgaggaattttct

SEQ ID NO: 1982429 - DNA, 20 bp, Homo sapiens
aactgaggaattttctttgt

SEQ ID NO: 1982430 - DNA, 14 bp, Homo sapiens
aactgaggagtagc

SEQ ID NO: 1982431 - DNA, 19 bp, Homo sapiens
aactgaggagtagctgaga

SEQ ID NO: 1982432 - DNA, 22 bp, Homo sapiens
aactgagtaaattggaaacatt

SEQ ID NO: 1982433 - DNA, 15 bp, Homo sapiens
aactgatcaaaaata

SEQ ID NO: 1982434 - DNA, 18 bp, Homo sapiens
aactgatcaaaaataaac

SEQ ID NO: 1982435 - DNA, 22 bp, Homo sapiens
aactgatcaaaaataaactagt

SEQ ID NO: 1982436 - DNA, 20 bp, Homo sapiens
aactgatgcgaaaacttgaa

SEQ ID NO: 1982437 - DNA, 21 bp, Homo sapiens
aactgatgcgaaaacttgaat

SEQ ID NO: 1982438 - DNA, 15 bp, Homo sapiens
aactgatggaccggg

SEQ ID NO: 1982439 - DNA, 19 bp, Homo sapiens
aactgcacacacagctcct

SEQ ID NO: 1982440 - DNA, 19 bp, Homo sapiens
aactgcactgtcaagatga

SEQ ID NO: 1982441 - DNA, 13 bp, Homo sapiens
aactgccaagaaa

SEQ ID NO: 1982442 - DNA, 19 bp, Homo sapiens
aactgctaaatactgtaca

SEQ ID NO: 1982443 - DNA, 20 bp, Homo sapiens
aactgctaaatactgtacat

SEQ ID NO: 1982444 - DNA, 13 bp, Homo sapiens
aactgctccaagt

SEQ ID NO: 1982445 - DNA, 13 bp, Homo sapiens
aactgctctgccc

SEQ ID NO: 1982446 - DNA, 16 bp, Homo sapiens
aactgctgagccactc

SEQ ID NO: 1982447 - DNA, 18 bp, Homo sapiens
aactgctgatcaatgaaa

SEQ ID NO: 1982448 - DNA, 20 bp, Homo sapiens
aactggtccactcagggctg

SEQ ID NO: 1982449 - DNA, 22 bp, Homo sapiens
aactggttcaagagacactgct

SEQ ID NO: 1982450 - DNA, 19 bp, Homo sapiens
aactgtatcaaatctgtat

SEQ ID NO: 1982451 - DNA, 20 bp, Homo sapiens
aactgtatcaaatctgtata

SEQ ID NO: 1982452 - DNA, 14 bp, Homo sapiens
aactgtatgtgtct

SEQ ID NO: 1982453 - DNA, 18 bp, Homo sapiens
aactgtctaatgacacgg

SEQ ID NO: 1982454 - DNA, 19 bp, Homo sapiens
aactgtctctcatgaacct

SEQ ID NO: 1982455 - DNA, 18 bp, Homo sapiens
aactgtgtgaagaaatgg

SEQ ID NO: 1982456 - DNA, 21 bp, Homo sapiens
aactgttatcacttatatata

SEQ ID NO: 1982457 - DNA, 14 bp, Homo sapiens
aactgtttttgaag

SEQ ID NO: 1982458 - DNA, 15 bp, Homo sapiens
aactgtttttgaaga

SEQ ID NO: 1982459 - DNA, 11 bp, Homo sapiens
aacttaaaaga

SEQ ID NO: 1982460 - DNA, 16 bp, Homo sapiens
aacttaaatcactgag

SEQ ID NO: 1982461 - DNA, 14 bp, Homo sapiens
aacttaacatattt

SEQ ID NO: 1982462 - DNA, 13 bp, Homo sapiens
aacttaacatgaa

SEQ ID NO: 1982463 - DNA, 20 bp, Homo sapiens
aacttaatgttctgaataat

SEQ ID NO: 1982464 - DNA, 18 bp, Homo sapiens
aacttacacttggagccc

SEQ ID NO: 1982465 - DNA, 21 bp, Homo sapiens
aacttaccaggcaccaaaaga

SEQ ID NO: 1982466 - DNA, 15 bp, Homo sapiens
aacttagaataaaat

SEQ ID NO: 1982467 - DNA, 16 bp, Homo sapiens
aacttagaataaaatt

SEQ ID NO: 1982468 - DNA, 20 bp, Homo sapiens
aacttatatactatttccct

SEQ ID NO: 1982469 - DNA, 17 bp, Homo sapiens
aacttcaaatatagaga

SEQ ID NO: 1982470 - DNA, 13 bp, Homo sapiens
aacttcagagaag

SEQ ID NO: 1982471 - DNA, 21 bp, Homo sapiens
aacttcaggataataaagtgt

SEQ ID NO: 1982472 - DNA, 16 bp, Homo sapiens
aacttctaatatattt

SEQ ID NO: 1982473 - DNA, 24 bp, Homo sapiens
aacttctttgtaatcgttatgtgt

SEQ ID NO: 1982474 - DNA, 12 bp, Homo sapiens
aacttgaggaca

SEQ ID NO: 1982475 - DNA, 15 bp, Homo sapiens
aacttgaggacacat

SEQ ID NO: 1982476 - DNA, 16 bp, Homo sapiens
aacttgaggacacatg

SEQ ID NO: 1982477 - DNA, 19 bp, Homo sapiens
aacttgaggacacatgtcc

SEQ ID NO: 1982478 - DNA, 20 bp, Homo sapiens
aacttgaggacacatgtcca

SEQ ID NO: 1982479 - DNA, 12 bp, Homo sapiens
aacttgatatag

SEQ ID NO: 1982480 - DNA, 16 bp, Homo sapiens
aacttgctgaatttca

SEQ ID NO: 1982481 - DNA, 17 bp, Homo sapiens
aacttgcttctaaatgc

SEQ ID NO: 1982482 - DNA, 17 bp, Homo sapiens
aacttggaaaaagaaag

SEQ ID NO: 1982483 - DNA, 23 bp, Homo sapiens
aacttggaaaaatccagaaagaa

SEQ ID NO: 1982484 - DNA, 15 bp, Homo sapiens
aacttgtaaatacac

SEQ ID NO: 1982485 - DNA, 15 bp, Homo sapiens
aacttgtaaatgctg

SEQ ID NO: 1982486 - DNA, 15 bp, Homo sapiens
aacttgtactatgtt

SEQ ID NO: 1982487 - DNA, 15 bp, Homo sapiens
aacttgtatattcca

SEQ ID NO: 1982488 - DNA, 14 bp, Homo sapiens
aacttgtatctgaa

SEQ ID NO: 1982489 - DNA, 22 bp, Homo sapiens
aacttgtcagaatttctttgtc

SEQ ID NO: 1982490 - DNA, 20 bp, Homo sapiens
aacttgtgtactgataaaat

SEQ ID NO: 1982491 - DNA, 14 bp, Homo sapiens
aactttagaaataa

SEQ ID NO: 1982492 - DNA, 15 bp, Homo sapiens
aactttataaagata

SEQ ID NO: 1982493 - DNA, 11 bp, Homo sapiens
aactttctgta

SEQ ID NO: 1982494 - DNA, 16 bp, Homo sapiens
aactttgtgcctttga

SEQ ID NO: 1982495 - DNA, 18 bp, Homo sapiens
aacttttaaacatgagaa

SEQ ID NO: 1982496 - DNA, 18 bp, Homo sapiens
aacttttaatgccttcca

SEQ ID NO: 1982497 - DNA, 17 bp, Homo sapiens
aacttttagtaaagtca

SEQ ID NO: 1982498 - DNA, 23 bp, Homo sapiens
aacttttttatttaaaaaactaa

SEQ ID NO: 1982499 - DNA, 16 bp, Homo sapiens
aagaaaaaaaaaatat

SEQ ID NO: 1982500 - DNA, 11 bp, Homo sapiens
aagaaaagata

SEQ ID NO: 1982501 - DNA, 22 bp, Homo sapiens
aagaaaagtaggtttacattca

SEQ ID NO: 1982502 - DNA, 19 bp, Homo sapiens
aagaaaagtgaatgctcaa

SEQ ID NO: 1982503 - DNA, 14 bp, Homo sapiens
aagaaacactcaac

SEQ ID NO: 1982504 - DNA, 14 bp, Homo sapiens
aagaaacaggggat

SEQ ID NO: 1982505 - DNA, 18 bp, Homo sapiens
aagaaactcacgatgaaa

SEQ ID NO: 1982506 - DNA, 20 bp, Homo sapiens
aagaaactgaggaattttct

SEQ ID NO: 1982507 - DNA, 14 bp, Homo sapiens
aagaaagaaggaag

SEQ ID NO: 1982508 - DNA, 21 bp, Homo sapiens
aagaaagaatgcaagagtgga

SEQ ID NO: 1982509 - DNA, 23 bp, Homo sapiens
aagaaagaggtgaccccagggca

SEQ ID NO: 1982510 - DNA, 22 bp, Homo sapiens
aagaaagcttcaaactgcatga

SEQ ID NO: 1982511 - DNA, 21 bp, Homo sapiens
aagaaagttaggttataagaa

SEQ ID NO: 1982512 - DNA, 14 bp, Homo sapiens
aagaaatccctgtt

SEQ ID NO: 1982513 - DNA, 23 bp, Homo sapiens
aagaaatccctgtttaatattta

SEQ ID NO: 1982514 - DNA, 16 bp, Homo sapiens
aagaaattgcctcctt

SEQ ID NO: 1982515 - DNA, 15 bp, Homo sapiens
aagaaatttattact

SEQ ID NO: 1982516 - DNA, 18 bp, Homo sapiens
aagaaatttattacttgt

SEQ ID NO: 1982517 - DNA, 16 bp, Homo sapiens
aagaaatttgatttct

SEQ ID NO: 1982518 - DNA, 14 bp, Homo sapiens
aagaacaagaattt

SEQ ID NO: 1982519 - DNA, 16 bp, Homo sapiens
aagaactccttatttt

SEQ ID NO: 1982520 - DNA, 17 bp, Homo sapiens
aagaactccttattttg

SEQ ID NO: 1982521 - DNA, 20 bp, Homo sapiens
aagaactccttattttgtat

SEQ ID NO: 1982522 - DNA, 18 bp, Homo sapiens
aagaactctgcacagcaa

SEQ ID NO: 1982523 - DNA, 13 bp, Homo sapiens
aagaactgcccca

SEQ ID NO: 1982524 - DNA, 14 bp, Homo sapiens
aagaagacatgaca

SEQ ID NO: 1982525 - DNA, 16 bp, Homo sapiens
aagaagctcccagatg

SEQ ID NO: 1982526 - DNA, 19 bp, Homo sapiens
aagaagctcccagatgctg

SEQ ID NO: 1982527 - DNA, 13 bp, Homo sapiens
aagaagctgagga

SEQ ID NO: 1982528 - DNA, 21 bp, Homo sapiens
aagaagctttaatatttaaat

SEQ ID NO: 1982529 - DNA, 17 bp, Homo sapiens
aagaaggaaaaggcagg

SEQ ID NO: 1982530 - DNA, 16 bp, Homo sapiens
aagaaggacacttgta

SEQ ID NO: 1982531 - DNA, 19 bp, Homo sapiens
aagaagggaaattcacact

SEQ ID NO: 1982532 - DNA, 21 bp, Homo sapiens
aagaagggaaattcacactgt

SEQ ID NO: 1982533 - DNA, 14 bp, Homo sapiens
aagaagtaaaagca

SEQ ID NO: 1982534 - DNA, 22 bp, Homo sapiens
aagaagtaaaagcaaaaaagaa

SEQ ID NO: 1982535 - DNA, 20 bp, Homo sapiens
aagaagtttctggagcaaga

SEQ ID NO: 1982536 - DNA, 16 bp, Homo sapiens
aagaatacagaaaatg

SEQ ID NO: 1982537 - DNA, 14 bp, Homo sapiens
aagaatacagaaag

SEQ ID NO: 1982538 - DNA, 18 bp, Homo sapiens
aagaataggtcattttct

SEQ ID NO: 1982539 - DNA, 13 bp, Homo sapiens
aagaatatgttca

SEQ ID NO: 1982540 - DNA, 16 bp, Homo sapiens
aagaatattcagagaa

SEQ ID NO: 1982541 - DNA, 16 bp, Homo sapiens
aagcccaggctggaga

SEQ ID NO: 1982542 - DNA, 14 bp, Homo sapiens
aagcccagtttccc

SEQ ID NO: 1982543 - DNA, 14 bp, Homo sapiens
aagcccatgctttc

SEQ ID NO: 1982544 - DNA, 20 bp, Homo sapiens
aagcccctcagcccttgccc

SEQ ID NO: 1982545 - DNA, 21 bp, Homo sapiens
aagccccttgctctcccctgc

SEQ ID NO: 1982546 - DNA, 19 bp, Homo sapiens
aagcccgtgtcctgccttg

SEQ ID NO: 1982547 - DNA, 14 bp, Homo sapiens
aagccctccttcca

SEQ ID NO: 1982548 - DNA, 12 bp, Homo sapiens
aagccctgaggg

SEQ ID NO: 1982549 - DNA, 19 bp, Homo sapiens
aagccctgtcgagacactt

SEQ ID NO: 1982550 - DNA, 20 bp, Homo sapiens
aagccctgtcgagacacttg

SEQ ID NO: 1982551 - DNA, 15 bp, Homo sapiens
aagcccttccatgtc

SEQ ID NO: 1982552 - DNA, 20 bp, Homo sapiens
aagcccttccatgtcgcctc

SEQ ID NO: 1982553 - DNA, 23 bp, Homo sapiens
aagcccttccatgtcgcctctgc

SEQ ID NO: 1982554 - DNA, 23 bp, Homo sapiens
aagataatgttctttaatgttgt

SEQ ID NO: 1982555 - DNA, 14 bp, Homo sapiens
aagatacactcctg

SEQ ID NO: 1982556 - DNA, 15 bp, Homo sapiens
aagatacactcctgc

SEQ ID NO: 1982557 - DNA, 19 bp, Homo sapiens
aagatacactcctgctgtg

SEQ ID NO: 1982558 - DNA, 17 bp, Homo sapiens
aagatacttaagtgctg

SEQ ID NO: 1982559 - DNA, 21 bp, Homo sapiens
aagatatatacacaggatcct

SEQ ID NO: 1982560 - DNA, 18 bp, Homo sapiens
aagatatttatatatatt

SEQ ID NO: 1982561 - DNA, 14 bp, Homo sapiens
aagatcgttagtat

SEQ ID NO: 1982562 - DNA, 13 bp, Homo sapiens
aagatgaagagaa

SEQ ID NO: 1982563 - DNA, 14 bp, Homo sapiens
aagatgaagagaag

SEQ ID NO: 1982564 - DNA, 18 bp, Homo sapiens
aagatgagatttgccagc

SEQ ID NO: 1982565 - DNA, 19 bp, Homo sapiens
aagatgagatttgccagca

SEQ ID NO: 1982566 - DNA, 16 bp, Homo sapiens
aagatgagctctgaac

SEQ ID NO: 1982567 - DNA, 21 bp, Homo sapiens
aagatgagctctgaacaaaca

SEQ ID NO: 1982568 - DNA, 22 bp, Homo sapiens
aagatgagctctgaacaaacac

SEQ ID NO: 1982569 - DNA, 17 bp, Homo sapiens
aagatgatctactcaga

SEQ ID NO: 1982570 - DNA, 21 bp, Homo sapiens
aagatgccctccaatcctttc

SEQ ID NO: 1982571 - DNA, 16 bp, Homo sapiens
aagatggctgtgcctc

SEQ ID NO: 1982572 - DNA, 17 bp, Homo sapiens
aaggactaacataaaat

SEQ ID NO: 1982573 - DNA, 21 bp, Homo sapiens
aaggactaacataaaatctgt

SEQ ID NO: 1982574 - DNA, 21 bp, Homo sapiens
aaggactacgttaagggaagg

SEQ ID NO: 1982575 - DNA, 13 bp, Homo sapiens
aaggacttctgca

SEQ ID NO: 1982576 - DNA, 23 bp, Homo sapiens
aaggagaagactgggctagggag

SEQ ID NO: 1982577 - DNA, 15 bp, Homo sapiens
aaggagaaggaagga

SEQ ID NO: 1982578 - DNA, 17 bp, Homo sapiens
aaggagactcacctctg

SEQ ID NO: 1982579 - DNA, 15 bp, Homo sapiens
aaggagatataaaat

SEQ ID NO: 1982580 - DNA, 16 bp, Homo sapiens
aaggagatataaaatc

SEQ ID NO: 1982581 - DNA, 23 bp, Homo sapiens
aaggagcagagctgatggagaag

SEQ ID NO: 1982582 - DNA, 23 bp, Homo sapiens
aaggtggtctgcttttgctgggg

SEQ ID NO: 1982583 - DNA, 21 bp, Homo sapiens
aaggtgtttccatttctcaat

SEQ ID NO: 1982584 - DNA, 19 bp, Homo sapiens
aaggttactcagcagcaga

SEQ ID NO: 1982585 - DNA, 21 bp, Homo sapiens
aaggttactcagcagcagaga

SEQ ID NO: 1982586 - DNA, 18 bp, Homo sapiens
aaggttaggatttaacag

SEQ ID NO: 1982587 - DNA, 21 bp, Homo sapiens
aaggttgactcaagtttttac

SEQ ID NO: 1982588 - DNA, 13 bp, Homo sapiens
aaggttgtattgc

SEQ ID NO: 1982589 - DNA, 17 bp, Homo sapiens
aaggttgtattgcatat

SEQ ID NO: 1982590 - DNA, 16 bp, Homo sapiens
aaggtttctgaaaatt

SEQ ID NO: 1982591 - DNA, 17 bp, Homo sapiens
aagtaaaaccacagcag

SEQ ID NO: 1982592 - DNA, 13 bp, Homo sapiens
aagtaaaagcaaa

SEQ ID NO: 1982593 - DNA, 21 bp, Homo sapiens
aagtaaaagcaaaaaagaaaa

SEQ ID NO: 1982594 - DNA, 15 bp, Homo sapiens
aagtaaaagctaatt

SEQ ID NO: 1982595 - DNA, 18 bp, Homo sapiens
aagtaaagtttatttcat

SEQ ID NO: 1982596 - DNA, 18 bp, Homo sapiens
aagtaaattacattaaaa

SEQ ID NO: 1982597 - DNA, 20 bp, Homo sapiens
aagtaagtaccactcaggcc

SEQ ID NO: 1982598 - DNA, 21 bp, Homo sapiens
aagtaagtaccactcaggcca

SEQ ID NO: 1982599 - DNA, 13 bp, Homo sapiens
aagtaatataatg

SEQ ID NO: 1982600 - DNA, 16 bp, Homo sapiens
aagtaatataatggaa

SEQ ID NO: 1982601 - DNA, 13 bp, Homo sapiens
aagtaattatcgg

SEQ ID NO: 1982602 - DNA, 14 bp, Homo sapiens
aagtaattcctctc

SEQ ID NO: 1982603 - DNA, 12 bp, Homo sapiens
aagtacatttaa

SEQ ID NO: 1982604 - DNA, 16 bp, Homo sapiens
aagtacgtttttgcat

SEQ ID NO: 1982605 - DNA, 17 bp, Homo sapiens
aagtactgctgtaaata

SEQ ID NO: 1982606 - DNA, 20 bp, Homo sapiens
aagtactgctgtaaataaat

SEQ ID NO: 1982607 - DNA, 23 bp, Homo sapiens
aagtactgctgtaaataaatgct

SEQ ID NO: 1982608 - DNA, 19 bp, Homo sapiens
aagtacttctccaccctgc

SEQ ID NO: 1982609 - DNA, 22 bp, Homo sapiens
aagtacttctccaccctgctct

SEQ ID NO: 1982610 - DNA, 16 bp, Homo sapiens
aagtagaagaggagga

SEQ ID NO: 1982611 - DNA, 13 bp, Homo sapiens
aagtagagaagta

SEQ ID NO: 1982612 - DNA, 21 bp, Homo sapiens
aagtagcaaccttcattttac

SEQ ID NO: 1982613 - DNA, 18 bp, Homo sapiens
aagtaggggcagtgatgg

SEQ ID NO: 1982614 - DNA, 22 bp, Homo sapiens
aagtatatagtatatttatact

SEQ ID NO: 1982615 - DNA, 11 bp, Homo sapiens
aagtatatata

SEQ ID NO: 1982616 - DNA, 14 bp, Homo sapiens
aagtatatattcta

SEQ ID NO: 1982617 - DNA, 13 bp, Homo sapiens
aagtatatattta

SEQ ID NO: 1982618 - DNA, 14 bp, Homo sapiens
aagtatcatgcatt

SEQ ID NO: 1982619 - DNA, 15 bp, Homo sapiens
aagtatcatgcattc

SEQ ID NO: 1982620 - DNA, 21 bp, Homo sapiens
aagtatgagggaaaatgagta

SEQ ID NO: 1982621 - DNA, 13 bp, Homo sapiens
aagtattcttcat

SEQ ID NO: 1982622 - DNA, 21 bp, Homo sapiens
aagtattgctgagtccaacaa

SEQ ID NO: 1982623 - DNA, 10 bp, Homo sapiens
aagtatttag

SEQ ID NO: 1982624 - DNA, 14 bp, Homo sapiens
aagtatttatatat

SEQ ID NO: 1982625 - DNA, 15 bp, Homo sapiens
aagtatttatatatt

SEQ ID NO: 1982626 - DNA, 16 bp, Homo sapiens
aagtatttatatattt

SEQ ID NO: 1982627 - DNA, 18 bp, Homo sapiens
aagtatttatatatttat

SEQ ID NO: 1982628 - DNA, 20 bp, Homo sapiens
aagtatttatatatttataa

SEQ ID NO: 1982629 - DNA, 18 bp, Homo sapiens
aagtatttttttaagtta

SEQ ID NO: 1982630 - DNA, 19 bp, Homo sapiens
aagtcaaaaggtgcctgtg

SEQ ID NO: 1982631 - DNA, 14 bp, Homo sapiens
aagtcaaagtaaaa

SEQ ID NO: 1982632 - DNA, 16 bp, Homo sapiens
aagtcaaccaatgtag

SEQ ID NO: 1982633 - DNA, 12 bp, Homo sapiens
aagtcacacaga

SEQ ID NO: 1982634 - DNA, 24 bp, Homo sapiens
aagtcacacagtattacttctgct

SEQ ID NO: 1982635 - DNA, 12 bp, Homo sapiens
aagtcacagctg

SEQ ID NO: 1982636 - DNA, 14 bp, Homo sapiens
aagtcacagctgca

SEQ ID NO: 1982637 - DNA, 22 bp, Homo sapiens
aagtcacagctgcagctgggcc

SEQ ID NO: 1982638 - DNA, 16 bp, Homo sapiens
aagtcacatcacagga

SEQ ID NO: 1982639 - DNA, 13 bp, Homo sapiens
aagtcaccaaaat

SEQ ID NO: 1982640 - DNA, 16 bp, Homo sapiens
aagtcacttccagtgt

SEQ ID NO: 1982641 - DNA, 20 bp, Homo sapiens
aagtcagactgctgggactg

SEQ ID NO: 1982642 - DNA, 16 bp, Homo sapiens
aagtcaggacctggct

SEQ ID NO: 1982643 - DNA, 17 bp, Homo sapiens
aagtcaggacctggctt

SEQ ID NO: 1982644 - DNA, 14 bp, Homo sapiens
aagtcatggcccaa

SEQ ID NO: 1982645 - DNA, 16 bp, Homo sapiens
aagtcattttaacttt

SEQ ID NO: 1982646 - DNA, 20 bp, Homo sapiens
aagtcattttaactttatca

SEQ ID NO: 1982647 - DNA, 17 bp, Homo sapiens
aagtccacctgcctatc

SEQ ID NO: 1982648 - DNA, 15 bp, Homo sapiens
aagtccaggtcctgg

SEQ ID NO: 1982649 - DNA, 13 bp, Homo sapiens
aagtccctgttct

SEQ ID NO: 1982650 - DNA, 17 bp, Homo sapiens
aagtccctgttctcagc

SEQ ID NO: 1982651 - DNA, 18 bp, Homo sapiens
aagtcctcttttctgaga

SEQ ID NO: 1982652 - DNA, 18 bp, Homo sapiens
aagtcgacatactcattt

SEQ ID NO: 1982653 - DNA, 21 bp, Homo sapiens
aagtctaaagtttacagtaaa

SEQ ID NO: 1982654 - DNA, 15 bp, Homo sapiens
aagtctagaaaccag

SEQ ID NO: 1982655 - DNA, 19 bp, Homo sapiens
aagtctaggagctgggagg

SEQ ID NO: 1982656 - DNA, 22 bp, Homo sapiens
aagtctaggagctgggaggaaa

SEQ ID NO: 1982657 - DNA, 13 bp, Homo sapiens
aagtctctgctgc

SEQ ID NO: 1982658 - DNA, 14 bp, Homo sapiens
aagtctgtgtccaa

SEQ ID NO: 1982659 - DNA, 23 bp, Homo sapiens
aagtcttaaaataacttatatca

SEQ ID NO: 1982660 - DNA, 17 bp, Homo sapiens
aagtcttacttaaaaaa

SEQ ID NO: 1982661 - DNA, 22 bp, Homo sapiens
aagtcttccctgatcaagtcac

SEQ ID NO: 1982662 - DNA, 19 bp, Homo sapiens
aagtgaagccccttgtcct

SEQ ID NO: 1982663 - DNA, 12 bp, Homo sapiens
aagtgaataaac

SEQ ID NO: 1982664 - DNA, 13 bp, Homo sapiens
aagtgaataaact

SEQ ID NO: 1982665 - DNA, 17 bp, Homo sapiens
aagtgaataaacttcag

SEQ ID NO: 1982666 - DNA, 18 bp, Homo sapiens
aagtgaataaacttcagc

SEQ ID NO: 1982667 - DNA, 16 bp, Homo sapiens
aagtgaatttgcctgt

SEQ ID NO: 1982668 - DNA, 20 bp, Homo sapiens
aagtgacctatacctgtgtt

SEQ ID NO: 1982669 - DNA, 20 bp, Homo sapiens
aagtgactaccagaaagtga

SEQ ID NO: 1982670 - DNA, 21 bp, Homo sapiens
aagtgaggaagcctaaataaa

SEQ ID NO: 1982671 - DNA, 18 bp, Homo sapiens
aagtgagggctgggcagc

SEQ ID NO: 1982672 - DNA, 15 bp, Homo sapiens
aagtgatatatgtat

SEQ ID NO: 1982673 - DNA, 16 bp, Homo sapiens
aagtgatatatgtatt

SEQ ID NO: 1982674 - DNA, 17 bp, Homo sapiens
aagtgatatatgtattt

SEQ ID NO: 1982675 - DNA, 18 bp, Homo sapiens
aagtgatatatgtattta

SEQ ID NO: 1982676 - DNA, 22 bp, Homo sapiens
aagtgatatcacctctcttcag

SEQ ID NO: 1982677 - DNA, 20 bp, Homo sapiens
aagtgatcctcccacctcag

SEQ ID NO: 1982678 - DNA, 20 bp, Homo sapiens
aagtgatctgtcccctctcc

SEQ ID NO: 1982679 - DNA, 21 bp, Homo sapiens
aagtgatctgtcccctctccc

SEQ ID NO: 1982680 - DNA, 14 bp, Homo sapiens
aagtgattgaaaat

SEQ ID NO: 1982681 - DNA, 21 bp, Homo sapiens
aagtgcaaatactccaagctt

SEQ ID NO: 1982682 - DNA, 17 bp, Homo sapiens
aagtgcagcccttcctc

SEQ ID NO: 1982683 - DNA, 17 bp, Homo sapiens
aagtgccatcccacatt

SEQ ID NO: 1982684 - DNA, 22 bp, Homo sapiens
aagtgccatcccacattcggac

SEQ ID NO: 1982685 - DNA, 18 bp, Homo sapiens
aagtgccatttcctgtct

SEQ ID NO: 1982686 - DNA, 16 bp, Homo sapiens
aagtgcccgccctgcc

SEQ ID NO: 1982687 - DNA, 17 bp, Homo sapiens
aagtgcctcttgttgca

SEQ ID NO: 1982688 - DNA, 12 bp, Homo sapiens
aagtgctcccca

SEQ ID NO: 1982689 - DNA, 16 bp, Homo sapiens
aagtgctccccacacg

SEQ ID NO: 1982690 - DNA, 17 bp, Homo sapiens
aagtgctccccacacgt

SEQ ID NO: 1982691 - DNA, 16 bp, Homo sapiens
taatgtgtgtatgtgt

SEQ ID NO: 1982692 - DNA, 17 bp, Homo sapiens
taatgtgtgtatgtgta

SEQ ID NO: 1982693 - DNA, 18 bp, Homo sapiens
taatgtgtgtatgtgtat

SEQ ID NO: 1982694 - DNA, 16 bp, Homo sapiens
taatgttctttaatgt

SEQ ID NO: 1982695 - DNA, 13 bp, Homo sapiens
taatgttgtccag

SEQ ID NO: 1982696 - DNA, 17 bp, Homo sapiens
taatgtttgatttagta

SEQ ID NO: 1982697 - DNA, 12 bp, Homo sapiens
taatgttttctg

SEQ ID NO: 1982698 - DNA, 17 bp, Homo sapiens
taatgttttgtacaatt

SEQ ID NO: 1982699 - DNA, 15 bp, Homo sapiens
taattaaaaagttaa

SEQ ID NO: 1982700 - DNA, 18 bp, Homo sapiens
taattaaaaagttaatct

SEQ ID NO: 1982701 - DNA, 20 bp, Homo sapiens
taattaaaagaatattttaa

SEQ ID NO: 1982702 - DNA, 15 bp, Homo sapiens
taattaataaacgaa

SEQ ID NO: 1982703 - DNA, 23 bp, Homo sapiens
taattaatgtgtgtctgaagact

SEQ ID NO: 1982704 - DNA, 15 bp, Homo sapiens
taattacatccagaa

SEQ ID NO: 1982705 - DNA, 16 bp, Homo sapiens
taattaggatctatgc

SEQ ID NO: 1982706 - DNA, 20 bp, Homo sapiens
taattaggatctatgcaatt

SEQ ID NO: 1982707 - DNA, 22 bp, Homo sapiens
taattaggatctatgcaatttt

SEQ ID NO: 1982708 - DNA, 19 bp, Homo sapiens
taattatcgggaacagtgt

SEQ ID NO: 1982709 - DNA, 12 bp, Homo sapiens
taattatctgat

SEQ ID NO: 1982710 - DNA, 15 bp, Homo sapiens
taattattccactca

SEQ ID NO: 1982711 - DNA, 22 bp, Homo sapiens
taattcaaagctctattaagat

SEQ ID NO: 1982712 - DNA, 19 bp, Homo sapiens
taattcaattcaaagctgt

SEQ ID NO: 1982713 - DNA, 21 bp, Homo sapiens
taattcataattagaacaata

SEQ ID NO: 1982714 - DNA, 13 bp, Homo sapiens
taattccaagatt

SEQ ID NO: 1982715 - DNA, 23 bp, Homo sapiens
taattccaagattaaaagttcat

SEQ ID NO: 1982716 - DNA, 20 bp, Homo sapiens
taattccaatatgatgactc

SEQ ID NO: 1982717 - DNA, 17 bp, Homo sapiens
taattcccattttgcaa

SEQ ID NO: 1982718 - DNA, 18 bp, Homo sapiens
taattctaaatgaatgtt

SEQ ID NO: 1982719 - DNA, 12 bp, Homo sapiens
taattctactaa

SEQ ID NO: 1982720 - DNA, 23 bp, Homo sapiens
taattctccctaaggaatctgaa

SEQ ID NO: 1982721 - DNA, 19 bp, Homo sapiens
taattcttaataggcttta

SEQ ID NO: 1982722 - DNA, 14 bp, Homo sapiens
taattcttatttct

SEQ ID NO: 1982723 - DNA, 15 bp, Homo sapiens
taattgaaatttaaa

SEQ ID NO: 1982724 - DNA, 22 bp, Homo sapiens
taattgaatggaagcaaaatta

SEQ ID NO: 1982725 - DNA, 18 bp, Homo sapiens
taattgatcaaattcatt

SEQ ID NO: 1982726 - DNA, 14 bp, Homo sapiens
taattgatttcaag

SEQ ID NO: 1982727 - DNA, 20 bp, Homo sapiens
taattggaagaaattcctgt

SEQ ID NO: 1982728 - DNA, 17 bp, Homo sapiens
taattggtgacaatgtc

SEQ ID NO: 1982729 - DNA, 15 bp, Homo sapiens
taattgtagatggaa

SEQ ID NO: 1982730 - DNA, 18 bp, Homo sapiens
taattgtccctgtttcaa

SEQ ID NO: 1982731 - DNA, 12 bp, Homo sapiens
taatttaaacca

SEQ ID NO: 1982732 - DNA, 21 bp, Homo sapiens
taatttaaaccagcagaaaag

SEQ ID NO: 1982733 - DNA, 12 bp, Homo sapiens
taatttaaagcc

SEQ ID NO: 1982734 - DNA, 14 bp, Homo sapiens
taatttaactaatt

SEQ ID NO: 1982735 - DNA, 21 bp, Homo sapiens
taatttaatgcatgttaggaa

SEQ ID NO: 1982736 - DNA, 15 bp, Homo sapiens
taatttagaaaactt

SEQ ID NO: 1982737 - DNA, 21 bp, Homo sapiens
taatttagaaaactttaaagc

SEQ ID NO: 1982738 - DNA, 21 bp, Homo sapiens
taatttagacttcaagcatgg

SEQ ID NO: 1982739 - DNA, 16 bp, Homo sapiens
taatttagtttcatat

SEQ ID NO: 1982740 - DNA, 21 bp, Homo sapiens
taatttataaaagaataaaat

SEQ ID NO: 1982741 - DNA, 18 bp, Homo sapiens
taatttatatttgaaatt

SEQ ID NO: 1982742 - DNA, 20 bp, Homo sapiens
taatttatgagtttttgata

SEQ ID NO: 1982743 - DNA, 15 bp, Homo sapiens
taatttatttcatcc

SEQ ID NO: 1982744 - DNA, 17 bp, Homo sapiens
taatttctgtgtatttt

SEQ ID NO: 1982745 - DNA, 19 bp, Homo sapiens
taatttcttactaaacatt

SEQ ID NO: 1982746 - DNA, 17 bp, Homo sapiens
taatttgagaattattc

SEQ ID NO: 1982747 - DNA, 22 bp, Homo sapiens
taatttgaggacaaccattcca

SEQ ID NO: 1982748 - DNA, 14 bp, Homo sapiens
taatttgatgttta

SEQ ID NO: 1982749 - DNA, 12 bp, Homo sapiens
taattttaagtt

SEQ ID NO: 1982750 - DNA, 12 bp, Homo sapiens
taattttattat

SEQ ID NO: 1982751 - DNA, 14 bp, Homo sapiens
taattttgcagcag

SEQ ID NO: 1982752 - DNA, 14 bp, Homo sapiens
taattttgtttgta

SEQ ID NO: 1982753 - DNA, 16 bp, Homo sapiens
taattttgtttgtaat

SEQ ID NO: 1982754 - DNA, 14 bp, Homo sapiens
taatttttacatga

SEQ ID NO: 1982755 - DNA, 22 bp, Homo sapiens
taatttttacatgaccagaaaa

SEQ ID NO: 1982756 - DNA, 20 bp, Homo sapiens
taatttttgatactaagcat

SEQ ID NO: 1982757 - DNA, 22 bp, Homo sapiens
tacagtagcttaaataaattca

SEQ ID NO: 1982758 - DNA, 13 bp, Homo sapiens
tacagtgaggagg

SEQ ID NO: 1982759 - DNA, 21 bp, Homo sapiens
tacataaaggtggtatgtgtg

SEQ ID NO: 1982760 - DNA, 13 bp, Homo sapiens
tacataacaagaa

SEQ ID NO: 1982761 - DNA, 14 bp, Homo sapiens
tacatacacttgta

SEQ ID NO: 1982762 - DNA, 21 bp, Homo sapiens
tacatacacttgtataaatgt

SEQ ID NO: 1982763 - DNA, 9 bp, Homo sapiens
tacatacat

SEQ ID NO: 1982764 - DNA, 18 bp, Homo sapiens
tacatacatacatacata

SEQ ID NO: 1982765 - DNA, 16 bp, Homo sapiens
tacatacatatatatc

SEQ ID NO: 1982766 - DNA, 14 bp, Homo sapiens
tacatacctctctc

SEQ ID NO: 1982767 - DNA, 13 bp, Homo sapiens
tacatagatggac

SEQ ID NO: 1982768 - DNA, 18 bp, Homo sapiens
tacatagatgtatcatta

SEQ ID NO: 1982769 - DNA, 20 bp, Homo sapiens
tacatagatgtatcattaat

SEQ ID NO: 1982770 - DNA, 16 bp, Homo sapiens
tacatatatatataca

SEQ ID NO: 1982771 - DNA, 19 bp, Homo sapiens
tacatatatatatacacat

SEQ ID NO: 1982772 - DNA, 17 bp, Homo sapiens
tacatatcagaaaagta

SEQ ID NO: 1982773 - DNA, 22 bp, Homo sapiens
tacatatcagaaaagtagaatt

SEQ ID NO: 1982774 - DNA, 14 bp, Homo sapiens
tacatatggaaatc

SEQ ID NO: 1982775 - DNA, 20 bp, Homo sapiens
tacatatgtaaaataaaatt

SEQ ID NO: 1982776 - DNA, 15 bp, Homo sapiens
tacatatgtagacta

SEQ ID NO: 1982777 - DNA, 17 bp, Homo sapiens
tacatatgtagactata

SEQ ID NO: 1982778 - DNA, 20 bp, Homo sapiens
tacatatgtagactatatac

SEQ ID NO: 1982779 - DNA, 21 bp, Homo sapiens
tacatatgtagactatataca

SEQ ID NO: 1982780 - DNA, 23 bp, Homo sapiens
tacatatgtagactatatacatg

SEQ ID NO: 1982781 - DNA, 13 bp, Homo sapiens
tacatattataaa

SEQ ID NO: 1982782 - DNA, 17 bp, Homo sapiens
tacatattataaataaa

SEQ ID NO: 1982783 - DNA, 22 bp, Homo sapiens
tacatattataaataaatgcca

SEQ ID NO: 1982784 - DNA, 15 bp, Homo sapiens
tacatcatcctcctt

SEQ ID NO: 1982785 - DNA, 16 bp, Homo sapiens
tacatcatcctcctta

SEQ ID NO: 1982786 - DNA, 14 bp, Homo sapiens
tacatccagaaaga

SEQ ID NO: 1982787 - DNA, 22 bp, Homo sapiens
tacatcctgctttccctcccca

SEQ ID NO: 1982788 - DNA, 23 bp, Homo sapiens
tacatctgcagctctttcttctt

SEQ ID NO: 1982789 - DNA, 21 bp, Homo sapiens
tacatcttcagctcccatagc

SEQ ID NO: 1982790 - DNA, 20 bp, Homo sapiens
tacatcttttcaacaagtaa

SEQ ID NO: 1982791 - DNA, 14 bp, Homo sapiens
tacatgaaacagaa

SEQ ID NO: 1982792 - DNA, 23 bp, Homo sapiens
tacatgaacacagctgctgaaga

SEQ ID NO: 1982793 - DNA, 19 bp, Homo sapiens
tacatgactcagcatacct

SEQ ID NO: 1982794 - DNA, 19 bp, Homo sapiens
tacatgcaatttattaaaa

SEQ ID NO: 1982795 - DNA, 22 bp, Homo sapiens
tacatgcaatttattaaaatga

SEQ ID NO: 1982796 - DNA, 20 bp, Homo sapiens
tacatgcattactgcatgca

SEQ ID NO: 1982797 - DNA, 19 bp, Homo sapiens
tacatgctaagagaagtag

SEQ ID NO: 1982798 - DNA, 20 bp, Homo sapiens
tacatggtattgtaatgaat

SEQ ID NO: 1982799 - DNA, 23 bp, Homo sapiens
tacatgtatagtgagtgtggctt

SEQ ID NO: 1982800 - DNA, 14 bp, Homo sapiens
tacatgtggtttat

SEQ ID NO: 1982801 - DNA, 19 bp, Homo sapiens
tacatgtgtagggaaagtt

SEQ ID NO: 1982802 - DNA, 19 bp, Homo sapiens
tacatgtgtggatgtgtaa

SEQ ID NO: 1982803 - DNA, 20 bp, Homo sapiens
tacatgtttaaattgtaaat

SEQ ID NO: 1982804 - DNA, 22 bp, Homo sapiens
tacatgtttgcacctttctagt

SEQ ID NO: 1982805 - DNA, 23 bp, Homo sapiens
tacattaatgttaattcagcact

SEQ ID NO: 1982806 - DNA, 19 bp, Homo sapiens
tacattagcagtttgcttt

SEQ ID NO: 1982807 - DNA, 12 bp, Homo sapiens
tacattccctat

SEQ ID NO: 1982808 - DNA, 16 bp, Homo sapiens
tacattccctatcaaa

SEQ ID NO: 1982809 - DNA, 10 bp, Homo sapiens
tacattcctc

SEQ ID NO: 1982810 - DNA, 16 bp, Homo sapiens
tacattcctcagctgc

SEQ ID NO: 1982811 - DNA, 17 bp, Homo sapiens
tacattcctcagctgcc

SEQ ID NO: 1982812 - DNA, 23 bp, Homo sapiens
tacattcctcagctgccaagcac

SEQ ID NO: 1982813 - DNA, 23 bp, Homo sapiens
tacattctcatctactcattgtc

SEQ ID NO: 1982814 - DNA, 19 bp, Homo sapiens
tacatttataatgtttgct

SEQ ID NO: 1982815 - DNA, 14 bp, Homo sapiens
tacatttatacatc

SEQ ID NO: 1982816 - DNA, 16 bp, Homo sapiens
tacatttctgaaatga

SEQ ID NO: 1982817 - DNA, 18 bp, Homo sapiens
tacattttatttattagc

SEQ ID NO: 1982818 - DNA, 22 bp, Homo sapiens
tacattttatttattagctgta

SEQ ID NO: 1982819 - DNA, 12 bp, Homo sapiens
tacattttgtta

SEQ ID NO: 1982820 - DNA, 15 bp, Homo sapiens
tacatttttacaata

SEQ ID NO: 1982821 - DNA, 23 bp, Homo sapiens
taccaaatataaacttgtgtatg

SEQ ID NO: 1982822 - DNA, 15 bp, Homo sapiens
taccaaatattttag

SEQ ID NO: 1982823 - DNA, 18 bp, Homo sapiens
taccaaatccacaagcca

SEQ ID NO: 1982824 - DNA, 13 bp, Homo sapiens
taccaactttctg

SEQ ID NO: 1982825 - DNA, 14 bp, Homo sapiens
taccaactttctgt

SEQ ID NO: 1982826 - DNA, 17 bp, Homo sapiens
taccaactttctgtaaa

SEQ ID NO: 1982827 - DNA, 16 bp, Homo sapiens
taccaaggcccagcta

SEQ ID NO: 1982828 - DNA, 13 bp, Homo sapiens
taccaagtgtgtt

SEQ ID NO: 1982829 - DNA, 19 bp, Homo sapiens
taccaatcattttaattat

SEQ ID NO: 1982830 - DNA, 21 bp, Homo sapiens
taccaatgccaagataattca

SEQ ID NO: 1982831 - DNA, 19 bp, Homo sapiens
taccaatgcttttatcaaa

SEQ ID NO: 1982832 - DNA, 12 bp, Homo sapiens
taccacagcagc

SEQ ID NO: 1982833 - DNA, 13 bp, Homo sapiens
taccacagtgtct

SEQ ID NO: 1982834 - DNA, 15 bp, Homo sapiens
taccaccccttcctg

SEQ ID NO: 1982835 - DNA, 17 bp, Homo sapiens
taccaccccttcctgtc

SEQ ID NO: 1982836 - DNA, 13 bp, Homo sapiens
taccaccttccct

SEQ ID NO: 1982837 - DNA, 19 bp, Homo sapiens
taccaccttccctctttct

SEQ ID NO: 1982838 - DNA, 14 bp, Homo sapiens
taccactcaggcca

SEQ ID NO: 1982839 - DNA, 14 bp, Homo sapiens
taccagatatttga

SEQ ID NO: 1982840 - DNA, 11 bp, Homo sapiens
taccagccagg

SEQ ID NO: 1982841 - DNA, 12 bp, Homo sapiens
taccagccagga

SEQ ID NO: 1982842 - DNA, 21 bp, Homo sapiens
taccagctaactccagtctcc

SEQ ID NO: 1982843 - DNA, 18 bp, Homo sapiens
taccagtgaaccaaagag

SEQ ID NO: 1982844 - DNA, 11 bp, Homo sapiens
taccagtgtga

SEQ ID NO: 1982845 - DNA, 16 bp, Homo sapiens
taccatactcatttct

SEQ ID NO: 1982846 - DNA, 14 bp, Homo sapiens
taccatagaacaga

SEQ ID NO: 1982847 - DNA, 19 bp, Homo sapiens
taccatatgtctgcttctg

SEQ ID NO: 1982848 - DNA, 20 bp, Homo sapiens
taccatatgtctgcttctgt

SEQ ID NO: 1982849 - DNA, 15 bp, Homo sapiens
taccatcaataaagt

SEQ ID NO: 1982850 - DNA, 16 bp, Homo sapiens
taccatcaataaagta

SEQ ID NO: 1982851 - DNA, 23 bp, Homo sapiens
taccatctgtcttgccagccaga

SEQ ID NO: 1982852 - DNA, 16 bp, Homo sapiens
taccatgccatttaaa

SEQ ID NO: 1982853 - DNA, 13 bp, Homo sapiens
taccatgctgctt

SEQ ID NO: 1982854 - DNA, 18 bp, Homo sapiens
taccattacttgtataaa

SEQ ID NO: 1982855 - DNA, 23 bp, Homo sapiens
taccattttggggtacccactgc

SEQ ID NO: 1982856 - DNA, 14 bp, Homo sapiens
tacccactcctcac

SEQ ID NO: 1982857 - DNA, 22 bp, Homo sapiens
tacccactctttgctacaataa

SEQ ID NO: 1982858 - DNA, 15 bp, Homo sapiens
tacccactgctctgg

SEQ ID NO: 1982859 - DNA, 16 bp, Homo sapiens
tacccagagccttctc

SEQ ID NO: 1982860 - DNA, 23 bp, Homo sapiens
tacccagagccttctcctgccta

SEQ ID NO: 1982861 - DNA, 18 bp, Homo sapiens
tacccagcgagccctggt

SEQ ID NO: 1982862 - DNA, 22 bp, Homo sapiens
tacccagtaactcatctgtcac

SEQ ID NO: 1982863 - DNA, 19 bp, Homo sapiens
taccccaagtccacctgcc

SEQ ID NO: 1982864 - DNA, 20 bp, Homo sapiens
taccccaagtccacctgcct

SEQ ID NO: 1982865 - DNA, 18 bp, Homo sapiens
taccccacctcatgcctg

SEQ ID NO: 1982866 - DNA, 22 bp, Homo sapiens
tacccccgtggtctttgaataa

SEQ ID NO: 1982867 - DNA, 19 bp, Homo sapiens
tacccgagcccagctacat

SEQ ID NO: 1982868 - DNA, 13 bp, Homo sapiens
tacccggcccaga

SEQ ID NO: 1982869 - DNA, 13 bp, Homo sapiens
taccctccagagt

SEQ ID NO: 1982870 - DNA, 14 bp, Homo sapiens
taccctccagagtg

SEQ ID NO: 1982871 - DNA, 20 bp, Homo sapiens
tacccttccacctcctagag

SEQ ID NO: 1982872 - DNA, 15 bp, Homo sapiens
ccccagagccactac

SEQ ID NO: 1982873 - DNA, 15 bp, Homo sapiens
ccccagagccccact

SEQ ID NO: 1982874 - DNA, 18 bp, Homo sapiens
ccccagaggcctctctct

SEQ ID NO: 1982875 - DNA, 17 bp, Homo sapiens
ccccagatctgcctggg

SEQ ID NO: 1982876 - DNA, 20 bp, Homo sapiens
ccccagattgcaacaggctg

SEQ ID NO: 1982877 - DNA, 21 bp, Homo sapiens
ccccagattgcaacaggctgg

SEQ ID NO: 1982878 - DNA, 23 bp, Homo sapiens
ccccagattgcaacaggctgggc

SEQ ID NO: 1982879 - DNA, 12 bp, Homo sapiens
ccccagcaagag

SEQ ID NO: 1982880 - DNA, 19 bp, Homo sapiens
ccccagcaagtgagagctg

SEQ ID NO: 1982881 - DNA, 12 bp, Homo sapiens
ccccagcactga

SEQ ID NO: 1982882 - DNA, 12 bp, Homo sapiens
ccccagcagctc

SEQ ID NO: 1982883 - DNA, 13 bp, Homo sapiens
ccccagccagaag

SEQ ID NO: 1982884 - DNA, 18 bp, Homo sapiens
ccccagccccgactccag

SEQ ID NO: 1982885 - DNA, 19 bp, Homo sapiens
ccccagccccgactccagc

SEQ ID NO: 1982886 - DNA, 21 bp, Homo sapiens
ccccagcccctcctccccttc

SEQ ID NO: 1982887 - DNA, 15 bp, Homo sapiens
ccccagccctcaggc

SEQ ID NO: 1982888 - DNA, 13 bp, Homo sapiens
ccccagccctggc

SEQ ID NO: 1982889 - DNA, 23 bp, Homo sapiens
ccccagcgcggcttggccgccat

SEQ ID NO: 1982890 - DNA, 11 bp, Homo sapiens
ccccagctccc

SEQ ID NO: 1982891 - DNA, 11 bp, Homo sapiens
ccccagctggc

SEQ ID NO: 1982892 - DNA, 12 bp, Homo sapiens
ccccaggacgcc

SEQ ID NO: 1982893 - DNA, 15 bp, Homo sapiens
ccccaggactcaccc

SEQ ID NO: 1982894 - DNA, 16 bp, Homo sapiens
ccccaggactcaccct

SEQ ID NO: 1982895 - DNA, 19 bp, Homo sapiens
ccccaggactcaccctcat

SEQ ID NO: 1982896 - DNA, 17 bp, Homo sapiens
ccccaggatcccagagc

SEQ ID NO: 1982897 - DNA, 19 bp, Homo sapiens
ccccaggcatcccatccct

SEQ ID NO: 1982898 - DNA, 15 bp, Homo sapiens
ccccaggccaatgca

SEQ ID NO: 1982899 - DNA, 12 bp, Homo sapiens
ccccaggccagg

SEQ ID NO: 1982900 - DNA, 22 bp, Homo sapiens
ccccaggccaggccaccaggat

SEQ ID NO: 1982901 - DNA, 14 bp, Homo sapiens
ccccaggccctccc

SEQ ID NO: 1982902 - DNA, 15 bp, Homo sapiens
ccccaggccctccct

SEQ ID NO: 1982903 - DNA, 16 bp, Homo sapiens
ccccaggcctccagcc

SEQ ID NO: 1982904 - DNA, 11 bp, Homo sapiens
ccccagggcac

SEQ ID NO: 1982905 - DNA, 15 bp, Homo sapiens
ccccagggcacagga

SEQ ID NO: 1982906 - DNA, 16 bp, Homo sapiens
ccccagggcacaggag

SEQ ID NO: 1982907 - DNA, 18 bp, Homo sapiens
ccccagggcacaggagct

SEQ ID NO: 1982908 - DNA, 20 bp, Homo sapiens
ccccagggcccccacaggcc

SEQ ID NO: 1982909 - DNA, 21 bp, Homo sapiens
ccccagggcccctccctctgc

SEQ ID NO: 1982910 - DNA, 14 bp, Homo sapiens
ccccagggcctggg

SEQ ID NO: 1982911 - DNA, 16 bp, Homo sapiens
ccccaggggaaaatga

SEQ ID NO: 1982912 - DNA, 13 bp, Homo sapiens
ccccagggttgaa

SEQ ID NO: 1982913 - DNA, 17 bp, Homo sapiens
ccccaggtgccaccaat

SEQ ID NO: 1982914 - DNA, 18 bp, Homo sapiens
ccccaggtgccaccaata

SEQ ID NO: 1982915 - DNA, 19 bp, Homo sapiens
ccccaggtgccaccaataa

SEQ ID NO: 1982916 - DNA, 20 bp, Homo sapiens
ccccaggtggctgacccagt

SEQ ID NO: 1982917 - DNA, 14 bp, Homo sapiens
ccccagtcgagccc

SEQ ID NO: 1982918 - DNA, 19 bp, Homo sapiens
ccccagtcgagccctgcag

SEQ ID NO: 1982919 - DNA, 15 bp, Homo sapiens
ccccagtgcccacag

SEQ ID NO: 1982920 - DNA, 16 bp, Homo sapiens
ccccagtgctacctct

SEQ ID NO: 1982921 - DNA, 15 bp, Homo sapiens
ccccagttctgctcc

SEQ ID NO: 1982922 - DNA, 17 bp, Homo sapiens
ccccagttctgctcctc

SEQ ID NO: 1982923 - DNA, 23 bp, Homo sapiens
ccccagttctgctcctctccagg

SEQ ID NO: 1982924 - DNA, 17 bp, Homo sapiens
ccccatcagaggctggg

SEQ ID NO: 1982925 - DNA, 21 bp, Homo sapiens
ccccatcagcaccatggaggc

SEQ ID NO: 1982926 - DNA, 12 bp, Homo sapiens
ccccatccccca

SEQ ID NO: 1982927 - DNA, 16 bp, Homo sapiens
ccccatcccccactgc

SEQ ID NO: 1982928 - DNA, 15 bp, Homo sapiens
ccccatcctgggcct

SEQ ID NO: 1982929 - DNA, 15 bp, Homo sapiens
ccccatgacctccag

SEQ ID NO: 1982930 - DNA, 14 bp, Homo sapiens
ccccatgctctgcc

SEQ ID NO: 1982931 - DNA, 15 bp, Homo sapiens
ccccatgctctgccc

SEQ ID NO: 1982932 - DNA, 13 bp, Homo sapiens
ccccatgggcttg

SEQ ID NO: 1982933 - DNA, 14 bp, Homo sapiens
ccccattcacagag

SEQ ID NO: 1982934 - DNA, 15 bp, Homo sapiens
ccccattctgcctgc

SEQ ID NO: 1982935 - DNA, 21 bp, Homo sapiens
ccccattcttcctagttttct

SEQ ID NO: 1982936 - DNA, 20 bp, Homo sapiens
ccccatttctatttatttac

SEQ ID NO: 1982937 - DNA, 22 bp, Homo sapiens
cccccacaggccccccgcagca

SEQ ID NO: 1982938 - DNA, 15 bp, Homo sapiens
cccccaccactagga

SEQ ID NO: 1982939 - DNA, 15 bp, Homo sapiens
cccccaccccagagt

SEQ ID NO: 1982940 - DNA, 22 bp, Homo sapiens
cccccacctgacaatggcagct

SEQ ID NO: 1982941 - DNA, 15 bp, Homo sapiens
cccccacctggctca

SEQ ID NO: 1982942 - DNA, 14 bp, Homo sapiens
cccccactgcaggc

SEQ ID NO: 1982943 - DNA, 13 bp, Homo sapiens
cccccactgccac

SEQ ID NO: 1982944 - DNA, 11 bp, Homo sapiens
cccccagagac

SEQ ID NO: 1982945 - DNA, 23 bp, Homo sapiens
cccccagcactaaggccgtgtct

SEQ ID NO: 1982946 - DNA, 24 bp, Homo sapiens
cccccagccccgactccagccagc

SEQ ID NO: 1982947 - DNA, 12 bp, Homo sapiens
cccccagcctgc

SEQ ID NO: 1982948 - DNA, 15 bp, Homo sapiens
cccccagcctgggcc

SEQ ID NO: 1982949 - DNA, 18 bp, Homo sapiens
cccccagtcgagccctgc

SEQ ID NO: 1982950 - DNA, 17 bp, Homo sapiens
cccccatctccccaggc

SEQ ID NO: 1982951 - DNA, 14 bp, Homo sapiens
cccccatgtggctg

SEQ ID NO: 1982952 - DNA, 12 bp, Homo sapiens
ccccccagcact

SEQ ID NO: 1982953 - DNA, 13 bp, Homo sapiens
ccccccgcagcac

SEQ ID NO: 1982954 - DNA, 18 bp, Homo sapiens
cccccgacagcccagcct

SEQ ID NO: 1982955 - DNA, 13 bp, Homo sapiens
cccccgcagcacc

SEQ ID NO: 1982956 - DNA, 20 bp, Homo sapiens
cccccgcagcaccctgcaga

SEQ ID NO: 1982957 - DNA, 17 bp, Homo sapiens
cccccgccatccttcac

SEQ ID NO: 1982958 - DNA, 14 bp, Homo sapiens
cccccgtggtcttt

SEQ ID NO: 1982959 - DNA, 16 bp, Homo sapiens
cccccgtggtctttga

SEQ ID NO: 1982960 - DNA, 17 bp, Homo sapiens
cccccgtggtctttgaa

SEQ ID NO: 1982961 - DNA, 15 bp, Homo sapiens
ccccctccttgctct

SEQ ID NO: 1982962 - DNA, 20 bp, Homo sapiens
ccccctggatgtcccctgtc

SEQ ID NO: 1982963 - DNA, 20 bp, Homo sapiens
ccccctggggcttctcctga

SEQ ID NO: 1982964 - DNA, 21 bp, Homo sapiens
ccccctggggcttctcctgac

SEQ ID NO: 1982965 - DNA, 19 bp, Homo sapiens
ccccctggtggacagtcct

SEQ ID NO: 1982966 - DNA, 19 bp, Homo sapiens
ccccctgtgccagctcagg

SEQ ID NO: 1982967 - DNA, 21 bp, Homo sapiens
ccccctgtgccagctcaggtg

SEQ ID NO: 1982968 - DNA, 15 bp, Homo sapiens
cccccttcagtgccc

SEQ ID NO: 1982969 - DNA, 18 bp, Homo sapiens
cccccttgccagacatgt

SEQ ID NO: 1982970 - DNA, 17 bp, Homo sapiens
ccccgactccagccagc

SEQ ID NO: 1982971 - DNA, 13 bp, Homo sapiens
ccccgcagcaccc

SEQ ID NO: 1982972 - DNA, 14 bp, Homo sapiens
ccccgcagcccgtg

SEQ ID NO: 1982973 - DNA, 12 bp, Homo sapiens
ccccgcagtccc

SEQ ID NO: 1982974 - DNA, 17 bp, Homo sapiens
ccccgcggtgctctggc

SEQ ID NO: 1982975 - DNA, 15 bp, Homo sapiens
ccccgctccagatct

SEQ ID NO: 1982976 - DNA, 15 bp, Homo sapiens
ccccgctgggggtgg

SEQ ID NO: 1982977 - DNA, 12 bp, Homo sapiens
ccccgcttcccc

SEQ ID NO: 1982978 - DNA, 17 bp, Homo sapiens
ccccgcttccccacaga

SEQ ID NO: 1982979 - DNA, 18 bp, Homo sapiens
ccccgcttgtccagcgcc

SEQ ID NO: 1982980 - DNA, 19 bp, Homo sapiens
ccccgcttgtccagcgcct

SEQ ID NO: 1982981 - DNA, 14 bp, Homo sapiens
ccccgggcctgcct

SEQ ID NO: 1982982 - DNA, 16 bp, Homo sapiens
ccccgggcctgcctct

SEQ ID NO: 1982983 - DNA, 18 bp, Homo sapiens
ccccgggtccccagctcc

SEQ ID NO: 1982984 - DNA, 22 bp, Homo sapiens
ccccgtcagccacacctgtcag

SEQ ID NO: 1982985 - DNA, 21 bp, Homo sapiens
ccccgtctggggttcagcccc

SEQ ID NO: 1982986 - DNA, 16 bp, Homo sapiens
ccccgtcttctctcca

SEQ ID NO: 1982987 - DNA, 21 bp, Homo sapiens
cccctatccacccagcccatt

SEQ ID NO: 1982988 - DNA, 15 bp, Homo sapiens
cccctcactctgtca

SEQ ID NO: 1982989 - DNA, 13 bp, Homo sapiens
cccctcagccctt

SEQ ID NO: 1982990 - DNA, 17 bp, Homo sapiens
cccagtgccacagagaa

SEQ ID NO: 1982991 - DNA, 13 bp, Homo sapiens
cccagtgcccaca

SEQ ID NO: 1982992 - DNA, 14 bp, Homo sapiens
cccagtgctgccat

SEQ ID NO: 1982993 - DNA, 16 bp, Homo sapiens
cccagtgctgccatgc

SEQ ID NO: 1982994 - DNA, 19 bp, Homo sapiens
cccagtgctgccatgccac

SEQ ID NO: 1982995 - DNA, 13 bp, Homo sapiens
cccagtgcttctc

SEQ ID NO: 1982996 - DNA, 20 bp, Homo sapiens
cccagtgtaaagaataaatg

SEQ ID NO: 1982997 - DNA, 22 bp, Homo sapiens
cccagtgtaaagaataaatgaa

SEQ ID NO: 1982998 - DNA, 19 bp, Homo sapiens
cccagttcaggagtcccaa

SEQ ID NO: 1982999 - DNA, 22 bp, Homo sapiens
cccagttcaggagtcccaagga

SEQ ID NO: 1983000 - DNA, 20 bp, Homo sapiens
cccagttctgctcctctcca

SEQ ID NO: 1983001 - DNA, 22 bp, Homo sapiens
cccagttctgctcctctccagg

SEQ ID NO: 1983002 - DNA, 14 bp, Homo sapiens
cccagttgggtgga

SEQ ID NO: 1983003 - DNA, 22 bp, Homo sapiens
cccagtttcccttctatgcagt

SEQ ID NO: 1983004 - DNA, 23 bp, Homo sapiens
cccagtttgcagaaaagcacctg

SEQ ID NO: 1983005 - DNA, 23 bp, Homo sapiens
cccataatagttagccctcagtc

SEQ ID NO: 1983006 - DNA, 22 bp, Homo sapiens
cccatagatcttctgaaatgaa

SEQ ID NO: 1983007 - DNA, 17 bp, Homo sapiens
cccatagcgctggctca

SEQ ID NO: 1983008 - DNA, 20 bp, Homo sapiens
cccatagcgctggctcagga

SEQ ID NO: 1983009 - DNA, 13 bp, Homo sapiens
cccatatttcatc

SEQ ID NO: 1983010 - DNA, 21 bp, Homo sapiens
cccatcacctactcacacagg

SEQ ID NO: 1983011 - DNA, 22 bp, Homo sapiens
cccatcacctactcacacaggc

SEQ ID NO: 1983012 - DNA, 14 bp, Homo sapiens
cccatcagcaccat

SEQ ID NO: 1983013 - DNA, 18 bp, Homo sapiens
cccatcagcaccatggag

SEQ ID NO: 1983014 - DNA, 22 bp, Homo sapiens
cccatcatatcctttgccccaa

SEQ ID NO: 1983015 - DNA, 13 bp, Homo sapiens
cccatccccagcg

SEQ ID NO: 1983016 - DNA, 21 bp, Homo sapiens
cccatcccctggactgggagg

SEQ ID NO: 1983017 - DNA, 23 bp, Homo sapiens
cccatcccctttcctccccacct

SEQ ID NO: 1983018 - DNA, 17 bp, Homo sapiens
cccatcctaccaatgca

SEQ ID NO: 1983019 - DNA, 19 bp, Homo sapiens
cccatcctaccaatgcatg

SEQ ID NO: 1983020 - DNA, 21 bp, Homo sapiens
cccatcctaccaatgcatgca

SEQ ID NO: 1983021 - DNA, 13 bp, Homo sapiens
cccatcctgggcc

SEQ ID NO: 1983022 - DNA, 15 bp, Homo sapiens
cccatcctgggcctt

SEQ ID NO: 1983023 - DNA, 16 bp, Homo sapiens
cccatctccccaggcc

SEQ ID NO: 1983024 - DNA, 22 bp, Homo sapiens
cccatctccccaggcctccagc

SEQ ID NO: 1983025 - DNA, 12 bp, Homo sapiens
cccatctccccc

SEQ ID NO: 1983026 - DNA, 18 bp, Homo sapiens
cccatctcttcctaccca

SEQ ID NO: 1983027 - DNA, 18 bp, Homo sapiens
cccatctgctcctcccat

SEQ ID NO: 1983028 - DNA, 22 bp, Homo sapiens
cccatctgggtccttgcacccc

SEQ ID NO: 1983029 - DNA, 12 bp, Homo sapiens
cccatcttcctg

SEQ ID NO: 1983030 - DNA, 20 bp, Homo sapiens
cccatcttcctgctgctgta

SEQ ID NO: 1983031 - DNA, 17 bp, Homo sapiens
cccatcttggtcctgtc

SEQ ID NO: 1983032 - DNA, 18 bp, Homo sapiens
cccatgaagacaggacag

SEQ ID NO: 1983033 - DNA, 19 bp, Homo sapiens
cccatgaagacaggacagt

SEQ ID NO: 1983034 - DNA, 22 bp, Homo sapiens
cccatgaagacaggacagtgct

SEQ ID NO: 1983035 - DNA, 16 bp, Homo sapiens
cccatgagcctcagca

SEQ ID NO: 1983036 - DNA, 23 bp, Homo sapiens
cccatgatgccgctcttctgtca

SEQ ID NO: 1983037 - DNA, 22 bp, Homo sapiens
cccatgcacacaaacacctcct

SEQ ID NO: 1983038 - DNA, 19 bp, Homo sapiens
cccatgctcaaccactgtg

SEQ ID NO: 1983039 - DNA, 13 bp, Homo sapiens
cccatgctctgcc

SEQ ID NO: 1983040 - DNA, 15 bp, Homo sapiens
cccatgctctgcccc

SEQ ID NO: 1983041 - DNA, 23 bp, Homo sapiens
cccatgtgcatggaaatgtcctc

SEQ ID NO: 1983042 - DNA, 13 bp, Homo sapiens
cccatgtgccaag

SEQ ID NO: 1983043 - DNA, 16 bp, Homo sapiens
cccatgtggctgaaga

SEQ ID NO: 1983044 - DNA, 22 bp, Homo sapiens
cccatgtgtcccctcactctgt

SEQ ID NO: 1983045 - DNA, 23 bp, Homo sapiens
cccatgtgtcccctcactctgtc

SEQ ID NO: 1983046 - DNA, 20 bp, Homo sapiens
cccatgtttaaactttgtgc

SEQ ID NO: 1983047 - DNA, 18 bp, Homo sapiens
cccattaggcatgcctaa

SEQ ID NO: 1983048 - DNA, 13 bp, Homo sapiens
cccattcacagag

SEQ ID NO: 1983049 - DNA, 14 bp, Homo sapiens
cccattcacagagc

SEQ ID NO: 1983050 - DNA, 13 bp, Homo sapiens
cccattcagacac

SEQ ID NO: 1983051 - DNA, 23 bp, Homo sapiens
cccattctgcctgcccaggcccc

SEQ ID NO: 1983052 - DNA, 20 bp, Homo sapiens
cccattcttcctagttttct

SEQ ID NO: 1983053 - DNA, 15 bp, Homo sapiens
cccatttctatttat

SEQ ID NO: 1983054 - DNA, 20 bp, Homo sapiens
cccatttctatttatttact

SEQ ID NO: 1983055 - DNA, 12 bp, Homo sapiens
cccatttgtaat

SEQ ID NO: 1983056 - DNA, 17 bp, Homo sapiens
cccattttgaggccaga

SEQ ID NO: 1983057 - DNA, 17 bp, Homo sapiens
cccattttgagtgactc

SEQ ID NO: 1983058 - DNA, 12 bp, Homo sapiens
cccattttgcaa

SEQ ID NO: 1983059 - DNA, 19 bp, Homo sapiens
cccattttgcaaaatttcc

SEQ ID NO: 1983060 - DNA, 22 bp, Homo sapiens
cccattttggaagttttcagga

SEQ ID NO: 1983061 - DNA, 17 bp, Homo sapiens
cccatttttgagccaag

SEQ ID NO: 1983062 - DNA, 20 bp, Homo sapiens
ccccaaaaacctcacccgag

SEQ ID NO: 1983063 - DNA, 16 bp, Homo sapiens
ccccaaaccagggtgc

SEQ ID NO: 1983064 - DNA, 19 bp, Homo sapiens
ccccaaacgggctgccctg

SEQ ID NO: 1983065 - DNA, 20 bp, Homo sapiens
ccccaaactgtgccctgcct

SEQ ID NO: 1983066 - DNA, 15 bp, Homo sapiens
ccccaaagagcctgg

SEQ ID NO: 1983067 - DNA, 19 bp, Homo sapiens
ccccaaagagcctggagaa

SEQ ID NO: 1983068 - DNA, 12 bp, Homo sapiens
ccccaaagcccc

SEQ ID NO: 1983069 - DNA, 19 bp, Homo sapiens
ccccaaaggtggtctgctt

SEQ ID NO: 1983070 - DNA, 16 bp, Homo sapiens
ccccaaccccgcggtg

SEQ ID NO: 1983071 - DNA, 19 bp, Homo sapiens
ccccaacctttccctcacc

SEQ ID NO: 1983072 - DNA, 13 bp, Homo sapiens
ccccaagcagcca

SEQ ID NO: 1983073 - DNA, 15 bp, Homo sapiens
ccccaagcagccagc

SEQ ID NO: 1983074 - DNA, 16 bp, Homo sapiens
ccccaagcagccagcc

SEQ ID NO: 1983075 - DNA, 19 bp, Homo sapiens
ccccaagcagccagccagt

SEQ ID NO: 1983076 - DNA, 16 bp, Homo sapiens
ccccaagcctctgccc

SEQ ID NO: 1983077 - DNA, 21 bp, Homo sapiens
ccccaagcctctgccccaagg

SEQ ID NO: 1983078 - DNA, 12 bp, Homo sapiens
ccccaagggaca

SEQ ID NO: 1983079 - DNA, 17 bp, Homo sapiens
ccccacacctccctact

SEQ ID NO: 1983080 - DNA, 20 bp, Homo sapiens
ccccacacgtgctcgcagcc

SEQ ID NO: 1983081 - DNA, 19 bp, Homo sapiens
ccccacagcacccaggctc

SEQ ID NO: 1983082 - DNA, 12 bp, Homo sapiens
ccccacagtcct

SEQ ID NO: 1983083 - DNA, 13 bp, Homo sapiens
ccccacataccat

SEQ ID NO: 1983084 - DNA, 17 bp, Homo sapiens
ccccaccagccacctct

SEQ ID NO: 1983085 - DNA, 12 bp, Homo sapiens
ccccaccccacg

SEQ ID NO: 1983086 - DNA, 13 bp, Homo sapiens
ccccaccccagag

SEQ ID NO: 1983087 - DNA, 15 bp, Homo sapiens
ccccaccccagagtt

SEQ ID NO: 1983088 - DNA, 12 bp, Homo sapiens
ccccaccccctt

SEQ ID NO: 1983089 - DNA, 21 bp, Homo sapiens
ccccaccctcgtggacacctg

SEQ ID NO: 1983090 - DNA, 23 bp, Homo sapiens
ccccaccctcgtggacacctgcc

SEQ ID NO: 1983091 - DNA, 20 bp, Homo sapiens
ccccaccgaagagccctgag

SEQ ID NO: 1983092 - DNA, 13 bp, Homo sapiens
ccccacctccgcc

SEQ ID NO: 1983093 - DNA, 14 bp, Homo sapiens
ccccacctcttcct

SEQ ID NO: 1983094 - DNA, 12 bp, Homo sapiens
ccccacctgcca

SEQ ID NO: 1983095 - DNA, 17 bp, Homo sapiens
ccccaccttccccagac

SEQ ID NO: 1983096 - DNA, 14 bp, Homo sapiens
ccccacctttggga

SEQ ID NO: 1983097 - DNA, 15 bp, Homo sapiens
ccccactctcattcc

SEQ ID NO: 1983098 - DNA, 12 bp, Homo sapiens
ccccactgcagg

SEQ ID NO: 1983099 - DNA, 19 bp, Homo sapiens
ccccacttctctactctgg

SEQ ID NO: 1983100 - DNA, 22 bp, Homo sapiens
ccccactttcctacaaaatgga

SEQ ID NO: 1983101 - DNA, 13 bp, Homo sapiens
ccccagacactgg

SEQ ID NO: 1983102 - DNA, 20 bp, Homo sapiens
ccccagactcaaactcaagg

SEQ ID NO: 1983103 - DNA, 13 bp, Homo sapiens
ccccagacttctc

SEQ ID NO: 1983104 - DNA, 19 bp, Homo sapiens
ccccagacttctctttctt

SEQ ID NO: 1983105 - DNA, 19 bp, Homo sapiens
ccccagagcacaagttcca

SEQ ID NO: 1983106 - DNA, 23 bp, Homo sapiens
cccagcccccacctccgccccag

SEQ ID NO: 1983107 - DNA, 17 bp, Homo sapiens
cccagccccgactccag

SEQ ID NO: 1983108 - DNA, 16 bp, Homo sapiens
cccagcccctcctccc

SEQ ID NO: 1983109 - DNA, 21 bp, Homo sapiens
cccagcccctcctccccttcc

SEQ ID NO: 1983110 - DNA, 14 bp, Homo sapiens
cccagccctcaggc

SEQ ID NO: 1983111 - DNA, 16 bp, Homo sapiens
cccagccctcaggcca

SEQ ID NO: 1983112 - DNA, 14 bp, Homo sapiens
cccagcccttctgc

SEQ ID NO: 1983113 - DNA, 20 bp, Homo sapiens
cccagcccttctgcctttct

SEQ ID NO: 1983114 - DNA, 10 bp, Homo sapiens
cccagcctgg

SEQ ID NO: 1983115 - DNA, 14 bp, Homo sapiens
cccagcctgggcct

SEQ ID NO: 1983116 - DNA, 14 bp, Homo sapiens
cccagcctgtcctg

SEQ ID NO: 1983117 - DNA, 20 bp, Homo sapiens
cccagcctgtcctggtacag

SEQ ID NO: 1983118 - DNA, 17 bp, Homo sapiens
cccagcgagccctggtg

SEQ ID NO: 1983119 - DNA, 18 bp, Homo sapiens
cccagcgagccctggtgg

SEQ ID NO: 1983120 - DNA, 21 bp, Homo sapiens
cccagcgcctgtgctgaggac

SEQ ID NO: 1983121 - DNA, 20 bp, Homo sapiens
cccagcgcggcttggccgcc

SEQ ID NO: 1983122 - DNA, 21 bp, Homo sapiens
cccagcgcggcttggccgcca

SEQ ID NO: 1983123 - DNA, 22 bp, Homo sapiens
cccagcgcggcttggccgccat

SEQ ID NO: 1983124 - DNA, 23 bp, Homo sapiens
cccagcgcggcttggccgccatc

SEQ ID NO: 1983125 - DNA, 16 bp, Homo sapiens
cccagctacattcctc

SEQ ID NO: 1983126 - DNA, 21 bp, Homo sapiens
cccagctacattcctcagctg

SEQ ID NO: 1983127 - DNA, 21 bp, Homo sapiens
cccagctactcagaagcctga

SEQ ID NO: 1983128 - DNA, 22 bp, Homo sapiens
cccagctactcagaagcctgag

SEQ ID NO: 1983129 - DNA, 16 bp, Homo sapiens
cccagctactctgtcc

SEQ ID NO: 1983130 - DNA, 19 bp, Homo sapiens
cccagctactctgtccagg

SEQ ID NO: 1983131 - DNA, 15 bp, Homo sapiens
cccagctccccagga

SEQ ID NO: 1983132 - DNA, 16 bp, Homo sapiens
cccagctccccaggac

SEQ ID NO: 1983133 - DNA, 14 bp, Homo sapiens
cccagctctccctc

SEQ ID NO: 1983134 - DNA, 15 bp, Homo sapiens
cccagctctccctct

SEQ ID NO: 1983135 - DNA, 21 bp, Homo sapiens
cccagctctccctctggccct

SEQ ID NO: 1983136 - DNA, 13 bp, Homo sapiens
cccagctgcacct

SEQ ID NO: 1983137 - DNA, 21 bp, Homo sapiens
cccagctgcacctgccagcct

SEQ ID NO: 1983138 - DNA, 16 bp, Homo sapiens
cccagctggtgggaag

SEQ ID NO: 1983139 - DNA, 13 bp, Homo sapiens
cccagctgtagcc

SEQ ID NO: 1983140 - DNA, 16 bp, Homo sapiens
cccagctgtagccatg

SEQ ID NO: 1983141 - DNA, 17 bp, Homo sapiens
cccagctgtagccatgg

SEQ ID NO: 1983142 - DNA, 19 bp, Homo sapiens
cccagctgtagccatggct

SEQ ID NO: 1983143 - DNA, 22 bp, Homo sapiens
cccagctgtagccatggctcag

SEQ ID NO: 1983144 - DNA, 23 bp, Homo sapiens
cccagctgtagccatggctcagg

SEQ ID NO: 1983145 - DNA, 23 bp, Homo sapiens
cccagctgtctgtgtcagcctgt

SEQ ID NO: 1983146 - DNA, 23 bp, Homo sapiens
cccagctgtgctctggacaggca

SEQ ID NO: 1983147 - DNA, 15 bp, Homo sapiens
cccagctttatctgt

SEQ ID NO: 1983148 - DNA, 13 bp, Homo sapiens
cccaggacgccac

SEQ ID NO: 1983149 - DNA, 17 bp, Homo sapiens
cccaggagacagttcaa

SEQ ID NO: 1983150 - DNA, 14 bp, Homo sapiens
cccaggagagccag

SEQ ID NO: 1983151 - DNA, 15 bp, Homo sapiens
cccaggagagccagc

SEQ ID NO: 1983152 - DNA, 13 bp, Homo sapiens
cccaggagccccg

SEQ ID NO: 1983153 - DNA, 18 bp, Homo sapiens
cccaggagccccgaggcc

SEQ ID NO: 1983154 - DNA, 20 bp, Homo sapiens
cccaggagctgagtcacctc

SEQ ID NO: 1983155 - DNA, 21 bp, Homo sapiens
cccaggagctgagtcacctcc

SEQ ID NO: 1983156 - DNA, 23 bp, Homo sapiens
cccaggagctgagtcacctcctc

SEQ ID NO: 1983157 - DNA, 17 bp, Homo sapiens
cccaggatccctcccag

SEQ ID NO: 1983158 - DNA, 13 bp, Homo sapiens
cccaggcaggtct

SEQ ID NO: 1983159 - DNA, 14 bp, Homo sapiens
cccaggcatcccat

SEQ ID NO: 1983160 - DNA, 17 bp, Homo sapiens
cccaggccaggccacca

SEQ ID NO: 1983161 - DNA, 20 bp, Homo sapiens
cccaggccaggccaccagga

SEQ ID NO: 1983162 - DNA, 21 bp, Homo sapiens
cccaggccccatgacctccag

SEQ ID NO: 1983163 - DNA, 22 bp, Homo sapiens
cccaggcccctgccaccctggg

SEQ ID NO: 1983164 - DNA, 18 bp, Homo sapiens
cccaggccctccatgggc

SEQ ID NO: 1983165 - DNA, 17 bp, Homo sapiens
cccaggccctccctgac

SEQ ID NO: 1983166 - DNA, 12 bp, Homo sapiens
cccaggccgcct

SEQ ID NO: 1983167 - DNA, 16 bp, Homo sapiens
cccaggccgcctgcca

SEQ ID NO: 1983168 - DNA, 19 bp, Homo sapiens
cccaggccgcctgccatac

SEQ ID NO: 1983169 - DNA, 12 bp, Homo sapiens
cccaggcctcca

SEQ ID NO: 1983170 - DNA, 13 bp, Homo sapiens
cccaggcctccag

SEQ ID NO: 1983171 - DNA, 15 bp, Homo sapiens
cccaggcctccagcc

SEQ ID NO: 1983172 - DNA, 15 bp, Homo sapiens
cccaggcctgcctgt

SEQ ID NO: 1983173 - DNA, 15 bp, Homo sapiens
cccaggctccatggg

SEQ ID NO: 1983174 - DNA, 22 bp, Homo sapiens
cccaggctccatggggaagtgc

SEQ ID NO: 1983175 - DNA, 15 bp, Homo sapiens
cccaggctctgggaa

SEQ ID NO: 1983176 - DNA, 14 bp, Homo sapiens
cccaggctggcctg

SEQ ID NO: 1983177 - DNA, 13 bp, Homo sapiens
cccaggctggcgt

SEQ ID NO: 1983178 - DNA, 18 bp, Homo sapiens
cccaggctggcgtgcagt

SEQ ID NO: 1983179 - DNA, 22 bp, Homo sapiens
cccaggcttgtcactagcagct

SEQ ID NO: 1983180 - DNA, 19 bp, Homo sapiens
cccagggacaagggaagga

SEQ ID NO: 1983181 - DNA, 20 bp, Homo sapiens
cccagggacaagggaaggaa

SEQ ID NO: 1983182 - DNA, 14 bp, Homo sapiens
cccagggcacagga

SEQ ID NO: 1983183 - DNA, 15 bp, Homo sapiens
cccagggcacaggag

SEQ ID NO: 1983184 - DNA, 16 bp, Homo sapiens
cccagggcacaggagc

SEQ ID NO: 1983185 - DNA, 17 bp, Homo sapiens
cccagggcacaggagct

SEQ ID NO: 1983186 - DNA, 18 bp, Homo sapiens
cccagggcacaggagcta

SEQ ID NO: 1983187 - DNA, 14 bp, Homo sapiens
cccagggcatccca

SEQ ID NO: 1983188 - DNA, 16 bp, Homo sapiens
cccagggcatcccatg

SEQ ID NO: 1983189 - DNA, 18 bp, Homo sapiens
cccagggcatcccatggg

SEQ ID NO: 1983190 - DNA, 19 bp, Homo sapiens
cccagggcatcccatgggg

SEQ ID NO: 1983191 - DNA, 21 bp, Homo sapiens
cccagggcatcccatgggggt

SEQ ID NO: 1983192 - DNA, 21 bp, Homo sapiens
cccagggccagggccctgcag

SEQ ID NO: 1983193 - DNA, 17 bp, Homo sapiens
cccagggcccccacagg

SEQ ID NO: 1983194 - DNA, 17 bp, Homo sapiens
cccagggcccctccctc

SEQ ID NO: 1983195 - DNA, 20 bp, Homo sapiens
cccagggcccctccctctgc

SEQ ID NO: 1983196 - DNA, 11 bp, Homo sapiens
cccagggccct

SEQ ID NO: 1983197 - DNA, 18 bp, Homo sapiens
cccagggcctgggggcag

SEQ ID NO: 1983198 - DNA, 18 bp, Homo sapiens
cccagggctcagcctggt

SEQ ID NO: 1983199 - DNA, 22 bp, Homo sapiens
cccaggggagagggtctggaga

SEQ ID NO: 1983200 - DNA, 23 bp, Homo sapiens
cccaggggagagggtctggagaa

SEQ ID NO: 1983201 - DNA, 24 bp, Homo sapiens
cccaggggagagggtctggagaag

SEQ ID NO: 1983202 - DNA, 17 bp, Homo sapiens
cccaggggctccacctg

SEQ ID NO: 1983203 - DNA, 15 bp, Homo sapiens
cccaggtcctctgat

SEQ ID NO: 1983204 - DNA, 14 bp, Homo sapiens
cccaggtctctcca

SEQ ID NO: 1983205 - DNA, 20 bp, Homo sapiens
cccaggtctctccactgctc

SEQ ID NO: 1983206 - DNA, 18 bp, Homo sapiens
cccaggtggctgacccag

SEQ ID NO: 1983207 - DNA, 22 bp, Homo sapiens
cccaggtggctgacccagtccc

SEQ ID NO: 1983208 - DNA, 23 bp, Homo sapiens
cccaggtggctgacccagtccct

SEQ ID NO: 1983209 - DNA, 15 bp, Homo sapiens
cccagtaactcatct

SEQ ID NO: 1983210 - DNA, 24 bp, Homo sapiens
cccagtagtcagaagcaggttctt

SEQ ID NO: 1983211 - DNA, 21 bp, Homo sapiens
cccagtcacctcttctgccag

SEQ ID NO: 1983212 - DNA, 21 bp, Homo sapiens
cccagtcccagaaccacactg

SEQ ID NO: 1983213 - DNA, 12 bp, Homo sapiens
cccagtccctgg

SEQ ID NO: 1983214 - DNA, 13 bp, Homo sapiens
cccagtcctggcc

SEQ ID NO: 1983215 - DNA, 19 bp, Homo sapiens
cccagtcgagccctgcagc

SEQ ID NO: 1983216 - DNA, 18 bp, Homo sapiens
cccagtctggaatgcagt

SEQ ID NO: 1983217 - DNA, 20 bp, Homo sapiens
cccagtctggaatgcagtgg

SEQ ID NO: 1983218 - DNA, 17 bp, Homo sapiens
cccagtctgttccccat

SEQ ID NO: 1983219 - DNA, 16 bp, Homo sapiens
cccagtgacctgaccg

SEQ ID NO: 1983220 - DNA, 13 bp, Homo sapiens
cccagtgccacag

SEQ ID NO: 1983221 - DNA, 16 bp, Homo sapiens
cccagtgccacagaga

SEQ ID NO: 1983222 - DNA, 14 bp, Homo sapiens
aggcgaataaatgt

SEQ ID NO: 1983223 - DNA, 18 bp, Homo sapiens
aggcgaataaatgttcaa

SEQ ID NO: 1983224 - DNA, 19 bp, Homo sapiens
aggcgacttcctctccagc

SEQ ID NO: 1983225 - DNA, 18 bp, Homo sapiens
aggcgagtgccaggactc

SEQ ID NO: 1983226 - DNA, 24 bp, Homo sapiens
aggcgagtgccaggactccccagg

SEQ ID NO: 1983227 - DNA, 21 bp, Homo sapiens
aggcgcagtgcttctctacag

SEQ ID NO: 1983228 - DNA, 14 bp, Homo sapiens
aggcgcatgtgcca

SEQ ID NO: 1983229 - DNA, 18 bp, Homo sapiens
aggcgcatgtgccagttg

SEQ ID NO: 1983230 - DNA, 21 bp, Homo sapiens
aggcgccccaacccgtggagg

SEQ ID NO: 1983231 - DNA, 16 bp, Homo sapiens
aggcgccctcccttcc

SEQ ID NO: 1983232 - DNA, 20 bp, Homo sapiens
aggcgcgtctgccccaccct

SEQ ID NO: 1983233 - DNA, 22 bp, Homo sapiens
aggcgcgtctgccccaccctca

SEQ ID NO: 1983234 - DNA, 15 bp, Homo sapiens
aggcgctggacagag

SEQ ID NO: 1983235 - DNA, 12 bp, Homo sapiens
aggcggaaacct

SEQ ID NO: 1983236 - DNA, 19 bp, Homo sapiens
aggcggaaaccttgcagca

SEQ ID NO: 1983237 - DNA, 20 bp, Homo sapiens
aggcggaaaccttgcagcat

SEQ ID NO: 1983238 - DNA, 24 bp, Homo sapiens
aggcggagagtacagtgagccaag

SEQ ID NO: 1983239 - DNA, 15 bp, Homo sapiens
aggcggcacagaggc

SEQ ID NO: 1983240 - DNA, 16 bp, Homo sapiens
aggcggctccaggtcc

SEQ ID NO: 1983241 - DNA, 15 bp, Homo sapiens
aggcgggagatggac

SEQ ID NO: 1983242 - DNA, 16 bp, Homo sapiens
aggcggggtgctgtgg

SEQ ID NO: 1983243 - DNA, 16 bp, Homo sapiens
aggcggtcatgtgtgc

SEQ ID NO: 1983244 - DNA, 17 bp, Homo sapiens
aggcggtcatgtgtgca

SEQ ID NO: 1983245 - DNA, 18 bp, Homo sapiens
aggcggtcatgtgtgcat

SEQ ID NO: 1983246 - DNA, 21 bp, Homo sapiens
aggcggtcatgtgtgcatgtg

SEQ ID NO: 1983247 - DNA, 15 bp, Homo sapiens
aggcggtttccagga

SEQ ID NO: 1983248 - DNA, 18 bp, Homo sapiens
aggcggtttccaggaaga

SEQ ID NO: 1983249 - DNA, 17 bp, Homo sapiens
aggcgtcttgtattttc

SEQ ID NO: 1983250 - DNA, 18 bp, Homo sapiens
aggcgttcttcgaggtgg

SEQ ID NO: 1983251 - DNA, 16 bp, Homo sapiens
aggcgttggtgccact

SEQ ID NO: 1983252 - DNA, 22 bp, Homo sapiens
aggctaagatgagatttgccag

SEQ ID NO: 1983253 - DNA, 17 bp, Homo sapiens
aggctactgtcagctcc

SEQ ID NO: 1983254 - DNA, 17 bp, Homo sapiens
aggctacttcggggctg

SEQ ID NO: 1983255 - DNA, 19 bp, Homo sapiens
aggctagaacctggcaagc

SEQ ID NO: 1983256 - DNA, 17 bp, Homo sapiens
aggctattaaaagaatc

SEQ ID NO: 1983257 - DNA, 14 bp, Homo sapiens
aggctatttgttca

SEQ ID NO: 1983258 - DNA, 17 bp, Homo sapiens
aggctcaacaataaaac

SEQ ID NO: 1983259 - DNA, 19 bp, Homo sapiens
aggctcaacaataaaacat

SEQ ID NO: 1983260 - DNA, 16 bp, Homo sapiens
aggctcaagaggccca

SEQ ID NO: 1983261 - DNA, 17 bp, Homo sapiens
aggctcaagaggcccag

SEQ ID NO: 1983262 - DNA, 19 bp, Homo sapiens
aggctcaagaggcccaggg

SEQ ID NO: 1983263 - DNA, 16 bp, Homo sapiens
aggctcacaactgttt

SEQ ID NO: 1983264 - DNA, 21 bp, Homo sapiens
aggctcaggacggaaggtcag

SEQ ID NO: 1983265 - DNA, 13 bp, Homo sapiens
aggctccatgggg

SEQ ID NO: 1983266 - DNA, 15 bp, Homo sapiens
aggctccatggggaa

SEQ ID NO: 1983267 - DNA, 17 bp, Homo sapiens
aggctccatggggaagt

SEQ ID NO: 1983268 - DNA, 16 bp, Homo sapiens
aggctctggagccaga

SEQ ID NO: 1983269 - DNA, 17 bp, Homo sapiens
aggctctggagccagag

SEQ ID NO: 1983270 - DNA, 19 bp, Homo sapiens
aggctctggagccagagag

SEQ ID NO: 1983271 - DNA, 15 bp, Homo sapiens
aggctctgggctcag

SEQ ID NO: 1983272 - DNA, 16 bp, Homo sapiens
aggctctgggctcagg

SEQ ID NO: 1983273 - DNA, 18 bp, Homo sapiens
aggctctgggctcagggc

SEQ ID NO: 1983274 - DNA, 22 bp, Homo sapiens
aggctctgggctcagggctgga

SEQ ID NO: 1983275 - DNA, 19 bp, Homo sapiens
aggctcttcctggacctga

SEQ ID NO: 1983276 - DNA, 23 bp, Homo sapiens
aggctcttctccttggaggacag

SEQ ID NO: 1983277 - DNA, 15 bp, Homo sapiens
aggctgaccaagaga

SEQ ID NO: 1983278 - DNA, 22 bp, Homo sapiens
aggctgaccaagagagaaagaa

SEQ ID NO: 1983279 - DNA, 13 bp, Homo sapiens
aggctgagacagg

SEQ ID NO: 1983280 - DNA, 18 bp, Homo sapiens
aggctgagacaggagaat

SEQ ID NO: 1983281 - DNA, 17 bp, Homo sapiens
aggctgagactgcggga

SEQ ID NO: 1983282 - DNA, 12 bp, Homo sapiens
aggctgagccca

SEQ ID NO: 1983283 - DNA, 13 bp, Homo sapiens
aggctgagcccag

SEQ ID NO: 1983284 - DNA, 23 bp, Homo sapiens
aggctgagcccagccacctccca

SEQ ID NO: 1983285 - DNA, 13 bp, Homo sapiens
aggctgagctggc

SEQ ID NO: 1983286 - DNA, 11 bp, Homo sapiens
aggctgaggac

SEQ ID NO: 1983287 - DNA, 11 bp, Homo sapiens
aggctgaggca

SEQ ID NO: 1983288 - DNA, 14 bp, Homo sapiens
aggctgaggcagaa

SEQ ID NO: 1983289 - DNA, 22 bp, Homo sapiens
aggctgaggggaggatcactgg

SEQ ID NO: 1983290 - DNA, 14 bp, Homo sapiens
aggctgaggtgtct

SEQ ID NO: 1983291 - DNA, 17 bp, Homo sapiens
aggctgcactgcagtga

SEQ ID NO: 1983292 - DNA, 20 bp, Homo sapiens
aggctgcagaaggccaagaa

SEQ ID NO: 1983293 - DNA, 18 bp, Homo sapiens
aggctgcagagctgaccc

SEQ ID NO: 1983294 - DNA, 20 bp, Homo sapiens
aggctgcagagctgacccag

SEQ ID NO: 1983295 - DNA, 22 bp, Homo sapiens
aggctgcaggacttctgcctga

SEQ ID NO: 1983296 - DNA, 18 bp, Homo sapiens
aggctgcatgctctggaa

SEQ ID NO: 1983297 - DNA, 23 bp, Homo sapiens
aggctgccccgggtccccagctc

SEQ ID NO: 1983298 - DNA, 22 bp, Homo sapiens
aggctgcctcatgaccctcctg

SEQ ID NO: 1983299 - DNA, 15 bp, Homo sapiens
aggctgctcagaggg

SEQ ID NO: 1983300 - DNA, 21 bp, Homo sapiens
aggctgctcagaggggccccg

SEQ ID NO: 1983301 - DNA, 17 bp, Homo sapiens
aggctgctcggggtgca

SEQ ID NO: 1983302 - DNA, 23 bp, Homo sapiens
aggctgctcggggtgcacaggag

SEQ ID NO: 1983303 - DNA, 14 bp, Homo sapiens
aggctggagaagct

SEQ ID NO: 1983304 - DNA, 15 bp, Homo sapiens
aggctggaggcaggg

SEQ ID NO: 1983305 - DNA, 23 bp, Homo sapiens
aggctggaggcagggccttgccc

SEQ ID NO: 1983306 - DNA, 20 bp, Homo sapiens
aggctggagtgcagtggcat

SEQ ID NO: 1983307 - DNA, 20 bp, Homo sapiens
aggctggagtggagtggcac

SEQ ID NO: 1983308 - DNA, 13 bp, Homo sapiens
aggctggcactcc

SEQ ID NO: 1983309 - DNA, 15 bp, Homo sapiens
aggctggcactcccc

SEQ ID NO: 1983310 - DNA, 17 bp, Homo sapiens
aggctggcactcccctg

SEQ ID NO: 1983311 - DNA, 17 bp, Homo sapiens
aggctggcgtgcagtgg

SEQ ID NO: 1983312 - DNA, 20 bp, Homo sapiens
aggctggctgaaaatcacta

SEQ ID NO: 1983313 - DNA, 18 bp, Homo sapiens
aggctggctgagtggaat

SEQ ID NO: 1983314 - DNA, 21 bp, Homo sapiens
aggctgggcttcagtggcagc

SEQ ID NO: 1983315 - DNA, 20 bp, Homo sapiens
aggctggggctcgtaaatat

SEQ ID NO: 1983316 - DNA, 22 bp, Homo sapiens
aggctgggggcgggggagccaa

SEQ ID NO: 1983317 - DNA, 23 bp, Homo sapiens
aggctgggggcgggggagccaac

SEQ ID NO: 1983318 - DNA, 18 bp, Homo sapiens
aggctggtcgtgaactcc

SEQ ID NO: 1983319 - DNA, 23 bp, Homo sapiens
aggctggtcgtgaactcctgagc

SEQ ID NO: 1983320 - DNA, 22 bp, Homo sapiens
gcagagaaagaagagacaggag

SEQ ID NO: 1983321 - DNA, 15 bp, Homo sapiens
gcagagaaggcctct

SEQ ID NO: 1983322 - DNA, 20 bp, Homo sapiens
gcagagaatcatacttagca

SEQ ID NO: 1983323 - DNA, 19 bp, Homo sapiens
gcagagaatgaaagggccc

SEQ ID NO: 1983324 - DNA, 12 bp, Homo sapiens
gcagagacaata

SEQ ID NO: 1983325 - DNA, 21 bp, Homo sapiens
gcagagacaataaaacattcc

SEQ ID NO: 1983326 - DNA, 14 bp, Homo sapiens
gcagagagaagcct

SEQ ID NO: 1983327 - DNA, 18 bp, Homo sapiens
gcagagagccctgggtga

SEQ ID NO: 1983328 - DNA, 16 bp, Homo sapiens
gcagagaggtggagaa

SEQ ID NO: 1983329 - DNA, 14 bp, Homo sapiens
gcagagcaggggca

SEQ ID NO: 1983330 - DNA, 14 bp, Homo sapiens
gcagagccatgggc

SEQ ID NO: 1983331 - DNA, 21 bp, Homo sapiens
gcagagccttttacccctgca

SEQ ID NO: 1983332 - DNA, 17 bp, Homo sapiens
gcagagcggggaggtgc

SEQ ID NO: 1983333 - DNA, 19 bp, Homo sapiens
gcagagcggggaggtgcct

SEQ ID NO: 1983334 - DNA, 22 bp, Homo sapiens
gcagagcggggaggtgcctgag

SEQ ID NO: 1983335 - DNA, 18 bp, Homo sapiens
gcagagctgatggagaag

SEQ ID NO: 1983336 - DNA, 23 bp, Homo sapiens
gcagagctgatggagaaggaagg

SEQ ID NO: 1983337 - DNA, 23 bp, Homo sapiens
gcagaggatgttctggacctccc

SEQ ID NO: 1983338 - DNA, 18 bp, Homo sapiens
gcagaggattgaggctta

SEQ ID NO: 1983339 - DNA, 16 bp, Homo sapiens
gcagaggcggaaacct

SEQ ID NO: 1983340 - DNA, 18 bp, Homo sapiens
gcagaggcggaaaccttg

SEQ ID NO: 1983341 - DNA, 14 bp, Homo sapiens
gcagaggctttggg

SEQ ID NO: 1983342 - DNA, 16 bp, Homo sapiens
gcagagggcagaggct

SEQ ID NO: 1983343 - DNA, 18 bp, Homo sapiens
gcagaggggcagccgcta

SEQ ID NO: 1983344 - DNA, 19 bp, Homo sapiens
gcagaggggtaggcagagc

SEQ ID NO: 1983345 - DNA, 13 bp, Homo sapiens
gcagaggtaaaag

SEQ ID NO: 1983346 - DNA, 23 bp, Homo sapiens
gcagaggtaaaagtgtgagcagt

SEQ ID NO: 1983347 - DNA, 23 bp, Homo sapiens
gcagaggtggccagagctgggag

SEQ ID NO: 1983348 - DNA, 19 bp, Homo sapiens
gcagagtgaggatgtgttt

SEQ ID NO: 1983349 - DNA, 17 bp, Homo sapiens
gcagagtgggctgcctg

SEQ ID NO: 1983350 - DNA, 22 bp, Homo sapiens
gcagagtgggctgcctggggat

SEQ ID NO: 1983351 - DNA, 17 bp, Homo sapiens
gcagatagccagacaca

SEQ ID NO: 1983352 - DNA, 19 bp, Homo sapiens
gcagatcatgtaaggaagg

SEQ ID NO: 1983353 - DNA, 12 bp, Homo sapiens
gcagatgggctg

SEQ ID NO: 1983354 - DNA, 14 bp, Homo sapiens
gcagattcctgggc

SEQ ID NO: 1983355 - DNA, 11 bp, Homo sapiens
gcagcaactcc

SEQ ID NO: 1983356 - DNA, 14 bp, Homo sapiens
gcagcaactcccac

SEQ ID NO: 1983357 - DNA, 22 bp, Homo sapiens
gcagcacatggtgttgtatact

SEQ ID NO: 1983358 - DNA, 13 bp, Homo sapiens
gcagcaccctccc

SEQ ID NO: 1983359 - DNA, 15 bp, Homo sapiens
gcagcaccctccccc

SEQ ID NO: 1983360 - DNA, 18 bp, Homo sapiens
gcagcactttaaccctct

SEQ ID NO: 1983361 - DNA, 11 bp, Homo sapiens
gcagcagaagc

SEQ ID NO: 1983362 - DNA, 13 bp, Homo sapiens
gcagcagaagcca

SEQ ID NO: 1983363 - DNA, 14 bp, Homo sapiens
gcagcagagagccc

SEQ ID NO: 1983364 - DNA, 16 bp, Homo sapiens
gcagcagagagccctg

SEQ ID NO: 1983365 - DNA, 15 bp, Homo sapiens
gcagcagccagccct

SEQ ID NO: 1983366 - DNA, 19 bp, Homo sapiens
gcagcagccagccctgcct

SEQ ID NO: 1983367 - DNA, 20 bp, Homo sapiens
gcagcagccagccctgcctg

SEQ ID NO: 1983368 - DNA, 22 bp, Homo sapiens
gcagcagccagccctgcctgga

SEQ ID NO: 1983369 - DNA, 12 bp, Homo sapiens
gcagcagctcag

SEQ ID NO: 1983370 - DNA, 17 bp, Homo sapiens
gcagcagctcagcctcc

SEQ ID NO: 1983371 - DNA, 15 bp, Homo sapiens
gcagcagctgggacc

SEQ ID NO: 1983372 - DNA, 19 bp, Homo sapiens
gcagcaggtgcaagagaca

SEQ ID NO: 1983373 - DNA, 18 bp, Homo sapiens
gcagcagttccatgaaga

SEQ ID NO: 1983374 - DNA, 20 bp, Homo sapiens
gcagcagttccatgaagaca

SEQ ID NO: 1983375 - DNA, 17 bp, Homo sapiens
gcagcatgtggggaagc

SEQ ID NO: 1983376 - DNA, 20 bp, Homo sapiens
gcagcattcagcacacccca

SEQ ID NO: 1983377 - DNA, 21 bp, Homo sapiens
gcagcattcagcacaccccaa

SEQ ID NO: 1983378 - DNA, 20 bp, Homo sapiens
gcagccacacttctcaggac

SEQ ID NO: 1983379 - DNA, 21 bp, Homo sapiens
gcagccacacttctcaggaca

SEQ ID NO: 1983380 - DNA, 12 bp, Homo sapiens
gcagccaccctg

SEQ ID NO: 1983381 - DNA, 16 bp, Homo sapiens
gcagccaccctgagga

SEQ ID NO: 1983382 - DNA, 23 bp, Homo sapiens
gcagccagccagtcttgcctagg

SEQ ID NO: 1983383 - DNA, 21 bp, Homo sapiens
gcagccagcccagcccagctg

SEQ ID NO: 1983384 - DNA, 13 bp, Homo sapiens
gcagccagccctg

SEQ ID NO: 1983385 - DNA, 16 bp, Homo sapiens
ctgccccagctctggc

SEQ ID NO: 1983386 - DNA, 13 bp, Homo sapiens
ctgccccatcctg

SEQ ID NO: 1983387 - DNA, 14 bp, Homo sapiens
ctgccccatcctgg

SEQ ID NO: 1983388 - DNA, 20 bp, Homo sapiens
ctgcccccatcccacatgat

SEQ ID NO: 1983389 - DNA, 14 bp, Homo sapiens
ctgcccccatctcc

SEQ ID NO: 1983390 - DNA, 22 bp, Homo sapiens
ctgccccctggtggacagtcct

SEQ ID NO: 1983391 - DNA, 16 bp, Homo sapiens
ctgccccgcccagctg

SEQ ID NO: 1983392 - DNA, 14 bp, Homo sapiens
ctgccccgcttccc

SEQ ID NO: 1983393 - DNA, 19 bp, Homo sapiens
ctgccccgcttccccacag

SEQ ID NO: 1983394 - DNA, 23 bp, Homo sapiens
ctgccccgggtccccagctcccc

SEQ ID NO: 1983395 - DNA, 21 bp, Homo sapiens
ctgccccgggtgcctcagagc

SEQ ID NO: 1983396 - DNA, 16 bp, Homo sapiens
ctgccccgttccctgt

SEQ ID NO: 1983397 - DNA, 19 bp, Homo sapiens
ctgccccgttccctgtcag

SEQ ID NO: 1983398 - DNA, 20 bp, Homo sapiens
ctgccccgttccctgtcaga

SEQ ID NO: 1983399 - DNA, 22 bp, Homo sapiens
ctgccccgttccctgtcagagg

SEQ ID NO: 1983400 - DNA, 18 bp, Homo sapiens
ctgcccctccccagccct

SEQ ID NO: 1983401 - DNA, 14 bp, Homo sapiens
ctgcccctcccttc

SEQ ID NO: 1983402 - DNA, 14 bp, Homo sapiens
ctgcccctcgcctt

SEQ ID NO: 1983403 - DNA, 18 bp, Homo sapiens
ctgcccctcttcccggga

SEQ ID NO: 1983404 - DNA, 14 bp, Homo sapiens
ctgccccttgggca

SEQ ID NO: 1983405 - DNA, 18 bp, Homo sapiens
ctgccccttgggcatcca

SEQ ID NO: 1983406 - DNA, 19 bp, Homo sapiens
ctgccccttgggcatccac

SEQ ID NO: 1983407 - DNA, 17 bp, Homo sapiens
ctgcccgcagagcccac

SEQ ID NO: 1983408 - DNA, 15 bp, Homo sapiens
ctgcccggctgcgga

SEQ ID NO: 1983409 - DNA, 15 bp, Homo sapiens
ctgcccgtcttcagc

SEQ ID NO: 1983410 - DNA, 16 bp, Homo sapiens
ctgcccgtcttcagcc

SEQ ID NO: 1983411 - DNA, 21 bp, Homo sapiens
ctgcccgtcttcagcctagcc

SEQ ID NO: 1983412 - DNA, 19 bp, Homo sapiens
ctgccctagagcacactgt

SEQ ID NO: 1983413 - DNA, 21 bp, Homo sapiens
ctgccctcccacctccgctgg

SEQ ID NO: 1983414 - DNA, 13 bp, Homo sapiens
ctgccctctctca

SEQ ID NO: 1983415 - DNA, 20 bp, Homo sapiens
ctgccctctctcagttattc

SEQ ID NO: 1983416 - DNA, 13 bp, Homo sapiens
ctgccctgccact

SEQ ID NO: 1983417 - DNA, 15 bp, Homo sapiens
ctgccctgccctgcc

SEQ ID NO: 1983418 - DNA, 13 bp, Homo sapiens
ctgccctgcctcc

SEQ ID NO: 1983419 - DNA, 12 bp, Homo sapiens
ctgccctgcctg

SEQ ID NO: 1983420 - DNA, 15 bp, Homo sapiens
ctgccctgcctgccc

SEQ ID NO: 1983421 - DNA, 17 bp, Homo sapiens
ctgccctgcctgcccac

SEQ ID NO: 1983422 - DNA, 11 bp, Homo sapiens
ctgccctgctg

SEQ ID NO: 1983423 - DNA, 21 bp, Homo sapiens
ctgccctgctgccgcctccca

SEQ ID NO: 1983424 - DNA, 22 bp, Homo sapiens
ctgccctgctgccgcctcccag

SEQ ID NO: 1983425 - DNA, 12 bp, Homo sapiens
ctgccctggagg

SEQ ID NO: 1983426 - DNA, 17 bp, Homo sapiens
ctgccctggagggaggc

SEQ ID NO: 1983427 - DNA, 15 bp, Homo sapiens
ctgccctggtgctgc

SEQ ID NO: 1983428 - DNA, 17 bp, Homo sapiens
ctgccctggtgctgcca

SEQ ID NO: 1983429 - DNA, 19 bp, Homo sapiens
ctgccctggtgctgccaca

SEQ ID NO: 1983430 - DNA, 21 bp, Homo sapiens
ctgccctgtaccccagcactt

SEQ ID NO: 1983431 - DNA, 13 bp, Homo sapiens
ctgccctgtatat

SEQ ID NO: 1983432 - DNA, 16 bp, Homo sapiens
ctgccctgtcctccag

SEQ ID NO: 1983433 - DNA, 19 bp, Homo sapiens
ctgccctgttgtgtataga

SEQ ID NO: 1983434 - DNA, 14 bp, Homo sapiens
ctgcccttcgctgc

SEQ ID NO: 1983435 - DNA, 20 bp, Homo sapiens
ctgcccttcgctgccaggac

SEQ ID NO: 1983436 - DNA, 16 bp, Homo sapiens
ctgccgaccagagccc

SEQ ID NO: 1983437 - DNA, 21 bp, Homo sapiens
ctgccgagcaaccgtggccct

SEQ ID NO: 1983438 - DNA, 16 bp, Homo sapiens
ctgccgcaaggccctg

SEQ ID NO: 1983439 - DNA, 22 bp, Homo sapiens
ctgccgcaaggccctgtcccag

SEQ ID NO: 1983440 - DNA, 15 bp, Homo sapiens
ctgccgcccaaagag

SEQ ID NO: 1983441 - DNA, 18 bp, Homo sapiens
ctgccgcctcccagcctg

SEQ ID NO: 1983442 - DNA, 13 bp, Homo sapiens
ctgccgctgcacc

SEQ ID NO: 1983443 - DNA, 15 bp, Homo sapiens
ctgccgctgcaccac

SEQ ID NO: 1983444 - DNA, 19 bp, Homo sapiens
ctgccgctgccgctgcacc

SEQ ID NO: 1983445 - DNA, 19 bp, Homo sapiens
ctgcctaagtggctgctga

SEQ ID NO: 1983446 - DNA, 14 bp, Homo sapiens
ctgcctaataaaga

SEQ ID NO: 1983447 - DNA, 16 bp, Homo sapiens
ctgcctaataaagaga

SEQ ID NO: 1983448 - DNA, 18 bp, Homo sapiens
ctgcctaataaagagact

SEQ ID NO: 1983449 - DNA, 16 bp, Homo sapiens
ctgcctacattccctg

SEQ ID NO: 1983450 - DNA, 21 bp, Homo sapiens
ctgcctacattccctggcctg

SEQ ID NO: 1983451 - DNA, 19 bp, Homo sapiens
ctgcctaggaattcccagc

SEQ ID NO: 1983452 - DNA, 18 bp, Homo sapiens
ctgcctatttattggggt

SEQ ID NO: 1983453 - DNA, 21 bp, Homo sapiens
ctgcctcaatgtgaatcagac

SEQ ID NO: 1983454 - DNA, 19 bp, Homo sapiens
ctgcctcagcctcccaaag

SEQ ID NO: 1983455 - DNA, 16 bp, Homo sapiens
ctgcctcagcctctca

SEQ ID NO: 1983456 - DNA, 22 bp, Homo sapiens
ctgcctccaagatttcagaagc

SEQ ID NO: 1983457 - DNA, 14 bp, Homo sapiens
ctgcctccagaatg

SEQ ID NO: 1983458 - DNA, 17 bp, Homo sapiens
ctgcctcccagccctgc

SEQ ID NO: 1983459 - DNA, 20 bp, Homo sapiens
ctgcctcccagccctgccag

SEQ ID NO: 1983460 - DNA, 15 bp, Homo sapiens
ctgcctccctttctg

SEQ ID NO: 1983461 - DNA, 16 bp, Homo sapiens
ctgcctccctttctgg

SEQ ID NO: 1983462 - DNA, 20 bp, Homo sapiens
ctgcctccctttctgggagg

SEQ ID NO: 1983463 - DNA, 13 bp, Homo sapiens
ctgcctcctcttc

SEQ ID NO: 1983464 - DNA, 24 bp, Homo sapiens
ctgcctcctcttcaactgaccagc

SEQ ID NO: 1983465 - DNA, 17 bp, Homo sapiens
ctgcctcgaactggctg

SEQ ID NO: 1983466 - DNA, 20 bp, Homo sapiens
ctgcctcgaactggctgcaa

SEQ ID NO: 1983467 - DNA, 17 bp, Homo sapiens
ctgcctctactgggaag

SEQ ID NO: 1983468 - DNA, 16 bp, Homo sapiens
ctgcctctcacacaca

SEQ ID NO: 1983469 - DNA, 15 bp, Homo sapiens
ctgcctctccccaaa

SEQ ID NO: 1983470 - DNA, 16 bp, Homo sapiens
ctgcctctctgctcca

SEQ ID NO: 1983471 - DNA, 15 bp, Homo sapiens
ctgcctctgacacac

SEQ ID NO: 1983472 - DNA, 22 bp, Homo sapiens
ctgcctctgacacacagctctg

SEQ ID NO: 1983473 - DNA, 16 bp, Homo sapiens
ctgcctctgccatgcc

SEQ ID NO: 1983474 - DNA, 17 bp, Homo sapiens
ctgcctctgccatgccc

SEQ ID NO: 1983475 - DNA, 21 bp, Homo sapiens
atttaacataggttttgattt

SEQ ID NO: 1983476 - DNA, 13 bp, Homo sapiens
atttaactggctt

SEQ ID NO: 1983477 - DNA, 23 bp, Homo sapiens
atttaacttgagggtaataaact

SEQ ID NO: 1983478 - DNA, 17 bp, Homo sapiens
atttaacttttagtaaa

SEQ ID NO: 1983479 - DNA, 21 bp, Homo sapiens
atttaagaaggagttctgaca

SEQ ID NO: 1983480 - DNA, 15 bp, Homo sapiens
atttaagatagtttt

SEQ ID NO: 1983481 - DNA, 17 bp, Homo sapiens
atttaagcctcatattt

SEQ ID NO: 1983482 - DNA, 17 bp, Homo sapiens
atttaagccttttgtgt

SEQ ID NO: 1983483 - DNA, 20 bp, Homo sapiens
atttaagccttttgtgtaat

SEQ ID NO: 1983484 - DNA, 14 bp, Homo sapiens
atttaagggaaaaa

SEQ ID NO: 1983485 - DNA, 18 bp, Homo sapiens
atttaagggaaaaatata

SEQ ID NO: 1983486 - DNA, 12 bp, Homo sapiens
atttaagtttgt

SEQ ID NO: 1983487 - DNA, 14 bp, Homo sapiens
atttaataaatgta

SEQ ID NO: 1983488 - DNA, 20 bp, Homo sapiens
atttaatagcaaagaattga

SEQ ID NO: 1983489 - DNA, 19 bp, Homo sapiens
atttaatatagctattttt

SEQ ID NO: 1983490 - DNA, 19 bp, Homo sapiens
atttaatggccaaatggtt

SEQ ID NO: 1983491 - DNA, 20 bp, Homo sapiens
atttaatggtttttatttct

SEQ ID NO: 1983492 - DNA, 12 bp, Homo sapiens
atttaatgtttg

SEQ ID NO: 1983493 - DNA, 14 bp, Homo sapiens
atttaatgtttgat

SEQ ID NO: 1983494 - DNA, 19 bp, Homo sapiens
atttaatgtttgatttagt

SEQ ID NO: 1983495 - DNA, 16 bp, Homo sapiens
atttaatgttttctgc

SEQ ID NO: 1983496 - DNA, 14 bp, Homo sapiens
atttaattcataat

SEQ ID NO: 1983497 - DNA, 18 bp, Homo sapiens
atttaattcataattaga

SEQ ID NO: 1983498 - DNA, 23 bp, Homo sapiens
atttaattcataattagaacaat

SEQ ID NO: 1983499 - DNA, 17 bp, Homo sapiens
atttaattctgaaatca

SEQ ID NO: 1983500 - DNA, 22 bp, Homo sapiens
atttaattttcctggaaagact

SEQ ID NO: 1983501 - DNA, 19 bp, Homo sapiens
atttaatttttttgagaca

SEQ ID NO: 1983502 - DNA, 23 bp, Homo sapiens
atttaatttttttgagacagagt

SEQ ID NO: 1983503 - DNA, 17 bp, Homo sapiens
atttacaataaatattc

SEQ ID NO: 1983504 - DNA, 18 bp, Homo sapiens
atttacaataaatattct

SEQ ID NO: 1983505 - DNA, 16 bp, Homo sapiens
atttacagagaagtga

SEQ ID NO: 1983506 - DNA, 14 bp, Homo sapiens
atttacatatgaaa

SEQ ID NO: 1983507 - DNA, 15 bp, Homo sapiens
atttaccacagcagc

SEQ ID NO: 1983508 - DNA, 16 bp, Homo sapiens
atttacgactgaagaa

SEQ ID NO: 1983509 - DNA, 14 bp, Homo sapiens
atttactaaaagaa

SEQ ID NO: 1983510 - DNA, 23 bp, Homo sapiens
atttactaagccacaagaaattt

SEQ ID NO: 1983511 - DNA, 20 bp, Homo sapiens
atttactgagcttctctgtg

SEQ ID NO: 1983512 - DNA, 17 bp, Homo sapiens
atttactgtgagactgt

SEQ ID NO: 1983513 - DNA, 20 bp, Homo sapiens
atttagaaaacattcatcca

SEQ ID NO: 1983514 - DNA, 14 bp, Homo sapiens
atttagaactgtat

SEQ ID NO: 1983515 - DNA, 14 bp, Homo sapiens
atttagaatatatt

SEQ ID NO: 1983516 - DNA, 20 bp, Homo sapiens
atttagaatatattaaatcg

SEQ ID NO: 1983517 - DNA, 13 bp, Homo sapiens
atttagaccctgt

SEQ ID NO: 1983518 - DNA, 21 bp, Homo sapiens
atttaggtttctgagttcctg

SEQ ID NO: 1983519 - DNA, 23 bp, Homo sapiens
atttaggtttctgagttcctgca

SEQ ID NO: 1983520 - DNA, 22 bp, Homo sapiens
atttagtaatagtccaatattt

SEQ ID NO: 1983521 - DNA, 15 bp, Homo sapiens
atttagtgaactacg

SEQ ID NO: 1983522 - DNA, 16 bp, Homo sapiens
atttagttctttgtta

SEQ ID NO: 1983523 - DNA, 20 bp, Homo sapiens
ctgccttgaagccactgaag

SEQ ID NO: 1983524 - DNA, 18 bp, Homo sapiens
ctgccttgatgaagcccg

SEQ ID NO: 1983525 - DNA, 18 bp, Homo sapiens
ctgccttgatgaagcctg

SEQ ID NO: 1983526 - DNA, 20 bp, Homo sapiens
ctgccttgatgaagcctgtg

SEQ ID NO: 1983527 - DNA, 23 bp, Homo sapiens
ctgccttgatgaagcctgtgcca

SEQ ID NO: 1983528 - DNA, 24 bp, Homo sapiens
ctgccttgatgaagcctgtgccac

SEQ ID NO: 1983529 - DNA, 14 bp, Homo sapiens
ctgccttgtgtaca

SEQ ID NO: 1983530 - DNA, 17 bp, Homo sapiens
ctgcctttctcccccga

SEQ ID NO: 1983531 - DNA, 16 bp, Homo sapiens
ctgccttttgctgctg

SEQ ID NO: 1983532 - DNA, 18 bp, Homo sapiens
ctgccttttgctgctgct

SEQ ID NO: 1983533 - DNA, 17 bp, Homo sapiens
ctgccttttttcacagc

SEQ ID NO: 1983534 - DNA, 17 bp, Homo sapiens
ctgcgaaggggccctgg

SEQ ID NO: 1983535 - DNA, 19 bp, Homo sapiens
ctgcgagatcgctggcaga

SEQ ID NO: 1983536 - DNA, 19 bp, Homo sapiens
ctgcgagcatttccctccc

SEQ ID NO: 1983537 - DNA, 20 bp, Homo sapiens
ctgcgagctccttgggtcct

SEQ ID NO: 1983538 - DNA, 19 bp, Homo sapiens
ctgcgatcttcagagcagg

SEQ ID NO: 1983539 - DNA, 20 bp, Homo sapiens
ctgcgctggacgatagcttg

SEQ ID NO: 1983540 - DNA, 15 bp, Homo sapiens
ctgcggagccggcac

SEQ ID NO: 1983541 - DNA, 16 bp, Homo sapiens
ctgcggccgggctgcc

SEQ ID NO: 1983542 - DNA, 20 bp, Homo sapiens
ctgcgggatggtcctggggc

SEQ ID NO: 1983543 - DNA, 22 bp, Homo sapiens
ctgcgggatggtcctggggctc

SEQ ID NO: 1983544 - DNA, 17 bp, Homo sapiens
ctgcgggtctgaaggaa

SEQ ID NO: 1983545 - DNA, 14 bp, Homo sapiens
ctgcgggttttaat

SEQ ID NO: 1983546 - DNA, 15 bp, Homo sapiens
ctgcggtccacccag

SEQ ID NO: 1983547 - DNA, 17 bp, Homo sapiens
ctgcggtccacccagga

SEQ ID NO: 1983548 - DNA, 20 bp, Homo sapiens
ctgcggtccacccaggagcc

SEQ ID NO: 1983549 - DNA, 23 bp, Homo sapiens
ctgcggtccacccaggagccccg

SEQ ID NO: 1983550 - DNA, 18 bp, Homo sapiens
ctgcgtcccccagccctc

SEQ ID NO: 1983551 - DNA, 22 bp, Homo sapiens
ctgcgtgactattttttaataa

SEQ ID NO: 1983552 - DNA, 16 bp, Homo sapiens
ctgcgttggagccact

SEQ ID NO: 1983553 - DNA, 18 bp, Homo sapiens
ctgctaaatactgtacat

SEQ ID NO: 1983554 - DNA, 19 bp, Homo sapiens
ctgctaaatactgtacata

SEQ ID NO: 1983555 - DNA, 21 bp, Homo sapiens
ctgctaaatactgtacataga

SEQ ID NO: 1983556 - DNA, 16 bp, Homo sapiens
ctgctaattccccaga

SEQ ID NO: 1983557 - DNA, 15 bp, Homo sapiens
ctgctacaccttagc

SEQ ID NO: 1983558 - DNA, 18 bp, Homo sapiens
ctgctaccaaggcccagc

SEQ ID NO: 1983559 - DNA, 12 bp, Homo sapiens
ctgctacctcac

SEQ ID NO: 1983560 - DNA, 13 bp, Homo sapiens
ctgctacctcact

SEQ ID NO: 1983561 - DNA, 20 bp, Homo sapiens
ctgctactacccgagcccag

SEQ ID NO: 1983562 - DNA, 19 bp, Homo sapiens
ctgctactcctgtgctctg

SEQ ID NO: 1983563 - DNA, 15 bp, Homo sapiens
ctgctagagcaaccc

SEQ ID NO: 1983564 - DNA, 14 bp, Homo sapiens
ctgctagcacttgg

SEQ ID NO: 1983565 - DNA, 19 bp, Homo sapiens
ctgctagctgtagaaatgt

SEQ ID NO: 1983566 - DNA, 15 bp, Homo sapiens
ctgctaggcgagtgc

SEQ ID NO: 1983567 - DNA, 19 bp, Homo sapiens
ctgctaggcgagtgccagg

SEQ ID NO: 1983568 - DNA, 23 bp, Homo sapiens
ctgctaggcgagtgccaggactc

SEQ ID NO: 1983569 - DNA, 23 bp, Homo sapiens
ctgctatattttcatgacttttc

SEQ ID NO: 1983570 - DNA, 21 bp, Homo sapiens
ctgctatggttttctccaaga

SEQ ID NO: 1983571 - DNA, 22 bp, Homo sapiens
ctgctattatgtaacatccaga

SEQ ID NO: 1983572 - DNA, 14 bp, Homo sapiens
ctgctatttgaagt

SEQ ID NO: 1983573 - DNA, 16 bp, Homo sapiens
ctgctcagaggggccc

SEQ ID NO: 1983574 - DNA, 21 bp, Homo sapiens
ctgctcagaggggccccggtc

SEQ ID NO: 1983575 - DNA, 23 bp, Homo sapiens
ctgctcaggaattgaagatgtaa

SEQ ID NO: 1983576 - DNA, 18 bp, Homo sapiens
ctgctcccatctgcacta

SEQ ID NO: 1983577 - DNA, 16 bp, Homo sapiens
ctgctccccagccctg

SEQ ID NO: 1983578 - DNA, 19 bp, Homo sapiens
ctgctccccagccctggct

SEQ ID NO: 1983579 - DNA, 14 bp, Homo sapiens
ctgctcccccaccc

SEQ ID NO: 1983580 - DNA, 23 bp, Homo sapiens
ctgctcccccaccccctccccag

SEQ ID NO: 1983581 - DNA, 23 bp, Homo sapiens
ctgctcctaaacccccgctccag

SEQ ID NO: 1983582 - DNA, 11 bp, Homo sapiens
ctgctcctcca

SEQ ID NO: 1983583 - DNA, 12 bp, Homo sapiens
ctgctcctccag

SEQ ID NO: 1983584 - DNA, 13 bp, Homo sapiens
ctgctcctccagg

SEQ ID NO: 1983585 - DNA, 13 bp, Homo sapiens
ctgctcctctcca

SEQ ID NO: 1983586 - DNA, 16 bp, Homo sapiens
ctgctcctctccaggc

SEQ ID NO: 1983587 - DNA, 16 bp, Homo sapiens
ctgctcctctccccag

SEQ ID NO: 1983588 - DNA, 19 bp, Homo sapiens
ctgctcctctccccagcaa

SEQ ID NO: 1983589 - DNA, 20 bp, Homo sapiens
ctgctcctctccccagcaag

SEQ ID NO: 1983590 - DNA, 17 bp, Homo sapiens
ctgctcgaagaacaatg

SEQ ID NO: 1983591 - DNA, 17 bp, Homo sapiens
ctgctcggggtgcacag

SEQ ID NO: 1983592 - DNA, 18 bp, Homo sapiens
ctgctcggggtgcacagg

SEQ ID NO: 1983593 - DNA, 23 bp, Homo sapiens
ctgctcggggtgcacaggagggg

SEQ ID NO: 1983594 - DNA, 22 bp, Homo sapiens
ctgctcgtccccaagtgaccta

SEQ ID NO: 1983595 - DNA, 23 bp, Homo sapiens
ctgctctagccaggagtctgtgc

SEQ ID NO: 1983596 - DNA, 15 bp, Homo sapiens
ctgctctagctggca

SEQ ID NO: 1983597 - DNA, 17 bp, Homo sapiens
ctgctctagctggcagg

SEQ ID NO: 1983598 - DNA, 20 bp, Homo sapiens
ctgctctagctggcaggaca

SEQ ID NO: 1983599 - DNA, 22 bp, Homo sapiens
ctgctctagctggcaggacaca

SEQ ID NO: 1983600 - DNA, 15 bp, Homo sapiens
ctgctctattgtagc

SEQ ID NO: 1983601 - DNA, 18 bp, Homo sapiens
tattactgtctggtttta

SEQ ID NO: 1983602 - DNA, 23 bp, Homo sapiens
tattacttatttttgacagtgtt

SEQ ID NO: 1983603 - DNA, 14 bp, Homo sapiens
tattacttctgcta

SEQ ID NO: 1983604 - DNA, 21 bp, Homo sapiens
tattacttgaactttccaaaa

SEQ ID NO: 1983605 - DNA, 21 bp, Homo sapiens
tattacttgttgcaaaggtct

SEQ ID NO: 1983606 - DNA, 21 bp, Homo sapiens
tattagagtgcccttaaaata

SEQ ID NO: 1983607 - DNA, 24 bp, Homo sapiens
tattagagtgcccttaaaataatg

SEQ ID NO: 1983608 - DNA, 22 bp, Homo sapiens
tattagctgtaaatacatgtgt

SEQ ID NO: 1983609 - DNA, 21 bp, Homo sapiens
tattagttaggtgtgccaaac

SEQ ID NO: 1983610 - DNA, 18 bp, Homo sapiens
tattagttttctttgtaa

SEQ ID NO: 1983611 - DNA, 15 bp, Homo sapiens
tattataaaaccatg

SEQ ID NO: 1983612 - DNA, 15 bp, Homo sapiens
tattataaataaatg

SEQ ID NO: 1983613 - DNA, 19 bp, Homo sapiens
tattataaataaatgccaa

SEQ ID NO: 1983614 - DNA, 16 bp, Homo sapiens
tattataacttaaaaa

SEQ ID NO: 1983615 - DNA, 12 bp, Homo sapiens
tattataattta

SEQ ID NO: 1983616 - DNA, 19 bp, Homo sapiens
tattataatttttttcaat

SEQ ID NO: 1983617 - DNA, 13 bp, Homo sapiens
tattatcctgcat

SEQ ID NO: 1983618 - DNA, 23 bp, Homo sapiens
tattatggcaagtgatatcacct

SEQ ID NO: 1983619 - DNA, 16 bp, Homo sapiens
tattatggtgtaatgc

SEQ ID NO: 1983620 - DNA, 19 bp, Homo sapiens
tattatggtgtaatgcaca

SEQ ID NO: 1983621 - DNA, 21 bp, Homo sapiens
tattatggtgtaatgcacaat

SEQ ID NO: 1983622 - DNA, 15 bp, Homo sapiens
tattattagattctc

SEQ ID NO: 1983623 - DNA, 12 bp, Homo sapiens
tattattgttct

SEQ ID NO: 1983624 - DNA, 15 bp, Homo sapiens
tattatttacaatgc

SEQ ID NO: 1983625 - DNA, 13 bp, Homo sapiens
tattatttatata

SEQ ID NO: 1983626 - DNA, 15 bp, Homo sapiens
tattattttcacctg

SEQ ID NO: 1983627 - DNA, 16 bp, Homo sapiens
tattattttctatagc

SEQ ID NO: 1983628 - DNA, 13 bp, Homo sapiens
tattcaaatgaag

SEQ ID NO: 1983629 - DNA, 17 bp, Homo sapiens
tattcaagtgcctcttg

SEQ ID NO: 1983630 - DNA, 19 bp, Homo sapiens
tattcaagtgcctcttgtt

SEQ ID NO: 1983631 - DNA, 16 bp, Homo sapiens
tattcaagttattgta

SEQ ID NO: 1983632 - DNA, 20 bp, Homo sapiens
tattcaagttattgtacagc

SEQ ID NO: 1983633 - DNA, 13 bp, Homo sapiens
tattcaataaagc

SEQ ID NO: 1983634 - DNA, 14 bp, Homo sapiens
tattcaataaagct

SEQ ID NO: 1983635 - DNA, 15 bp, Homo sapiens
tattcaattcctctg

SEQ ID NO: 1983636 - DNA, 20 bp, Homo sapiens
tattcagatcgtattaatta

SEQ ID NO: 1983637 - DNA, 19 bp, Homo sapiens
tattcagcttcatttgtgt

SEQ ID NO: 1983638 - DNA, 12 bp, Homo sapiens
tattcaggactt

SEQ ID NO: 1983639 - DNA, 15 bp, Homo sapiens
tattcagtgctgtgg

SEQ ID NO: 1983640 - DNA, 19 bp, Homo sapiens
tattcataataaactagat

SEQ ID NO: 1983641 - DNA, 14 bp, Homo sapiens
tattcatgccatct

SEQ ID NO: 1983642 - DNA, 16 bp, Homo sapiens
tattcatgctttctcc

SEQ ID NO: 1983643 - DNA, 15 bp, Homo sapiens
tattcatgtaataaa

SEQ ID NO: 1983644 - DNA, 16 bp, Homo sapiens
tattcatgtaataaat

SEQ ID NO: 1983645 - DNA, 19 bp, Homo sapiens
tattcatgtaataaatctg

SEQ ID NO: 1983646 - DNA, 12 bp, Homo sapiens
tattcatttaaa

SEQ ID NO: 1983647 - DNA, 17 bp, Homo sapiens
tattcatttaaaatgat

SEQ ID NO: 1983648 - DNA, 19 bp, Homo sapiens
tattcatttaaaatgatta

SEQ ID NO: 1983649 - DNA, 16 bp, Homo sapiens
tattcatttttgttat

SEQ ID NO: 1983650 - DNA, 18 bp, Homo sapiens
tattccatatattagcat

SEQ ID NO: 1983651 - DNA, 19 bp, Homo sapiens
tattccatgggatgttaag

SEQ ID NO: 1983652 - DNA, 22 bp, Homo sapiens
tattcccaactgctctgcccac

SEQ ID NO: 1983653 - DNA, 17 bp, Homo sapiens
tattccccatcttccaa

SEQ ID NO: 1983654 - DNA, 22 bp, Homo sapiens
tattcccctatctctagaattt

SEQ ID NO: 1983655 - DNA, 21 bp, Homo sapiens
tattcctatatagtttattga

SEQ ID NO: 1983656 - DNA, 22 bp, Homo sapiens
tattcctatatagtttattgac

SEQ ID NO: 1983657 - DNA, 14 bp, Homo sapiens
tattcctgaatgaa

SEQ ID NO: 1983658 - DNA, 19 bp, Homo sapiens
tattcctgcatttgtgaaa

SEQ ID NO: 1983659 - DNA, 21 bp, Homo sapiens
tattccttttgtgtacagtgt

SEQ ID NO: 1983660 - DNA, 22 bp, Homo sapiens
tattctaaagctttctgacaag

SEQ ID NO: 1983661 - DNA, 16 bp, Homo sapiens
tattctacacatatat

SEQ ID NO: 1983662 - DNA, 18 bp, Homo sapiens
tattctacacatatatgt

SEQ ID NO: 1983663 - DNA, 15 bp, Homo sapiens
tattctcaccaggaa

SEQ ID NO: 1983664 - DNA, 13 bp, Homo sapiens
tattctcactcca

SEQ ID NO: 1983665 - DNA, 19 bp, Homo sapiens
tattctcactccaccaccc

SEQ ID NO: 1983666 - DNA, 22 bp, Homo sapiens
tattctcactccaccacccaaa

SEQ ID NO: 1983667 - DNA, 17 bp, Homo sapiens
tattctctcctcagact

SEQ ID NO: 1983668 - DNA, 12 bp, Homo sapiens
tattctcttcac

SEQ ID NO: 1983669 - DNA, 12 bp, Homo sapiens
tattctgagcct

SEQ ID NO: 1983670 - DNA, 13 bp, Homo sapiens
tattctgagcctt

SEQ ID NO: 1983671 - DNA, 23 bp, Homo sapiens
tattctggaaaaaaaatatatat

SEQ ID NO: 1983672 - DNA, 14 bp, Homo sapiens
tattctgtgttgaa

SEQ ID NO: 1983673 - DNA, 16 bp, Homo sapiens
tattctgttggccagt

SEQ ID NO: 1983674 - DNA, 16 bp, Homo sapiens
tattcttcatcagcat

SEQ ID NO: 1983675 - DNA, 17 bp, Homo sapiens
tattcttggagaacttt

SEQ ID NO: 1983676 - DNA, 15 bp, Homo sapiens
tattgaactgagcca

SEQ ID NO: 1983677 - DNA, 18 bp, Homo sapiens
tattgaacttggaaagaa

SEQ ID NO: 1983678 - DNA, 22 bp, Homo sapiens
tattgaagaaacagataccata

SEQ ID NO: 1983679 - DNA, 13 bp, Homo sapiens
tattgaataagta

SEQ ID NO: 1983680 - DNA, 13 bp, Homo sapiens
tattgaatatatc

SEQ ID NO: 1983681 - DNA, 21 bp, Homo sapiens
tattgaatatatcagaatctg

SEQ ID NO: 1983682 - DNA, 18 bp, Homo sapiens
tattgatgtttccagaaa

SEQ ID NO: 1983683 - DNA, 19 bp, Homo sapiens
tattgcactatgaaaatca

SEQ ID NO: 1983684 - DNA, 15 bp, Homo sapiens
tattgcagttataga

SEQ ID NO: 1983685 - DNA, 18 bp, Homo sapiens
tattgcatgtaaaatgca

SEQ ID NO: 1983686 - DNA, 13 bp, Homo sapiens
tattgcccacgct

SEQ ID NO: 1983687 - DNA, 21 bp, Homo sapiens
tattgcttgatacttttgaca

SEQ ID NO: 1983688 - DNA, 15 bp, Homo sapiens
tattggaccagaagt

SEQ ID NO: 1983689 - DNA, 16 bp, Homo sapiens
tattggaccagaagtc

SEQ ID NO: 1983690 - DNA, 22 bp, Homo sapiens
tattggtaacatcctttctatt

SEQ ID NO: 1983691 - DNA, 16 bp, Homo sapiens
tattgtaaacatgtgt

SEQ ID NO: 1983692 - DNA, 15 bp, Homo sapiens
tattgtaaatattgt

SEQ ID NO: 1983693 - DNA, 14 bp, Homo sapiens
tattgtaatgaata

SEQ ID NO: 1983694 - DNA, 11 bp, Homo sapiens
tattgtacctc

SEQ ID NO: 1983695 - DNA, 16 bp, Homo sapiens
tattgtagcatttctt

SEQ ID NO: 1983696 - DNA, 17 bp, Homo sapiens
tattgtagcatttcttg

SEQ ID NO: 1983697 - DNA, 22 bp, Homo sapiens
tattgtataagattagaatgaa

SEQ ID NO: 1983698 - DNA, 19 bp, Homo sapiens
tattgtatattctggaaaa

SEQ ID NO: 1983699 - DNA, 20 bp, Homo sapiens
tattgtatattctggaaaaa

SEQ ID NO: 1983700 - DNA, 16 bp, Homo sapiens
tattgtattaagggca

SEQ ID NO: 1983701 - DNA, 18 bp, Homo sapiens
tattgtccttcagagctc

SEQ ID NO: 1983702 - DNA, 13 bp, Homo sapiens
tattgtgatctat

SEQ ID NO: 1983703 - DNA, 17 bp, Homo sapiens
tattgtgcaatgtaaat

SEQ ID NO: 1983704 - DNA, 14 bp, Homo sapiens
tattgtgttgcctt

SEQ ID NO: 1983705 - DNA, 21 bp, Homo sapiens
tattgtttaaaaacaggaaaa

SEQ ID NO: 1983706 - DNA, 24 bp, Homo sapiens
tattgtttattctttttaaagtat

SEQ ID NO: 1983707 - DNA, 16 bp, Homo sapiens
tattgttttatgttct

SEQ ID NO: 1983708 - DNA, 16 bp, Homo sapiens
tatttaaaaaactaaa

SEQ ID NO: 1983709 - DNA, 21 bp, Homo sapiens
tatttaaaaaactaaaaacta

SEQ ID NO: 1983710 - DNA, 14 bp, Homo sapiens
tatttaaaaaataa

SEQ ID NO: 1983711 - DNA, 15 bp, Homo sapiens
tatttaaaaaataaa

SEQ ID NO: 1983712 - DNA, 23 bp, Homo sapiens
tatttaaaagtataaaactgctt

SEQ ID NO: 1983713 - DNA, 14 bp, Homo sapiens
tatttaaaatagca

SEQ ID NO: 1983714 - DNA, 19 bp, Homo sapiens
tatttaaaccgctaaaaga

SEQ ID NO: 1983715 - DNA, 18 bp, Homo sapiens
tatttaaatgttgaaatc

SEQ ID NO: 1983716 - DNA, 13 bp, Homo sapiens
tcaaaactgcact

SEQ ID NO: 1983717 - DNA, 19 bp, Homo sapiens
tcaaaagaatcagaaacag

SEQ ID NO: 1983718 - DNA, 17 bp, Homo sapiens
tcaaaagacatgttgta

SEQ ID NO: 1983719 - DNA, 18 bp, Homo sapiens
tcaaaagcaaatgagatc

SEQ ID NO: 1983720 - DNA, 21 bp, Homo sapiens
tcaaaagcacttgttccttct

SEQ ID NO: 1983721 - DNA, 23 bp, Homo sapiens
tcaaaagcacttgttccttctgc

SEQ ID NO: 1983722 - DNA, 12 bp, Homo sapiens
tcaaaagctgct

SEQ ID NO: 1983723 - DNA, 14 bp, Homo sapiens
tcaaaataaattga

SEQ ID NO: 1983724 - DNA, 16 bp, Homo sapiens
tcaaaatatttgtaca

SEQ ID NO: 1983725 - DNA, 21 bp, Homo sapiens
tcaaaatcactatctttctga

SEQ ID NO: 1983726 - DNA, 18 bp, Homo sapiens
tcaaaatgttcgtattct

SEQ ID NO: 1983727 - DNA, 13 bp, Homo sapiens
tcaaaccaggatt

SEQ ID NO: 1983728 - DNA, 14 bp, Homo sapiens
tcaaaccatttaat

SEQ ID NO: 1983729 - DNA, 16 bp, Homo sapiens
tcaaaccatttaattc

SEQ ID NO: 1983730 - DNA, 19 bp, Homo sapiens
tcaaaccatttaattcata

SEQ ID NO: 1983731 - DNA, 20 bp, Homo sapiens
tcaaaccatttaattcataa

SEQ ID NO: 1983732 - DNA, 19 bp, Homo sapiens
tcaaaccccgaccacctgc

SEQ ID NO: 1983733 - DNA, 20 bp, Homo sapiens
tcaaaccccgaccacctgcc

SEQ ID NO: 1983734 - DNA, 23 bp, Homo sapiens
tcaaaccccgaccacctgcccaa

SEQ ID NO: 1983735 - DNA, 13 bp, Homo sapiens
tcaaactcaaggt

SEQ ID NO: 1983736 - DNA, 23 bp, Homo sapiens
tcaaactgagtaaattggaaaca

SEQ ID NO: 1983737 - DNA, 20 bp, Homo sapiens
tcaaacttgtgctgagaata

SEQ ID NO: 1983738 - DNA, 19 bp, Homo sapiens
tcaaagaaatgctgatgga

SEQ ID NO: 1983739 - DNA, 16 bp, Homo sapiens
tcaaagaaggatggca

SEQ ID NO: 1983740 - DNA, 13 bp, Homo sapiens
tcaaagcaagggc

SEQ ID NO: 1983741 - DNA, 17 bp, Homo sapiens
tcaaagcaagggctcca

SEQ ID NO: 1983742 - DNA, 18 bp, Homo sapiens
tcaaagcaagggctccag

SEQ ID NO: 1983743 - DNA, 19 bp, Homo sapiens
tcaaagcaagggctccagc

SEQ ID NO: 1983744 - DNA, 18 bp, Homo sapiens
tcaaagccggttgcagag

SEQ ID NO: 1983745 - DNA, 14 bp, Homo sapiens
tcaaagcttgaaga

SEQ ID NO: 1983746 - DNA, 15 bp, Homo sapiens
tcaaagctttttcca

SEQ ID NO: 1983747 - DNA, 12 bp, Homo sapiens
tcaaaggaagac

SEQ ID NO: 1983748 - DNA, 14 bp, Homo sapiens
tcaaagtaaaactt

SEQ ID NO: 1983749 - DNA, 19 bp, Homo sapiens
tcaaagtaaaacttgctgc

SEQ ID NO: 1983750 - DNA, 18 bp, Homo sapiens
tcaaatatagagatattt

SEQ ID NO: 1983751 - DNA, 15 bp, Homo sapiens
tcaaatattaccaaa

SEQ ID NO: 1983752 - DNA, 23 bp, Homo sapiens
tcaaatccccggctgcttccttc

SEQ ID NO: 1983753 - DNA, 15 bp, Homo sapiens
tcaaatctattcaga

SEQ ID NO: 1983754 - DNA, 18 bp, Homo sapiens
tcaaatctattcagacaa

SEQ ID NO: 1983755 - DNA, 12 bp, Homo sapiens
tcaaatctgtat

SEQ ID NO: 1983756 - DNA, 20 bp, Homo sapiens
tcaaatctgtatatgttgta

SEQ ID NO: 1983757 - DNA, 21 bp, Homo sapiens
tcaaatctgtatatgttgtaa

SEQ ID NO: 1983758 - DNA, 13 bp, Homo sapiens
tcaaatgctaaat

SEQ ID NO: 1983759 - DNA, 16 bp, Homo sapiens
tcaaatgctaaatgca

SEQ ID NO: 1983760 - DNA, 15 bp, Homo sapiens
tcaaatgtcagagct

SEQ ID NO: 1983761 - DNA, 15 bp, Homo sapiens
tcaaattgttaggaa

SEQ ID NO: 1983762 - DNA, 15 bp, Homo sapiens
tcaacaaagaaatat

SEQ ID NO: 1983763 - DNA, 15 bp, Homo sapiens
tcaacaaagcacagt

SEQ ID NO: 1983764 - DNA, 20 bp, Homo sapiens
tcaacaagaatattgtatgt

SEQ ID NO: 1983765 - DNA, 14 bp, Homo sapiens
tcaacacattactt

SEQ ID NO: 1983766 - DNA, 17 bp, Homo sapiens
tcaacacattacttgca

SEQ ID NO: 1983767 - DNA, 16 bp, Homo sapiens
tcaacagttcaaagaa

SEQ ID NO: 1983768 - DNA, 15 bp, Homo sapiens
tcaacatctaagcct

SEQ ID NO: 1983769 - DNA, 18 bp, Homo sapiens
tcaacattcaaagcagca

SEQ ID NO: 1983770 - DNA, 11 bp, Homo sapiens
tcaaccactgt

SEQ ID NO: 1983771 - DNA, 23 bp, Homo sapiens
tcaaccactgtaaaatgaaatta

SEQ ID NO: 1983772 - DNA, 14 bp, Homo sapiens
tcaaccagcatttt

SEQ ID NO: 1983773 - DNA, 15 bp, Homo sapiens
tcaaccattccccat

SEQ ID NO: 1983774 - DNA, 20 bp, Homo sapiens
tcaaccccaccacttctttt

SEQ ID NO: 1983775 - DNA, 11 bp, Homo sapiens
tcaaccccaga

SEQ ID NO: 1983776 - DNA, 23 bp, Homo sapiens
tcaaccccttcgctcctgtgtct

SEQ ID NO: 1983777 - DNA, 18 bp, Homo sapiens
tcaacctaccaccccttc

SEQ ID NO: 1983778 - DNA, 20 bp, Homo sapiens
tcaacctaccaccccttcct

SEQ ID NO: 1983779 - DNA, 21 bp, Homo sapiens
tcaacctaccaccccttcctg

SEQ ID NO: 1983780 - DNA, 23 bp, Homo sapiens
tcaacctaccaccccttcctgtc

SEQ ID NO: 1983781 - DNA, 14 bp, Homo sapiens
tcaacctcctgggc

SEQ ID NO: 1983782 - DNA, 15 bp, Homo sapiens
tcaacctcctgggct

SEQ ID NO: 1983783 - DNA, 19 bp, Homo sapiens
tcaacctggtggcaccaga

SEQ ID NO: 1983784 - DNA, 18 bp, Homo sapiens
tcaacgcagccctgcttt

SEQ ID NO: 1983785 - DNA, 19 bp, Homo sapiens
tcaactggacatcacagca

SEQ ID NO: 1983786 - DNA, 22 bp, Homo sapiens
tcaactggacatcacagcagaa

SEQ ID NO: 1983787 - DNA, 15 bp, Homo sapiens
tcaactggctgggac

SEQ ID NO: 1983788 - DNA, 15 bp, Homo sapiens
tcaacttaaatcact

SEQ ID NO: 1983789 - DNA, 16 bp, Homo sapiens
tcaacttaaatcactg

SEQ ID NO: 1983790 - DNA, 17 bp, Homo sapiens
tcaacttggaaaaagaa

SEQ ID NO: 1983791 - DNA, 21 bp, Homo sapiens
tcaactttagtatttttacta

SEQ ID NO: 1983792 - DNA, 23 bp, Homo sapiens
tcaagaaaaaataaatggaaatc

SEQ ID NO: 1983793 - DNA, 21 bp, Homo sapiens
tcaagaaaaattattgtataa

SEQ ID NO: 1983794 - DNA, 16 bp, Homo sapiens
tcaagaaaactggaaa

SEQ ID NO: 1983795 - DNA, 17 bp, Homo sapiens
tcaagaaaactggaaat

SEQ ID NO: 1983796 - DNA, 18 bp, Homo sapiens
tcaagaaactgaggaatt

SEQ ID NO: 1983797 - DNA, 20 bp, Homo sapiens
tcaagaaactgaggaatttt

SEQ ID NO: 1983798 - DNA, 21 bp, Homo sapiens
tcaagaaagcttcaaactgca

SEQ ID NO: 1983799 - DNA, 19 bp, Homo sapiens
tcaagaagacatggagact

SEQ ID NO: 1983800 - DNA, 16 bp, Homo sapiens
tcaagaccttctcccc

SEQ ID NO: 1983801 - DNA, 14 bp, Homo sapiens
tcaagaggcccagg

SEQ ID NO: 1983802 - DNA, 20 bp, Homo sapiens
tcaagagggcactggtggcc

SEQ ID NO: 1983803 - DNA, 21 bp, Homo sapiens
tcaagagggcactggtggccc

SEQ ID NO: 1983804 - DNA, 15 bp, Homo sapiens
tcaagatgacagctc

SEQ ID NO: 1983805 - DNA, 17 bp, Homo sapiens
tcaagatgacagctctt

SEQ ID NO: 1983806 - DNA, 20 bp, Homo sapiens
tcaagattatattataataa

SEQ ID NO: 1983807 - DNA, 14 bp, Homo sapiens
tcaagattgcaaag

SEQ ID NO: 1983808 - DNA, 17 bp, Homo sapiens
tcaagatttcaggatta

SEQ ID NO: 1983809 - DNA, 16 bp, Homo sapiens
tcaagcaccctgttcc

SEQ ID NO: 1983810 - DNA, 17 bp, Homo sapiens
tcaagcaccctgttccc

SEQ ID NO: 1983811 - DNA, 16 bp, Homo sapiens
tcaagcactaaaaagt

SEQ ID NO: 1983812 - DNA, 13 bp, Homo sapiens
tcaagcatgcaat

SEQ ID NO: 1983813 - DNA, 19 bp, Homo sapiens
tcaagccagcaacacagag

SEQ ID NO: 1983814 - DNA, 16 bp, Homo sapiens
tcaagccccggactca

SEQ ID NO: 1983815 - DNA, 15 bp, Homo sapiens
tcaagcgattcttct

SEQ ID NO: 1983816 - DNA, 16 bp, Homo sapiens
tcaagcgattcttctg

SEQ ID NO: 1983817 - DNA, 18 bp, Homo sapiens
tcaagcgattcttctgct

SEQ ID NO: 1983818 - DNA, 20 bp, Homo sapiens
tcaagcgattcttgtgcctc

SEQ ID NO: 1983819 - DNA, 18 bp, Homo sapiens
tcaagctagaaggccaca

SEQ ID NO: 1983820 - DNA, 19 bp, Homo sapiens
tcaagctagaaggccacat

SEQ ID NO: 1983821 - DNA, 20 bp, Homo sapiens
tcaagctagaaggccacatg

SEQ ID NO: 1983822 - DNA, 16 bp, Homo sapiens
tcaagctagccagagg

SEQ ID NO: 1983823 - DNA, 18 bp, Homo sapiens
tcaagctgtcccctctgt

SEQ ID NO: 1983824 - DNA, 15 bp, Homo sapiens
tcaaggaatcctgag

SEQ ID NO: 1983825 - DNA, 16 bp, Homo sapiens
tcaaggaatcctgagt

SEQ ID NO: 1983826 - DNA, 14 bp, Homo sapiens
tcaaggactcctgt

SEQ ID NO: 1983827 - DNA, 13 bp, Homo sapiens
tcaagggaagaaa

SEQ ID NO: 1983828 - DNA, 24 bp, Homo sapiens
tcaagtacataaagtacataacaa

SEQ ID NO: 1983829 - DNA, 15 bp, Homo sapiens
tcaagtcatgatgga

SEQ ID NO: 1983830 - DNA, 15 bp, Homo sapiens
tcaagtgaatctaaa

SEQ ID NO: 1983831 - DNA, 21 bp, Homo sapiens
tcacatacaatttgcactgtt

SEQ ID NO: 1983832 - DNA, 13 bp, Homo sapiens
tcacatacactca

SEQ ID NO: 1983833 - DNA, 14 bp, Homo sapiens
tcacataccctccc

SEQ ID NO: 1983834 - DNA, 22 bp, Homo sapiens
tcacatataaaagttaaactac

SEQ ID NO: 1983835 - DNA, 18 bp, Homo sapiens
tcacatatacaaaagcaa

SEQ ID NO: 1983836 - DNA, 15 bp, Homo sapiens
tcacatatctgtcat

SEQ ID NO: 1983837 - DNA, 17 bp, Homo sapiens
tcacatatgtctgtatc

SEQ ID NO: 1983838 - DNA, 18 bp, Homo sapiens
tcacatatgtctgtatct

SEQ ID NO: 1983839 - DNA, 14 bp, Homo sapiens
tcacatattctagt

SEQ ID NO: 1983840 - DNA, 18 bp, Homo sapiens
tcacatcaagcatgcaat

SEQ ID NO: 1983841 - DNA, 13 bp, Homo sapiens
tcacatcacagga

SEQ ID NO: 1983842 - DNA, 17 bp, Homo sapiens
tcacatccaatgcatag

SEQ ID NO: 1983843 - DNA, 19 bp, Homo sapiens
tcacattaatggtctaaaa

SEQ ID NO: 1983844 - DNA, 13 bp, Homo sapiens
tcacattcaggaa

SEQ ID NO: 1983845 - DNA, 23 bp, Homo sapiens
tcacattgtaactgaacttcagg

SEQ ID NO: 1983846 - DNA, 18 bp, Homo sapiens
tcacatttattctgctca

SEQ ID NO: 1983847 - DNA, 15 bp, Homo sapiens
tcacatttgatgtac

SEQ ID NO: 1983848 - DNA, 16 bp, Homo sapiens
tcacatttgatgtaca

SEQ ID NO: 1983849 - DNA, 22 bp, Homo sapiens
tcacatttgatgtacatgtgta

SEQ ID NO: 1983850 - DNA, 19 bp, Homo sapiens
tcacattttgcctttctcg

SEQ ID NO: 1983851 - DNA, 16 bp, Homo sapiens
tcaccaagctcacagt

SEQ ID NO: 1983852 - DNA, 12 bp, Homo sapiens
tcaccaataact

SEQ ID NO: 1983853 - DNA, 18 bp, Homo sapiens
tcaccaataacttcagag

SEQ ID NO: 1983854 - DNA, 19 bp, Homo sapiens
tcaccaataacttcagaga

SEQ ID NO: 1983855 - DNA, 21 bp, Homo sapiens
tcaccaataacttcagagaag

SEQ ID NO: 1983856 - DNA, 15 bp, Homo sapiens
tcaccaatgtaccca

SEQ ID NO: 1983857 - DNA, 16 bp, Homo sapiens
tcaccaccttcccagc

SEQ ID NO: 1983858 - DNA, 18 bp, Homo sapiens
tcaccagaattgtgcaaa

SEQ ID NO: 1983859 - DNA, 20 bp, Homo sapiens
tcaccagagcccatgctcaa

SEQ ID NO: 1983860 - DNA, 21 bp, Homo sapiens
tcaccagagcccatgctcaac

SEQ ID NO: 1983861 - DNA, 13 bp, Homo sapiens
tcaccagcaacat

SEQ ID NO: 1983862 - DNA, 21 bp, Homo sapiens
tcaccagcaactctgactctt

SEQ ID NO: 1983863 - DNA, 18 bp, Homo sapiens
tcaccagctgctgctctg

SEQ ID NO: 1983864 - DNA, 16 bp, Homo sapiens
tcaccaggatgaaggc

SEQ ID NO: 1983865 - DNA, 21 bp, Homo sapiens
tcaccagggtccgcaccagct

SEQ ID NO: 1983866 - DNA, 11 bp, Homo sapiens
tcacccacagg

SEQ ID NO: 1983867 - DNA, 22 bp, Homo sapiens
tcacccacagggctaagagcta

SEQ ID NO: 1983868 - DNA, 22 bp, Homo sapiens
tcacccaggctctggagccaga

SEQ ID NO: 1983869 - DNA, 18 bp, Homo sapiens
tcacccagtcctggccat

SEQ ID NO: 1983870 - DNA, 18 bp, Homo sapiens
tcacccccagctttgcta

SEQ ID NO: 1983871 - DNA, 15 bp, Homo sapiens
tcaccccctcccacc

SEQ ID NO: 1983872 - DNA, 19 bp, Homo sapiens
tcaccccctcccaccccca

SEQ ID NO: 1983873 - DNA, 17 bp, Homo sapiens
tcaccctacctgtgcct

SEQ ID NO: 1983874 - DNA, 13 bp, Homo sapiens
tcaccctccacct

SEQ ID NO: 1983875 - DNA, 13 bp, Homo sapiens
tcacccttctggg

SEQ ID NO: 1983876 - DNA, 19 bp, Homo sapiens
tcaccgagacggctggacc

SEQ ID NO: 1983877 - DNA, 12 bp, Homo sapiens
tcaccggcatgc

SEQ ID NO: 1983878 - DNA, 15 bp, Homo sapiens
tcaccggcatgctgg

SEQ ID NO: 1983879 - DNA, 17 bp, Homo sapiens
tcaccggcatgctggcc

SEQ ID NO: 1983880 - DNA, 22 bp, Homo sapiens
tcaccggcatgctggcctgtgg

SEQ ID NO: 1983881 - DNA, 18 bp, Homo sapiens
tcaccgtggaccttcctg

SEQ ID NO: 1983882 - DNA, 19 bp, Homo sapiens
tcacctactcacacaggca

SEQ ID NO: 1983883 - DNA, 13 bp, Homo sapiens
tcacctcagctga

SEQ ID NO: 1983884 - DNA, 18 bp, Homo sapiens
tcacctcaggccaggtgc

SEQ ID NO: 1983885 - DNA, 11 bp, Homo sapiens
tcacctcctcc

SEQ ID NO: 1983886 - DNA, 17 bp, Homo sapiens
tcacctcctccactcac

SEQ ID NO: 1983887 - DNA, 21 bp, Homo sapiens
tcacctcctccactcactcca

SEQ ID NO: 1983888 - DNA, 13 bp, Homo sapiens
tcacctctctcta

SEQ ID NO: 1983889 - DNA, 23 bp, Homo sapiens
tcacctctctctaagtttagaag

SEQ ID NO: 1983890 - DNA, 22 bp, Homo sapiens
tcacctctcttcagcccctagt

SEQ ID NO: 1983891 - DNA, 12 bp, Homo sapiens
tcacctctgcct

SEQ ID NO: 1983892 - DNA, 19 bp, Homo sapiens
tcacctgaagactcattct

SEQ ID NO: 1983893 - DNA, 23 bp, Homo sapiens
tcacctgaagactcattcttctg

SEQ ID NO: 1983894 - DNA, 19 bp, Homo sapiens
tcacctgcaagccccaggg

SEQ ID NO: 1983895 - DNA, 22 bp, Homo sapiens
tcacctgcaagccccagggcct

SEQ ID NO: 1983896 - DNA, 16 bp, Homo sapiens
tcacctgcctgccctc

SEQ ID NO: 1983897 - DNA, 13 bp, Homo sapiens
tcacctggaagca

SEQ ID NO: 1983898 - DNA, 15 bp, Homo sapiens
tcacctggaatcaga

SEQ ID NO: 1983899 - DNA, 15 bp, Homo sapiens
tcaccttatgtatta

SEQ ID NO: 1983900 - DNA, 17 bp, Homo sapiens
tcaccttatgtattatt

SEQ ID NO: 1983901 - DNA, 17 bp, Homo sapiens
tcaccttcttggttgaa

SEQ ID NO: 1983902 - DNA, 21 bp, Homo sapiens
tcaccttgccgagagaggcgc

SEQ ID NO: 1983903 - DNA, 21 bp, Homo sapiens
tcaccttggagcctgaacatg

SEQ ID NO: 1983904 - DNA, 14 bp, Homo sapiens
tcacctttggtgca

SEQ ID NO: 1983905 - DNA, 16 bp, Homo sapiens
tcacctttggtgcaga

SEQ ID NO: 1983906 - DNA, 20 bp, Homo sapiens
tcacctttttgacttttcca

SEQ ID NO: 1983907 - DNA, 13 bp, Homo sapiens
tcacgccactgca

SEQ ID NO: 1983908 - DNA, 16 bp, Homo sapiens
tcacgccactgcacta

SEQ ID NO: 1983909 - DNA, 22 bp, Homo sapiens
tcacgccactgcactccagcct

SEQ ID NO: 1983910 - DNA, 19 bp, Homo sapiens
tcacgcctatgatcccagc

SEQ ID NO: 1983911 - DNA, 21 bp, Homo sapiens
tcacgcctgtaatcccagcac

SEQ ID NO: 1983912 - DNA, 22 bp, Homo sapiens
tcacgcctgtaatcccagcact

SEQ ID NO: 1983913 - DNA, 21 bp, Homo sapiens
tcacgctcccccgcagtcccc

SEQ ID NO: 1983914 - DNA, 16 bp, Homo sapiens
tcacgctctggacatg

SEQ ID NO: 1983915 - DNA, 13 bp, Homo sapiens
tcacggcatgttt

SEQ ID NO: 1983916 - DNA, 15 bp, Homo sapiens
tcacggctcactgca

SEQ ID NO: 1983917 - DNA, 14 bp, Homo sapiens
tcacgtgaaatatt

SEQ ID NO: 1983918 - DNA, 12 bp, Homo sapiens
tcactaaatctt

SEQ ID NO: 1983919 - DNA, 12 bp, Homo sapiens
tcactagagctg

SEQ ID NO: 1983920 - DNA, 12 bp, Homo sapiens
tcactagcagct

SEQ ID NO: 1983921 - DNA, 13 bp, Homo sapiens
tcactagcagctg

SEQ ID NO: 1983922 - DNA, 15 bp, Homo sapiens
tcactagcagctgca

SEQ ID NO: 1983923 - DNA, 16 bp, Homo sapiens
tcactagcagctgcag

SEQ ID NO: 1983924 - DNA, 18 bp, Homo sapiens
tcactatgacactgagca

SEQ ID NO: 1983925 - DNA, 15 bp, Homo sapiens
tcactatgctatttc

SEQ ID NO: 1983926 - DNA, 13 bp, Homo sapiens
tcactatggtatg

SEQ ID NO: 1983927 - DNA, 23 bp, Homo sapiens
tcactatggtatgctggccagca

SEQ ID NO: 1983928 - DNA, 19 bp, Homo sapiens
tcactatgttgcccaggca

SEQ ID NO: 1983929 - DNA, 20 bp, Homo sapiens
tcactatgttgcccaggcag

SEQ ID NO: 1983930 - DNA, 16 bp, Homo sapiens
tcactattacttgaac

SEQ ID NO: 1983931 - DNA, 18 bp, Homo sapiens
tcactattacttgaactt

SEQ ID NO: 1983932 - DNA, 18 bp, Homo sapiens
tcactattcaagtattag

SEQ ID NO: 1983933 - DNA, 18 bp, Homo sapiens
tcactattcctaggagga

SEQ ID NO: 1983934 - DNA, 13 bp, Homo sapiens
tcactcagccaca

SEQ ID NO: 1983935 - DNA, 24 bp, Homo sapiens
tcactccctccctggctctgccag

SEQ ID NO: 1983936 - DNA, 20 bp, Homo sapiens
tcactccggtgtgcctgcag

SEQ ID NO: 1983937 - DNA, 10 bp, Homo sapiens
tcactcctgt

SEQ ID NO: 1983938 - DNA, 19 bp, Homo sapiens
tcactctacttagcatgtc

SEQ ID NO: 1983939 - DNA, 15 bp, Homo sapiens
tcactctgtcagcca

SEQ ID NO: 1983940 - DNA, 23 bp, Homo sapiens
tcactctgtcagccagccgccct

SEQ ID NO: 1983941 - DNA, 14 bp, Homo sapiens
tcactcttatgaaa

SEQ ID NO: 1983942 - DNA, 17 bp, Homo sapiens
tcactcttattgcccac

SEQ ID NO: 1983943 - DNA, 20 bp, Homo sapiens
tcactcttattgcccacgct

SEQ ID NO: 1983944 - DNA, 16 bp, Homo sapiens
tcactgaccctggagc

SEQ ID NO: 1983945 - DNA, 17 bp, Homo sapiens
tcactgaccctggagcg

SEQ ID NO: 1983946 - DNA, 14 bp, Homo sapiens
tcagatgcccagag

SEQ ID NO: 1983947 - DNA, 22 bp, Homo sapiens
tcagatgcccagagggcccagg

SEQ ID NO: 1983948 - DNA, 14 bp, Homo sapiens
tcagattcccagag

SEQ ID NO: 1983949 - DNA, 22 bp, Homo sapiens
tcagattgacaaggtagacatg

SEQ ID NO: 1983950 - DNA, 13 bp, Homo sapiens
tcagcaaatcctc

SEQ ID NO: 1983951 - DNA, 16 bp, Homo sapiens
tcagcacaccccaagg

SEQ ID NO: 1983952 - DNA, 18 bp, Homo sapiens
tcagcacaccccaaggga

SEQ ID NO: 1983953 - DNA, 21 bp, Homo sapiens
tcagcacaccccaagggacaa

SEQ ID NO: 1983954 - DNA, 20 bp, Homo sapiens
tcagcaccatggaggcaggc

SEQ ID NO: 1983955 - DNA, 17 bp, Homo sapiens
tcagcacccctgtctct

SEQ ID NO: 1983956 - DNA, 14 bp, Homo sapiens
tcagcaccctgggt

SEQ ID NO: 1983957 - DNA, 15 bp, Homo sapiens
tcagcaccctgggtg

SEQ ID NO: 1983958 - DNA, 16 bp, Homo sapiens
tcagcaccctgggtgc

SEQ ID NO: 1983959 - DNA, 23 bp, Homo sapiens
tcagcaccctgggtgccattccc

SEQ ID NO: 1983960 - DNA, 16 bp, Homo sapiens
tcagcactcagaaaag

SEQ ID NO: 1983961 - DNA, 14 bp, Homo sapiens
tcagcactgaaaat

SEQ ID NO: 1983962 - DNA, 21 bp, Homo sapiens
tcagcactgaaaataccatca

SEQ ID NO: 1983963 - DNA, 19 bp, Homo sapiens
tcagcagcagagagccctg

SEQ ID NO: 1983964 - DNA, 17 bp, Homo sapiens
tcagcatacctttattg

SEQ ID NO: 1983965 - DNA, 17 bp, Homo sapiens
tcagcatcctggcaccc

SEQ ID NO: 1983966 - DNA, 18 bp, Homo sapiens
tcagcattaggcttttaa

SEQ ID NO: 1983967 - DNA, 18 bp, Homo sapiens
tcagcattattcctccag

SEQ ID NO: 1983968 - DNA, 18 bp, Homo sapiens
tcagcattattcttcaga

SEQ ID NO: 1983969 - DNA, 16 bp, Homo sapiens
tcagccaaatgtaatt

SEQ ID NO: 1983970 - DNA, 18 bp, Homo sapiens
tcagccagccgccctggg

SEQ ID NO: 1983971 - DNA, 19 bp, Homo sapiens
tcagccagccgccctgggc

SEQ ID NO: 1983972 - DNA, 13 bp, Homo sapiens
tcagccagggcca

SEQ ID NO: 1983973 - DNA, 14 bp, Homo sapiens
tcagccagggccag

SEQ ID NO: 1983974 - DNA, 16 bp, Homo sapiens
tcagccagggccaggg

SEQ ID NO: 1983975 - DNA, 22 bp, Homo sapiens
tcagccataaagtgccagtttg

SEQ ID NO: 1983976 - DNA, 11 bp, Homo sapiens
tcagccatgtt

SEQ ID NO: 1983977 - DNA, 13 bp, Homo sapiens
tcagcccctcctc

SEQ ID NO: 1983978 - DNA, 19 bp, Homo sapiens
tcagcccctcctctgccac

SEQ ID NO: 1983979 - DNA, 21 bp, Homo sapiens
tcagcccctcctctgccacct

SEQ ID NO: 1983980 - DNA, 15 bp, Homo sapiens
tcagcccgggacagg

SEQ ID NO: 1983981 - DNA, 14 bp, Homo sapiens
tcagccctccctgc

SEQ ID NO: 1983982 - DNA, 15 bp, Homo sapiens
tcagccctccctgcc

SEQ ID NO: 1983983 - DNA, 19 bp, Homo sapiens
tcagccctccctgcccctc

SEQ ID NO: 1983984 - DNA, 12 bp, Homo sapiens
tcagccctgggc

SEQ ID NO: 1983985 - DNA, 19 bp, Homo sapiens
tcagccctgggccccacca

SEQ ID NO: 1983986 - DNA, 22 bp, Homo sapiens
tcagccgagccgggcctggggc

SEQ ID NO: 1983987 - DNA, 16 bp, Homo sapiens
tcagccgtgcactccc

SEQ ID NO: 1983988 - DNA, 19 bp, Homo sapiens
tcagcctagccgacctcag

SEQ ID NO: 1983989 - DNA, 21 bp, Homo sapiens
tcagcctagccgacctcagcc

SEQ ID NO: 1983990 - DNA, 22 bp, Homo sapiens
tcagcctagccgacctcagcct

SEQ ID NO: 1983991 - DNA, 13 bp, Homo sapiens
tcagcctcccaaa

SEQ ID NO: 1983992 - DNA, 13 bp, Homo sapiens
tcagcctcccaac

SEQ ID NO: 1983993 - DNA, 17 bp, Homo sapiens
tcagcctcccaacccca

SEQ ID NO: 1983994 - DNA, 21 bp, Homo sapiens
tcagcctcccaaccccagggc

SEQ ID NO: 1983995 - DNA, 17 bp, Homo sapiens
tcagcctccccccgctg

SEQ ID NO: 1983996 - DNA, 12 bp, Homo sapiens
tcagcctcccga

SEQ ID NO: 1983997 - DNA, 21 bp, Homo sapiens
tcagcctcctaagcagctggg

SEQ ID NO: 1983998 - DNA, 15 bp, Homo sapiens
tcagcctgagtctcc

SEQ ID NO: 1983999 - DNA, 12 bp, Homo sapiens
tcagcctgtgct

SEQ ID NO: 1984000 - DNA, 17 bp, Homo sapiens
tcagcctgtgctgcccg

SEQ ID NO: 1984001 - DNA, 21 bp, Homo sapiens
tcagccttccccttgcccagg

SEQ ID NO: 1984002 - DNA, 15 bp, Homo sapiens
tcagccttgaaaaac

SEQ ID NO: 1984003 - DNA, 17 bp, Homo sapiens
tcagcggggacagctcc

SEQ ID NO: 1984004 - DNA, 18 bp, Homo sapiens
tcagcggggacagctcct

SEQ ID NO: 1984005 - DNA, 20 bp, Homo sapiens
tcagcggggacagctccttc

SEQ ID NO: 1984006 - DNA, 23 bp, Homo sapiens
tcagcggggacagctccttctgt

SEQ ID NO: 1984007 - DNA, 23 bp, Homo sapiens
tcagctaagccccctactgagaa

SEQ ID NO: 1984008 - DNA, 19 bp, Homo sapiens
tcagctactgatttttgtg

SEQ ID NO: 1984009 - DNA, 12 bp, Homo sapiens
tcagctcacacc

SEQ ID NO: 1984010 - DNA, 13 bp, Homo sapiens
tcagctcagcctc

SEQ ID NO: 1984011 - DNA, 16 bp, Homo sapiens
tcagctcagcctcccc

SEQ ID NO: 1984012 - DNA, 19 bp, Homo sapiens
tcagctccagaataccttc

SEQ ID NO: 1984013 - DNA, 15 bp, Homo sapiens
tcagctccagctcac

SEQ ID NO: 1984014 - DNA, 18 bp, Homo sapiens
tcagctccagctcaccag

SEQ ID NO: 1984015 - DNA, 13 bp, Homo sapiens
tcagctcccatag

SEQ ID NO: 1984016 - DNA, 19 bp, Homo sapiens
tcagctcccatagcgctgg

SEQ ID NO: 1984017 - DNA, 18 bp, Homo sapiens
tcagctcccctcggagaa

SEQ ID NO: 1984018 - DNA, 21 bp, Homo sapiens
tcagctcccctcggagaagag

SEQ ID NO: 1984019 - DNA, 20 bp, Homo sapiens
tcagctcccttcccctgcct

SEQ ID NO: 1984020 - DNA, 16 bp, Homo sapiens
tcagctccgtcatctg

SEQ ID NO: 1984021 - DNA, 20 bp, Homo sapiens
tcagctctctgtataaacat

SEQ ID NO: 1984022 - DNA, 17 bp, Homo sapiens
tcagctgcacattcctg

SEQ ID NO: 1984023 - DNA, 20 bp, Homo sapiens
tcagctgcacattcctggcc

SEQ ID NO: 1984024 - DNA, 14 bp, Homo sapiens
tcagctgctcgcac

SEQ ID NO: 1984025 - DNA, 17 bp, Homo sapiens
tcagctgctcgcacaga

SEQ ID NO: 1984026 - DNA, 18 bp, Homo sapiens
tcagctgctcgcacagat

SEQ ID NO: 1984027 - DNA, 19 bp, Homo sapiens
tcagcttaaaattggtaat

SEQ ID NO: 1984028 - DNA, 14 bp, Homo sapiens
tcagcttcatttcc

SEQ ID NO: 1984029 - DNA, 16 bp, Homo sapiens
tcagcttcatttgtgt

SEQ ID NO: 1984030 - DNA, 20 bp, Homo sapiens
tcagcttgtaaatagctcag

SEQ ID NO: 1984031 - DNA, 22 bp, Homo sapiens
tcagcttgtaaatagctcaggt

SEQ ID NO: 1984032 - DNA, 14 bp, Homo sapiens
tcagctttcagagc

SEQ ID NO: 1984033 - DNA, 17 bp, Homo sapiens
tcagctttcagagccag

SEQ ID NO: 1984034 - DNA, 19 bp, Homo sapiens
tcagctttcagagccagtg

SEQ ID NO: 1984035 - DNA, 20 bp, Homo sapiens
tcagctttcagagccagtga

SEQ ID NO: 1984036 - DNA, 17 bp, Homo sapiens
tcagcttttaataaaat

SEQ ID NO: 1984037 - DNA, 18 bp, Homo sapiens
tcagcttttaataaaatt

SEQ ID NO: 1984038 - DNA, 18 bp, Homo sapiens
tcagctttttgtcttttc

SEQ ID NO: 1984039 - DNA, 20 bp, Homo sapiens
tcaggaaaactgacagagga

SEQ ID NO: 1984040 - DNA, 21 bp, Homo sapiens
tcaggaaaactgacagaggag

SEQ ID NO: 1984041 - DNA, 18 bp, Homo sapiens
tcaggaaaaggcctgggg

SEQ ID NO: 1984042 - DNA, 12 bp, Homo sapiens
tcaggaaaattg

SEQ ID NO: 1984043 - DNA, 23 bp, Homo sapiens
tcaggaaatcaaatatgcaaagc

SEQ ID NO: 1984044 - DNA, 16 bp, Homo sapiens
tcaggaacagaaggat

SEQ ID NO: 1984045 - DNA, 14 bp, Homo sapiens
tcaggaagaaaccc

SEQ ID NO: 1984046 - DNA, 22 bp, Homo sapiens
tcaggaagaaaccccaagcagc

SEQ ID NO: 1984047 - DNA, 16 bp, Homo sapiens
tcaggaagagaaggag

SEQ ID NO: 1984048 - DNA, 19 bp, Homo sapiens
tcaggaagggaaagccaga

SEQ ID NO: 1984049 - DNA, 17 bp, Homo sapiens
tcaggacacaggcctgt

SEQ ID NO: 1984050 - DNA, 18 bp, Homo sapiens
tcaggacacaggcctgtg

SEQ ID NO: 1984051 - DNA, 23 bp, Homo sapiens
tcaggacacaggcctgtgtagct

SEQ ID NO: 1984052 - DNA, 15 bp, Homo sapiens
tcaggacatggggca

SEQ ID NO: 1984053 - DNA, 12 bp, Homo sapiens
tcaggacccagg

SEQ ID NO: 1984054 - DNA, 13 bp, Homo sapiens
tcaggacccaggc

SEQ ID NO: 1984055 - DNA, 15 bp, Homo sapiens
tcaggacccaggccc

SEQ ID NO: 1984056 - DNA, 22 bp, Homo sapiens
tcaggacccaggccctccatgg

SEQ ID NO: 1984057 - DNA, 23 bp, Homo sapiens
tcaggacccaggccctccatggg

SEQ ID NO: 1984058 - DNA, 17 bp, Homo sapiens
tcaggacccaggccgcc

SEQ ID NO: 1984059 - DNA, 16 bp, Homo sapiens
tcaggacctggcttgg

SEQ ID NO: 1984060 - DNA, 14 bp, Homo sapiens
tcaggactggctca

SEQ ID NO: 1984061 - DNA, 14 bp, Homo sapiens
attcagaagaaaaa

SEQ ID NO: 1984062 - DNA, 15 bp, Homo sapiens
attcagaagcatcac

SEQ ID NO: 1984063 - DNA, 13 bp, Homo sapiens
attcagacaagca

SEQ ID NO: 1984064 - DNA, 14 bp, Homo sapiens
attcagagaatatc

SEQ ID NO: 1984065 - DNA, 17 bp, Homo sapiens
attcagagatgtaccat

SEQ ID NO: 1984066 - DNA, 21 bp, Homo sapiens
attcagagatgtaccatgtta

SEQ ID NO: 1984067 - DNA, 21 bp, Homo sapiens
attcagatatatttttcacag

SEQ ID NO: 1984068 - DNA, 19 bp, Homo sapiens
attcagattgacaaggtag

SEQ ID NO: 1984069 - DNA, 17 bp, Homo sapiens
attcagcaccctgggtg

SEQ ID NO: 1984070 - DNA, 21 bp, Homo sapiens
attcagcaccctgggtgccat

SEQ ID NO: 1984071 - DNA, 22 bp, Homo sapiens
attcagctagaactttgaagga

SEQ ID NO: 1984072 - DNA, 12 bp, Homo sapiens
attcagcttcat

SEQ ID NO: 1984073 - DNA, 15 bp, Homo sapiens
attcaggactggctc

SEQ ID NO: 1984074 - DNA, 16 bp, Homo sapiens
attcaggactggctca

SEQ ID NO: 1984075 - DNA, 15 bp, Homo sapiens
attcaggcagcactg

SEQ ID NO: 1984076 - DNA, 18 bp, Homo sapiens
attcaggtgaaaatgttc

SEQ ID NO: 1984077 - DNA, 23 bp, Homo sapiens
attcagtccgcctggccggctcc

SEQ ID NO: 1984078 - DNA, 14 bp, Homo sapiens
attcagtgcttctt

SEQ ID NO: 1984079 - DNA, 12 bp, Homo sapiens
attcataaatct

SEQ ID NO: 1984080 - DNA, 13 bp, Homo sapiens
attcataattaga

SEQ ID NO: 1984081 - DNA, 16 bp, Homo sapiens
attcataattagaaca

SEQ ID NO: 1984082 - DNA, 16 bp, Homo sapiens
attcatcaagctgtac

SEQ ID NO: 1984083 - DNA, 21 bp, Homo sapiens
attcatcatatgaatgttctt

SEQ ID NO: 1984084 - DNA, 22 bp, Homo sapiens
attcatccagttgcaataaaat

SEQ ID NO: 1984085 - DNA, 14 bp, Homo sapiens
attcatgctttctc

SEQ ID NO: 1984086 - DNA, 15 bp, Homo sapiens
attcatgctttctcc

SEQ ID NO: 1984087 - DNA, 16 bp, Homo sapiens
attcatgctttctcct

SEQ ID NO: 1984088 - DNA, 13 bp, Homo sapiens
attcatgtaataa

SEQ ID NO: 1984089 - DNA, 19 bp, Homo sapiens
attcattgtataaaaatag

SEQ ID NO: 1984090 - DNA, 15 bp, Homo sapiens
attcatttaaaatga

SEQ ID NO: 1984091 - DNA, 22 bp, Homo sapiens
attcatttcacattaatggtct

SEQ ID NO: 1984092 - DNA, 16 bp, Homo sapiens
attcatttcactttaa

SEQ ID NO: 1984093 - DNA, 16 bp, Homo sapiens
attcattttcattgtt

SEQ ID NO: 1984094 - DNA, 23 bp, Homo sapiens
attccaaagttttgaagtcatct

SEQ ID NO: 1984095 - DNA, 14 bp, Homo sapiens
attccaacagtgag

SEQ ID NO: 1984096 - DNA, 17 bp, Homo sapiens
attccaagattaaaagt

SEQ ID NO: 1984097 - DNA, 21 bp, Homo sapiens
attccaagtcaacactcttct

SEQ ID NO: 1984098 - DNA, 17 bp, Homo sapiens
attccaatatgatgact

SEQ ID NO: 1984099 - DNA, 18 bp, Homo sapiens
attccacacaaaatgtca

SEQ ID NO: 1984100 - DNA, 15 bp, Homo sapiens
attccacagtctctg

SEQ ID NO: 1984101 - DNA, 16 bp, Homo sapiens
attccacagtctctgg

SEQ ID NO: 1984102 - DNA, 15 bp, Homo sapiens
attccaccattcaca

SEQ ID NO: 1984103 - DNA, 22 bp, Homo sapiens
attccactcaatatgtgatttt

SEQ ID NO: 1984104 - DNA, 17 bp, Homo sapiens
attccatgattttacag

SEQ ID NO: 1984105 - DNA, 18 bp, Homo sapiens
attccatgattttacaga

SEQ ID NO: 1984106 - DNA, 21 bp, Homo sapiens
attccatttttactaaagcag

SEQ ID NO: 1984107 - DNA, 17 bp, Homo sapiens
attcccaactagacatt

SEQ ID NO: 1984108 - DNA, 19 bp, Homo sapiens
attcccaactgctctgccc

SEQ ID NO: 1984109 - DNA, 20 bp, Homo sapiens
attcccaactgctctgccca

SEQ ID NO: 1984110 - DNA, 14 bp, Homo sapiens
attcccaagaaatg

SEQ ID NO: 1984111 - DNA, 15 bp, Homo sapiens
attcccaagctctgc

SEQ ID NO: 1984112 - DNA, 16 bp, Homo sapiens
attcccaagctctgct

SEQ ID NO: 1984113 - DNA, 18 bp, Homo sapiens
attcccaagctctgctcc

SEQ ID NO: 1984114 - DNA, 13 bp, Homo sapiens
attcccaatcttg

SEQ ID NO: 1984115 - DNA, 14 bp, Homo sapiens
attcccaccaaggt

SEQ ID NO: 1984116 - DNA, 22 bp, Homo sapiens
attcccacccaattcaaaacat

SEQ ID NO: 1984117 - DNA, 12 bp, Homo sapiens
attcccagagac

SEQ ID NO: 1984118 - DNA, 19 bp, Homo sapiens
attcccagagacaggaaaa

SEQ ID NO: 1984119 - DNA, 16 bp, Homo sapiens
attcccagctgtctgt

SEQ ID NO: 1984120 - DNA, 17 bp, Homo sapiens
attcccagctgtctgtg

SEQ ID NO: 1984121 - DNA, 20 bp, Homo sapiens
tcaaaacaaccatcctgctc

SEQ ID NO: 1984122 - DNA, 21 bp, Homo sapiens
tcaaaacacatctttcctgtc

SEQ ID NO: 1984123 - DNA, 14 bp, Homo sapiens
tcaaaacagattgt

SEQ ID NO: 1984124 - DNA, 15 bp, Homo sapiens
tcaaaacatatcaat

SEQ ID NO: 1984125 - DNA, 20 bp, Homo sapiens
tcaaaacctttcaaatatca

SEQ ID NO: 1984126 - DNA, 18 bp, Homo sapiens
tcaaaacggggcagccaa

SEQ ID NO: 1984127 - DNA, 18 bp, Homo sapiens
tcaaaagaaaaggcaaaa

SEQ ID NO: 1984128 - DNA, 21 bp, Homo sapiens
tcaaaagacatgttgtaaatt

SEQ ID NO: 1984129 - DNA, 12 bp, Homo sapiens
tcaaaagcactt

SEQ ID NO: 1984130 - DNA, 15 bp, Homo sapiens
tcaaaagcacttgtt

SEQ ID NO: 1984131 - DNA, 19 bp, Homo sapiens
tcaaaagctctctttggaa

SEQ ID NO: 1984132 - DNA, 23 bp, Homo sapiens
tcaaaagctctctttggaatgaa

SEQ ID NO: 1984133 - DNA, 22 bp, Homo sapiens
tcaaaagtgatctgtcccctct

SEQ ID NO: 1984134 - DNA, 21 bp, Homo sapiens
tcaaaataccatgccatttaa

SEQ ID NO: 1984135 - DNA, 17 bp, Homo sapiens
tcaaaatagtgccacta

SEQ ID NO: 1984136 - DNA, 18 bp, Homo sapiens
tcaaaatatttgtacata

SEQ ID NO: 1984137 - DNA, 13 bp, Homo sapiens
tcaaacaagaatg

SEQ ID NO: 1984138 - DNA, 14 bp, Homo sapiens
tcaaacaagaatgt

SEQ ID NO: 1984139 - DNA, 21 bp, Homo sapiens
tcaaacaccaacataaaaatg

SEQ ID NO: 1984140 - DNA, 21 bp, Homo sapiens
tcaaacagtctcaggaaatca

SEQ ID NO: 1984141 - DNA, 22 bp, Homo sapiens
tcaaacatgaagtgtgtttcct

SEQ ID NO: 1984142 - DNA, 16 bp, Homo sapiens
tcaaaccataaacttc

SEQ ID NO: 1984143 - DNA, 21 bp, Homo sapiens
tcaaaccataaacttcatggt

SEQ ID NO: 1984144 - DNA, 20 bp, Homo sapiens
tcaaaccgcactcacccatg

SEQ ID NO: 1984145 - DNA, 13 bp, Homo sapiens
tcaaactgctcca

SEQ ID NO: 1984146 - DNA, 15 bp, Homo sapiens
tcaaactgctccaag

SEQ ID NO: 1984147 - DNA, 16 bp, Homo sapiens
tcaaactgctccaagt

SEQ ID NO: 1984148 - DNA, 13 bp, Homo sapiens
tcaaactgggtat

SEQ ID NO: 1984149 - DNA, 21 bp, Homo sapiens
tcaaactttactctaagtctc

SEQ ID NO: 1984150 - DNA, 12 bp, Homo sapiens
tcaaagaaatgc

SEQ ID NO: 1984151 - DNA, 22 bp, Homo sapiens
tcaaagaaggatggcacctaaa

SEQ ID NO: 1984152 - DNA, 16 bp, Homo sapiens
tcaaagagaaaactta

SEQ ID NO: 1984153 - DNA, 16 bp, Homo sapiens
tcaaagattttacctg

SEQ ID NO: 1984154 - DNA, 15 bp, Homo sapiens
tcaaagcaagcattc

SEQ ID NO: 1984155 - DNA, 20 bp, Homo sapiens
tcaaagcccccacttctctc

SEQ ID NO: 1984156 - DNA, 12 bp, Homo sapiens
tcaaagctgagt

SEQ ID NO: 1984157 - DNA, 19 bp, Homo sapiens
tcaaagctgtgtgtttgga

SEQ ID NO: 1984158 - DNA, 17 bp, Homo sapiens
tcaaagtgtaagcactt

SEQ ID NO: 1984159 - DNA, 20 bp, Homo sapiens
tcaaatatctcagaggctat

SEQ ID NO: 1984160 - DNA, 14 bp, Homo sapiens
tcaaatatgcaaag

SEQ ID NO: 1984161 - DNA, 17 bp, Homo sapiens
tcaaatatgcaaagcac

SEQ ID NO: 1984162 - DNA, 17 bp, Homo sapiens
tcaaatcctcaccatcc

SEQ ID NO: 1984163 - DNA, 17 bp, Homo sapiens
tcaaatctattcagaca

SEQ ID NO: 1984164 - DNA, 16 bp, Homo sapiens
tcaaatctccagtatt

SEQ ID NO: 1984165 - DNA, 15 bp, Homo sapiens
tcaaatgacccaaag

SEQ ID NO: 1984166 - DNA, 19 bp, Homo sapiens
tcaaatgacccaaagacca

SEQ ID NO: 1984167 - DNA, 16 bp, Homo sapiens
ggcacccggcccctgc

SEQ ID NO: 1984168 - DNA, 17 bp, Homo sapiens
ggcacccggcccctgct

SEQ ID NO: 1984169 - DNA, 12 bp, Homo sapiens
ggcacccttctt

SEQ ID NO: 1984170 - DNA, 17 bp, Homo sapiens
ggcacccttctttcctc

SEQ ID NO: 1984171 - DNA, 16 bp, Homo sapiens
ggcaccggcgctgcag

SEQ ID NO: 1984172 - DNA, 17 bp, Homo sapiens
ggcaccggcgctgcagg

SEQ ID NO: 1984173 - DNA, 17 bp, Homo sapiens
ggcacctacatccccag

SEQ ID NO: 1984174 - DNA, 20 bp, Homo sapiens
ggcacctacatccccaggtc

SEQ ID NO: 1984175 - DNA, 19 bp, Homo sapiens
ggcacctgccaccgccaga

SEQ ID NO: 1984176 - DNA, 13 bp, Homo sapiens
ggcacctgctgga

SEQ ID NO: 1984177 - DNA, 17 bp, Homo sapiens
ggcacctggcctgctgg

SEQ ID NO: 1984178 - DNA, 19 bp, Homo sapiens
ggcacctgggaaaacagag

SEQ ID NO: 1984179 - DNA, 20 bp, Homo sapiens
ggcacctgggaaaacagagg

SEQ ID NO: 1984180 - DNA, 22 bp, Homo sapiens
ggcacctgggaaaacagaggaa

SEQ ID NO: 1984181 - DNA, 17 bp, Homo sapiens
ggcacctgggccctggg

SEQ ID NO: 1984182 - DNA, 19 bp, Homo sapiens
ggcacctgggccctggggc

SEQ ID NO: 1984183 - DNA, 17 bp, Homo sapiens
ggcacgaacccacctgc

SEQ ID NO: 1984184 - DNA, 18 bp, Homo sapiens
ggcacgaacccacctgct

SEQ ID NO: 1984185 - DNA, 18 bp, Homo sapiens
ggcacgccaacagccccc

SEQ ID NO: 1984186 - DNA, 21 bp, Homo sapiens
ggcacgtcccatgtgcatgga

SEQ ID NO: 1984187 - DNA, 20 bp, Homo sapiens
ggcactcagaagacactgat

SEQ ID NO: 1984188 - DNA, 23 bp, Homo sapiens
ggcactcagaagacactgatggg

SEQ ID NO: 1984189 - DNA, 22 bp, Homo sapiens
ggcactgattgttttagagact

SEQ ID NO: 1984190 - DNA, 14 bp, Homo sapiens
ggcactgcaggggc

SEQ ID NO: 1984191 - DNA, 16 bp, Homo sapiens
ggcactggtggcatcg

SEQ ID NO: 1984192 - DNA, 22 bp, Homo sapiens
ggcactgtctgcgtgactattt

SEQ ID NO: 1984193 - DNA, 14 bp, Homo sapiens
ggcacttgtcacta

SEQ ID NO: 1984194 - DNA, 15 bp, Homo sapiens
ggcagaaaagaggag

SEQ ID NO: 1984195 - DNA, 17 bp, Homo sapiens
ggcagaagaattgaacc

SEQ ID NO: 1984196 - DNA, 20 bp, Homo sapiens
ggcagacaagagctgctgtc

SEQ ID NO: 1984197 - DNA, 16 bp, Homo sapiens
ggcagacagcagctca

SEQ ID NO: 1984198 - DNA, 19 bp, Homo sapiens
ggcagacagcagctcaggc

SEQ ID NO: 1984199 - DNA, 23 bp, Homo sapiens
ggcagacaggcgctggacagagg

SEQ ID NO: 1984200 - DNA, 17 bp, Homo sapiens
ggcagaccatctccagc

SEQ ID NO: 1984201 - DNA, 17 bp, Homo sapiens
ggcagaccgggggccag

SEQ ID NO: 1984202 - DNA, 18 bp, Homo sapiens
ggcagaccgggggccaga

SEQ ID NO: 1984203 - DNA, 23 bp, Homo sapiens
ggcagaccgggggccagacacag

SEQ ID NO: 1984204 - DNA, 17 bp, Homo sapiens
ggcagagaaggcctctt

SEQ ID NO: 1984205 - DNA, 14 bp, Homo sapiens
ggcagagaatcata

SEQ ID NO: 1984206 - DNA, 17 bp, Homo sapiens
ggcagagaccccaggat

SEQ ID NO: 1984207 - DNA, 18 bp, Homo sapiens
ggcagagaccccaggatc

SEQ ID NO: 1984208 - DNA, 24 bp, Homo sapiens
ggcagagaccccaggatcccagag

SEQ ID NO: 1984209 - DNA, 20 bp, Homo sapiens
ggcagagatcaggtgggcag

SEQ ID NO: 1984210 - DNA, 18 bp, Homo sapiens
ggcagagccatgggcctg

SEQ ID NO: 1984211 - DNA, 22 bp, Homo sapiens
ggcagagccatgggcctgggcc

SEQ ID NO: 1984212 - DNA, 16 bp, Homo sapiens
ggcagagccgggaagc

SEQ ID NO: 1984213 - DNA, 22 bp, Homo sapiens
ggcagagcctttggatgaccag

SEQ ID NO: 1984214 - DNA, 22 bp, Homo sapiens
ggcagagcggggaggtgcctga

SEQ ID NO: 1984215 - DNA, 14 bp, Homo sapiens
ggcagaggcagaca

SEQ ID NO: 1984216 - DNA, 12 bp, Homo sapiens
ggcagaggctgg

SEQ ID NO: 1984217 - DNA, 23 bp, Homo sapiens
ggcagaggctggaggcagggcct

SEQ ID NO: 1984218 - DNA, 16 bp, Homo sapiens
ggcagagggcagaggc

SEQ ID NO: 1984219 - DNA, 16 bp, Homo sapiens
ggcagaggggcagccg

SEQ ID NO: 1984220 - DNA, 23 bp, Homo sapiens
ggcagagtgagactcgtctcaaa

SEQ ID NO: 1984221 - DNA, 17 bp, Homo sapiens
ggcagagtgggctgcct

SEQ ID NO: 1984222 - DNA, 20 bp, Homo sapiens
ggcagagtgggctgcctggg

SEQ ID NO: 1984223 - DNA, 15 bp, Homo sapiens
ggcagataatcagcc

SEQ ID NO: 1984224 - DNA, 18 bp, Homo sapiens
ggcagatcaccagaggtc

SEQ ID NO: 1984225 - DNA, 16 bp, Homo sapiens
ggcagatgtaggaggg

SEQ ID NO: 1984226 - DNA, 19 bp, Homo sapiens
ggcagcaaggcccgagcag

SEQ ID NO: 1984227 - DNA, 20 bp, Homo sapiens
ggcagcaaggcccgagcagc

SEQ ID NO: 1984228 - DNA, 15 bp, Homo sapiens
ggagctgggaggaaa

SEQ ID NO: 1984229 - DNA, 23 bp, Homo sapiens
ggagctggttagaaatgcagaat

SEQ ID NO: 1984230 - DNA, 17 bp, Homo sapiens
ggagcttccagtgcatg

SEQ ID NO: 1984231 - DNA, 15 bp, Homo sapiens
ggagcttgcaagaag

SEQ ID NO: 1984232 - DNA, 13 bp, Homo sapiens
ggagcttgcagtg

SEQ ID NO: 1984233 - DNA, 10 bp, Homo sapiens
ggaggaaggg

SEQ ID NO: 1984234 - DNA, 14 bp, Homo sapiens
ggaggaagggccag

SEQ ID NO: 1984235 - DNA, 15 bp, Homo sapiens
ggaggaaggtgctga

SEQ ID NO: 1984236 - DNA, 10 bp, Homo sapiens
ggaggacagt

SEQ ID NO: 1984237 - DNA, 15 bp, Homo sapiens
ggaggacctgagcct

SEQ ID NO: 1984238 - DNA, 16 bp, Homo sapiens
ggaggacctgagcctg

SEQ ID NO: 1984239 - DNA, 17 bp, Homo sapiens
ggaggacctgagcctgc

SEQ ID NO: 1984240 - DNA, 18 bp, Homo sapiens
ggaggacctgagcctgcc

SEQ ID NO: 1984241 - DNA, 22 bp, Homo sapiens
ggaggacggttgtaagcagttg

SEQ ID NO: 1984242 - DNA, 13 bp, Homo sapiens
ggaggagaatgag

SEQ ID NO: 1984243 - DNA, 16 bp, Homo sapiens
ggaggagaccagctca

SEQ ID NO: 1984244 - DNA, 16 bp, Homo sapiens
ggaggaggagctgccg

SEQ ID NO: 1984245 - DNA, 17 bp, Homo sapiens
ggaggaggagctgccgc

SEQ ID NO: 1984246 - DNA, 14 bp, Homo sapiens
ggaggaggaggaag

SEQ ID NO: 1984247 - DNA, 16 bp, Homo sapiens
ggaggaggaggaggaa

SEQ ID NO: 1984248 - DNA, 18 bp, Homo sapiens
ggaggaggcagagaagaa

SEQ ID NO: 1984249 - DNA, 20 bp, Homo sapiens
ggaggaggtggcagccctgt

SEQ ID NO: 1984250 - DNA, 20 bp, Homo sapiens
ggaggatcactggagcccag

SEQ ID NO: 1984251 - DNA, 14 bp, Homo sapiens
ggaggatgccacag

SEQ ID NO: 1984252 - DNA, 18 bp, Homo sapiens
ggaggatgccacagcccc

SEQ ID NO: 1984253 - DNA, 14 bp, Homo sapiens
ggaggatggagaga

SEQ ID NO: 1984254 - DNA, 15 bp, Homo sapiens
ggaggatgttctggg

SEQ ID NO: 1984255 - DNA, 20 bp, Homo sapiens
ggaggcaccagctctgtggc

SEQ ID NO: 1984256 - DNA, 13 bp, Homo sapiens
ggaggcagctcca

SEQ ID NO: 1984257 - DNA, 21 bp, Homo sapiens
ggaggcaggctccccctgcct

SEQ ID NO: 1984258 - DNA, 13 bp, Homo sapiens
ggaggcagggcct

SEQ ID NO: 1984259 - DNA, 17 bp, Homo sapiens
ggaggcatggccctggg

SEQ ID NO: 1984260 - DNA, 20 bp, Homo sapiens
ggaggcccagccgcaggaag

SEQ ID NO: 1984261 - DNA, 21 bp, Homo sapiens
ggaggccctggtgtcaggcag

SEQ ID NO: 1984262 - DNA, 11 bp, Homo sapiens
ggaggcctcag

SEQ ID NO: 1984263 - DNA, 14 bp, Homo sapiens
ggaggcctgggggc

SEQ ID NO: 1984264 - DNA, 20 bp, Homo sapiens
ggaggcgcagcccgaagccc

SEQ ID NO: 1984265 - DNA, 23 bp, Homo sapiens
ggaggcgcagcccgaagcccagt

SEQ ID NO: 1984266 - DNA, 19 bp, Homo sapiens
ggaggctgaggcaggagga

SEQ ID NO: 1984267 - DNA, 20 bp, Homo sapiens
ggaggctgcagagctgaccc

SEQ ID NO: 1984268 - DNA, 16 bp, Homo sapiens
ggaggctgcatgctct

SEQ ID NO: 1984269 - DNA, 11 bp, Homo sapiens
ggaggctgctc

SEQ ID NO: 1984270 - DNA, 12 bp, Homo sapiens
ggaggctgctcg

SEQ ID NO: 1984271 - DNA, 16 bp, Homo sapiens
ggaggctgggcccctg

SEQ ID NO: 1984272 - DNA, 17 bp, Homo sapiens
ggaggctgggcccctgg

SEQ ID NO: 1984273 - DNA, 21 bp, Homo sapiens
ggaggcttcctgactgacaca

SEQ ID NO: 1984274 - DNA, 17 bp, Homo sapiens
ggagggacaaaggagcc

SEQ ID NO: 1984275 - DNA, 19 bp, Homo sapiens
ggagggacaaaggagcctg

SEQ ID NO: 1984276 - DNA, 17 bp, Homo sapiens
ggagggacagggcttgg

SEQ ID NO: 1984277 - DNA, 12 bp, Homo sapiens
ggagggagccgg

SEQ ID NO: 1984278 - DNA, 14 bp, Homo sapiens
ggagggagggagag

SEQ ID NO: 1984279 - DNA, 10 bp, Homo sapiens
ggagggcaga

SEQ ID NO: 1984280 - DNA, 22 bp, Homo sapiens
ggagggcagagccatgggcctg

SEQ ID NO: 1984281 - DNA, 12 bp, Homo sapiens
ggagggcagagt

SEQ ID NO: 1984282 - DNA, 20 bp, Homo sapiens
ggagggcagagtgggctgcc

SEQ ID NO: 1984283 - DNA, 21 bp, Homo sapiens
ggagggcagagtgggctgcct

SEQ ID NO: 1984284 - DNA, 19 bp, Homo sapiens
ggagggctagaactggaga

SEQ ID NO: 1984285 - DNA, 20 bp, Homo sapiens
ggagggctagaatctggaga

SEQ ID NO: 1984286 - DNA, 19 bp, Homo sapiens
gctgcccttcgctgccagg

SEQ ID NO: 1984287 - DNA, 13 bp, Homo sapiens
gctgccgcctccc

SEQ ID NO: 1984288 - DNA, 16 bp, Homo sapiens
gctgccgcctcccagc

SEQ ID NO: 1984289 - DNA, 13 bp, Homo sapiens
gctgccgctgcac

SEQ ID NO: 1984290 - DNA, 19 bp, Homo sapiens
gctgcctaataaagagact

SEQ ID NO: 1984291 - DNA, 20 bp, Homo sapiens
gctgcctcatgaccctcctg

SEQ ID NO: 1984292 - DNA, 20 bp, Homo sapiens
gctgcctggggattgggagg

SEQ ID NO: 1984293 - DNA, 21 bp, Homo sapiens
gctgcctggggattgggaggg

SEQ ID NO: 1984294 - DNA, 13 bp, Homo sapiens
gctgcctgtagtt

SEQ ID NO: 1984295 - DNA, 16 bp, Homo sapiens
gctgcctgtagttagg

SEQ ID NO: 1984296 - DNA, 18 bp, Homo sapiens
gctgcctgttcagctcca

SEQ ID NO: 1984297 - DNA, 22 bp, Homo sapiens
gctgcctgttcagctccagctc

SEQ ID NO: 1984298 - DNA, 17 bp, Homo sapiens
gctgccttttgctgctg

SEQ ID NO: 1984299 - DNA, 17 bp, Homo sapiens
gctgcggtccacccagg

SEQ ID NO: 1984300 - DNA, 22 bp, Homo sapiens
gctgcggtgtcactgggctacc

SEQ ID NO: 1984301 - DNA, 21 bp, Homo sapiens
gctgcgtcagaccagtactgg

SEQ ID NO: 1984302 - DNA, 19 bp, Homo sapiens
gctgctagcacttggagcc

SEQ ID NO: 1984303 - DNA, 16 bp, Homo sapiens
gctgctagtatatgtc

SEQ ID NO: 1984304 - DNA, 22 bp, Homo sapiens
gctgctcagaggggccccggtc

SEQ ID NO: 1984305 - DNA, 23 bp, Homo sapiens
gctgctcatcacccagtcctggc

SEQ ID NO: 1984306 - DNA, 11 bp, Homo sapiens
gctgctcctcc

SEQ ID NO: 1984307 - DNA, 18 bp, Homo sapiens
gctgctctagctggcagg

SEQ ID NO: 1984308 - DNA, 12 bp, Homo sapiens
gctgctctgccc

SEQ ID NO: 1984309 - DNA, 14 bp, Homo sapiens
gctgctctggaaaa

SEQ ID NO: 1984310 - DNA, 18 bp, Homo sapiens
gctgctcttagtgcccgc

SEQ ID NO: 1984311 - DNA, 16 bp, Homo sapiens
gctgctgaagaggcaa

SEQ ID NO: 1984312 - DNA, 17 bp, Homo sapiens
gctgctgaagaggcaag

SEQ ID NO: 1984313 - DNA, 19 bp, Homo sapiens
gctgctgaagttctgagcc

SEQ ID NO: 1984314 - DNA, 17 bp, Homo sapiens
gctgctgacaggatgtg

SEQ ID NO: 1984315 - DNA, 16 bp, Homo sapiens
gctgctgagaacctgg

SEQ ID NO: 1984316 - DNA, 20 bp, Homo sapiens
gctgctgagaacctggcctt

SEQ ID NO: 1984317 - DNA, 18 bp, Homo sapiens
gctgctgtaactgctgag

SEQ ID NO: 1984318 - DNA, 14 bp, Homo sapiens
gctgctgtgtagct

SEQ ID NO: 1984319 - DNA, 17 bp, Homo sapiens
gctgctgtgtagctctg

SEQ ID NO: 1984320 - DNA, 22 bp, Homo sapiens
gctgcttcccatgcctgcaacc

SEQ ID NO: 1984321 - DNA, 17 bp, Homo sapiens
gctgctttttggcacag

SEQ ID NO: 1984322 - DNA, 16 bp, Homo sapiens
gctggaaataaacctg

SEQ ID NO: 1984323 - DNA, 20 bp, Homo sapiens
gctggaaataaacctggaga

SEQ ID NO: 1984324 - DNA, 23 bp, Homo sapiens
gctggaagacgcaagggcctgat

SEQ ID NO: 1984325 - DNA, 16 bp, Homo sapiens
gctggaagctgggagg

SEQ ID NO: 1984326 - DNA, 17 bp, Homo sapiens
gctggaagctgggaggt

SEQ ID NO: 1984327 - DNA, 18 bp, Homo sapiens
gctggaaggcagggcaga

SEQ ID NO: 1984328 - DNA, 20 bp, Homo sapiens
gctggaaggcagggcagagg

SEQ ID NO: 1984329 - DNA, 19 bp, Homo sapiens
gctggaatcaatttcccag

SEQ ID NO: 1984330 - DNA, 17 bp, Homo sapiens
gctggaattgctgctct

SEQ ID NO: 1984331 - DNA, 13 bp, Homo sapiens
gctggacaaccca

SEQ ID NO: 1984332 - DNA, 15 bp, Homo sapiens
gctggacaacccaga

SEQ ID NO: 1984333 - DNA, 16 bp, Homo sapiens
gctggacaacccagaa

SEQ ID NO: 1984334 - DNA, 16 bp, Homo sapiens
gctggacaagaagctg

SEQ ID NO: 1984335 - DNA, 17 bp, Homo sapiens
gctggacatgctttggc

SEQ ID NO: 1984336 - DNA, 21 bp, Homo sapiens
gctggaccttgaactgggtac

SEQ ID NO: 1984337 - DNA, 16 bp, Homo sapiens
gctggacggcattcct

SEQ ID NO: 1984338 - DNA, 19 bp, Homo sapiens
gctggacggggactgggga

SEQ ID NO: 1984339 - DNA, 22 bp, Homo sapiens
gctggagcctcggtggccatgc

SEQ ID NO: 1984340 - DNA, 23 bp, Homo sapiens
gctggagcctcggtggccatgct

SEQ ID NO: 1984341 - DNA, 14 bp, Homo sapiens
gctggagctcttgg

SEQ ID NO: 1984342 - DNA, 15 bp, Homo sapiens
gctggagctcttgga

SEQ ID NO: 1984343 - DNA, 22 bp, Homo sapiens
gctggagctcttggaagagctc

SEQ ID NO: 1984344 - DNA, 21 bp, Homo sapiens
gctggaggactagaacctgga

SEQ ID NO: 1984345 - DNA, 12 bp, Homo sapiens
gctggagtgcag

SEQ ID NO: 1984346 - DNA, 15 bp, Homo sapiens
gctggataaaatgag

SEQ ID NO: 1984347 - DNA, 16 bp, Homo sapiens
gctggatattttacta

SEQ ID NO: 1984348 - DNA, 16 bp, Homo sapiens
gctggcaagcagggaa

SEQ ID NO: 1984349 - DNA, 23 bp, Homo sapiens
gctggcaaggagttcgtggctgc

SEQ ID NO: 1984350 - DNA, 18 bp, Homo sapiens
gctggcagagaaggcttc

SEQ ID NO: 1984351 - DNA, 14 bp, Homo sapiens
gctggcagcactca

SEQ ID NO: 1984352 - DNA, 18 bp, Homo sapiens
gctggcagcactcagtga

SEQ ID NO: 1984353 - DNA, 16 bp, Homo sapiens
gctggcagctgagagc

SEQ ID NO: 1984354 - DNA, 23 bp, Homo sapiens
gctggcagtgctgattcagcctg

SEQ ID NO: 1984355 - DNA, 16 bp, Homo sapiens
gctggccagcaccctc

SEQ ID NO: 1984356 - DNA, 19 bp, Homo sapiens
gctggccctggctcccaca

SEQ ID NO: 1984357 - DNA, 14 bp, Homo sapiens
gctggcctggccgg

SEQ ID NO: 1984358 - DNA, 21 bp, Homo sapiens
gctggcctgtggcaggcctag

SEQ ID NO: 1984359 - DNA, 16 bp, Homo sapiens
gctggcggctactcag

SEQ ID NO: 1984360 - DNA, 14 bp, Homo sapiens
gctggcgtgcagtg

SEQ ID NO: 1984361 - DNA, 15 bp, Homo sapiens
gctggcgtgcagtgg

SEQ ID NO: 1984362 - DNA, 13 bp, Homo sapiens
gctggctcaggaa

SEQ ID NO: 1984363 - DNA, 16 bp, Homo sapiens
gctggctgagggcagt

SEQ ID NO: 1984364 - DNA, 21 bp, Homo sapiens
gctggctgagtggaatgcagg

SEQ ID NO: 1984365 - DNA, 11 bp, Homo sapiens
gctggctgctg

SEQ ID NO: 1984366 - DNA, 12 bp, Homo sapiens
gctggctgctga

SEQ ID NO: 1984367 - DNA, 14 bp, Homo sapiens
gctggctgctgaca

SEQ ID NO: 1984368 - DNA, 15 bp, Homo sapiens
gctggctgctgacag

SEQ ID NO: 1984369 - DNA, 16 bp, Homo sapiens
gctggctgttggctgg

SEQ ID NO: 1984370 - DNA, 19 bp, Homo sapiens
gctggctgttggctggggg

SEQ ID NO: 1984371 - DNA, 23 bp, Homo sapiens
gctggctgttggctgggggcctc

SEQ ID NO: 1984372 - DNA, 21 bp, Homo sapiens
gctggcttctgttgcgccact

SEQ ID NO: 1984373 - DNA, 16 bp, Homo sapiens
ggacaaaggagcctgt

SEQ ID NO: 1984374 - DNA, 17 bp, Homo sapiens
ggacaaaggagcctgtg

SEQ ID NO: 1984375 - DNA, 12 bp, Homo sapiens
ggacaacccaga

SEQ ID NO: 1984376 - DNA, 19 bp, Homo sapiens
ggacaacctgcccctcccc

SEQ ID NO: 1984377 - DNA, 20 bp, Homo sapiens
ggacaacctgcccctcccca

SEQ ID NO: 1984378 - DNA, 23 bp, Homo sapiens
ggacaagccaacttgtaaataca

SEQ ID NO: 1984379 - DNA, 20 bp, Homo sapiens
ggacaaggaggtctgtgcca

SEQ ID NO: 1984380 - DNA, 13 bp, Homo sapiens
ggacacacaaggt

SEQ ID NO: 1984381 - DNA, 11 bp, Homo sapiens
ggacacacaca

SEQ ID NO: 1984382 - DNA, 13 bp, Homo sapiens
ggacacacacaca

SEQ ID NO: 1984383 - DNA, 12 bp, Homo sapiens
ggacacactaat

SEQ ID NO: 1984384 - DNA, 11 bp, Homo sapiens
ggacacactgt

SEQ ID NO: 1984385 - DNA, 16 bp, Homo sapiens
ggacacattttctcct

SEQ ID NO: 1984386 - DNA, 21 bp, Homo sapiens
ggacaccccccgccccccacc

SEQ ID NO: 1984387 - DNA, 19 bp, Homo sapiens
ggacaccccttatccagga

SEQ ID NO: 1984388 - DNA, 12 bp, Homo sapiens
ggacacctgccc

SEQ ID NO: 1984389 - DNA, 19 bp, Homo sapiens
ggacacctgccccagcgcg

SEQ ID NO: 1984390 - DNA, 21 bp, Homo sapiens
ggacacctgccccagcgcggc

SEQ ID NO: 1984391 - DNA, 17 bp, Homo sapiens
ggacactaaccacgctg

SEQ ID NO: 1984392 - DNA, 17 bp, Homo sapiens
ggacagagacacctgca

SEQ ID NO: 1984393 - DNA, 18 bp, Homo sapiens
ggacagagacacctgcac

SEQ ID NO: 1984394 - DNA, 15 bp, Homo sapiens
ggacagccacggcca

SEQ ID NO: 1984395 - DNA, 20 bp, Homo sapiens
ggacagccacggccaggcca

SEQ ID NO: 1984396 - DNA, 23 bp, Homo sapiens
ggacagcctgtggcggtgcctgg

SEQ ID NO: 1984397 - DNA, 19 bp, Homo sapiens
ggacagctccttctgtcct

SEQ ID NO: 1984398 - DNA, 13 bp, Homo sapiens
ggacagctgcttg

SEQ ID NO: 1984399 - DNA, 12 bp, Homo sapiens
ggacagctggct

SEQ ID NO: 1984400 - DNA, 13 bp, Homo sapiens
ggacagctggctg

SEQ ID NO: 1984401 - DNA, 15 bp, Homo sapiens
ggacagctggctgct

SEQ ID NO: 1984402 - DNA, 19 bp, Homo sapiens
ggacagctggctgctgaca

SEQ ID NO: 1984403 - DNA, 14 bp, Homo sapiens
ggacagctgtgcct

SEQ ID NO: 1984404 - DNA, 18 bp, Homo sapiens
ggacagggcttggggagc

SEQ ID NO: 1984405 - DNA, 13 bp, Homo sapiens
ggacagtcctggg

SEQ ID NO: 1984406 - DNA, 17 bp, Homo sapiens
ggacagtgcttcagcct

SEQ ID NO: 1984407 - DNA, 23 bp, Homo sapiens
ggacagtgcttcagcctgaggct

SEQ ID NO: 1984408 - DNA, 15 bp, Homo sapiens
ggacagttggcagag

SEQ ID NO: 1984409 - DNA, 16 bp, Homo sapiens
ggacagttggcagaga

SEQ ID NO: 1984410 - DNA, 18 bp, Homo sapiens
ggacagttggcagagaag

SEQ ID NO: 1984411 - DNA, 15 bp, Homo sapiens
ggacatggagagaga

SEQ ID NO: 1984412 - DNA, 22 bp, Homo sapiens
ggacatgtgctattgaactgag

SEQ ID NO: 1984413 - DNA, 19 bp, Homo sapiens
ggacattttctctttaaaa

SEQ ID NO: 1984414 - DNA, 20 bp, Homo sapiens
ggaccaaattgcttctagga

SEQ ID NO: 1984415 - DNA, 18 bp, Homo sapiens
ggaccaaccctgtttcct

SEQ ID NO: 1984416 - DNA, 13 bp, Homo sapiens
ggaccaactggct

SEQ ID NO: 1984417 - DNA, 19 bp, Homo sapiens
ggaccaactggcttctgtg

SEQ ID NO: 1984418 - DNA, 14 bp, Homo sapiens
ggaccaagatgggc

SEQ ID NO: 1984419 - DNA, 13 bp, Homo sapiens
ggaccacacctcc

SEQ ID NO: 1984420 - DNA, 20 bp, Homo sapiens
ggaccacagtgggtggcacc

SEQ ID NO: 1984421 - DNA, 20 bp, Homo sapiens
ggaccaccagccccagcaag

SEQ ID NO: 1984422 - DNA, 22 bp, Homo sapiens
ggaccacccgccctggcagttg

SEQ ID NO: 1984423 - DNA, 19 bp, Homo sapiens
ggaccagaagccaaagact

SEQ ID NO: 1984424 - DNA, 23 bp, Homo sapiens
gctttcttctacaaccagagccc

SEQ ID NO: 1984425 - DNA, 21 bp, Homo sapiens
gctttgaatacccccagagac

SEQ ID NO: 1984426 - DNA, 23 bp, Homo sapiens
gctttgaatacccccagagacct

SEQ ID NO: 1984427 - DNA, 18 bp, Homo sapiens
gctttgacatgaaaagat

SEQ ID NO: 1984428 - DNA, 14 bp, Homo sapiens
gctttgactcacct

SEQ ID NO: 1984429 - DNA, 16 bp, Homo sapiens
gctttgcagaccgcat

SEQ ID NO: 1984430 - DNA, 14 bp, Homo sapiens
gctttgcaggctct

SEQ ID NO: 1984431 - DNA, 18 bp, Homo sapiens
gctttgcaggctctgggc

SEQ ID NO: 1984432 - DNA, 19 bp, Homo sapiens
gctttgcaggctctgggct

SEQ ID NO: 1984433 - DNA, 20 bp, Homo sapiens
gctttgcattcctacaaaga

SEQ ID NO: 1984434 - DNA, 21 bp, Homo sapiens
gctttgccatgggcctgctgc

SEQ ID NO: 1984435 - DNA, 11 bp, Homo sapiens
gctttgcctgc

SEQ ID NO: 1984436 - DNA, 21 bp, Homo sapiens
gctttgcttatggtaataaaa

SEQ ID NO: 1984437 - DNA, 17 bp, Homo sapiens
gctttgcttttcctgga

SEQ ID NO: 1984438 - DNA, 17 bp, Homo sapiens
gctttgggaggccaagg

SEQ ID NO: 1984439 - DNA, 18 bp, Homo sapiens
gctttgggaggccaaggc

SEQ ID NO: 1984440 - DNA, 20 bp, Homo sapiens
gctttggggacagttggcag

SEQ ID NO: 1984441 - DNA, 18 bp, Homo sapiens
gctttgtatccatgaggg

SEQ ID NO: 1984442 - DNA, 15 bp, Homo sapiens
gctttgtgtgattga

SEQ ID NO: 1984443 - DNA, 15 bp, Homo sapiens
gctttgttttatata

SEQ ID NO: 1984444 - DNA, 12 bp, Homo sapiens
gcttttaagaaa

SEQ ID NO: 1984445 - DNA, 16 bp, Homo sapiens
gcttttaataaaattg

SEQ ID NO: 1984446 - DNA, 18 bp, Homo sapiens
gcttttcaaacaagaatg

SEQ ID NO: 1984447 - DNA, 16 bp, Homo sapiens
gcttttcatggaagtg

SEQ ID NO: 1984448 - DNA, 22 bp, Homo sapiens
gcttttgccactttggcttctc

SEQ ID NO: 1984449 - DNA, 13 bp, Homo sapiens
gcttttgctgggg

SEQ ID NO: 1984450 - DNA, 16 bp, Homo sapiens
ggaaaaaaaataatgt

SEQ ID NO: 1984451 - DNA, 14 bp, Homo sapiens
ggaaaaaaaatata

SEQ ID NO: 1984452 - DNA, 16 bp, Homo sapiens
ggaaaaaaaatatata

SEQ ID NO: 1984453 - DNA, 11 bp, Homo sapiens
ggaaaaaaagc

SEQ ID NO: 1984454 - DNA, 15 bp, Homo sapiens
ggaaaaaagttttga

SEQ ID NO: 1984455 - DNA, 15 bp, Homo sapiens
ggaaaaatatttaag

SEQ ID NO: 1984456 - DNA, 15 bp, Homo sapiens
ggaaaaatccagaaa

SEQ ID NO: 1984457 - DNA, 19 bp, Homo sapiens
ggaaaacataatatcttga

SEQ ID NO: 1984458 - DNA, 22 bp, Homo sapiens
ggaaaaccaagccgtggcttcc

SEQ ID NO: 1984459 - DNA, 14 bp, Homo sapiens
ggaaaaccagggat

SEQ ID NO: 1984460 - DNA, 15 bp, Homo sapiens
ggaaaaccagggata

SEQ ID NO: 1984461 - DNA, 16 bp, Homo sapiens
ggaaaaccagggatag

SEQ ID NO: 1984462 - DNA, 16 bp, Homo sapiens
ggaaaactgacagagg

SEQ ID NO: 1984463 - DNA, 14 bp, Homo sapiens
ggaaaagaatacag

SEQ ID NO: 1984464 - DNA, 20 bp, Homo sapiens
ggaaaagcactttacagatg

SEQ ID NO: 1984465 - DNA, 14 bp, Homo sapiens
ggaaaagctgctga

SEQ ID NO: 1984466 - DNA, 18 bp, Homo sapiens
ggaaaagctgctgacagt

SEQ ID NO: 1984467 - DNA, 16 bp, Homo sapiens
ggaaaaggcctggggt

SEQ ID NO: 1984468 - DNA, 16 bp, Homo sapiens
ggaaaatgtcctgtgg

SEQ ID NO: 1984469 - DNA, 20 bp, Homo sapiens
ggaaacagctaatgggacac

SEQ ID NO: 1984470 - DNA, 14 bp, Homo sapiens
ggaaaccaaaggaa

SEQ ID NO: 1984471 - DNA, 18 bp, Homo sapiens
ggaaaccttgcagcattt

SEQ ID NO: 1984472 - DNA, 16 bp, Homo sapiens
ggaaagacgtttttgt

SEQ ID NO: 1984473 - DNA, 16 bp, Homo sapiens
ggaaagactgaaagaa

SEQ ID NO: 1984474 - DNA, 12 bp, Homo sapiens
ggaaagagacca

SEQ ID NO: 1984475 - DNA, 19 bp, Homo sapiens
ggaaagcaccgcagcatgt

SEQ ID NO: 1984476 - DNA, 23 bp, Homo sapiens
ggaaagcaccgcagcatgtgggg

SEQ ID NO: 1984477 - DNA, 18 bp, Homo sapiens
ggaaagcatcacctcagg

SEQ ID NO: 1984478 - DNA, 12 bp, Homo sapiens
ggaaagccctcc

SEQ ID NO: 1984479 - DNA, 13 bp, Homo sapiens
ggaaagcctctgc

SEQ ID NO: 1984480 - DNA, 19 bp, Homo sapiens
ggaaaggaaaaccagggat

SEQ ID NO: 1984481 - DNA, 21 bp, Homo sapiens
ggaaaggaaaaccagggatag

SEQ ID NO: 1984482 - DNA, 12 bp, Homo sapiens
ggaaaggaccca

SEQ ID NO: 1984483 - DNA, 19 bp, Homo sapiens
ggaaaggctcagtctcagg

SEQ ID NO: 1984484 - DNA, 20 bp, Homo sapiens
ggaaaggctcagtctcagga

SEQ ID NO: 1984485 - DNA, 20 bp, Homo sapiens
ggaaaggctctgaaagccag

SEQ ID NO: 1984486 - DNA, 13 bp, Homo sapiens
ggaaataaatgat

SEQ ID NO: 1984487 - DNA, 16 bp, Homo sapiens
ggaaatatcagttact

SEQ ID NO: 1984488 - DNA, 22 bp, Homo sapiens
ggaaatatcagttactcagccc

SEQ ID NO: 1984489 - DNA, 14 bp, Homo sapiens
ggaaatctggattt

SEQ ID NO: 1984490 - DNA, 14 bp, Homo sapiens
ggaaatggagggtg

SEQ ID NO: 1984491 - DNA, 19 bp, Homo sapiens
ggaaatggtatgagctgag

SEQ ID NO: 1984492 - DNA, 17 bp, Homo sapiens
ggaaatgtcaacaagta

SEQ ID NO: 1984493 - DNA, 12 bp, Homo sapiens
ggaacagaagga

SEQ ID NO: 1984494 - DNA, 13 bp, Homo sapiens
ggaacagaaggat

SEQ ID NO: 1984495 - DNA, 13 bp, Homo sapiens
ggaacagagcggg

SEQ ID NO: 1984496 - DNA, 18 bp, Homo sapiens
ggaacagtgtttcccata

SEQ ID NO: 1984497 - DNA, 13 bp, Homo sapiens
ggaaccatgaagc

SEQ ID NO: 1984498 - DNA, 18 bp, Homo sapiens
ggaaccccgcagcccgtg

SEQ ID NO: 1984499 - DNA, 19 bp, Homo sapiens
ggaaccccgcagcccgtga

SEQ ID NO: 1984500 - DNA, 15 bp, Homo sapiens
ggaacctaattgaaa

SEQ ID NO: 1984501 - DNA, 23 bp, Homo sapiens
ggaacctagtactctctgctcta

SEQ ID NO: 1984502 - DNA, 15 bp, Homo sapiens
ggaacctcaaactgg

SEQ ID NO: 1984503 - DNA, 19 bp, Homo sapiens
ggaacctgaggcctgaagg

SEQ ID NO: 1984504 - DNA, 16 bp, Homo sapiens
ggaacgagcactggcc

SEQ ID NO: 1984505 - DNA, 19 bp, Homo sapiens
ggaacgagcactggccaga

SEQ ID NO: 1984506 - DNA, 23 bp, Homo sapiens
ggaacgcagaggcggaaaccttg

SEQ ID NO: 1984507 - DNA, 23 bp, Homo sapiens
ggaactcatcctgtgtggggagg

SEQ ID NO: 1984508 - DNA, 14 bp, Homo sapiens
ggaactccactctc

SEQ ID NO: 1984509 - DNA, 11 bp, Homo sapiens
ggaactcccag

SEQ ID NO: 1984510 - DNA, 13 bp, Homo sapiens
ggaactcccagca

SEQ ID NO: 1984511 - DNA, 12 bp, Homo sapiens
ggaactctgaca

SEQ ID NO: 1984512 - DNA, 19 bp, Homo sapiens
ggaactctgacaagggctg

SEQ ID NO: 1984513 - DNA, 19 bp, Homo sapiens
ggaactgaagacctccaca

SEQ ID NO: 1984514 - DNA, 15 bp, Homo sapiens
ggaactgaccccctc

SEQ ID NO: 1984515 - DNA, 20 bp, Homo sapiens
ggaactgaccccctcccctg

SEQ ID NO: 1984516 - DNA, 23 bp, Homo sapiens
ggaactgcagtatggccatgggc

SEQ ID NO: 1984517 - DNA, 14 bp, Homo sapiens
ggaactgtggcttt

SEQ ID NO: 1984518 - DNA, 19 bp, Homo sapiens
ggaagaaagagaaggagcc

SEQ ID NO: 1984519 - DNA, 18 bp, Homo sapiens
ggaagaaattcctgtagc

SEQ ID NO: 1984520 - DNA, 16 bp, Homo sapiens
ggaagagaagggaagc

SEQ ID NO: 1984521 - DNA, 18 bp, Homo sapiens
ggaagagagagagagagg

SEQ ID NO: 1984522 - DNA, 19 bp, Homo sapiens
ggaagagaggcacctgctg

SEQ ID NO: 1984523 - DNA, 13 bp, Homo sapiens
ggaagagcagcct

SEQ ID NO: 1984524 - DNA, 14 bp, Homo sapiens
ggaagagcagcctg

SEQ ID NO: 1984525 - DNA, 15 bp, Homo sapiens
ggaagagcagcctga

SEQ ID NO: 1984526 - DNA, 21 bp, Homo sapiens
ggaagagcaggcacatggagg

SEQ ID NO: 1984527 - DNA, 20 bp, Homo sapiens
ggaagagggcagtacctggg

SEQ ID NO: 1984528 - DNA, 22 bp, Homo sapiens
ggaagattccctcttcctgcca

SEQ ID NO: 1984529 - DNA, 18 bp, Homo sapiens
ggaagcaagacgtcctgg

SEQ ID NO: 1984530 - DNA, 14 bp, Homo sapiens
ggaagcaggcagag

SEQ ID NO: 1984531 - DNA, 15 bp, Homo sapiens
ggaagcaggcagagc

SEQ ID NO: 1984532 - DNA, 20 bp, Homo sapiens
ggaagcagtgccttccataa

SEQ ID NO: 1984533 - DNA, 21 bp, Homo sapiens
ggaagcagtgccttccataat

SEQ ID NO: 1984534 - DNA, 17 bp, Homo sapiens
ggaagcatgtaggagaa

SEQ ID NO: 1984535 - DNA, 21 bp, Homo sapiens
ggaagcatgtaggagaatcca

SEQ ID NO: 1984536 - DNA, 19 bp, Homo sapiens
ggaagcatttgtttctact

SEQ ID NO: 1984537 - DNA, 18 bp, Homo sapiens
ggaagccaacttggcttt

SEQ ID NO: 1984538 - DNA, 15 bp, Homo sapiens
ggaagccaggctgag

SEQ ID NO: 1984539 - DNA, 19 bp, Homo sapiens
ggaagccccttactatgat

SEQ ID NO: 1984540 - DNA, 17 bp, Homo sapiens
ggaagccctccttccac

SEQ ID NO: 1984541 - DNA, 16 bp, Homo sapiens
gcaaagtctaaagttt

SEQ ID NO: 1984542 - DNA, 16 bp, Homo sapiens
gcaaagtgcaaatact

SEQ ID NO: 1984543 - DNA, 15 bp, Homo sapiens
gcaaagtgccctcat

SEQ ID NO: 1984544 - DNA, 23 bp, Homo sapiens
gcaaagtgctgtacccttccacc

SEQ ID NO: 1984545 - DNA, 17 bp, Homo sapiens
gcaaatataagctggga

SEQ ID NO: 1984546 - DNA, 20 bp, Homo sapiens
gcaaatcaaccccagactca

SEQ ID NO: 1984547 - DNA, 12 bp, Homo sapiens
gcaaatcaatgc

SEQ ID NO: 1984548 - DNA, 19 bp, Homo sapiens
gcaaatcctcttctaactc

SEQ ID NO: 1984549 - DNA, 22 bp, Homo sapiens
gcaaatcgaatgaaattaactg

SEQ ID NO: 1984550 - DNA, 16 bp, Homo sapiens
gcaaatgacatgcact

SEQ ID NO: 1984551 - DNA, 19 bp, Homo sapiens
gcaaatgacatgcactgac

SEQ ID NO: 1984552 - DNA, 14 bp, Homo sapiens
gcaaatgagggagg

SEQ ID NO: 1984553 - DNA, 14 bp, Homo sapiens
gcaaattattttaa

SEQ ID NO: 1984554 - DNA, 23 bp, Homo sapiens
gcaaatttcaaaagacatgttgt

SEQ ID NO: 1984555 - DNA, 16 bp, Homo sapiens
gcaacaaaatatttaa

SEQ ID NO: 1984556 - DNA, 16 bp, Homo sapiens
gcaacacaagctggaa

SEQ ID NO: 1984557 - DNA, 17 bp, Homo sapiens
gcaacactctatattta

SEQ ID NO: 1984558 - DNA, 20 bp, Homo sapiens
gcaacaggaatctcagagac

SEQ ID NO: 1984559 - DNA, 21 bp, Homo sapiens
gcaacaggaatctcagagaca

SEQ ID NO: 1984560 - DNA, 14 bp, Homo sapiens
gcaacaggctgggc

SEQ ID NO: 1984561 - DNA, 16 bp, Homo sapiens
gcaacaggctgggctt

SEQ ID NO: 1984562 - DNA, 19 bp, Homo sapiens
gcaacaggctgggcttcag

SEQ ID NO: 1984563 - DNA, 19 bp, Homo sapiens
gcaacatctcgagccccct

SEQ ID NO: 1984564 - DNA, 15 bp, Homo sapiens
gcaaccacacacctc

SEQ ID NO: 1984565 - DNA, 16 bp, Homo sapiens
gcaaccccagttctgc

SEQ ID NO: 1984566 - DNA, 18 bp, Homo sapiens
gcaaccccagttctgctc

SEQ ID NO: 1984567 - DNA, 19 bp, Homo sapiens
gcaaccccagttctgctcc

SEQ ID NO: 1984568 - DNA, 21 bp, Homo sapiens
gcaaccccagttctgctcctc

SEQ ID NO: 1984569 - DNA, 18 bp, Homo sapiens
gcaacccccagcctgcta

SEQ ID NO: 1984570 - DNA, 20 bp, Homo sapiens
gcaacccctgtacccagctc

SEQ ID NO: 1984571 - DNA, 19 bp, Homo sapiens
gcaacccgtgccaagtcca

SEQ ID NO: 1984572 - DNA, 22 bp, Homo sapiens
gcaacccgtgccaagtccaggt

SEQ ID NO: 1984573 - DNA, 17 bp, Homo sapiens
gcaacccttgctgctgc

SEQ ID NO: 1984574 - DNA, 18 bp, Homo sapiens
gcaaccgtggcccttcct

SEQ ID NO: 1984575 - DNA, 22 bp, Homo sapiens
gcaaccgtggcccttcctggac

SEQ ID NO: 1984576 - DNA, 24 bp, Homo sapiens
gcaaccgtggcccttcctggacag

SEQ ID NO: 1984577 - DNA, 17 bp, Homo sapiens
gcaacctcccaacccag

SEQ ID NO: 1984578 - DNA, 19 bp, Homo sapiens
gcaacctccgcctcttggg

SEQ ID NO: 1984579 - DNA, 13 bp, Homo sapiens
gcaacctgttctt

SEQ ID NO: 1984580 - DNA, 16 bp, Homo sapiens
gcaactagccaaggct

SEQ ID NO: 1984581 - DNA, 18 bp, Homo sapiens
gcaactcagaatgctcta

SEQ ID NO: 1984582 - DNA, 17 bp, Homo sapiens
gcaactctccactccat

SEQ ID NO: 1984583 - DNA, 16 bp, Homo sapiens
gcaactctgactcttt

SEQ ID NO: 1984584 - DNA, 14 bp, Homo sapiens
gcaactgaggcaga

SEQ ID NO: 1984585 - DNA, 19 bp, Homo sapiens
gcaactgaggcagacagca

SEQ ID NO: 1984586 - DNA, 22 bp, Homo sapiens
gcaactgaggcagacagcagct

SEQ ID NO: 1984587 - DNA, 16 bp, Homo sapiens
gcaactgttggataat

SEQ ID NO: 1984588 - DNA, 16 bp, Homo sapiens
gcaagacgtcctggaa

SEQ ID NO: 1984589 - DNA, 18 bp, Homo sapiens
gcaagacgtcctggaatg

SEQ ID NO: 1984590 - DNA, 13 bp, Homo sapiens
gcaagagaacatt

SEQ ID NO: 1984591 - DNA, 22 bp, Homo sapiens
gcaagagccttggtgtccacct

SEQ ID NO: 1984592 - DNA, 15 bp, Homo sapiens
gcaagatatttatat

SEQ ID NO: 1984593 - DNA, 12 bp, Homo sapiens
gcaagatgtggg

SEQ ID NO: 1984594 - DNA, 16 bp, Homo sapiens
gcaagatgtgggcagt

SEQ ID NO: 1984595 - DNA, 13 bp, Homo sapiens
gcaagattgctta

SEQ ID NO: 1984596 - DNA, 22 bp, Homo sapiens
gcaagattttccacaagattcc

SEQ ID NO: 1984597 - DNA, 16 bp, Homo sapiens
gcaagcacctcctgcc

SEQ ID NO: 1984598 - DNA, 18 bp, Homo sapiens
gcaagcagcctcctgggc

SEQ ID NO: 1984599 - DNA, 21 bp, Homo sapiens
gcaagcagcctcctgggcagt

SEQ ID NO: 1984600 - DNA, 12 bp, Homo sapiens
gcaagcagggaa

SEQ ID NO: 1984601 - DNA, 14 bp, Homo sapiens
gcaagcagggaaag

SEQ ID NO: 1984602 - DNA, 20 bp, Homo sapiens
gcaagcatttatgtttattt

SEQ ID NO: 1984603 - DNA, 17 bp, Homo sapiens
gcaagccccagggcctg

SEQ ID NO: 1984604 - DNA, 18 bp, Homo sapiens
gcaagccccagggcctgg

SEQ ID NO: 1984605 - DNA, 15 bp, Homo sapiens
gcaagcccctcagcc

SEQ ID NO: 1984606 - DNA, 17 bp, Homo sapiens
gcaagcccctcagccct

SEQ ID NO: 1984607 - DNA, 16 bp, Homo sapiens
gcaagcgcagggagga

SEQ ID NO: 1984608 - DNA, 19 bp, Homo sapiens
gcaaggacaacctgcccct

SEQ ID NO: 1984609 - DNA, 14 bp, Homo sapiens
gcaaggcccgagca

SEQ ID NO: 1984610 - DNA, 21 bp, Homo sapiens
gcaaggcccgagcagctgagc

SEQ ID NO: 1984611 - DNA, 16 bp, Homo sapiens
gcaaggccctgtccca

SEQ ID NO: 1984612 - DNA, 15 bp, Homo sapiens
gcaagggccatgctg

SEQ ID NO: 1984613 - DNA, 19 bp, Homo sapiens
gcaagggccatgctgaagg

SEQ ID NO: 1984614 - DNA, 15 bp, Homo sapiens
gcaagggctccagca

SEQ ID NO: 1984615 - DNA, 21 bp, Homo sapiens
gcaagggctccagcatccagc

SEQ ID NO: 1984616 - DNA, 22 bp, Homo sapiens
gcaagggctccagcatccagcc

SEQ ID NO: 1984617 - DNA, 22 bp, Homo sapiens
gcaaggtgaacaccactttgtc

SEQ ID NO: 1984618 - DNA, 15 bp, Homo sapiens
gcaaggtgtgaatga

SEQ ID NO: 1984619 - DNA, 14 bp, Homo sapiens
gcaagtcatactta

SEQ ID NO: 1984620 - DNA, 14 bp, Homo sapiens
gctattatgtaaca

SEQ ID NO: 1984621 - DNA, 17 bp, Homo sapiens
gctattattttcactgt

SEQ ID NO: 1984622 - DNA, 12 bp, Homo sapiens
gctattgaaatt

SEQ ID NO: 1984623 - DNA, 19 bp, Homo sapiens
gctattgatgtttccagaa

SEQ ID NO: 1984624 - DNA, 23 bp, Homo sapiens
gctattgatgtttccagaaaata

SEQ ID NO: 1984625 - DNA, 14 bp, Homo sapiens
gctattgcactcca

SEQ ID NO: 1984626 - DNA, 23 bp, Homo sapiens
gctctggcggcttcctgtccact

SEQ ID NO: 1984627 - DNA, 15 bp, Homo sapiens
gctctgggaaggggt

SEQ ID NO: 1984628 - DNA, 17 bp, Homo sapiens
gctctgggctcagggct

SEQ ID NO: 1984629 - DNA, 11 bp, Homo sapiens
gctctggggat

SEQ ID NO: 1984630 - DNA, 12 bp, Homo sapiens
gctctgtccact

SEQ ID NO: 1984631 - DNA, 15 bp, Homo sapiens
gctctgtccactctg

SEQ ID NO: 1984632 - DNA, 11 bp, Homo sapiens
gctctgtggcc

SEQ ID NO: 1984633 - DNA, 14 bp, Homo sapiens
gctctgtggcctgt

SEQ ID NO: 1984634 - DNA, 16 bp, Homo sapiens
gctcttagtgcccgcc

SEQ ID NO: 1984635 - DNA, 17 bp, Homo sapiens
gctcttcactcagccac

SEQ ID NO: 1984636 - DNA, 18 bp, Homo sapiens
gctcttcactcagccaca

SEQ ID NO: 1984637 - DNA, 21 bp, Homo sapiens
gctcttcactcagccacaccc

SEQ ID NO: 1984638 - DNA, 19 bp, Homo sapiens
gctcttcagtgggagaaaa

SEQ ID NO: 1984639 - DNA, 17 bp, Homo sapiens
gctcttccaaagctcct

SEQ ID NO: 1984640 - DNA, 14 bp, Homo sapiens
gctcttcctggacc

SEQ ID NO: 1984641 - DNA, 20 bp, Homo sapiens
gctcttctaacctcagccaa

SEQ ID NO: 1984642 - DNA, 17 bp, Homo sapiens
gtctgattcccaagctc

SEQ ID NO: 1984643 - DNA, 20 bp, Homo sapiens
gtctgattcccaagctctgc

SEQ ID NO: 1984644 - DNA, 16 bp, Homo sapiens
gtctgatttgtgatga

SEQ ID NO: 1984645 - DNA, 16 bp, Homo sapiens
gtctgcaatgtccctt

SEQ ID NO: 1984646 - DNA, 15 bp, Homo sapiens
gtctgcacccagggg

SEQ ID NO: 1984647 - DNA, 18 bp, Homo sapiens
gtctgcattgttattgtg

SEQ ID NO: 1984648 - DNA, 15 bp, Homo sapiens
gtctgccagccagca

SEQ ID NO: 1984649 - DNA, 12 bp, Homo sapiens
gtctgccaggcc

SEQ ID NO: 1984650 - DNA, 13 bp, Homo sapiens
gtctgccccaccc

SEQ ID NO: 1984651 - DNA, 17 bp, Homo sapiens
gtctgctatattttcat

SEQ ID NO: 1984652 - DNA, 18 bp, Homo sapiens
gtctgctcaggaattgaa

SEQ ID NO: 1984653 - DNA, 17 bp, Homo sapiens
gtctggaaaagcacttt

SEQ ID NO: 1984654 - DNA, 13 bp, Homo sapiens
gtctggaagctga

SEQ ID NO: 1984655 - DNA, 17 bp, Homo sapiens
gtctggaagctgagcag

SEQ ID NO: 1984656 - DNA, 18 bp, Homo sapiens
gtctggaagctgagcagg

SEQ ID NO: 1984657 - DNA, 19 bp, Homo sapiens
gtctggaagctgagcaggc

SEQ ID NO: 1984658 - DNA, 17 bp, Homo sapiens
gtctggagaagcagtga

SEQ ID NO: 1984659 - DNA, 22 bp, Homo sapiens
gtctggatctgggaccctttcc

SEQ ID NO: 1984660 - DNA, 17 bp, Homo sapiens
gtctgggagtgttctgt

SEQ ID NO: 1984661 - DNA, 22 bp, Homo sapiens
gtctgggcaatgaaaccaaagc

SEQ ID NO: 1984662 - DNA, 14 bp, Homo sapiens
gtctggggagggag

SEQ ID NO: 1984663 - DNA, 16 bp, Homo sapiens
gtctggggttcagccc

SEQ ID NO: 1984664 - DNA, 17 bp, Homo sapiens
gtctggggttcagcccc

SEQ ID NO: 1984665 - DNA, 14 bp, Homo sapiens
gtctggtttctaga

SEQ ID NO: 1984666 - DNA, 14 bp, Homo sapiens
gtctgtacacgtgt

SEQ ID NO: 1984667 - DNA, 19 bp, Homo sapiens
gtctgtacacgtgtcctgt

SEQ ID NO: 1984668 - DNA, 17 bp, Homo sapiens
gtctgtatatacatttc

SEQ ID NO: 1984669 - DNA, 17 bp, Homo sapiens
gtctgtcgctgggctgt

SEQ ID NO: 1984670 - DNA, 17 bp, Homo sapiens
gtctgtgctgtgcctgc

SEQ ID NO: 1984671 - DNA, 16 bp, Homo sapiens
gtctgtggattttttc

SEQ ID NO: 1984672 - DNA, 14 bp, Homo sapiens
gtctgtgtgtgtgt

SEQ ID NO: 1984673 - DNA, 17 bp, Homo sapiens
gtctgttcacttttcct

SEQ ID NO: 1984674 - DNA, 20 bp, Homo sapiens
gtctgtttcaatgacctgta

SEQ ID NO: 1984675 - DNA, 19 bp, Homo sapiens
gtcttaattaaaagaatat

SEQ ID NO: 1984676 - DNA, 17 bp, Homo sapiens
gtcttatggcgttgcag

SEQ ID NO: 1984677 - DNA, 14 bp, Homo sapiens
gtcttatttcctca

SEQ ID NO: 1984678 - DNA, 20 bp, Homo sapiens
gtcttcaaattgtcttttgt

SEQ ID NO: 1984679 - DNA, 15 bp, Homo sapiens
gtcttcaattaaaag

SEQ ID NO: 1984680 - DNA, 12 bp, Homo sapiens
gtcttcagccta

SEQ ID NO: 1984681 - DNA, 13 bp, Homo sapiens
gtcttcagcctag

SEQ ID NO: 1984682 - DNA, 15 bp, Homo sapiens
gtcttccaaccccag

SEQ ID NO: 1984683 - DNA, 20 bp, Homo sapiens
gtcttccaaccccagctggc

SEQ ID NO: 1984684 - DNA, 22 bp, Homo sapiens
gtcttccaaccccagctggcct

SEQ ID NO: 1984685 - DNA, 17 bp, Homo sapiens
gtcttcttacttggaac

SEQ ID NO: 1984686 - DNA, 15 bp, Homo sapiens
gtcttcttgtgtcct

SEQ ID NO: 1984687 - DNA, 17 bp, Homo sapiens
gtcttgaactcctggcc

SEQ ID NO: 1984688 - DNA, 18 bp, Homo sapiens
gtcttgaactcctggcct

SEQ ID NO: 1984689 - DNA, 13 bp, Homo sapiens
gtcttgagaaaaa

SEQ ID NO: 1984690 - DNA, 19 bp, Homo sapiens
gtcttgatgtgtcatctaa

SEQ ID NO: 1984691 - DNA, 20 bp, Homo sapiens
gtcttgcaagcagcctcctg

SEQ ID NO: 1984692 - DNA, 19 bp, Homo sapiens
gtcttgcaatggcagcctt

SEQ ID NO: 1984693 - DNA, 15 bp, Homo sapiens
gtcttgccagccaga

SEQ ID NO: 1984694 - DNA, 19 bp, Homo sapiens
gtcttgggctactggcagc

SEQ ID NO: 1984695 - DNA, 12 bp, Homo sapiens
gtcttgtatttt

SEQ ID NO: 1984696 - DNA, 14 bp, Homo sapiens
gtcttgtattttct

SEQ ID NO: 1984697 - DNA, 22 bp, Homo sapiens
gtcttgtttgtagccaatacat

SEQ ID NO: 1984698 - DNA, 15 bp, Homo sapiens
gtctttaatcccagt

SEQ ID NO: 1984699 - DNA, 14 bp, Homo sapiens
gtctttctccaaag

SEQ ID NO: 1984700 - DNA, 13 bp, Homo sapiens
gtctttgaataaa

SEQ ID NO: 1984701 - DNA, 19 bp, Homo sapiens
gtctttgcacatgtgacca

SEQ ID NO: 1984702 - DNA, 17 bp, Homo sapiens
gtctttggaggaacagc

SEQ ID NO: 1984703 - DNA, 19 bp, Homo sapiens
gtctttgtaatgtcaccac

SEQ ID NO: 1984704 - DNA, 22 bp, Homo sapiens
gtctttgtaatgtcaccacctt

SEQ ID NO: 1984705 - DNA, 20 bp, Homo sapiens
gtctttttaagcttatttaa

SEQ ID NO: 1984706 - DNA, 21 bp, Homo sapiens
gtgaaaataggtatacagtgg

SEQ ID NO: 1984707 - DNA, 17 bp, Homo sapiens
gtgaaaccctgtctcta

SEQ ID NO: 1984708 - DNA, 16 bp, Homo sapiens
gtgaaacttcctaagt

SEQ ID NO: 1984709 - DNA, 22 bp, Homo sapiens
gtgaaagaattatttttgtgtt

SEQ ID NO: 1984710 - DNA, 19 bp, Homo sapiens
gtgaaagatgcaagcacct

SEQ ID NO: 1984711 - DNA, 13 bp, Homo sapiens
gtgaaagtgtaaa

SEQ ID NO: 1984712 - DNA, 21 bp, Homo sapiens
gtgaaataattaaaaaccact

SEQ ID NO: 1984713 - DNA, 22 bp, Homo sapiens
gtgaaattcaacctgtgtctta

SEQ ID NO: 1984714 - DNA, 21 bp, Homo sapiens
gtgaaatttattagttaatat

SEQ ID NO: 1984715 - DNA, 22 bp, Homo sapiens
gtgaaccaaagagactggagca

SEQ ID NO: 1984716 - DNA, 13 bp, Homo sapiens
gtgaacccaggac

SEQ ID NO: 1984717 - DNA, 14 bp, Homo sapiens
gtgaacgatttaga

SEQ ID NO: 1984718 - DNA, 21 bp, Homo sapiens
gtgaacttacacttggagccc

SEQ ID NO: 1984719 - DNA, 16 bp, Homo sapiens
gtgaacttgattttaa

SEQ ID NO: 1984720 - DNA, 18 bp, Homo sapiens
gtgaacttgattttaaaa

SEQ ID NO: 1984721 - DNA, 13 bp, Homo sapiens
gtgaagaaatgga

SEQ ID NO: 1984722 - DNA, 22 bp, Homo sapiens
gtgaagccccttgtcctctccc

SEQ ID NO: 1984723 - DNA, 19 bp, Homo sapiens
gtgaaggagaaaggagccg

SEQ ID NO: 1984724 - DNA, 13 bp, Homo sapiens
gtgaagggcaccg

SEQ ID NO: 1984725 - DNA, 14 bp, Homo sapiens
gtgaagggcaccga

SEQ ID NO: 1984726 - DNA, 21 bp, Homo sapiens
gtgaagttacctcttacattt

SEQ ID NO: 1984727 - DNA, 15 bp, Homo sapiens
gtgaataaaaaccct

SEQ ID NO: 1984728 - DNA, 18 bp, Homo sapiens
gtgaataaaaaccctgta

SEQ ID NO: 1984729 - DNA, 15 bp, Homo sapiens
gtgaatcagacccta

SEQ ID NO: 1984730 - DNA, 18 bp, Homo sapiens
gtgacaaaattttataag

SEQ ID NO: 1984731 - DNA, 16 bp, Homo sapiens
gtgacaacctttgtgt

SEQ ID NO: 1984732 - DNA, 22 bp, Homo sapiens
gtgacaacctttgtgtaataaa

SEQ ID NO: 1984733 - DNA, 21 bp, Homo sapiens
gtgacagacattttcaataat

SEQ ID NO: 1984734 - DNA, 12 bp, Homo sapiens
gtgacagagacc

SEQ ID NO: 1984735 - DNA, 13 bp, Homo sapiens
gtgacagaggcag

SEQ ID NO: 1984736 - DNA, 23 bp, Homo sapiens
gtgacagaggcagccccattctg

SEQ ID NO: 1984737 - DNA, 17 bp, Homo sapiens
gtgacagagttcactat

SEQ ID NO: 1984738 - DNA, 18 bp, Homo sapiens
gtgacagagttcactata

SEQ ID NO: 1984739 - DNA, 15 bp, Homo sapiens
gtgacaggaaagccc

SEQ ID NO: 1984740 - DNA, 18 bp, Homo sapiens
gtgacaggaaagccctcc

SEQ ID NO: 1984741 - DNA, 19 bp, Homo sapiens
gtgaccaagttataaatca

SEQ ID NO: 1984742 - DNA, 17 bp, Homo sapiens
gtgaccaggcatcctcc

SEQ ID NO: 1984743 - DNA, 19 bp, Homo sapiens
gtgacccaatgctcctgga

SEQ ID NO: 1984744 - DNA, 21 bp, Homo sapiens
gtgaccccagggcacaggagc

SEQ ID NO: 1984745 - DNA, 23 bp, Homo sapiens
gtgacccggcaccccctgcagct

SEQ ID NO: 1984746 - DNA, 16 bp, Homo sapiens
gtgacccttcagggcc

SEQ ID NO: 1984747 - DNA, 17 bp, Homo sapiens
gtgacccttcagggcca

SEQ ID NO: 1984748 - DNA, 19 bp, Homo sapiens
gtgacccttcagggccaga

SEQ ID NO: 1984749 - DNA, 23 bp, Homo sapiens
gtgacccttcccaatcagcactg

SEQ ID NO: 1984750 - DNA, 18 bp, Homo sapiens
gtgacctatacctgtgtt

SEQ ID NO: 1984751 - DNA, 14 bp, Homo sapiens
gtgacctctgcctg

SEQ ID NO: 1984752 - DNA, 12 bp, Homo sapiens
gtgacctgctga

SEQ ID NO: 1984753 - DNA, 14 bp, Homo sapiens
gtgacctgctgagc

SEQ ID NO: 1984754 - DNA, 16 bp, Homo sapiens
gtgacgggagcctcct

SEQ ID NO: 1984755 - DNA, 15 bp, Homo sapiens
gtgacggtcccacac

SEQ ID NO: 1984756 - DNA, 19 bp, Homo sapiens
gtgacggtcccacactggt

SEQ ID NO: 1984757 - DNA, 22 bp, Homo sapiens
gtgacggtcccacactggtgac

SEQ ID NO: 1984758 - DNA, 21 bp, Homo sapiens
gtgacggtcctttaggcagcc

SEQ ID NO: 1984759 - DNA, 13 bp, Homo sapiens
gggtaaggtgcct

SEQ ID NO: 1984760 - DNA, 14 bp, Homo sapiens
gggtaaggtgcctt

SEQ ID NO: 1984761 - DNA, 21 bp, Homo sapiens
gggtaataaacttagaataaa

SEQ ID NO: 1984762 - DNA, 19 bp, Homo sapiens
gggtacatttccctgtgct

SEQ ID NO: 1984763 - DNA, 13 bp, Homo sapiens
gggtacccactgc

SEQ ID NO: 1984764 - DNA, 14 bp, Homo sapiens
gtatatatagaatc

SEQ ID NO: 1984765 - DNA, 21 bp, Homo sapiens
gtatatatatatagtaactac

SEQ ID NO: 1984766 - DNA, 15 bp, Homo sapiens
gtatatatgtacagt

SEQ ID NO: 1984767 - DNA, 14 bp, Homo sapiens
gtatatatgtgtat

SEQ ID NO: 1984768 - DNA, 19 bp, Homo sapiens
gtatatatgtgtgtttaaa

SEQ ID NO: 1984769 - DNA, 21 bp, Homo sapiens
gtatatattctacacatatat

SEQ ID NO: 1984770 - DNA, 18 bp, Homo sapiens
gtatatctggacaagcca

SEQ ID NO: 1984771 - DNA, 17 bp, Homo sapiens
gtatatgtatatctata

SEQ ID NO: 1984772 - DNA, 17 bp, Homo sapiens
gtatatgtatgtgtgta

SEQ ID NO: 1984773 - DNA, 18 bp, Homo sapiens
gtatatgtgcgtctctct

SEQ ID NO: 1984774 - DNA, 16 bp, Homo sapiens
gtatatgttgggtgca

SEQ ID NO: 1984775 - DNA, 13 bp, Homo sapiens
gtatatgttgtaa

SEQ ID NO: 1984776 - DNA, 17 bp, Homo sapiens
gtatatgttgtaataaa

SEQ ID NO: 1984777 - DNA, 15 bp, Homo sapiens
gtatattacctcaaa

SEQ ID NO: 1984778 - DNA, 14 bp, Homo sapiens
gtatattagtttga

SEQ ID NO: 1984779 - DNA, 16 bp, Homo sapiens
gtatattatgtattta

SEQ ID NO: 1984780 - DNA, 22 bp, Homo sapiens
gtatattgtaggaatcctttga

SEQ ID NO: 1984781 - DNA, 14 bp, Homo sapiens
gtatatttatactc

SEQ ID NO: 1984782 - DNA, 16 bp, Homo sapiens
gtatatttatactcta

SEQ ID NO: 1984783 - DNA, 14 bp, Homo sapiens
gtatcaaatctgta

SEQ ID NO: 1984784 - DNA, 13 bp, Homo sapiens
gtatcaggcacag

SEQ ID NO: 1984785 - DNA, 15 bp, Homo sapiens
gtatcaggtctccca

SEQ ID NO: 1984786 - DNA, 16 bp, Homo sapiens
gtatcaggtgctgcca

SEQ ID NO: 1984787 - DNA, 11 bp, Homo sapiens
gtatcatgcat

SEQ ID NO: 1984788 - DNA, 14 bp, Homo sapiens
gtatcatttctaat

SEQ ID NO: 1984789 - DNA, 15 bp, Homo sapiens
gtatcatttctaatt

SEQ ID NO: 1984790 - DNA, 21 bp, Homo sapiens
gtatcattttgcacgtgctct

SEQ ID NO: 1984791 - DNA, 20 bp, Homo sapiens
gtatccaattatgtgacaac

SEQ ID NO: 1984792 - DNA, 14 bp, Homo sapiens
gtatcccactagcc

SEQ ID NO: 1984793 - DNA, 20 bp, Homo sapiens
gtatcctgataaacattaaa

SEQ ID NO: 1984794 - DNA, 14 bp, Homo sapiens
gtatcggagacagt

SEQ ID NO: 1984795 - DNA, 13 bp, Homo sapiens
gtatctccaggat

SEQ ID NO: 1984796 - DNA, 11 bp, Homo sapiens
gtatctgaagg

SEQ ID NO: 1984797 - DNA, 14 bp, Homo sapiens
gtatcttatttata

SEQ ID NO: 1984798 - DNA, 15 bp, Homo sapiens
gtatcttatttatat

SEQ ID NO: 1984799 - DNA, 16 bp, Homo sapiens
gtatcttctgcagaca

SEQ ID NO: 1984800 - DNA, 23 bp, Homo sapiens
gtatgaaagatggctgtgcctct

SEQ ID NO: 1984801 - DNA, 15 bp, Homo sapiens
gtatgaacttgagga

SEQ ID NO: 1984802 - DNA, 19 bp, Homo sapiens
gtatgaacttgaggacaca

SEQ ID NO: 1984803 - DNA, 20 bp, Homo sapiens
gtatgaacttgaggacacat

SEQ ID NO: 1984804 - DNA, 22 bp, Homo sapiens
gtatgaacttgaggacacatgt

SEQ ID NO: 1984805 - DNA, 18 bp, Homo sapiens
gtatgaataaagacacct

SEQ ID NO: 1984806 - DNA, 13 bp, Homo sapiens
gtatgatgtgttg

SEQ ID NO: 1984807 - DNA, 18 bp, Homo sapiens
gtatgccttcctgtttaa

SEQ ID NO: 1984808 - DNA, 14 bp, Homo sapiens
gtatgctggccagc

SEQ ID NO: 1984809 - DNA, 16 bp, Homo sapiens
gtatgcttattttaaa

SEQ ID NO: 1984810 - DNA, 15 bp, Homo sapiens
gtatgggtgtgtgtt

SEQ ID NO: 1984811 - DNA, 15 bp, Homo sapiens
gtatggtggctgggt

SEQ ID NO: 1984812 - DNA, 14 bp, Homo sapiens
gtatggttctcaga

SEQ ID NO: 1984813 - DNA, 15 bp, Homo sapiens
gtatggttctcagat

SEQ ID NO: 1984814 - DNA, 14 bp, Homo sapiens
gtatgtactgttat

SEQ ID NO: 1984815 - DNA, 10 bp, Homo sapiens
gtatgtatac

SEQ ID NO: 1984816 - DNA, 18 bp, Homo sapiens
gtatgtgaaagtgtaaaa

SEQ ID NO: 1984817 - DNA, 17 bp, Homo sapiens
gtatgtgatatctgaac

SEQ ID NO: 1984818 - DNA, 11 bp, Homo sapiens
gtatgtgtgtg

SEQ ID NO: 1984819 - DNA, 13 bp, Homo sapiens
gtatgtgtgtggt

SEQ ID NO: 1984820 - DNA, 23 bp, Homo sapiens
gtatgtttttgtgtatttgttaa

SEQ ID NO: 1984821 - DNA, 18 bp, Homo sapiens
gtattaaatatttaacat

SEQ ID NO: 1984822 - DNA, 14 bp, Homo sapiens
gtattaatactaaa

SEQ ID NO: 1984823 - DNA, 19 bp, Homo sapiens
gtattaatactaaaatatg

SEQ ID NO: 1984824 - DNA, 21 bp, Homo sapiens
gtattaatactaaaatatgtc

SEQ ID NO: 1984825 - DNA, 14 bp, Homo sapiens
gtattaatattcat

SEQ ID NO: 1984826 - DNA, 16 bp, Homo sapiens
gtattaattatctgat

SEQ ID NO: 1984827 - DNA, 19 bp, Homo sapiens
gtattaggggtaatatatt

SEQ ID NO: 1984828 - DNA, 14 bp, Homo sapiens
gtattcaggcactg

SEQ ID NO: 1984829 - DNA, 15 bp, Homo sapiens
gtattcaggcactga

SEQ ID NO: 1984830 - DNA, 17 bp, Homo sapiens
gtattcaggcactgaga

SEQ ID NO: 1984831 - DNA, 19 bp, Homo sapiens
gtattccagacctgaagaa

SEQ ID NO: 1984832 - DNA, 23 bp, Homo sapiens
gtattccatttttactaaagcag

SEQ ID NO: 1984833 - DNA, 14 bp, Homo sapiens
gtattcttgtcaaa

SEQ ID NO: 1984834 - DNA, 21 bp, Homo sapiens
gtattgagccattttttaaat

SEQ ID NO: 1984835 - DNA, 23 bp, Homo sapiens
gtattgcgaaacaacttgtgttc

SEQ ID NO: 1984836 - DNA, 16 bp, Homo sapiens
gtattgcgaatgtgca

SEQ ID NO: 1984837 - DNA, 20 bp, Homo sapiens
gtattgtaatgaatatctgc

SEQ ID NO: 1984838 - DNA, 16 bp, Homo sapiens
gtatttatattagagt

SEQ ID NO: 1984839 - DNA, 14 bp, Homo sapiens
gtatttatatttgg

SEQ ID NO: 1984840 - DNA, 16 bp, Homo sapiens
gtatttatatttggaa

SEQ ID NO: 1984841 - DNA, 18 bp, Homo sapiens
gtatttatatttggaaag

SEQ ID NO: 1984842 - DNA, 13 bp, Homo sapiens
gtatttatcttta

SEQ ID NO: 1984843 - DNA, 12 bp, Homo sapiens
gtatttctgccc

SEQ ID NO: 1984844 - DNA, 14 bp, Homo sapiens
gtatttgttaatgg

SEQ ID NO: 1984845 - DNA, 22 bp, Homo sapiens
gtatttgttaatttagaaaact

SEQ ID NO: 1984846 - DNA, 16 bp, Homo sapiens
gtattttaaatgtttt

SEQ ID NO: 1984847 - DNA, 15 bp, Homo sapiens
gtattttaagcattc

SEQ ID NO: 1984848 - DNA, 19 bp, Homo sapiens
gtattttaggcagggattt

SEQ ID NO: 1984849 - DNA, 17 bp, Homo sapiens
gtattttattaaagcaa

SEQ ID NO: 1984850 - DNA, 19 bp, Homo sapiens
gtattttattaaagcaaca

SEQ ID NO: 1984851 - DNA, 23 bp, Homo sapiens
gtattttccatacacatccccag

SEQ ID NO: 1984852 - DNA, 20 bp, Homo sapiens
gtattttcttcccatttgta

SEQ ID NO: 1984853 - DNA, 17 bp, Homo sapiens
gtattttggagaaatta

SEQ ID NO: 1984854 - DNA, 21 bp, Homo sapiens
gtatttttcaggtaggccctt

SEQ ID NO: 1984855 - DNA, 15 bp, Homo sapiens
gtatttttgaataaa

SEQ ID NO: 1984856 - DNA, 23 bp, Homo sapiens
gtattttttttactgtgcataca

SEQ ID NO: 1984857 - DNA, 14 bp, Homo sapiens
gtcaaaaggtgcct

SEQ ID NO: 1984858 - DNA, 15 bp, Homo sapiens
gtcaaaaggtgcctg

SEQ ID NO: 1984859 - DNA, 16 bp, Homo sapiens
gtcaaaaggtgcctgt

SEQ ID NO: 1984860 - DNA, 18 bp, Homo sapiens
gtcaaaatagtgccacta

SEQ ID NO: 1984861 - DNA, 12 bp, Homo sapiens
gtcaaacaaata

SEQ ID NO: 1984862 - DNA, 13 bp, Homo sapiens
gtcaaaccgcact

SEQ ID NO: 1984863 - DNA, 22 bp, Homo sapiens
gtcaaaccgcactcacccatgt

SEQ ID NO: 1984864 - DNA, 12 bp, Homo sapiens
gtcaaagaaatg

SEQ ID NO: 1984865 - DNA, 17 bp, Homo sapiens
gtcaacactcttcttga

SEQ ID NO: 1984866 - DNA, 19 bp, Homo sapiens
gtcaacacttaagggtttt

SEQ ID NO: 1984867 - DNA, 18 bp, Homo sapiens
gtcaacagagaaggcagg

SEQ ID NO: 1984868 - DNA, 23 bp, Homo sapiens
gtcaacagagaaggcaggaatgt

SEQ ID NO: 1984869 - DNA, 10 bp, Homo sapiens
gggaggctga

SEQ ID NO: 1984870 - DNA, 15 bp, Homo sapiens
gggaggctgagacag

SEQ ID NO: 1984871 - DNA, 17 bp, Homo sapiens
gggaggctgagacagga

SEQ ID NO: 1984872 - DNA, 14 bp, Homo sapiens
gggaggcttcctga

SEQ ID NO: 1984873 - DNA, 14 bp, Homo sapiens
gggagggctctgag

SEQ ID NO: 1984874 - DNA, 16 bp, Homo sapiens
gggaggggcctaggga

SEQ ID NO: 1984875 - DNA, 19 bp, Homo sapiens
gggaggggcctagggagcc

SEQ ID NO: 1984876 - DNA, 13 bp, Homo sapiens
gggagggggacgc

SEQ ID NO: 1984877 - DNA, 13 bp, Homo sapiens
gggagggggctcc

SEQ ID NO: 1984878 - DNA, 16 bp, Homo sapiens
gggagggtggatccac

SEQ ID NO: 1984879 - DNA, 14 bp, Homo sapiens
gggagggtggggca

SEQ ID NO: 1984880 - DNA, 14 bp, Homo sapiens
gggaggtcattttg

SEQ ID NO: 1984881 - DNA, 16 bp, Homo sapiens
gggaggtgaccccagg

SEQ ID NO: 1984882 - DNA, 18 bp, Homo sapiens
gggagtgttctgtgggct

SEQ ID NO: 1984883 - DNA, 13 bp, Homo sapiens
gggataagaatag

SEQ ID NO: 1984884 - DNA, 13 bp, Homo sapiens
gggatcacaaggt

SEQ ID NO: 1984885 - DNA, 18 bp, Homo sapiens
gggatcttgcattcccag

SEQ ID NO: 1984886 - DNA, 13 bp, Homo sapiens
gggatgagaaagg

SEQ ID NO: 1984887 - DNA, 15 bp, Homo sapiens
gggatggtcctgggg

SEQ ID NO: 1984888 - DNA, 12 bp, Homo sapiens
gggatgtcctct

SEQ ID NO: 1984889 - DNA, 19 bp, Homo sapiens
gggattctggtcttcactg

SEQ ID NO: 1984890 - DNA, 16 bp, Homo sapiens
gggattgggagggaca

SEQ ID NO: 1984891 - DNA, 17 bp, Homo sapiens
gggattgggagggacag

SEQ ID NO: 1984892 - DNA, 19 bp, Homo sapiens
gggatttcttcgctgctct

SEQ ID NO: 1984893 - DNA, 20 bp, Homo sapiens
gggcaacccccagcctgcta

SEQ ID NO: 1984894 - DNA, 21 bp, Homo sapiens
gggcaagaacctaaagtagca

SEQ ID NO: 1984895 - DNA, 22 bp, Homo sapiens
gggcaataaatgccctctctga

SEQ ID NO: 1984896 - DNA, 13 bp, Homo sapiens
gggcaatggggag

SEQ ID NO: 1984897 - DNA, 17 bp, Homo sapiens
gggcacaccactgccct

SEQ ID NO: 1984898 - DNA, 20 bp, Homo sapiens
gggcacaccactgccctgcc

SEQ ID NO: 1984899 - DNA, 23 bp, Homo sapiens
gggcacaccgggcactcagaaga

SEQ ID NO: 1984900 - DNA, 15 bp, Homo sapiens
gggcacaggagctac

SEQ ID NO: 1984901 - DNA, 15 bp, Homo sapiens
gggcacatgaggagg

SEQ ID NO: 1984902 - DNA, 16 bp, Homo sapiens
gggcacatgaggaggg

SEQ ID NO: 1984903 - DNA, 17 bp, Homo sapiens
gggcacatgaggagggt

SEQ ID NO: 1984904 - DNA, 19 bp, Homo sapiens
gggcacccccagcctgggc

SEQ ID NO: 1984905 - DNA, 21 bp, Homo sapiens
gggcacccccagcctgggcct

SEQ ID NO: 1984906 - DNA, 13 bp, Homo sapiens
gggcacctgccac

SEQ ID NO: 1984907 - DNA, 15 bp, Homo sapiens
gggcacctgccaccg

SEQ ID NO: 1984908 - DNA, 16 bp, Homo sapiens
gggcactcagaagaca

SEQ ID NO: 1984909 - DNA, 20 bp, Homo sapiens
gggcactgtctgcgtgacta

SEQ ID NO: 1984910 - DNA, 15 bp, Homo sapiens
gggcagaaagtggcc

SEQ ID NO: 1984911 - DNA, 22 bp, Homo sapiens
gggcagaacagccgctcctgtc

SEQ ID NO: 1984912 - DNA, 14 bp, Homo sapiens
gggcagaagggaga

SEQ ID NO: 1984913 - DNA, 16 bp, Homo sapiens
gggcagaagggagaag

SEQ ID NO: 1984914 - DNA, 19 bp, Homo sapiens
gggcagaagggagaaggat

SEQ ID NO: 1984915 - DNA, 16 bp, Homo sapiens
gggcagagccatgggc

SEQ ID NO: 1984916 - DNA, 18 bp, Homo sapiens
gggcagagccatgggcct

SEQ ID NO: 1984917 - DNA, 14 bp, Homo sapiens
gggcagagccggga

SEQ ID NO: 1984918 - DNA, 17 bp, Homo sapiens
gggcagagccgggaagc

SEQ ID NO: 1984919 - DNA, 21 bp, Homo sapiens
gggcagaggctggaggcaggg

SEQ ID NO: 1984920 - DNA, 23 bp, Homo sapiens
gggcagagggaatgttccctgca

SEQ ID NO: 1984921 - DNA, 15 bp, Homo sapiens
gggcagagggcagag

SEQ ID NO: 1984922 - DNA, 16 bp, Homo sapiens
gggcagagtgggctgc

SEQ ID NO: 1984923 - DNA, 14 bp, Homo sapiens
gggcagcaccctcc

SEQ ID NO: 1984924 - DNA, 13 bp, Homo sapiens
gggcagcagccag

SEQ ID NO: 1984925 - DNA, 15 bp, Homo sapiens
gggcagcagccagcc

SEQ ID NO: 1984926 - DNA, 18 bp, Homo sapiens
gggcagcagccagccctg

SEQ ID NO: 1984927 - DNA, 17 bp, Homo sapiens
gggcagccaaacccatg

SEQ ID NO: 1984928 - DNA, 14 bp, Homo sapiens
gggcagccaggggc

SEQ ID NO: 1984929 - DNA, 17 bp, Homo sapiens
gggcagccgctaggaga

SEQ ID NO: 1984930 - DNA, 12 bp, Homo sapiens
gggcagctcctc

SEQ ID NO: 1984931 - DNA, 17 bp, Homo sapiens
gggcagctgggccccac

SEQ ID NO: 1984932 - DNA, 19 bp, Homo sapiens
gggcaggagtagctgagct

SEQ ID NO: 1984933 - DNA, 14 bp, Homo sapiens
gggcaggcctggga

SEQ ID NO: 1984934 - DNA, 19 bp, Homo sapiens
gggcaggcctgggacccag

SEQ ID NO: 1984935 - DNA, 18 bp, Homo sapiens
gggcaggtcctgcccatg

SEQ ID NO: 1984936 - DNA, 13 bp, Homo sapiens
gggcagtgcctcc

SEQ ID NO: 1984937 - DNA, 18 bp, Homo sapiens
gggcagtgcctcctggga

SEQ ID NO: 1984938 - DNA, 13 bp, Homo sapiens
gggcatcaggcac

SEQ ID NO: 1984939 - DNA, 16 bp, Homo sapiens
gggcatcaggcactgg

SEQ ID NO: 1984940 - DNA, 18 bp, Homo sapiens
gggcatccgcagcccagg

SEQ ID NO: 1984941 - DNA, 20 bp, Homo sapiens
gggcatggacgttcggggca

SEQ ID NO: 1984942 - DNA, 20 bp, Homo sapiens
gggcatgggagggagggaga

SEQ ID NO: 1984943 - DNA, 16 bp, Homo sapiens
gggcatgtgtgcctgt

SEQ ID NO: 1984944 - DNA, 21 bp, Homo sapiens
gggcatgtgtgcctgtggcag

SEQ ID NO: 1984945 - DNA, 15 bp, Homo sapiens
gggcattgagcaagc

SEQ ID NO: 1984946 - DNA, 13 bp, Homo sapiens
gggccaagaaaga

SEQ ID NO: 1984947 - DNA, 17 bp, Homo sapiens
gggccaagacttggcaa

SEQ ID NO: 1984948 - DNA, 14 bp, Homo sapiens
gggccaagagagac

SEQ ID NO: 1984949 - DNA, 15 bp, Homo sapiens
gggccaagagagaca

SEQ ID NO: 1984950 - DNA, 21 bp, Homo sapiens
gggccaattaaaatatatata

SEQ ID NO: 1984951 - DNA, 19 bp, Homo sapiens
gggccactccttcctgccc

SEQ ID NO: 1984952 - DNA, 20 bp, Homo sapiens
gggccactccttcctgcccc

SEQ ID NO: 1984953 - DNA, 17 bp, Homo sapiens
gggccactgccagcagc

SEQ ID NO: 1984954 - DNA, 23 bp, Homo sapiens
gggccagagttccacaaatctat

SEQ ID NO: 1984955 - DNA, 18 bp, Homo sapiens
gggccagctggtgctgca

SEQ ID NO: 1984956 - DNA, 21 bp, Homo sapiens
gggccagctggtgctgcaagg

SEQ ID NO: 1984957 - DNA, 13 bp, Homo sapiens
gggccaggagaga

SEQ ID NO: 1984958 - DNA, 13 bp, Homo sapiens
gggccagggccct

SEQ ID NO: 1984959 - DNA, 14 bp, Homo sapiens
gggccagggccctg

SEQ ID NO: 1984960 - DNA, 15 bp, Homo sapiens
gggccagtctgggct

SEQ ID NO: 1984961 - DNA, 18 bp, Homo sapiens
gggccagtgagggctggg

SEQ ID NO: 1984962 - DNA, 14 bp, Homo sapiens
gggccatgctgaag

SEQ ID NO: 1984963 - DNA, 20 bp, Homo sapiens
gggcccacagacagatccca

SEQ ID NO: 1984964 - DNA, 16 bp, Homo sapiens
gggcccagctgtagcc

SEQ ID NO: 1984965 - DNA, 22 bp, Homo sapiens
gggcccagctgtagccatggct

SEQ ID NO: 1984966 - DNA, 11 bp, Homo sapiens
gggcccaggct

SEQ ID NO: 1984967 - DNA, 18 bp, Homo sapiens
ggctctccacctcagcct

SEQ ID NO: 1984968 - DNA, 19 bp, Homo sapiens
ggctctccacctcagcctt

SEQ ID NO: 1984969 - DNA, 21 bp, Homo sapiens
ggctctccacctcagccttgg

SEQ ID NO: 1984970 - DNA, 22 bp, Homo sapiens
ggctctccacctcagccttgga

SEQ ID NO: 1984971 - DNA, 21 bp, Homo sapiens
ggctctccaccttgttacaca

SEQ ID NO: 1984972 - DNA, 23 bp, Homo sapiens
ggctctcctgagaggtgctgcag

SEQ ID NO: 1984973 - DNA, 13 bp, Homo sapiens
ggctctcctggct

SEQ ID NO: 1984974 - DNA, 14 bp, Homo sapiens
ggctctgaggcgcc

SEQ ID NO: 1984975 - DNA, 18 bp, Homo sapiens
ggctctgccccagaggcc

SEQ ID NO: 1984976 - DNA, 21 bp, Homo sapiens
ggctctgccccagctctggct

SEQ ID NO: 1984977 - DNA, 14 bp, Homo sapiens
ggctctgcctggag

SEQ ID NO: 1984978 - DNA, 18 bp, Homo sapiens
ggctctggccaccctggc

SEQ ID NO: 1984979 - DNA, 23 bp, Homo sapiens
ggctctgggaaggggtgccctct

SEQ ID NO: 1984980 - DNA, 15 bp, Homo sapiens
ggctctgggctcagg

SEQ ID NO: 1984981 - DNA, 16 bp, Homo sapiens
ggctctgggctcaggg

SEQ ID NO: 1984982 - DNA, 16 bp, Homo sapiens
ggctcttcctggacct

SEQ ID NO: 1984983 - DNA, 17 bp, Homo sapiens
ggctcttcctggacctg

SEQ ID NO: 1984984 - DNA, 19 bp, Homo sapiens
ggctcttcctggacctgag

SEQ ID NO: 1984985 - DNA, 15 bp, Homo sapiens
ggctcttctcctttc

SEQ ID NO: 1984986 - DNA, 16 bp, Homo sapiens
ggctcttctcctttca

SEQ ID NO: 1984987 - DNA, 14 bp, Homo sapiens
ggctcttctctcgg

SEQ ID NO: 1984988 - DNA, 19 bp, Homo sapiens
ggctgacccagtccctggg

SEQ ID NO: 1984989 - DNA, 22 bp, Homo sapiens
ggctgacccagtccctggggga

SEQ ID NO: 1984990 - DNA, 20 bp, Homo sapiens
ggctgaccccaaagagcctg

SEQ ID NO: 1984991 - DNA, 15 bp, Homo sapiens
ggctgagacaggaga

SEQ ID NO: 1984992 - DNA, 15 bp, Homo sapiens
ggctgagcccagcca

SEQ ID NO: 1984993 - DNA, 16 bp, Homo sapiens
ggctgagcccagccac

SEQ ID NO: 1984994 - DNA, 18 bp, Homo sapiens
ggctgagcccagccacct

SEQ ID NO: 1984995 - DNA, 19 bp, Homo sapiens
ggctgagcccagccacctc

SEQ ID NO: 1984996 - DNA, 16 bp, Homo sapiens
ggctgagcttggccct

SEQ ID NO: 1984997 - DNA, 13 bp, Homo sapiens
ggctgaggcagaa

SEQ ID NO: 1984998 - DNA, 14 bp, Homo sapiens
ggctgaggcaggag

SEQ ID NO: 1984999 - DNA, 17 bp, Homo sapiens
ggctgagtgagccacag

SEQ ID NO: 1985000 - DNA, 15 bp, Homo sapiens
ggctgataattttaa

SEQ ID NO: 1985001 - DNA, 22 bp, Homo sapiens
ggctgcaaaagaagtttctgga

SEQ ID NO: 1985002 - DNA, 24 bp, Homo sapiens
ggctgcaaagggtatcaggtgctg

SEQ ID NO: 1985003 - DNA, 17 bp, Homo sapiens
ggctgcagggagtccga

SEQ ID NO: 1985004 - DNA, 15 bp, Homo sapiens
ggctgcatgctctgg

SEQ ID NO: 1985005 - DNA, 18 bp, Homo sapiens
ggctgcatgctctggaag

SEQ ID NO: 1985006 - DNA, 20 bp, Homo sapiens
ggctgcatgctctggaagcc

SEQ ID NO: 1985007 - DNA, 20 bp, Homo sapiens
ggctgccactaacctgtaga

SEQ ID NO: 1985008 - DNA, 12 bp, Homo sapiens
ggctgccaggcg

SEQ ID NO: 1985009 - DNA, 23 bp, Homo sapiens
ggctgccaggcgttggtgccact

SEQ ID NO: 1985010 - DNA, 21 bp, Homo sapiens
ggctgccccgggtccccagct

SEQ ID NO: 1985011 - DNA, 13 bp, Homo sapiens
ggctgccctggtg

SEQ ID NO: 1985012 - DNA, 14 bp, Homo sapiens
ggctgccctggtgc

SEQ ID NO: 1985013 - DNA, 18 bp, Homo sapiens
ggctgcccttcgctgcca

SEQ ID NO: 1985014 - DNA, 22 bp, Homo sapiens
ggctgcccttcgctgccaggac

SEQ ID NO: 1985015 - DNA, 23 bp, Homo sapiens
ggctgcccttcgctgccaggaca

SEQ ID NO: 1985016 - DNA, 21 bp, Homo sapiens
ggctgccgggttctagtctcc

SEQ ID NO: 1985017 - DNA, 11 bp, Homo sapiens
ggctgcctgcc

SEQ ID NO: 1985018 - DNA, 12 bp, Homo sapiens
ggctgcctgccg

SEQ ID NO: 1985019 - DNA, 17 bp, Homo sapiens
ggctgcctggggattgg

SEQ ID NO: 1985020 - DNA, 18 bp, Homo sapiens
ggctgcggcctaggggtc

SEQ ID NO: 1985021 - DNA, 20 bp, Homo sapiens
ggctgcgggacagaggacca

SEQ ID NO: 1985022 - DNA, 21 bp, Homo sapiens
ggctgcgtcgaactgtcctgg

SEQ ID NO: 1985023 - DNA, 21 bp, Homo sapiens
ggctgctcattccttctggag

SEQ ID NO: 1985024 - DNA, 13 bp, Homo sapiens
ggctgctgacagg

SEQ ID NO: 1985025 - DNA, 13 bp, Homo sapiens
ggctgctggggca

SEQ ID NO: 1985026 - DNA, 18 bp, Homo sapiens
ggctgctgtgtagctctg

SEQ ID NO: 1985027 - DNA, 14 bp, Homo sapiens
ggctggacctgcac

SEQ ID NO: 1985028 - DNA, 18 bp, Homo sapiens
ggctggatgtggtggcat

SEQ ID NO: 1985029 - DNA, 13 bp, Homo sapiens
ggctggcaagcag

SEQ ID NO: 1985030 - DNA, 14 bp, Homo sapiens
ggctggcaagcagg

SEQ ID NO: 1985031 - DNA, 17 bp, Homo sapiens
ggctggcaagcagggaa

SEQ ID NO: 1985032 - DNA, 13 bp, Homo sapiens
ggctggcccagcc

SEQ ID NO: 1985033 - DNA, 19 bp, Homo sapiens
ggctggctgaaaatcacta

SEQ ID NO: 1985034 - DNA, 15 bp, Homo sapiens
ggctggctgagggca

SEQ ID NO: 1985035 - DNA, 17 bp, Homo sapiens
ggctgggccagcctcag

SEQ ID NO: 1985036 - DNA, 15 bp, Homo sapiens
ggctgggcccctggg

SEQ ID NO: 1985037 - DNA, 21 bp, Homo sapiens
ggctgggcccctgggatggga

SEQ ID NO: 1985038 - DNA, 13 bp, Homo sapiens
ggctggggcagag

SEQ ID NO: 1985039 - DNA, 14 bp, Homo sapiens
ggctggggcagagg

SEQ ID NO: 1985040 - DNA, 16 bp, Homo sapiens
ggctgggggcctcagt

SEQ ID NO: 1985041 - DNA, 19 bp, Homo sapiens
ggctggtgctgtggccagg

SEQ ID NO: 1985042 - DNA, 20 bp, Homo sapiens
ggctgtatcccatgagcctc

SEQ ID NO: 1985043 - DNA, 23 bp, Homo sapiens
ggctgtatcccatgagcctcagc

SEQ ID NO: 1985044 - DNA, 14 bp, Homo sapiens
ggctgtctctgtcc

SEQ ID NO: 1985045 - DNA, 14 bp, Homo sapiens
ggctgtctgtcacc

SEQ ID NO: 1985046 - DNA, 13 bp, Homo sapiens
ggctgtgaggccc

SEQ ID NO: 1985047 - DNA, 13 bp, Homo sapiens
ggctgtggaggcc

SEQ ID NO: 1985048 - DNA, 15 bp, Homo sapiens
ggctgtggaggcctg

SEQ ID NO: 1985049 - DNA, 21 bp, Homo sapiens
ggctgtggaggcctgatgctg

SEQ ID NO: 1985050 - DNA, 14 bp, Homo sapiens
ggctgtggcacaga

SEQ ID NO: 1985051 - DNA, 16 bp, Homo sapiens
ggctgtggtggctgtc

SEQ ID NO: 1985052 - DNA, 21 bp, Homo sapiens
ggctgttctgcactgaaaagg

SEQ ID NO: 1985053 - DNA, 20 bp, Homo sapiens
ggctgttggacagctgcttg

SEQ ID NO: 1985054 - DNA, 12 bp, Homo sapiens
ggcagcaccctc

SEQ ID NO: 1985055 - DNA, 14 bp, Homo sapiens
ggcagcaccctccc

SEQ ID NO: 1985056 - DNA, 20 bp, Homo sapiens
ggcagcaccctcccccgcag

SEQ ID NO: 1985057 - DNA, 13 bp, Homo sapiens
ggcagcagccagc

SEQ ID NO: 1985058 - DNA, 17 bp, Homo sapiens
ggcagcagccagccctg

SEQ ID NO: 1985059 - DNA, 20 bp, Homo sapiens
ggcagcagccagccctgcct

SEQ ID NO: 1985060 - DNA, 22 bp, Homo sapiens
ggcagcagccagccctgcctgg

SEQ ID NO: 1985061 - DNA, 16 bp, Homo sapiens
ggcagccaaacccatg

SEQ ID NO: 1985062 - DNA, 20 bp, Homo sapiens
ggcagccaaacccatgaggc

SEQ ID NO: 1985063 - DNA, 21 bp, Homo sapiens
ggcagccacacttctcaggac

SEQ ID NO: 1985064 - DNA, 15 bp, Homo sapiens
ggcagccatgcctca

SEQ ID NO: 1985065 - DNA, 19 bp, Homo sapiens
ggcagccatgcctcatgcc

SEQ ID NO: 1985066 - DNA, 16 bp, Homo sapiens
ggcagccccattctgc

SEQ ID NO: 1985067 - DNA, 20 bp, Homo sapiens
ggcagccccattctgcctgc

SEQ ID NO: 1985068 - DNA, 22 bp, Homo sapiens
ggcagccccattctgcctgccc

SEQ ID NO: 1985069 - DNA, 23 bp, Homo sapiens
ggcagccccattctgcctgccca

SEQ ID NO: 1985070 - DNA, 11 bp, Homo sapiens
ggcagcctgcc

SEQ ID NO: 1985071 - DNA, 14 bp, Homo sapiens
ggcagcctgccgcc

SEQ ID NO: 1985072 - DNA, 14 bp, Homo sapiens
ggcagctccaacag

SEQ ID NO: 1985073 - DNA, 22 bp, Homo sapiens
ggcagctccaacagcttgacca

SEQ ID NO: 1985074 - DNA, 14 bp, Homo sapiens
ggcagctcctctcc

SEQ ID NO: 1985075 - DNA, 22 bp, Homo sapiens
ggcagctcctctccttgggctc

SEQ ID NO: 1985076 - DNA, 13 bp, Homo sapiens
ggcagctcctctg

SEQ ID NO: 1985077 - DNA, 18 bp, Homo sapiens
ggcagctgagagccctgc

SEQ ID NO: 1985078 - DNA, 21 bp, Homo sapiens
ggcagctgcggtccacccagg

SEQ ID NO: 1985079 - DNA, 13 bp, Homo sapiens
ggcagctgctctt

SEQ ID NO: 1985080 - DNA, 15 bp, Homo sapiens
ggcagctgctcttag

SEQ ID NO: 1985081 - DNA, 14 bp, Homo sapiens
ggcagctgggcccc

SEQ ID NO: 1985082 - DNA, 23 bp, Homo sapiens
ggcagctgtcatggaaaagccca

SEQ ID NO: 1985083 - DNA, 21 bp, Homo sapiens
ggcagcttgagcctgtcacgt

SEQ ID NO: 1985084 - DNA, 21 bp, Homo sapiens
ggcagcttgagggttgggctg

SEQ ID NO: 1985085 - DNA, 12 bp, Homo sapiens
ggcaggaagaga

SEQ ID NO: 1985086 - DNA, 16 bp, Homo sapiens
ggcaggaagagagaga

SEQ ID NO: 1985087 - DNA, 23 bp, Homo sapiens
ggcaggaagagagagagagaggt

SEQ ID NO: 1985088 - DNA, 22 bp, Homo sapiens
ggcaggacacatcccggcctct

SEQ ID NO: 1985089 - DNA, 17 bp, Homo sapiens
ggcaggaggcctggcct

SEQ ID NO: 1985090 - DNA, 18 bp, Homo sapiens
ggcaggagtagctgagct

SEQ ID NO: 1985091 - DNA, 20 bp, Homo sapiens
ggcaggcacacagcagcccc

SEQ ID NO: 1985092 - DNA, 15 bp, Homo sapiens
ggcaggcagggctct

SEQ ID NO: 1985093 - DNA, 18 bp, Homo sapiens
ggcaggctagaacctggc

SEQ ID NO: 1985094 - DNA, 19 bp, Homo sapiens
ggcaggctagaacctggca

SEQ ID NO: 1985095 - DNA, 13 bp, Homo sapiens
ggcagggcagagg

SEQ ID NO: 1985096 - DNA, 19 bp, Homo sapiens
ggcagggccttgcccagag

SEQ ID NO: 1985097 - DNA, 20 bp, Homo sapiens
ggcagggccttgcccagaga

SEQ ID NO: 1985098 - DNA, 13 bp, Homo sapiens
ggcagggctctcc

SEQ ID NO: 1985099 - DNA, 20 bp, Homo sapiens
ggcagggctctcctggcttc

SEQ ID NO: 1985100 - DNA, 11 bp, Homo sapiens
ggcagggctgg

SEQ ID NO: 1985101 - DNA, 23 bp, Homo sapiens
ggcagggtgggatggaggagaag

SEQ ID NO: 1985102 - DNA, 16 bp, Homo sapiens
ggcaggtcctgcccat

SEQ ID NO: 1985103 - DNA, 19 bp, Homo sapiens
ggcaggtcctgcccatgtg

SEQ ID NO: 1985104 - DNA, 16 bp, Homo sapiens
tcaagctagaaggcca

SEQ ID NO: 1985105 - DNA, 19 bp, Homo sapiens
tcaagctgtcccctctgtc

SEQ ID NO: 1985106 - DNA, 20 bp, Homo sapiens
tcaagctgtcccctctgtca

SEQ ID NO: 1985107 - DNA, 21 bp, Homo sapiens
tcaagctgtcccctctgtcat

SEQ ID NO: 1985108 - DNA, 17 bp, Homo sapiens
tcaaggtcaacggctta

SEQ ID NO: 1985109 - DNA, 22 bp, Homo sapiens
tcaagtatttattattgaagat

SEQ ID NO: 1985110 - DNA, 12 bp, Homo sapiens
tcaagtccagag

SEQ ID NO: 1985111 - DNA, 13 bp, Homo sapiens
tcaagtccagagc

SEQ ID NO: 1985112 - DNA, 19 bp, Homo sapiens
tcaagtgaatctaaaagct

SEQ ID NO: 1985113 - DNA, 13 bp, Homo sapiens
tcaagtgatatat

SEQ ID NO: 1985114 - DNA, 22 bp, Homo sapiens
tcaagtgatatatgtatttatt

SEQ ID NO: 1985115 - DNA, 19 bp, Homo sapiens
tcaagtgcatgctctctgc

SEQ ID NO: 1985116 - DNA, 21 bp, Homo sapiens
tcaagtgcatgctctctgcag

SEQ ID NO: 1985117 - DNA, 13 bp, Homo sapiens
tcaagttattgta

SEQ ID NO: 1985118 - DNA, 16 bp, Homo sapiens
tcaagtttttacaaaa

SEQ ID NO: 1985119 - DNA, 16 bp, Homo sapiens
tcaataaaatcatgta

SEQ ID NO: 1985120 - DNA, 21 bp, Homo sapiens
tcaataaaatcatgtacattt

SEQ ID NO: 1985121 - DNA, 15 bp, Homo sapiens
tcaataaagtaccct

SEQ ID NO: 1985122 - DNA, 17 bp, Homo sapiens
tcaataaagtatctaca

SEQ ID NO: 1985123 - DNA, 17 bp, Homo sapiens
tcaataggaattgcatt

SEQ ID NO: 1985124 - DNA, 16 bp, Homo sapiens
tcaatattaaatacag

SEQ ID NO: 1985125 - DNA, 19 bp, Homo sapiens
tcaatattaaatacagaca

SEQ ID NO: 1985126 - DNA, 14 bp, Homo sapiens
tcaatattcctgaa

SEQ ID NO: 1985127 - DNA, 17 bp, Homo sapiens
tcaatattcctgaatga

SEQ ID NO: 1985128 - DNA, 18 bp, Homo sapiens
tcaatattcctgaatgaa

SEQ ID NO: 1985129 - DNA, 21 bp, Homo sapiens
tcaatattcctgaatgaaata

SEQ ID NO: 1985130 - DNA, 12 bp, Homo sapiens
tcaatatttatt

SEQ ID NO: 1985131 - DNA, 16 bp, Homo sapiens
tcaatattttccatga

SEQ ID NO: 1985132 - DNA, 19 bp, Homo sapiens
tcaatcagtctcagaatgt

SEQ ID NO: 1985133 - DNA, 16 bp, Homo sapiens
tcaatcagtgcagtga

SEQ ID NO: 1985134 - DNA, 15 bp, Homo sapiens
tcaatcatctgtgtg

SEQ ID NO: 1985135 - DNA, 17 bp, Homo sapiens
tcaatcccctcattcag

SEQ ID NO: 1985136 - DNA, 20 bp, Homo sapiens
tcaatcccctcattcaggaa

SEQ ID NO: 1985137 - DNA, 15 bp, Homo sapiens
tcaatcctgccccca

SEQ ID NO: 1985138 - DNA, 18 bp, Homo sapiens
tcaatgaaatatttgctt

SEQ ID NO: 1985139 - DNA, 16 bp, Homo sapiens
tcaatgattattttca

SEQ ID NO: 1985140 - DNA, 13 bp, Homo sapiens
tcaatgccctgcc

SEQ ID NO: 1985141 - DNA, 15 bp, Homo sapiens
tcaatgccctgccat

SEQ ID NO: 1985142 - DNA, 17 bp, Homo sapiens
tcaatggtttgcaagga

SEQ ID NO: 1985143 - DNA, 18 bp, Homo sapiens
tcaatggtttgcaaggaa

SEQ ID NO: 1985144 - DNA, 15 bp, Homo sapiens
tcaatgtgattctaa

SEQ ID NO: 1985145 - DNA, 16 bp, Homo sapiens
tcaatgtgattctaat

SEQ ID NO: 1985146 - DNA, 21 bp, Homo sapiens
tcaatgtgattctaatgtctt

SEQ ID NO: 1985147 - DNA, 20 bp, Homo sapiens
tcaatgttcacgcaacttga

SEQ ID NO: 1985148 - DNA, 22 bp, Homo sapiens
tcaatgttcacgcaacttgaaa

SEQ ID NO: 1985149 - DNA, 22 bp, Homo sapiens
tcaatgtttatgcaaggaagga

SEQ ID NO: 1985150 - DNA, 14 bp, Homo sapiens
tcaattaaatgtag

SEQ ID NO: 1985151 - DNA, 14 bp, Homo sapiens
tcaattagtacagt

SEQ ID NO: 1985152 - DNA, 15 bp, Homo sapiens
tcaattagtacagta

SEQ ID NO: 1985153 - DNA, 16 bp, Homo sapiens
tcaattagtacagtag

SEQ ID NO: 1985154 - DNA, 17 bp, Homo sapiens
tcaattagtacagtagc

SEQ ID NO: 1985155 - DNA, 18 bp, Homo sapiens
tatgatgttaaaaaaata

SEQ ID NO: 1985156 - DNA, 14 bp, Homo sapiens
tatgatttaaaaaa

SEQ ID NO: 1985157 - DNA, 16 bp, Homo sapiens
tatgatttaaaaaata

SEQ ID NO: 1985158 - DNA, 16 bp, Homo sapiens
tatgattttatttgac

SEQ ID NO: 1985159 - DNA, 17 bp, Homo sapiens
tatgatttttacaataa

SEQ ID NO: 1985160 - DNA, 18 bp, Homo sapiens
tatgattttttaaaagaa

SEQ ID NO: 1985161 - DNA, 12 bp, Homo sapiens
tatgcaaagcac

SEQ ID NO: 1985162 - DNA, 13 bp, Homo sapiens
tatgcaaagcact

SEQ ID NO: 1985163 - DNA, 16 bp, Homo sapiens
tatgcaagaagaatat

SEQ ID NO: 1985164 - DNA, 16 bp, Homo sapiens
tatgcaatttcctttt

SEQ ID NO: 1985165 - DNA, 21 bp, Homo sapiens
tatgcaatttttaaactagta

SEQ ID NO: 1985166 - DNA, 23 bp, Homo sapiens
tatgcaatttttaaactagtaat

SEQ ID NO: 1985167 - DNA, 13 bp, Homo sapiens
tatgcacatatgg

SEQ ID NO: 1985168 - DNA, 19 bp, Homo sapiens
tatgcacatatggactctg

SEQ ID NO: 1985169 - DNA, 18 bp, Homo sapiens
tatgcaccttgtgtctgt

SEQ ID NO: 1985170 - DNA, 17 bp, Homo sapiens
tatgcacgaccttggga

SEQ ID NO: 1985171 - DNA, 19 bp, Homo sapiens
tatgcagtattgagcactg

SEQ ID NO: 1985172 - DNA, 22 bp, Homo sapiens
tatgcataatcagcgccctgga

SEQ ID NO: 1985173 - DNA, 22 bp, Homo sapiens
tatgcatatattttagggctgt

SEQ ID NO: 1985174 - DNA, 17 bp, Homo sapiens
tatgccagctcagtccc

SEQ ID NO: 1985175 - DNA, 20 bp, Homo sapiens
tatgcctacttgtaatttct

SEQ ID NO: 1985176 - DNA, 20 bp, Homo sapiens
tatgcctgtactaaggagca

SEQ ID NO: 1985177 - DNA, 17 bp, Homo sapiens
tatgccttgtctgggga

SEQ ID NO: 1985178 - DNA, 22 bp, Homo sapiens
tatgctgccaaattttggccaa

SEQ ID NO: 1985179 - DNA, 18 bp, Homo sapiens
tatgctggccagcaccct

SEQ ID NO: 1985180 - DNA, 19 bp, Homo sapiens
tatgctggccagcaccctc

SEQ ID NO: 1985181 - DNA, 23 bp, Homo sapiens
tatggaaaagggtcttcttggca

SEQ ID NO: 1985182 - DNA, 17 bp, Homo sapiens
tatggaaataaatgtat

SEQ ID NO: 1985183 - DNA, 20 bp, Homo sapiens
tatggaaccttccctccaaa

SEQ ID NO: 1985184 - DNA, 24 bp, Homo sapiens
tatggaatacagtgttattttctt

SEQ ID NO: 1985185 - DNA, 12 bp, Homo sapiens
tatggactctgc

SEQ ID NO: 1985186 - DNA, 16 bp, Homo sapiens
tatggagagccctggg

SEQ ID NO: 1985187 - DNA, 14 bp, Homo sapiens
tatggagggcagag

SEQ ID NO: 1985188 - DNA, 19 bp, Homo sapiens
tatggatcccaattcattt

SEQ ID NO: 1985189 - DNA, 11 bp, Homo sapiens
tatggatgtgg

SEQ ID NO: 1985190 - DNA, 13 bp, Homo sapiens
tatggattctaaa

SEQ ID NO: 1985191 - DNA, 14 bp, Homo sapiens
tatggattctaaaa

SEQ ID NO: 1985192 - DNA, 22 bp, Homo sapiens
tagtcagaagcaggttcttgat

SEQ ID NO: 1985193 - DNA, 13 bp, Homo sapiens
tagtcatttattt

SEQ ID NO: 1985194 - DNA, 19 bp, Homo sapiens
tagtcatttattttaaaaa

SEQ ID NO: 1985195 - DNA, 13 bp, Homo sapiens
tagtccaatattt

SEQ ID NO: 1985196 - DNA, 14 bp, Homo sapiens
tagtccccatcagc

SEQ ID NO: 1985197 - DNA, 21 bp, Homo sapiens
tagtccgcaagttcagggaag

SEQ ID NO: 1985198 - DNA, 22 bp, Homo sapiens
tagtcctattctattgcagtta

SEQ ID NO: 1985199 - DNA, 22 bp, Homo sapiens
tagtctcctttgcactgagggc

SEQ ID NO: 1985200 - DNA, 14 bp, Homo sapiens
tagtctctgtgctt

SEQ ID NO: 1985201 - DNA, 13 bp, Homo sapiens
tagtctgtcatcc

SEQ ID NO: 1985202 - DNA, 17 bp, Homo sapiens
tagtctgtgtgcacaat

SEQ ID NO: 1985203 - DNA, 21 bp, Homo sapiens
tagtcttttactcctttgcat

SEQ ID NO: 1985204 - DNA, 20 bp, Homo sapiens
tagtgacaaaattggccaga

SEQ ID NO: 1985205 - DNA, 15 bp, Homo sapiens
tagtgacccacatgc

SEQ ID NO: 1985206 - DNA, 20 bp, Homo sapiens
tagtgagatttgtatttata

SEQ ID NO: 1985207 - DNA, 13 bp, Homo sapiens
tagtgatggttcc

SEQ ID NO: 1985208 - DNA, 14 bp, Homo sapiens
tagtgatggttccc

SEQ ID NO: 1985209 - DNA, 16 bp, Homo sapiens
tagtgatttcattacc

SEQ ID NO: 1985210 - DNA, 14 bp, Homo sapiens
tagtgcggacaagt

SEQ ID NO: 1985211 - DNA, 15 bp, Homo sapiens
tagtgctatatatat

SEQ ID NO: 1985212 - DNA, 17 bp, Homo sapiens
tagtgctattctgtgtt

SEQ ID NO: 1985213 - DNA, 18 bp, Homo sapiens
tagtgctattctgtgttg

SEQ ID NO: 1985214 - DNA, 21 bp, Homo sapiens
tagtgctattctgtgttgaac

SEQ ID NO: 1985215 - DNA, 16 bp, Homo sapiens
tagtggaagagcagcc

SEQ ID NO: 1985216 - DNA, 17 bp, Homo sapiens
tagtggaagagcagcct

SEQ ID NO: 1985217 - DNA, 21 bp, Homo sapiens
tagtggaagagcagcctgatg

SEQ ID NO: 1985218 - DNA, 15 bp, Homo sapiens
tagtggcaataagtt

SEQ ID NO: 1985219 - DNA, 20 bp, Homo sapiens
tagtggcttaaaacaacact

SEQ ID NO: 1985220 - DNA, 21 bp, Homo sapiens
tagtggggtaattctgcttct

SEQ ID NO: 1985221 - DNA, 20 bp, Homo sapiens
tagtggggtctccctctcct

SEQ ID NO: 1985222 - DNA, 20 bp, Homo sapiens
tagtgtcttcctagtatatt

SEQ ID NO: 1985223 - DNA, 17 bp, Homo sapiens
tagtgtgagtggcagcc

SEQ ID NO: 1985224 - DNA, 20 bp, Homo sapiens
tagtgtgagtggcagccatg

SEQ ID NO: 1985225 - DNA, 13 bp, Homo sapiens
tagtgtgtcagag

SEQ ID NO: 1985226 - DNA, 18 bp, Homo sapiens
tagtgtgtgtgcatgtgt

SEQ ID NO: 1985227 - DNA, 14 bp, Homo sapiens
tagtgttctgtatt

SEQ ID NO: 1985228 - DNA, 22 bp, Homo sapiens
tagttagctgctttaaatctat

SEQ ID NO: 1985229 - DNA, 16 bp, Homo sapiens
tagttaggaaataaaa

SEQ ID NO: 1985230 - DNA, 15 bp, Homo sapiens
tagttaggtgtgcca

SEQ ID NO: 1985231 - DNA, 16 bp, Homo sapiens
tagttaggtgtgccaa

SEQ ID NO: 1985232 - DNA, 21 bp, Homo sapiens
tagttaggtgtgccaaactac

SEQ ID NO: 1985233 - DNA, 16 bp, Homo sapiens
tagttatagtttcaga

SEQ ID NO: 1985234 - DNA, 20 bp, Homo sapiens
tagttatatttgctgatact

SEQ ID NO: 1985235 - DNA, 17 bp, Homo sapiens
tagttatttacttgaaa

SEQ ID NO: 1985236 - DNA, 16 bp, Homo sapiens
tagttcctgtggccag

SEQ ID NO: 1985237 - DNA, 18 bp, Homo sapiens
tagttcctgtggccagga

SEQ ID NO: 1985238 - DNA, 15 bp, Homo sapiens
tagttcgtagctttc

SEQ ID NO: 1985239 - DNA, 17 bp, Homo sapiens
tagttgaaaataaagtg

SEQ ID NO: 1985240 - DNA, 19 bp, Homo sapiens
tagttgaacatctcacttt

SEQ ID NO: 1985241 - DNA, 22 bp, Homo sapiens
tagttgatgaccaatctctgtg

SEQ ID NO: 1985242 - DNA, 23 bp, Homo sapiens
tagttgatgaccaatctctgtga

SEQ ID NO: 1985243 - DNA, 19 bp, Homo sapiens
tagttgcagaaacattttg

SEQ ID NO: 1985244 - DNA, 18 bp, Homo sapiens
tagttgcagactcagttt

SEQ ID NO: 1985245 - DNA, 12 bp, Homo sapiens
tagttgtgtctg

SEQ ID NO: 1985246 - DNA, 20 bp, Homo sapiens
tagtttacttcctaaatttc

SEQ ID NO: 1985247 - DNA, 22 bp, Homo sapiens
tagtttagatcccatgtcacct

SEQ ID NO: 1985248 - DNA, 17 bp, Homo sapiens
tagtttcagtaaataat

SEQ ID NO: 1985249 - DNA, 19 bp, Homo sapiens
tagtttcatataaagtatc

SEQ ID NO: 1985250 - DNA, 16 bp, Homo sapiens
tagtttctagaggcct

SEQ ID NO: 1985251 - DNA, 11 bp, Homo sapiens
tagtttggata

SEQ ID NO: 1985252 - DNA, 14 bp, Homo sapiens
tagtttgttttaca

SEQ ID NO: 1985253 - DNA, 15 bp, Homo sapiens
tagttttaaatatga

SEQ ID NO: 1985254 - DNA, 18 bp, Homo sapiens
tagttttaaatatgaaca

SEQ ID NO: 1985255 - DNA, 17 bp, Homo sapiens
tagttttagttgcagaa

SEQ ID NO: 1985256 - DNA, 18 bp, Homo sapiens
tagttttatggcatgatt

SEQ ID NO: 1985257 - DNA, 20 bp, Homo sapiens
tagttttatggcatgattta

SEQ ID NO: 1985258 - DNA, 15 bp, Homo sapiens
tagttttcagccttg

SEQ ID NO: 1985259 - DNA, 13 bp, Homo sapiens
tagttttctttgt

SEQ ID NO: 1985260 - DNA, 16 bp, Homo sapiens
tagttttctttgtaaa

SEQ ID NO: 1985261 - DNA, 18 bp, Homo sapiens
tagtttttacctaccaca

SEQ ID NO: 1985262 - DNA, 14 bp, Homo sapiens
tagtttttatatta

SEQ ID NO: 1985263 - DNA, 21 bp, Homo sapiens
tagttttttttgtaaactgta

SEQ ID NO: 1985264 - DNA, 11 bp, Homo sapiens
tataaaaacaa

SEQ ID NO: 1985265 - DNA, 19 bp, Homo sapiens
tataaaaagaaaagataaa

SEQ ID NO: 1985266 - DNA, 23 bp, Homo sapiens
tataaaaagaaaagataaagatg

SEQ ID NO: 1985267 - DNA, 15 bp, Homo sapiens
tataaaattattttt

SEQ ID NO: 1985268 - DNA, 14 bp, Homo sapiens
tataaacactatat

SEQ ID NO: 1985269 - DNA, 23 bp, Homo sapiens
tataaacattaaaagaagactgg

SEQ ID NO: 1985270 - DNA, 15 bp, Homo sapiens
tataaactactgtaa

SEQ ID NO: 1985271 - DNA, 16 bp, Homo sapiens
tataaactactgtaat

SEQ ID NO: 1985272 - DNA, 23 bp, Homo sapiens
tataaacttagtgcggacaagtt

SEQ ID NO: 1985273 - DNA, 21 bp, Homo sapiens
tataaactttagagtagcatg

SEQ ID NO: 1985274 - DNA, 22 bp, Homo sapiens
tataaactttagagtagcatga

SEQ ID NO: 1985275 - DNA, 15 bp, Homo sapiens
tataaagaacaaggt

SEQ ID NO: 1985276 - DNA, 15 bp, Homo sapiens
tataaagtcacttcc

SEQ ID NO: 1985277 - DNA, 22 bp, Homo sapiens
tataaagtcaggacctggcttg

SEQ ID NO: 1985278 - DNA, 20 bp, Homo sapiens
tataaataaataaaaatatt

SEQ ID NO: 1985279 - DNA, 13 bp, Homo sapiens
tataaataaatgc

SEQ ID NO: 1985280 - DNA, 14 bp, Homo sapiens
tataaataaatgcc

SEQ ID NO: 1985281 - DNA, 13 bp, Homo sapiens
tataaataataaa

SEQ ID NO: 1985282 - DNA, 12 bp, Homo sapiens
tataaatatata

SEQ ID NO: 1985283 - DNA, 16 bp, Homo sapiens
tataaatatgaaatga

SEQ ID NO: 1985284 - DNA, 17 bp, Homo sapiens
tataaatatgaaatgat

SEQ ID NO: 1985285 - DNA, 11 bp, Homo sapiens
tataaatgcat

SEQ ID NO: 1985286 - DNA, 12 bp, Homo sapiens
tataaatgcatg

SEQ ID NO: 1985287 - DNA, 18 bp, Homo sapiens
tataaatgcatgatttta

SEQ ID NO: 1985288 - DNA, 19 bp, Homo sapiens
tataaatgcatgattttat

SEQ ID NO: 1985289 - DNA, 22 bp, Homo sapiens
tataaatgcatgattttataca

SEQ ID NO: 1985290 - DNA, 19 bp, Homo sapiens
tataaatgtatatacacat

SEQ ID NO: 1985291 - DNA, 14 bp, Homo sapiens
tataaatgtgtggt

SEQ ID NO: 1985292 - DNA, 22 bp, Homo sapiens
tataaccatcagttactggttt

SEQ ID NO: 1985293 - DNA, 16 bp, Homo sapiens
taacctgtagaacacc

SEQ ID NO: 1985294 - DNA, 20 bp, Homo sapiens
taacgccctatttttgcaat

SEQ ID NO: 1985295 - DNA, 19 bp, Homo sapiens
taacgggggtgcggcagga

SEQ ID NO: 1985296 - DNA, 19 bp, Homo sapiens
taactaatgctaagaaatg

SEQ ID NO: 1985297 - DNA, 19 bp, Homo sapiens
taactaatttaaaccagca

SEQ ID NO: 1985298 - DNA, 17 bp, Homo sapiens
taactactttttatact

SEQ ID NO: 1985299 - DNA, 15 bp, Homo sapiens
taactagaatttatt

SEQ ID NO: 1985300 - DNA, 18 bp, Homo sapiens
taactagaatttattcaa

SEQ ID NO: 1985301 - DNA, 15 bp, Homo sapiens
taactagatctcctg

SEQ ID NO: 1985302 - DNA, 17 bp, Homo sapiens
taactaggccatttgta

SEQ ID NO: 1985303 - DNA, 17 bp, Homo sapiens
taactagtttaattaac

SEQ ID NO: 1985304 - DNA, 16 bp, Homo sapiens
taactatcaatattta

SEQ ID NO: 1985305 - DNA, 14 bp, Homo sapiens
taactcaatatttt

SEQ ID NO: 1985306 - DNA, 16 bp, Homo sapiens
taactcattagactgg

SEQ ID NO: 1985307 - DNA, 19 bp, Homo sapiens
taactccagtgatgttctt

SEQ ID NO: 1985308 - DNA, 11 bp, Homo sapiens
taactctggca

SEQ ID NO: 1985309 - DNA, 12 bp, Homo sapiens
taactctggcac

SEQ ID NO: 1985310 - DNA, 15 bp, Homo sapiens
taactgaaggagaag

SEQ ID NO: 1985311 - DNA, 16 bp, Homo sapiens
taactgaaggagaagg

SEQ ID NO: 1985312 - DNA, 19 bp, Homo sapiens
taactgcaaagtgaagttg

SEQ ID NO: 1985313 - DNA, 14 bp, Homo sapiens
taactgctgagcca

SEQ ID NO: 1985314 - DNA, 16 bp, Homo sapiens
taactgctgagccact

SEQ ID NO: 1985315 - DNA, 11 bp, Homo sapiens
taactggctgt

SEQ ID NO: 1985316 - DNA, 17 bp, Homo sapiens
taactgggggaaaagat

SEQ ID NO: 1985317 - DNA, 17 bp, Homo sapiens
taactgggtaatgaaac

SEQ ID NO: 1985318 - DNA, 13 bp, Homo sapiens
taactggtataga

SEQ ID NO: 1985319 - DNA, 16 bp, Homo sapiens
taactgtaaatcactt

SEQ ID NO: 1985320 - DNA, 22 bp, Homo sapiens
taactgtaaatcacttgtaaat

SEQ ID NO: 1985321 - DNA, 23 bp, Homo sapiens
taactgtaaatcacttgtaaata

SEQ ID NO: 1985322 - DNA, 14 bp, Homo sapiens
taacttaaatagta

SEQ ID NO: 1985323 - DNA, 16 bp, Homo sapiens
taacttaaatagtatt

SEQ ID NO: 1985324 - DNA, 23 bp, Homo sapiens
taacttatatcatcagcatacct

SEQ ID NO: 1985325 - DNA, 16 bp, Homo sapiens
taacttcagagaagtc

SEQ ID NO: 1985326 - DNA, 19 bp, Homo sapiens
taacttcagagaagtcagt

SEQ ID NO: 1985327 - DNA, 21 bp, Homo sapiens
taacttgatatagaaagctgt

SEQ ID NO: 1985328 - DNA, 20 bp, Homo sapiens
taacttgctgaatttcaggc

SEQ ID NO: 1985329 - DNA, 21 bp, Homo sapiens
taacttgctgaatttcaggca

SEQ ID NO: 1985330 - DNA, 20 bp, Homo sapiens
taacttgtatattccaccat

SEQ ID NO: 1985331 - DNA, 19 bp, Homo sapiens
taacttgtcctatgtcaat

SEQ ID NO: 1985332 - DNA, 19 bp, Homo sapiens
taactttataaataaacat

SEQ ID NO: 1985333 - DNA, 17 bp, Homo sapiens
taactttatcacattat

SEQ ID NO: 1985334 - DNA, 13 bp, Homo sapiens
taactttcagaag

SEQ ID NO: 1985335 - DNA, 19 bp, Homo sapiens
taactttcattaaagcatt

SEQ ID NO: 1985336 - DNA, 20 bp, Homo sapiens
taacttttcttacagcacat

SEQ ID NO: 1985337 - DNA, 16 bp, Homo sapiens
taagaaaacatcactg

SEQ ID NO: 1985338 - DNA, 22 bp, Homo sapiens
taagaaacacagggttttgtat

SEQ ID NO: 1985339 - DNA, 19 bp, Homo sapiens
taagaaagtgcagaatcaa

SEQ ID NO: 1985340 - DNA, 20 bp, Homo sapiens
taagaaatgctgaaaatcaa

SEQ ID NO: 1985341 - DNA, 22 bp, Homo sapiens
taagaacaaagagaaaaaatac

SEQ ID NO: 1985342 - DNA, 15 bp, Homo sapiens
taagaagacatgaca

SEQ ID NO: 1985343 - DNA, 19 bp, Homo sapiens
taagaataggtcattttct

SEQ ID NO: 1985344 - DNA, 17 bp, Homo sapiens
taagaatctagcaagaa

SEQ ID NO: 1985345 - DNA, 15 bp, Homo sapiens
taagaatgctggttt

SEQ ID NO: 1985346 - DNA, 23 bp, Homo sapiens
taagaatgctggttttcctaaat

SEQ ID NO: 1985347 - DNA, 13 bp, Homo sapiens
taagaatggaaga

SEQ ID NO: 1985348 - DNA, 17 bp, Homo sapiens
taagaatggttgcctta

SEQ ID NO: 1985349 - DNA, 22 bp, Homo sapiens
taagacaagaatatgttcacat

SEQ ID NO: 1985350 - DNA, 17 bp, Homo sapiens
taagacacacctctgga

SEQ ID NO: 1985351 - DNA, 15 bp, Homo sapiens
taagaccccatctct

SEQ ID NO: 1985352 - DNA, 19 bp, Homo sapiens
taagaccgtgtcccaagga

SEQ ID NO: 1985353 - DNA, 23 bp, Homo sapiens
taagaccgtgtcccaaggagctg

SEQ ID NO: 1985354 - DNA, 13 bp, Homo sapiens
taagacctcccca

SEQ ID NO: 1985355 - DNA, 20 bp, Homo sapiens
taagacgtgaatgtctcagc

SEQ ID NO: 1985356 - DNA, 20 bp, Homo sapiens
taagacttcagtcctggtct

SEQ ID NO: 1985357 - DNA, 21 bp, Homo sapiens
taagacttcagtcctggtctg

SEQ ID NO: 1985358 - DNA, 12 bp, Homo sapiens
taagagaagtag

SEQ ID NO: 1985359 - DNA, 21 bp, Homo sapiens
taagagatctggtcaaagcaa

SEQ ID NO: 1985360 - DNA, 14 bp, Homo sapiens
taagagcaataaat

SEQ ID NO: 1985361 - DNA, 22 bp, Homo sapiens
taagaggcagggtctcactctg

SEQ ID NO: 1985362 - DNA, 23 bp, Homo sapiens
taagagggattagggagagaaga

SEQ ID NO: 1985363 - DNA, 19 bp, Homo sapiens
taagataaatagagttcca

SEQ ID NO: 1985364 - DNA, 14 bp, Homo sapiens
taagataatgatga

SEQ ID NO: 1985365 - DNA, 19 bp, Homo sapiens
taagatacactcctgctgt

SEQ ID NO: 1985366 - DNA, 17 bp, Homo sapiens
taagatctatagcctct

SEQ ID NO: 1985367 - DNA, 20 bp, Homo sapiens
taagatgagatttgccagca

SEQ ID NO: 1985368 - DNA, 17 bp, Homo sapiens
taagattaaaggaagga

SEQ ID NO: 1985369 - DNA, 13 bp, Homo sapiens
taagattagaatg

SEQ ID NO: 1985370 - DNA, 18 bp, Homo sapiens
taagattagaatgaaaat

SEQ ID NO: 1985371 - DNA, 13 bp, Homo sapiens
taagattgtaatt

SEQ ID NO: 1985372 - DNA, 14 bp, Homo sapiens
taagattgtacata

SEQ ID NO: 1985373 - DNA, 15 bp, Homo sapiens
taagattgtacatat

SEQ ID NO: 1985374 - DNA, 18 bp, Homo sapiens
taagattgtacatatgga

SEQ ID NO: 1985375 - DNA, 23 bp, Homo sapiens
taagcaaatttcaaaagacatgt

SEQ ID NO: 1985376 - DNA, 15 bp, Homo sapiens
taagcaacagaaata

SEQ ID NO: 1985377 - DNA, 17 bp, Homo sapiens
taagcaacttgcttcta

SEQ ID NO: 1985378 - DNA, 14 bp, Homo sapiens
taagcaagaaggca

SEQ ID NO: 1985379 - DNA, 21 bp, Homo sapiens
taagcagatttaacaattcca

SEQ ID NO: 1985380 - DNA, 14 bp, Homo sapiens
taagcaggaaggat

SEQ ID NO: 1985381 - DNA, 16 bp, Homo sapiens
taagcagtgcttgtaa

SEQ ID NO: 1985382 - DNA, 19 bp, Homo sapiens
taagcatgatcttgttaat

SEQ ID NO: 1985383 - DNA, 15 bp, Homo sapiens
taagcattctgagct

SEQ ID NO: 1985384 - DNA, 21 bp, Homo sapiens
taagcattctgagctgggctt

SEQ ID NO: 1985385 - DNA, 16 bp, Homo sapiens
taagcattcttagact

SEQ ID NO: 1985386 - DNA, 18 bp, Homo sapiens
taagcattgggtgggtaa

SEQ ID NO: 1985387 - DNA, 20 bp, Homo sapiens
taagcattttactgtctgta

SEQ ID NO: 1985388 - DNA, 20 bp, Homo sapiens
taagccctgtcgagacactt

SEQ ID NO: 1985389 - DNA, 22 bp, Homo sapiens
taagccctgtcgagacacttgc

SEQ ID NO: 1985390 - DNA, 17 bp, Homo sapiens
taagcctcatatttaaa

SEQ ID NO: 1985391 - DNA, 19 bp, Homo sapiens
taagcctccatttagttct

SEQ ID NO: 1985392 - DNA, 19 bp, Homo sapiens
tacataattttttattcaa

SEQ ID NO: 1985393 - DNA, 13 bp, Homo sapiens
tacatacacatac

SEQ ID NO: 1985394 - DNA, 14 bp, Homo sapiens
tacatacacataca

SEQ ID NO: 1985395 - DNA, 15 bp, Homo sapiens
tacatacatacatat

SEQ ID NO: 1985396 - DNA, 16 bp, Homo sapiens
tacatacatacatata

SEQ ID NO: 1985397 - DNA, 17 bp, Homo sapiens
tacatacatacatatat

SEQ ID NO: 1985398 - DNA, 15 bp, Homo sapiens
tacatacatatatat

SEQ ID NO: 1985399 - DNA, 23 bp, Homo sapiens
tacatacctctctctatatatac

SEQ ID NO: 1985400 - DNA, 16 bp, Homo sapiens
tacatagatggaccag

SEQ ID NO: 1985401 - DNA, 19 bp, Homo sapiens
tacatagatgtatcattaa

SEQ ID NO: 1985402 - DNA, 20 bp, Homo sapiens
tacatatatatatacacata

SEQ ID NO: 1985403 - DNA, 22 bp, Homo sapiens
tacatatatatatacacataca

SEQ ID NO: 1985404 - DNA, 14 bp, Homo sapiens
tacatatatatctg

SEQ ID NO: 1985405 - DNA, 16 bp, Homo sapiens
tacatatcagaaaagt

SEQ ID NO: 1985406 - DNA, 20 bp, Homo sapiens
tacatatcagaaaagtagaa

SEQ ID NO: 1985407 - DNA, 13 bp, Homo sapiens
tacatatgaaatt

SEQ ID NO: 1985408 - DNA, 17 bp, Homo sapiens
tacatatgtaaaataaa

SEQ ID NO: 1985409 - DNA, 19 bp, Homo sapiens
tacatatgtagactatata

SEQ ID NO: 1985410 - DNA, 15 bp, Homo sapiens
tacatattataaata

SEQ ID NO: 1985411 - DNA, 16 bp, Homo sapiens
tacatattataaataa

SEQ ID NO: 1985412 - DNA, 14 bp, Homo sapiens
tacatattctttaa

SEQ ID NO: 1985413 - DNA, 23 bp, Homo sapiens
tacatcacctttttgacttttcc

SEQ ID NO: 1985414 - DNA, 16 bp, Homo sapiens
tacatcttcagctccc

SEQ ID NO: 1985415 - DNA, 19 bp, Homo sapiens
tacatcttcagctcccata

SEQ ID NO: 1985416 - DNA, 13 bp, Homo sapiens
tacatgaaacaga

SEQ ID NO: 1985417 - DNA, 15 bp, Homo sapiens
tacatgaacacagct

SEQ ID NO: 1985418 - DNA, 16 bp, Homo sapiens
tacatgaacacagctg

SEQ ID NO: 1985419 - DNA, 18 bp, Homo sapiens
tacatgaattgcatttta

SEQ ID NO: 1985420 - DNA, 22 bp, Homo sapiens
tacatgaccagaaaacaaatct

SEQ ID NO: 1985421 - DNA, 15 bp, Homo sapiens
tacatgattcatttt

SEQ ID NO: 1985422 - DNA, 20 bp, Homo sapiens
tacatgcaatttattaaaat

SEQ ID NO: 1985423 - DNA, 21 bp, Homo sapiens
tacatgcacttggctgcataa

SEQ ID NO: 1985424 - DNA, 18 bp, Homo sapiens
tacatgctaagagaagta

SEQ ID NO: 1985425 - DNA, 12 bp, Homo sapiens
tacatgctgcta

SEQ ID NO: 1985426 - DNA, 16 bp, Homo sapiens
tacatggtattgtaat

SEQ ID NO: 1985427 - DNA, 17 bp, Homo sapiens
tacatgtactccagagg

SEQ ID NO: 1985428 - DNA, 14 bp, Homo sapiens
tacatgtatagtga

SEQ ID NO: 1985429 - DNA, 18 bp, Homo sapiens
tacatgtgtagcctgtgc

SEQ ID NO: 1985430 - DNA, 19 bp, Homo sapiens
tacatgtgtagcctgtgca

SEQ ID NO: 1985431 - DNA, 12 bp, Homo sapiens
tacatgtgtgta

SEQ ID NO: 1985432 - DNA, 16 bp, Homo sapiens
tacatgtgtgtatata

SEQ ID NO: 1985433 - DNA, 19 bp, Homo sapiens
tacatgtgtgtatatatgt

SEQ ID NO: 1985434 - DNA, 12 bp, Homo sapiens
tacattaatgtt

SEQ ID NO: 1985435 - DNA, 23 bp, Homo sapiens
tacattaattattattgctgttg

SEQ ID NO: 1985436 - DNA, 18 bp, Homo sapiens
tacattagtatcccacta

SEQ ID NO: 1985437 - DNA, 15 bp, Homo sapiens
tacattcaatgttta

SEQ ID NO: 1985438 - DNA, 18 bp, Homo sapiens
tacattccctatcaaaac

SEQ ID NO: 1985439 - DNA, 20 bp, Homo sapiens
tacattccctatcaaaacat

SEQ ID NO: 1985440 - DNA, 21 bp, Homo sapiens
tacattccctatcaaaacata

SEQ ID NO: 1985441 - DNA, 14 bp, Homo sapiens
tacattccctggcc

SEQ ID NO: 1985442 - DNA, 15 bp, Homo sapiens
tacattccctggcct

SEQ ID NO: 1985443 - DNA, 19 bp, Homo sapiens
tacattcctcagctgccaa

SEQ ID NO: 1985444 - DNA, 12 bp, Homo sapiens
tacattcctgat

SEQ ID NO: 1985445 - DNA, 19 bp, Homo sapiens
tacattggtctttctacat

SEQ ID NO: 1985446 - DNA, 16 bp, Homo sapiens
tacattgtgaaacttc

SEQ ID NO: 1985447 - DNA, 19 bp, Homo sapiens
tacattgtttgtctgtctt

SEQ ID NO: 1985448 - DNA, 23 bp, Homo sapiens
tacattgtttgtctgtcttcata

SEQ ID NO: 1985449 - DNA, 13 bp, Homo sapiens
tacatttcatctg

SEQ ID NO: 1985450 - DNA, 15 bp, Homo sapiens
tacatttccaaatga

SEQ ID NO: 1985451 - DNA, 19 bp, Homo sapiens
tacattttatatctggatt

SEQ ID NO: 1985452 - DNA, 19 bp, Homo sapiens
taccaaagtgacctaccca

SEQ ID NO: 1985453 - DNA, 14 bp, Homo sapiens
taccaaatataaac

SEQ ID NO: 1985454 - DNA, 17 bp, Homo sapiens
taccaaatataaacttg

SEQ ID NO: 1985455 - DNA, 19 bp, Homo sapiens
taccaactttctgtaaact

SEQ ID NO: 1985456 - DNA, 19 bp, Homo sapiens
taccaagtgtgttgggaat

SEQ ID NO: 1985457 - DNA, 22 bp, Homo sapiens
taccaatcattttaattattat

SEQ ID NO: 1985458 - DNA, 13 bp, Homo sapiens
taccaatgcatgc

SEQ ID NO: 1985459 - DNA, 14 bp, Homo sapiens
taccaatgcatgca

SEQ ID NO: 1985460 - DNA, 14 bp, Homo sapiens
taccaatgccaaga

SEQ ID NO: 1985461 - DNA, 14 bp, Homo sapiens
taccaccccttcct

SEQ ID NO: 1985462 - DNA, 19 bp, Homo sapiens
taccaccccttcctgtccc

SEQ ID NO: 1985463 - DNA, 18 bp, Homo sapiens
taccagctcactccctgg

SEQ ID NO: 1985464 - DNA, 18 bp, Homo sapiens
taccaggcaccaaaagaa

SEQ ID NO: 1985465 - DNA, 16 bp, Homo sapiens
taccagggatgtagat

SEQ ID NO: 1985466 - DNA, 15 bp, Homo sapiens
taccaggttgaaaga

SEQ ID NO: 1985467 - DNA, 14 bp, Homo sapiens
taccagtgtactgc

SEQ ID NO: 1985468 - DNA, 11 bp, Homo sapiens
taccagtgtgg

SEQ ID NO: 1985469 - DNA, 22 bp, Homo sapiens
taccatactcatttctaaaaga

SEQ ID NO: 1985470 - DNA, 18 bp, Homo sapiens
taccatatgtctgcttct

SEQ ID NO: 1985471 - DNA, 14 bp, Homo sapiens
taccatctgctgcc

SEQ ID NO: 1985472 - DNA, 20 bp, Homo sapiens
taccatctgtcttgccagcc

SEQ ID NO: 1985473 - DNA, 11 bp, Homo sapiens
taccatgaaga

SEQ ID NO: 1985474 - DNA, 20 bp, Homo sapiens
taccatgagaagagggcctg

SEQ ID NO: 1985475 - DNA, 12 bp, Homo sapiens
taccatgctgct

SEQ ID NO: 1985476 - DNA, 23 bp, Homo sapiens
taccatgctgctttttggcacag

SEQ ID NO: 1985477 - DNA, 15 bp, Homo sapiens
taccatgttaaagag

SEQ ID NO: 1985478 - DNA, 22 bp, Homo sapiens
taccattacttgtataaataca

SEQ ID NO: 1985479 - DNA, 15 bp, Homo sapiens
taccatttcagagag

SEQ ID NO: 1985480 - DNA, 16 bp, Homo sapiens
taccatttcagagagg

SEQ ID NO: 1985481 - DNA, 13 bp, Homo sapiens
tacccaaccactc

SEQ ID NO: 1985482 - DNA, 18 bp, Homo sapiens
tacccaatttaattccat

SEQ ID NO: 1985483 - DNA, 22 bp, Homo sapiens
tacccaccgggccactccttcc

SEQ ID NO: 1985484 - DNA, 16 bp, Homo sapiens
tacccactcctcactg

SEQ ID NO: 1985485 - DNA, 13 bp, Homo sapiens
tacccactctttg

SEQ ID NO: 1985486 - DNA, 13 bp, Homo sapiens
tacccactgctct

SEQ ID NO: 1985487 - DNA, 21 bp, Homo sapiens
tacccacttctaaatagcaat

SEQ ID NO: 1985488 - DNA, 19 bp, Homo sapiens
tacccagtaactcatctgt

SEQ ID NO: 1985489 - DNA, 16 bp, Homo sapiens
taccccaagtccacct

SEQ ID NO: 1985490 - DNA, 22 bp, Homo sapiens
taccccaccacgatgtggccct

SEQ ID NO: 1985491 - DNA, 20 bp, Homo sapiens
taccccacctcatgcctggc

SEQ ID NO: 1985492 - DNA, 13 bp, Homo sapiens
taccccatccctt

SEQ ID NO: 1985493 - DNA, 14 bp, Homo sapiens
tacccccagagacc

SEQ ID NO: 1985494 - DNA, 19 bp, Homo sapiens
taccccccctcctgctgcc

SEQ ID NO: 1985495 - DNA, 17 bp, Homo sapiens
tacccccgtggtctttg

SEQ ID NO: 1985496 - DNA, 19 bp, Homo sapiens
tacccccgtggtctttgaa

SEQ ID NO: 1985497 - DNA, 13 bp, Homo sapiens
tacccctgcctgg

SEQ ID NO: 1985498 - DNA, 16 bp, Homo sapiens
tacccctgcctgggtt

SEQ ID NO: 1985499 - DNA, 20 bp, Homo sapiens
tacccctgcctgggttttct

SEQ ID NO: 1985500 - DNA, 18 bp, Homo sapiens
tacccctttctggctctc

SEQ ID NO: 1985501 - DNA, 16 bp, Homo sapiens
tacccgagcccagcta

SEQ ID NO: 1985502 - DNA, 21 bp, Homo sapiens
tacccgagcccagctacattc

SEQ ID NO: 1985503 - DNA, 23 bp, Homo sapiens
tacccgagcccagctacattcct

SEQ ID NO: 1985504 - DNA, 22 bp, Homo sapiens
tacccggcccagagaccccttc

SEQ ID NO: 1985505 - DNA, 11 bp, Homo sapiens
taccctccccc

SEQ ID NO: 1985506 - DNA, 20 bp, Homo sapiens
taccctgcgattttgcctgt

SEQ ID NO: 1985507 - DNA, 14 bp, Homo sapiens
tacccttccacctc

SEQ ID NO: 1985508 - DNA, 23 bp, Homo sapiens
tactgagccttgtaattctaaat

SEQ ID NO: 1985509 - DNA, 19 bp, Homo sapiens
tactgagcggacagaatga

SEQ ID NO: 1985510 - DNA, 14 bp, Homo sapiens
tactgagcttctct

SEQ ID NO: 1985511 - DNA, 17 bp, Homo sapiens
tactgagcttctctgtg

SEQ ID NO: 1985512 - DNA, 22 bp, Homo sapiens
tactgaggcctaaaagtaaaca

SEQ ID NO: 1985513 - DNA, 13 bp, Homo sapiens
tactgcacatttt

SEQ ID NO: 1985514 - DNA, 15 bp, Homo sapiens
tactgcacattttgt

SEQ ID NO: 1985515 - DNA, 21 bp, Homo sapiens
tactgccggtcacccaggctc

SEQ ID NO: 1985516 - DNA, 13 bp, Homo sapiens
tactgcctttgga

SEQ ID NO: 1985517 - DNA, 11 bp, Homo sapiens
tactgctctga

SEQ ID NO: 1985518 - DNA, 13 bp, Homo sapiens
tactgctctgaat

SEQ ID NO: 1985519 - DNA, 14 bp, Homo sapiens
tactgctctgaata

SEQ ID NO: 1985520 - DNA, 19 bp, Homo sapiens
tactgctgcaaagtgcaaa

SEQ ID NO: 1985521 - DNA, 15 bp, Homo sapiens
tactgctgtcattgt

SEQ ID NO: 1985522 - DNA, 17 bp, Homo sapiens
tactggaagttttgcat

SEQ ID NO: 1985523 - DNA, 22 bp, Homo sapiens
tactggaccccgcctcccagcc

SEQ ID NO: 1985524 - DNA, 12 bp, Homo sapiens
tactggcattaa

SEQ ID NO: 1985525 - DNA, 17 bp, Homo sapiens
tactgggaaggctactt

SEQ ID NO: 1985526 - DNA, 17 bp, Homo sapiens
tactgtaaatgtatttg

SEQ ID NO: 1985527 - DNA, 15 bp, Homo sapiens
tactgtaattaagtg

SEQ ID NO: 1985528 - DNA, 11 bp, Homo sapiens
tactgtacata

SEQ ID NO: 1985529 - DNA, 17 bp, Homo sapiens
tactgtagctgatgaaa

SEQ ID NO: 1985530 - DNA, 21 bp, Homo sapiens
tactgtctggttttaacaatt

SEQ ID NO: 1985531 - DNA, 19 bp, Homo sapiens
tactgtggaaaaatattta

SEQ ID NO: 1985532 - DNA, 23 bp, Homo sapiens
tactgtgtacagaattctgctac

SEQ ID NO: 1985533 - DNA, 15 bp, Homo sapiens
tactgttttgtatca

SEQ ID NO: 1985534 - DNA, 18 bp, Homo sapiens
tacttaaatgaaagcatg

SEQ ID NO: 1985535 - DNA, 12 bp, Homo sapiens
tacttaactgtg

SEQ ID NO: 1985536 - DNA, 12 bp, Homo sapiens
tacttaagagaa

SEQ ID NO: 1985537 - DNA, 17 bp, Homo sapiens
tacttaataaattcaga

SEQ ID NO: 1985538 - DNA, 13 bp, Homo sapiens
tacttattcttcc

SEQ ID NO: 1985539 - DNA, 15 bp, Homo sapiens
tacttattttccaat

SEQ ID NO: 1985540 - DNA, 19 bp, Homo sapiens
tacttattttccaataaaa

SEQ ID NO: 1985541 - DNA, 19 bp, Homo sapiens
tacttcactttaattctca

SEQ ID NO: 1985542 - DNA, 14 bp, Homo sapiens
tacttcaggtgctt

SEQ ID NO: 1985543 - DNA, 19 bp, Homo sapiens
tacttcaggtgcttttgat

SEQ ID NO: 1985544 - DNA, 18 bp, Homo sapiens
tacttcattttcagagtg

SEQ ID NO: 1985545 - DNA, 19 bp, Homo sapiens
tacttcattttcagagtga

SEQ ID NO: 1985546 - DNA, 23 bp, Homo sapiens
tacttcccattttggaagttttc

SEQ ID NO: 1985547 - DNA, 18 bp, Homo sapiens
tacttcctcctgatggcc

SEQ ID NO: 1985548 - DNA, 20 bp, Homo sapiens
tacttcggggctgggaagtc

SEQ ID NO: 1985549 - DNA, 21 bp, Homo sapiens
tacttctagagatagtacata

SEQ ID NO: 1985550 - DNA, 21 bp, Homo sapiens
tacttctctctatctggaatt

SEQ ID NO: 1985551 - DNA, 13 bp, Homo sapiens
tacttgagctgta

SEQ ID NO: 1985552 - DNA, 12 bp, Homo sapiens
tacttgcacaag

SEQ ID NO: 1985553 - DNA, 14 bp, Homo sapiens
tacttgcacaagct

SEQ ID NO: 1985554 - DNA, 12 bp, Homo sapiens
tacttgggaggc

SEQ ID NO: 1985555 - DNA, 22 bp, Homo sapiens
tacttgggaggctgaggcagga

SEQ ID NO: 1985556 - DNA, 16 bp, Homo sapiens
tacttgtagaaatctg

SEQ ID NO: 1985557 - DNA, 19 bp, Homo sapiens
tacttgtagaaatctgtaa

SEQ ID NO: 1985558 - DNA, 20 bp, Homo sapiens
tacttgtagaaatctgtaat

SEQ ID NO: 1985559 - DNA, 13 bp, Homo sapiens
tacttgtggacac

SEQ ID NO: 1985560 - DNA, 14 bp, Homo sapiens
tacttgtggacaca

SEQ ID NO: 1985561 - DNA, 20 bp, Homo sapiens
tacttgttacctttcccatg

SEQ ID NO: 1985562 - DNA, 19 bp, Homo sapiens
tactttatccaatcctcag

SEQ ID NO: 1985563 - DNA, 22 bp, Homo sapiens
tactttcctattttcttttcca

SEQ ID NO: 1985564 - DNA, 17 bp, Homo sapiens
tacttttgcatgaaaat

SEQ ID NO: 1985565 - DNA, 17 bp, Homo sapiens
tactttttatactccat

SEQ ID NO: 1985566 - DNA, 15 bp, Homo sapiens
tactttttattcaat

SEQ ID NO: 1985567 - DNA, 20 bp, Homo sapiens
tactttttattcaattctgt

SEQ ID NO: 1985568 - DNA, 18 bp, Homo sapiens
tacttttttcttatttaa

SEQ ID NO: 1985569 - DNA, 14 bp, Homo sapiens
tactttttttcaca

SEQ ID NO: 1985570 - DNA, 14 bp, Homo sapiens
tagaaaacattcat

SEQ ID NO: 1985571 - DNA, 17 bp, Homo sapiens
tagaaaacgcacctcca

SEQ ID NO: 1985572 - DNA, 13 bp, Homo sapiens
tagaaaactgaaa

SEQ ID NO: 1985573 - DNA, 21 bp, Homo sapiens
tagaaaactgaaaatctaata

SEQ ID NO: 1985574 - DNA, 16 bp, Homo sapiens
tagaaaagatgagagg

SEQ ID NO: 1985575 - DNA, 16 bp, Homo sapiens
tagaaacaccattcat

SEQ ID NO: 1985576 - DNA, 15 bp, Homo sapiens
tagaaaccttaatat

SEQ ID NO: 1985577 - DNA, 22 bp, Homo sapiens
tagaaagaaaagaccctgagac

SEQ ID NO: 1985578 - DNA, 23 bp, Homo sapiens
tagaaagaaaagaccctgagact

SEQ ID NO: 1985579 - DNA, 16 bp, Homo sapiens
tagaaagcaataaaaa

SEQ ID NO: 1985580 - DNA, 21 bp, Homo sapiens
tagaaagctctgcatgtgtgt

SEQ ID NO: 1985581 - DNA, 20 bp, Homo sapiens
tagaaagctgtttatttatt

SEQ ID NO: 1985582 - DNA, 17 bp, Homo sapiens
tagaaagtgccagaaag

SEQ ID NO: 1985583 - DNA, 15 bp, Homo sapiens
tagaaagtgggttca

SEQ ID NO: 1985584 - DNA, 22 bp, Homo sapiens
tagaaataagtggttatttctc

SEQ ID NO: 1985585 - DNA, 23 bp, Homo sapiens
tagaaataagtggttatttctca

SEQ ID NO: 1985586 - DNA, 14 bp, Homo sapiens
tagaaatgtatcct

SEQ ID NO: 1985587 - DNA, 19 bp, Homo sapiens
tagaaattacacccaaaga

SEQ ID NO: 1985588 - DNA, 17 bp, Homo sapiens
tagaacatgcacattta

SEQ ID NO: 1985589 - DNA, 20 bp, Homo sapiens
tagaacatgcacatttatat

SEQ ID NO: 1985590 - DNA, 21 bp, Homo sapiens
tagaacatgcacatttatata

SEQ ID NO: 1985591 - DNA, 17 bp, Homo sapiens
tagaaccaagaagggct

SEQ ID NO: 1985592 - DNA, 15 bp, Homo sapiens
tagaaccaagcttca

SEQ ID NO: 1985593 - DNA, 20 bp, Homo sapiens
tagaaccaagcttcagagcc

SEQ ID NO: 1985594 - DNA, 15 bp, Homo sapiens
tagaacctaattcaa

SEQ ID NO: 1985595 - DNA, 23 bp, Homo sapiens
tagaacctaattcaattcaaagc

SEQ ID NO: 1985596 - DNA, 23 bp, Homo sapiens
tagaacctagagaagctaaaacc

SEQ ID NO: 1985597 - DNA, 16 bp, Homo sapiens
tagaacctggaagggc

SEQ ID NO: 1985598 - DNA, 22 bp, Homo sapiens
tagaacctggagagctagaacc

SEQ ID NO: 1985599 - DNA, 13 bp, Homo sapiens
tagaacctggagg

SEQ ID NO: 1985600 - DNA, 22 bp, Homo sapiens
tagaactggagaggctagaacc

SEQ ID NO: 1985601 - DNA, 22 bp, Homo sapiens
tagaagaacatccaaggagaaa

SEQ ID NO: 1985602 - DNA, 13 bp, Homo sapiens
tagaagagcctga

SEQ ID NO: 1985603 - DNA, 17 bp, Homo sapiens
tagaagagcctgactgt

SEQ ID NO: 1985604 - DNA, 10 bp, Homo sapiens
tagaagccag

SEQ ID NO: 1985605 - DNA, 16 bp, Homo sapiens
tagaagcgctcatctg

SEQ ID NO: 1985606 - DNA, 14 bp, Homo sapiens
tagaagctggagga

SEQ ID NO: 1985607 - DNA, 22 bp, Homo sapiens
tagaagggctagaacctggaga

SEQ ID NO: 1985608 - DNA, 20 bp, Homo sapiens
tagaagtaggaagtgaaaat

SEQ ID NO: 1985609 - DNA, 23 bp, Homo sapiens
tagaagtccaggcagagacaata

SEQ ID NO: 1985610 - DNA, 18 bp, Homo sapiens
tagaagtggaccaggaca

SEQ ID NO: 1985611 - DNA, 19 bp, Homo sapiens
tagaagtggaccaggacag

SEQ ID NO: 1985612 - DNA, 19 bp, Homo sapiens
tagaagtgggccaggacag

SEQ ID NO: 1985613 - DNA, 15 bp, Homo sapiens
tagaataataataaa

SEQ ID NO: 1985614 - DNA, 17 bp, Homo sapiens
tagaataataataaaaa

SEQ ID NO: 1985615 - DNA, 12 bp, Homo sapiens
tagaatactttt

SEQ ID NO: 1985616 - DNA, 21 bp, Homo sapiens
tagaatacttttttctagttt

SEQ ID NO: 1985617 - DNA, 18 bp, Homo sapiens
tagaatagccatgtacta

SEQ ID NO: 1985618 - DNA, 12 bp, Homo sapiens
tagaatctggag

SEQ ID NO: 1985619 - DNA, 12 bp, Homo sapiens
tagaatgaaaat

SEQ ID NO: 1985620 - DNA, 15 bp, Homo sapiens
tagaatgtaaagctt

SEQ ID NO: 1985621 - DNA, 18 bp, Homo sapiens
tagaatgtgttttctgaa

SEQ ID NO: 1985622 - DNA, 20 bp, Homo sapiens
tagaatgtgttttctgaata

SEQ ID NO: 1985623 - DNA, 20 bp, Homo sapiens
tagcctaatacaacatgtag

SEQ ID NO: 1985624 - DNA, 18 bp, Homo sapiens
tagcctcacttttaatga

SEQ ID NO: 1985625 - DNA, 17 bp, Homo sapiens
tagcctcctgacctgag

SEQ ID NO: 1985626 - DNA, 20 bp, Homo sapiens
tagcctggagcacctttcct

SEQ ID NO: 1985627 - DNA, 16 bp, Homo sapiens
tagcctgggccagaga

SEQ ID NO: 1985628 - DNA, 20 bp, Homo sapiens
tagccttaaatttttgtcat

SEQ ID NO: 1985629 - DNA, 14 bp, Homo sapiens
tagccttctctgtt

SEQ ID NO: 1985630 - DNA, 17 bp, Homo sapiens
tagccttgtgccctgcc

SEQ ID NO: 1985631 - DNA, 15 bp, Homo sapiens
taaaacaacactcac

SEQ ID NO: 1985632 - DNA, 21 bp, Homo sapiens
taaaacacacctaagagaaaa

SEQ ID NO: 1985633 - DNA, 13 bp, Homo sapiens
taaaacacagctt

SEQ ID NO: 1985634 - DNA, 19 bp, Homo sapiens
taaaacacttccataatct

SEQ ID NO: 1985635 - DNA, 12 bp, Homo sapiens
taaaacattatg

SEQ ID NO: 1985636 - DNA, 16 bp, Homo sapiens
taaaaccatgcagctt

SEQ ID NO: 1985637 - DNA, 18 bp, Homo sapiens
taaaaccatgtagtttta

SEQ ID NO: 1985638 - DNA, 15 bp, Homo sapiens
taaaacccagcatgt

SEQ ID NO: 1985639 - DNA, 21 bp, Homo sapiens
taaaaccccagccaactcatt

SEQ ID NO: 1985640 - DNA, 18 bp, Homo sapiens
taaaacctgagctagaag

SEQ ID NO: 1985641 - DNA, 15 bp, Homo sapiens
taaaacctgtcaatg

SEQ ID NO: 1985642 - DNA, 14 bp, Homo sapiens
taaaacctttcaaa

SEQ ID NO: 1985643 - DNA, 21 bp, Homo sapiens
taaaactatggttcccaataa

SEQ ID NO: 1985644 - DNA, 23 bp, Homo sapiens
taaaactatggttcccaataaaa

SEQ ID NO: 1985645 - DNA, 21 bp, Homo sapiens
taaaactttgaagttagcttt

SEQ ID NO: 1985646 - DNA, 17 bp, Homo sapiens
taaaagaacagtaaaca

SEQ ID NO: 1985647 - DNA, 18 bp, Homo sapiens
taaaagaacagtaaacat

SEQ ID NO: 1985648 - DNA, 16 bp, Homo sapiens
taaaagactgcagctg

SEQ ID NO: 1985649 - DNA, 20 bp, Homo sapiens
taaaagactgcagctgctga

SEQ ID NO: 1985650 - DNA, 23 bp, Homo sapiens
taaaagataacaagatctttcag

SEQ ID NO: 1985651 - DNA, 14 bp, Homo sapiens
taaaagatgaaaat

SEQ ID NO: 1985652 - DNA, 18 bp, Homo sapiens
taaaagcataaatgcaaa

SEQ ID NO: 1985653 - DNA, 13 bp, Homo sapiens
taaaagccacata

SEQ ID NO: 1985654 - DNA, 15 bp, Homo sapiens
taaaagccacataga

SEQ ID NO: 1985655 - DNA, 14 bp, Homo sapiens
taaaaggagagaag

SEQ ID NO: 1985656 - DNA, 13 bp, Homo sapiens
taaaagtaaacat

SEQ ID NO: 1985657 - DNA, 21 bp, Homo sapiens
taaaagtactgaagacccgtt

SEQ ID NO: 1985658 - DNA, 18 bp, Homo sapiens
taaaagtgtgagcagtga

SEQ ID NO: 1985659 - DNA, 24 bp, Homo sapiens
taaaagttgggaaaagtgttatta

SEQ ID NO: 1985660 - DNA, 21 bp, Homo sapiens
taaaagttgtgattccagata

SEQ ID NO: 1985661 - DNA, 19 bp, Homo sapiens
taaaagtttcaatgtgatt

SEQ ID NO: 1985662 - DNA, 14 bp, Homo sapiens
taaaataaaaaagt

SEQ ID NO: 1985663 - DNA, 17 bp, Homo sapiens
taaaataaaaaccagaa

SEQ ID NO: 1985664 - DNA, 15 bp, Homo sapiens
taaaataaagcctat

SEQ ID NO: 1985665 - DNA, 17 bp, Homo sapiens
taaaataaagtatatat

SEQ ID NO: 1985666 - DNA, 19 bp, Homo sapiens
taaaataaggataataatc

SEQ ID NO: 1985667 - DNA, 15 bp, Homo sapiens
taaaataatgattta

SEQ ID NO: 1985668 - DNA, 18 bp, Homo sapiens
taaaataattttaaaagt

SEQ ID NO: 1985669 - DNA, 23 bp, Homo sapiens
taaaatactctagcctgggccag

SEQ ID NO: 1985670 - DNA, 17 bp, Homo sapiens
taaaatagaaataagtg

SEQ ID NO: 1985671 - DNA, 22 bp, Homo sapiens
taaaatagatcctaggtgctgg

SEQ ID NO: 1985672 - DNA, 13 bp, Homo sapiens
taaaatagcaaaa

SEQ ID NO: 1985673 - DNA, 17 bp, Homo sapiens
taaaatagcaaaagaag

SEQ ID NO: 1985674 - DNA, 22 bp, Homo sapiens
taaaatagcaaaagaagaagtt

SEQ ID NO: 1985675 - DNA, 21 bp, Homo sapiens
taaaatagcaacactctatat

SEQ ID NO: 1985676 - DNA, 21 bp, Homo sapiens
taaaatagccacttaccttca

SEQ ID NO: 1985677 - DNA, 23 bp, Homo sapiens
taaaatagccacttaccttcaat

SEQ ID NO: 1985678 - DNA, 17 bp, Homo sapiens
taaaatagttgtccata

SEQ ID NO: 1985679 - DNA, 23 bp, Homo sapiens
taaaatagttgtccatattttca

SEQ ID NO: 1985680 - DNA, 16 bp, Homo sapiens
taaaatatacaaacat

SEQ ID NO: 1985681 - DNA, 18 bp, Homo sapiens
taaaatatacaaacatgt

SEQ ID NO: 1985682 - DNA, 15 bp, Homo sapiens
taaaatatatataaa

SEQ ID NO: 1985683 - DNA, 17 bp, Homo sapiens
taaaatatatttcagat

SEQ ID NO: 1985684 - DNA, 18 bp, Homo sapiens
taaaatatggctataaat

SEQ ID NO: 1985685 - DNA, 13 bp, Homo sapiens
taaaatattcctg

SEQ ID NO: 1985686 - DNA, 17 bp, Homo sapiens
taaaatatttttgaaag

SEQ ID NO: 1985687 - DNA, 19 bp, Homo sapiens
taaaatcatgtacatttct

SEQ ID NO: 1985688 - DNA, 17 bp, Homo sapiens
taaaatctgatttaatg

SEQ ID NO: 1985689 - DNA, 23 bp, Homo sapiens
taaaatctggaaatctgttttgt

SEQ ID NO: 1985690 - DNA, 20 bp, Homo sapiens
taaaatctggcaaagttata

SEQ ID NO: 1985691 - DNA, 13 bp, Homo sapiens
taaaatctgtgaa

SEQ ID NO: 1985692 - DNA, 14 bp, Homo sapiens
taaaatctgtgaat

SEQ ID NO: 1985693 - DNA, 16 bp, Homo sapiens
taaaatcttgaaaatg

SEQ ID NO: 1985694 - DNA, 19 bp, Homo sapiens
taaaatcttggcacagaaa

SEQ ID NO: 1985695 - DNA, 20 bp, Homo sapiens
taaaatcttggcacagaaac

SEQ ID NO: 1985696 - DNA, 17 bp, Homo sapiens
taaaatgaggacatgtt

SEQ ID NO: 1985697 - DNA, 20 bp, Homo sapiens
taaaatgaggttcaactgtt

SEQ ID NO: 1985698 - DNA, 16 bp, Homo sapiens
taaaatgattgtagta

SEQ ID NO: 1985699 - DNA, 19 bp, Homo sapiens
taaaatgcaaaataaatgt

SEQ ID NO: 1985700 - DNA, 19 bp, Homo sapiens
taaaatgcccatttcgaag

SEQ ID NO: 1985701 - DNA, 19 bp, Homo sapiens
taaaatgtacactggatat

SEQ ID NO: 1985702 - DNA, 12 bp, Homo sapiens
taaaattagtga

SEQ ID NO: 1985703 - DNA, 14 bp, Homo sapiens
taaaattatggtga

SEQ ID NO: 1985704 - DNA, 21 bp, Homo sapiens
taaaattgacaacattttatt

SEQ ID NO: 1985705 - DNA, 14 bp, Homo sapiens
taaaattgcacttt

SEQ ID NO: 1985706 - DNA, 23 bp, Homo sapiens
taaaattgtatagagatatgcag

SEQ ID NO: 1985707 - DNA, 12 bp, Homo sapiens
taaaattgtgat

SEQ ID NO: 1985708 - DNA, 18 bp, Homo sapiens
taaaattgtgatgttttg

SEQ ID NO: 1985709 - DNA, 23 bp, Homo sapiens
taaaatttattgcttgatacttt

SEQ ID NO: 1985710 - DNA, 13 bp, Homo sapiens
taaaatttcaaca

SEQ ID NO: 1985711 - DNA, 17 bp, Homo sapiens
taaaattttatctctta

SEQ ID NO: 1985712 - DNA, 23 bp, Homo sapiens
taaaattttttgatgtcagcctt

SEQ ID NO: 1985713 - DNA, 18 bp, Homo sapiens
taaacaaaatagaagctg

SEQ ID NO: 1985714 - DNA, 22 bp, Homo sapiens
taaacaagtatttgttaattta

SEQ ID NO: 1985715 - DNA, 16 bp, Homo sapiens
taaacaattcaagtga

SEQ ID NO: 1985716 - DNA, 22 bp, Homo sapiens
taaacaatttctgcattcttaa

SEQ ID NO: 1985717 - DNA, 22 bp, Homo sapiens
taaacacccatgaatcaaagac

SEQ ID NO: 1985718 - DNA, 18 bp, Homo sapiens
taaacacccttcacatac

SEQ ID NO: 1985719 - DNA, 13 bp, Homo sapiens
taaacagcagtgt

SEQ ID NO: 1985720 - DNA, 22 bp, Homo sapiens
taaacagcagtgttccccatct

SEQ ID NO: 1985721 - DNA, 14 bp, Homo sapiens
taaacagcatttat

SEQ ID NO: 1985722 - DNA, 19 bp, Homo sapiens
taaacagcatttattacct

SEQ ID NO: 1985723 - DNA, 12 bp, Homo sapiens
taaacagtgcct

SEQ ID NO: 1985724 - DNA, 17 bp, Homo sapiens
taaacagtgcctgctga

SEQ ID NO: 1985725 - DNA, 18 bp, Homo sapiens
taaacagtgcctgctgaa

SEQ ID NO: 1985726 - DNA, 21 bp, Homo sapiens
taaacattaaaagaagactgg

SEQ ID NO: 1985727 - DNA, 20 bp, Homo sapiens
taaacattaaacactgtaat

SEQ ID NO: 1985728 - DNA, 18 bp, Homo sapiens
taaacattaaatgtctta

SEQ ID NO: 1985729 - DNA, 15 bp, Homo sapiens
taaaccaaaggacat

SEQ ID NO: 1985730 - DNA, 22 bp, Homo sapiens
taaaccaccagtgcccaaagtc

SEQ ID NO: 1985731 - DNA, 13 bp, Homo sapiens
taaaccagcagaa

SEQ ID NO: 1985732 - DNA, 20 bp, Homo sapiens
taaaccagcagaaaagtgct

SEQ ID NO: 1985733 - DNA, 17 bp, Homo sapiens
taaacccctgggtaact

SEQ ID NO: 1985734 - DNA, 18 bp, Homo sapiens
taaaccctatctgtgatt

SEQ ID NO: 1985735 - DNA, 16 bp, Homo sapiens
taaacctggagatgat

SEQ ID NO: 1985736 - DNA, 18 bp, Homo sapiens
taaacctggagatgatga

SEQ ID NO: 1985737 - DNA, 19 bp, Homo sapiens
taaacgactccgagaacaa

SEQ ID NO: 1985738 - DNA, 17 bp, Homo sapiens
taaacgtgatgatcagc

SEQ ID NO: 1985739 - DNA, 13 bp, Homo sapiens
taaactactgtaa

SEQ ID NO: 1985740 - DNA, 15 bp, Homo sapiens
taaactactgtaatt

SEQ ID NO: 1985741 - DNA, 14 bp, Homo sapiens
taaactagatactg

SEQ ID NO: 1985742 - DNA, 14 bp, Homo sapiens
taaactagatctcc

SEQ ID NO: 1985743 - DNA, 22 bp, Homo sapiens
taaactagatctcctatttttc

SEQ ID NO: 1985744 - DNA, 17 bp, Homo sapiens
taaactagtttccagtg

SEQ ID NO: 1985745 - DNA, 17 bp, Homo sapiens
gtgactatatagagatg

SEQ ID NO: 1985746 - DNA, 20 bp, Homo sapiens
gtgactatatagagatgttt

SEQ ID NO: 1985747 - DNA, 18 bp, Homo sapiens
gtgactgaaggggcacac

SEQ ID NO: 1985748 - DNA, 21 bp, Homo sapiens
gtgactgaaggggcacaccac

SEQ ID NO: 1985749 - DNA, 20 bp, Homo sapiens
gtgactgccccaactcctgg

SEQ ID NO: 1985750 - DNA, 21 bp, Homo sapiens
gtgactggagcccgagggcct

SEQ ID NO: 1985751 - DNA, 23 bp, Homo sapiens
gtgactggagcccgagggcctga

SEQ ID NO: 1985752 - DNA, 15 bp, Homo sapiens
gtgactggcaggtgc

SEQ ID NO: 1985753 - DNA, 22 bp, Homo sapiens
gtgactgtcccaccgggagcct

SEQ ID NO: 1985754 - DNA, 16 bp, Homo sapiens
gtgactgtcgtgttta

SEQ ID NO: 1985755 - DNA, 23 bp, Homo sapiens
gtgactgtcgtgtttacaaaagg

SEQ ID NO: 1985756 - DNA, 16 bp, Homo sapiens
gtgactttacaggagg

SEQ ID NO: 1985757 - DNA, 20 bp, Homo sapiens
gtgactttttagccagtgac

SEQ ID NO: 1985758 - DNA, 17 bp, Homo sapiens
gtgagaaaaagctcctg

SEQ ID NO: 1985759 - DNA, 22 bp, Homo sapiens
gtgagaaaaagctcctgtcctc

SEQ ID NO: 1985760 - DNA, 15 bp, Homo sapiens
gtgagaaatttaaac

SEQ ID NO: 1985761 - DNA, 21 bp, Homo sapiens
gtgagaagaaatgacattttg

SEQ ID NO: 1985762 - DNA, 19 bp, Homo sapiens
gtgagaataattgtgtaca

SEQ ID NO: 1985763 - DNA, 20 bp, Homo sapiens
gtgagaataattgtgtacaa

SEQ ID NO: 1985764 - DNA, 19 bp, Homo sapiens
gtgagaatcgacctcactg

SEQ ID NO: 1985765 - DNA, 19 bp, Homo sapiens
gtgagaatctggctcctgt

SEQ ID NO: 1985766 - DNA, 14 bp, Homo sapiens
gtgagaccacctct

SEQ ID NO: 1985767 - DNA, 16 bp, Homo sapiens
gtgagactctgtctca

SEQ ID NO: 1985768 - DNA, 17 bp, Homo sapiens
gtgagagaatctgcctg

SEQ ID NO: 1985769 - DNA, 13 bp, Homo sapiens
gtgagagctgggt

SEQ ID NO: 1985770 - DNA, 15 bp, Homo sapiens
gtgagaggaagggtg

SEQ ID NO: 1985771 - DNA, 23 bp, Homo sapiens
gtgagagggcatgcgcacaaggc

SEQ ID NO: 1985772 - DNA, 15 bp, Homo sapiens
gtgagatgtaattgt

SEQ ID NO: 1985773 - DNA, 16 bp, Homo sapiens
gtgagatttgtattta

SEQ ID NO: 1985774 - DNA, 21 bp, Homo sapiens
gtgagcaagaagtcaaagtaa

SEQ ID NO: 1985775 - DNA, 17 bp, Homo sapiens
gtgagcatctctgtgta

SEQ ID NO: 1985776 - DNA, 13 bp, Homo sapiens
gtgagccactgca

SEQ ID NO: 1985777 - DNA, 15 bp, Homo sapiens
gtgagccactgcacc

SEQ ID NO: 1985778 - DNA, 14 bp, Homo sapiens
gtgagctgggaagc

SEQ ID NO: 1985779 - DNA, 12 bp, Homo sapiens
gtgaggagggtg

SEQ ID NO: 1985780 - DNA, 20 bp, Homo sapiens
gtgaggattatgggtcctgc

SEQ ID NO: 1985781 - DNA, 15 bp, Homo sapiens
gtgaggcccagcctg

SEQ ID NO: 1985782 - DNA, 23 bp, Homo sapiens
gtgaggcccagcctgtcctggta

SEQ ID NO: 1985783 - DNA, 13 bp, Homo sapiens
gtgaggcctggcc

SEQ ID NO: 1985784 - DNA, 15 bp, Homo sapiens
gtgaggcttccaggc

SEQ ID NO: 1985785 - DNA, 16 bp, Homo sapiens
gtgaggcttccaggct

SEQ ID NO: 1985786 - DNA, 17 bp, Homo sapiens
gtgaggcttccaggctc

SEQ ID NO: 1985787 - DNA, 18 bp, Homo sapiens
gtgaggcttccaggctct

SEQ ID NO: 1985788 - DNA, 13 bp, Homo sapiens
gtgagggctgggc

SEQ ID NO: 1985789 - DNA, 20 bp, Homo sapiens
gtgaggtgggttttcttccc

SEQ ID NO: 1985790 - DNA, 19 bp, Homo sapiens
gtgagtcaccaagcccagt

SEQ ID NO: 1985791 - DNA, 15 bp, Homo sapiens
gtgagtcgaggacag

SEQ ID NO: 1985792 - DNA, 22 bp, Homo sapiens
gtgagtgactcggtgtaaaacc

SEQ ID NO: 1985793 - DNA, 13 bp, Homo sapiens
gtgagtggcagcc

SEQ ID NO: 1985794 - DNA, 15 bp, Homo sapiens
gtgagtgtggcttag

SEQ ID NO: 1985795 - DNA, 17 bp, Homo sapiens
gtgagttacagcgagag

SEQ ID NO: 1985796 - DNA, 17 bp, Homo sapiens
gtgagttgagtctcctc

SEQ ID NO: 1985797 - DNA, 14 bp, Homo sapiens
gtgataagtggaaa

SEQ ID NO: 1985798 - DNA, 16 bp, Homo sapiens
gtgataagtggaaaaa

SEQ ID NO: 1985799 - DNA, 21 bp, Homo sapiens
gtgatatatgtatttattgtc

SEQ ID NO: 1985800 - DNA, 17 bp, Homo sapiens
gtgatcagaaggctggg

SEQ ID NO: 1985801 - DNA, 20 bp, Homo sapiens
gtgatcagaccataatgtta

SEQ ID NO: 1985802 - DNA, 21 bp, Homo sapiens
gtgatcagtatgctgttttaa

SEQ ID NO: 1985803 - DNA, 24 bp, Homo sapiens
gtgatccacccacctcagcctccc

SEQ ID NO: 1985804 - DNA, 14 bp, Homo sapiens
gtgatcctcccacc

SEQ ID NO: 1985805 - DNA, 15 bp, Homo sapiens
gtgatcctcccacct

SEQ ID NO: 1985806 - DNA, 22 bp, Homo sapiens
gtgatcctcccacctcagcctc

SEQ ID NO: 1985807 - DNA, 23 bp, Homo sapiens
gtgatcctcccacctcagcctcc

SEQ ID NO: 1985808 - DNA, 19 bp, Homo sapiens
gtgatccttttatgttatt

SEQ ID NO: 1985809 - DNA, 12 bp, Homo sapiens
gtgatctccata

SEQ ID NO: 1985810 - DNA, 20 bp, Homo sapiens
gtgatctgtcccctctcccc

SEQ ID NO: 1985811 - DNA, 15 bp, Homo sapiens
gtgatgaactttctc

SEQ ID NO: 1985812 - DNA, 22 bp, Homo sapiens
gtgatgagggcagcagccagcc

SEQ ID NO: 1985813 - DNA, 22 bp, Homo sapiens
gtgatgctaaaggttgtattgc

SEQ ID NO: 1985814 - DNA, 16 bp, Homo sapiens
gtgatgctcaggcttg

SEQ ID NO: 1985815 - DNA, 14 bp, Homo sapiens
gtgatgggatctgt

SEQ ID NO: 1985816 - DNA, 14 bp, Homo sapiens
gtgatggttcccct

SEQ ID NO: 1985817 - DNA, 16 bp, Homo sapiens
gtgatggttcccctgt

SEQ ID NO: 1985818 - DNA, 19 bp, Homo sapiens
gtgatggttgccaggacga

SEQ ID NO: 1985819 - DNA, 13 bp, Homo sapiens
gtgatgtgctgga

SEQ ID NO: 1985820 - DNA, 22 bp, Homo sapiens
gtgattagagggaggagaatga

SEQ ID NO: 1985821 - DNA, 16 bp, Homo sapiens
gtgattctaatgtctt

SEQ ID NO: 1985822 - DNA, 23 bp, Homo sapiens
gtgattctcctgcctcagcctcc

SEQ ID NO: 1985823 - DNA, 13 bp, Homo sapiens
gtgattgtgtctg

SEQ ID NO: 1985824 - DNA, 23 bp, Homo sapiens
gtgatttagaactgtatgtcaga

SEQ ID NO: 1985825 - DNA, 13 bp, Homo sapiens
gtgattttgtaca

SEQ ID NO: 1985826 - DNA, 20 bp, Homo sapiens
gtgattttgtacagaatttt

SEQ ID NO: 1985827 - DNA, 22 bp, Homo sapiens
gtgcaaagttccctacttcctg

SEQ ID NO: 1985828 - DNA, 22 bp, Homo sapiens
gtgcaaatactccaagcttcaa

SEQ ID NO: 1985829 - DNA, 13 bp, Homo sapiens
gtgcaaattttgc

SEQ ID NO: 1985830 - DNA, 16 bp, Homo sapiens
gtgcaagagacagagc

SEQ ID NO: 1985831 - DNA, 19 bp, Homo sapiens
gtgcaagagactctggcct

SEQ ID NO: 1985832 - DNA, 15 bp, Homo sapiens
gtgcaatgagccaga

SEQ ID NO: 1985833 - DNA, 17 bp, Homo sapiens
gtgcacacaccagagcc

SEQ ID NO: 1985834 - DNA, 11 bp, Homo sapiens
gtgcacacaga

SEQ ID NO: 1985835 - DNA, 22 bp, Homo sapiens
gtgcacacagaaatatatatac

SEQ ID NO: 1985836 - DNA, 23 bp, Homo sapiens
gtgcacacagaaatatatataca

SEQ ID NO: 1985837 - DNA, 14 bp, Homo sapiens
gtgcacaggagggg

SEQ ID NO: 1985838 - DNA, 14 bp, Homo sapiens
gtgcacatgtgtct

SEQ ID NO: 1985839 - DNA, 20 bp, Homo sapiens
gtgcacccactcaccagggt

SEQ ID NO: 1985840 - DNA, 21 bp, Homo sapiens
gtgcacccactcaccagggtc

SEQ ID NO: 1985841 - DNA, 19 bp, Homo sapiens
gtgcaccttacattcctag

SEQ ID NO: 1985842 - DNA, 20 bp, Homo sapiens
gtgcaccttaccaactttct

SEQ ID NO: 1985843 - DNA, 21 bp, Homo sapiens
gtgcaccttaccaactttctg

SEQ ID NO: 1985844 - DNA, 17 bp, Homo sapiens
gtgcagaggtttcttga

SEQ ID NO: 1985845 - DNA, 16 bp, Homo sapiens
gtgcagcagcccagct

SEQ ID NO: 1985846 - DNA, 18 bp, Homo sapiens
gtgcagcagcccagcttc

SEQ ID NO: 1985847 - DNA, 19 bp, Homo sapiens
gtgcagccccgccctctgc

SEQ ID NO: 1985848 - DNA, 21 bp, Homo sapiens
gtgcagccccgccctctgcgt

SEQ ID NO: 1985849 - DNA, 19 bp, Homo sapiens
gtgcagcccttcctcctga

SEQ ID NO: 1985850 - DNA, 16 bp, Homo sapiens
gtgcagcttctgtcct

SEQ ID NO: 1985851 - DNA, 18 bp, Homo sapiens
gtgcaggcctgctcaggg

SEQ ID NO: 1985852 - DNA, 23 bp, Homo sapiens
gtgcagggaggaggtggcagccc

SEQ ID NO: 1985853 - DNA, 17 bp, Homo sapiens
gtgcagtaggagcaaga

SEQ ID NO: 1985854 - DNA, 17 bp, Homo sapiens
gtgcagtcccgtggagg

SEQ ID NO: 1985855 - DNA, 20 bp, Homo sapiens
gtgcagtggtgcgatctggg

SEQ ID NO: 1985856 - DNA, 15 bp, Homo sapiens
gtgcagttgacagca

SEQ ID NO: 1985857 - DNA, 13 bp, Homo sapiens
gtgcatctcagcc

SEQ ID NO: 1985858 - DNA, 22 bp, Homo sapiens
gtgcatgaaggtttctgaaaat

SEQ ID NO: 1985859 - DNA, 19 bp, Homo sapiens
gtgcatgctctctgcagcc

SEQ ID NO: 1985860 - DNA, 18 bp, Homo sapiens
gtgcatggcttggggagc

SEQ ID NO: 1985861 - DNA, 20 bp, Homo sapiens
gttccctacttcctgtgact

SEQ ID NO: 1985862 - DNA, 12 bp, Homo sapiens
gttccctctgag

SEQ ID NO: 1985863 - DNA, 14 bp, Homo sapiens
gttccctctgagaa

SEQ ID NO: 1985864 - DNA, 21 bp, Homo sapiens
gttccctgaaaacccagagag

SEQ ID NO: 1985865 - DNA, 18 bp, Homo sapiens
gttccctgaacatctgtg

SEQ ID NO: 1985866 - DNA, 23 bp, Homo sapiens
gttccctgagaaacccaccagcc

SEQ ID NO: 1985867 - DNA, 11 bp, Homo sapiens
gttccctgcac

SEQ ID NO: 1985868 - DNA, 12 bp, Homo sapiens
gttccctgcacc

SEQ ID NO: 1985869 - DNA, 14 bp, Homo sapiens
gttccctgcaccct

SEQ ID NO: 1985870 - DNA, 20 bp, Homo sapiens
gttccctgtcagaggctaag

SEQ ID NO: 1985871 - DNA, 20 bp, Homo sapiens
gttcccttgaccattggctg

SEQ ID NO: 1985872 - DNA, 23 bp, Homo sapiens
gttcccttgaccattggctgcgc

SEQ ID NO: 1985873 - DNA, 13 bp, Homo sapiens
gttcctcaccaat

SEQ ID NO: 1985874 - DNA, 17 bp, Homo sapiens
gttcctcaccaataact

SEQ ID NO: 1985875 - DNA, 12 bp, Homo sapiens
gttcctgcactc

SEQ ID NO: 1985876 - DNA, 17 bp, Homo sapiens
gttcgagaccagcctgg

SEQ ID NO: 1985877 - DNA, 13 bp, Homo sapiens
gttcgcagccacc

SEQ ID NO: 1985878 - DNA, 15 bp, Homo sapiens
gttcgcagccaccct

SEQ ID NO: 1985879 - DNA, 18 bp, Homo sapiens
gttctaaaggactaacat

SEQ ID NO: 1985880 - DNA, 17 bp, Homo sapiens
gttctacaagcatattt

SEQ ID NO: 1985881 - DNA, 15 bp, Homo sapiens
gttctagagaagagg

SEQ ID NO: 1985882 - DNA, 21 bp, Homo sapiens
gttctagtctcctttgcactg

SEQ ID NO: 1985883 - DNA, 23 bp, Homo sapiens
gttctagtctcctttgcactgag

SEQ ID NO: 1985884 - DNA, 15 bp, Homo sapiens
gttctatatgcattt

SEQ ID NO: 1985885 - DNA, 14 bp, Homo sapiens
gttctcaaatgcta

SEQ ID NO: 1985886 - DNA, 13 bp, Homo sapiens
gttctccagccca

SEQ ID NO: 1985887 - DNA, 14 bp, Homo sapiens
gttctccagcccac

SEQ ID NO: 1985888 - DNA, 17 bp, Homo sapiens
gttctccagcccacacc

SEQ ID NO: 1985889 - DNA, 23 bp, Homo sapiens
gttctccgggtgtggcctcagcc

SEQ ID NO: 1985890 - DNA, 14 bp, Homo sapiens
gttctctgaggaca

SEQ ID NO: 1985891 - DNA, 16 bp, Homo sapiens
gttctctgaggacact

SEQ ID NO: 1985892 - DNA, 15 bp, Homo sapiens
gttctgaataatttc

SEQ ID NO: 1985893 - DNA, 14 bp, Homo sapiens
gttctgacattcat

SEQ ID NO: 1985894 - DNA, 16 bp, Homo sapiens
gttctgcactgaaaag

SEQ ID NO: 1985895 - DNA, 22 bp, Homo sapiens
gttctgctcctctccaggcacc

SEQ ID NO: 1985896 - DNA, 14 bp, Homo sapiens
gttctgctggcctg

SEQ ID NO: 1985897 - DNA, 19 bp, Homo sapiens
gttctgctggcctggatct

SEQ ID NO: 1985898 - DNA, 17 bp, Homo sapiens
gttctggacctccccct

SEQ ID NO: 1985899 - DNA, 21 bp, Homo sapiens
gttctggagctgctgttccaa

SEQ ID NO: 1985900 - DNA, 19 bp, Homo sapiens
gttctggctttacatttta

SEQ ID NO: 1985901 - DNA, 14 bp, Homo sapiens
gttctgggacacag

SEQ ID NO: 1985902 - DNA, 16 bp, Homo sapiens
gttctgggacacagtt

SEQ ID NO: 1985903 - DNA, 17 bp, Homo sapiens
gttctggggaggaaggg

SEQ ID NO: 1985904 - DNA, 18 bp, Homo sapiens
gttctgtgggcttggcct

SEQ ID NO: 1985905 - DNA, 21 bp, Homo sapiens
gttctgtgtgggtctggggag

SEQ ID NO: 1985906 - DNA, 16 bp, Homo sapiens
gttctgttgatcccac

SEQ ID NO: 1985907 - DNA, 18 bp, Homo sapiens
gttctgttgatcccactt

SEQ ID NO: 1985908 - DNA, 20 bp, Homo sapiens
gttctgttgatcccacttca

SEQ ID NO: 1985909 - DNA, 19 bp, Homo sapiens
gttcttgagtagatctgct

SEQ ID NO: 1985910 - DNA, 20 bp, Homo sapiens
gttcttgagtagatctgctt

SEQ ID NO: 1985911 - DNA, 23 bp, Homo sapiens
gttcttgagtagatctgcttctt

SEQ ID NO: 1985912 - DNA, 15 bp, Homo sapiens
gttcttgatgtcatg

SEQ ID NO: 1985913 - DNA, 21 bp, Homo sapiens
gttcttgctgagcaccctctc

SEQ ID NO: 1985914 - DNA, 16 bp, Homo sapiens
gttcttgtgcatgttt

SEQ ID NO: 1985915 - DNA, 18 bp, Homo sapiens
gttctttagctgtcactt

SEQ ID NO: 1985916 - DNA, 16 bp, Homo sapiens
gttctttcttcctctg

SEQ ID NO: 1985917 - DNA, 19 bp, Homo sapiens
gttctttcttcctctgctg

SEQ ID NO: 1985918 - DNA, 13 bp, Homo sapiens
gttcttttactgt

SEQ ID NO: 1985919 - DNA, 14 bp, Homo sapiens
gttcttttactgta

SEQ ID NO: 1985920 - DNA, 19 bp, Homo sapiens
gtttgcactgtatgctgga

SEQ ID NO: 1985921 - DNA, 20 bp, Homo sapiens
gtttgcactgtatgctggac

SEQ ID NO: 1985922 - DNA, 16 bp, Homo sapiens
gtttgcctctgcctct

SEQ ID NO: 1985923 - DNA, 20 bp, Homo sapiens
gtttgctttgcccttctttc

SEQ ID NO: 1985924 - DNA, 20 bp, Homo sapiens
gtttgctttgtatgcacttt

SEQ ID NO: 1985925 - DNA, 20 bp, Homo sapiens
gtttggatatgtaaaacatt

SEQ ID NO: 1985926 - DNA, 21 bp, Homo sapiens
gtttggatatgtaaaacattt

SEQ ID NO: 1985927 - DNA, 22 bp, Homo sapiens
gtttgggccactgcactctagc

SEQ ID NO: 1985928 - DNA, 13 bp, Homo sapiens
gtttggggagaaa

SEQ ID NO: 1985929 - DNA, 14 bp, Homo sapiens
gtttggggagaaat

SEQ ID NO: 1985930 - DNA, 22 bp, Homo sapiens
gtttgtaaattctggaaatgtc

SEQ ID NO: 1985931 - DNA, 15 bp, Homo sapiens
gtttgtataacttct

SEQ ID NO: 1985932 - DNA, 16 bp, Homo sapiens
gtttgtataacttctt

SEQ ID NO: 1985933 - DNA, 19 bp, Homo sapiens
gtttgtcatatattcatgt

SEQ ID NO: 1985934 - DNA, 19 bp, Homo sapiens
gtttgtggaaaatgaaaat

SEQ ID NO: 1985935 - DNA, 13 bp, Homo sapiens
gtttgtgtggatg

SEQ ID NO: 1985936 - DNA, 12 bp, Homo sapiens
gtttgtgtgtct

SEQ ID NO: 1985937 - DNA, 12 bp, Homo sapiens
gtttgttctccg

SEQ ID NO: 1985938 - DNA, 12 bp, Homo sapiens
gtttgtttactt

SEQ ID NO: 1985939 - DNA, 18 bp, Homo sapiens
gtttgtttctccccctgg

SEQ ID NO: 1985940 - DNA, 11 bp, Homo sapiens
gttttaaatta

SEQ ID NO: 1985941 - DNA, 19 bp, Homo sapiens
gttttaaatttatttcaaa

SEQ ID NO: 1985942 - DNA, 17 bp, Homo sapiens
gttttaacagaaccaga

SEQ ID NO: 1985943 - DNA, 20 bp, Homo sapiens
gttttaaccagtacttctaa

SEQ ID NO: 1985944 - DNA, 19 bp, Homo sapiens
gttttaactagaatttatt

SEQ ID NO: 1985945 - DNA, 14 bp, Homo sapiens
gttttaagaggcag

SEQ ID NO: 1985946 - DNA, 20 bp, Homo sapiens
gttttaattccaatatgatg

SEQ ID NO: 1985947 - DNA, 21 bp, Homo sapiens
gttttacaaatttttcctgca

SEQ ID NO: 1985948 - DNA, 15 bp, Homo sapiens
gttttattctgactt

SEQ ID NO: 1985949 - DNA, 20 bp, Homo sapiens
gttttattctgacttcctct

SEQ ID NO: 1985950 - DNA, 16 bp, Homo sapiens
gttttcataacttgct

SEQ ID NO: 1985951 - DNA, 23 bp, Homo sapiens
gttttcataacttgctgaatttc

SEQ ID NO: 1985952 - DNA, 17 bp, Homo sapiens
gttttcatcctggcctc

SEQ ID NO: 1985953 - DNA, 10 bp, Homo sapiens
gttttcatgg

SEQ ID NO: 1985954 - DNA, 22 bp, Homo sapiens
gttttcatggtgaaaatgtact

SEQ ID NO: 1985955 - DNA, 23 bp, Homo sapiens
gttttcatggtgaaaatgtactg

SEQ ID NO: 1985956 - DNA, 21 bp, Homo sapiens
gttttccctgacctccctcta

SEQ ID NO: 1985957 - DNA, 17 bp, Homo sapiens
gttttcctaaatgcagt

SEQ ID NO: 1985958 - DNA, 13 bp, Homo sapiens
gttttctaactgt

SEQ ID NO: 1985959 - DNA, 16 bp, Homo sapiens
gttttctaactgtaaa

SEQ ID NO: 1985960 - DNA, 21 bp, Homo sapiens
gttttctaactgtaaatcact

SEQ ID NO: 1985961 - DNA, 24 bp, Homo sapiens
gttttctaactgtaaatcacttgt

SEQ ID NO: 1985962 - DNA, 18 bp, Homo sapiens
gttttctccaagagctac

SEQ ID NO: 1985963 - DNA, 16 bp, Homo sapiens
gttttctcctcccagg

SEQ ID NO: 1985964 - DNA, 22 bp, Homo sapiens
gttttctgagaaagactattca

SEQ ID NO: 1985965 - DNA, 10 bp, Homo sapiens
gttttctgat

SEQ ID NO: 1985966 - DNA, 23 bp, Homo sapiens
gttttcttcaagggaagaaacac

SEQ ID NO: 1985967 - DNA, 12 bp, Homo sapiens
gttttcttccca

SEQ ID NO: 1985968 - DNA, 22 bp, Homo sapiens
gttttgaactaataaaagcata

SEQ ID NO: 1985969 - DNA, 23 bp, Homo sapiens
gttttgaactaataaaagcataa

SEQ ID NO: 1985970 - DNA, 15 bp, Homo sapiens
gttttgatatgagta

SEQ ID NO: 1985971 - DNA, 18 bp, Homo sapiens
gttttgcactgacaagat

SEQ ID NO: 1985972 - DNA, 16 bp, Homo sapiens
gttttggaagctctga

SEQ ID NO: 1985973 - DNA, 17 bp, Homo sapiens
gttttgtcccatttcct

SEQ ID NO: 1985974 - DNA, 18 bp, Homo sapiens
gttttgtcctttgagaaa

SEQ ID NO: 1985975 - DNA, 24 bp, Homo sapiens
gttttgtgactatatagagatgtt

SEQ ID NO: 1985976 - DNA, 19 bp, Homo sapiens
gttttgtggaggagctcag

SEQ ID NO: 1985977 - DNA, 16 bp, Homo sapiens
gtttttaaaagtttca

SEQ ID NO: 1985978 - DNA, 13 bp, Homo sapiens
gtttttaagctgt

SEQ ID NO: 1985979 - DNA, 15 bp, Homo sapiens
gtttttaagctgttt

SEQ ID NO: 1985980 - DNA, 20 bp, Homo sapiens
gtttttaatctttgtgacag

SEQ ID NO: 1985981 - DNA, 12 bp, Homo sapiens
gtttttaatgta

SEQ ID NO: 1985982 - DNA, 18 bp, Homo sapiens
gtttttaatgtatagtaa

SEQ ID NO: 1985983 - DNA, 21 bp, Homo sapiens
gtttttacctaccacagtgtc

SEQ ID NO: 1985984 - DNA, 14 bp, Homo sapiens
gtttttactccagt

SEQ ID NO: 1985985 - DNA, 19 bp, Homo sapiens
gtttttatgatatccctga

SEQ ID NO: 1985986 - DNA, 20 bp, Homo sapiens
gtttttatgatatccctgat

SEQ ID NO: 1985987 - DNA, 16 bp, Homo sapiens
gtttttctgggtggcc

SEQ ID NO: 1985988 - DNA, 14 bp, Homo sapiens
gtttttgctataga

SEQ ID NO: 1985989 - DNA, 13 bp, Homo sapiens
gtttttggctctt

SEQ ID NO: 1985990 - DNA, 22 bp, Homo sapiens
gttttttgcctaaatccaaaga

SEQ ID NO: 1985991 - DNA, 14 bp, Homo sapiens
gatgaggcctcttg

SEQ ID NO: 1985992 - DNA, 12 bp, Homo sapiens
gatgagggcagc

SEQ ID NO: 1985993 - DNA, 15 bp, Homo sapiens
gatgagggcagcagc

SEQ ID NO: 1985994 - DNA, 16 bp, Homo sapiens
gatgagggcagcagcc

SEQ ID NO: 1985995 - DNA, 17 bp, Homo sapiens
gatgagggcagcagcca

SEQ ID NO: 1985996 - DNA, 18 bp, Homo sapiens
gatgagggcagcagccag

SEQ ID NO: 1985997 - DNA, 15 bp, Homo sapiens
gatgataaatattta

SEQ ID NO: 1985998 - DNA, 19 bp, Homo sapiens
gatgatcagctgtttgtca

SEQ ID NO: 1985999 - DNA, 22 bp, Homo sapiens
gatgatctctccacggtagcac

SEQ ID NO: 1986000 - DNA, 21 bp, Homo sapiens
gatgatgaaatgaggtcagag

SEQ ID NO: 1986001 - DNA, 23 bp, Homo sapiens
gatgattaaacacctgacacatc

SEQ ID NO: 1986002 - DNA, 19 bp, Homo sapiens
gatgatttcagaaggagaa

SEQ ID NO: 1986003 - DNA, 14 bp, Homo sapiens
gatgcacggcggca

SEQ ID NO: 1986004 - DNA, 18 bp, Homo sapiens
gatgcacggcggcagggt

SEQ ID NO: 1986005 - DNA, 19 bp, Homo sapiens
gatgccaaaaaaaaataca

SEQ ID NO: 1986006 - DNA, 13 bp, Homo sapiens
gatgccacagccc

SEQ ID NO: 1986007 - DNA, 20 bp, Homo sapiens
gatgccacagccccacagca

SEQ ID NO: 1986008 - DNA, 23 bp, Homo sapiens
gatgccagccgggtacctcagtt

SEQ ID NO: 1986009 - DNA, 13 bp, Homo sapiens
gatgccagtggaa

SEQ ID NO: 1986010 - DNA, 12 bp, Homo sapiens
gatgccatgttt

SEQ ID NO: 1986011 - DNA, 17 bp, Homo sapiens
gatgccgctcttctgtc

SEQ ID NO: 1986012 - DNA, 20 bp, Homo sapiens
gatgccgctcttctgtcatc

SEQ ID NO: 1986013 - DNA, 12 bp, Homo sapiens
gatgcctccacc

SEQ ID NO: 1986014 - DNA, 13 bp, Homo sapiens
gatgcctccaccg

SEQ ID NO: 1986015 - DNA, 17 bp, Homo sapiens
gatgcctccaccgctgc

SEQ ID NO: 1986016 - DNA, 16 bp, Homo sapiens
gatgcctggtggcagc

SEQ ID NO: 1986017 - DNA, 18 bp, Homo sapiens
gatgcctggtggcagctg

SEQ ID NO: 1986018 - DNA, 21 bp, Homo sapiens
gatgcgaaaacttgaatctgt

SEQ ID NO: 1986019 - DNA, 21 bp, Homo sapiens
gatgctcaggcttgaaatgca

SEQ ID NO: 1986020 - DNA, 19 bp, Homo sapiens
gatgctgccccgttccctg

SEQ ID NO: 1986021 - DNA, 16 bp, Homo sapiens
gatgctgcctgagtca

SEQ ID NO: 1986022 - DNA, 11 bp, Homo sapiens
gatgctgggga

SEQ ID NO: 1986023 - DNA, 21 bp, Homo sapiens
gatggaagttgcagtgagctg

SEQ ID NO: 1986024 - DNA, 14 bp, Homo sapiens
gatggaccagtaga

SEQ ID NO: 1986025 - DNA, 16 bp, Homo sapiens
gatggacccctccctt

SEQ ID NO: 1986026 - DNA, 17 bp, Homo sapiens
gatggaccctcgcagca

SEQ ID NO: 1986027 - DNA, 23 bp, Homo sapiens
gatggaccctcgcagcaggtgca

SEQ ID NO: 1986028 - DNA, 21 bp, Homo sapiens
gatggaccgggtgggcctggc

SEQ ID NO: 1986029 - DNA, 22 bp, Homo sapiens
gatggaccgggtgggcctggcc

SEQ ID NO: 1986030 - DNA, 12 bp, Homo sapiens
gatggagaagga

SEQ ID NO: 1986031 - DNA, 23 bp, Homo sapiens
gatggagactggtcctgtgtgca

SEQ ID NO: 1986032 - DNA, 16 bp, Homo sapiens
gatggagagaggggaa

SEQ ID NO: 1986033 - DNA, 16 bp, Homo sapiens
gatggagcgcacctgc

SEQ ID NO: 1986034 - DNA, 14 bp, Homo sapiens
gatggaggagaaat

SEQ ID NO: 1986035 - DNA, 16 bp, Homo sapiens
gatggaggagaaataa

SEQ ID NO: 1986036 - DNA, 17 bp, Homo sapiens
gatggaggccgagccaa

SEQ ID NO: 1986037 - DNA, 13 bp, Homo sapiens
gatggatggacag

SEQ ID NO: 1986038 - DNA, 14 bp, Homo sapiens
gatggatggacaga

SEQ ID NO: 1986039 - DNA, 15 bp, Homo sapiens
gatggccaagagcat

SEQ ID NO: 1986040 - DNA, 18 bp, Homo sapiens
gatggctgtgcctctgcc

SEQ ID NO: 1986041 - DNA, 19 bp, Homo sapiens
gatgggaagatggtagcag

SEQ ID NO: 1986042 - DNA, 13 bp, Homo sapiens
gatgggacatcaa

SEQ ID NO: 1986043 - DNA, 14 bp, Homo sapiens
gatgggaccaggga

SEQ ID NO: 1986044 - DNA, 20 bp, Homo sapiens
gatgggatcccaggccaggg

SEQ ID NO: 1986045 - DNA, 21 bp, Homo sapiens
gatgggcaacccccagcctgc

SEQ ID NO: 1986046 - DNA, 18 bp, Homo sapiens
gatgggcattgggctgac

SEQ ID NO: 1986047 - DNA, 21 bp, Homo sapiens
gatggggtgggcagggctggg

SEQ ID NO: 1986048 - DNA, 21 bp, Homo sapiens
gatgggtctggctgagctgaa

SEQ ID NO: 1986049 - DNA, 21 bp, Homo sapiens
gatggtccgccacgaggagct

SEQ ID NO: 1986050 - DNA, 14 bp, Homo sapiens
gatggtgctcccct

SEQ ID NO: 1986051 - DNA, 21 bp, Homo sapiens
gatggtggtgagcacatctgg

SEQ ID NO: 1986052 - DNA, 13 bp, Homo sapiens
gatggttcccctg

SEQ ID NO: 1986053 - DNA, 22 bp, Homo sapiens
gatggttctcaattgtatagtt

SEQ ID NO: 1986054 - DNA, 20 bp, Homo sapiens
gatgtaaacagtgcctgctg

SEQ ID NO: 1986055 - DNA, 16 bp, Homo sapiens
gatgtaactattgaat

SEQ ID NO: 1986056 - DNA, 23 bp, Homo sapiens
gatgtaaggtaatttctgtgtat

SEQ ID NO: 1986057 - DNA, 18 bp, Homo sapiens
gatgtatttttgtaccct

SEQ ID NO: 1986058 - DNA, 22 bp, Homo sapiens
gatgtcagccgagccgggcctg

SEQ ID NO: 1986059 - DNA, 20 bp, Homo sapiens
gatgtcatccccttgtgtca

SEQ ID NO: 1986060 - DNA, 21 bp, Homo sapiens
gatgtcatgtacttcctgtgt

SEQ ID NO: 1986061 - DNA, 16 bp, Homo sapiens
gatgtcccatctgctc

SEQ ID NO: 1986062 - DNA, 16 bp, Homo sapiens
gatgtcccctgtccca

SEQ ID NO: 1986063 - DNA, 22 bp, Homo sapiens
gatgtcccctgtcccaccaact

SEQ ID NO: 1986064 - DNA, 14 bp, Homo sapiens
gatgtctaatagtt

SEQ ID NO: 1986065 - DNA, 17 bp, Homo sapiens
gatgtctcttgtagaag

SEQ ID NO: 1986066 - DNA, 21 bp, Homo sapiens
gatgtgaattgcctgcagaga

SEQ ID NO: 1986067 - DNA, 19 bp, Homo sapiens
gatgtgcccacagggacca

SEQ ID NO: 1986068 - DNA, 16 bp, Homo sapiens
gatgtgctggagctgg

SEQ ID NO: 1986069 - DNA, 17 bp, Homo sapiens
gatgtggcaaagtgctg

SEQ ID NO: 1986070 - DNA, 21 bp, Homo sapiens
gatgtggccctggcctgctgg

SEQ ID NO: 1986071 - DNA, 17 bp, Homo sapiens
gatgtgggtcaaggaat

SEQ ID NO: 1986072 - DNA, 16 bp, Homo sapiens
gatgtgtggggcatgg

SEQ ID NO: 1986073 - DNA, 16 bp, Homo sapiens
gatgtgttttgcacgt

SEQ ID NO: 1986074 - DNA, 17 bp, Homo sapiens
gatgtgttttgcacgtc

SEQ ID NO: 1986075 - DNA, 16 bp, Homo sapiens
gagtgacagaggcagc

SEQ ID NO: 1986076 - DNA, 17 bp, Homo sapiens
gagtgacagaggcagcc

SEQ ID NO: 1986077 - DNA, 11 bp, Homo sapiens
gagtgacatgg

SEQ ID NO: 1986078 - DNA, 23 bp, Homo sapiens
gagtgacatgggtgtgccaggct

SEQ ID NO: 1986079 - DNA, 15 bp, Homo sapiens
gagtgactcgagggt

SEQ ID NO: 1986080 - DNA, 21 bp, Homo sapiens
gagtgactgtaggcagggaac

SEQ ID NO: 1986081 - DNA, 14 bp, Homo sapiens
gagtgagaatctgg

SEQ ID NO: 1986082 - DNA, 14 bp, Homo sapiens
gagtgagactctgt

SEQ ID NO: 1986083 - DNA, 24 bp, Homo sapiens
gagtgagcactaaggtgtgctctg

SEQ ID NO: 1986084 - DNA, 20 bp, Homo sapiens
gagtgaggcttccaggctct

SEQ ID NO: 1986085 - DNA, 20 bp, Homo sapiens
gagtgatgtagcgtaacaaa

SEQ ID NO: 1986086 - DNA, 15 bp, Homo sapiens
gagtgattcaggggc

SEQ ID NO: 1986087 - DNA, 12 bp, Homo sapiens
gagtgccaggac

SEQ ID NO: 1986088 - DNA, 13 bp, Homo sapiens
gagtgccaggact

SEQ ID NO: 1986089 - DNA, 19 bp, Homo sapiens
gagtgccaggactccccag

SEQ ID NO: 1986090 - DNA, 23 bp, Homo sapiens
gagtgcccttaaaataatgattt

SEQ ID NO: 1986091 - DNA, 13 bp, Homo sapiens
gagtggaatgcag

SEQ ID NO: 1986092 - DNA, 16 bp, Homo sapiens
gagtggatctccaagg

SEQ ID NO: 1986093 - DNA, 12 bp, Homo sapiens
gagtggatggat

SEQ ID NO: 1986094 - DNA, 14 bp, Homo sapiens
gagtggatggatgg

SEQ ID NO: 1986095 - DNA, 13 bp, Homo sapiens
gagtggcagccat

SEQ ID NO: 1986096 - DNA, 15 bp, Homo sapiens
gagtggcagccatgc

SEQ ID NO: 1986097 - DNA, 18 bp, Homo sapiens
gagtggcagccatgcctc

SEQ ID NO: 1986098 - DNA, 21 bp, Homo sapiens
gagtggcccctcacctgggcc

SEQ ID NO: 1986099 - DNA, 13 bp, Homo sapiens
gagtggctcctcc

SEQ ID NO: 1986100 - DNA, 21 bp, Homo sapiens
gagtggcttgtgattctggga

SEQ ID NO: 1986101 - DNA, 15 bp, Homo sapiens
gagtgggctgcctgg

SEQ ID NO: 1986102 - DNA, 15 bp, Homo sapiens
gagtggttgttgcca

SEQ ID NO: 1986103 - DNA, 21 bp, Homo sapiens
gagtgtgaccaaaagttacat

SEQ ID NO: 1986104 - DNA, 14 bp, Homo sapiens
gagtgtgcagactg

SEQ ID NO: 1986105 - DNA, 20 bp, Homo sapiens
gagtgtgcgtgtgtgcatgt

SEQ ID NO: 1986106 - DNA, 22 bp, Homo sapiens
gagtgtgtttgtgtgcatgaaa

SEQ ID NO: 1986107 - DNA, 22 bp, Homo sapiens
gagtgttcattttagtgactgt

SEQ ID NO: 1986108 - DNA, 23 bp, Homo sapiens
gagtgttctgtgggcttggcctt

SEQ ID NO: 1986109 - DNA, 18 bp, Homo sapiens
gagttacttgtctgaggc

SEQ ID NO: 1986110 - DNA, 21 bp, Homo sapiens
gagttacttgtctgaggcctc

SEQ ID NO: 1986111 - DNA, 16 bp, Homo sapiens
gagttataaaaataca

SEQ ID NO: 1986112 - DNA, 23 bp, Homo sapiens
gagttccaaataaggatttgttc

SEQ ID NO: 1986113 - DNA, 23 bp, Homo sapiens
gagttcctgtgggtgtgtctctc

SEQ ID NO: 1986114 - DNA, 19 bp, Homo sapiens
gagttcgagaccagcctgg

SEQ ID NO: 1986115 - DNA, 16 bp, Homo sapiens
gagttctgacattcat

SEQ ID NO: 1986116 - DNA, 14 bp, Homo sapiens
gagttgatgtctcc

SEQ ID NO: 1986117 - DNA, 19 bp, Homo sapiens
gagttgctcactcaggact

SEQ ID NO: 1986118 - DNA, 15 bp, Homo sapiens
gagttggacacactg

SEQ ID NO: 1986119 - DNA, 16 bp, Homo sapiens
gagttgtggaaagcct

SEQ ID NO: 1986120 - DNA, 22 bp, Homo sapiens
gagttgttttcagactcagact

SEQ ID NO: 1986121 - DNA, 21 bp, Homo sapiens
gagttgttttggtgcctgcct

SEQ ID NO: 1986122 - DNA, 17 bp, Homo sapiens
gagtttgagacaagccc

SEQ ID NO: 1986123 - DNA, 20 bp, Homo sapiens
gagtttgagacaagccctgg

SEQ ID NO: 1986124 - DNA, 12 bp, Homo sapiens
gagtttggtccc

SEQ ID NO: 1986125 - DNA, 15 bp, Homo sapiens
gagtttggtccctgg

SEQ ID NO: 1986126 - DNA, 19 bp, Homo sapiens
gagtttttatggggctgaa

SEQ ID NO: 1986127 - DNA, 20 bp, Homo sapiens
gataaaactaaatatatgtc

SEQ ID NO: 1986128 - DNA, 18 bp, Homo sapiens
gataaaattgtgatgttt

SEQ ID NO: 1986129 - DNA, 18 bp, Homo sapiens
gataaagacagctgacag

SEQ ID NO: 1986130 - DNA, 21 bp, Homo sapiens
gataaagacagctgacagata

SEQ ID NO: 1986131 - DNA, 19 bp, Homo sapiens
gataaagattttttaataa

SEQ ID NO: 1986132 - DNA, 13 bp, Homo sapiens
gataaattataag

SEQ ID NO: 1986133 - DNA, 16 bp, Homo sapiens
gataaattccactgga

SEQ ID NO: 1986134 - DNA, 22 bp, Homo sapiens
gataaccacaaccaggaagaac

SEQ ID NO: 1986135 - DNA, 15 bp, Homo sapiens
gataaccagctgtaa

SEQ ID NO: 1986136 - DNA, 21 bp, Homo sapiens
gataacctgtacttcaagtta

SEQ ID NO: 1986137 - DNA, 22 bp, Homo sapiens
gataacctgtacttcaagttaa

SEQ ID NO: 1986138 - DNA, 11 bp, Homo sapiens
gataactctcc

SEQ ID NO: 1986139 - DNA, 20 bp, Homo sapiens
gataagaataggtcattttc

SEQ ID NO: 1986140 - DNA, 16 bp, Homo sapiens
gataagcttcaaagct

SEQ ID NO: 1986141 - DNA, 22 bp, Homo sapiens
gataagtggaaaaaagagaaaa

SEQ ID NO: 1986142 - DNA, 13 bp, Homo sapiens
gataatatgtttg

SEQ ID NO: 1986143 - DNA, 21 bp, Homo sapiens
gataatcaattattacattta

SEQ ID NO: 1986144 - DNA, 13 bp, Homo sapiens
gataatcagcctc

SEQ ID NO: 1986145 - DNA, 15 bp, Homo sapiens
gataatgctgttgcc

SEQ ID NO: 1986146 - DNA, 14 bp, Homo sapiens
gataattataatat

SEQ ID NO: 1986147 - DNA, 16 bp, Homo sapiens
gataatttattttgta

SEQ ID NO: 1986148 - DNA, 14 bp, Homo sapiens
gatacaaggatcag

SEQ ID NO: 1986149 - DNA, 14 bp, Homo sapiens
gatacactcctgct

SEQ ID NO: 1986150 - DNA, 20 bp, Homo sapiens
gatacactgaagttaacaga

SEQ ID NO: 1986151 - DNA, 12 bp, Homo sapiens
gatacagaatga

SEQ ID NO: 1986152 - DNA, 23 bp, Homo sapiens
gatacaggaaaagctgctgacag

SEQ ID NO: 1986153 - DNA, 14 bp, Homo sapiens
gatacatagatgga

SEQ ID NO: 1986154 - DNA, 18 bp, Homo sapiens
gatacatggggaactgca

SEQ ID NO: 1986155 - DNA, 18 bp, Homo sapiens
gatacattccctatcaaa

SEQ ID NO: 1986156 - DNA, 22 bp, Homo sapiens
gataccataaaaagaggatgat

SEQ ID NO: 1986157 - DNA, 13 bp, Homo sapiens
gatacccagtccc

SEQ ID NO: 1986158 - DNA, 20 bp, Homo sapiens
gatacccatagcttccatga

SEQ ID NO: 1986159 - DNA, 13 bp, Homo sapiens
gataccttgaaaa

SEQ ID NO: 1986160 - DNA, 20 bp, Homo sapiens
gatactaaaagttcttctcc

SEQ ID NO: 1986161 - DNA, 21 bp, Homo sapiens
gatactgactagtcatagaaa

SEQ ID NO: 1986162 - DNA, 19 bp, Homo sapiens
gatactggaagttttgcat

SEQ ID NO: 1986163 - DNA, 20 bp, Homo sapiens
gatactggaagttttgcatt

SEQ ID NO: 1986164 - DNA, 21 bp, Homo sapiens
gatacttcaggtgcttttgat

SEQ ID NO: 1986165 - DNA, 18 bp, Homo sapiens
gatactttgatattttca

SEQ ID NO: 1986166 - DNA, 16 bp, Homo sapiens
gatagccagacacatg

SEQ ID NO: 1986167 - DNA, 13 bp, Homo sapiens
gatagtgctttat

SEQ ID NO: 1986168 - DNA, 21 bp, Homo sapiens
gatatatatttactaaaagaa

SEQ ID NO: 1986169 - DNA, 16 bp, Homo sapiens
gattcaaactgctcca

SEQ ID NO: 1986170 - DNA, 15 bp, Homo sapiens
gattcacatctcatt

SEQ ID NO: 1986171 - DNA, 23 bp, Homo sapiens
gattcaggaaaaggcctggggtg

SEQ ID NO: 1986172 - DNA, 11 bp, Homo sapiens
gattcataaca

SEQ ID NO: 1986173 - DNA, 14 bp, Homo sapiens
gattcataacaatg

SEQ ID NO: 1986174 - DNA, 15 bp, Homo sapiens
gattcataacaatgt

SEQ ID NO: 1986175 - DNA, 15 bp, Homo sapiens
gattcatctatggag

SEQ ID NO: 1986176 - DNA, 16 bp, Homo sapiens
gattcatctatggagg

SEQ ID NO: 1986177 - DNA, 17 bp, Homo sapiens
gattcccaagctctgct

SEQ ID NO: 1986178 - DNA, 18 bp, Homo sapiens
gattcccaagctctgctc

SEQ ID NO: 1986179 - DNA, 21 bp, Homo sapiens
gattcccaagctctgctcctc

SEQ ID NO: 1986180 - DNA, 14 bp, Homo sapiens
gattccctctccca

SEQ ID NO: 1986181 - DNA, 17 bp, Homo sapiens
gattccctctcccaggc

SEQ ID NO: 1986182 - DNA, 19 bp, Homo sapiens
gattccctctcccaggccc

SEQ ID NO: 1986183 - DNA, 14 bp, Homo sapiens
gattccctcttcct

SEQ ID NO: 1986184 - DNA, 14 bp, Homo sapiens
gattcctgggcctg

SEQ ID NO: 1986185 - DNA, 15 bp, Homo sapiens
gattcctgggcctgt

SEQ ID NO: 1986186 - DNA, 16 bp, Homo sapiens
gattccttcaattcaa

SEQ ID NO: 1986187 - DNA, 21 bp, Homo sapiens
gattccttttgatggggagaa

SEQ ID NO: 1986188 - DNA, 20 bp, Homo sapiens
gattctagccaaactattct

SEQ ID NO: 1986189 - DNA, 19 bp, Homo sapiens
gattctcctgcctcagcct

SEQ ID NO: 1986190 - DNA, 21 bp, Homo sapiens
gattctcctgcctcagcctcc

SEQ ID NO: 1986191 - DNA, 17 bp, Homo sapiens
gattctgggatgctcct

SEQ ID NO: 1986192 - DNA, 23 bp, Homo sapiens
gattctgggatggaccctcgcag

SEQ ID NO: 1986193 - DNA, 12 bp, Homo sapiens
gattcttctgct

SEQ ID NO: 1986194 - DNA, 20 bp, Homo sapiens
gattcttctgcttcagcctc

SEQ ID NO: 1986195 - DNA, 15 bp, Homo sapiens
gattgacacacagca

SEQ ID NO: 1986196 - DNA, 13 bp, Homo sapiens
gattgaggcctgc

SEQ ID NO: 1986197 - DNA, 19 bp, Homo sapiens
gattgatagagtgttatca

SEQ ID NO: 1986198 - DNA, 15 bp, Homo sapiens
gattgcaacaggctg

SEQ ID NO: 1986199 - DNA, 17 bp, Homo sapiens
gattgcaacaggctggg

SEQ ID NO: 1986200 - DNA, 15 bp, Homo sapiens
gattgcagtccccag

SEQ ID NO: 1986201 - DNA, 22 bp, Homo sapiens
gattgcgtggaattgtgctgag

SEQ ID NO: 1986202 - DNA, 19 bp, Homo sapiens
gattgcttgagcccaggag

SEQ ID NO: 1986203 - DNA, 20 bp, Homo sapiens
gattggattattcatttaaa

SEQ ID NO: 1986204 - DNA, 12 bp, Homo sapiens
gattggctcacc

SEQ ID NO: 1986205 - DNA, 16 bp, Homo sapiens
gattggctttaaacac

SEQ ID NO: 1986206 - DNA, 14 bp, Homo sapiens
gattgggagggaca

SEQ ID NO: 1986207 - DNA, 20 bp, Homo sapiens
gattggggaagactgtggct

SEQ ID NO: 1986208 - DNA, 20 bp, Homo sapiens
gattgtaaaatagcttgtat

SEQ ID NO: 1986209 - DNA, 16 bp, Homo sapiens
gattgttaaaataact

SEQ ID NO: 1986210 - DNA, 13 bp, Homo sapiens
gattgttcatcat

SEQ ID NO: 1986211 - DNA, 17 bp, Homo sapiens
gatttaaaaaataaata

SEQ ID NO: 1986212 - DNA, 19 bp, Homo sapiens
gatttaaaaaataaatata

SEQ ID NO: 1986213 - DNA, 18 bp, Homo sapiens
gatttaacagtcatttaa

SEQ ID NO: 1986214 - DNA, 15 bp, Homo sapiens
gatttaactgtgaac

SEQ ID NO: 1986215 - DNA, 11 bp, Homo sapiens
gatttaagtaa

SEQ ID NO: 1986216 - DNA, 13 bp, Homo sapiens
gatttaatgtttt

SEQ ID NO: 1986217 - DNA, 14 bp, Homo sapiens
gatttaatgttttc

SEQ ID NO: 1986218 - DNA, 15 bp, Homo sapiens
gatttaatgttttct

SEQ ID NO: 1986219 - DNA, 17 bp, Homo sapiens
gatttaccttttctgtt

SEQ ID NO: 1986220 - DNA, 16 bp, Homo sapiens
gatttagatatgcaaa

SEQ ID NO: 1986221 - DNA, 22 bp, Homo sapiens
gatttagtgaaagctagagata

SEQ ID NO: 1986222 - DNA, 21 bp, Homo sapiens
gatttatagtttgtacatgca

SEQ ID NO: 1986223 - DNA, 14 bp, Homo sapiens
gatttatatctata

SEQ ID NO: 1986224 - DNA, 23 bp, Homo sapiens
gatttattttttaatcatttaaa

SEQ ID NO: 1986225 - DNA, 12 bp, Homo sapiens
gatttcaagaaa

SEQ ID NO: 1986226 - DNA, 14 bp, Homo sapiens
gatttcaatgattg

SEQ ID NO: 1986227 - DNA, 20 bp, Homo sapiens
gatttcaatgattgtttaat

SEQ ID NO: 1986228 - DNA, 22 bp, Homo sapiens
gatttcaggatactctgtcaga

SEQ ID NO: 1986229 - DNA, 18 bp, Homo sapiens
gatttcatgctatctctg

SEQ ID NO: 1986230 - DNA, 12 bp, Homo sapiens
gatttcattgac

SEQ ID NO: 1986231 - DNA, 20 bp, Homo sapiens
gatttcatttcaactgtttg

SEQ ID NO: 1986232 - DNA, 17 bp, Homo sapiens
gatttccaggcccctga

SEQ ID NO: 1986233 - DNA, 17 bp, Homo sapiens
gatttcctattttaaaa

SEQ ID NO: 1986234 - DNA, 19 bp, Homo sapiens
gatttcctattttaaaacc

SEQ ID NO: 1986235 - DNA, 22 bp, Homo sapiens
gatttcctattttaaaaccatg

SEQ ID NO: 1986236 - DNA, 15 bp, Homo sapiens
gatttctctgaacag

SEQ ID NO: 1986237 - DNA, 18 bp, Homo sapiens
gatttcttttaaagaagt

SEQ ID NO: 1986238 - DNA, 18 bp, Homo sapiens
gatttgaagctgtaccca

SEQ ID NO: 1986239 - DNA, 21 bp, Homo sapiens
gatttgctatcaaaataaatt

SEQ ID NO: 1986240 - DNA, 19 bp, Homo sapiens
gatttggaagagaggcacc

SEQ ID NO: 1986241 - DNA, 23 bp, Homo sapiens
gatttggaagagaggcacctgct

SEQ ID NO: 1986242 - DNA, 13 bp, Homo sapiens
gatttgtatttat

SEQ ID NO: 1986243 - DNA, 14 bp, Homo sapiens
gattttaaaaacat

SEQ ID NO: 1986244 - DNA, 21 bp, Homo sapiens
gattttaaaaacatgagaaat

SEQ ID NO: 1986245 - DNA, 24 bp, Homo sapiens
gattttaaaaaccagtcaagagca

SEQ ID NO: 1986246 - DNA, 22 bp, Homo sapiens
gattttaaaaggttgactcaag

SEQ ID NO: 1986247 - DNA, 21 bp, Homo sapiens
gattttaaattcacaatagaa

SEQ ID NO: 1986248 - DNA, 13 bp, Homo sapiens
gattttacagaga

SEQ ID NO: 1986249 - DNA, 15 bp, Homo sapiens
gattttcatgttctt

SEQ ID NO: 1986250 - DNA, 19 bp, Homo sapiens
gattttgatccaagctggt

SEQ ID NO: 1986251 - DNA, 21 bp, Homo sapiens
gagtcctacagtggctgtcac

SEQ ID NO: 1986252 - DNA, 13 bp, Homo sapiens
gagtcctgtctct

SEQ ID NO: 1986253 - DNA, 20 bp, Homo sapiens
gagtctcactgttgcccagg

SEQ ID NO: 1986254 - DNA, 21 bp, Homo sapiens
gagtctcactgttgcccaggc

SEQ ID NO: 1986255 - DNA, 19 bp, Homo sapiens
gagtctcctctctgagact

SEQ ID NO: 1986256 - DNA, 15 bp, Homo sapiens
gagtctcttctccac

SEQ ID NO: 1986257 - DNA, 17 bp, Homo sapiens
gagtctcttctccactg

SEQ ID NO: 1986258 - DNA, 23 bp, Homo sapiens
gagtctcttggtgatggagtgtg

SEQ ID NO: 1986259 - DNA, 13 bp, Homo sapiens
gagtctgagcccc

SEQ ID NO: 1986260 - DNA, 14 bp, Homo sapiens
gagtctgaggtcct

SEQ ID NO: 1986261 - DNA, 19 bp, Homo sapiens
gagtctgaggtcctgagca

SEQ ID NO: 1986262 - DNA, 13 bp, Homo sapiens
gagtctgagtcct

SEQ ID NO: 1986263 - DNA, 18 bp, Homo sapiens
gagtctgagtcctgtctc

SEQ ID NO: 1986264 - DNA, 21 bp, Homo sapiens
gagtctgctatattttcatga

SEQ ID NO: 1986265 - DNA, 17 bp, Homo sapiens
gagtctttaatcccagt

SEQ ID NO: 1986266 - DNA, 14 bp, Homo sapiens
gagtgaaagggcta

SEQ ID NO: 1986267 - DNA, 24 bp, Homo sapiens
gagtgaaataattaaaaaccactg

SEQ ID NO: 1986268 - DNA, 19 bp, Homo sapiens
gagtgaacaactatttata

SEQ ID NO: 1986269 - DNA, 21 bp, Homo sapiens
gagtgacacccaagagggctg

SEQ ID NO: 1986270 - DNA, 18 bp, Homo sapiens
gaggcaccggcgctgcag

SEQ ID NO: 1986271 - DNA, 22 bp, Homo sapiens
gaggcagacagcagctcaggca

SEQ ID NO: 1986272 - DNA, 16 bp, Homo sapiens
gaggcagagaaagaag

SEQ ID NO: 1986273 - DNA, 17 bp, Homo sapiens
gaggcagagaaagaaga

SEQ ID NO: 1986274 - DNA, 18 bp, Homo sapiens
gaggcagagaagaaagaa

SEQ ID NO: 1986275 - DNA, 19 bp, Homo sapiens
gaggcagccccattctgcc

SEQ ID NO: 1986276 - DNA, 22 bp, Homo sapiens
gaggcagccccattctgcctgc

SEQ ID NO: 1986277 - DNA, 23 bp, Homo sapiens
gaggcagccccattctgcctgcc

SEQ ID NO: 1986278 - DNA, 20 bp, Homo sapiens
gaggcagctccaacagcttg

SEQ ID NO: 1986279 - DNA, 17 bp, Homo sapiens
gaggcaggctccccctg

SEQ ID NO: 1986280 - DNA, 9 bp, Homo sapiens
gaggcaggg

SEQ ID NO: 1986281 - DNA, 15 bp, Homo sapiens
gaggcagggagggga

SEQ ID NO: 1986282 - DNA, 16 bp, Homo sapiens
gaggcagggaggggac

SEQ ID NO: 1986283 - DNA, 15 bp, Homo sapiens
gaggcagggccttgc

SEQ ID NO: 1986284 - DNA, 15 bp, Homo sapiens
gaggcaggggcggag

SEQ ID NO: 1986285 - DNA, 19 bp, Homo sapiens
gaggcagggtctcactctg

SEQ ID NO: 1986286 - DNA, 14 bp, Homo sapiens
gaggcataaagact

SEQ ID NO: 1986287 - DNA, 17 bp, Homo sapiens
gaggcatggccctgggg

SEQ ID NO: 1986288 - DNA, 18 bp, Homo sapiens
gaggcatggccctggggt

SEQ ID NO: 1986289 - DNA, 17 bp, Homo sapiens
gaggcatgtgatgtgca

SEQ ID NO: 1986290 - DNA, 12 bp, Homo sapiens
gaggccaaggca

SEQ ID NO: 1986291 - DNA, 16 bp, Homo sapiens
gaggccagcctggcct

SEQ ID NO: 1986292 - DNA, 19 bp, Homo sapiens
gaggccagcctggcctcct

SEQ ID NO: 1986293 - DNA, 20 bp, Homo sapiens
gaggccagcctggcctcctg

SEQ ID NO: 1986294 - DNA, 22 bp, Homo sapiens
gaggccagcctggcctcctgcc

SEQ ID NO: 1986295 - DNA, 12 bp, Homo sapiens
gaggccaggagt

SEQ ID NO: 1986296 - DNA, 22 bp, Homo sapiens
gaggccaggagtttgagaccag

SEQ ID NO: 1986297 - DNA, 17 bp, Homo sapiens
gaggccatgggcctcct

SEQ ID NO: 1986298 - DNA, 18 bp, Homo sapiens
gaggccatgggcctcctg

SEQ ID NO: 1986299 - DNA, 20 bp, Homo sapiens
gaggccatgggcctcctgtg

SEQ ID NO: 1986300 - DNA, 11 bp, Homo sapiens
gaggcccagcc

SEQ ID NO: 1986301 - DNA, 14 bp, Homo sapiens
gaggcccagcctgt

SEQ ID NO: 1986302 - DNA, 15 bp, Homo sapiens
gaggcccagcctgtc

SEQ ID NO: 1986303 - DNA, 12 bp, Homo sapiens
gaggcccaggga

SEQ ID NO: 1986304 - DNA, 14 bp, Homo sapiens
gaggcccagggagc

SEQ ID NO: 1986305 - DNA, 23 bp, Homo sapiens
gaggccctggatcagcgtggcct

SEQ ID NO: 1986306 - DNA, 14 bp, Homo sapiens
gaggccctggtgtc

SEQ ID NO: 1986307 - DNA, 16 bp, Homo sapiens
gaggccctggtgtcag

SEQ ID NO: 1986308 - DNA, 14 bp, Homo sapiens
gaggccgcccggca

SEQ ID NO: 1986309 - DNA, 13 bp, Homo sapiens
gaggcctcagttc

SEQ ID NO: 1986310 - DNA, 19 bp, Homo sapiens
gaggcctcagtttctccat

SEQ ID NO: 1986311 - DNA, 14 bp, Homo sapiens
gaggcctcatccct

SEQ ID NO: 1986312 - DNA, 20 bp, Homo sapiens
gaggcctcgtaccagccagg

SEQ ID NO: 1986313 - DNA, 18 bp, Homo sapiens
gaggcctcttggacctct

SEQ ID NO: 1986314 - DNA, 14 bp, Homo sapiens
gaggcctgatgctg

SEQ ID NO: 1986315 - DNA, 15 bp, Homo sapiens
gaggcctgatgctgc

SEQ ID NO: 1986316 - DNA, 18 bp, Homo sapiens
gaggcctgatgctgcccc

SEQ ID NO: 1986317 - DNA, 20 bp, Homo sapiens
gaggcctgccctcagggatc

SEQ ID NO: 1986318 - DNA, 14 bp, Homo sapiens
gaggcctggccagg

SEQ ID NO: 1986319 - DNA, 15 bp, Homo sapiens
gaggcctggccaggc

SEQ ID NO: 1986320 - DNA, 21 bp, Homo sapiens
gaggccttacttaaacccagc

SEQ ID NO: 1986321 - DNA, 19 bp, Homo sapiens
gaggccttctctgaaggac

SEQ ID NO: 1986322 - DNA, 14 bp, Homo sapiens
gaggcgaataaatg

SEQ ID NO: 1986323 - DNA, 15 bp, Homo sapiens
gaggcgcagcccgaa

SEQ ID NO: 1986324 - DNA, 21 bp, Homo sapiens
gaggcgcagcccgaagcccag

SEQ ID NO: 1986325 - DNA, 22 bp, Homo sapiens
gaggcgcagcccgaagcccagt

SEQ ID NO: 1986326 - DNA, 21 bp, Homo sapiens
gaggcgccccaacccgtggag

SEQ ID NO: 1986327 - DNA, 14 bp, Homo sapiens
gaggcgcgtctgcc

SEQ ID NO: 1986328 - DNA, 20 bp, Homo sapiens
gaggcggaaaccttgcagca

SEQ ID NO: 1986329 - DNA, 16 bp, Homo sapiens
gaggcggctccaggtc

SEQ ID NO: 1986330 - DNA, 19 bp, Homo sapiens
gaggcgggtggatcacctg

SEQ ID NO: 1986331 - DNA, 19 bp, Homo sapiens
gaggcggtttccaggaaga

SEQ ID NO: 1986332 - DNA, 14 bp, Homo sapiens
gaggcgtcttgtat

SEQ ID NO: 1986333 - DNA, 19 bp, Homo sapiens
gaggctaagatgagatttg

SEQ ID NO: 1986334 - DNA, 16 bp, Homo sapiens
gaggctcaagaggccc

SEQ ID NO: 1986335 - DNA, 19 bp, Homo sapiens
gaggctcaagaggcccagg

SEQ ID NO: 1986336 - DNA, 20 bp, Homo sapiens
gaggctcaagaggcccaggg

SEQ ID NO: 1986337 - DNA, 21 bp, Homo sapiens
gaggctcaagaggcccaggga

SEQ ID NO: 1986338 - DNA, 23 bp, Homo sapiens
gaggctcaagaggcccagggagc

SEQ ID NO: 1986339 - DNA, 16 bp, Homo sapiens
gaggctgaggcaagag

SEQ ID NO: 1986340 - DNA, 13 bp, Homo sapiens
gaggctgaggcag

SEQ ID NO: 1986341 - DNA, 14 bp, Homo sapiens
gaggctgaggcaga

SEQ ID NO: 1986342 - DNA, 18 bp, Homo sapiens
gaggctgaggcagaagaa

SEQ ID NO: 1986343 - DNA, 16 bp, Homo sapiens
gaggctgaggcaggag

SEQ ID NO: 1986344 - DNA, 19 bp, Homo sapiens
gaggctgaggcaggagaat

SEQ ID NO: 1986345 - DNA, 17 bp, Homo sapiens
gaggctgaggcaggagg

SEQ ID NO: 1986346 - DNA, 20 bp, Homo sapiens
gaggctgcagaaggccaaga

SEQ ID NO: 1986347 - DNA, 15 bp, Homo sapiens
gaggctgcatgctct

SEQ ID NO: 1986348 - DNA, 16 bp, Homo sapiens
gaggctgcatgctctg

SEQ ID NO: 1986349 - DNA, 23 bp, Homo sapiens
gaggctgctcggggtgcacagga

SEQ ID NO: 1986350 - DNA, 19 bp, Homo sapiens
gaggctggaggcagggcct

SEQ ID NO: 1986351 - DNA, 15 bp, Homo sapiens
gaggctgggccagcc

SEQ ID NO: 1986352 - DNA, 16 bp, Homo sapiens
gaggctgggcccctgg

SEQ ID NO: 1986353 - DNA, 13 bp, Homo sapiens
gaggctggggctc

SEQ ID NO: 1986354 - DNA, 22 bp, Homo sapiens
gaggctggtgctgtggccaggg

SEQ ID NO: 1986355 - DNA, 23 bp, Homo sapiens
gaggctgtggtggctgtctctgt

SEQ ID NO: 1986356 - DNA, 22 bp, Homo sapiens
gaggcttccagagagtcctctg

SEQ ID NO: 1986357 - DNA, 23 bp, Homo sapiens
gaggcttccagagagtcctctgg

SEQ ID NO: 1986358 - DNA, 13 bp, Homo sapiens
gaggcttccaggc

SEQ ID NO: 1986359 - DNA, 19 bp, Homo sapiens
gaggcttccaggctcttcc

SEQ ID NO: 1986360 - DNA, 14 bp, Homo sapiens
gaggcttccttcat

SEQ ID NO: 1986361 - DNA, 21 bp, Homo sapiens
gagggaatgttccctgcaccc

SEQ ID NO: 1986362 - DNA, 14 bp, Homo sapiens
gagggacagggctt

SEQ ID NO: 1986363 - DNA, 13 bp, Homo sapiens
gagggacagggtg

SEQ ID NO: 1986364 - DNA, 23 bp, Homo sapiens
gagggactgtcgctgcttcgtgg

SEQ ID NO: 1986365 - DNA, 20 bp, Homo sapiens
gagggagacagagacagaaa

SEQ ID NO: 1986366 - DNA, 12 bp, Homo sapiens
gagggagcagac

SEQ ID NO: 1986367 - DNA, 15 bp, Homo sapiens
gagggagggagaggt

SEQ ID NO: 1986368 - DNA, 14 bp, Homo sapiens
gagggaggttcctc

SEQ ID NO: 1986369 - DNA, 14 bp, Homo sapiens
gagggagtgacaga

SEQ ID NO: 1986370 - DNA, 15 bp, Homo sapiens
gagggatcacagggc

SEQ ID NO: 1986371 - DNA, 23 bp, Homo sapiens
gagggatcacagggccccagaag

SEQ ID NO: 1986372 - DNA, 16 bp, Homo sapiens
gagggatgatgaagag

SEQ ID NO: 1986373 - DNA, 15 bp, Homo sapiens
gagggatgctgcctg

SEQ ID NO: 1986374 - DNA, 18 bp, Homo sapiens
gagggcaagggccatgct

SEQ ID NO: 1986375 - DNA, 12 bp, Homo sapiens
gagggcactggt

SEQ ID NO: 1986376 - DNA, 20 bp, Homo sapiens
gagggcagagccatgggcct

SEQ ID NO: 1986377 - DNA, 19 bp, Homo sapiens
ctgggctctccacctcagc

SEQ ID NO: 1986378 - DNA, 20 bp, Homo sapiens
ctgggctgtctgtcaccagc

SEQ ID NO: 1986379 - DNA, 16 bp, Homo sapiens
ctgggcttcagcctct

SEQ ID NO: 1986380 - DNA, 19 bp, Homo sapiens
ctgggcttcagcctctccc

SEQ ID NO: 1986381 - DNA, 15 bp, Homo sapiens
ctgggcttcagtggc

SEQ ID NO: 1986382 - DNA, 19 bp, Homo sapiens
ctgggcttcagtggcagct

SEQ ID NO: 1986383 - DNA, 22 bp, Homo sapiens
ctgggcttcagtggcagctgct

SEQ ID NO: 1986384 - DNA, 20 bp, Homo sapiens
ctgggcttctgtccaaggca

SEQ ID NO: 1986385 - DNA, 20 bp, Homo sapiens
ctgggcttggggcttcctaa

SEQ ID NO: 1986386 - DNA, 19 bp, Homo sapiens
ctggggacaggtcctcagt

SEQ ID NO: 1986387 - DNA, 15 bp, Homo sapiens
ctggggacctggttt

SEQ ID NO: 1986388 - DNA, 21 bp, Homo sapiens
ctggggaggaagggccaggag

SEQ ID NO: 1986389 - DNA, 19 bp, Homo sapiens
ctggggagggagagcacct

SEQ ID NO: 1986390 - DNA, 22 bp, Homo sapiens
ctggggatgtgggagggagcag

SEQ ID NO: 1986391 - DNA, 16 bp, Homo sapiens
ctggggattgggaggg

SEQ ID NO: 1986392 - DNA, 20 bp, Homo sapiens
ctggggattgggagggacag

SEQ ID NO: 1986393 - DNA, 16 bp, Homo sapiens
ctggggcaagtccctg

SEQ ID NO: 1986394 - DNA, 21 bp, Homo sapiens
ctggggcaagtccctgactct

SEQ ID NO: 1986395 - DNA, 24 bp, Homo sapiens
ctggggcagaggggcagccgctag

SEQ ID NO: 1986396 - DNA, 18 bp, Homo sapiens
ctggggcatgtgtgcctg

SEQ ID NO: 1986397 - DNA, 17 bp, Homo sapiens
ctggggccccgctggga

SEQ ID NO: 1986398 - DNA, 18 bp, Homo sapiens
ctggggccccgctgggat

SEQ ID NO: 1986399 - DNA, 14 bp, Homo sapiens
ctggggccccttgg

SEQ ID NO: 1986400 - DNA, 21 bp, Homo sapiens
ctggggcctggagaggggcct

SEQ ID NO: 1986401 - DNA, 18 bp, Homo sapiens
ctggggcctgtactgcct

SEQ ID NO: 1986402 - DNA, 19 bp, Homo sapiens
ctggggctcctttctccag

SEQ ID NO: 1986403 - DNA, 20 bp, Homo sapiens
ctggggctctaacgcctgag

SEQ ID NO: 1986404 - DNA, 14 bp, Homo sapiens
ctggggctctgtgc

SEQ ID NO: 1986405 - DNA, 16 bp, Homo sapiens
ctggggcttgcaagag

SEQ ID NO: 1986406 - DNA, 13 bp, Homo sapiens
ctgggggcagtga

SEQ ID NO: 1986407 - DNA, 20 bp, Homo sapiens
ctgggggcagtgactggcag

SEQ ID NO: 1986408 - DNA, 14 bp, Homo sapiens
ctgggggccagctg

SEQ ID NO: 1986409 - DNA, 19 bp, Homo sapiens
ctgggggccagctggtgct

SEQ ID NO: 1986410 - DNA, 23 bp, Homo sapiens
ctgggggccagctggtgctgcaa

SEQ ID NO: 1986411 - DNA, 14 bp, Homo sapiens
ctgggggcctggct

SEQ ID NO: 1986412 - DNA, 15 bp, Homo sapiens
ctgggggcctggctg

SEQ ID NO: 1986413 - DNA, 16 bp, Homo sapiens
ctgggggcctggctgg

SEQ ID NO: 1986414 - DNA, 23 bp, Homo sapiens
ctgggggcctggctggctgaggg

SEQ ID NO: 1986415 - DNA, 16 bp, Homo sapiens
ctgggggcgggggagc

SEQ ID NO: 1986416 - DNA, 19 bp, Homo sapiens
ctgggggcgggggagccaa

SEQ ID NO: 1986417 - DNA, 23 bp, Homo sapiens
ctgggggcttcgcttccttagcc

SEQ ID NO: 1986418 - DNA, 12 bp, Homo sapiens
ctggggtacagg

SEQ ID NO: 1986419 - DNA, 23 bp, Homo sapiens
ctggggtgggggtggggagacct

SEQ ID NO: 1986420 - DNA, 15 bp, Homo sapiens
ctggggttcagcccc

SEQ ID NO: 1986421 - DNA, 20 bp, Homo sapiens
ctggggttcagcccctcctc

SEQ ID NO: 1986422 - DNA, 21 bp, Homo sapiens
ctggggttcagcccctcctct

SEQ ID NO: 1986423 - DNA, 13 bp, Homo sapiens
ctgggtaactgtc

SEQ ID NO: 1986424 - DNA, 16 bp, Homo sapiens
ctgggtacaagagcca

SEQ ID NO: 1986425 - DNA, 19 bp, Homo sapiens
ctgggtacttgtggacaca

SEQ ID NO: 1986426 - DNA, 20 bp, Homo sapiens
ctgggtaggtgttgaaaatg

SEQ ID NO: 1986427 - DNA, 23 bp, Homo sapiens
ctgggtccaattgtggcacttgg

SEQ ID NO: 1986428 - DNA, 20 bp, Homo sapiens
ctgggtccctcggagctgcc

SEQ ID NO: 1986429 - DNA, 21 bp, Homo sapiens
ctgggtccctcggagctgcca

SEQ ID NO: 1986430 - DNA, 18 bp, Homo sapiens
ctgggtccttgcacccct

SEQ ID NO: 1986431 - DNA, 23 bp, Homo sapiens
ctgggtccttgcacccctcactc

SEQ ID NO: 1986432 - DNA, 23 bp, Homo sapiens
ctgggtctatgtaggcccctggt

SEQ ID NO: 1986433 - DNA, 15 bp, Homo sapiens
ctgggtctcactcct

SEQ ID NO: 1986434 - DNA, 22 bp, Homo sapiens
ctgggtgacagagcaagactct

SEQ ID NO: 1986435 - DNA, 24 bp, Homo sapiens
ctgggtgagaatcctgcctctccc

SEQ ID NO: 1986436 - DNA, 17 bp, Homo sapiens
ctgggtggctactctgt

SEQ ID NO: 1986437 - DNA, 19 bp, Homo sapiens
ctgggtggctactctgtgc

SEQ ID NO: 1986438 - DNA, 19 bp, Homo sapiens
ctgggtggctcctgccact

SEQ ID NO: 1986439 - DNA, 23 bp, Homo sapiens
ctgggtggctcctgccactgacc

SEQ ID NO: 1986440 - DNA, 24 bp, Homo sapiens
ctgggtggctcctgccactgacct

SEQ ID NO: 1986441 - DNA, 17 bp, Homo sapiens
ctgggtggggctgctcc

SEQ ID NO: 1986442 - DNA, 12 bp, Homo sapiens
ctgggtgggtga

SEQ ID NO: 1986443 - DNA, 20 bp, Homo sapiens
ctgggttatttttgtccctg

SEQ ID NO: 1986444 - DNA, 21 bp, Homo sapiens
ctgggttatttttgtccctgc

SEQ ID NO: 1986445 - DNA, 14 bp, Homo sapiens
ctgggttcactgca

SEQ ID NO: 1986446 - DNA, 20 bp, Homo sapiens
ctgggttcactgcaacctcc

SEQ ID NO: 1986447 - DNA, 23 bp, Homo sapiens
ctgggtttattacatggcagtgt

SEQ ID NO: 1986448 - DNA, 18 bp, Homo sapiens
ctgggtttctctgtatag

SEQ ID NO: 1986449 - DNA, 15 bp, Homo sapiens
ctgggttttctaact

SEQ ID NO: 1986450 - DNA, 23 bp, Homo sapiens
gagactgtctcaagagggcactg

SEQ ID NO: 1986451 - DNA, 20 bp, Homo sapiens
gagacttccaaacctgacag

SEQ ID NO: 1986452 - DNA, 22 bp, Homo sapiens
gagacttttaatcagacaaagt

SEQ ID NO: 1986453 - DNA, 11 bp, Homo sapiens
gagagaaagaa

SEQ ID NO: 1986454 - DNA, 11 bp, Homo sapiens
gagagaactta

SEQ ID NO: 1986455 - DNA, 14 bp, Homo sapiens
gagagaacttaaaa

SEQ ID NO: 1986456 - DNA, 13 bp, Homo sapiens
gagagaagaaagt

SEQ ID NO: 1986457 - DNA, 20 bp, Homo sapiens
gagagaagccacgctgtcct

SEQ ID NO: 1986458 - DNA, 14 bp, Homo sapiens
gagagaatctgcct

SEQ ID NO: 1986459 - DNA, 19 bp, Homo sapiens
gagagacactcccagggac

SEQ ID NO: 1986460 - DNA, 21 bp, Homo sapiens
gagagacagagacagagagag

SEQ ID NO: 1986461 - DNA, 20 bp, Homo sapiens
gagcacacggccctgcccca

SEQ ID NO: 1986462 - DNA, 21 bp, Homo sapiens
gagcacacggccctgccccat

SEQ ID NO: 1986463 - DNA, 23 bp, Homo sapiens
gagcacctactttatgtatggag

SEQ ID NO: 1986464 - DNA, 22 bp, Homo sapiens
gagcaccttaatattattgggg

SEQ ID NO: 1986465 - DNA, 13 bp, Homo sapiens
gagcactgccagg

SEQ ID NO: 1986466 - DNA, 13 bp, Homo sapiens
gagcactggccag

SEQ ID NO: 1986467 - DNA, 15 bp, Homo sapiens
gagcactggccagag

SEQ ID NO: 1986468 - DNA, 16 bp, Homo sapiens
gagcactggccagaga

SEQ ID NO: 1986469 - DNA, 24 bp, Homo sapiens
gagcactggccagagagggcccag

SEQ ID NO: 1986470 - DNA, 19 bp, Homo sapiens
gagcacttgcgtcctgcag

SEQ ID NO: 1986471 - DNA, 14 bp, Homo sapiens
gagcacttgctgta

SEQ ID NO: 1986472 - DNA, 17 bp, Homo sapiens
gagcagacagagaaatg

SEQ ID NO: 1986473 - DNA, 14 bp, Homo sapiens
gagcagacaggagg

SEQ ID NO: 1986474 - DNA, 21 bp, Homo sapiens
gagcagagagcttagcctgga

SEQ ID NO: 1986475 - DNA, 20 bp, Homo sapiens
gagcagagtataggatggat

SEQ ID NO: 1986476 - DNA, 19 bp, Homo sapiens
gagcagcctgatggccaag

SEQ ID NO: 1986477 - DNA, 19 bp, Homo sapiens
gagcagctgagcagggccg

SEQ ID NO: 1986478 - DNA, 19 bp, Homo sapiens
gagcagctggctctccacc

SEQ ID NO: 1986479 - DNA, 12 bp, Homo sapiens
gagcaggaacag

SEQ ID NO: 1986480 - DNA, 16 bp, Homo sapiens
gagcaggaacagagac

SEQ ID NO: 1986481 - DNA, 14 bp, Homo sapiens
gagcaggaatggga

SEQ ID NO: 1986482 - DNA, 23 bp, Homo sapiens
gagcaggccacgctcaggcccgg

SEQ ID NO: 1986483 - DNA, 18 bp, Homo sapiens
gagcaggcccgacagaga

SEQ ID NO: 1986484 - DNA, 20 bp, Homo sapiens
gagcaggcccgacagagaga

SEQ ID NO: 1986485 - DNA, 21 bp, Homo sapiens
gagcaggctactgtcagctcc

SEQ ID NO: 1986486 - DNA, 18 bp, Homo sapiens
gagcaggctcagactctg

SEQ ID NO: 1986487 - DNA, 21 bp, Homo sapiens
gagcagggccggggaactggc

SEQ ID NO: 1986488 - DNA, 18 bp, Homo sapiens
gagcaggtctctggcaga

SEQ ID NO: 1986489 - DNA, 17 bp, Homo sapiens
gagcagtgtcttccata

SEQ ID NO: 1986490 - DNA, 18 bp, Homo sapiens
gagcagtgtcttccataa

SEQ ID NO: 1986491 - DNA, 22 bp, Homo sapiens
gagcatcatgcctctgaggcca

SEQ ID NO: 1986492 - DNA, 15 bp, Homo sapiens
gagcatcgtgaccct

SEQ ID NO: 1986493 - DNA, 21 bp, Homo sapiens
gagcatcgtgacccttcaggg

SEQ ID NO: 1986494 - DNA, 20 bp, Homo sapiens
gagcatctcttgaggccagg

SEQ ID NO: 1986495 - DNA, 22 bp, Homo sapiens
gagcatctcttgaggccaggag

SEQ ID NO: 1986496 - DNA, 22 bp, Homo sapiens
gagcatggggataaaggagaag

SEQ ID NO: 1986497 - DNA, 22 bp, Homo sapiens
gagcatgtactgagccttgtaa

SEQ ID NO: 1986498 - DNA, 21 bp, Homo sapiens
gagcattacgtgagccaggta

SEQ ID NO: 1986499 - DNA, 20 bp, Homo sapiens
gagcattcaggcagcactga

SEQ ID NO: 1986500 - DNA, 24 bp, Homo sapiens
gagcatttccctcccgggagagga

SEQ ID NO: 1986501 - DNA, 19 bp, Homo sapiens
gagccaaacacactgtaaa

SEQ ID NO: 1986502 - DNA, 14 bp, Homo sapiens
gagccaacagcagc

SEQ ID NO: 1986503 - DNA, 19 bp, Homo sapiens
gagccaagggttcagagac

SEQ ID NO: 1986504 - DNA, 23 bp, Homo sapiens
gagccaagggttcagagactcag

SEQ ID NO: 1986505 - DNA, 15 bp, Homo sapiens
gagccaatagactga

SEQ ID NO: 1986506 - DNA, 23 bp, Homo sapiens
gagccactacctttgtccaggcc

SEQ ID NO: 1986507 - DNA, 12 bp, Homo sapiens
gagccactcctg

SEQ ID NO: 1986508 - DNA, 16 bp, Homo sapiens
gagccactcctgtccc

SEQ ID NO: 1986509 - DNA, 17 bp, Homo sapiens
gagccactcctgtcccg

SEQ ID NO: 1986510 - DNA, 16 bp, Homo sapiens
gagccagaacctggag

SEQ ID NO: 1986511 - DNA, 12 bp, Homo sapiens
gagccagcctgg

SEQ ID NO: 1986512 - DNA, 13 bp, Homo sapiens
gagccagcctggg

SEQ ID NO: 1986513 - DNA, 12 bp, Homo sapiens
gagccaggctct

SEQ ID NO: 1986514 - DNA, 15 bp, Homo sapiens
gagccaggctctgcc

SEQ ID NO: 1986515 - DNA, 14 bp, Homo sapiens
gagccagggtctca

SEQ ID NO: 1986516 - DNA, 22 bp, Homo sapiens
gagccaggtaatgagggactgg

SEQ ID NO: 1986517 - DNA, 22 bp, Homo sapiens
gagccatgatcgagccactgca

SEQ ID NO: 1986518 - DNA, 16 bp, Homo sapiens
gagccatgggcctggg

SEQ ID NO: 1986519 - DNA, 22 bp, Homo sapiens
gagccatgggcctgggcctgct

SEQ ID NO: 1986520 - DNA, 15 bp, Homo sapiens
gagccatgtaccagt

SEQ ID NO: 1986521 - DNA, 21 bp, Homo sapiens
gagccattttggggggccccc

SEQ ID NO: 1986522 - DNA, 14 bp, Homo sapiens
gagcccaagtgcca

SEQ ID NO: 1986523 - DNA, 17 bp, Homo sapiens
gagcccaagtgccatcc

SEQ ID NO: 1986524 - DNA, 22 bp, Homo sapiens
gagcccaagtgccatcccacat

SEQ ID NO: 1986525 - DNA, 13 bp, Homo sapiens
gagcccaccttgg

SEQ ID NO: 1986526 - DNA, 15 bp, Homo sapiens
gagcccaccttggct

SEQ ID NO: 1986527 - DNA, 23 bp, Homo sapiens
gagcccacgcccgactagcaggc

SEQ ID NO: 1986528 - DNA, 15 bp, Homo sapiens
gagcccagccacctc

SEQ ID NO: 1986529 - DNA, 21 bp, Homo sapiens
gagcccagccacctcccaagg

SEQ ID NO: 1986530 - DNA, 22 bp, Homo sapiens
gagcccagccattaccatggag

SEQ ID NO: 1986531 - DNA, 24 bp, Homo sapiens
gagcccaggagctgagtcacctcc

SEQ ID NO: 1986532 - DNA, 13 bp, Homo sapiens
gagcccatgctca

SEQ ID NO: 1986533 - DNA, 23 bp, Homo sapiens
gagcccatgctcaaccactgtgg

SEQ ID NO: 1986534 - DNA, 16 bp, Homo sapiens
gagccccacacggagg

SEQ ID NO: 1986535 - DNA, 14 bp, Homo sapiens
gagccccactcccg

SEQ ID NO: 1986536 - DNA, 16 bp, Homo sapiens
gagcccccaagcctct

SEQ ID NO: 1986537 - DNA, 13 bp, Homo sapiens
gagccccctggat

SEQ ID NO: 1986538 - DNA, 15 bp, Homo sapiens
gagcccctccctgct

SEQ ID NO: 1986539 - DNA, 13 bp, Homo sapiens
gagcccctggtcc

SEQ ID NO: 1986540 - DNA, 19 bp, Homo sapiens
gagcccgagggcctgacag

SEQ ID NO: 1986541 - DNA, 20 bp, Homo sapiens
gagcccgtgcagtacaggca

SEQ ID NO: 1986542 - DNA, 11 bp, Homo sapiens
gagccctgagc

SEQ ID NO: 1986543 - DNA, 16 bp, Homo sapiens
gagccctgagctcagg

SEQ ID NO: 1986544 - DNA, 20 bp, Homo sapiens
gagccctgagctcaggctga

SEQ ID NO: 1986545 - DNA, 12 bp, Homo sapiens
gagccctgcagc

SEQ ID NO: 1986546 - DNA, 13 bp, Homo sapiens
gagccctggcagg

SEQ ID NO: 1986547 - DNA, 14 bp, Homo sapiens
gagccctggtggca

SEQ ID NO: 1986548 - DNA, 18 bp, Homo sapiens
gagccctggtggcagtgg

SEQ ID NO: 1986549 - DNA, 22 bp, Homo sapiens
gagccgcatcttctccatctgg

SEQ ID NO: 1986550 - DNA, 19 bp, Homo sapiens
gagccgctgtgagcccctg

SEQ ID NO: 1986551 - DNA, 15 bp, Homo sapiens
gagcctaaatctaat

SEQ ID NO: 1986552 - DNA, 15 bp, Homo sapiens
gagcctagccacctc

SEQ ID NO: 1986553 - DNA, 20 bp, Homo sapiens
gagcctcagcatcctggcac

SEQ ID NO: 1986554 - DNA, 21 bp, Homo sapiens
gagcctcagcatcctggcacc

SEQ ID NO: 1986555 - DNA, 20 bp, Homo sapiens
gagcctcatccgaggcaggg

SEQ ID NO: 1986556 - DNA, 13 bp, Homo sapiens
gagcctccccctc

SEQ ID NO: 1986557 - DNA, 16 bp, Homo sapiens
gagcctcggtggccat

SEQ ID NO: 1986558 - DNA, 17 bp, Homo sapiens
gagcctcggtggccatg

SEQ ID NO: 1986559 - DNA, 20 bp, Homo sapiens
gagcctcttctgccaagaga

SEQ ID NO: 1986560 - DNA, 21 bp, Homo sapiens
gagcctgcaaactcactgctc

SEQ ID NO: 1986561 - DNA, 21 bp, Homo sapiens
gagcctgccgagcaaccgtgg

SEQ ID NO: 1986562 - DNA, 17 bp, Homo sapiens
gagcctggcacaggact

SEQ ID NO: 1986563 - DNA, 19 bp, Homo sapiens
gagcctggcacaggactga

SEQ ID NO: 1986564 - DNA, 18 bp, Homo sapiens
gagcctggcccatagaaa

SEQ ID NO: 1986565 - DNA, 11 bp, Homo sapiens
gagcctggggc

SEQ ID NO: 1986566 - DNA, 18 bp, Homo sapiens
gagcctgtcacgtggtca

SEQ ID NO: 1986567 - DNA, 19 bp, Homo sapiens
gagcctgtctttcagcatt

SEQ ID NO: 1986568 - DNA, 16 bp, Homo sapiens
gagcctgtgaacccag

SEQ ID NO: 1986569 - DNA, 19 bp, Homo sapiens
gagcctgtgaacccaggac

SEQ ID NO: 1986570 - DNA, 23 bp, Homo sapiens
gagcctgtgaacccaggacaagc

SEQ ID NO: 1986571 - DNA, 17 bp, Homo sapiens
gagccttcacaaccagc

SEQ ID NO: 1986572 - DNA, 13 bp, Homo sapiens
gagccttctcctg

SEQ ID NO: 1986573 - DNA, 12 bp, Homo sapiens
gactccctgtgg

SEQ ID NO: 1986574 - DNA, 14 bp, Homo sapiens
gactccctgtgggg

SEQ ID NO: 1986575 - DNA, 24 bp, Homo sapiens
gactccctgtgggggtggccatcc

SEQ ID NO: 1986576 - DNA, 14 bp, Homo sapiens
gactcctcccacaa

SEQ ID NO: 1986577 - DNA, 14 bp, Homo sapiens
gactcctgccctgt

SEQ ID NO: 1986578 - DNA, 15 bp, Homo sapiens
gactcctttcctctg

SEQ ID NO: 1986579 - DNA, 16 bp, Homo sapiens
gactcctttcctctga

SEQ ID NO: 1986580 - DNA, 13 bp, Homo sapiens
gactctctgtgac

SEQ ID NO: 1986581 - DNA, 15 bp, Homo sapiens
gactctctgtgacct

SEQ ID NO: 1986582 - DNA, 19 bp, Homo sapiens
gactctctgtgacctgccc

SEQ ID NO: 1986583 - DNA, 20 bp, Homo sapiens
gactctgaaaaacattccag

SEQ ID NO: 1986584 - DNA, 19 bp, Homo sapiens
gactctgaggctctttctg

SEQ ID NO: 1986585 - DNA, 12 bp, Homo sapiens
gactctgcacat

SEQ ID NO: 1986586 - DNA, 15 bp, Homo sapiens
gactctgcacatgtc

SEQ ID NO: 1986587 - DNA, 21 bp, Homo sapiens
gactctgccttttttcacagc

SEQ ID NO: 1986588 - DNA, 15 bp, Homo sapiens
gactctggaagcccc

SEQ ID NO: 1986589 - DNA, 19 bp, Homo sapiens
gactctgggtccctcggag

SEQ ID NO: 1986590 - DNA, 16 bp, Homo sapiens
gactcttcctgcaaag

SEQ ID NO: 1986591 - DNA, 17 bp, Homo sapiens
gactcttctgagcacct

SEQ ID NO: 1986592 - DNA, 14 bp, Homo sapiens
gactcttgcctttc

SEQ ID NO: 1986593 - DNA, 9 bp, Homo sapiens
gactcttgt

SEQ ID NO: 1986594 - DNA, 14 bp, Homo sapiens
gactcttgttttca

SEQ ID NO: 1986595 - DNA, 20 bp, Homo sapiens
gactctttttagggccaggc

SEQ ID NO: 1986596 - DNA, 15 bp, Homo sapiens
gactgaaagcagcag

SEQ ID NO: 1986597 - DNA, 18 bp, Homo sapiens
gactgaaagcagcagcta

SEQ ID NO: 1986598 - DNA, 15 bp, Homo sapiens
gactgaaggggcaca

SEQ ID NO: 1986599 - DNA, 15 bp, Homo sapiens
gactgacacaggcca

SEQ ID NO: 1986600 - DNA, 20 bp, Homo sapiens
gactgacacaggccagcccc

SEQ ID NO: 1986601 - DNA, 21 bp, Homo sapiens
gactgacacaggccagcccca

SEQ ID NO: 1986602 - DNA, 16 bp, Homo sapiens
gactgagactggcact

SEQ ID NO: 1986603 - DNA, 15 bp, Homo sapiens
gactgagaggcagaa

SEQ ID NO: 1986604 - DNA, 15 bp, Homo sapiens
gactgagcacctgct

SEQ ID NO: 1986605 - DNA, 16 bp, Homo sapiens
gactgattctgggatg

SEQ ID NO: 1986606 - DNA, 18 bp, Homo sapiens
gactgcaagaggctcctg

SEQ ID NO: 1986607 - DNA, 13 bp, Homo sapiens
gactgcagctgct

SEQ ID NO: 1986608 - DNA, 15 bp, Homo sapiens
gactgcagctgctga

SEQ ID NO: 1986609 - DNA, 20 bp, Homo sapiens
gactgccagtccccctgccc

SEQ ID NO: 1986610 - DNA, 19 bp, Homo sapiens
gactgctccccagccctgg

SEQ ID NO: 1986611 - DNA, 12 bp, Homo sapiens
gactgctgggac

SEQ ID NO: 1986612 - DNA, 14 bp, Homo sapiens
gactgctgggactg

SEQ ID NO: 1986613 - DNA, 15 bp, Homo sapiens
gactggaagcacagc

SEQ ID NO: 1986614 - DNA, 18 bp, Homo sapiens
gactggaagcacagcttc

SEQ ID NO: 1986615 - DNA, 21 bp, Homo sapiens
gactggacagcttgtggcaag

SEQ ID NO: 1986616 - DNA, 21 bp, Homo sapiens
gactggagcccgagggcctga

SEQ ID NO: 1986617 - DNA, 22 bp, Homo sapiens
gactggagcccgagggcctgac

SEQ ID NO: 1986618 - DNA, 15 bp, Homo sapiens
gactggagtgaggct

SEQ ID NO: 1986619 - DNA, 20 bp, Homo sapiens
gactggagtgaggcttccag

SEQ ID NO: 1986620 - DNA, 21 bp, Homo sapiens
gactggagtgaggcttccagg

SEQ ID NO: 1986621 - DNA, 22 bp, Homo sapiens
gactggagtgaggcttccaggc

SEQ ID NO: 1986622 - DNA, 23 bp, Homo sapiens
gactggcaggtgcagatgggctg

SEQ ID NO: 1986623 - DNA, 14 bp, Homo sapiens
gactggctcacccc

SEQ ID NO: 1986624 - DNA, 19 bp, Homo sapiens
gactggctcacccctctcc

SEQ ID NO: 1986625 - DNA, 21 bp, Homo sapiens
gactggctcacccctctcccc

SEQ ID NO: 1986626 - DNA, 18 bp, Homo sapiens
gactgggaccaggcacca

SEQ ID NO: 1986627 - DNA, 18 bp, Homo sapiens
gactggggatgtgggagg

SEQ ID NO: 1986628 - DNA, 23 bp, Homo sapiens
gactggggatgtgggagggagca

SEQ ID NO: 1986629 - DNA, 20 bp, Homo sapiens
gactggtgctataggctgga

SEQ ID NO: 1986630 - DNA, 16 bp, Homo sapiens
gactgtcgtgtttaca

SEQ ID NO: 1986631 - DNA, 21 bp, Homo sapiens
gactgtggctgcagagacctt

SEQ ID NO: 1986632 - DNA, 20 bp, Homo sapiens
gactgtgttcagtgccttgg

SEQ ID NO: 1986633 - DNA, 18 bp, Homo sapiens
gactgtttttcggacagt

SEQ ID NO: 1986634 - DNA, 19 bp, Homo sapiens
gactgtttttcggacagtt

SEQ ID NO: 1986635 - DNA, 16 bp, Homo sapiens
gacttacatgattcat

SEQ ID NO: 1986636 - DNA, 22 bp, Homo sapiens
gacttactgtttcttaccttaa

SEQ ID NO: 1986637 - DNA, 14 bp, Homo sapiens
gacttagctggcca

SEQ ID NO: 1986638 - DNA, 21 bp, Homo sapiens
gacttcaagcatggctatttt

SEQ ID NO: 1986639 - DNA, 15 bp, Homo sapiens
gacttcacaaaatgc

SEQ ID NO: 1986640 - DNA, 18 bp, Homo sapiens
gacttcacaaaatgcaag

SEQ ID NO: 1986641 - DNA, 13 bp, Homo sapiens
gacttcacactgc

SEQ ID NO: 1986642 - DNA, 21 bp, Homo sapiens
gacttcagaacatgctggata

SEQ ID NO: 1986643 - DNA, 13 bp, Homo sapiens
gacttcaggtgga

SEQ ID NO: 1986644 - DNA, 17 bp, Homo sapiens
gacttcaggttgttctg

SEQ ID NO: 1986645 - DNA, 22 bp, Homo sapiens
gacttcctctttctctccttct

SEQ ID NO: 1986646 - DNA, 13 bp, Homo sapiens
gacttcctggggc

SEQ ID NO: 1986647 - DNA, 14 bp, Homo sapiens
gacttctctttgcc

SEQ ID NO: 1986648 - DNA, 17 bp, Homo sapiens
gacttctggaaggctgg

SEQ ID NO: 1986649 - DNA, 21 bp, Homo sapiens
gacttcttggtttggggagaa

SEQ ID NO: 1986650 - DNA, 17 bp, Homo sapiens
gacttgaagcacagagg

SEQ ID NO: 1986651 - DNA, 20 bp, Homo sapiens
gacttgaagcacagagggct

SEQ ID NO: 1986652 - DNA, 19 bp, Homo sapiens
gacttgaggattttgagta

SEQ ID NO: 1986653 - DNA, 14 bp, Homo sapiens
gacttggaagctcc

SEQ ID NO: 1986654 - DNA, 15 bp, Homo sapiens
gacttggaagctccg

SEQ ID NO: 1986655 - DNA, 22 bp, Homo sapiens
gacttgggcacccccagcctgg

SEQ ID NO: 1986656 - DNA, 20 bp, Homo sapiens
gacttggggagatggagttc

SEQ ID NO: 1986657 - DNA, 10 bp, Homo sapiens
gacttgtgcc

SEQ ID NO: 1986658 - DNA, 13 bp, Homo sapiens
gacttgtgtctct

SEQ ID NO: 1986659 - DNA, 16 bp, Homo sapiens
gactttatacagaact

SEQ ID NO: 1986660 - DNA, 14 bp, Homo sapiens
gactttcaggtact

SEQ ID NO: 1986661 - DNA, 11 bp, Homo sapiens
gactttctgtt

SEQ ID NO: 1986662 - DNA, 18 bp, Homo sapiens
gactttgatgcatttcca

SEQ ID NO: 1986663 - DNA, 22 bp, Homo sapiens
gactttgatgcatttccacact

SEQ ID NO: 1986664 - DNA, 12 bp, Homo sapiens
gactttgttcac

SEQ ID NO: 1986665 - DNA, 17 bp, Homo sapiens
gacttttccaagccctt

SEQ ID NO: 1986666 - DNA, 19 bp, Homo sapiens
gacttttctggaagacatg

SEQ ID NO: 1986667 - DNA, 19 bp, Homo sapiens
gacttttggtttttatatt

SEQ ID NO: 1986668 - DNA, 16 bp, Homo sapiens
gactttttagccagtg

SEQ ID NO: 1986669 - DNA, 19 bp, Homo sapiens
gactttttagccagtgact

SEQ ID NO: 1986670 - DNA, 21 bp, Homo sapiens
gaatgatagtaataggataca

SEQ ID NO: 1986671 - DNA, 23 bp, Homo sapiens
gaatgatggacttttgggggttg

SEQ ID NO: 1986672 - DNA, 20 bp, Homo sapiens
gaatgcacactagcctctcc

SEQ ID NO: 1986673 - DNA, 22 bp, Homo sapiens
gaatgcacactagcctctccag

SEQ ID NO: 1986674 - DNA, 19 bp, Homo sapiens
gaatgcagattcctgggcc

SEQ ID NO: 1986675 - DNA, 20 bp, Homo sapiens
gaatgcagattcctgggcct

SEQ ID NO: 1986676 - DNA, 22 bp, Homo sapiens
gaatgcagattcctgggcctgt

SEQ ID NO: 1986677 - DNA, 23 bp, Homo sapiens
gaatgcagattcctgggcctgtc

SEQ ID NO: 1986678 - DNA, 20 bp, Homo sapiens
gaatgcctcaatgtgaccag

SEQ ID NO: 1986679 - DNA, 22 bp, Homo sapiens
gaatgcctcaatgtgaccaggg

SEQ ID NO: 1986680 - DNA, 22 bp, Homo sapiens
gaatgctcaagtttttcagaaa

SEQ ID NO: 1986681 - DNA, 21 bp, Homo sapiens
gaatgctgagacccccggagc

SEQ ID NO: 1986682 - DNA, 18 bp, Homo sapiens
gaatgctggttttcctaa

SEQ ID NO: 1986683 - DNA, 21 bp, Homo sapiens
gaatggagcagtacatgggaa

SEQ ID NO: 1986684 - DNA, 21 bp, Homo sapiens
gaatggcaaagcggttgcttc

SEQ ID NO: 1986685 - DNA, 14 bp, Homo sapiens
gaatggcagctgga

SEQ ID NO: 1986686 - DNA, 14 bp, Homo sapiens
gaatgggtttactc

SEQ ID NO: 1986687 - DNA, 15 bp, Homo sapiens
gaatggtcagttgta

SEQ ID NO: 1986688 - DNA, 13 bp, Homo sapiens
gaatggtccaggg

SEQ ID NO: 1986689 - DNA, 21 bp, Homo sapiens
gaatggtgtgggagagggatg

SEQ ID NO: 1986690 - DNA, 20 bp, Homo sapiens
gaatgtaaagcttgtctgat

SEQ ID NO: 1986691 - DNA, 11 bp, Homo sapiens
gaatgtaatca

SEQ ID NO: 1986692 - DNA, 13 bp, Homo sapiens
gaatgtaatcaat

SEQ ID NO: 1986693 - DNA, 18 bp, Homo sapiens
gaatgtaatcaatgtttc

SEQ ID NO: 1986694 - DNA, 22 bp, Homo sapiens
gaatgtgagtgtgtttgtgtgc

SEQ ID NO: 1986695 - DNA, 18 bp, Homo sapiens
gaatgtgtacaaagtgta

SEQ ID NO: 1986696 - DNA, 16 bp, Homo sapiens
gaatgttaaagtcagt

SEQ ID NO: 1986697 - DNA, 20 bp, Homo sapiens
gaatgttacattgtttgtct

SEQ ID NO: 1986698 - DNA, 16 bp, Homo sapiens
gaatgttactttggaa

SEQ ID NO: 1986699 - DNA, 17 bp, Homo sapiens
gaatgttccctgcaccc

SEQ ID NO: 1986700 - DNA, 15 bp, Homo sapiens
gaatgtttatgttct

SEQ ID NO: 1986701 - DNA, 20 bp, Homo sapiens
gaatgtttgaactgccaaga

SEQ ID NO: 1986702 - DNA, 15 bp, Homo sapiens
gaatgtttgcctctg

SEQ ID NO: 1986703 - DNA, 16 bp, Homo sapiens
gaatgtttgcctctgc

SEQ ID NO: 1986704 - DNA, 18 bp, Homo sapiens
gaattaagttagggaatg

SEQ ID NO: 1986705 - DNA, 14 bp, Homo sapiens
gaattatgaggcat

SEQ ID NO: 1986706 - DNA, 23 bp, Homo sapiens
cttggctcaagtcctcttttctg

SEQ ID NO: 1986707 - DNA, 21 bp, Homo sapiens
cttggctcaatcctctaagct

SEQ ID NO: 1986708 - DNA, 12 bp, Homo sapiens
cttggctgcagg

SEQ ID NO: 1986709 - DNA, 13 bp, Homo sapiens
cttggctgcaggg

SEQ ID NO: 1986710 - DNA, 17 bp, Homo sapiens
cttggctgtaatcagtt

SEQ ID NO: 1986711 - DNA, 23 bp, Homo sapiens
cttggcttcctccgtccacccag

SEQ ID NO: 1986712 - DNA, 15 bp, Homo sapiens
cttggcttctgggac

SEQ ID NO: 1986713 - DNA, 18 bp, Homo sapiens
cttggcttctgggacctg

SEQ ID NO: 1986714 - DNA, 22 bp, Homo sapiens
cttggctttaaccgtttttcaa

SEQ ID NO: 1986715 - DNA, 23 bp, Homo sapiens
cttgggaaacagagaaccctgtg

SEQ ID NO: 1986716 - DNA, 16 bp, Homo sapiens
cttgggaactccactc

SEQ ID NO: 1986717 - DNA, 17 bp, Homo sapiens
cttgggagtcaggacct

SEQ ID NO: 1986718 - DNA, 21 bp, Homo sapiens
cttgggcacccccagcctggg

SEQ ID NO: 1986719 - DNA, 19 bp, Homo sapiens
cttgggcatccacccagtg

SEQ ID NO: 1986720 - DNA, 24 bp, Homo sapiens
cttgggcatccacccagtgctgcc

SEQ ID NO: 1986721 - DNA, 14 bp, Homo sapiens
cttgggcatgctca

SEQ ID NO: 1986722 - DNA, 15 bp, Homo sapiens
cttgggccctgcaca

SEQ ID NO: 1986723 - DNA, 17 bp, Homo sapiens
cttgggctactggcagc

SEQ ID NO: 1986724 - DNA, 13 bp, Homo sapiens
cttgggctcctgg

SEQ ID NO: 1986725 - DNA, 14 bp, Homo sapiens
cttgggctcctggc

SEQ ID NO: 1986726 - DNA, 19 bp, Homo sapiens
cttggggagcaggtctctg

SEQ ID NO: 1986727 - DNA, 22 bp, Homo sapiens
cttggggagcaggtctctggca

SEQ ID NO: 1986728 - DNA, 19 bp, Homo sapiens
cttggggattcttccatct

SEQ ID NO: 1986729 - DNA, 13 bp, Homo sapiens
cttggggcctggc

SEQ ID NO: 1986730 - DNA, 14 bp, Homo sapiens
cttggggcctggct

SEQ ID NO: 1986731 - DNA, 17 bp, Homo sapiens
cttggggcctggcttgc

SEQ ID NO: 1986732 - DNA, 23 bp, Homo sapiens
cttggggcctggcttgctccagg

SEQ ID NO: 1986733 - DNA, 22 bp, Homo sapiens
cttggggctcgccccacccagg

SEQ ID NO: 1986734 - DNA, 24 bp, Homo sapiens
cttgggggatgactagaggcaggg

SEQ ID NO: 1986735 - DNA, 20 bp, Homo sapiens
cttggggggtgatgagggca

SEQ ID NO: 1986736 - DNA, 24 bp, Homo sapiens
cttggggggtgatgagggcagcag

SEQ ID NO: 1986737 - DNA, 22 bp, Homo sapiens
cttggggggtttttactccagt

SEQ ID NO: 1986738 - DNA, 19 bp, Homo sapiens
cttggggtaagccagagcc

SEQ ID NO: 1986739 - DNA, 15 bp, Homo sapiens
cttggggttccccca

SEQ ID NO: 1986740 - DNA, 17 bp, Homo sapiens
cttgggtttttgttacc

SEQ ID NO: 1986741 - DNA, 15 bp, Homo sapiens
cttggtaagaagccg

SEQ ID NO: 1986742 - DNA, 13 bp, Homo sapiens
cttggtcctgtca

SEQ ID NO: 1986743 - DNA, 13 bp, Homo sapiens
cttggtctcagct

SEQ ID NO: 1986744 - DNA, 20 bp, Homo sapiens
cttggtctgatttcaggata

SEQ ID NO: 1986745 - DNA, 15 bp, Homo sapiens
cttggtcttatttat

SEQ ID NO: 1986746 - DNA, 22 bp, Homo sapiens
cttggtgaatttttttttccta

SEQ ID NO: 1986747 - DNA, 21 bp, Homo sapiens
cttggtggctgagcttggccc

SEQ ID NO: 1986748 - DNA, 16 bp, Homo sapiens
cttggttggctggcag

SEQ ID NO: 1986749 - DNA, 20 bp, Homo sapiens
cttggtttggacacagtgtt

SEQ ID NO: 1986750 - DNA, 15 bp, Homo sapiens
cttggtttggggaga

SEQ ID NO: 1986751 - DNA, 14 bp, Homo sapiens
cttgtaaataaata

SEQ ID NO: 1986752 - DNA, 17 bp, Homo sapiens
cttgtaaataaatagat

SEQ ID NO: 1986753 - DNA, 12 bp, Homo sapiens
cttgtaaataca

SEQ ID NO: 1986754 - DNA, 16 bp, Homo sapiens
cttgtaattctaaatg

SEQ ID NO: 1986755 - DNA, 12 bp, Homo sapiens
cttgtacaaaat

SEQ ID NO: 1986756 - DNA, 13 bp, Homo sapiens
cttgtacaaaata

SEQ ID NO: 1986757 - DNA, 14 bp, Homo sapiens
cttgtacatgtgta

SEQ ID NO: 1986758 - DNA, 20 bp, Homo sapiens
cttgtacatgtgtagcctgt

SEQ ID NO: 1986759 - DNA, 23 bp, Homo sapiens
cttgtacatgtgtagcctgtgca

SEQ ID NO: 1986760 - DNA, 16 bp, Homo sapiens
cttgtactatgttaat

SEQ ID NO: 1986761 - DNA, 14 bp, Homo sapiens
cttgtagaaatctg

SEQ ID NO: 1986762 - DNA, 13 bp, Homo sapiens
cttgtataaatgt

SEQ ID NO: 1986763 - DNA, 14 bp, Homo sapiens
cttgtataaatgta

SEQ ID NO: 1986764 - DNA, 17 bp, Homo sapiens
cttgtataaatgtatat

SEQ ID NO: 1986765 - DNA, 21 bp, Homo sapiens
cttgtataaatgtatatacac

SEQ ID NO: 1986766 - DNA, 20 bp, Homo sapiens
cttgtatatacatattataa

SEQ ID NO: 1986767 - DNA, 18 bp, Homo sapiens
cttgtatttaaatattaa

SEQ ID NO: 1986768 - DNA, 20 bp, Homo sapiens
cttgtatttaaatattaaat

SEQ ID NO: 1986769 - DNA, 14 bp, Homo sapiens
cttgtattttccat

SEQ ID NO: 1986770 - DNA, 19 bp, Homo sapiens
cttgtattttcttcccatt

SEQ ID NO: 1986771 - DNA, 16 bp, Homo sapiens
cttgtcactagcagct

SEQ ID NO: 1986772 - DNA, 18 bp, Homo sapiens
cttgtcactagcagctgc

SEQ ID NO: 1986773 - DNA, 15 bp, Homo sapiens
cttgtcactatgcta

SEQ ID NO: 1986774 - DNA, 22 bp, Homo sapiens
cttgtcactggtagaccaaaat

SEQ ID NO: 1986775 - DNA, 15 bp, Homo sapiens
cttgtcaggacccag

SEQ ID NO: 1986776 - DNA, 16 bp, Homo sapiens
cttgtcaggacccagg

SEQ ID NO: 1986777 - DNA, 24 bp, Homo sapiens
cttgtccacagtctcccattctca

SEQ ID NO: 1986778 - DNA, 14 bp, Homo sapiens
cttgtccagcgcct

SEQ ID NO: 1986779 - DNA, 15 bp, Homo sapiens
cttgtcctgctctct

SEQ ID NO: 1986780 - DNA, 18 bp, Homo sapiens
cttgtcctgctctcttca

SEQ ID NO: 1986781 - DNA, 21 bp, Homo sapiens
cttgtcctgctctcttcagga

SEQ ID NO: 1986782 - DNA, 12 bp, Homo sapiens
cttgtctccact

SEQ ID NO: 1986783 - DNA, 12 bp, Homo sapiens
cttgtctctcat

SEQ ID NO: 1986784 - DNA, 22 bp, Homo sapiens
cttgtctctcattctctttctt

SEQ ID NO: 1986785 - DNA, 19 bp, Homo sapiens
cttgtctgaggcctcatcc

SEQ ID NO: 1986786 - DNA, 21 bp, Homo sapiens
cttgtctgaggcctcatccct

SEQ ID NO: 1986787 - DNA, 15 bp, Homo sapiens
cttgtctttaaatct

SEQ ID NO: 1986788 - DNA, 17 bp, Homo sapiens
cttgtctttactgacaa

SEQ ID NO: 1986789 - DNA, 15 bp, Homo sapiens
cttgtgactgaaggg

SEQ ID NO: 1986790 - DNA, 14 bp, Homo sapiens
cttgtgagagctgg

SEQ ID NO: 1986791 - DNA, 15 bp, Homo sapiens
cttgtgagagctggt

SEQ ID NO: 1986792 - DNA, 15 bp, Homo sapiens
cttgtgattctggga

SEQ ID NO: 1986793 - DNA, 15 bp, Homo sapiens
cttgtgcagtgttga

SEQ ID NO: 1986794 - DNA, 19 bp, Homo sapiens
cttgtgccatagtcacatg

SEQ ID NO: 1986795 - DNA, 14 bp, Homo sapiens
cttgtgccctgccc

SEQ ID NO: 1986796 - DNA, 17 bp, Homo sapiens
cttgtgccctgccccca

SEQ ID NO: 1986797 - DNA, 13 bp, Homo sapiens
cttgtgcctcagc

SEQ ID NO: 1986798 - DNA, 17 bp, Homo sapiens
cttgtggacacagctct

SEQ ID NO: 1986799 - DNA, 14 bp, Homo sapiens
cttgtggtttatgt

SEQ ID NO: 1986800 - DNA, 14 bp, Homo sapiens
cttgtgtcagagac

SEQ ID NO: 1986801 - DNA, 18 bp, Homo sapiens
cttgtgtcagagacagac

SEQ ID NO: 1986802 - DNA, 15 bp, Homo sapiens
cttgtgtctctgtgc

SEQ ID NO: 1986803 - DNA, 12 bp, Homo sapiens
cttgtgtctgta

SEQ ID NO: 1986804 - DNA, 15 bp, Homo sapiens
cttgtgtctgtacac

SEQ ID NO: 1986805 - DNA, 15 bp, Homo sapiens
cttgttccttctgct

SEQ ID NO: 1986806 - DNA, 22 bp, Homo sapiens
cttgttctactcatatatatct

SEQ ID NO: 1986807 - DNA, 19 bp, Homo sapiens
cttgttgcatgatgtattt

SEQ ID NO: 1986808 - DNA, 23 bp, Homo sapiens
cttgttgctgagtctgcagatga

SEQ ID NO: 1986809 - DNA, 21 bp, Homo sapiens
cttgttgctgattcaagaaac

SEQ ID NO: 1986810 - DNA, 21 bp, Homo sapiens
cttgttggttgtcactctaca

SEQ ID NO: 1986811 - DNA, 15 bp, Homo sapiens
cttgttgtcaagtat

SEQ ID NO: 1986812 - DNA, 14 bp, Homo sapiens
cttgtttggggcag

SEQ ID NO: 1986813 - DNA, 17 bp, Homo sapiens
cttgtttggggcaggag

SEQ ID NO: 1986814 - DNA, 14 bp, Homo sapiens
cttgtttgttctag

SEQ ID NO: 1986815 - DNA, 12 bp, Homo sapiens
cttgttttaaga

SEQ ID NO: 1986816 - DNA, 14 bp, Homo sapiens
cttgttttcttgcc

SEQ ID NO: 1986817 - DNA, 21 bp, Homo sapiens
cttgttttttttttccactta

SEQ ID NO: 1986818 - DNA, 15 bp, Homo sapiens
ctttaaaagatgaaa

SEQ ID NO: 1986819 - DNA, 23 bp, Homo sapiens
ctttaaaataaggataataatca

SEQ ID NO: 1986820 - DNA, 17 bp, Homo sapiens
ctttaaactaccctcca

SEQ ID NO: 1986821 - DNA, 21 bp, Homo sapiens
ctttaaactaccctccagagt

SEQ ID NO: 1986822 - DNA, 20 bp, Homo sapiens
ctttaaagacttaagattaa

SEQ ID NO: 1986823 - DNA, 18 bp, Homo sapiens
ctttaaagtacctgtagt

SEQ ID NO: 1986824 - DNA, 12 bp, Homo sapiens
ctttaaagtctt

SEQ ID NO: 1986825 - DNA, 19 bp, Homo sapiens
ctttaaagtgtaataatat

SEQ ID NO: 1986826 - DNA, 13 bp, Homo sapiens
ctttaaatcaaaa

SEQ ID NO: 1986827 - DNA, 16 bp, Homo sapiens
ctttaaatcaaaagct

SEQ ID NO: 1986828 - DNA, 18 bp, Homo sapiens
ctttaaatcaaaagctgc

SEQ ID NO: 1986829 - DNA, 13 bp, Homo sapiens
ctttaaattcaag

SEQ ID NO: 1986830 - DNA, 17 bp, Homo sapiens
ctttaacaaaacaagaa

SEQ ID NO: 1986831 - DNA, 18 bp, Homo sapiens
ctttaacaaaacaagaaa

SEQ ID NO: 1986832 - DNA, 19 bp, Homo sapiens
ctttaaccctctcttccct

SEQ ID NO: 1986833 - DNA, 22 bp, Homo sapiens
ctttaaccgtttttcaagaaaa

SEQ ID NO: 1986834 - DNA, 18 bp, Homo sapiens
ctttaagaatctatttcc

SEQ ID NO: 1986835 - DNA, 17 bp, Homo sapiens
ctttaagagagaaatct

SEQ ID NO: 1986836 - DNA, 12 bp, Homo sapiens
ctttaaggaaaa

SEQ ID NO: 1986837 - DNA, 16 bp, Homo sapiens
ctttaagtattgtttt

SEQ ID NO: 1986838 - DNA, 20 bp, Homo sapiens
ctttaatactcacctcctcc

SEQ ID NO: 1986839 - DNA, 23 bp, Homo sapiens
ctttaatgtcacaggcaggtcca

SEQ ID NO: 1986840 - DNA, 20 bp, Homo sapiens
ctttaatgtgtattgaagaa

SEQ ID NO: 1986841 - DNA, 20 bp, Homo sapiens
ctttaattctcatgtgatcc

SEQ ID NO: 1986842 - DNA, 18 bp, Homo sapiens
ctttacataattgcaata

SEQ ID NO: 1986843 - DNA, 14 bp, Homo sapiens
ctttacatgcaatt

SEQ ID NO: 1986844 - DNA, 21 bp, Homo sapiens
ctttactcccttcctggcctc

SEQ ID NO: 1986845 - DNA, 14 bp, Homo sapiens
ctttagcgcccagt

SEQ ID NO: 1986846 - DNA, 15 bp, Homo sapiens
ctttagcgcccagtt

SEQ ID NO: 1986847 - DNA, 13 bp, Homo sapiens
ctttagctgtcac

SEQ ID NO: 1986848 - DNA, 16 bp, Homo sapiens
ctttagcttctctgcc

SEQ ID NO: 1986849 - DNA, 14 bp, Homo sapiens
ctttaggcagcctg

SEQ ID NO: 1986850 - DNA, 14 bp, Homo sapiens
ctttaggtctggtt

SEQ ID NO: 1986851 - DNA, 17 bp, Homo sapiens
ctttaggtgcctcctgt

SEQ ID NO: 1986852 - DNA, 18 bp, Homo sapiens
ctttaggtgcctcctgtc

SEQ ID NO: 1986853 - DNA, 21 bp, Homo sapiens
ctttaggtgcctcctgtctta

SEQ ID NO: 1986854 - DNA, 19 bp, Homo sapiens
ctttatccaatcctcagga

SEQ ID NO: 1986855 - DNA, 21 bp, Homo sapiens
ctttatctaatacctctgtgt

SEQ ID NO: 1986856 - DNA, 14 bp, Homo sapiens
ctttatcttgacat

SEQ ID NO: 1986857 - DNA, 16 bp, Homo sapiens
ctttatgctgtgttta

SEQ ID NO: 1986858 - DNA, 13 bp, Homo sapiens
ctttatggtttct

SEQ ID NO: 1986859 - DNA, 16 bp, Homo sapiens
ctttattaatgaactg

SEQ ID NO: 1986860 - DNA, 21 bp, Homo sapiens
ctttattcaataaaaaaaaga

SEQ ID NO: 1986861 - DNA, 21 bp, Homo sapiens
ctttattcctccctcatgagc

SEQ ID NO: 1986862 - DNA, 17 bp, Homo sapiens
ctttatttatggcttat

SEQ ID NO: 1986863 - DNA, 22 bp, Homo sapiens
ctttattttttaagtatttata

SEQ ID NO: 1986864 - DNA, 23 bp, Homo sapiens
ctttattttttaagtatttatat

SEQ ID NO: 1986865 - DNA, 15 bp, Homo sapiens
ctttcaaagaaggaa

SEQ ID NO: 1986866 - DNA, 18 bp, Homo sapiens
ctttcaaagaaggaattc

SEQ ID NO: 1986867 - DNA, 17 bp, Homo sapiens
ctttcaacttaaatcac

SEQ ID NO: 1986868 - DNA, 19 bp, Homo sapiens
ctttcaacttaaatcactg

SEQ ID NO: 1986869 - DNA, 20 bp, Homo sapiens
ctttcaacttaaatcactga

SEQ ID NO: 1986870 - DNA, 21 bp, Homo sapiens
ctttcaatggtttgcaaggaa

SEQ ID NO: 1986871 - DNA, 17 bp, Homo sapiens
ctttcacaaaattttat

SEQ ID NO: 1986872 - DNA, 18 bp, Homo sapiens
ctttcagagccagtgaag

SEQ ID NO: 1986873 - DNA, 20 bp, Homo sapiens
ctttcagcaagacttctctt

SEQ ID NO: 1986874 - DNA, 17 bp, Homo sapiens
ctttcagcactcagaaa

SEQ ID NO: 1986875 - DNA, 13 bp, Homo sapiens
ctttcagctgtga

SEQ ID NO: 1986876 - DNA, 21 bp, Homo sapiens
ctttcaggggggttgtgaggc

SEQ ID NO: 1986877 - DNA, 12 bp, Homo sapiens
ctttcaggtact

SEQ ID NO: 1986878 - DNA, 18 bp, Homo sapiens
ctttcatgaacacagcct

SEQ ID NO: 1986879 - DNA, 13 bp, Homo sapiens
ctttccacctgct

SEQ ID NO: 1986880 - DNA, 16 bp, Homo sapiens
ctttccagcctgggca

SEQ ID NO: 1986881 - DNA, 15 bp, Homo sapiens
ctttccagtgaggaa

SEQ ID NO: 1986882 - DNA, 22 bp, Homo sapiens
ctttccatttggtttagaacat

SEQ ID NO: 1986883 - DNA, 17 bp, Homo sapiens
ctttccccacctcttcc

SEQ ID NO: 1986884 - DNA, 19 bp, Homo sapiens
ctttccccacctcttcctt

SEQ ID NO: 1986885 - DNA, 20 bp, Homo sapiens
ctttccccacctcttccttc

SEQ ID NO: 1986886 - DNA, 17 bp, Homo sapiens
ctttccccagacacatt

SEQ ID NO: 1986887 - DNA, 13 bp, Homo sapiens
ctttccccagtgt

SEQ ID NO: 1986888 - DNA, 20 bp, Homo sapiens
ctttcccccaccccagagtt

SEQ ID NO: 1986889 - DNA, 18 bp, Homo sapiens
ctttcccggactgcaagc

SEQ ID NO: 1986890 - DNA, 16 bp, Homo sapiens
ctttccctcaccccct

SEQ ID NO: 1986891 - DNA, 14 bp, Homo sapiens
ctttccctccccaa

SEQ ID NO: 1986892 - DNA, 15 bp, Homo sapiens
ctttcccttccagtt

SEQ ID NO: 1986893 - DNA, 19 bp, Homo sapiens
ctttccgctgtcgccccag

SEQ ID NO: 1986894 - DNA, 12 bp, Homo sapiens
ctttcctcccca

SEQ ID NO: 1986895 - DNA, 20 bp, Homo sapiens
ctttcctccccaccttcccc

SEQ ID NO: 1986896 - DNA, 13 bp, Homo sapiens
ctttcctccctgg

SEQ ID NO: 1986897 - DNA, 16 bp, Homo sapiens
ctttcctcgtgaagga

SEQ ID NO: 1986898 - DNA, 19 bp, Homo sapiens
ctttcctgggggatgtgca

SEQ ID NO: 1986899 - DNA, 12 bp, Homo sapiens
ctttcctgtgcc

SEQ ID NO: 1986900 - DNA, 12 bp, Homo sapiens
ctttccttgtct

SEQ ID NO: 1986901 - DNA, 16 bp, Homo sapiens
ctttccttgtctctca

SEQ ID NO: 1986902 - DNA, 17 bp, Homo sapiens
ctttctaatgtgtgaat

SEQ ID NO: 1986903 - DNA, 15 bp, Homo sapiens
ctttctacccagcga

SEQ ID NO: 1986904 - DNA, 20 bp, Homo sapiens
ctttctagtcctattctatt

SEQ ID NO: 1986905 - DNA, 21 bp, Homo sapiens
ctttctagtcctattctattg

SEQ ID NO: 1986906 - DNA, 19 bp, Homo sapiens
ctttctattcataataaac

SEQ ID NO: 1986907 - DNA, 21 bp, Homo sapiens
ctttctattcataataaacta

SEQ ID NO: 1986908 - DNA, 15 bp, Homo sapiens
ctttctccaaagtta

SEQ ID NO: 1986909 - DNA, 19 bp, Homo sapiens
ctttctccagccagcaatg

SEQ ID NO: 1986910 - DNA, 18 bp, Homo sapiens
ctttctcccactgagttt

SEQ ID NO: 1986911 - DNA, 12 bp, Homo sapiens
ctttctcctttg

SEQ ID NO: 1986912 - DNA, 20 bp, Homo sapiens
ctttctcgtggtagaagcca

SEQ ID NO: 1986913 - DNA, 14 bp, Homo sapiens
ctttctctccttct

SEQ ID NO: 1986914 - DNA, 14 bp, Homo sapiens
ctttctctggctcc

SEQ ID NO: 1986915 - DNA, 17 bp, Homo sapiens
ctttctctggctccaga

SEQ ID NO: 1986916 - DNA, 16 bp, Homo sapiens
ctttctcttccctcct

SEQ ID NO: 1986917 - DNA, 22 bp, Homo sapiens
ctttctgacaagataaaggaag

SEQ ID NO: 1986918 - DNA, 18 bp, Homo sapiens
ctttctggaccagatcct

SEQ ID NO: 1986919 - DNA, 21 bp, Homo sapiens
ctttctggccctttctggacc

SEQ ID NO: 1986920 - DNA, 14 bp, Homo sapiens
ctttctgggccaag

SEQ ID NO: 1986921 - DNA, 16 bp, Homo sapiens
ctttctgtaaccataa

SEQ ID NO: 1986922 - DNA, 14 bp, Homo sapiens
ctttctgtgcttct

SEQ ID NO: 1986923 - DNA, 17 bp, Homo sapiens
ctttcttattttgtaat

SEQ ID NO: 1986924 - DNA, 19 bp, Homo sapiens
ctttcttattttgtaataa

SEQ ID NO: 1986925 - DNA, 20 bp, Homo sapiens
ctttcttattttgtaataaa

SEQ ID NO: 1986926 - DNA, 21 bp, Homo sapiens
ctttcttattttgtaataaac

SEQ ID NO: 1986927 - DNA, 22 bp, Homo sapiens
ctttcttattttgtaataaact

SEQ ID NO: 1986928 - DNA, 12 bp, Homo sapiens
ctttcttcctct

SEQ ID NO: 1986929 - DNA, 16 bp, Homo sapiens
ctttcttcctctgctg

SEQ ID NO: 1986930 - DNA, 22 bp, Homo sapiens
ctttcttctacaaccagagccc

SEQ ID NO: 1986931 - DNA, 15 bp, Homo sapiens
ctttcttggtgtctg

SEQ ID NO: 1986932 - DNA, 17 bp, Homo sapiens
ctttctttctaactcca

SEQ ID NO: 1986933 - DNA, 22 bp, Homo sapiens
ctttcttttctggaatgtaatc

SEQ ID NO: 1986934 - DNA, 18 bp, Homo sapiens
ctttcttttgattcttcc

SEQ ID NO: 1986935 - DNA, 13 bp, Homo sapiens
ctttctttttctg

SEQ ID NO: 1986936 - DNA, 16 bp, Homo sapiens
ctttctttttctggaa

SEQ ID NO: 1986937 - DNA, 17 bp, Homo sapiens
ctttctttttctgtctc

SEQ ID NO: 1986938 - DNA, 12 bp, Homo sapiens
ctttgaaaagaa

SEQ ID NO: 1986939 - DNA, 13 bp, Homo sapiens
ctttgaaaagaaa

SEQ ID NO: 1986940 - DNA, 14 bp, Homo sapiens
ctttgaagcagttg

SEQ ID NO: 1986941 - DNA, 20 bp, Homo sapiens
ctttgaataaagtctgagtg

SEQ ID NO: 1986942 - DNA, 18 bp, Homo sapiens
ctttgaatacccccagag

SEQ ID NO: 1986943 - DNA, 19 bp, Homo sapiens
ctttgaatttcctatctgt

SEQ ID NO: 1986944 - DNA, 19 bp, Homo sapiens
ctttgactcacctgttact

SEQ ID NO: 1986945 - DNA, 13 bp, Homo sapiens
ctttgagaaagaa

SEQ ID NO: 1986946 - DNA, 15 bp, Homo sapiens
ctttgaggttgcttt

SEQ ID NO: 1986947 - DNA, 21 bp, Homo sapiens
ctttgagtgtcttaattaaaa

SEQ ID NO: 1986948 - DNA, 19 bp, Homo sapiens
ctttgatgcatttccacac

SEQ ID NO: 1986949 - DNA, 13 bp, Homo sapiens
ctttgcacatgtg

SEQ ID NO: 1986950 - DNA, 15 bp, Homo sapiens
ctttgcacatgtgac

SEQ ID NO: 1986951 - DNA, 17 bp, Homo sapiens
ctttgcacatgtgacca

SEQ ID NO: 1986952 - DNA, 16 bp, Homo sapiens
ctttgcactgagggcc

SEQ ID NO: 1986953 - DNA, 15 bp, Homo sapiens
ctttgcagacaggca

SEQ ID NO: 1986954 - DNA, 22 bp, Homo sapiens
ctttgcagaccgcatagtcact

SEQ ID NO: 1986955 - DNA, 13 bp, Homo sapiens
ctttgcagagcct

SEQ ID NO: 1986956 - DNA, 20 bp, Homo sapiens
ctttgcaggcccagcagact

SEQ ID NO: 1986957 - DNA, 23 bp, Homo sapiens
ctttgcaggctctgggctcaggg

SEQ ID NO: 1986958 - DNA, 15 bp, Homo sapiens
ctttgccccagttac

SEQ ID NO: 1986959 - DNA, 19 bp, Homo sapiens
ctttgcccttctttctacc

SEQ ID NO: 1986960 - DNA, 14 bp, Homo sapiens
ctttgcctgtgtga

SEQ ID NO: 1986961 - DNA, 16 bp, Homo sapiens
ctttgctacaataaat

SEQ ID NO: 1986962 - DNA, 18 bp, Homo sapiens
ctttgctacaataaatgc

SEQ ID NO: 1986963 - DNA, 22 bp, Homo sapiens
ctttgctacaataaatgctgaa

SEQ ID NO: 1986964 - DNA, 20 bp, Homo sapiens
ctttgcttcaaatccatcca

SEQ ID NO: 1986965 - DNA, 11 bp, Homo sapiens
ctttggaagga

SEQ ID NO: 1986966 - DNA, 15 bp, Homo sapiens
ctttggaaggagtga

SEQ ID NO: 1986967 - DNA, 15 bp, Homo sapiens
ctttggaggaacagc

SEQ ID NO: 1986968 - DNA, 17 bp, Homo sapiens
ctttggccattccaaca

SEQ ID NO: 1986969 - DNA, 18 bp, Homo sapiens
ctttggcttctcctgtga

SEQ ID NO: 1986970 - DNA, 21 bp, Homo sapiens
ctttggcttctcctgtgaccc

SEQ ID NO: 1986971 - DNA, 19 bp, Homo sapiens
ctttgggctgccctggtgc

SEQ ID NO: 1986972 - DNA, 21 bp, Homo sapiens
ctttgggctgccctggtgctg

SEQ ID NO: 1986973 - DNA, 20 bp, Homo sapiens
ctttggggacagttggcaga

SEQ ID NO: 1986974 - DNA, 22 bp, Homo sapiens
ctttggggacagttggcagaga

SEQ ID NO: 1986975 - DNA, 21 bp, Homo sapiens
ctttggggcttttacaccagt

SEQ ID NO: 1986976 - DNA, 21 bp, Homo sapiens
ctttggggtcagccagggcca

SEQ ID NO: 1986977 - DNA, 22 bp, Homo sapiens
ctttggtacatggccagtgtga

SEQ ID NO: 1986978 - DNA, 14 bp, Homo sapiens
ctttggttcagcta

SEQ ID NO: 1986979 - DNA, 15 bp, Homo sapiens
ctttggttctctcca

SEQ ID NO: 1986980 - DNA, 22 bp, Homo sapiens
ctttgtaatgtcaccaccttcc

SEQ ID NO: 1986981 - DNA, 18 bp, Homo sapiens
ctttgtcatctttcttct

SEQ ID NO: 1986982 - DNA, 17 bp, Homo sapiens
ctttgtgataacaaaga

SEQ ID NO: 1986983 - DNA, 13 bp, Homo sapiens
ctttgtgcctttg

SEQ ID NO: 1986984 - DNA, 14 bp, Homo sapiens
ctttgtgcctttga

SEQ ID NO: 1986985 - DNA, 13 bp, Homo sapiens
ctttgtggcttcc

SEQ ID NO: 1986986 - DNA, 16 bp, Homo sapiens
ctttgtgtagctttgc

SEQ ID NO: 1986987 - DNA, 16 bp, Homo sapiens
ctttgttcagttgact

SEQ ID NO: 1986988 - DNA, 18 bp, Homo sapiens
cttttaaaatgaaatgtt

SEQ ID NO: 1986989 - DNA, 17 bp, Homo sapiens
cttttaaagaagtaaat

SEQ ID NO: 1986990 - DNA, 23 bp, Homo sapiens
cttttaaaggggcagaaaaactc

SEQ ID NO: 1986991 - DNA, 20 bp, Homo sapiens
cttttaacatttatctaaaa

SEQ ID NO: 1986992 - DNA, 18 bp, Homo sapiens
cttttaatgaacaaatgg

SEQ ID NO: 1986993 - DNA, 23 bp, Homo sapiens
cttttaattaatatgttcattaa

SEQ ID NO: 1986994 - DNA, 13 bp, Homo sapiens
cttttacaaaaca

SEQ ID NO: 1986995 - DNA, 19 bp, Homo sapiens
cttttactcctttgcattc

SEQ ID NO: 1986996 - DNA, 23 bp, Homo sapiens
cttttagagccccccgtgtggct

SEQ ID NO: 1986997 - DNA, 21 bp, Homo sapiens
cttttagtaaagtcaaggaga

SEQ ID NO: 1986998 - DNA, 14 bp, Homo sapiens
cttttatagctatt

SEQ ID NO: 1986999 - DNA, 21 bp, Homo sapiens
cttttataggatttatttaaa

SEQ ID NO: 1987000 - DNA, 13 bp, Homo sapiens
cttttatcaaaca

SEQ ID NO: 1987001 - DNA, 19 bp, Homo sapiens
cttttatctgtagcagaaa

SEQ ID NO: 1987002 - DNA, 17 bp, Homo sapiens
cttttattcatttgagt

SEQ ID NO: 1987003 - DNA, 13 bp, Homo sapiens
cttttattgtata

SEQ ID NO: 1987004 - DNA, 21 bp, Homo sapiens
cttttattgtataaactatca

SEQ ID NO: 1987005 - DNA, 15 bp, Homo sapiens
cttttatttccaaaa

SEQ ID NO: 1987006 - DNA, 12 bp, Homo sapiens
cttttcactgct

SEQ ID NO: 1987007 - DNA, 17 bp, Homo sapiens
cttttcactgctggctg

SEQ ID NO: 1987008 - DNA, 20 bp, Homo sapiens
cttttccaggatcctgcagg

SEQ ID NO: 1987009 - DNA, 22 bp, Homo sapiens
cttttcccaaaatgttgaaata

SEQ ID NO: 1987010 - DNA, 20 bp, Homo sapiens
cttttcccaggaatatccca

SEQ ID NO: 1987011 - DNA, 14 bp, Homo sapiens
cttttcccttcttt

SEQ ID NO: 1987012 - DNA, 24 bp, Homo sapiens
cttttcgcttgcttctgcagcaac

SEQ ID NO: 1987013 - DNA, 14 bp, Homo sapiens
cttttctcccatat

SEQ ID NO: 1987014 - DNA, 14 bp, Homo sapiens
cttttctctcccat

SEQ ID NO: 1987015 - DNA, 12 bp, Homo sapiens
cttttctgcaga

SEQ ID NO: 1987016 - DNA, 20 bp, Homo sapiens
cttttgaagtagtttgtata

SEQ ID NO: 1987017 - DNA, 14 bp, Homo sapiens
cttttgactctttt

SEQ ID NO: 1987018 - DNA, 15 bp, Homo sapiens
cttttgatggggaga

SEQ ID NO: 1987019 - DNA, 14 bp, Homo sapiens
cttttgatgtgaaa

SEQ ID NO: 1987020 - DNA, 14 bp, Homo sapiens
cttttgcaaacttt

SEQ ID NO: 1987021 - DNA, 22 bp, Homo sapiens
cttttgcataagattaaaggaa

SEQ ID NO: 1987022 - DNA, 14 bp, Homo sapiens
cttttgctgctgct

SEQ ID NO: 1987023 - DNA, 18 bp, Homo sapiens
cttttgcttggcagagag

SEQ ID NO: 1987024 - DNA, 17 bp, Homo sapiens
cttttggataatatcca

SEQ ID NO: 1987025 - DNA, 16 bp, Homo sapiens
cttttggtctgtgtga

SEQ ID NO: 1987026 - DNA, 10 bp, Homo sapiens
cttttgtaag

SEQ ID NO: 1987027 - DNA, 16 bp, Homo sapiens
cttttgtaccagtgtg

SEQ ID NO: 1987028 - DNA, 15 bp, Homo sapiens
cttttgtccccaggg

SEQ ID NO: 1987029 - DNA, 19 bp, Homo sapiens
cttttgtccttcctgtgcc

SEQ ID NO: 1987030 - DNA, 18 bp, Homo sapiens
cttttgtgtaataagaaa

SEQ ID NO: 1987031 - DNA, 19 bp, Homo sapiens
cttttgtgtaataagaaag

SEQ ID NO: 1987032 - DNA, 14 bp, Homo sapiens
cttttgtgtacagt

SEQ ID NO: 1987033 - DNA, 13 bp, Homo sapiens
cttttgttgtgac

SEQ ID NO: 1987034 - DNA, 13 bp, Homo sapiens
cttttgtttcagg

SEQ ID NO: 1987035 - DNA, 17 bp, Homo sapiens
ctttttaagcttattta

SEQ ID NO: 1987036 - DNA, 15 bp, Homo sapiens
ctttttagtctttta

SEQ ID NO: 1987037 - DNA, 17 bp, Homo sapiens
ctttttagtcttttact

SEQ ID NO: 1987038 - DNA, 22 bp, Homo sapiens
ctttttcaaaaattacactaca

SEQ ID NO: 1987039 - DNA, 15 bp, Homo sapiens
ctttttcataaactg

SEQ ID NO: 1987040 - DNA, 13 bp, Homo sapiens
ctttttctggaaa

SEQ ID NO: 1987041 - DNA, 17 bp, Homo sapiens
ctttttctgtctctctt

SEQ ID NO: 1987042 - DNA, 12 bp, Homo sapiens
ctttttctttat

SEQ ID NO: 1987043 - DNA, 16 bp, Homo sapiens
ctttttctttataaac

SEQ ID NO: 1987044 - DNA, 21 bp, Homo sapiens
ctttttctttttttctttggt

SEQ ID NO: 1987045 - DNA, 11 bp, Homo sapiens
ctttttgaatg

SEQ ID NO: 1987046 - DNA, 22 bp, Homo sapiens
ctttttgattacagtgtagctt

SEQ ID NO: 1987047 - DNA, 18 bp, Homo sapiens
cttttttaaatgaagaaa

SEQ ID NO: 1987048 - DNA, 15 bp, Homo sapiens
cttttttcactacat

SEQ ID NO: 1987049 - DNA, 13 bp, Homo sapiens
cttttttcctcct

SEQ ID NO: 1987050 - DNA, 17 bp, Homo sapiens
ctttttttgctttgttt

SEQ ID NO: 1987051 - DNA, 13 bp, Homo sapiens
gaaaaaaaatata

SEQ ID NO: 1987052 - DNA, 15 bp, Homo sapiens
gaaaaaaaatatata

SEQ ID NO: 1987053 - DNA, 23 bp, Homo sapiens
gaaaaaaaatatatatatatatt

SEQ ID NO: 1987054 - DNA, 18 bp, Homo sapiens
gaaaaaaagtttgccaga

SEQ ID NO: 1987055 - DNA, 20 bp, Homo sapiens
gaaaaaaagtttgccagaag

SEQ ID NO: 1987056 - DNA, 15 bp, Homo sapiens
gaaaaaatacatttt

SEQ ID NO: 1987057 - DNA, 20 bp, Homo sapiens
gaaaaaattaagagatacat

SEQ ID NO: 1987058 - DNA, 22 bp, Homo sapiens
gaaaaaattaagagatacattc

SEQ ID NO: 1987059 - DNA, 23 bp, Homo sapiens
gaaaaaccaatgattcataacaa

SEQ ID NO: 1987060 - DNA, 23 bp, Homo sapiens
gaaaaactgatcaaaaataaact

SEQ ID NO: 1987061 - DNA, 20 bp, Homo sapiens
gaaaaacttccatgaggcca

SEQ ID NO: 1987062 - DNA, 22 bp, Homo sapiens
gaaaaagaaatgcaaaaatctc

SEQ ID NO: 1987063 - DNA, 12 bp, Homo sapiens
gaaaaagaagca

SEQ ID NO: 1987064 - DNA, 13 bp, Homo sapiens
gaaaaagcgaaaa

SEQ ID NO: 1987065 - DNA, 15 bp, Homo sapiens
gaaaaatatgatatt

SEQ ID NO: 1987066 - DNA, 13 bp, Homo sapiens
gaaaaatatttaa

SEQ ID NO: 1987067 - DNA, 16 bp, Homo sapiens
gaaaaatcttgggcaa

SEQ ID NO: 1987068 - DNA, 23 bp, Homo sapiens
gaaaacaaatcttcaaggtgtaa

SEQ ID NO: 1987069 - DNA, 14 bp, Homo sapiens
gaaaacagaggaat

SEQ ID NO: 1987070 - DNA, 21 bp, Homo sapiens
gaaaacataatataagaatca

SEQ ID NO: 1987071 - DNA, 19 bp, Homo sapiens
gaaaaccaagccgtggctt

SEQ ID NO: 1987072 - DNA, 12 bp, Homo sapiens
gaaaaccaggga

SEQ ID NO: 1987073 - DNA, 15 bp, Homo sapiens
gaaaacccagagagg

SEQ ID NO: 1987074 - DNA, 19 bp, Homo sapiens
gaaaacctcatttaccata

SEQ ID NO: 1987075 - DNA, 15 bp, Homo sapiens
gaaaacgttgacccc

SEQ ID NO: 1987076 - DNA, 23 bp, Homo sapiens
gaaaacgttgacccctttccccc

SEQ ID NO: 1987077 - DNA, 17 bp, Homo sapiens
gaaaactaacaaccaac

SEQ ID NO: 1987078 - DNA, 17 bp, Homo sapiens
gaaaactcattactttt

SEQ ID NO: 1987079 - DNA, 18 bp, Homo sapiens
gaaaactgaaaatctaat

SEQ ID NO: 1987080 - DNA, 19 bp, Homo sapiens
gaaaactggaaatctggat

SEQ ID NO: 1987081 - DNA, 21 bp, Homo sapiens
gaaaactgtttatggtatttt

SEQ ID NO: 1987082 - DNA, 15 bp, Homo sapiens
gaaaacttatttgag

SEQ ID NO: 1987083 - DNA, 12 bp, Homo sapiens
gaaaacttgaat

SEQ ID NO: 1987084 - DNA, 19 bp, Homo sapiens
gaaaagaacgtattttaaa

SEQ ID NO: 1987085 - DNA, 18 bp, Homo sapiens
gaaaagaatacagaaaga

SEQ ID NO: 1987086 - DNA, 19 bp, Homo sapiens
gaaaagaatacagaaagat

SEQ ID NO: 1987087 - DNA, 15 bp, Homo sapiens
gaaaagaccagggct

SEQ ID NO: 1987088 - DNA, 11 bp, Homo sapiens
gaaaagagaga

SEQ ID NO: 1987089 - DNA, 21 bp, Homo sapiens
gaaaagaggtggattcctggg

SEQ ID NO: 1987090 - DNA, 13 bp, Homo sapiens
gaaaagataaaga

SEQ ID NO: 1987091 - DNA, 18 bp, Homo sapiens
gaaaagataggtttgagt

SEQ ID NO: 1987092 - DNA, 16 bp, Homo sapiens
gaaaagatgagaggca

SEQ ID NO: 1987093 - DNA, 23 bp, Homo sapiens
gaaaagctagaattgagtgttta

SEQ ID NO: 1987094 - DNA, 17 bp, Homo sapiens
gaaaagctgctgacagt

SEQ ID NO: 1987095 - DNA, 12 bp, Homo sapiens
gaaaaggcaaaa

SEQ ID NO: 1987096 - DNA, 22 bp, Homo sapiens
gaaaaggcatggagacagcgaa

SEQ ID NO: 1987097 - DNA, 14 bp, Homo sapiens
gaaaaggcctgggg

SEQ ID NO: 1987098 - DNA, 22 bp, Homo sapiens
gaaaaggtttatgaaaaagaag

SEQ ID NO: 1987099 - DNA, 18 bp, Homo sapiens
gaaaagtagaattatatc

SEQ ID NO: 1987100 - DNA, 21 bp, Homo sapiens
gaaaagtagaattatatctaa

SEQ ID NO: 1987101 - DNA, 16 bp, Homo sapiens
gaaaagtcacacagac

SEQ ID NO: 1987102 - DNA, 19 bp, Homo sapiens
gaaaagtcacacagacaca

SEQ ID NO: 1987103 - DNA, 21 bp, Homo sapiens
gaaaagtcacacagacacaca

SEQ ID NO: 1987104 - DNA, 16 bp, Homo sapiens
gaaaagtgaatgctca

SEQ ID NO: 1987105 - DNA, 13 bp, Homo sapiens
gaaaagtgctgtt

SEQ ID NO: 1987106 - DNA, 23 bp, Homo sapiens
gaaaagtgcttagaaagttattg

SEQ ID NO: 1987107 - DNA, 15 bp, Homo sapiens
gaaaagtgttattat

SEQ ID NO: 1987108 - DNA, 12 bp, Homo sapiens
gaaaagttcata

SEQ ID NO: 1987109 - DNA, 13 bp, Homo sapiens
gaaaatataaatg

SEQ ID NO: 1987110 - DNA, 19 bp, Homo sapiens
gaaaatataaatgcatgat

SEQ ID NO: 1987111 - DNA, 22 bp, Homo sapiens
gaaaatataaatgcatgatttt

SEQ ID NO: 1987112 - DNA, 21 bp, Homo sapiens
gaaaatcagttatattcttta

SEQ ID NO: 1987113 - DNA, 14 bp, Homo sapiens
gaaaatcctctggc

SEQ ID NO: 1987114 - DNA, 15 bp, Homo sapiens
gaaaatcctctggct

SEQ ID NO: 1987115 - DNA, 12 bp, Homo sapiens
gaaaatgtactg

SEQ ID NO: 1987116 - DNA, 23 bp, Homo sapiens
gaaaattatttaaaccgctaaaa

SEQ ID NO: 1987117 - DNA, 20 bp, Homo sapiens
gaaaattcaaaaagtgttta

SEQ ID NO: 1987118 - DNA, 16 bp, Homo sapiens
gaaaattcatttcaca

SEQ ID NO: 1987119 - DNA, 23 bp, Homo sapiens
gaaacaaagagttcaagaaataa

SEQ ID NO: 1987120 - DNA, 17 bp, Homo sapiens
gaaacaaataatcacat

SEQ ID NO: 1987121 - DNA, 14 bp, Homo sapiens
gaaacagaaacaaa

SEQ ID NO: 1987122 - DNA, 15 bp, Homo sapiens
gaaacagagaaccct

SEQ ID NO: 1987123 - DNA, 18 bp, Homo sapiens
gaaacagagagagacaga

SEQ ID NO: 1987124 - DNA, 22 bp, Homo sapiens
gaaacagaggcgtctcacattt

SEQ ID NO: 1987125 - DNA, 20 bp, Homo sapiens
gaaacagatgataaatattt

SEQ ID NO: 1987126 - DNA, 18 bp, Homo sapiens
gaaacagctaatgggaca

SEQ ID NO: 1987127 - DNA, 17 bp, Homo sapiens
gaaacagggacaaagaa

SEQ ID NO: 1987128 - DNA, 12 bp, Homo sapiens
gaaacagggagc

SEQ ID NO: 1987129 - DNA, 15 bp, Homo sapiens
gaaacagggcagtga

SEQ ID NO: 1987130 - DNA, 23 bp, Homo sapiens
gaaacagggcagtgacaagtgga

SEQ ID NO: 1987131 - DNA, 16 bp, Homo sapiens
gaaacatgacactgac

SEQ ID NO: 1987132 - DNA, 18 bp, Homo sapiens
gaaacattccgaagaggg

SEQ ID NO: 1987133 - DNA, 11 bp, Homo sapiens
gaaacatttac

SEQ ID NO: 1987134 - DNA, 19 bp, Homo sapiens
gaaacatttacaataaata

SEQ ID NO: 1987135 - DNA, 22 bp, Homo sapiens
gaaacatttacaataaatattc

SEQ ID NO: 1987136 - DNA, 22 bp, Homo sapiens
gaaaccaaagatatatacacag

SEQ ID NO: 1987137 - DNA, 17 bp, Homo sapiens
gaaaccagtatggaagg

SEQ ID NO: 1987138 - DNA, 20 bp, Homo sapiens
gaaaccagtatggaagggag

SEQ ID NO: 1987139 - DNA, 19 bp, Homo sapiens
gaaaccagtgtagccttgc

SEQ ID NO: 1987140 - DNA, 21 bp, Homo sapiens
gaaaccattatgaagaagaga

SEQ ID NO: 1987141 - DNA, 15 bp, Homo sapiens
gaaacccaccagcct

SEQ ID NO: 1987142 - DNA, 23 bp, Homo sapiens
gaaacctatcaatcctgccccca

SEQ ID NO: 1987143 - DNA, 18 bp, Homo sapiens
gaaacctgaaaaaaagtt

SEQ ID NO: 1987144 - DNA, 12 bp, Homo sapiens
gaaaccttgcag

SEQ ID NO: 1987145 - DNA, 15 bp, Homo sapiens
gaaaccttgcagcat

SEQ ID NO: 1987146 - DNA, 16 bp, Homo sapiens
gaaaccttgcagcatt

SEQ ID NO: 1987147 - DNA, 17 bp, Homo sapiens
gaaaccttgcagcattt

SEQ ID NO: 1987148 - DNA, 19 bp, Homo sapiens
gaaacgtacttaactgtgt

SEQ ID NO: 1987149 - DNA, 22 bp, Homo sapiens
gaaacgtacttaactgtgtgaa

SEQ ID NO: 1987150 - DNA, 20 bp, Homo sapiens
gaaactcaccatgtaaaaga

SEQ ID NO: 1987151 - DNA, 18 bp, Homo sapiens
gaaactccgtcttagaag

SEQ ID NO: 1987152 - DNA, 15 bp, Homo sapiens
gaaactgccagcaac

SEQ ID NO: 1987153 - DNA, 16 bp, Homo sapiens
gaaactttctttctca

SEQ ID NO: 1987154 - DNA, 16 bp, Homo sapiens
gaaagaaaaaacaaaa

SEQ ID NO: 1987155 - DNA, 24 bp, Homo sapiens
gaaagaaaaataccatgtctctaa

SEQ ID NO: 1987156 - DNA, 12 bp, Homo sapiens
gaaagaaaagac

SEQ ID NO: 1987157 - DNA, 16 bp, Homo sapiens
gaaagaaaagaccctg

SEQ ID NO: 1987158 - DNA, 21 bp, Homo sapiens
gaaagaaaagaccctgagact

SEQ ID NO: 1987159 - DNA, 23 bp, Homo sapiens
gaaagaaacgtacttaactgtgt

SEQ ID NO: 1987160 - DNA, 13 bp, Homo sapiens
gaaagaattattt

SEQ ID NO: 1987161 - DNA, 14 bp, Homo sapiens
gaaagactattcaa

SEQ ID NO: 1987162 - DNA, 22 bp, Homo sapiens
gaaagactattcaaacagtctc

SEQ ID NO: 1987163 - DNA, 23 bp, Homo sapiens
gaaagactggacggggaaaccta

SEQ ID NO: 1987164 - DNA, 11 bp, Homo sapiens
gaaagagacca

SEQ ID NO: 1987165 - DNA, 23 bp, Homo sapiens
gaaagaggtgaccccagggcaca

SEQ ID NO: 1987166 - DNA, 18 bp, Homo sapiens
gaaagcaccgcagcatgt

SEQ ID NO: 1987167 - DNA, 19 bp, Homo sapiens
gaaagcaccgcagcatgtg

SEQ ID NO: 1987168 - DNA, 20 bp, Homo sapiens
gaaagcaccgcagcatgtgg

SEQ ID NO: 1987169 - DNA, 22 bp, Homo sapiens
gaaagcaccgcagcatgtgggg

SEQ ID NO: 1987170 - DNA, 17 bp, Homo sapiens
gaaagcatcacctcagg

SEQ ID NO: 1987171 - DNA, 18 bp, Homo sapiens
gaaagcatcacctcaggc

SEQ ID NO: 1987172 - DNA, 21 bp, Homo sapiens
gaaagcatgtggcatgttcat

SEQ ID NO: 1987173 - DNA, 14 bp, Homo sapiens
gaaagccccagcac

SEQ ID NO: 1987174 - DNA, 21 bp, Homo sapiens
gaaagccctcccccttcccct

SEQ ID NO: 1987175 - DNA, 18 bp, Homo sapiens
gaaagcctcactgatata

SEQ ID NO: 1987176 - DNA, 16 bp, Homo sapiens
gaaagctagagatatg

SEQ ID NO: 1987177 - DNA, 22 bp, Homo sapiens
gaaagctccacggtgcgtggct

SEQ ID NO: 1987178 - DNA, 21 bp, Homo sapiens
gaaagctgagaccctcgccac

SEQ ID NO: 1987179 - DNA, 17 bp, Homo sapiens
gaaaggaggcatgcctc

SEQ ID NO: 1987180 - DNA, 20 bp, Homo sapiens
gaaaggaggcatgcctctga

SEQ ID NO: 1987181 - DNA, 21 bp, Homo sapiens
gaaaggctcagtctcaggagc

SEQ ID NO: 1987182 - DNA, 18 bp, Homo sapiens
gaaagggaagtgatatca

SEQ ID NO: 1987183 - DNA, 21 bp, Homo sapiens
gaaagggacccgaagcccagg

SEQ ID NO: 1987184 - DNA, 14 bp, Homo sapiens
gaaagggagggctc

SEQ ID NO: 1987185 - DNA, 15 bp, Homo sapiens
gaaagggagggctct

SEQ ID NO: 1987186 - DNA, 21 bp, Homo sapiens
gaaagggagggctctgaggcg

SEQ ID NO: 1987187 - DNA, 17 bp, Homo sapiens
gaaagggcaagaaggaa

SEQ ID NO: 1987188 - DNA, 13 bp, Homo sapiens
gaaagggcccaga

SEQ ID NO: 1987189 - DNA, 20 bp, Homo sapiens
gaaaggggcagtttaaagca

SEQ ID NO: 1987190 - DNA, 20 bp, Homo sapiens
gaaagggtctgataaacaca

SEQ ID NO: 1987191 - DNA, 21 bp, Homo sapiens
gaaagtacttctccaccctgc

SEQ ID NO: 1987192 - DNA, 19 bp, Homo sapiens
gaaagtatgtgatatctga

SEQ ID NO: 1987193 - DNA, 17 bp, Homo sapiens
gaaagtcagatgcccag

SEQ ID NO: 1987194 - DNA, 18 bp, Homo sapiens
gaaagtccttgtttttgc

SEQ ID NO: 1987195 - DNA, 13 bp, Homo sapiens
gaaagtctgtgtc

SEQ ID NO: 1987196 - DNA, 16 bp, Homo sapiens
gaaagtgacagagacc

SEQ ID NO: 1987197 - DNA, 21 bp, Homo sapiens
gaaagtgatatcccccagcct

SEQ ID NO: 1987198 - DNA, 20 bp, Homo sapiens
gaaagtgcaaagtgccctca

SEQ ID NO: 1987199 - DNA, 21 bp, Homo sapiens
gaaagtggccatgccaccctg

SEQ ID NO: 1987200 - DNA, 22 bp, Homo sapiens
gaaagttattgtgttgccttag

SEQ ID NO: 1987201 - DNA, 15 bp, Homo sapiens
gaaataaaagcctct

SEQ ID NO: 1987202 - DNA, 23 bp, Homo sapiens
gaaataaacctggagatgatgat

SEQ ID NO: 1987203 - DNA, 18 bp, Homo sapiens
gaaataaagttggtgaca

SEQ ID NO: 1987204 - DNA, 21 bp, Homo sapiens
gaaataaatgtatcatagaaa

SEQ ID NO: 1987205 - DNA, 21 bp, Homo sapiens
gaaataaattggtgataagtg

SEQ ID NO: 1987206 - DNA, 22 bp, Homo sapiens
gaaataaattggtgataagtgg

SEQ ID NO: 1987207 - DNA, 21 bp, Homo sapiens
gaaataagtttttgtttcaca

SEQ ID NO: 1987208 - DNA, 18 bp, Homo sapiens
gaaatactttatctgtga

SEQ ID NO: 1987209 - DNA, 21 bp, Homo sapiens
gaaatactttatctgtgacca

SEQ ID NO: 1987210 - DNA, 15 bp, Homo sapiens
gaaatataatgcaaa

SEQ ID NO: 1987211 - DNA, 19 bp, Homo sapiens
gaaatatatatacatatgt

SEQ ID NO: 1987212 - DNA, 22 bp, Homo sapiens
gaaatatgattttatttgacaa

SEQ ID NO: 1987213 - DNA, 13 bp, Homo sapiens
gaaatatttaagt

SEQ ID NO: 1987214 - DNA, 19 bp, Homo sapiens
gaaatatttaagtatatag

SEQ ID NO: 1987215 - DNA, 22 bp, Homo sapiens
gaaatatttaagtatatagtat

SEQ ID NO: 1987216 - DNA, 20 bp, Homo sapiens
gaaatcaaatatgcaaagca

SEQ ID NO: 1987217 - DNA, 17 bp, Homo sapiens
gaaatcacaggggcggg

SEQ ID NO: 1987218 - DNA, 19 bp, Homo sapiens
gaaatcacaggggcggggc

SEQ ID NO: 1987219 - DNA, 22 bp, Homo sapiens
gaaatccccccttcagaacaga

SEQ ID NO: 1987220 - DNA, 21 bp, Homo sapiens
gaaatccctgtttaatattta

SEQ ID NO: 1987221 - DNA, 12 bp, Homo sapiens
gaaatcttaaaa

SEQ ID NO: 1987222 - DNA, 16 bp, Homo sapiens
gaaatgaatttatctg

SEQ ID NO: 1987223 - DNA, 17 bp, Homo sapiens
gaaatgaatttatctga

SEQ ID NO: 1987224 - DNA, 14 bp, Homo sapiens
gaaatgacattttg

SEQ ID NO: 1987225 - DNA, 18 bp, Homo sapiens
gaaatgaggtcagagcct

SEQ ID NO: 1987226 - DNA, 23 bp, Homo sapiens
gaaatgcatccattcctcaggga

SEQ ID NO: 1987227 - DNA, 20 bp, Homo sapiens
gaaatgctattgttgtgggc

SEQ ID NO: 1987228 - DNA, 15 bp, Homo sapiens
gaaatggagaagctc

SEQ ID NO: 1987229 - DNA, 16 bp, Homo sapiens
gaaatggagggtgggg

SEQ ID NO: 1987230 - DNA, 18 bp, Homo sapiens
gaaatgggagatggtcag

SEQ ID NO: 1987231 - DNA, 22 bp, Homo sapiens
gaaatgtaagggaaactgccag

SEQ ID NO: 1987232 - DNA, 18 bp, Homo sapiens
gaaatgtgaagggtgggg

SEQ ID NO: 1987233 - DNA, 21 bp, Homo sapiens
gaaatgttattttttaattat

SEQ ID NO: 1987234 - DNA, 17 bp, Homo sapiens
gaaattacacccaaaga

SEQ ID NO: 1987235 - DNA, 20 bp, Homo sapiens
gaaattaccagagttgttct

SEQ ID NO: 1987236 - DNA, 16 bp, Homo sapiens
gaaattactgaaaaca

SEQ ID NO: 1987237 - DNA, 13 bp, Homo sapiens
gaaattatttaat

SEQ ID NO: 1987238 - DNA, 20 bp, Homo sapiens
gaaattcaacctgtgtctta

SEQ ID NO: 1987239 - DNA, 19 bp, Homo sapiens
gaaattcctgtagcatctt

SEQ ID NO: 1987240 - DNA, 14 bp, Homo sapiens
gaaattccttccca

SEQ ID NO: 1987241 - DNA, 15 bp, Homo sapiens
gaaattgaacctggt

SEQ ID NO: 1987242 - DNA, 21 bp, Homo sapiens
gaaattgtctagcagagcagg

SEQ ID NO: 1987243 - DNA, 19 bp, Homo sapiens
gaaatttaaaaataaagct

SEQ ID NO: 1987244 - DNA, 22 bp, Homo sapiens
gaaatttaaaaataaagctact

SEQ ID NO: 1987245 - DNA, 19 bp, Homo sapiens
gaaatttattagttaatat

SEQ ID NO: 1987246 - DNA, 19 bp, Homo sapiens
gaaatttatttccatctag

SEQ ID NO: 1987247 - DNA, 23 bp, Homo sapiens
gaaatttcagattcccagagcaa

SEQ ID NO: 1987248 - DNA, 21 bp, Homo sapiens
gaaatttgatttctattcaag

SEQ ID NO: 1987249 - DNA, 18 bp, Homo sapiens
gaaattttactgacagaa

SEQ ID NO: 1987250 - DNA, 14 bp, Homo sapiens
gaaattttatttag

SEQ ID NO: 1987251 - DNA, 18 bp, Homo sapiens
gaacaaagaaaaaaatat

SEQ ID NO: 1987252 - DNA, 20 bp, Homo sapiens
gaacaaagaaaaaaatatat

SEQ ID NO: 1987253 - DNA, 21 bp, Homo sapiens
gaacaaagaaaaaaatatatt

SEQ ID NO: 1987254 - DNA, 15 bp, Homo sapiens
gaacaaatctgggca

SEQ ID NO: 1987255 - DNA, 19 bp, Homo sapiens
gaacaacaacaacaataac

SEQ ID NO: 1987256 - DNA, 15 bp, Homo sapiens
gaacaactactgtga

SEQ ID NO: 1987257 - DNA, 21 bp, Homo sapiens
gaacaactaggcttcagcata

SEQ ID NO: 1987258 - DNA, 23 bp, Homo sapiens
gaacaactatttataaactagat

SEQ ID NO: 1987259 - DNA, 18 bp, Homo sapiens
gaacaagtcacagctgca

SEQ ID NO: 1987260 - DNA, 19 bp, Homo sapiens
gaacaagtcacagctgcag

SEQ ID NO: 1987261 - DNA, 22 bp, Homo sapiens
gaacaatagctattgcatgtaa

SEQ ID NO: 1987262 - DNA, 24 bp, Homo sapiens
gaacacaattgatacttcaggtgc

SEQ ID NO: 1987263 - DNA, 18 bp, Homo sapiens
gaacacatactagaaagc

SEQ ID NO: 1987264 - DNA, 16 bp, Homo sapiens
gaacaccaacttttat

SEQ ID NO: 1987265 - DNA, 22 bp, Homo sapiens
gaacaccaacttttatttggaa

SEQ ID NO: 1987266 - DNA, 14 bp, Homo sapiens
gaacacccactggc

SEQ ID NO: 1987267 - DNA, 17 bp, Homo sapiens
gaacacccactggccag

SEQ ID NO: 1987268 - DNA, 15 bp, Homo sapiens
gaacacccggaaaga

SEQ ID NO: 1987269 - DNA, 16 bp, Homo sapiens
gaacacccggaaagac

SEQ ID NO: 1987270 - DNA, 18 bp, Homo sapiens
gaacacccggaaagactg

SEQ ID NO: 1987271 - DNA, 19 bp, Homo sapiens
gaacacccggaaagactga

SEQ ID NO: 1987272 - DNA, 16 bp, Homo sapiens
gaacaccctatatttt

SEQ ID NO: 1987273 - DNA, 16 bp, Homo sapiens
gaacactagctaagga

SEQ ID NO: 1987274 - DNA, 17 bp, Homo sapiens
gaacactgggggagggg

SEQ ID NO: 1987275 - DNA, 19 bp, Homo sapiens
gaacagaaggatgaatgag

SEQ ID NO: 1987276 - DNA, 19 bp, Homo sapiens
gaacagacaacagaagtca

SEQ ID NO: 1987277 - DNA, 16 bp, Homo sapiens
gaacagacaggagaaa

SEQ ID NO: 1987278 - DNA, 18 bp, Homo sapiens
gaacagacaggagaaatg

SEQ ID NO: 1987279 - DNA, 11 bp, Homo sapiens
gaacagagact

SEQ ID NO: 1987280 - DNA, 16 bp, Homo sapiens
gaacagagactctgga

SEQ ID NO: 1987281 - DNA, 23 bp, Homo sapiens
gaacagccaaatgcatggtgcag

SEQ ID NO: 1987282 - DNA, 20 bp, Homo sapiens
gaacagctcttcactcagcc

SEQ ID NO: 1987283 - DNA, 22 bp, Homo sapiens
gaacagctcttcactcagccac

SEQ ID NO: 1987284 - DNA, 23 bp, Homo sapiens
gaacagctcttcactcagccaca

SEQ ID NO: 1987285 - DNA, 14 bp, Homo sapiens
gaacaggtggatgt

SEQ ID NO: 1987286 - DNA, 13 bp, Homo sapiens
gaacagtaaacat

SEQ ID NO: 1987287 - DNA, 16 bp, Homo sapiens
gaacatagacagaaga

SEQ ID NO: 1987288 - DNA, 23 bp, Homo sapiens
gaacatcaccgacgcgtctcctg

SEQ ID NO: 1987289 - DNA, 12 bp, Homo sapiens
gaacatccaagg

SEQ ID NO: 1987290 - DNA, 14 bp, Homo sapiens
gaacatctgtgtgt

SEQ ID NO: 1987291 - DNA, 21 bp, Homo sapiens
gaacatgagtttatgggaatg

SEQ ID NO: 1987292 - DNA, 18 bp, Homo sapiens
gaacatgcacatttatat

SEQ ID NO: 1987293 - DNA, 20 bp, Homo sapiens
gaacatgcctgattttaaaa

SEQ ID NO: 1987294 - DNA, 15 bp, Homo sapiens
gaacatggagagcta

SEQ ID NO: 1987295 - DNA, 19 bp, Homo sapiens
gaacatggcctaagggcca

SEQ ID NO: 1987296 - DNA, 20 bp, Homo sapiens
gaacatgtcggagtagaaat

SEQ ID NO: 1987297 - DNA, 23 bp, Homo sapiens
gaacattcgaggtgtcaccctgc

SEQ ID NO: 1987298 - DNA, 17 bp, Homo sapiens
gaaccaaagagactgga

SEQ ID NO: 1987299 - DNA, 20 bp, Homo sapiens
gaaccaaagagactggagca

SEQ ID NO: 1987300 - DNA, 15 bp, Homo sapiens
gaaccaagcttcaga

SEQ ID NO: 1987301 - DNA, 19 bp, Homo sapiens
gaaccaagcttcagagcct

SEQ ID NO: 1987302 - DNA, 13 bp, Homo sapiens
gaaccaaggcagc

SEQ ID NO: 1987303 - DNA, 18 bp, Homo sapiens
gaaccaaggcagcctcca

SEQ ID NO: 1987304 - DNA, 13 bp, Homo sapiens
gaaccaatatttg

SEQ ID NO: 1987305 - DNA, 21 bp, Homo sapiens
gaaccacatcttgctctgctg

SEQ ID NO: 1987306 - DNA, 15 bp, Homo sapiens
gaaccatccttccca

SEQ ID NO: 1987307 - DNA, 19 bp, Homo sapiens
gaacccacctgctgagaga

SEQ ID NO: 1987308 - DNA, 14 bp, Homo sapiens
gaacccagccctgg

SEQ ID NO: 1987309 - DNA, 14 bp, Homo sapiens
gaaccccgcagccc

SEQ ID NO: 1987310 - DNA, 16 bp, Homo sapiens
gaaccctgcccactcc

SEQ ID NO: 1987311 - DNA, 22 bp, Homo sapiens
gaacctaaagtagcaggactcg

SEQ ID NO: 1987312 - DNA, 14 bp, Homo sapiens
gaacctaattgaaa

SEQ ID NO: 1987313 - DNA, 16 bp, Homo sapiens
gaacctaattgaaatt

SEQ ID NO: 1987314 - DNA, 20 bp, Homo sapiens
gaacctaccagttggccatg

SEQ ID NO: 1987315 - DNA, 14 bp, Homo sapiens
gaacctcaggcttc

SEQ ID NO: 1987316 - DNA, 22 bp, Homo sapiens
gaacctcagtttcctcatctgc

SEQ ID NO: 1987317 - DNA, 15 bp, Homo sapiens
gaacctcctatttta

SEQ ID NO: 1987318 - DNA, 21 bp, Homo sapiens
gaacctggagggctggaatct

SEQ ID NO: 1987319 - DNA, 16 bp, Homo sapiens
gaacctggccttcagt

SEQ ID NO: 1987320 - DNA, 15 bp, Homo sapiens
gaacctgtactgggt

SEQ ID NO: 1987321 - DNA, 22 bp, Homo sapiens
gaacgagcactggccagagagg

SEQ ID NO: 1987322 - DNA, 18 bp, Homo sapiens
gaacgatatgtagcagaa

SEQ ID NO: 1987323 - DNA, 18 bp, Homo sapiens
gaacgatttagaaagaag

SEQ ID NO: 1987324 - DNA, 21 bp, Homo sapiens
gaacgcagaggcggaaacctt

SEQ ID NO: 1987325 - DNA, 22 bp, Homo sapiens
gaacgcagaggcggaaaccttg

SEQ ID NO: 1987326 - DNA, 22 bp, Homo sapiens
gaacggagccccaggcctctgt

SEQ ID NO: 1987327 - DNA, 14 bp, Homo sapiens
gaacggggagaaaa

SEQ ID NO: 1987328 - DNA, 14 bp, Homo sapiens
gaacgtgactgccc

SEQ ID NO: 1987329 - DNA, 18 bp, Homo sapiens
gaactaagttttttactt

SEQ ID NO: 1987330 - DNA, 22 bp, Homo sapiens
gaactacgcttgctcatttttt

SEQ ID NO: 1987331 - DNA, 15 bp, Homo sapiens
gaactattggagggt

SEQ ID NO: 1987332 - DNA, 13 bp, Homo sapiens
gaactcagagccc

SEQ ID NO: 1987333 - DNA, 17 bp, Homo sapiens
gaactcagagcccctcc

SEQ ID NO: 1987334 - DNA, 20 bp, Homo sapiens
gaactcagagcccctccctg

SEQ ID NO: 1987335 - DNA, 19 bp, Homo sapiens
gaactcccagcaacacaag

SEQ ID NO: 1987336 - DNA, 13 bp, Homo sapiens
gaactcctgagct

SEQ ID NO: 1987337 - DNA, 20 bp, Homo sapiens
gaactcctggaaatatcagt

SEQ ID NO: 1987338 - DNA, 22 bp, Homo sapiens
gaactcgaagcccttccagtgg

SEQ ID NO: 1987339 - DNA, 18 bp, Homo sapiens
gaactctaccctggtagg

SEQ ID NO: 1987340 - DNA, 15 bp, Homo sapiens
gaactctgcacagca

SEQ ID NO: 1987341 - DNA, 19 bp, Homo sapiens
gaactctggcttccaggta

SEQ ID NO: 1987342 - DNA, 20 bp, Homo sapiens
gaactctggcttccaggtat

SEQ ID NO: 1987343 - DNA, 13 bp, Homo sapiens
gaactcttaatca

SEQ ID NO: 1987344 - DNA, 20 bp, Homo sapiens
gaactcttaatcaaatagca

SEQ ID NO: 1987345 - DNA, 19 bp, Homo sapiens
gaactgaacgtcctgcagc

SEQ ID NO: 1987346 - DNA, 18 bp, Homo sapiens
gaactgaattaagttatt

SEQ ID NO: 1987347 - DNA, 22 bp, Homo sapiens
gaactgagccaaacacactgta

SEQ ID NO: 1987348 - DNA, 12 bp, Homo sapiens
gaactgccccat

SEQ ID NO: 1987349 - DNA, 18 bp, Homo sapiens
gaactgccccatctcctc

SEQ ID NO: 1987350 - DNA, 22 bp, Homo sapiens
gaactgctaaatactgtacata

SEQ ID NO: 1987351 - DNA, 17 bp, Homo sapiens
gaactgcttactagccc

SEQ ID NO: 1987352 - DNA, 16 bp, Homo sapiens
gaactggacgcccagc

SEQ ID NO: 1987353 - DNA, 19 bp, Homo sapiens
gaactggacgcccagctga

SEQ ID NO: 1987354 - DNA, 14 bp, Homo sapiens
gaactggagggtga

SEQ ID NO: 1987355 - DNA, 20 bp, Homo sapiens
gaactggagggtgagaggaa

SEQ ID NO: 1987356 - DNA, 14 bp, Homo sapiens
gaactggccaagct

SEQ ID NO: 1987357 - DNA, 18 bp, Homo sapiens
gaactggccaagctgagg

SEQ ID NO: 1987358 - DNA, 14 bp, Homo sapiens
gaactggttcaaga

SEQ ID NO: 1987359 - DNA, 23 bp, Homo sapiens
gaactggttcaagagacactgct

SEQ ID NO: 1987360 - DNA, 21 bp, Homo sapiens
gaactgtctctcatgaacctc

SEQ ID NO: 1987361 - DNA, 17 bp, Homo sapiens
gaactgtgacaggaagc

SEQ ID NO: 1987362 - DNA, 21 bp, Homo sapiens
gaactgtgatggggtgggcag

SEQ ID NO: 1987363 - DNA, 17 bp, Homo sapiens
gaacttacacttggagc

SEQ ID NO: 1987364 - DNA, 22 bp, Homo sapiens
gaacttcaagaagtaagagcta

SEQ ID NO: 1987365 - DNA, 15 bp, Homo sapiens
gaacttgaactgatt

SEQ ID NO: 1987366 - DNA, 16 bp, Homo sapiens
gaacttgaactgattc

SEQ ID NO: 1987367 - DNA, 18 bp, Homo sapiens
gaacttgaggacacatgt

SEQ ID NO: 1987368 - DNA, 18 bp, Homo sapiens
gaagaaaaaatacatttt

SEQ ID NO: 1987369 - DNA, 15 bp, Homo sapiens
gaagaaaaggtacat

SEQ ID NO: 1987370 - DNA, 17 bp, Homo sapiens
gaagaaatgacattttg

SEQ ID NO: 1987371 - DNA, 15 bp, Homo sapiens
gaagaaattcctgta

SEQ ID NO: 1987372 - DNA, 18 bp, Homo sapiens
gaagaaattcctgtagca

SEQ ID NO: 1987373 - DNA, 13 bp, Homo sapiens
gaagaagccccgt

SEQ ID NO: 1987374 - DNA, 13 bp, Homo sapiens
gaagaagctgagg

SEQ ID NO: 1987375 - DNA, 15 bp, Homo sapiens
gaagaagctgaggat

SEQ ID NO: 1987376 - DNA, 19 bp, Homo sapiens
gaagaattgaacccaggag

SEQ ID NO: 1987377 - DNA, 20 bp, Homo sapiens
gaagaattgaacccaggagg

SEQ ID NO: 1987378 - DNA, 20 bp, Homo sapiens
gaagacaaaccactgtacat

SEQ ID NO: 1987379 - DNA, 15 bp, Homo sapiens
gaagacaggacagtg

SEQ ID NO: 1987380 - DNA, 20 bp, Homo sapiens
gaagaccacatccacacacg

SEQ ID NO: 1987381 - DNA, 21 bp, Homo sapiens
gaagaccacatccacacacgc

SEQ ID NO: 1987382 - DNA, 22 bp, Homo sapiens
gaagaccacatccacacacgca

SEQ ID NO: 1987383 - DNA, 15 bp, Homo sapiens
gaagacccagcagga

SEQ ID NO: 1987384 - DNA, 18 bp, Homo sapiens
gaagacccagcaggaagc

SEQ ID NO: 1987385 - DNA, 18 bp, Homo sapiens
gaagacccagtgtaaaga

SEQ ID NO: 1987386 - DNA, 16 bp, Homo sapiens
gaagaccgaattttat

SEQ ID NO: 1987387 - DNA, 16 bp, Homo sapiens
gaagactcattcttct

SEQ ID NO: 1987388 - DNA, 21 bp, Homo sapiens
gaagactcattcttctgtacg

SEQ ID NO: 1987389 - DNA, 12 bp, Homo sapiens
gaagagaaacca

SEQ ID NO: 1987390 - DNA, 18 bp, Homo sapiens
gaagagaagctgagaaga

SEQ ID NO: 1987391 - DNA, 21 bp, Homo sapiens
gaagagaagctgagaagaagc

SEQ ID NO: 1987392 - DNA, 13 bp, Homo sapiens
gaagagaaggagc

SEQ ID NO: 1987393 - DNA, 15 bp, Homo sapiens
gaagagaccacagca

SEQ ID NO: 1987394 - DNA, 19 bp, Homo sapiens
gaagagagatatatctgaa

SEQ ID NO: 1987395 - DNA, 23 bp, Homo sapiens
gaagagaggcacctgctggaaac

SEQ ID NO: 1987396 - DNA, 17 bp, Homo sapiens
gaagagatcaggaagag

SEQ ID NO: 1987397 - DNA, 22 bp, Homo sapiens
gaagagatgtggcaaagtgctg

SEQ ID NO: 1987398 - DNA, 16 bp, Homo sapiens
gaagagcagctggtca

SEQ ID NO: 1987399 - DNA, 18 bp, Homo sapiens
gaagagcaggcacatgga

SEQ ID NO: 1987400 - DNA, 17 bp, Homo sapiens
gaagagcctgactgtgt

SEQ ID NO: 1987401 - DNA, 20 bp, Homo sapiens
gaagagctgttcacagccag

SEQ ID NO: 1987402 - DNA, 23 bp, Homo sapiens
gaagagctgttcacagccagact

SEQ ID NO: 1987403 - DNA, 16 bp, Homo sapiens
gaagaggaagcaagaa

SEQ ID NO: 1987404 - DNA, 20 bp, Homo sapiens
gaagaggaggagggattctg

SEQ ID NO: 1987405 - DNA, 18 bp, Homo sapiens
gaagaggcctagcctgag

SEQ ID NO: 1987406 - DNA, 22 bp, Homo sapiens
gaagagggaatggatggggaga

SEQ ID NO: 1987407 - DNA, 23 bp, Homo sapiens
gaagaggggaggggcctagggag

SEQ ID NO: 1987408 - DNA, 19 bp, Homo sapiens
gaagagtttaactttgggc

SEQ ID NO: 1987409 - DNA, 14 bp, Homo sapiens
gaagagtttgcaaa

SEQ ID NO: 1987410 - DNA, 21 bp, Homo sapiens
gaagatcttttaaaaaggcag

SEQ ID NO: 1987411 - DNA, 14 bp, Homo sapiens
gaagatgaagagaa

SEQ ID NO: 1987412 - DNA, 20 bp, Homo sapiens
gaagatggtagcagataaag

SEQ ID NO: 1987413 - DNA, 21 bp, Homo sapiens
gaagatgttgtcattatgtac

SEQ ID NO: 1987414 - DNA, 12 bp, Homo sapiens
gaagatttacct

SEQ ID NO: 1987415 - DNA, 21 bp, Homo sapiens
gaagcaaaattataagaagag

SEQ ID NO: 1987416 - DNA, 22 bp, Homo sapiens
gaagcaacctcagtaatttaga

SEQ ID NO: 1987417 - DNA, 16 bp, Homo sapiens
gaagcaagcttaatgg

SEQ ID NO: 1987418 - DNA, 16 bp, Homo sapiens
gaagcaggcagagcgg

SEQ ID NO: 1987419 - DNA, 17 bp, Homo sapiens
gaagcaggcagagcggg

SEQ ID NO: 1987420 - DNA, 19 bp, Homo sapiens
gaagcaggcagagcgggga

SEQ ID NO: 1987421 - DNA, 16 bp, Homo sapiens
gaagcagtgagccgca

SEQ ID NO: 1987422 - DNA, 22 bp, Homo sapiens
gaagcagtgcctcgaggcaccg

SEQ ID NO: 1987423 - DNA, 18 bp, Homo sapiens
gaagcagtgccttccata

SEQ ID NO: 1987424 - DNA, 19 bp, Homo sapiens
gaagcatgtttcatgtttt

SEQ ID NO: 1987425 - DNA, 17 bp, Homo sapiens
gaagcatttactttgtg

SEQ ID NO: 1987426 - DNA, 13 bp, Homo sapiens
gaagcatttgttt

SEQ ID NO: 1987427 - DNA, 17 bp, Homo sapiens
gaagccaacttggcttt

SEQ ID NO: 1987428 - DNA, 20 bp, Homo sapiens
gaagccatattcacacctca

SEQ ID NO: 1987429 - DNA, 14 bp, Homo sapiens
gaagcccaataaac

SEQ ID NO: 1987430 - DNA, 19 bp, Homo sapiens
gaagcccaataaacctctt

SEQ ID NO: 1987431 - DNA, 16 bp, Homo sapiens
gaagcccatggagcag

SEQ ID NO: 1987432 - DNA, 19 bp, Homo sapiens
gaagccccatttgcacagg

SEQ ID NO: 1987433 - DNA, 12 bp, Homo sapiens
gaagccctcctt

SEQ ID NO: 1987434 - DNA, 14 bp, Homo sapiens
gaagccctccttcc

SEQ ID NO: 1987435 - DNA, 23 bp, Homo sapiens
gaagccgtctgactccagagtct

SEQ ID NO: 1987436 - DNA, 24 bp, Homo sapiens
gaagccgtctgactccagagtctg

SEQ ID NO: 1987437 - DNA, 14 bp, Homo sapiens
gaagcctaaataaa

SEQ ID NO: 1987438 - DNA, 16 bp, Homo sapiens
gaagcgagcactgacc

SEQ ID NO: 1987439 - DNA, 17 bp, Homo sapiens
gaagcggagcttgcagt

SEQ ID NO: 1987440 - DNA, 17 bp, Homo sapiens
gaagctaacagggaagg

SEQ ID NO: 1987441 - DNA, 18 bp, Homo sapiens
gaagctaacagggaaggc

SEQ ID NO: 1987442 - DNA, 20 bp, Homo sapiens
gaagctaacagggaaggcag

SEQ ID NO: 1987443 - DNA, 22 bp, Homo sapiens
gaagctaacagggaaggcaggc

SEQ ID NO: 1987444 - DNA, 21 bp, Homo sapiens
gaagctattgagaaagacctg

SEQ ID NO: 1987445 - DNA, 18 bp, Homo sapiens
gaagctattgatgtttcc

SEQ ID NO: 1987446 - DNA, 14 bp, Homo sapiens
gaagctccactgtc

SEQ ID NO: 1987447 - DNA, 18 bp, Homo sapiens
gaagctccactgtcaccc

SEQ ID NO: 1987448 - DNA, 22 bp, Homo sapiens
gaagctccgctttctacccagc

SEQ ID NO: 1987449 - DNA, 13 bp, Homo sapiens
gaagctctgaagt

SEQ ID NO: 1987450 - DNA, 16 bp, Homo sapiens
gaagctctgaagtcac

SEQ ID NO: 1987451 - DNA, 17 bp, Homo sapiens
gaagctgagaagaagct

SEQ ID NO: 1987452 - DNA, 14 bp, Homo sapiens
gaagctgagcaggc

SEQ ID NO: 1987453 - DNA, 15 bp, Homo sapiens
gaagctgagcaggcc

SEQ ID NO: 1987454 - DNA, 18 bp, Homo sapiens
gaagctgagcaggcccga

SEQ ID NO: 1987455 - DNA, 14 bp, Homo sapiens
gaagctgaggatcc

SEQ ID NO: 1987456 - DNA, 19 bp, Homo sapiens
gaagctgaggatcctcaca

SEQ ID NO: 1987457 - DNA, 21 bp, Homo sapiens
gaagctgatgctttgcttcaa

SEQ ID NO: 1987458 - DNA, 13 bp, Homo sapiens
gaagctgggggaa

SEQ ID NO: 1987459 - DNA, 19 bp, Homo sapiens
gaagctgtactcagagcag

SEQ ID NO: 1987460 - DNA, 23 bp, Homo sapiens
gaagctgtagtagccctttctgt

SEQ ID NO: 1987461 - DNA, 17 bp, Homo sapiens
gaagctgtgtccttgca

SEQ ID NO: 1987462 - DNA, 12 bp, Homo sapiens
gaagctttacca

SEQ ID NO: 1987463 - DNA, 18 bp, Homo sapiens
gaagctttaccagctgaa

SEQ ID NO: 1987464 - DNA, 15 bp, Homo sapiens
gaaggaactctggct

SEQ ID NO: 1987465 - DNA, 23 bp, Homo sapiens
gaaggaactctggcttccaggta

SEQ ID NO: 1987466 - DNA, 16 bp, Homo sapiens
gaaggaaggaggcaga

SEQ ID NO: 1987467 - DNA, 20 bp, Homo sapiens
gaaggaaggcagggaggagg

SEQ ID NO: 1987468 - DNA, 17 bp, Homo sapiens
gaaggaatagccagaga

SEQ ID NO: 1987469 - DNA, 18 bp, Homo sapiens
gaaggaccctggctcttc

SEQ ID NO: 1987470 - DNA, 13 bp, Homo sapiens
gaaggagaaagga

SEQ ID NO: 1987471 - DNA, 16 bp, Homo sapiens
gaaggagaaaggagcc

SEQ ID NO: 1987472 - DNA, 21 bp, Homo sapiens
gaaggagaaaggagccggacc

SEQ ID NO: 1987473 - DNA, 17 bp, Homo sapiens
gaaggagaaggaaggag

SEQ ID NO: 1987474 - DNA, 20 bp, Homo sapiens
gaaggagactcacctctgcc

SEQ ID NO: 1987475 - DNA, 13 bp, Homo sapiens
gaaggagatcagg

SEQ ID NO: 1987476 - DNA, 16 bp, Homo sapiens
gaaggagatcagggca

SEQ ID NO: 1987477 - DNA, 17 bp, Homo sapiens
gaaggaggcagactgat

SEQ ID NO: 1987478 - DNA, 13 bp, Homo sapiens
gaaggagggcaga

SEQ ID NO: 1987479 - DNA, 17 bp, Homo sapiens
gaaggagggcagagcca

SEQ ID NO: 1987480 - DNA, 20 bp, Homo sapiens
gaaggagggcagagccatgg

SEQ ID NO: 1987481 - DNA, 15 bp, Homo sapiens
gaaggaggtgaggga

SEQ ID NO: 1987482 - DNA, 18 bp, Homo sapiens
gaaggatgtccgttccag

SEQ ID NO: 1987483 - DNA, 15 bp, Homo sapiens
gaaggcaaagcacga

SEQ ID NO: 1987484 - DNA, 18 bp, Homo sapiens
gaaggcaaatataagctg

SEQ ID NO: 1987485 - DNA, 18 bp, Homo sapiens
gaaggcacaggtgtaaat

SEQ ID NO: 1987486 - DNA, 21 bp, Homo sapiens
gaaggcacaggtgtaaatata

SEQ ID NO: 1987487 - DNA, 14 bp, Homo sapiens
gaaggcagcattcc

SEQ ID NO: 1987488 - DNA, 14 bp, Homo sapiens
gaaggcagctgctc

SEQ ID NO: 1987489 - DNA, 17 bp, Homo sapiens
gaaggcaggcagggctc

SEQ ID NO: 1987490 - DNA, 18 bp, Homo sapiens
gaaggcaggcagggctct

SEQ ID NO: 1987491 - DNA, 19 bp, Homo sapiens
gaaggcaggcagggctctc

SEQ ID NO: 1987492 - DNA, 22 bp, Homo sapiens
gaaggcaggcagggctctcctg

SEQ ID NO: 1987493 - DNA, 16 bp, Homo sapiens
gaaggcagggaggagg

SEQ ID NO: 1987494 - DNA, 17 bp, Homo sapiens
gaaggcagggaggaggc

SEQ ID NO: 1987495 - DNA, 17 bp, Homo sapiens
gaaggcagggcagaggg

SEQ ID NO: 1987496 - DNA, 16 bp, Homo sapiens
gaaggcagtctgaacc

SEQ ID NO: 1987497 - DNA, 13 bp, Homo sapiens
gaaggccacatgt

SEQ ID NO: 1987498 - DNA, 21 bp, Homo sapiens
gaaggcctcttgtgctcacgc

SEQ ID NO: 1987499 - DNA, 13 bp, Homo sapiens
gaaggcgtgcaag

SEQ ID NO: 1987500 - DNA, 18 bp, Homo sapiens
gaaggcgtgcaaggggct

SEQ ID NO: 1987501 - DNA, 19 bp, Homo sapiens
gaaggctgcctaaggagga

SEQ ID NO: 1987502 - DNA, 13 bp, Homo sapiens
gaaggctgctgtg

SEQ ID NO: 1987503 - DNA, 14 bp, Homo sapiens
gaaggcttcctcca

SEQ ID NO: 1987504 - DNA, 20 bp, Homo sapiens
gaaggcttcctccagcggct

SEQ ID NO: 1987505 - DNA, 15 bp, Homo sapiens
gaagggaaaacagtc

SEQ ID NO: 1987506 - DNA, 16 bp, Homo sapiens
gaagggaggggtcctg

SEQ ID NO: 1987507 - DNA, 14 bp, Homo sapiens
gaagggcaccgaga

SEQ ID NO: 1987508 - DNA, 19 bp, Homo sapiens
gaagggcatccttctgcct

SEQ ID NO: 1987509 - DNA, 13 bp, Homo sapiens
gaagggccagccc

SEQ ID NO: 1987510 - DNA, 14 bp, Homo sapiens
gaagggccagccct

SEQ ID NO: 1987511 - DNA, 12 bp, Homo sapiens
gaagggccagga

SEQ ID NO: 1987512 - DNA, 21 bp, Homo sapiens
gaagggccaggagagagatct

SEQ ID NO: 1987513 - DNA, 14 bp, Homo sapiens
gaagggccagtctg

SEQ ID NO: 1987514 - DNA, 22 bp, Homo sapiens
gaagggctagaacctggagagc

SEQ ID NO: 1987515 - DNA, 20 bp, Homo sapiens
gaagggctagaacctggagg

SEQ ID NO: 1987516 - DNA, 14 bp, Homo sapiens
gaaggggccccggg

SEQ ID NO: 1987517 - DNA, 22 bp, Homo sapiens
gaaggggccccggggctggcaa

SEQ ID NO: 1987518 - DNA, 16 bp, Homo sapiens
gaagggggaagtctct

SEQ ID NO: 1987519 - DNA, 22 bp, Homo sapiens
gaagggggattggagggaagac

SEQ ID NO: 1987520 - DNA, 18 bp, Homo sapiens
gaagggggtccacccagc

SEQ ID NO: 1987521 - DNA, 13 bp, Homo sapiens
gaaggtagcccag

SEQ ID NO: 1987522 - DNA, 21 bp, Homo sapiens
gaaggtttttatgtgcctttt

SEQ ID NO: 1987523 - DNA, 19 bp, Homo sapiens
gaagtaaaagcaaaaaaga

SEQ ID NO: 1987524 - DNA, 17 bp, Homo sapiens
gaagtaaagtttatttc

SEQ ID NO: 1987525 - DNA, 20 bp, Homo sapiens
gaagtaaagtttatttcatg

SEQ ID NO: 1987526 - DNA, 23 bp, Homo sapiens
gaagtaagttctgaaaactgttt

SEQ ID NO: 1987527 - DNA, 15 bp, Homo sapiens
gaagtcactgcacag

SEQ ID NO: 1987528 - DNA, 22 bp, Homo sapiens
gaagtcagcccgaatgcctgtc

SEQ ID NO: 1987529 - DNA, 17 bp, Homo sapiens
gaagtcataaacagcat

SEQ ID NO: 1987530 - DNA, 16 bp, Homo sapiens
gaagtcattgtcgctc

SEQ ID NO: 1987531 - DNA, 21 bp, Homo sapiens
gaagtcattgtcgctcagcaa

SEQ ID NO: 1987532 - DNA, 20 bp, Homo sapiens
gaagtccctgttctcagctc

SEQ ID NO: 1987533 - DNA, 23 bp, Homo sapiens
gaagtcgtccttactcctgtggg

SEQ ID NO: 1987534 - DNA, 14 bp, Homo sapiens
gaagtgaaggagaa

SEQ ID NO: 1987535 - DNA, 15 bp, Homo sapiens
gaagtgaaggagaaa

SEQ ID NO: 1987536 - DNA, 21 bp, Homo sapiens
gaagtgaaggagaaaggagcc

SEQ ID NO: 1987537 - DNA, 20 bp, Homo sapiens
gaagtgatatcataaaagta

SEQ ID NO: 1987538 - DNA, 16 bp, Homo sapiens
gaagtgggccaggaca

SEQ ID NO: 1987539 - DNA, 19 bp, Homo sapiens
gaagtgggccaggacaggc

SEQ ID NO: 1987540 - DNA, 22 bp, Homo sapiens
gaagtgggggccgctggcccag

SEQ ID NO: 1987541 - DNA, 18 bp, Homo sapiens
gaagtggtaggaaagcct

SEQ ID NO: 1987542 - DNA, 16 bp, Homo sapiens
gaagtgtcgaaagcaa

SEQ ID NO: 1987543 - DNA, 15 bp, Homo sapiens
gaagtgtgtttcctt

SEQ ID NO: 1987544 - DNA, 19 bp, Homo sapiens
gaagtgttcaagaaataaa

SEQ ID NO: 1987545 - DNA, 15 bp, Homo sapiens
gaagttaacagagac

SEQ ID NO: 1987546 - DNA, 19 bp, Homo sapiens
gaagttagctttaacttaa

SEQ ID NO: 1987547 - DNA, 23 bp, Homo sapiens
gaagttattaacgggcatgtatt

SEQ ID NO: 1987548 - DNA, 17 bp, Homo sapiens
gaagttttgcatttatg

SEQ ID NO: 1987549 - DNA, 15 bp, Homo sapiens
gaataaaaaccctgt

SEQ ID NO: 1987550 - DNA, 13 bp, Homo sapiens
gaataaaattgta

SEQ ID NO: 1987551 - DNA, 13 bp, Homo sapiens
gaataaacttcag

SEQ ID NO: 1987552 - DNA, 14 bp, Homo sapiens
gaataaacttcagc

SEQ ID NO: 1987553 - DNA, 15 bp, Homo sapiens
gaataaacttcagca

SEQ ID NO: 1987554 - DNA, 16 bp, Homo sapiens
gaataaacttcagcac

SEQ ID NO: 1987555 - DNA, 18 bp, Homo sapiens
gaataaacttcagcacca

SEQ ID NO: 1987556 - DNA, 17 bp, Homo sapiens
gaataaagtctgagtgg

SEQ ID NO: 1987557 - DNA, 22 bp, Homo sapiens
gaataaccacttaaaaaatgtc

SEQ ID NO: 1987558 - DNA, 23 bp, Homo sapiens
gaataagaaaacaatcacactca

SEQ ID NO: 1987559 - DNA, 17 bp, Homo sapiens
gaataagaaagtttcac

SEQ ID NO: 1987560 - DNA, 16 bp, Homo sapiens
gaataagaatggagca

SEQ ID NO: 1987561 - DNA, 18 bp, Homo sapiens
gaataagctcccagggcc

SEQ ID NO: 1987562 - DNA, 23 bp, Homo sapiens
gaataatgagtctgcataaactt

SEQ ID NO: 1987563 - DNA, 13 bp, Homo sapiens
gaataatgtgtta

SEQ ID NO: 1987564 - DNA, 20 bp, Homo sapiens
gaataattatttatttaata

SEQ ID NO: 1987565 - DNA, 14 bp, Homo sapiens
gaataattgtgtac

SEQ ID NO: 1987566 - DNA, 16 bp, Homo sapiens
gaataattgtgtacaa

SEQ ID NO: 1987567 - DNA, 17 bp, Homo sapiens
gaataattgtgtacaaa

SEQ ID NO: 1987568 - DNA, 16 bp, Homo sapiens
gaatacaaacatattt

SEQ ID NO: 1987569 - DNA, 14 bp, Homo sapiens
gaatacagaaagat

SEQ ID NO: 1987570 - DNA, 21 bp, Homo sapiens
gaatacagtaagctgctctat

SEQ ID NO: 1987571 - DNA, 20 bp, Homo sapiens
gaatacagtgagtcctcctc

SEQ ID NO: 1987572 - DNA, 20 bp, Homo sapiens
gaatacagtgttattttctt

SEQ ID NO: 1987573 - DNA, 16 bp, Homo sapiens
gaatacccccagagac

SEQ ID NO: 1987574 - DNA, 17 bp, Homo sapiens
gaatacccccagagacc

SEQ ID NO: 1987575 - DNA, 21 bp, Homo sapiens
gaatacccccagagacctttt

SEQ ID NO: 1987576 - DNA, 22 bp, Homo sapiens
gaatagaaaagatgagaggcag

SEQ ID NO: 1987577 - DNA, 15 bp, Homo sapiens
gaatagatgctgact

SEQ ID NO: 1987578 - DNA, 19 bp, Homo sapiens
gaatagatgtgatcactga

SEQ ID NO: 1987579 - DNA, 18 bp, Homo sapiens
gaatagccagagaggagc

SEQ ID NO: 1987580 - DNA, 14 bp, Homo sapiens
gaatagctgggact

SEQ ID NO: 1987581 - DNA, 13 bp, Homo sapiens
gaatataaacact

SEQ ID NO: 1987582 - DNA, 21 bp, Homo sapiens
gaatataaacactatatggca

SEQ ID NO: 1987583 - DNA, 19 bp, Homo sapiens
gaatataattgttttatct

SEQ ID NO: 1987584 - DNA, 14 bp, Homo sapiens
gaatataggaagca

SEQ ID NO: 1987585 - DNA, 15 bp, Homo sapiens
gaatataggaagcat

SEQ ID NO: 1987586 - DNA, 18 bp, Homo sapiens
gaatatatcagaatctgt

SEQ ID NO: 1987587 - DNA, 23 bp, Homo sapiens
gaatatatcagaatctgtgtgaa

SEQ ID NO: 1987588 - DNA, 14 bp, Homo sapiens
gaatatgacagctg

SEQ ID NO: 1987589 - DNA, 16 bp, Homo sapiens
gaatatggacaaagaa

SEQ ID NO: 1987590 - DNA, 12 bp, Homo sapiens
gaatattcagga

SEQ ID NO: 1987591 - DNA, 12 bp, Homo sapiens
gaatatttatta

SEQ ID NO: 1987592 - DNA, 21 bp, Homo sapiens
gaatatttattacctctgata

SEQ ID NO: 1987593 - DNA, 17 bp, Homo sapiens
gaatatttcaaaataaa

SEQ ID NO: 1987594 - DNA, 15 bp, Homo sapiens
gaatcaaaactctcc

SEQ ID NO: 1987595 - DNA, 22 bp, Homo sapiens
gaatcaaagcagttaactttaa

SEQ ID NO: 1987596 - DNA, 23 bp, Homo sapiens
gaatcaagagggcagcccccact

SEQ ID NO: 1987597 - DNA, 21 bp, Homo sapiens
gaatcaagatgtcagactggc

SEQ ID NO: 1987598 - DNA, 22 bp, Homo sapiens
gaatcaaggaatcctgagtctg

SEQ ID NO: 1987599 - DNA, 14 bp, Homo sapiens
gaatcaataaaaat

SEQ ID NO: 1987600 - DNA, 18 bp, Homo sapiens
gaatcaatttcccagaag

SEQ ID NO: 1987601 - DNA, 23 bp, Homo sapiens
gaatcagaccctaccccaccacg

SEQ ID NO: 1987602 - DNA, 15 bp, Homo sapiens
gaatcagattattaa

SEQ ID NO: 1987603 - DNA, 19 bp, Homo sapiens
gaatcagctgcagctgctt

SEQ ID NO: 1987604 - DNA, 21 bp, Homo sapiens
gaatcagcttttaataaaatt

SEQ ID NO: 1987605 - DNA, 10 bp, Homo sapiens
gaatcataat

SEQ ID NO: 1987606 - DNA, 16 bp, Homo sapiens
gaatcataattttcaa

SEQ ID NO: 1987607 - DNA, 19 bp, Homo sapiens
gaatcatacttagcaaagt

SEQ ID NO: 1987608 - DNA, 23 bp, Homo sapiens
gaatcatgatctgactttaattg

SEQ ID NO: 1987609 - DNA, 17 bp, Homo sapiens
gaatcatgtcaggcctg

SEQ ID NO: 1987610 - DNA, 15 bp, Homo sapiens
gaatccacccatcct

SEQ ID NO: 1987611 - DNA, 13 bp, Homo sapiens
gaatccatgcttg

SEQ ID NO: 1987612 - DNA, 14 bp, Homo sapiens
gaatccatgcttgg

SEQ ID NO: 1987613 - DNA, 22 bp, Homo sapiens
gaatcccacccacatgtgacac

SEQ ID NO: 1987614 - DNA, 18 bp, Homo sapiens
gaatccgcctgcagagga

SEQ ID NO: 1987615 - DNA, 12 bp, Homo sapiens
gaatcctgcctc

SEQ ID NO: 1987616 - DNA, 22 bp, Homo sapiens
gaatcctgtcgattagactgga

SEQ ID NO: 1987617 - DNA, 19 bp, Homo sapiens
gaatcgatctgtactgtaa

SEQ ID NO: 1987618 - DNA, 16 bp, Homo sapiens
gaatctacagaacaaa

SEQ ID NO: 1987619 - DNA, 19 bp, Homo sapiens
gaatctagataggtgcttt

SEQ ID NO: 1987620 - DNA, 13 bp, Homo sapiens
gaatctatattta

SEQ ID NO: 1987621 - DNA, 19 bp, Homo sapiens
gaatctcccctcctcacag

SEQ ID NO: 1987622 - DNA, 18 bp, Homo sapiens
gaatctgataggaaaaga

SEQ ID NO: 1987623 - DNA, 19 bp, Homo sapiens
gaatctgcctgtggccttg

SEQ ID NO: 1987624 - DNA, 21 bp, Homo sapiens
gaatctgcctgtggccttgcc

SEQ ID NO: 1987625 - DNA, 21 bp, Homo sapiens
gaatctgctgttgccatagcc

SEQ ID NO: 1987626 - DNA, 23 bp, Homo sapiens
gaatctgttactgaaatgaggag

SEQ ID NO: 1987627 - DNA, 16 bp, Homo sapiens
gaatgaaaattgtatg

SEQ ID NO: 1987628 - DNA, 14 bp, Homo sapiens
gaatgaaagggccc

SEQ ID NO: 1987629 - DNA, 15 bp, Homo sapiens
gaatgaagcatgtag

SEQ ID NO: 1987630 - DNA, 14 bp, Homo sapiens
gaatgaattaaata

SEQ ID NO: 1987631 - DNA, 16 bp, Homo sapiens
gaatgaccagcatgat

SEQ ID NO: 1987632 - DNA, 18 bp, Homo sapiens
gaatgaccttgttgcatg

SEQ ID NO: 1987633 - DNA, 14 bp, Homo sapiens
gaatgagagtgtga

SEQ ID NO: 1987634 - DNA, 19 bp, Homo sapiens
gaatgaggtcccaggcaga

SEQ ID NO: 1987635 - DNA, 21 bp, Homo sapiens
gaatgaggtcccaggcagaga

SEQ ID NO: 1987636 - DNA, 22 bp, Homo sapiens
gaatgaggtcccaggcagagaa

SEQ ID NO: 1987637 - DNA, 13 bp, Homo sapiens
cttgactccttgt

SEQ ID NO: 1987638 - DNA, 19 bp, Homo sapiens
cttgactctactgatctga

SEQ ID NO: 1987639 - DNA, 11 bp, Homo sapiens
cttgagaaacc

SEQ ID NO: 1987640 - DNA, 22 bp, Homo sapiens
cttgagagaaaaagtgcccctt

SEQ ID NO: 1987641 - DNA, 13 bp, Homo sapiens
cttgagcagaccg

SEQ ID NO: 1987642 - DNA, 11 bp, Homo sapiens
cttgagcccag

SEQ ID NO: 1987643 - DNA, 20 bp, Homo sapiens
cttgagcccaggagtttgag

SEQ ID NO: 1987644 - DNA, 19 bp, Homo sapiens
cttgagcctccatttctgg

SEQ ID NO: 1987645 - DNA, 14 bp, Homo sapiens
cttgagctgtatat

SEQ ID NO: 1987646 - DNA, 16 bp, Homo sapiens
cttgaggacacatgtc

SEQ ID NO: 1987647 - DNA, 22 bp, Homo sapiens
cttgaggaggggcacctgccac

SEQ ID NO: 1987648 - DNA, 23 bp, Homo sapiens
cttgaggaggggcacctgccacc

SEQ ID NO: 1987649 - DNA, 16 bp, Homo sapiens
cttgaggattttgagt

SEQ ID NO: 1987650 - DNA, 17 bp, Homo sapiens
cttgaggattttgagta

SEQ ID NO: 1987651 - DNA, 18 bp, Homo sapiens
cttgaggctggcactccc

SEQ ID NO: 1987652 - DNA, 23 bp, Homo sapiens
cttgagtctttaatcccagtttg

SEQ ID NO: 1987653 - DNA, 15 bp, Homo sapiens
cttgatctgtatata

SEQ ID NO: 1987654 - DNA, 22 bp, Homo sapiens
cttgatctgtatatacaataac

SEQ ID NO: 1987655 - DNA, 15 bp, Homo sapiens
cttgatgaagcccgt

SEQ ID NO: 1987656 - DNA, 20 bp, Homo sapiens
cttgatgaagcctgtgccac

SEQ ID NO: 1987657 - DNA, 16 bp, Homo sapiens
cttgcaagcagcctcc

SEQ ID NO: 1987658 - DNA, 14 bp, Homo sapiens
cttgcaatggcagc

SEQ ID NO: 1987659 - DNA, 15 bp, Homo sapiens
cttgcaatggcagcc

SEQ ID NO: 1987660 - DNA, 17 bp, Homo sapiens
cttgcacaagcttgtat

SEQ ID NO: 1987661 - DNA, 23 bp, Homo sapiens
cttgcacaagcttgtatatacat

SEQ ID NO: 1987662 - DNA, 18 bp, Homo sapiens
cttgcacccctcactctg

SEQ ID NO: 1987663 - DNA, 20 bp, Homo sapiens
cttgcacccctcactctggc

SEQ ID NO: 1987664 - DNA, 14 bp, Homo sapiens
cttgcacctgcatc

SEQ ID NO: 1987665 - DNA, 21 bp, Homo sapiens
cttgcactaaagtatgtaaag

SEQ ID NO: 1987666 - DNA, 17 bp, Homo sapiens
cttgcagatcatctggg

SEQ ID NO: 1987667 - DNA, 17 bp, Homo sapiens
cttgcagtcatcagaag

SEQ ID NO: 1987668 - DNA, 23 bp, Homo sapiens
cttgcatcaatttttcttatttc

SEQ ID NO: 1987669 - DNA, 19 bp, Homo sapiens
cttgcatcctcctcccaac

SEQ ID NO: 1987670 - DNA, 14 bp, Homo sapiens
cttgcattcccagt

SEQ ID NO: 1987671 - DNA, 22 bp, Homo sapiens
cttgccaaattccatgtccctg

SEQ ID NO: 1987672 - DNA, 21 bp, Homo sapiens
cttgccaccggggaacccagc

SEQ ID NO: 1987673 - DNA, 13 bp, Homo sapiens
cttgccagccaga

SEQ ID NO: 1987674 - DNA, 19 bp, Homo sapiens
cttgcccagagatgcctcc

SEQ ID NO: 1987675 - DNA, 23 bp, Homo sapiens
cttgcccagagatgcctccaccg

SEQ ID NO: 1987676 - DNA, 14 bp, Homo sapiens
cttgcccagggctc

SEQ ID NO: 1987677 - DNA, 15 bp, Homo sapiens
cttgcccagggctca

SEQ ID NO: 1987678 - DNA, 16 bp, Homo sapiens
cttgcccagggctcag

SEQ ID NO: 1987679 - DNA, 18 bp, Homo sapiens
cttgcccagggctcagcc

SEQ ID NO: 1987680 - DNA, 19 bp, Homo sapiens
cttgcccagggctcagcct

SEQ ID NO: 1987681 - DNA, 21 bp, Homo sapiens
cttgcccagggctcagcctgg

SEQ ID NO: 1987682 - DNA, 15 bp, Homo sapiens
cttgcccccatccct

SEQ ID NO: 1987683 - DNA, 17 bp, Homo sapiens
cttgccccttgggcctc

SEQ ID NO: 1987684 - DNA, 15 bp, Homo sapiens
cttgcccgccagcct

SEQ ID NO: 1987685 - DNA, 17 bp, Homo sapiens
cttgcccgccagcctca

SEQ ID NO: 1987686 - DNA, 19 bp, Homo sapiens
cttgcccgccagcctcagt

SEQ ID NO: 1987687 - DNA, 12 bp, Homo sapiens
cttgccctgacc

SEQ ID NO: 1987688 - DNA, 15 bp, Homo sapiens
cttgcccttgccctg

SEQ ID NO: 1987689 - DNA, 16 bp, Homo sapiens
cttgcccttgccctga

SEQ ID NO: 1987690 - DNA, 15 bp, Homo sapiens
cttgccgagagaggc

SEQ ID NO: 1987691 - DNA, 16 bp, Homo sapiens
cttgccgagagaggcg

SEQ ID NO: 1987692 - DNA, 19 bp, Homo sapiens
cttgccgagcctaatgaaa

SEQ ID NO: 1987693 - DNA, 14 bp, Homo sapiens
cttgcctaggccaa

SEQ ID NO: 1987694 - DNA, 13 bp, Homo sapiens
cttgcctctctca

SEQ ID NO: 1987695 - DNA, 12 bp, Homo sapiens
cttgcctgaggc

SEQ ID NO: 1987696 - DNA, 15 bp, Homo sapiens
cttgcctgaggctca

SEQ ID NO: 1987697 - DNA, 20 bp, Homo sapiens
cttgcctgcacccttcctcc

SEQ ID NO: 1987698 - DNA, 19 bp, Homo sapiens
cttgccttcttcacccagc

SEQ ID NO: 1987699 - DNA, 17 bp, Homo sapiens
cttgcctttccacctgc

SEQ ID NO: 1987700 - DNA, 20 bp, Homo sapiens
cttgcctttccacctgcttt

SEQ ID NO: 1987701 - DNA, 21 bp, Homo sapiens
cttgcctttcttatttgcaat

SEQ ID NO: 1987702 - DNA, 16 bp, Homo sapiens
cttgcgaccatgtgta

SEQ ID NO: 1987703 - DNA, 15 bp, Homo sapiens
cttgcgtcctgcaga

SEQ ID NO: 1987704 - DNA, 18 bp, Homo sapiens
cttgcgtcctgcagagga

SEQ ID NO: 1987705 - DNA, 19 bp, Homo sapiens
cttgcgtcctgcagaggac

SEQ ID NO: 1987706 - DNA, 22 bp, Homo sapiens
cttgctatttgagcatgcacag

SEQ ID NO: 1987707 - DNA, 14 bp, Homo sapiens
cttgctcagtgcct

SEQ ID NO: 1987708 - DNA, 16 bp, Homo sapiens
cttgctcagtgcctcc

SEQ ID NO: 1987709 - DNA, 20 bp, Homo sapiens
cttgctcagtgcctcctggc

SEQ ID NO: 1987710 - DNA, 21 bp, Homo sapiens
cttgctcagtgcctcctggcc

SEQ ID NO: 1987711 - DNA, 21 bp, Homo sapiens
cttgctccagggtcttgggct

SEQ ID NO: 1987712 - DNA, 19 bp, Homo sapiens
cttgctctcccctgccctg

SEQ ID NO: 1987713 - DNA, 15 bp, Homo sapiens
cttgctctctggcct

SEQ ID NO: 1987714 - DNA, 22 bp, Homo sapiens
cttgctctctggccttttccta

SEQ ID NO: 1987715 - DNA, 14 bp, Homo sapiens
cttgctctgctgac

SEQ ID NO: 1987716 - DNA, 17 bp, Homo sapiens
cttgctctgctgacaga

SEQ ID NO: 1987717 - DNA, 22 bp, Homo sapiens
cttgctctgctgacagacacag

SEQ ID NO: 1987718 - DNA, 19 bp, Homo sapiens
cttgctcttcagtgggaga

SEQ ID NO: 1987719 - DNA, 12 bp, Homo sapiens
cttgctcttctt

SEQ ID NO: 1987720 - DNA, 16 bp, Homo sapiens
cttgctggattaatgt

SEQ ID NO: 1987721 - DNA, 19 bp, Homo sapiens
cttgctgtaactcagacat

SEQ ID NO: 1987722 - DNA, 20 bp, Homo sapiens
cttgctgtcctaggccacac

SEQ ID NO: 1987723 - DNA, 23 bp, Homo sapiens
cttgcttagtatggttctcagat

SEQ ID NO: 1987724 - DNA, 15 bp, Homo sapiens
cttgcttctgcagca

SEQ ID NO: 1987725 - DNA, 13 bp, Homo sapiens
cttgcttgtcttt

SEQ ID NO: 1987726 - DNA, 18 bp, Homo sapiens
cttgctttgctgtctggt

SEQ ID NO: 1987727 - DNA, 12 bp, Homo sapiens
cttgctttgggc

SEQ ID NO: 1987728 - DNA, 21 bp, Homo sapiens
cttgctttgggctttgcaggc

SEQ ID NO: 1987729 - DNA, 16 bp, Homo sapiens
cttggaaaaaaattac

SEQ ID NO: 1987730 - DNA, 21 bp, Homo sapiens
cttggaaaaagaaagaaacac

SEQ ID NO: 1987731 - DNA, 20 bp, Homo sapiens
cttggaaaaatccagaaaga

SEQ ID NO: 1987732 - DNA, 21 bp, Homo sapiens
cttggaaagcatcacctcagg

SEQ ID NO: 1987733 - DNA, 22 bp, Homo sapiens
cttggaaagcatcacctcaggc

SEQ ID NO: 1987734 - DNA, 18 bp, Homo sapiens
cttggaaagttcagccag

SEQ ID NO: 1987735 - DNA, 13 bp, Homo sapiens
cttggaagctccg

SEQ ID NO: 1987736 - DNA, 14 bp, Homo sapiens
cttggaagctccgc

SEQ ID NO: 1987737 - DNA, 12 bp, Homo sapiens
cttggaatgaat

SEQ ID NO: 1987738 - DNA, 22 bp, Homo sapiens
cttggaatgaattctctctaaa

SEQ ID NO: 1987739 - DNA, 16 bp, Homo sapiens
cttggacctctgctct

SEQ ID NO: 1987740 - DNA, 17 bp, Homo sapiens
cttggacctctgctctg

SEQ ID NO: 1987741 - DNA, 19 bp, Homo sapiens
cttggacctctgctctgag

SEQ ID NO: 1987742 - DNA, 16 bp, Homo sapiens
cttggactcattttaa

SEQ ID NO: 1987743 - DNA, 14 bp, Homo sapiens
cttggactcctccc

SEQ ID NO: 1987744 - DNA, 15 bp, Homo sapiens
cttggactcctccca

SEQ ID NO: 1987745 - DNA, 13 bp, Homo sapiens
cttggacttcctg

SEQ ID NO: 1987746 - DNA, 16 bp, Homo sapiens
cttggacttcctgggg

SEQ ID NO: 1987747 - DNA, 22 bp, Homo sapiens
cttggagagggacgaagaaagg

SEQ ID NO: 1987748 - DNA, 18 bp, Homo sapiens
cttggagcccgtgcagta

SEQ ID NO: 1987749 - DNA, 18 bp, Homo sapiens
cttggagcctgaacatga

SEQ ID NO: 1987750 - DNA, 12 bp, Homo sapiens
cttggaggacag

SEQ ID NO: 1987751 - DNA, 22 bp, Homo sapiens
cttggcatcacagggcagagcc

SEQ ID NO: 1987752 - DNA, 15 bp, Homo sapiens
cttggcccctgtgtg

SEQ ID NO: 1987753 - DNA, 21 bp, Homo sapiens
cttggccgccatccgggacgc

SEQ ID NO: 1987754 - DNA, 23 bp, Homo sapiens
cttctccttggaggacagtggga

SEQ ID NO: 1987755 - DNA, 22 bp, Homo sapiens
cttctcctttcacaaccttctg

SEQ ID NO: 1987756 - DNA, 15 bp, Homo sapiens
cttctcgcattttct

SEQ ID NO: 1987757 - DNA, 11 bp, Homo sapiens
cttctctacag

SEQ ID NO: 1987758 - DNA, 13 bp, Homo sapiens
cttctctacagac

SEQ ID NO: 1987759 - DNA, 12 bp, Homo sapiens
cttctctaccca

SEQ ID NO: 1987760 - DNA, 18 bp, Homo sapiens
cttctctacccatctccc

SEQ ID NO: 1987761 - DNA, 19 bp, Homo sapiens
cttctctattcctgaccct

SEQ ID NO: 1987762 - DNA, 11 bp, Homo sapiens
cttctctccag

SEQ ID NO: 1987763 - DNA, 14 bp, Homo sapiens
cttctctccttccc

SEQ ID NO: 1987764 - DNA, 16 bp, Homo sapiens
cttctctccttccctc

SEQ ID NO: 1987765 - DNA, 21 bp, Homo sapiens
cttctctcggggcgacccctc

SEQ ID NO: 1987766 - DNA, 13 bp, Homo sapiens
cttctctctctgg

SEQ ID NO: 1987767 - DNA, 14 bp, Homo sapiens
cttctctctctggt

SEQ ID NO: 1987768 - DNA, 22 bp, Homo sapiens
cttctctgggggcctctttctg

SEQ ID NO: 1987769 - DNA, 22 bp, Homo sapiens
cttctctgtgaacgatttagaa

SEQ ID NO: 1987770 - DNA, 13 bp, Homo sapiens
cttctctgttcat

SEQ ID NO: 1987771 - DNA, 21 bp, Homo sapiens
cttctcttacgctctctgtct

SEQ ID NO: 1987772 - DNA, 13 bp, Homo sapiens
cttctcttcctgt

SEQ ID NO: 1987773 - DNA, 13 bp, Homo sapiens
cttctctttctta

SEQ ID NO: 1987774 - DNA, 22 bp, Homo sapiens
cttctctttcttattttgtaat

SEQ ID NO: 1987775 - DNA, 15 bp, Homo sapiens
cttctgaaatgaaac

SEQ ID NO: 1987776 - DNA, 23 bp, Homo sapiens
cttctgaaatgaaacaaataatc

SEQ ID NO: 1987777 - DNA, 15 bp, Homo sapiens
cttctgaagatctca

SEQ ID NO: 1987778 - DNA, 13 bp, Homo sapiens
cttctgacctccc

SEQ ID NO: 1987779 - DNA, 13 bp, Homo sapiens
cttctgactgctg

SEQ ID NO: 1987780 - DNA, 21 bp, Homo sapiens
cttctgactgctgattctccc

SEQ ID NO: 1987781 - DNA, 14 bp, Homo sapiens
cttctgcacccaga

SEQ ID NO: 1987782 - DNA, 23 bp, Homo sapiens
cttctgcagcaactcccacgact

SEQ ID NO: 1987783 - DNA, 10 bp, Homo sapiens
cttctgcagt

SEQ ID NO: 1987784 - DNA, 14 bp, Homo sapiens
cttctgccaagaga

SEQ ID NO: 1987785 - DNA, 19 bp, Homo sapiens
cttctgccccagctttatc

SEQ ID NO: 1987786 - DNA, 13 bp, Homo sapiens
cttctgccttttt

SEQ ID NO: 1987787 - DNA, 17 bp, Homo sapiens
cttctgctggataaaat

SEQ ID NO: 1987788 - DNA, 18 bp, Homo sapiens
cttctgcttcagcctccc

SEQ ID NO: 1987789 - DNA, 15 bp, Homo sapiens
cttctgcttctccct

SEQ ID NO: 1987790 - DNA, 17 bp, Homo sapiens
cttctggaaggctggct

SEQ ID NO: 1987791 - DNA, 22 bp, Homo sapiens
cttctggaaggctggctgagtg

SEQ ID NO: 1987792 - DNA, 20 bp, Homo sapiens
cttctggagtctccagtggt

SEQ ID NO: 1987793 - DNA, 17 bp, Homo sapiens
cttctggcacttggaga

SEQ ID NO: 1987794 - DNA, 22 bp, Homo sapiens
cttctggctcctccttcccctg

SEQ ID NO: 1987795 - DNA, 14 bp, Homo sapiens
cttctggcttcctt

SEQ ID NO: 1987796 - DNA, 17 bp, Homo sapiens
cttctgggacctgtgtt

SEQ ID NO: 1987797 - DNA, 15 bp, Homo sapiens
cttctgggtggctcc

SEQ ID NO: 1987798 - DNA, 16 bp, Homo sapiens
cttctgggtggctcct

SEQ ID NO: 1987799 - DNA, 18 bp, Homo sapiens
cttctgggtggctcctgc

SEQ ID NO: 1987800 - DNA, 23 bp, Homo sapiens
cttctgggtggctcctgccactg

SEQ ID NO: 1987801 - DNA, 14 bp, Homo sapiens
cttctgtacgtctg

SEQ ID NO: 1987802 - DNA, 18 bp, Homo sapiens
cttctgtacgtctgacag

SEQ ID NO: 1987803 - DNA, 18 bp, Homo sapiens
cttctgtatactgtggag

SEQ ID NO: 1987804 - DNA, 21 bp, Homo sapiens
cttctgtcctactctgtgtca

SEQ ID NO: 1987805 - DNA, 22 bp, Homo sapiens
cttctgtcttcacaacagatta

SEQ ID NO: 1987806 - DNA, 13 bp, Homo sapiens
cttctgtggctca

SEQ ID NO: 1987807 - DNA, 22 bp, Homo sapiens
cttctgtggctcacagaaccct

SEQ ID NO: 1987808 - DNA, 13 bp, Homo sapiens
cttctgtgtcaca

SEQ ID NO: 1987809 - DNA, 12 bp, Homo sapiens
cttctgttctca

SEQ ID NO: 1987810 - DNA, 19 bp, Homo sapiens
cttcttaaaggcctggaac

SEQ ID NO: 1987811 - DNA, 23 bp, Homo sapiens
cttcttattcatgctttctcctt

SEQ ID NO: 1987812 - DNA, 14 bp, Homo sapiens
cttcttattctcac

SEQ ID NO: 1987813 - DNA, 14 bp, Homo sapiens
cttcttcacccagc

SEQ ID NO: 1987814 - DNA, 15 bp, Homo sapiens
cttcttcacccagct

SEQ ID NO: 1987815 - DNA, 18 bp, Homo sapiens
cttcttcacccagctaat

SEQ ID NO: 1987816 - DNA, 14 bp, Homo sapiens
cttcttcagggact

SEQ ID NO: 1987817 - DNA, 15 bp, Homo sapiens
cttcttcatcttgac

SEQ ID NO: 1987818 - DNA, 16 bp, Homo sapiens
cttcttcatcttgaca

SEQ ID NO: 1987819 - DNA, 21 bp, Homo sapiens
cttcttccctaatcagctccc

SEQ ID NO: 1987820 - DNA, 12 bp, Homo sapiens
cttcttccctgt

SEQ ID NO: 1987821 - DNA, 20 bp, Homo sapiens
cttcttccctgttttaaatt

SEQ ID NO: 1987822 - DNA, 21 bp, Homo sapiens
cttcttccctgttttaaatta

SEQ ID NO: 1987823 - DNA, 20 bp, Homo sapiens
cttcttcgcaaactgatgga

SEQ ID NO: 1987824 - DNA, 21 bp, Homo sapiens
cttcttctacttcagtcttct

SEQ ID NO: 1987825 - DNA, 17 bp, Homo sapiens
cttcttgccccttgggc

SEQ ID NO: 1987826 - DNA, 16 bp, Homo sapiens
cttcttggcttctggg

SEQ ID NO: 1987827 - DNA, 16 bp, Homo sapiens
cttcttggtcttattt

SEQ ID NO: 1987828 - DNA, 19 bp, Homo sapiens
cttcttggtttggggagaa

SEQ ID NO: 1987829 - DNA, 15 bp, Homo sapiens
cttcttgtgtcctga

SEQ ID NO: 1987830 - DNA, 14 bp, Homo sapiens
cttctttaaatcaa

SEQ ID NO: 1987831 - DNA, 17 bp, Homo sapiens
cttctttaaatcaaaag

SEQ ID NO: 1987832 - DNA, 22 bp, Homo sapiens
cttctttaaatcaaaagctgct

SEQ ID NO: 1987833 - DNA, 15 bp, Homo sapiens
cttctttcctcttcc

SEQ ID NO: 1987834 - DNA, 19 bp, Homo sapiens
cttctttctcttccctcct

SEQ ID NO: 1987835 - DNA, 16 bp, Homo sapiens
cttctttgcagagcct

SEQ ID NO: 1987836 - DNA, 20 bp, Homo sapiens
cttctttttattttcttttg

SEQ ID NO: 1987837 - DNA, 17 bp, Homo sapiens
cttgaaaaaatgttcta

SEQ ID NO: 1987838 - DNA, 22 bp, Homo sapiens
cttgaaaacctcatttaccata

SEQ ID NO: 1987839 - DNA, 15 bp, Homo sapiens
cttgaaacagcctgg

SEQ ID NO: 1987840 - DNA, 20 bp, Homo sapiens
cttgaaagcagttaaactga

SEQ ID NO: 1987841 - DNA, 17 bp, Homo sapiens
cttgaaattatatctgt

SEQ ID NO: 1987842 - DNA, 20 bp, Homo sapiens
cttgaaattatatctgtggt

SEQ ID NO: 1987843 - DNA, 17 bp, Homo sapiens
cttgaactcctggcctc

SEQ ID NO: 1987844 - DNA, 18 bp, Homo sapiens
cttgaactcctggcctca

SEQ ID NO: 1987845 - DNA, 22 bp, Homo sapiens
cttgaactgttctggcctcaga

SEQ ID NO: 1987846 - DNA, 13 bp, Homo sapiens
cttgaactttcca

SEQ ID NO: 1987847 - DNA, 12 bp, Homo sapiens
cttgaagaatat

SEQ ID NO: 1987848 - DNA, 23 bp, Homo sapiens
cttgaagaggggaggggcctagg

SEQ ID NO: 1987849 - DNA, 13 bp, Homo sapiens
cttgaagccactg

SEQ ID NO: 1987850 - DNA, 21 bp, Homo sapiens
cttgaagccactgaagctggg

SEQ ID NO: 1987851 - DNA, 16 bp, Homo sapiens
cttgaaggaacagtgc

SEQ ID NO: 1987852 - DNA, 16 bp, Homo sapiens
cttgaagtaaccttat

SEQ ID NO: 1987853 - DNA, 19 bp, Homo sapiens
cttgaatctgttactgaaa

SEQ ID NO: 1987854 - DNA, 14 bp, Homo sapiens
cttgacaacagact

SEQ ID NO: 1987855 - DNA, 15 bp, Homo sapiens
cttgacaacagactg

SEQ ID NO: 1987856 - DNA, 20 bp, Homo sapiens
cttgacacggtgaaatccag

SEQ ID NO: 1987857 - DNA, 14 bp, Homo sapiens
cttgacagaacact

SEQ ID NO: 1987858 - DNA, 16 bp, Homo sapiens
cttgacagaacactgt

SEQ ID NO: 1987859 - DNA, 13 bp, Homo sapiens
cttgacagggcac

SEQ ID NO: 1987860 - DNA, 15 bp, Homo sapiens
cttgacagggcacac

SEQ ID NO: 1987861 - DNA, 20 bp, Homo sapiens
cttgacagggcacaccgggc

SEQ ID NO: 1987862 - DNA, 14 bp, Homo sapiens
cttgacatgtaatg

SEQ ID NO: 1987863 - DNA, 12 bp, Homo sapiens
cttgacattcct

SEQ ID NO: 1987864 - DNA, 13 bp, Homo sapiens
cttgaccagacct

SEQ ID NO: 1987865 - DNA, 14 bp, Homo sapiens
cttgaccagaccta

SEQ ID NO: 1987866 - DNA, 21 bp, Homo sapiens
cttgaccagacctagacctgg

SEQ ID NO: 1987867 - DNA, 12 bp, Homo sapiens
cttgacctccta

SEQ ID NO: 1987868 - DNA, 18 bp, Homo sapiens
cttgaccttttcgacgct

SEQ ID NO: 1987869 - DNA, 17 bp, Homo sapiens
cttgactatcacataca

SEQ ID NO: 1987870 - DNA, 23 bp, Homo sapiens
cttgactatcacatacaatttgc

SEQ ID NO: 1987871 - DNA, 18 bp, Homo sapiens
ctgtagccatggctcagg

SEQ ID NO: 1987872 - DNA, 24 bp, Homo sapiens
ctgtagccatggctcaggcaagcc

SEQ ID NO: 1987873 - DNA, 17 bp, Homo sapiens
ctgtagccccagtgaca

SEQ ID NO: 1987874 - DNA, 19 bp, Homo sapiens
ctgtagctcccgagctact

SEQ ID NO: 1987875 - DNA, 15 bp, Homo sapiens
ctgtagctctgcctc

SEQ ID NO: 1987876 - DNA, 17 bp, Homo sapiens
ctgtagggctggaccta

SEQ ID NO: 1987877 - DNA, 21 bp, Homo sapiens
ctgtaggtggaagaaatttag

SEQ ID NO: 1987878 - DNA, 23 bp, Homo sapiens
ctgtaggtggtgttgagaaagaa

SEQ ID NO: 1987879 - DNA, 13 bp, Homo sapiens
ctgtagtcacttt

SEQ ID NO: 1987880 - DNA, 23 bp, Homo sapiens
ctgtagtcccagccactcgggag

SEQ ID NO: 1987881 - DNA, 22 bp, Homo sapiens
ctgtagtcctagccactcagga

SEQ ID NO: 1987882 - DNA, 19 bp, Homo sapiens
ctgtagtgagaaactgatt

SEQ ID NO: 1987883 - DNA, 14 bp, Homo sapiens
ctgtagttaggaaa

SEQ ID NO: 1987884 - DNA, 17 bp, Homo sapiens
ctgtagttaggaaataa

SEQ ID NO: 1987885 - DNA, 15 bp, Homo sapiens
ctgtatatacaataa

SEQ ID NO: 1987886 - DNA, 19 bp, Homo sapiens
ctgtatatacaataacata

SEQ ID NO: 1987887 - DNA, 15 bp, Homo sapiens
ctgtatatacatttc

SEQ ID NO: 1987888 - DNA, 16 bp, Homo sapiens
ctgtatatgttgtaat

SEQ ID NO: 1987889 - DNA, 17 bp, Homo sapiens
ctgtatatgttgtaata

SEQ ID NO: 1987890 - DNA, 13 bp, Homo sapiens
ctgtatattatgg

SEQ ID NO: 1987891 - DNA, 21 bp, Homo sapiens
ctgtatcccatgagcctcagc

SEQ ID NO: 1987892 - DNA, 17 bp, Homo sapiens
ctgtatcggagacagtg

SEQ ID NO: 1987893 - DNA, 13 bp, Homo sapiens
ctgtatgcagttt

SEQ ID NO: 1987894 - DNA, 12 bp, Homo sapiens
ctgtattcagat

SEQ ID NO: 1987895 - DNA, 20 bp, Homo sapiens
ctgtattcagatcgtattaa

SEQ ID NO: 1987896 - DNA, 22 bp, Homo sapiens
ctgtattcagatcgtattaatt

SEQ ID NO: 1987897 - DNA, 18 bp, Homo sapiens
ctgtatttgttcccaaga

SEQ ID NO: 1987898 - DNA, 19 bp, Homo sapiens
ctgtatttgttcccaagag

SEQ ID NO: 1987899 - DNA, 19 bp, Homo sapiens
ctgtattttcatttaacta

SEQ ID NO: 1987900 - DNA, 15 bp, Homo sapiens
ctgtatttttagaga

SEQ ID NO: 1987901 - DNA, 20 bp, Homo sapiens
ctgtcaagtcatgatggaga

SEQ ID NO: 1987902 - DNA, 14 bp, Homo sapiens
cttctccactggat

SEQ ID NO: 1987903 - DNA, 15 bp, Homo sapiens
cttctccactggatg

SEQ ID NO: 1987904 - DNA, 14 bp, Homo sapiens
cttctccaggctgt

SEQ ID NO: 1987905 - DNA, 15 bp, Homo sapiens
cttctccctggctga

SEQ ID NO: 1987906 - DNA, 13 bp, Homo sapiens
cttctcctccagg

SEQ ID NO: 1987907 - DNA, 16 bp, Homo sapiens
cttctcctctcctagc

SEQ ID NO: 1987908 - DNA, 20 bp, Homo sapiens
cttctcctgaagttcagcca

SEQ ID NO: 1987909 - DNA, 15 bp, Homo sapiens
cttctcctgcctaca

SEQ ID NO: 1987910 - DNA, 13 bp, Homo sapiens
cttctcctgtgac

SEQ ID NO: 1987911 - DNA, 17 bp, Homo sapiens
ctggactgggaggtaga

SEQ ID NO: 1987912 - DNA, 20 bp, Homo sapiens
ctggactgggttttgtctct

SEQ ID NO: 1987913 - DNA, 18 bp, Homo sapiens
ctggactgtcatagaaat

SEQ ID NO: 1987914 - DNA, 14 bp, Homo sapiens
ctggagaactagag

SEQ ID NO: 1987915 - DNA, 19 bp, Homo sapiens
ctggagaagctgatgcttt

SEQ ID NO: 1987916 - DNA, 21 bp, Homo sapiens
ctggagaccgcttcacccctg

SEQ ID NO: 1987917 - DNA, 22 bp, Homo sapiens
ctggagaccgcttcacccctgc

SEQ ID NO: 1987918 - DNA, 23 bp, Homo sapiens
ctggagagccagaacctggaggg

SEQ ID NO: 1987919 - DNA, 19 bp, Homo sapiens
ctggagagctagaacctgg

SEQ ID NO: 1987920 - DNA, 14 bp, Homo sapiens
ctggagatgatgat

SEQ ID NO: 1987921 - DNA, 19 bp, Homo sapiens
ctggagatttcagttactt

SEQ ID NO: 1987922 - DNA, 23 bp, Homo sapiens
ctggagcaagaaggaaggaggca

SEQ ID NO: 1987923 - DNA, 17 bp, Homo sapiens
ctggagcaagagagagc

SEQ ID NO: 1987924 - DNA, 18 bp, Homo sapiens
ctggagcaagagagagct

SEQ ID NO: 1987925 - DNA, 13 bp, Homo sapiens
ctggagcaccagg

SEQ ID NO: 1987926 - DNA, 15 bp, Homo sapiens
ctggagcaccaggca

SEQ ID NO: 1987927 - DNA, 15 bp, Homo sapiens
ctggagcatcccagg

SEQ ID NO: 1987928 - DNA, 16 bp, Homo sapiens
ctggagcatctgactc

SEQ ID NO: 1987929 - DNA, 23 bp, Homo sapiens
ctggagcatctgactcacaagaa

SEQ ID NO: 1987930 - DNA, 12 bp, Homo sapiens
ctggagccagag

SEQ ID NO: 1987931 - DNA, 15 bp, Homo sapiens
ctggagccagagaga

SEQ ID NO: 1987932 - DNA, 13 bp, Homo sapiens
ctggagcccagga

SEQ ID NO: 1987933 - DNA, 20 bp, Homo sapiens
ctggagcctcggtggccatg

SEQ ID NO: 1987934 - DNA, 14 bp, Homo sapiens
ctggagctgctgtt

SEQ ID NO: 1987935 - DNA, 18 bp, Homo sapiens
ctggaggacctgagcctg

SEQ ID NO: 1987936 - DNA, 18 bp, Homo sapiens
ctggaggatccctccatc

SEQ ID NO: 1987937 - DNA, 15 bp, Homo sapiens
ctggaggatgaccag

SEQ ID NO: 1987938 - DNA, 17 bp, Homo sapiens
ctggaggattttccagt

SEQ ID NO: 1987939 - DNA, 13 bp, Homo sapiens
ctggaggcagggc

SEQ ID NO: 1987940 - DNA, 16 bp, Homo sapiens
ctggaggcagggcctt

SEQ ID NO: 1987941 - DNA, 16 bp, Homo sapiens
ctggaggctgcagagc

SEQ ID NO: 1987942 - DNA, 23 bp, Homo sapiens
ctggagggaatgaacctggaggg

SEQ ID NO: 1987943 - DNA, 14 bp, Homo sapiens
ctggagggaggctc

SEQ ID NO: 1987944 - DNA, 20 bp, Homo sapiens
ctggagggctagaacctaga

SEQ ID NO: 1987945 - DNA, 20 bp, Homo sapiens
ctggagggctagaacctgga

SEQ ID NO: 1987946 - DNA, 19 bp, Homo sapiens
ctggagggctagaatctgg

SEQ ID NO: 1987947 - DNA, 22 bp, Homo sapiens
ctggagggctagaatctggaga

SEQ ID NO: 1987948 - DNA, 20 bp, Homo sapiens
ctggaggtgggagacaagga

SEQ ID NO: 1987949 - DNA, 20 bp, Homo sapiens
ctggagtcccctgggcctgg

SEQ ID NO: 1987950 - DNA, 15 bp, Homo sapiens
ctggagtctccagtg

SEQ ID NO: 1987951 - DNA, 16 bp, Homo sapiens
ctggagtgaggcttcc

SEQ ID NO: 1987952 - DNA, 20 bp, Homo sapiens
ctggagtgaggcttccaggc

SEQ ID NO: 1987953 - DNA, 19 bp, Homo sapiens
ctggagtgcgctcttggtc

SEQ ID NO: 1987954 - DNA, 22 bp, Homo sapiens
ctggagttacattaatgttaat

SEQ ID NO: 1987955 - DNA, 13 bp, Homo sapiens
ctggatcagcgtg

SEQ ID NO: 1987956 - DNA, 14 bp, Homo sapiens
ctggatcagcgtgg

SEQ ID NO: 1987957 - DNA, 16 bp, Homo sapiens
ctggatcagcgtggcc

SEQ ID NO: 1987958 - DNA, 17 bp, Homo sapiens
ctggatccatcaggcca

SEQ ID NO: 1987959 - DNA, 19 bp, Homo sapiens
ctggatccatcaggccact

SEQ ID NO: 1987960 - DNA, 17 bp, Homo sapiens
ctggatcctgctgtggc

SEQ ID NO: 1987961 - DNA, 17 bp, Homo sapiens
ctggctggctgagggca

SEQ ID NO: 1987962 - DNA, 12 bp, Homo sapiens
ctggctgggaca

SEQ ID NO: 1987963 - DNA, 14 bp, Homo sapiens
ctggctgggcatgg

SEQ ID NO: 1987964 - DNA, 17 bp, Homo sapiens
ctggctgggcatggacg

SEQ ID NO: 1987965 - DNA, 13 bp, Homo sapiens
ctggctggggcag

SEQ ID NO: 1987966 - DNA, 22 bp, Homo sapiens
ctggctggggcagaggggcagc

SEQ ID NO: 1987967 - DNA, 17 bp, Homo sapiens
ctggctgtggaggcctg

SEQ ID NO: 1987968 - DNA, 18 bp, Homo sapiens
ctggctgtggaggcctga

SEQ ID NO: 1987969 - DNA, 19 bp, Homo sapiens
ctggctgtggaggcctgat

SEQ ID NO: 1987970 - DNA, 20 bp, Homo sapiens
ctggctgtggaggcctgatg

SEQ ID NO: 1987971 - DNA, 22 bp, Homo sapiens
ctggctgtggaggcctgatgct

SEQ ID NO: 1987972 - DNA, 23 bp, Homo sapiens
ctggctgtggaggcctgatgctg

SEQ ID NO: 1987973 - DNA, 20 bp, Homo sapiens
ctggctgttggctgggggcc

SEQ ID NO: 1987974 - DNA, 15 bp, Homo sapiens
ctggcttattcccaa

SEQ ID NO: 1987975 - DNA, 12 bp, Homo sapiens
ctggcttccagg

SEQ ID NO: 1987976 - DNA, 23 bp, Homo sapiens
ctggcttccaggtatctccagga

SEQ ID NO: 1987977 - DNA, 21 bp, Homo sapiens
ctggcttcccatccccagcga

SEQ ID NO: 1987978 - DNA, 20 bp, Homo sapiens
ctggcttctagtctggtgtt

SEQ ID NO: 1987979 - DNA, 15 bp, Homo sapiens
ctggcttctggagcc

SEQ ID NO: 1987980 - DNA, 20 bp, Homo sapiens
ctggcttctggagcccttgg

SEQ ID NO: 1987981 - DNA, 15 bp, Homo sapiens
ctggcttgctccagg

SEQ ID NO: 1987982 - DNA, 16 bp, Homo sapiens
ctggcttgctccaggg

SEQ ID NO: 1987983 - DNA, 17 bp, Homo sapiens
ctggcttgctccagggt

SEQ ID NO: 1987984 - DNA, 22 bp, Homo sapiens
ctggcttgctccagggtcttgg

SEQ ID NO: 1987985 - DNA, 20 bp, Homo sapiens
ctggcttgtaactccaccaa

SEQ ID NO: 1987986 - DNA, 18 bp, Homo sapiens
ctggctttacattttatt

SEQ ID NO: 1987987 - DNA, 14 bp, Homo sapiens
ctggctttgacatg

SEQ ID NO: 1987988 - DNA, 15 bp, Homo sapiens
ctggcttttcactgc

SEQ ID NO: 1987989 - DNA, 20 bp, Homo sapiens
ctggcttttcactgctggct

SEQ ID NO: 1987990 - DNA, 23 bp, Homo sapiens
ctggcttttcactgctggctgcc

SEQ ID NO: 1987991 - DNA, 18 bp, Homo sapiens
ctgggaaaacagaggaat

SEQ ID NO: 1987992 - DNA, 15 bp, Homo sapiens
ctgggaaacagggag

SEQ ID NO: 1987993 - DNA, 23 bp, Homo sapiens
ctgggaaaggaaaaccagggata

SEQ ID NO: 1987994 - DNA, 17 bp, Homo sapiens
ctgggaaaggacccacc

SEQ ID NO: 1987995 - DNA, 17 bp, Homo sapiens
ctgggaaataagagaga

SEQ ID NO: 1987996 - DNA, 22 bp, Homo sapiens
ctgggaacccaagtccaagcat

SEQ ID NO: 1987997 - DNA, 15 bp, Homo sapiens
ctgggaactcatcct

SEQ ID NO: 1987998 - DNA, 23 bp, Homo sapiens
ctgggaactggttcaagagacac

SEQ ID NO: 1987999 - DNA, 19 bp, Homo sapiens
ctgggaagctgtactcaga

SEQ ID NO: 1988000 - DNA, 20 bp, Homo sapiens
ctgggaagctgtactcagag

SEQ ID NO: 1988001 - DNA, 23 bp, Homo sapiens
ctgggaagctgtactcagagcag

SEQ ID NO: 1988002 - DNA, 23 bp, Homo sapiens
ctgggaaggctacttcggggctg

SEQ ID NO: 1988003 - DNA, 13 bp, Homo sapiens
ctgggaagggaag

SEQ ID NO: 1988004 - DNA, 23 bp, Homo sapiens
ctgggaagtcgtccttactcctg

SEQ ID NO: 1988005 - DNA, 21 bp, Homo sapiens
ctgggaatggaaggctttgcc

SEQ ID NO: 1988006 - DNA, 16 bp, Homo sapiens
ctgggaccagggcata

SEQ ID NO: 1988007 - DNA, 14 bp, Homo sapiens
ctgggacccagcta

SEQ ID NO: 1988008 - DNA, 17 bp, Homo sapiens
ctgggacccagctactc

SEQ ID NO: 1988009 - DNA, 22 bp, Homo sapiens
ctgggacccagctactctgtcc

SEQ ID NO: 1988010 - DNA, 22 bp, Homo sapiens
ctgggaccccagctagggctgg

SEQ ID NO: 1988011 - DNA, 23 bp, Homo sapiens
ctgggaccctttccttccttccc

SEQ ID NO: 1988012 - DNA, 14 bp, Homo sapiens
ctgggacctgtgtt

SEQ ID NO: 1988013 - DNA, 14 bp, Homo sapiens
ctgggactcccagt

SEQ ID NO: 1988014 - DNA, 16 bp, Homo sapiens
ctgggagaacctcagg

SEQ ID NO: 1988015 - DNA, 16 bp, Homo sapiens
ctgggagagaaggaga

SEQ ID NO: 1988016 - DNA, 13 bp, Homo sapiens
ctgggagctctgc

SEQ ID NO: 1988017 - DNA, 15 bp, Homo sapiens
ctgggagctctgcag

SEQ ID NO: 1988018 - DNA, 22 bp, Homo sapiens
ctgggaggcatggccctggggt

SEQ ID NO: 1988019 - DNA, 22 bp, Homo sapiens
ctgggaggcggagagtacagtg

SEQ ID NO: 1988020 - DNA, 22 bp, Homo sapiens
ctgggaggtctccactgaggat

SEQ ID NO: 1988021 - DNA, 20 bp, Homo sapiens
ctgggatggaccctcgcagc

SEQ ID NO: 1988022 - DNA, 20 bp, Homo sapiens
ctgggattacaggcatgagc

SEQ ID NO: 1988023 - DNA, 19 bp, Homo sapiens
ctgggcaaacccttctctt

SEQ ID NO: 1988024 - DNA, 18 bp, Homo sapiens
ctgggcaatgaaaccaaa

SEQ ID NO: 1988025 - DNA, 17 bp, Homo sapiens
ctgggcacccacctcca

SEQ ID NO: 1988026 - DNA, 18 bp, Homo sapiens
ctgggcacccacctccac

SEQ ID NO: 1988027 - DNA, 16 bp, Homo sapiens
ctgggcacctctagtg

SEQ ID NO: 1988028 - DNA, 20 bp, Homo sapiens
ctggtgctgtggccagggtg

SEQ ID NO: 1988029 - DNA, 16 bp, Homo sapiens
ctggtggacagtcctg

SEQ ID NO: 1988030 - DNA, 15 bp, Homo sapiens
ctggtggaccacagg

SEQ ID NO: 1988031 - DNA, 13 bp, Homo sapiens
ctggtggcaccag

SEQ ID NO: 1988032 - DNA, 19 bp, Homo sapiens
ctggtggcaccagatgcaa

SEQ ID NO: 1988033 - DNA, 15 bp, Homo sapiens
ctggtggcagctgcg

SEQ ID NO: 1988034 - DNA, 20 bp, Homo sapiens
ctggtggcatcgtagaagag

SEQ ID NO: 1988035 - DNA, 20 bp, Homo sapiens
ctggtggcccgacagcctgg

SEQ ID NO: 1988036 - DNA, 21 bp, Homo sapiens
ctggtggcccgacagcctggc

SEQ ID NO: 1988037 - DNA, 13 bp, Homo sapiens
ctggtgggaggca

SEQ ID NO: 1988038 - DNA, 12 bp, Homo sapiens
ctggtgggcctc

SEQ ID NO: 1988039 - DNA, 15 bp, Homo sapiens
ctggtggggcagctc

SEQ ID NO: 1988040 - DNA, 20 bp, Homo sapiens
ctggtggggcagctcctctg

SEQ ID NO: 1988041 - DNA, 15 bp, Homo sapiens
ctggtgtgaggctgg

SEQ ID NO: 1988042 - DNA, 22 bp, Homo sapiens
ctggttaattccataaccccag

SEQ ID NO: 1988043 - DNA, 14 bp, Homo sapiens
ctggttagaaatgc

SEQ ID NO: 1988044 - DNA, 23 bp, Homo sapiens
ctggttagaaatgcagaatccta

SEQ ID NO: 1988045 - DNA, 20 bp, Homo sapiens
ctggttcaagagacactgct

SEQ ID NO: 1988046 - DNA, 16 bp, Homo sapiens
ctggttcaagcgattc

SEQ ID NO: 1988047 - DNA, 20 bp, Homo sapiens
ctggttcacactgaccaaga

SEQ ID NO: 1988048 - DNA, 22 bp, Homo sapiens
ctggttgttgcaccatctgctt

SEQ ID NO: 1988049 - DNA, 21 bp, Homo sapiens
ctggtttagcacaatttatat

SEQ ID NO: 1988050 - DNA, 19 bp, Homo sapiens
ctggtttagtgttctgtat

SEQ ID NO: 1988051 - DNA, 21 bp, Homo sapiens
ctggtttgtcaaacaacatgt

SEQ ID NO: 1988052 - DNA, 18 bp, Homo sapiens
ctgtaaacatagatagtg

SEQ ID NO: 1988053 - DNA, 22 bp, Homo sapiens
ctgtaaacatagatagtgcttt

SEQ ID NO: 1988054 - DNA, 14 bp, Homo sapiens
ctgtaaacccctgg

SEQ ID NO: 1988055 - DNA, 17 bp, Homo sapiens
ctgtaaacccctgggta

SEQ ID NO: 1988056 - DNA, 22 bp, Homo sapiens
ctgtaaacccctgggtaactgt

SEQ ID NO: 1988057 - DNA, 13 bp, Homo sapiens
ctgtaaactataa

SEQ ID NO: 1988058 - DNA, 22 bp, Homo sapiens
ctgtaaactcaaaacttaacat

SEQ ID NO: 1988059 - DNA, 12 bp, Homo sapiens
ctgtaaatacaa

SEQ ID NO: 1988060 - DNA, 16 bp, Homo sapiens
ctgtaaatacaaaata

SEQ ID NO: 1988061 - DNA, 17 bp, Homo sapiens
ctgtaaatacaaaataa

SEQ ID NO: 1988062 - DNA, 17 bp, Homo sapiens
ctgtaaatacatgtgtg

SEQ ID NO: 1988063 - DNA, 21 bp, Homo sapiens
ctgtaaatagttttaaatatg

SEQ ID NO: 1988064 - DNA, 17 bp, Homo sapiens
ctgtaaatatgtttgtg

SEQ ID NO: 1988065 - DNA, 18 bp, Homo sapiens
ctgtaaatatgtttgtgc

SEQ ID NO: 1988066 - DNA, 19 bp, Homo sapiens
ctgtaaatatgtttgtgcc

SEQ ID NO: 1988067 - DNA, 19 bp, Homo sapiens
ctgtaaatcacttgtaaat

SEQ ID NO: 1988068 - DNA, 19 bp, Homo sapiens
ctgtaacacaagccacaga

SEQ ID NO: 1988069 - DNA, 21 bp, Homo sapiens
ctgtaacacaagccacagaag

SEQ ID NO: 1988070 - DNA, 21 bp, Homo sapiens
ctgtaacacagctgagagact

SEQ ID NO: 1988071 - DNA, 19 bp, Homo sapiens
ctgtaactcagacattcca

SEQ ID NO: 1988072 - DNA, 20 bp, Homo sapiens
ctgtaagcattctgagctgg

SEQ ID NO: 1988073 - DNA, 14 bp, Homo sapiens
ctgtaagtttattt

SEQ ID NO: 1988074 - DNA, 16 bp, Homo sapiens
ctgtaagtttattttt

SEQ ID NO: 1988075 - DNA, 20 bp, Homo sapiens
ctgtaatcccagcactttgg

SEQ ID NO: 1988076 - DNA, 15 bp, Homo sapiens
ctgtaatcccagcag

SEQ ID NO: 1988077 - DNA, 17 bp, Homo sapiens
ctgtaattaagtgcaat

SEQ ID NO: 1988078 - DNA, 15 bp, Homo sapiens
ctgtaattaatattc

SEQ ID NO: 1988079 - DNA, 19 bp, Homo sapiens
ctgtaattggtgacaatgt

SEQ ID NO: 1988080 - DNA, 14 bp, Homo sapiens
ctgtaattttgtag

SEQ ID NO: 1988081 - DNA, 15 bp, Homo sapiens
ctgtaattttgtagt

SEQ ID NO: 1988082 - DNA, 19 bp, Homo sapiens
ctgtaattttgtagtagtt

SEQ ID NO: 1988083 - DNA, 22 bp, Homo sapiens
ctgtaattttgtttgtaatcct

SEQ ID NO: 1988084 - DNA, 13 bp, Homo sapiens
ctgtacactgcac

SEQ ID NO: 1988085 - DNA, 15 bp, Homo sapiens
ctgtacatagatgta

SEQ ID NO: 1988086 - DNA, 15 bp, Homo sapiens
ctgtacccagctcct

SEQ ID NO: 1988087 - DNA, 16 bp, Homo sapiens
ctgtacccttccacct

SEQ ID NO: 1988088 - DNA, 18 bp, Homo sapiens
ctgtacgtctggtgttct

SEQ ID NO: 1988089 - DNA, 17 bp, Homo sapiens
ctgtactaaggagcatg

SEQ ID NO: 1988090 - DNA, 13 bp, Homo sapiens
ctgtactcagagc

SEQ ID NO: 1988091 - DNA, 20 bp, Homo sapiens
ctgtactcagagcagagcaa

SEQ ID NO: 1988092 - DNA, 12 bp, Homo sapiens
ctgtactgcctg

SEQ ID NO: 1988093 - DNA, 15 bp, Homo sapiens
ctgtactgcctgctt

SEQ ID NO: 1988094 - DNA, 16 bp, Homo sapiens
ctgtactgcctgcttg

SEQ ID NO: 1988095 - DNA, 12 bp, Homo sapiens
ctgtactgtaat

SEQ ID NO: 1988096 - DNA, 18 bp, Homo sapiens
ctgtacttaataaattca

SEQ ID NO: 1988097 - DNA, 16 bp, Homo sapiens
ctgtacttattttcca

SEQ ID NO: 1988098 - DNA, 21 bp, Homo sapiens
ctgtacttattttccaataaa

SEQ ID NO: 1988099 - DNA, 22 bp, Homo sapiens
ctgtacttattttccaataaaa

SEQ ID NO: 1988100 - DNA, 13 bp, Homo sapiens
ctgtagaaagaat

SEQ ID NO: 1988101 - DNA, 19 bp, Homo sapiens
ctgtagaacacccctgtgc

SEQ ID NO: 1988102 - DNA, 21 bp, Homo sapiens
ctgtagacttactttcctatt

SEQ ID NO: 1988103 - DNA, 21 bp, Homo sapiens
ctgtagagctagaacatggag

SEQ ID NO: 1988104 - DNA, 16 bp, Homo sapiens
ctgtagcatcttctgg

SEQ ID NO: 1988105 - DNA, 12 bp, Homo sapiens
ctgtagccatgg

SEQ ID NO: 1988106 - DNA, 15 bp, Homo sapiens
ctgtagccatggctc

SEQ ID NO: 1988107 - DNA, 16 bp, Homo sapiens
ctgtagccatggctca

SEQ ID NO: 1988108 - DNA, 21 bp, Homo sapiens
ctgcctttgaaattcccccac

SEQ ID NO: 1988109 - DNA, 15 bp, Homo sapiens
ctgcctttggaagaa

SEQ ID NO: 1988110 - DNA, 19 bp, Homo sapiens
ctgcgaaggggccctggtc

SEQ ID NO: 1988111 - DNA, 19 bp, Homo sapiens
ctgcgagaggtccctgctt

SEQ ID NO: 1988112 - DNA, 23 bp, Homo sapiens
ctgcgagcatttccctcccggga

SEQ ID NO: 1988113 - DNA, 14 bp, Homo sapiens
ctgcggaaaaggaa

SEQ ID NO: 1988114 - DNA, 17 bp, Homo sapiens
ctgcggccgggctgccc

SEQ ID NO: 1988115 - DNA, 17 bp, Homo sapiens
ctgcggctgctgtgtgc

SEQ ID NO: 1988116 - DNA, 19 bp, Homo sapiens
ctgcggctgctgtgtgcct

SEQ ID NO: 1988117 - DNA, 18 bp, Homo sapiens
ctgcgggatggtcctggg

SEQ ID NO: 1988118 - DNA, 19 bp, Homo sapiens
ctgcgggatggtcctgggg

SEQ ID NO: 1988119 - DNA, 14 bp, Homo sapiens
ctgcggggcttctg

SEQ ID NO: 1988120 - DNA, 18 bp, Homo sapiens
ctgcggtccacccaggag

SEQ ID NO: 1988121 - DNA, 20 bp, Homo sapiens
ctgcggtggtgccagaggtt

SEQ ID NO: 1988122 - DNA, 13 bp, Homo sapiens
ctgcgtcccccag

SEQ ID NO: 1988123 - DNA, 17 bp, Homo sapiens
ctgcgtcccccagccct

SEQ ID NO: 1988124 - DNA, 21 bp, Homo sapiens
ctgcgtcccccagccctcagg

SEQ ID NO: 1988125 - DNA, 23 bp, Homo sapiens
ctgcgtcccccagccctcaggcc

SEQ ID NO: 1988126 - DNA, 20 bp, Homo sapiens
ctgcgtcctgacgccctgcg

SEQ ID NO: 1988127 - DNA, 19 bp, Homo sapiens
ctgcgtgccagtgtcccca

SEQ ID NO: 1988128 - DNA, 14 bp, Homo sapiens
ctgcgtgctttatt

SEQ ID NO: 1988129 - DNA, 21 bp, Homo sapiens
ctgcgtgctttatttatggct

SEQ ID NO: 1988130 - DNA, 15 bp, Homo sapiens
ctgcgttggagccac

SEQ ID NO: 1988131 - DNA, 17 bp, Homo sapiens
ctgcgttggagccactc

SEQ ID NO: 1988132 - DNA, 19 bp, Homo sapiens
ctgcgttggagccactcct

SEQ ID NO: 1988133 - DNA, 23 bp, Homo sapiens
ctgcgttggagccactcctgtcc

SEQ ID NO: 1988134 - DNA, 20 bp, Homo sapiens
ctgcgttttggaagctctga

SEQ ID NO: 1988135 - DNA, 22 bp, Homo sapiens
ctgctacaccttagcagctctt

SEQ ID NO: 1988136 - DNA, 17 bp, Homo sapiens
ctgctaccaaggcccag

SEQ ID NO: 1988137 - DNA, 19 bp, Homo sapiens
ctgctaccaaggcccagct

SEQ ID NO: 1988138 - DNA, 20 bp, Homo sapiens
ctgctaccaaggcccagcta

SEQ ID NO: 1988139 - DNA, 14 bp, Homo sapiens
ctgctacctcactg

SEQ ID NO: 1988140 - DNA, 22 bp, Homo sapiens
ctgctactacccgagcccagct

SEQ ID NO: 1988141 - DNA, 23 bp, Homo sapiens
ctgctagagcaacccctgtaccc

SEQ ID NO: 1988142 - DNA, 18 bp, Homo sapiens
ctgctaggcgagtgccag

SEQ ID NO: 1988143 - DNA, 17 bp, Homo sapiens
ctgctatattttcatga

SEQ ID NO: 1988144 - DNA, 14 bp, Homo sapiens
ctgctattaaatta

SEQ ID NO: 1988145 - DNA, 17 bp, Homo sapiens
ctgctattatgtaacat

SEQ ID NO: 1988146 - DNA, 23 bp, Homo sapiens
ctgctattatgtaacatccagaa

SEQ ID NO: 1988147 - DNA, 14 bp, Homo sapiens
ctgctcaacctctc

SEQ ID NO: 1988148 - DNA, 22 bp, Homo sapiens
ctgctcaacctctctccttctg

SEQ ID NO: 1988149 - DNA, 20 bp, Homo sapiens
ctgctcaagaagacatggag

SEQ ID NO: 1988150 - DNA, 14 bp, Homo sapiens
ctgctcacatatct

SEQ ID NO: 1988151 - DNA, 19 bp, Homo sapiens
ctgctcacatatctgtcat

SEQ ID NO: 1988152 - DNA, 13 bp, Homo sapiens
ctgctcagacaga

SEQ ID NO: 1988153 - DNA, 21 bp, Homo sapiens
ctgctcatcacccagtcctgg

SEQ ID NO: 1988154 - DNA, 12 bp, Homo sapiens
ctgctccagaga

SEQ ID NO: 1988155 - DNA, 20 bp, Homo sapiens
ctgctccagagagaggatgc

SEQ ID NO: 1988156 - DNA, 14 bp, Homo sapiens
ctgctcccagcagc

SEQ ID NO: 1988157 - DNA, 15 bp, Homo sapiens
ctgctcccagcagcc

SEQ ID NO: 1988158 - DNA, 22 bp, Homo sapiens
ctgctcccagcagccctaagga

SEQ ID NO: 1988159 - DNA, 17 bp, Homo sapiens
ctgctccccagccctgg

SEQ ID NO: 1988160 - DNA, 20 bp, Homo sapiens
ctgctccccagccctggctc

SEQ ID NO: 1988161 - DNA, 17 bp, Homo sapiens
ctgctcccccaccccct

SEQ ID NO: 1988162 - DNA, 22 bp, Homo sapiens
ctgctcccccaccccctcccca

SEQ ID NO: 1988163 - DNA, 22 bp, Homo sapiens
ctgctcctccagggccacgtgc

SEQ ID NO: 1988164 - DNA, 13 bp, Homo sapiens
ctgctcctcccaa

SEQ ID NO: 1988165 - DNA, 14 bp, Homo sapiens
ctgctcctcccaac

SEQ ID NO: 1988166 - DNA, 17 bp, Homo sapiens
ctgctcctctccccagc

SEQ ID NO: 1988167 - DNA, 23 bp, Homo sapiens
ctgctcctctccccagcaagtga

SEQ ID NO: 1988168 - DNA, 13 bp, Homo sapiens
ctgctcgcacaga

SEQ ID NO: 1988169 - DNA, 13 bp, Homo sapiens
ctgctcggggtgc

SEQ ID NO: 1988170 - DNA, 20 bp, Homo sapiens
ctgctcggggtgcacaggag

SEQ ID NO: 1988171 - DNA, 21 bp, Homo sapiens
ctgctcggggtgcacaggagg

SEQ ID NO: 1988172 - DNA, 22 bp, Homo sapiens
ctgctcggggtgcacaggaggg

SEQ ID NO: 1988173 - DNA, 21 bp, Homo sapiens
ctgctcgtccccaagtgacct

SEQ ID NO: 1988174 - DNA, 15 bp, Homo sapiens
ctgctcgtctatcac

SEQ ID NO: 1988175 - DNA, 19 bp, Homo sapiens
ctgcagcctcaacctcctg

SEQ ID NO: 1988176 - DNA, 20 bp, Homo sapiens
ctgcagcctcaacctcctgg

SEQ ID NO: 1988177 - DNA, 14 bp, Homo sapiens
ctgcagcctccccc

SEQ ID NO: 1988178 - DNA, 16 bp, Homo sapiens
ctgcagcctcctcctg

SEQ ID NO: 1988179 - DNA, 20 bp, Homo sapiens
ctgcagctatgcgcaatgtg

SEQ ID NO: 1988180 - DNA, 22 bp, Homo sapiens
ctgcagctgctgaagttctgag

SEQ ID NO: 1988181 - DNA, 12 bp, Homo sapiens
ctgcagctgggc

SEQ ID NO: 1988182 - DNA, 13 bp, Homo sapiens
ctgcagctgggcc

SEQ ID NO: 1988183 - DNA, 13 bp, Homo sapiens
ctgcagcttcctg

SEQ ID NO: 1988184 - DNA, 23 bp, Homo sapiens
ctgcagcttcggggcaagtgaga

SEQ ID NO: 1988185 - DNA, 11 bp, Homo sapiens
ctgcagcttgt

SEQ ID NO: 1988186 - DNA, 19 bp, Homo sapiens
ctgcagcttgtagccagcc

SEQ ID NO: 1988187 - DNA, 18 bp, Homo sapiens
ctgcaggaacgagcactg

SEQ ID NO: 1988188 - DNA, 21 bp, Homo sapiens
ctgcaggaacgagcactggcc

SEQ ID NO: 1988189 - DNA, 23 bp, Homo sapiens
ctgcaggaacgagcactggccag

SEQ ID NO: 1988190 - DNA, 15 bp, Homo sapiens
ctgcaggaatcaaaa

SEQ ID NO: 1988191 - DNA, 22 bp, Homo sapiens
ctgcaggaatcaaaaattgaag

SEQ ID NO: 1988192 - DNA, 11 bp, Homo sapiens
ctgcaggactt

SEQ ID NO: 1988193 - DNA, 23 bp, Homo sapiens
ctgcaggccaagagcagaggcag

SEQ ID NO: 1988194 - DNA, 23 bp, Homo sapiens
ctgcagggagcaactctccactc

SEQ ID NO: 1988195 - DNA, 16 bp, Homo sapiens
ctgcagggccaagcac

SEQ ID NO: 1988196 - DNA, 16 bp, Homo sapiens
ctgcaggtacttcctc

SEQ ID NO: 1988197 - DNA, 15 bp, Homo sapiens
ctgcagtagtctctg

SEQ ID NO: 1988198 - DNA, 20 bp, Homo sapiens
ctgcagtagtctctgtgctt

SEQ ID NO: 1988199 - DNA, 21 bp, Homo sapiens
ctgcagtccgcagtctggcct

SEQ ID NO: 1988200 - DNA, 22 bp, Homo sapiens
ctgcagtgatggcgcgggaggc

SEQ ID NO: 1988201 - DNA, 16 bp, Homo sapiens
ctgcatatcggaggtg

SEQ ID NO: 1988202 - DNA, 12 bp, Homo sapiens
ctgcatcccctt

SEQ ID NO: 1988203 - DNA, 22 bp, Homo sapiens
ctgcatccccttggctgtgagg

SEQ ID NO: 1988204 - DNA, 14 bp, Homo sapiens
ctgcatctactcag

SEQ ID NO: 1988205 - DNA, 17 bp, Homo sapiens
ctgcatctactcaggcc

SEQ ID NO: 1988206 - DNA, 22 bp, Homo sapiens
ctgcatgcctggtctttcctct

SEQ ID NO: 1988207 - DNA, 14 bp, Homo sapiens
ctgcatgctctgga

SEQ ID NO: 1988208 - DNA, 16 bp, Homo sapiens
ctgcatgctctggaag

SEQ ID NO: 1988209 - DNA, 21 bp, Homo sapiens
ctgcatgctctggaagcctgg

SEQ ID NO: 1988210 - DNA, 21 bp, Homo sapiens
ctgcatggagtgagcagtaga

SEQ ID NO: 1988211 - DNA, 17 bp, Homo sapiens
ctgcatgtgttgtacaa

SEQ ID NO: 1988212 - DNA, 23 bp, Homo sapiens
ctgcattattggaatataattgt

SEQ ID NO: 1988213 - DNA, 21 bp, Homo sapiens
ctgcatttataaatgtgtggt

SEQ ID NO: 1988214 - DNA, 12 bp, Homo sapiens
ctgcattttacg

SEQ ID NO: 1988215 - DNA, 19 bp, Homo sapiens
ctgccaagcactcgagacc

SEQ ID NO: 1988216 - DNA, 24 bp, Homo sapiens
ctgccaagcactcgagaccatcct

SEQ ID NO: 1988217 - DNA, 12 bp, Homo sapiens
ctgccacacagg

SEQ ID NO: 1988218 - DNA, 14 bp, Homo sapiens
ctgccacaccctcc

SEQ ID NO: 1988219 - DNA, 17 bp, Homo sapiens
ctgccacaccctcccca

SEQ ID NO: 1988220 - DNA, 16 bp, Homo sapiens
ctgccacacctgagcc

SEQ ID NO: 1988221 - DNA, 13 bp, Homo sapiens
ctgccacacttca

SEQ ID NO: 1988222 - DNA, 17 bp, Homo sapiens
ctgccacacttcaggct

SEQ ID NO: 1988223 - DNA, 17 bp, Homo sapiens
ctgccaccacgtctgcc

SEQ ID NO: 1988224 - DNA, 18 bp, Homo sapiens
ctgccaccacgtctgcca

SEQ ID NO: 1988225 - DNA, 19 bp, Homo sapiens
ctgccaccacgtctgccag

SEQ ID NO: 1988226 - DNA, 20 bp, Homo sapiens
ctgccaccacgtctgccagg

SEQ ID NO: 1988227 - DNA, 12 bp, Homo sapiens
ctgccaccagtc

SEQ ID NO: 1988228 - DNA, 17 bp, Homo sapiens
ctgccaccagtcactgt

SEQ ID NO: 1988229 - DNA, 19 bp, Homo sapiens
ctgccacccgcttcctgtt

SEQ ID NO: 1988230 - DNA, 23 bp, Homo sapiens
ctgccacccgcttcctgtttctt

SEQ ID NO: 1988231 - DNA, 12 bp, Homo sapiens
ctgccaccctgg

SEQ ID NO: 1988232 - DNA, 15 bp, Homo sapiens
ctgccaccctgggga

SEQ ID NO: 1988233 - DNA, 20 bp, Homo sapiens
ctgccaccctggggagaaag

SEQ ID NO: 1988234 - DNA, 14 bp, Homo sapiens
ctgccacccttgac

SEQ ID NO: 1988235 - DNA, 14 bp, Homo sapiens
ctgccaccgccaga

SEQ ID NO: 1988236 - DNA, 14 bp, Homo sapiens
ctgccacctcccct

SEQ ID NO: 1988237 - DNA, 11 bp, Homo sapiens
ctgccacctgt

SEQ ID NO: 1988238 - DNA, 13 bp, Homo sapiens
ctgccactgacct

SEQ ID NO: 1988239 - DNA, 14 bp, Homo sapiens
ctgccactgacctc

SEQ ID NO: 1988240 - DNA, 20 bp, Homo sapiens
ctgccagagcccaagtgcca

SEQ ID NO: 1988241 - DNA, 21 bp, Homo sapiens
ctgccagagcccaagtgccat

SEQ ID NO: 1988242 - DNA, 15 bp, Homo sapiens
ctgccagcaacgcag

SEQ ID NO: 1988243 - DNA, 12 bp, Homo sapiens
ctgccagccaca

SEQ ID NO: 1988244 - DNA, 11 bp, Homo sapiens
ctgccagccat

SEQ ID NO: 1988245 - DNA, 12 bp, Homo sapiens
ctgccagccatc

SEQ ID NO: 1988246 - DNA, 13 bp, Homo sapiens
ctgccagccatca

SEQ ID NO: 1988247 - DNA, 15 bp, Homo sapiens
ctgccagccatcaca

SEQ ID NO: 1988248 - DNA, 15 bp, Homo sapiens
ctgccagcctggctt

SEQ ID NO: 1988249 - DNA, 19 bp, Homo sapiens
ctgccagcctggcttctgg

SEQ ID NO: 1988250 - DNA, 22 bp, Homo sapiens
ctgccagcgtcagaggccctgg

SEQ ID NO: 1988251 - DNA, 19 bp, Homo sapiens
ctggaacttgaactgattc

SEQ ID NO: 1988252 - DNA, 15 bp, Homo sapiens
ctggaagcacagctt

SEQ ID NO: 1988253 - DNA, 23 bp, Homo sapiens
ctggaagcatgtaggagaatcca

SEQ ID NO: 1988254 - DNA, 14 bp, Homo sapiens
ctggaagctgagca

SEQ ID NO: 1988255 - DNA, 17 bp, Homo sapiens
ctggaagctgagcaggc

SEQ ID NO: 1988256 - DNA, 15 bp, Homo sapiens
ctggaagctgggagg

SEQ ID NO: 1988257 - DNA, 16 bp, Homo sapiens
ctggaagctgtgtcct

SEQ ID NO: 1988258 - DNA, 12 bp, Homo sapiens
ctggaaggcagg

SEQ ID NO: 1988259 - DNA, 16 bp, Homo sapiens
ctggaaggcagggcag

SEQ ID NO: 1988260 - DNA, 19 bp, Homo sapiens
ctggaaggcagggcagagg

SEQ ID NO: 1988261 - DNA, 20 bp, Homo sapiens
ctggaaggcagggcagaggg

SEQ ID NO: 1988262 - DNA, 12 bp, Homo sapiens
ctggaaggctgg

SEQ ID NO: 1988263 - DNA, 15 bp, Homo sapiens
ctggaaggctggctg

SEQ ID NO: 1988264 - DNA, 16 bp, Homo sapiens
ctggaaggctggctga

SEQ ID NO: 1988265 - DNA, 17 bp, Homo sapiens
ctggaaggctggctgag

SEQ ID NO: 1988266 - DNA, 22 bp, Homo sapiens
ctggaagggctagaacctgtag

SEQ ID NO: 1988267 - DNA, 16 bp, Homo sapiens
ctggaatcaatttccc

SEQ ID NO: 1988268 - DNA, 18 bp, Homo sapiens
ctggaatcaatttcccag

SEQ ID NO: 1988269 - DNA, 21 bp, Homo sapiens
ctggaatcaatttcccagaag

SEQ ID NO: 1988270 - DNA, 17 bp, Homo sapiens
ctggaatcgatctgtac

SEQ ID NO: 1988271 - DNA, 22 bp, Homo sapiens
ctggaatcgatctgtactgtaa

SEQ ID NO: 1988272 - DNA, 19 bp, Homo sapiens
ctggaatgaagcatgtagc

SEQ ID NO: 1988273 - DNA, 21 bp, Homo sapiens
ctggaatggaattcagtaaca

SEQ ID NO: 1988274 - DNA, 15 bp, Homo sapiens
ctggaattcagcacc

SEQ ID NO: 1988275 - DNA, 17 bp, Homo sapiens
ctggaattcagcaccct

SEQ ID NO: 1988276 - DNA, 19 bp, Homo sapiens
ctggaattcagcaccctgg

SEQ ID NO: 1988277 - DNA, 22 bp, Homo sapiens
ctggaattcagcaccctgggtg

SEQ ID NO: 1988278 - DNA, 21 bp, Homo sapiens
ctggaattctaaatgctggtc

SEQ ID NO: 1988279 - DNA, 17 bp, Homo sapiens
ctggaattgctgctctc

SEQ ID NO: 1988280 - DNA, 14 bp, Homo sapiens
ctggacaacccaga

SEQ ID NO: 1988281 - DNA, 16 bp, Homo sapiens
ctggacaacccagaac

SEQ ID NO: 1988282 - DNA, 15 bp, Homo sapiens
ctggacaagaagctg

SEQ ID NO: 1988283 - DNA, 21 bp, Homo sapiens
ctggacaagccaacttgtaaa

SEQ ID NO: 1988284 - DNA, 22 bp, Homo sapiens
ctggacacttatggggacagca

SEQ ID NO: 1988285 - DNA, 14 bp, Homo sapiens
ctggacagctgtgc

SEQ ID NO: 1988286 - DNA, 16 bp, Homo sapiens
ctggacagctgtgcct

SEQ ID NO: 1988287 - DNA, 17 bp, Homo sapiens
ctggacaggcatgttct

SEQ ID NO: 1988288 - DNA, 21 bp, Homo sapiens
ctggaccaccagccccagcaa

SEQ ID NO: 1988289 - DNA, 22 bp, Homo sapiens
ctggaccaccagccccagcaag

SEQ ID NO: 1988290 - DNA, 20 bp, Homo sapiens
ctggaccccgcctcccagcc

SEQ ID NO: 1988291 - DNA, 19 bp, Homo sapiens
ctggacctatgtcctaagg

SEQ ID NO: 1988292 - DNA, 19 bp, Homo sapiens
ctggacctccccctcttgg

SEQ ID NO: 1988293 - DNA, 22 bp, Homo sapiens
ctggacctccccctcttggtcc

SEQ ID NO: 1988294 - DNA, 12 bp, Homo sapiens
ctggacctgagt

SEQ ID NO: 1988295 - DNA, 21 bp, Homo sapiens
ctggaccttgaactgggtact

SEQ ID NO: 1988296 - DNA, 17 bp, Homo sapiens
ctggaccttttgtctca

SEQ ID NO: 1988297 - DNA, 21 bp, Homo sapiens
ctggacgatagcttggaggga

SEQ ID NO: 1988298 - DNA, 18 bp, Homo sapiens
ctggacggggactgggga

SEQ ID NO: 1988299 - DNA, 17 bp, Homo sapiens
ctggactcctctgtcca

SEQ ID NO: 1988300 - DNA, 18 bp, Homo sapiens
ctggactcctctgtccag

SEQ ID NO: 1988301 - DNA, 19 bp, Homo sapiens
ctggactcctctgtccagg

SEQ ID NO: 1988302 - DNA, 22 bp, Homo sapiens
ctggactcctctgtccaggcac

SEQ ID NO: 1988303 - DNA, 23 bp, Homo sapiens
ctggactcctctgtccaggcact

SEQ ID NO: 1988304 - DNA, 20 bp, Homo sapiens
ctggactctaagctggagct

SEQ ID NO: 1988305 - DNA, 15 bp, Homo sapiens
ctggactctggcacc

SEQ ID NO: 1988306 - DNA, 13 bp, Homo sapiens
ctggactgaggac

SEQ ID NO: 1988307 - DNA, 13 bp, Homo sapiens
ctggactgggagg

SEQ ID NO: 1988308 - DNA, 16 bp, Homo sapiens
ctggactgggaggtag

SEQ ID NO: 1988309 - DNA, 23 bp, Homo sapiens
acatgtttttgttttctttgaat

SEQ ID NO: 1988310 - DNA, 19 bp, Homo sapiens
acattaaaagaagactgga

SEQ ID NO: 1988311 - DNA, 20 bp, Homo sapiens
acattaaacactgtaatctt

SEQ ID NO: 1988312 - DNA, 21 bp, Homo sapiens
acattaaacactgtaatctta

SEQ ID NO: 1988313 - DNA, 13 bp, Homo sapiens
acattaaatgtct

SEQ ID NO: 1988314 - DNA, 15 bp, Homo sapiens
acattaacatctatt

SEQ ID NO: 1988315 - DNA, 16 bp, Homo sapiens
acattaacatctatta

SEQ ID NO: 1988316 - DNA, 13 bp, Homo sapiens
acattaactcatt

SEQ ID NO: 1988317 - DNA, 14 bp, Homo sapiens
acattaactcatta

SEQ ID NO: 1988318 - DNA, 14 bp, Homo sapiens
acattaaggagcag

SEQ ID NO: 1988319 - DNA, 17 bp, Homo sapiens
acattaatcaccaaagt

SEQ ID NO: 1988320 - DNA, 15 bp, Homo sapiens
acattaatgttaatt

SEQ ID NO: 1988321 - DNA, 20 bp, Homo sapiens
acattacatcatcctcctta

SEQ ID NO: 1988322 - DNA, 18 bp, Homo sapiens
acattagaacactgcatt

SEQ ID NO: 1988323 - DNA, 18 bp, Homo sapiens
acattagcagtttgcttt

SEQ ID NO: 1988324 - DNA, 17 bp, Homo sapiens
acattagtatcccacta

SEQ ID NO: 1988325 - DNA, 15 bp, Homo sapiens
acattatagattttc

SEQ ID NO: 1988326 - DNA, 15 bp, Homo sapiens
acattatcattcaaa

SEQ ID NO: 1988327 - DNA, 19 bp, Homo sapiens
acattatcgggagcagtgt

SEQ ID NO: 1988328 - DNA, 22 bp, Homo sapiens
acattatcgggagcagtgtctt

SEQ ID NO: 1988329 - DNA, 15 bp, Homo sapiens
acattatgtgtgcat

SEQ ID NO: 1988330 - DNA, 18 bp, Homo sapiens
acattattatcaacaata

SEQ ID NO: 1988331 - DNA, 14 bp, Homo sapiens
acattatttgcatg

SEQ ID NO: 1988332 - DNA, 13 bp, Homo sapiens
acattcaaggcat

SEQ ID NO: 1988333 - DNA, 12 bp, Homo sapiens
acattcaatgtt

SEQ ID NO: 1988334 - DNA, 16 bp, Homo sapiens
acattcaggaagatga

SEQ ID NO: 1988335 - DNA, 21 bp, Homo sapiens
acattcatccagttgcaataa

SEQ ID NO: 1988336 - DNA, 18 bp, Homo sapiens
acattccctatcaaaaca

SEQ ID NO: 1988337 - DNA, 15 bp, Homo sapiens
acattccgaagaggg

SEQ ID NO: 1988338 - DNA, 23 bp, Homo sapiens
acattcctagagagcagaaataa

SEQ ID NO: 1988339 - DNA, 22 bp, Homo sapiens
acattcgaggtgtcaccctgca

SEQ ID NO: 1988340 - DNA, 23 bp, Homo sapiens
acattcgaggtgtcaccctgcag

SEQ ID NO: 1988341 - DNA, 20 bp, Homo sapiens
acattctcacaattgtaaag

SEQ ID NO: 1988342 - DNA, 22 bp, Homo sapiens
acattctcctgtgcccctcaga

SEQ ID NO: 1988343 - DNA, 22 bp, Homo sapiens
acattcttaaaggaaaagtcaa

SEQ ID NO: 1988344 - DNA, 12 bp, Homo sapiens
acattgcctcca

SEQ ID NO: 1988345 - DNA, 15 bp, Homo sapiens
acattggacttcctt

SEQ ID NO: 1988346 - DNA, 14 bp, Homo sapiens
acattggcagtgtg

SEQ ID NO: 1988347 - DNA, 17 bp, Homo sapiens
acattggcagtgtgtca

SEQ ID NO: 1988348 - DNA, 22 bp, Homo sapiens
acattggtatatttccattcat

SEQ ID NO: 1988349 - DNA, 15 bp, Homo sapiens
acattgtctggatac

SEQ ID NO: 1988350 - DNA, 21 bp, Homo sapiens
acattgttgctccctgtgaca

SEQ ID NO: 1988351 - DNA, 19 bp, Homo sapiens
acatttacacattctcaca

SEQ ID NO: 1988352 - DNA, 15 bp, Homo sapiens
acatttatacatcac

SEQ ID NO: 1988353 - DNA, 16 bp, Homo sapiens
acatttattttgacat

SEQ ID NO: 1988354 - DNA, 18 bp, Homo sapiens
acatttcataaggcctgc

SEQ ID NO: 1988355 - DNA, 17 bp, Homo sapiens
acatttctaacatatgt

SEQ ID NO: 1988356 - DNA, 19 bp, Homo sapiens
acatttctaacatatgtat

SEQ ID NO: 1988357 - DNA, 21 bp, Homo sapiens
acatttctaacatatgtatta

SEQ ID NO: 1988358 - DNA, 12 bp, Homo sapiens
acatttctagaa

SEQ ID NO: 1988359 - DNA, 15 bp, Homo sapiens
acatttctctgagca

SEQ ID NO: 1988360 - DNA, 16 bp, Homo sapiens
acatttgatgtacatg

SEQ ID NO: 1988361 - DNA, 14 bp, Homo sapiens
acatttgccttgct

SEQ ID NO: 1988362 - DNA, 21 bp, Homo sapiens
acatttgctttgttttctaaa

SEQ ID NO: 1988363 - DNA, 12 bp, Homo sapiens
acatttgtacat

SEQ ID NO: 1988364 - DNA, 15 bp, Homo sapiens
acatttgtacattcc

SEQ ID NO: 1988365 - DNA, 17 bp, Homo sapiens
acattttaaataaaaga

SEQ ID NO: 1988366 - DNA, 15 bp, Homo sapiens
acatttttacaataa

SEQ ID NO: 1988367 - DNA, 20 bp, Homo sapiens
accaaaaaaatacttgagct

SEQ ID NO: 1988368 - DNA, 17 bp, Homo sapiens
accaaaaaagtattttt

SEQ ID NO: 1988369 - DNA, 22 bp, Homo sapiens
accaaaaaagtatttttttaag

SEQ ID NO: 1988370 - DNA, 15 bp, Homo sapiens
accaaaagaacaaga

SEQ ID NO: 1988371 - DNA, 14 bp, Homo sapiens
accaaaagttacat

SEQ ID NO: 1988372 - DNA, 23 bp, Homo sapiens
accaaaagttacatgtttgcacc

SEQ ID NO: 1988373 - DNA, 18 bp, Homo sapiens
accaaagagactggagca

SEQ ID NO: 1988374 - DNA, 20 bp, Homo sapiens
ctgaaggggcacaccactgc

SEQ ID NO: 1988375 - DNA, 21 bp, Homo sapiens
ctgaaggggcacaccactgcc

SEQ ID NO: 1988376 - DNA, 15 bp, Homo sapiens
ctgaagggggcggcc

SEQ ID NO: 1988377 - DNA, 20 bp, Homo sapiens
ctgaagggggcggcctatga

SEQ ID NO: 1988378 - DNA, 15 bp, Homo sapiens
ctgaagggtgacatc

SEQ ID NO: 1988379 - DNA, 19 bp, Homo sapiens
ctgaagggtgacatcccag

SEQ ID NO: 1988380 - DNA, 15 bp, Homo sapiens
ctgaaggttcctgag

SEQ ID NO: 1988381 - DNA, 17 bp, Homo sapiens
ctgaagtcacacagtga

SEQ ID NO: 1988382 - DNA, 18 bp, Homo sapiens
ctgagagttggctcaggc

SEQ ID NO: 1988383 - DNA, 21 bp, Homo sapiens
ctgagagttggctcaggcaga

SEQ ID NO: 1988384 - DNA, 14 bp, Homo sapiens
ctgagatcgtgccg

SEQ ID NO: 1988385 - DNA, 16 bp, Homo sapiens
ctgagcaacagagtga

SEQ ID NO: 1988386 - DNA, 12 bp, Homo sapiens
ctgagcaagagc

SEQ ID NO: 1988387 - DNA, 17 bp, Homo sapiens
ctgagcaagagctggca

SEQ ID NO: 1988388 - DNA, 20 bp, Homo sapiens
ctgagcaagatcttgtctcc

SEQ ID NO: 1988389 - DNA, 16 bp, Homo sapiens
ctgagcaccccctcat

SEQ ID NO: 1988390 - DNA, 16 bp, Homo sapiens
ctgagcacctgcttca

SEQ ID NO: 1988391 - DNA, 23 bp, Homo sapiens
ctgagcacctgcttcatgctcag

SEQ ID NO: 1988392 - DNA, 13 bp, Homo sapiens
ctgagcactgcca

SEQ ID NO: 1988393 - DNA, 17 bp, Homo sapiens
ctgagcactgccaggag

SEQ ID NO: 1988394 - DNA, 21 bp, Homo sapiens
ctgagcaggcccgacagagag

SEQ ID NO: 1988395 - DNA, 23 bp, Homo sapiens
ctgagcagggccggggaactggc

SEQ ID NO: 1988396 - DNA, 18 bp, Homo sapiens
ctgagcattcaggcagca

SEQ ID NO: 1988397 - DNA, 14 bp, Homo sapiens
ctgagtctgagtcc

SEQ ID NO: 1988398 - DNA, 18 bp, Homo sapiens
ctgagtctgagtcctgtc

SEQ ID NO: 1988399 - DNA, 22 bp, Homo sapiens
ctgagtctgagtcctgtctctg

SEQ ID NO: 1988400 - DNA, 21 bp, Homo sapiens
ctgagtctgctatattttcat

SEQ ID NO: 1988401 - DNA, 13 bp, Homo sapiens
ctgagtcttggcc

SEQ ID NO: 1988402 - DNA, 14 bp, Homo sapiens
ctgagtgaaaaatc

SEQ ID NO: 1988403 - DNA, 21 bp, Homo sapiens
ctgagtgaaaaatctgtggaa

SEQ ID NO: 1988404 - DNA, 13 bp, Homo sapiens
ctgagtgactgta

SEQ ID NO: 1988405 - DNA, 18 bp, Homo sapiens
ctgagtgctttaccttta

SEQ ID NO: 1988406 - DNA, 17 bp, Homo sapiens
ctgagtggaatgcaggg

SEQ ID NO: 1988407 - DNA, 23 bp, Homo sapiens
ctgagtggcttgtgattctggga

SEQ ID NO: 1988408 - DNA, 12 bp, Homo sapiens
ctgagtgtggga

SEQ ID NO: 1988409 - DNA, 16 bp, Homo sapiens
ctgagttacttgtctg

SEQ ID NO: 1988410 - DNA, 23 bp, Homo sapiens
ctgagttacttgtctgaggcctc

SEQ ID NO: 1988411 - DNA, 20 bp, Homo sapiens
ctgagtttcattctcctgcc

SEQ ID NO: 1988412 - DNA, 12 bp, Homo sapiens
ctgataaaatac

SEQ ID NO: 1988413 - DNA, 13 bp, Homo sapiens
ctgataaaattgt

SEQ ID NO: 1988414 - DNA, 19 bp, Homo sapiens
ctgataaacacagaggttt

SEQ ID NO: 1988415 - DNA, 12 bp, Homo sapiens
ctgataaacatt

SEQ ID NO: 1988416 - DNA, 17 bp, Homo sapiens
ctgataaacattaaaca

SEQ ID NO: 1988417 - DNA, 18 bp, Homo sapiens
ctgataacaacctggaga

SEQ ID NO: 1988418 - DNA, 14 bp, Homo sapiens
ctgataagcttcaa

SEQ ID NO: 1988419 - DNA, 18 bp, Homo sapiens
ctgataattttaaattct

SEQ ID NO: 1988420 - DNA, 14 bp, Homo sapiens
tttttaagctgtaa

SEQ ID NO: 1988421 - DNA, 15 bp, Homo sapiens
tttttaatgactttt

SEQ ID NO: 1988422 - DNA, 19 bp, Homo sapiens
tttttaatgactttttata

SEQ ID NO: 1988423 - DNA, 21 bp, Homo sapiens
tttttaattgaggacagcctg

SEQ ID NO: 1988424 - DNA, 18 bp, Homo sapiens
tttttacaaataaagatg

SEQ ID NO: 1988425 - DNA, 16 bp, Homo sapiens
tttttactacagttgt

SEQ ID NO: 1988426 - DNA, 22 bp, Homo sapiens
tttttagacagagtctcactgt

SEQ ID NO: 1988427 - DNA, 13 bp, Homo sapiens
tttttagtctttt

SEQ ID NO: 1988428 - DNA, 19 bp, Homo sapiens
tttttatacatatcagaaa

SEQ ID NO: 1988429 - DNA, 21 bp, Homo sapiens
tttttatactccatacataac

SEQ ID NO: 1988430 - DNA, 19 bp, Homo sapiens
tttttatttgtttgtgcat

SEQ ID NO: 1988431 - DNA, 22 bp, Homo sapiens
tttttcactttagctatgtgga

SEQ ID NO: 1988432 - DNA, 21 bp, Homo sapiens
tttttcattgatatgaaaaat

SEQ ID NO: 1988433 - DNA, 16 bp, Homo sapiens
tttttccgtaaaaatg

SEQ ID NO: 1988434 - DNA, 18 bp, Homo sapiens
tttttcctagccctctca

SEQ ID NO: 1988435 - DNA, 19 bp, Homo sapiens
tttttccttcaaagtttaa

SEQ ID NO: 1988436 - DNA, 11 bp, Homo sapiens
tttttctggaa

SEQ ID NO: 1988437 - DNA, 22 bp, Homo sapiens
tttttcttctaaaatgctttta

SEQ ID NO: 1988438 - DNA, 17 bp, Homo sapiens
tttttctttataaactt

SEQ ID NO: 1988439 - DNA, 13 bp, Homo sapiens
tttttgaaaacat

SEQ ID NO: 1988440 - DNA, 23 bp, Homo sapiens
tttttgaaaggcatgttcctctg

SEQ ID NO: 1988441 - DNA, 12 bp, Homo sapiens
tttttgaataaa

SEQ ID NO: 1988442 - DNA, 22 bp, Homo sapiens
tttttgtaaactgtatcaaatc

SEQ ID NO: 1988443 - DNA, 14 bp, Homo sapiens
tttttgtaacttca

SEQ ID NO: 1988444 - DNA, 21 bp, Homo sapiens
tttttgtacgttatatattgt

SEQ ID NO: 1988445 - DNA, 12 bp, Homo sapiens
tttttgtccctg

SEQ ID NO: 1988446 - DNA, 13 bp, Homo sapiens
tttttgtcttttc

SEQ ID NO: 1988447 - DNA, 20 bp, Homo sapiens
tttttgtttctgagaaaaga

SEQ ID NO: 1988448 - DNA, 15 bp, Homo sapiens
tttttgttttctgat

SEQ ID NO: 1988449 - DNA, 17 bp, Homo sapiens
ttttttaacacataact

SEQ ID NO: 1988450 - DNA, 21 bp, Homo sapiens
ttttttaacactagaaaacat

SEQ ID NO: 1988451 - DNA, 13 bp, Homo sapiens
ttttttatgctaa

SEQ ID NO: 1988452 - DNA, 16 bp, Homo sapiens
ttttttatgctaatca

SEQ ID NO: 1988453 - DNA, 13 bp, Homo sapiens
ttttttatttcca

SEQ ID NO: 1988454 - DNA, 13 bp, Homo sapiens
ttttttgtaaact

SEQ ID NO: 1988455 - DNA, 12 bp, Homo sapiens
tttttttctgat

SEQ ID NO: 1988456 - DNA, 15 bp, Homo sapiens
ttgaaggatctgttt

SEQ ID NO: 1988457 - DNA, 14 bp, Homo sapiens
ttgaaggcagtctg

SEQ ID NO: 1988458 - DNA, 23 bp, Homo sapiens
ttgaaggcccaggtcaacatcta

SEQ ID NO: 1988459 - DNA, 22 bp, Homo sapiens
ttgaagttgtgttaacaatgca

SEQ ID NO: 1988460 - DNA, 19 bp, Homo sapiens
ttgaataaaaaacatttgt

SEQ ID NO: 1988461 - DNA, 20 bp, Homo sapiens
ttgaataaaaaacatttgta

SEQ ID NO: 1988462 - DNA, 18 bp, Homo sapiens
ttgaataaagtctgagtg

SEQ ID NO: 1988463 - DNA, 12 bp, Homo sapiens
ttgaataaataa

SEQ ID NO: 1988464 - DNA, 13 bp, Homo sapiens
ttgaatatattat

SEQ ID NO: 1988465 - DNA, 19 bp, Homo sapiens
ttgaatccatgcttgggtg

SEQ ID NO: 1988466 - DNA, 15 bp, Homo sapiens
ttgaatcctctctct

SEQ ID NO: 1988467 - DNA, 20 bp, Homo sapiens
ttgaatgacaacagaagctt

SEQ ID NO: 1988468 - DNA, 21 bp, Homo sapiens
ttgaatgacaacagaagcttc

SEQ ID NO: 1988469 - DNA, 15 bp, Homo sapiens
ttgaatgctttttga

SEQ ID NO: 1988470 - DNA, 20 bp, Homo sapiens
ttgaatgctttttgaatgtt

SEQ ID NO: 1988471 - DNA, 22 bp, Homo sapiens
ttgaatggagattctgattcag

SEQ ID NO: 1988472 - DNA, 18 bp, Homo sapiens
ttgaatggcctgccttga

SEQ ID NO: 1988473 - DNA, 20 bp, Homo sapiens
ttgaatggctatgtttttaa

SEQ ID NO: 1988474 - DNA, 23 bp, Homo sapiens
ttgaattctggaggaagaagaca

SEQ ID NO: 1988475 - DNA, 14 bp, Homo sapiens
ttgacaacaaatta

SEQ ID NO: 1988476 - DNA, 18 bp, Homo sapiens
ttgacaacattttattac

SEQ ID NO: 1988477 - DNA, 15 bp, Homo sapiens
ttgacagaacactgt

SEQ ID NO: 1988478 - DNA, 14 bp, Homo sapiens
ttgacagtatattt

SEQ ID NO: 1988479 - DNA, 15 bp, Homo sapiens
ttgacagtatatttg

SEQ ID NO: 1988480 - DNA, 19 bp, Homo sapiens
ttgacataaagttgataaa

SEQ ID NO: 1988481 - DNA, 18 bp, Homo sapiens
ttgaccactccagagaag

SEQ ID NO: 1988482 - DNA, 12 bp, Homo sapiens
ttgaccagacct

SEQ ID NO: 1988483 - DNA, 14 bp, Homo sapiens
ttgaccagacctag

SEQ ID NO: 1988484 - DNA, 13 bp, Homo sapiens
ttgacccctttcc

SEQ ID NO: 1988485 - DNA, 20 bp, Homo sapiens
ttgacccctttcccccaccc

SEQ ID NO: 1988486 - DNA, 22 bp, Homo sapiens
ttgacctcacagtgacccttcc

SEQ ID NO: 1988487 - DNA, 23 bp, Homo sapiens
ttgacctcacagtgacccttccc

SEQ ID NO: 1988488 - DNA, 15 bp, Homo sapiens
ttgacctcagctgca

SEQ ID NO: 1988489 - DNA, 22 bp, Homo sapiens
ttgacctcagctgcacattcct

SEQ ID NO: 1988490 - DNA, 23 bp, Homo sapiens
ttgacctcagctgcacattcctg

SEQ ID NO: 1988491 - DNA, 15 bp, Homo sapiens
ttgacggatgattgg

SEQ ID NO: 1988492 - DNA, 20 bp, Homo sapiens
ttgacgggaggcctcagttc

SEQ ID NO: 1988493 - DNA, 19 bp, Homo sapiens
ttgactcacctgttacttg

SEQ ID NO: 1988494 - DNA, 23 bp, Homo sapiens
ttgactccttgtggtttatgtca

SEQ ID NO: 1988495 - DNA, 23 bp, Homo sapiens
ttgactgggtttctctgtatagt

SEQ ID NO: 1988496 - DNA, 15 bp, Homo sapiens
ttgacttactgtttc

SEQ ID NO: 1988497 - DNA, 20 bp, Homo sapiens
ttgacttactgtttcttacc

SEQ ID NO: 1988498 - DNA, 13 bp, Homo sapiens
ttgactttcaggt

SEQ ID NO: 1988499 - DNA, 10 bp, Homo sapiens
ttgagaaacc

SEQ ID NO: 1988500 - DNA, 22 bp, Homo sapiens
ttgagaaaccttattgtacctc

SEQ ID NO: 1988501 - DNA, 14 bp, Homo sapiens
ttgagaaagaaata

SEQ ID NO: 1988502 - DNA, 23 bp, Homo sapiens
ttgagaagggaaatcttagcatg

SEQ ID NO: 1988503 - DNA, 18 bp, Homo sapiens
ttgagaagttttgtacag

SEQ ID NO: 1988504 - DNA, 13 bp, Homo sapiens
ttgagaattattc

SEQ ID NO: 1988505 - DNA, 19 bp, Homo sapiens
ttgagacaagccctggcaa

SEQ ID NO: 1988506 - DNA, 15 bp, Homo sapiens
ttgagaccagcctgg

SEQ ID NO: 1988507 - DNA, 14 bp, Homo sapiens
ttgagacctcagcc

SEQ ID NO: 1988508 - DNA, 17 bp, Homo sapiens
ttgagacctcagccatg

SEQ ID NO: 1988509 - DNA, 17 bp, Homo sapiens
ttgagagaagagacaaa

SEQ ID NO: 1988510 - DNA, 19 bp, Homo sapiens
ttgagataatatctgtgag

SEQ ID NO: 1988511 - DNA, 14 bp, Homo sapiens
ttgagataatgtca

SEQ ID NO: 1988512 - DNA, 13 bp, Homo sapiens
ttgagatgtgatg

SEQ ID NO: 1988513 - DNA, 18 bp, Homo sapiens
ttgagatgtgatgctggt

SEQ ID NO: 1988514 - DNA, 12 bp, Homo sapiens
ttgagcagggct

SEQ ID NO: 1988515 - DNA, 22 bp, Homo sapiens
ttgagcatgcacagctgcttgt

SEQ ID NO: 1988516 - DNA, 18 bp, Homo sapiens
ttgagcctccatttctgg

SEQ ID NO: 1988517 - DNA, 13 bp, Homo sapiens
ttgagcctgtcac

SEQ ID NO: 1988518 - DNA, 23 bp, Homo sapiens
ttgagctcagacccccactctca

SEQ ID NO: 1988519 - DNA, 22 bp, Homo sapiens
ttgagctgtatatatatatgtg

SEQ ID NO: 1988520 - DNA, 21 bp, Homo sapiens
ttgcaattattctaattttat

SEQ ID NO: 1988521 - DNA, 18 bp, Homo sapiens
ttgcacaagcttgtatat

SEQ ID NO: 1988522 - DNA, 21 bp, Homo sapiens
ttgcacaagcttgtatataca

SEQ ID NO: 1988523 - DNA, 12 bp, Homo sapiens
ttgcacaatttg

SEQ ID NO: 1988524 - DNA, 13 bp, Homo sapiens
ttgcacaatttga

SEQ ID NO: 1988525 - DNA, 22 bp, Homo sapiens
ttgcacaatttgagcaattcat

SEQ ID NO: 1988526 - DNA, 13 bp, Homo sapiens
ttgcacatgtgac

SEQ ID NO: 1988527 - DNA, 16 bp, Homo sapiens
ttgcaccatctgcttg

SEQ ID NO: 1988528 - DNA, 24 bp, Homo sapiens
ttgcacccctcactctggcctcag

SEQ ID NO: 1988529 - DNA, 18 bp, Homo sapiens
ttgcacgtcttgctattt

SEQ ID NO: 1988530 - DNA, 19 bp, Homo sapiens
ttgcactaaagtatgtaaa

SEQ ID NO: 1988531 - DNA, 13 bp, Homo sapiens
ttgcactaggtca

SEQ ID NO: 1988532 - DNA, 14 bp, Homo sapiens
ttgcactccagtct

SEQ ID NO: 1988533 - DNA, 16 bp, Homo sapiens
ttgcactgacaagatg

SEQ ID NO: 1988534 - DNA, 12 bp, Homo sapiens
ttgcactgaggg

SEQ ID NO: 1988535 - DNA, 21 bp, Homo sapiens
ttgcactgatgtccggagaga

SEQ ID NO: 1988536 - DNA, 16 bp, Homo sapiens
ttgcactgtgggggct

SEQ ID NO: 1988537 - DNA, 20 bp, Homo sapiens
ttgcagaaaagcacctgccg

SEQ ID NO: 1988538 - DNA, 21 bp, Homo sapiens
ttgcagaaaagcacctgccga

SEQ ID NO: 1988539 - DNA, 22 bp, Homo sapiens
ttgcagaaacattttgtggtca

SEQ ID NO: 1988540 - DNA, 12 bp, Homo sapiens
ttgcagaagcag

SEQ ID NO: 1988541 - DNA, 14 bp, Homo sapiens
ttgcagagacagga

SEQ ID NO: 1988542 - DNA, 19 bp, Homo sapiens
ttgcagattattttagtct

SEQ ID NO: 1988543 - DNA, 22 bp, Homo sapiens
ttgcagcagaagccaaattttt

SEQ ID NO: 1988544 - DNA, 20 bp, Homo sapiens
ttgcaggccaggttatgcct

SEQ ID NO: 1988545 - DNA, 21 bp, Homo sapiens
ttgcaggctctgggctcaggg

SEQ ID NO: 1988546 - DNA, 22 bp, Homo sapiens
ttgcagggaagtcttacttaaa

SEQ ID NO: 1988547 - DNA, 20 bp, Homo sapiens
ttgcagttcaaatcctcacc

SEQ ID NO: 1988548 - DNA, 14 bp, Homo sapiens
ttgcagttgagagg

SEQ ID NO: 1988549 - DNA, 21 bp, Homo sapiens
ttgcagtttttttatggcatt

SEQ ID NO: 1988550 - DNA, 14 bp, Homo sapiens
ttgcatatatacat

SEQ ID NO: 1988551 - DNA, 13 bp, Homo sapiens
ttgcatcaatttt

SEQ ID NO: 1988552 - DNA, 20 bp, Homo sapiens
ttgcatcacctctgtaattt

SEQ ID NO: 1988553 - DNA, 15 bp, Homo sapiens
ttgcatcagtattaa

SEQ ID NO: 1988554 - DNA, 14 bp, Homo sapiens
ttgcatgtaaaatg

SEQ ID NO: 1988555 - DNA, 15 bp, Homo sapiens
ttgcatgtaaaatgc

SEQ ID NO: 1988556 - DNA, 17 bp, Homo sapiens
ttgcatgtaaaatgcag

SEQ ID NO: 1988557 - DNA, 12 bp, Homo sapiens
ttgcattagaaa

SEQ ID NO: 1988558 - DNA, 16 bp, Homo sapiens
ttgcattagaaactga

SEQ ID NO: 1988559 - DNA, 22 bp, Homo sapiens
ttgcattagtccaaggcctttt

SEQ ID NO: 1988560 - DNA, 17 bp, Homo sapiens
ttgcattccatgatttt

SEQ ID NO: 1988561 - DNA, 18 bp, Homo sapiens
ttgcatttagttttatgg

SEQ ID NO: 1988562 - DNA, 13 bp, Homo sapiens
ttgcatttctgct

SEQ ID NO: 1988563 - DNA, 18 bp, Homo sapiens
ttgccaaggcagcgggat

SEQ ID NO: 1988564 - DNA, 20 bp, Homo sapiens
ttgccacaatgcctctccca

SEQ ID NO: 1988565 - DNA, 23 bp, Homo sapiens
ttgccaccaccagatgagaagtt

SEQ ID NO: 1988566 - DNA, 17 bp, Homo sapiens
ttgccactttggcttct

SEQ ID NO: 1988567 - DNA, 22 bp, Homo sapiens
ttgccactttggcttctcctgt

SEQ ID NO: 1988568 - DNA, 24 bp, Homo sapiens
ttgccactttggcttctcctgtga

SEQ ID NO: 1988569 - DNA, 20 bp, Homo sapiens
ttgccagaaagcataaaatt

SEQ ID NO: 1988570 - DNA, 15 bp, Homo sapiens
ttgccagtgaagact

SEQ ID NO: 1988571 - DNA, 14 bp, Homo sapiens
ttgccatgaggcct

SEQ ID NO: 1988572 - DNA, 15 bp, Homo sapiens
ttgccatgaggcctt

SEQ ID NO: 1988573 - DNA, 19 bp, Homo sapiens
ttgccatgaggcctttccc

SEQ ID NO: 1988574 - DNA, 19 bp, Homo sapiens
ttgccatgttggccaggct

SEQ ID NO: 1988575 - DNA, 15 bp, Homo sapiens
ttgccatttctctgc

SEQ ID NO: 1988576 - DNA, 23 bp, Homo sapiens
ttgcccacgctggagtgcagtga

SEQ ID NO: 1988577 - DNA, 13 bp, Homo sapiens
ttgcccaggcagg

SEQ ID NO: 1988578 - DNA, 11 bp, Homo sapiens
ttgcccaggct

SEQ ID NO: 1988579 - DNA, 23 bp, Homo sapiens
ttgcccaggctggcgtgcagtgg

SEQ ID NO: 1988580 - DNA, 17 bp, Homo sapiens
ttgcccagggctcagcc

SEQ ID NO: 1988581 - DNA, 20 bp, Homo sapiens
ttgcccagggctcagcctgg

SEQ ID NO: 1988582 - DNA, 18 bp, Homo sapiens
ttgccccagagccccact

SEQ ID NO: 1988583 - DNA, 20 bp, Homo sapiens
ttgccccagagccccactcc

SEQ ID NO: 1988584 - DNA, 14 bp, Homo sapiens
ttgcccccatccct

SEQ ID NO: 1988585 - DNA, 17 bp, Homo sapiens
ttgccccttgggcctcc

SEQ ID NO: 1988586 - DNA, 20 bp, Homo sapiens
ttgccctgtggattccagca

SEQ ID NO: 1988587 - DNA, 14 bp, Homo sapiens
ttgcccttgccctg

SEQ ID NO: 1988588 - DNA, 15 bp, Homo sapiens
ttgcccttgccctga

SEQ ID NO: 1988589 - DNA, 17 bp, Homo sapiens
ttgcctaaatccaaaga

SEQ ID NO: 1988590 - DNA, 22 bp, Homo sapiens
ttgcctccacctctccttggaa

SEQ ID NO: 1988591 - DNA, 19 bp, Homo sapiens
ttgcctccttatttatcaa

SEQ ID NO: 1988592 - DNA, 23 bp, Homo sapiens
ttgcctgaatccatcaggacttg

SEQ ID NO: 1988593 - DNA, 19 bp, Homo sapiens
ttgcctgcagagagaagcc

SEQ ID NO: 1988594 - DNA, 20 bp, Homo sapiens
ttgcctgcagagagaagcct

SEQ ID NO: 1988595 - DNA, 15 bp, Homo sapiens
ttgcctggctgtgga

SEQ ID NO: 1988596 - DNA, 20 bp, Homo sapiens
ttgcctggctgtggaggcct

SEQ ID NO: 1988597 - DNA, 21 bp, Homo sapiens
ttgccttatcttgaaaagaat

SEQ ID NO: 1988598 - DNA, 15 bp, Homo sapiens
ttgcctttccacctg

SEQ ID NO: 1988599 - DNA, 13 bp, Homo sapiens
ttgccttttgcaa

SEQ ID NO: 1988600 - DNA, 13 bp, Homo sapiens
ttgcgccactgca

SEQ ID NO: 1988601 - DNA, 20 bp, Homo sapiens
ttgcgggggagctggaaata

SEQ ID NO: 1988602 - DNA, 21 bp, Homo sapiens
ttgcgggggagctggaaataa

SEQ ID NO: 1988603 - DNA, 14 bp, Homo sapiens
ttgcggttcaggaa

SEQ ID NO: 1988604 - DNA, 21 bp, Homo sapiens
ttgcgtggaattgtgctgagt

SEQ ID NO: 1988605 - DNA, 16 bp, Homo sapiens
ttgctaattaaaaagt

SEQ ID NO: 1988606 - DNA, 16 bp, Homo sapiens
ttgctacaataaatgc

SEQ ID NO: 1988607 - DNA, 18 bp, Homo sapiens
ttgctacaataaatgctg

SEQ ID NO: 1988608 - DNA, 19 bp, Homo sapiens
ttgctacaataaatgctga

SEQ ID NO: 1988609 - DNA, 16 bp, Homo sapiens
ttgctacataattatc

SEQ ID NO: 1988610 - DNA, 20 bp, Homo sapiens
ttgctcaccaagctgttcca

SEQ ID NO: 1988611 - DNA, 19 bp, Homo sapiens
ttgctcaggtgcaagtgcc

SEQ ID NO: 1988612 - DNA, 14 bp, Homo sapiens
ttgctcagtgcctc

SEQ ID NO: 1988613 - DNA, 21 bp, Homo sapiens
ttgctcagtgcctcctggccg

SEQ ID NO: 1988614 - DNA, 11 bp, Homo sapiens
ttgctcctcct

SEQ ID NO: 1988615 - DNA, 21 bp, Homo sapiens
ttgctctagtcttgctttgct

SEQ ID NO: 1988616 - DNA, 15 bp, Homo sapiens
ttgctctgcaggcac

SEQ ID NO: 1988617 - DNA, 17 bp, Homo sapiens
ttgctctgcaggcacct

SEQ ID NO: 1988618 - DNA, 13 bp, Homo sapiens
ttgctcttggaaa

SEQ ID NO: 1988619 - DNA, 16 bp, Homo sapiens
ttgctcttggaaagct

SEQ ID NO: 1988620 - DNA, 12 bp, Homo sapiens
ttgctgaaacac

SEQ ID NO: 1988621 - DNA, 14 bp, Homo sapiens
ttgctgagcaccct

SEQ ID NO: 1988622 - DNA, 12 bp, Homo sapiens
ttgctgctgccc

SEQ ID NO: 1988623 - DNA, 21 bp, Homo sapiens
ttgctggaagacgcaagggcc

SEQ ID NO: 1988624 - DNA, 15 bp, Homo sapiens
ttgctggactgagga

SEQ ID NO: 1988625 - DNA, 20 bp, Homo sapiens
ttgctggtgtctgagcttca

SEQ ID NO: 1988626 - DNA, 21 bp, Homo sapiens
ttgctgtcataagaatgaata

SEQ ID NO: 1988627 - DNA, 19 bp, Homo sapiens
ttgctgttgttccttcaca

SEQ ID NO: 1988628 - DNA, 13 bp, Homo sapiens
ttgctgttttgat

SEQ ID NO: 1988629 - DNA, 22 bp, Homo sapiens
ttgcttaaaattttacttttgt

SEQ ID NO: 1988630 - DNA, 15 bp, Homo sapiens
ttgcttaactggctg

SEQ ID NO: 1988631 - DNA, 24 bp, Homo sapiens
ttgcttaggatgtttttcatgaaa

SEQ ID NO: 1988632 - DNA, 21 bp, Homo sapiens
ttgcttagtatggttctcaga

SEQ ID NO: 1988633 - DNA, 24 bp, Homo sapiens
ttgcttctgcagcaactcccacga

SEQ ID NO: 1988634 - DNA, 13 bp, Homo sapiens
ttgcttgaaacca

SEQ ID NO: 1988635 - DNA, 14 bp, Homo sapiens
ttgcttgagcccag

SEQ ID NO: 1988636 - DNA, 11 bp, Homo sapiens
ttctctcccat

SEQ ID NO: 1988637 - DNA, 18 bp, Homo sapiens
ttctctccttcttccctg

SEQ ID NO: 1988638 - DNA, 16 bp, Homo sapiens
ttctctctaaaaataa

SEQ ID NO: 1988639 - DNA, 12 bp, Homo sapiens
ttctctctctgg

SEQ ID NO: 1988640 - DNA, 13 bp, Homo sapiens
ttctctctctggt

SEQ ID NO: 1988641 - DNA, 20 bp, Homo sapiens
ttctctgaggacactaacca

SEQ ID NO: 1988642 - DNA, 21 bp, Homo sapiens
ttctctgcttacccttcacct

SEQ ID NO: 1988643 - DNA, 18 bp, Homo sapiens
ttctcttacgctctctgt

SEQ ID NO: 1988644 - DNA, 12 bp, Homo sapiens
ttctcttcctgt

SEQ ID NO: 1988645 - DNA, 22 bp, Homo sapiens
ttctctttcttattttgtaata

SEQ ID NO: 1988646 - DNA, 17 bp, Homo sapiens
ttctctttctttttctg

SEQ ID NO: 1988647 - DNA, 14 bp, Homo sapiens
ttctctttgcctca

SEQ ID NO: 1988648 - DNA, 16 bp, Homo sapiens
ttctcttttcaaaaca

SEQ ID NO: 1988649 - DNA, 17 bp, Homo sapiens
ttctgaaaactgtttat

SEQ ID NO: 1988650 - DNA, 19 bp, Homo sapiens
ttctgaactcaagctgcgt

SEQ ID NO: 1988651 - DNA, 18 bp, Homo sapiens
ttctgaagctttaccagc

SEQ ID NO: 1988652 - DNA, 21 bp, Homo sapiens
ttctgacccaagaggtgggga

SEQ ID NO: 1988653 - DNA, 13 bp, Homo sapiens
ttctgactgctga

SEQ ID NO: 1988654 - DNA, 20 bp, Homo sapiens
ttctgacttctcccatctag

SEQ ID NO: 1988655 - DNA, 15 bp, Homo sapiens
ttctgagaaagacta

SEQ ID NO: 1988656 - DNA, 22 bp, Homo sapiens
ttctgagagttggctcaggcag

SEQ ID NO: 1988657 - DNA, 23 bp, Homo sapiens
ttctgagagttggctcaggcaga

SEQ ID NO: 1988658 - DNA, 20 bp, Homo sapiens
ttctgagtgtttttactaca

SEQ ID NO: 1988659 - DNA, 18 bp, Homo sapiens
ttctgatgacataataaa

SEQ ID NO: 1988660 - DNA, 12 bp, Homo sapiens
ttctgattccac

SEQ ID NO: 1988661 - DNA, 19 bp, Homo sapiens
ttctgcaactagccaaggc

SEQ ID NO: 1988662 - DNA, 13 bp, Homo sapiens
ttctgcacccaga

SEQ ID NO: 1988663 - DNA, 16 bp, Homo sapiens
ttctgcagcaactccc

SEQ ID NO: 1988664 - DNA, 18 bp, Homo sapiens
ttctgcagcaactcccac

SEQ ID NO: 1988665 - DNA, 16 bp, Homo sapiens
ttactacttgttacct

SEQ ID NO: 1988666 - DNA, 17 bp, Homo sapiens
ttactattatctgtgct

SEQ ID NO: 1988667 - DNA, 14 bp, Homo sapiens
ttactcacctctct

SEQ ID NO: 1988668 - DNA, 21 bp, Homo sapiens
ttactccacagcggaggagac

SEQ ID NO: 1988669 - DNA, 16 bp, Homo sapiens
ttactcccttcctggc

SEQ ID NO: 1988670 - DNA, 18 bp, Homo sapiens
ttactcccttcctggcct

SEQ ID NO: 1988671 - DNA, 19 bp, Homo sapiens
ttactcccttcctggcctc

SEQ ID NO: 1988672 - DNA, 15 bp, Homo sapiens
ttactcctttgcatt

SEQ ID NO: 1988673 - DNA, 16 bp, Homo sapiens
ttactctgagcccagg

SEQ ID NO: 1988674 - DNA, 20 bp, Homo sapiens
ttactctgagcccaggccgt

SEQ ID NO: 1988675 - DNA, 20 bp, Homo sapiens
ttactgaaaacaaaatatct

SEQ ID NO: 1988676 - DNA, 17 bp, Homo sapiens
ttactgacagaaatgca

SEQ ID NO: 1988677 - DNA, 18 bp, Homo sapiens
ttactgacagaaatgcaa

SEQ ID NO: 1988678 - DNA, 13 bp, Homo sapiens
ttactgagcttct

SEQ ID NO: 1988679 - DNA, 11 bp, Homo sapiens
ttactgctgtc

SEQ ID NO: 1988680 - DNA, 15 bp, Homo sapiens
ttactggaccccgcc

SEQ ID NO: 1988681 - DNA, 24 bp, Homo sapiens
ttactgtaattggtgacaatgtca

SEQ ID NO: 1988682 - DNA, 23 bp, Homo sapiens
ttactgtctggttttaacaattt

SEQ ID NO: 1988683 - DNA, 14 bp, Homo sapiens
ttacttattcttcc

SEQ ID NO: 1988684 - DNA, 14 bp, Homo sapiens
ttacttattttctg

SEQ ID NO: 1988685 - DNA, 11 bp, Homo sapiens
ttacttctgct

SEQ ID NO: 1988686 - DNA, 20 bp, Homo sapiens
ttacttgaaaaaatgttcta

SEQ ID NO: 1988687 - DNA, 19 bp, Homo sapiens
ttacttgcacaagcttgta

SEQ ID NO: 1988688 - DNA, 15 bp, Homo sapiens
ttacttgtagaaatc

SEQ ID NO: 1988689 - DNA, 16 bp, Homo sapiens
ttacttgtagaaatct

SEQ ID NO: 1988690 - DNA, 20 bp, Homo sapiens
ttacttttgtcttcctcact

SEQ ID NO: 1988691 - DNA, 19 bp, Homo sapiens
ttacttttgttctgtattt

SEQ ID NO: 1988692 - DNA, 14 bp, Homo sapiens
ttagaaaactttaa

SEQ ID NO: 1988693 - DNA, 16 bp, Homo sapiens
ttagaaaactttaaag

SEQ ID NO: 1988694 - DNA, 14 bp, Homo sapiens
ttagaaaccttaat

SEQ ID NO: 1988695 - DNA, 16 bp, Homo sapiens
ttagaaagttattgtg

SEQ ID NO: 1988696 - DNA, 16 bp, Homo sapiens
ttagaaatgcagaatc

SEQ ID NO: 1988697 - DNA, 20 bp, Homo sapiens
ttagaacactggtttaaagg

SEQ ID NO: 1988698 - DNA, 18 bp, Homo sapiens
ttagaacaggcaagtgaa

SEQ ID NO: 1988699 - DNA, 20 bp, Homo sapiens
ttagaacaggcaagtgaaga

SEQ ID NO: 1988700 - DNA, 14 bp, Homo sapiens
ttagaagtgtttta

SEQ ID NO: 1988701 - DNA, 14 bp, Homo sapiens
ttagaatatattaa

SEQ ID NO: 1988702 - DNA, 12 bp, Homo sapiens
ttagaatgaaaa

SEQ ID NO: 1988703 - DNA, 13 bp, Homo sapiens
ttagaatgaaaat

SEQ ID NO: 1988704 - DNA, 20 bp, Homo sapiens
ttagacagagtctcactgtt

SEQ ID NO: 1988705 - DNA, 16 bp, Homo sapiens
ttagacctcagcctgt

SEQ ID NO: 1988706 - DNA, 14 bp, Homo sapiens
ttagactagttgaa

SEQ ID NO: 1988707 - DNA, 16 bp, Homo sapiens
ttagactagttgaaca

SEQ ID NO: 1988708 - DNA, 17 bp, Homo sapiens
ttagactggaacttgaa

SEQ ID NO: 1988709 - DNA, 22 bp, Homo sapiens
ttagactggaacttgaactgat

SEQ ID NO: 1988710 - DNA, 21 bp, Homo sapiens
ttagacttcgactcaggatcc

SEQ ID NO: 1988711 - DNA, 16 bp, Homo sapiens
ttagagattaatttgt

SEQ ID NO: 1988712 - DNA, 22 bp, Homo sapiens
ttagagtatgcaagaagaatat

SEQ ID NO: 1988713 - DNA, 14 bp, Homo sapiens
ttagagtcagcctt

SEQ ID NO: 1988714 - DNA, 21 bp, Homo sapiens
ttagatatataactttagaaa

SEQ ID NO: 1988715 - DNA, 18 bp, Homo sapiens
ttagatcccatgtcacct

SEQ ID NO: 1988716 - DNA, 14 bp, Homo sapiens
ttagatgtgacaca

SEQ ID NO: 1988717 - DNA, 14 bp, Homo sapiens
ttagattagctctg

SEQ ID NO: 1988718 - DNA, 17 bp, Homo sapiens
ttagattcatctatgga

SEQ ID NO: 1988719 - DNA, 13 bp, Homo sapiens
ttagattttatga

SEQ ID NO: 1988720 - DNA, 18 bp, Homo sapiens
ttagattttgtgcagtta

SEQ ID NO: 1988721 - DNA, 18 bp, Homo sapiens
ttagcacaatttatattt

SEQ ID NO: 1988722 - DNA, 21 bp, Homo sapiens
ttagccttctctgttcatttc

SEQ ID NO: 1988723 - DNA, 14 bp, Homo sapiens
ttagccttgctcag

SEQ ID NO: 1988724 - DNA, 17 bp, Homo sapiens
ttagccttgtgccctgc

SEQ ID NO: 1988725 - DNA, 21 bp, Homo sapiens
ttagcgtagctaagtgaaaag

SEQ ID NO: 1988726 - DNA, 10 bp, Homo sapiens
ttagctgagc

SEQ ID NO: 1988727 - DNA, 16 bp, Homo sapiens
ttagcttagacctcag

SEQ ID NO: 1988728 - DNA, 17 bp, Homo sapiens
ttagcttagacctcagc

SEQ ID NO: 1988729 - DNA, 15 bp, Homo sapiens
ttagcttctctgcca

SEQ ID NO: 1988730 - DNA, 21 bp, Homo sapiens
ttagcttgaaggatctgtttt

SEQ ID NO: 1988731 - DNA, 20 bp, Homo sapiens
ttaggaaataaaacctttca

SEQ ID NO: 1988732 - DNA, 14 bp, Homo sapiens
ttaggaacagagta

SEQ ID NO: 1988733 - DNA, 17 bp, Homo sapiens
ttaggaacagagtatat

SEQ ID NO: 1988734 - DNA, 15 bp, Homo sapiens
ttaggaatatgttca

SEQ ID NO: 1988735 - DNA, 17 bp, Homo sapiens
ttaggaggctcaacaat

SEQ ID NO: 1988736 - DNA, 21 bp, Homo sapiens
ttaggagttcgagaccagcct

SEQ ID NO: 1988737 - DNA, 22 bp, Homo sapiens
ttaggataaagaatatttacaa

SEQ ID NO: 1988738 - DNA, 17 bp, Homo sapiens
ttaggatctatgcaatt

SEQ ID NO: 1988739 - DNA, 14 bp, Homo sapiens
ttaggatttaacag

SEQ ID NO: 1988740 - DNA, 22 bp, Homo sapiens
ttaggatttaacagtcatttaa

SEQ ID NO: 1988741 - DNA, 13 bp, Homo sapiens
ttaggcagcagct

SEQ ID NO: 1988742 - DNA, 15 bp, Homo sapiens
ttaggcatgcctaat

SEQ ID NO: 1988743 - DNA, 13 bp, Homo sapiens
ttaggcattattt

SEQ ID NO: 1988744 - DNA, 17 bp, Homo sapiens
ttaggcattatttaatg

SEQ ID NO: 1988745 - DNA, 19 bp, Homo sapiens
ttaggcattatttaatgtt

SEQ ID NO: 1988746 - DNA, 18 bp, Homo sapiens
ttaggcttaccttggtca

SEQ ID NO: 1988747 - DNA, 15 bp, Homo sapiens
ttagggagagaagat

SEQ ID NO: 1988748 - DNA, 14 bp, Homo sapiens
ttaggttataagaa

SEQ ID NO: 1988749 - DNA, 16 bp, Homo sapiens
ttaggttataagaaac

SEQ ID NO: 1988750 - DNA, 21 bp, Homo sapiens
ttaggtttccttttattctgt

SEQ ID NO: 1988751 - DNA, 23 bp, Homo sapiens
ttagtaaatccttatttatatat

SEQ ID NO: 1988752 - DNA, 21 bp, Homo sapiens
ttagtaataaaacccagcatg

SEQ ID NO: 1988753 - DNA, 18 bp, Homo sapiens
ttagtacagtagcttaaa

SEQ ID NO: 1988754 - DNA, 22 bp, Homo sapiens
ttagtacagtagcttaaataaa

SEQ ID NO: 1988755 - DNA, 14 bp, Homo sapiens
ttagtagagacagg

SEQ ID NO: 1988756 - DNA, 20 bp, Homo sapiens
ttagtattcaggcactgaga

SEQ ID NO: 1988757 - DNA, 14 bp, Homo sapiens
ttagtctgtcatcc

SEQ ID NO: 1988758 - DNA, 18 bp, Homo sapiens
ttagtcttttactccttt

SEQ ID NO: 1988759 - DNA, 11 bp, Homo sapiens
ttagtgactgt

SEQ ID NO: 1988760 - DNA, 14 bp, Homo sapiens
ttagtgagatttgt

SEQ ID NO: 1988761 - DNA, 16 bp, Homo sapiens
ttagtgattgtgtctg

SEQ ID NO: 1988762 - DNA, 21 bp, Homo sapiens
ttagtgtgtgtgcatgtgtgt

SEQ ID NO: 1988763 - DNA, 13 bp, Homo sapiens
ttagttaatatat

SEQ ID NO: 1988764 - DNA, 15 bp, Homo sapiens
ttagttagaaaataa

SEQ ID NO: 1988765 - DNA, 13 bp, Homo sapiens
ttagttatagttt

SEQ ID NO: 1988766 - DNA, 18 bp, Homo sapiens
ttagttatagtttcagat

SEQ ID NO: 1988767 - DNA, 15 bp, Homo sapiens
ttagttctttgttat

SEQ ID NO: 1988768 - DNA, 13 bp, Homo sapiens
ttagttgaaaaat

SEQ ID NO: 1988769 - DNA, 14 bp, Homo sapiens
ttagtttctttggg

SEQ ID NO: 1988770 - DNA, 15 bp, Homo sapiens
ttagtttgttttaca

SEQ ID NO: 1988771 - DNA, 15 bp, Homo sapiens
ttagttttagttgca

SEQ ID NO: 1988772 - DNA, 17 bp, Homo sapiens
ttagttttagttgcaga

SEQ ID NO: 1988773 - DNA, 17 bp, Homo sapiens
ttagttttatggcatga

SEQ ID NO: 1988774 - DNA, 19 bp, Homo sapiens
ttccaaataaggatttgtt

SEQ ID NO: 1988775 - DNA, 21 bp, Homo sapiens
ttccaaataaggatttgttca

SEQ ID NO: 1988776 - DNA, 17 bp, Homo sapiens
ttccaaatgaatgttgt

SEQ ID NO: 1988777 - DNA, 21 bp, Homo sapiens
ttccaacaatggggtgggccc

SEQ ID NO: 1988778 - DNA, 14 bp, Homo sapiens
ttccaaccccagct

SEQ ID NO: 1988779 - DNA, 20 bp, Homo sapiens
ttccaaccccagctggcctc

SEQ ID NO: 1988780 - DNA, 13 bp, Homo sapiens
ttccaagagctga

SEQ ID NO: 1988781 - DNA, 22 bp, Homo sapiens
ttccaagggttgaattctggag

SEQ ID NO: 1988782 - DNA, 15 bp, Homo sapiens
ttccacacaaaatgt

SEQ ID NO: 1988783 - DNA, 13 bp, Homo sapiens
ttccacataaagg

SEQ ID NO: 1988784 - DNA, 16 bp, Homo sapiens
ttccacatataaagct

SEQ ID NO: 1988785 - DNA, 14 bp, Homo sapiens
ttccacccattccc

SEQ ID NO: 1988786 - DNA, 19 bp, Homo sapiens
ttccacgatgaaaaacttc

SEQ ID NO: 1988787 - DNA, 15 bp, Homo sapiens
ttccactactgtgta

SEQ ID NO: 1988788 - DNA, 18 bp, Homo sapiens
ttccactgccaaaacaat

SEQ ID NO: 1988789 - DNA, 22 bp, Homo sapiens
ttccactggacttgagcttggc

SEQ ID NO: 1988790 - DNA, 13 bp, Homo sapiens
ttccactgtgcta

SEQ ID NO: 1988791 - DNA, 17 bp, Homo sapiens
ttccagaaaaccccagc

SEQ ID NO: 1988792 - DNA, 12 bp, Homo sapiens
ttccagaaaata

SEQ ID NO: 1988793 - DNA, 23 bp, Homo sapiens
ttccagaaaatataaatgcatga

SEQ ID NO: 1988794 - DNA, 17 bp, Homo sapiens
ttccagaagatgccctc

SEQ ID NO: 1988795 - DNA, 19 bp, Homo sapiens
ttccagaagatgccctcca

SEQ ID NO: 1988796 - DNA, 20 bp, Homo sapiens
ttccagaccacctgccagcc

SEQ ID NO: 1988797 - DNA, 23 bp, Homo sapiens
ttccagaccacctgccagccatc

SEQ ID NO: 1988798 - DNA, 16 bp, Homo sapiens
ttccagacctgaagaa

SEQ ID NO: 1988799 - DNA, 23 bp, Homo sapiens
ttccagactgcttccaattttct

SEQ ID NO: 1988800 - DNA, 17 bp, Homo sapiens
ttccagagagtcctctg

SEQ ID NO: 1988801 - DNA, 20 bp, Homo sapiens
ttccagagagtcctctggat

SEQ ID NO: 1988802 - DNA, 19 bp, Homo sapiens
ttccagagagtggctcctc

SEQ ID NO: 1988803 - DNA, 17 bp, Homo sapiens
ttccagagcctaagaaa

SEQ ID NO: 1988804 - DNA, 20 bp, Homo sapiens
ttccagaggctattattttc

SEQ ID NO: 1988805 - DNA, 14 bp, Homo sapiens
ttccagctgcctgg

SEQ ID NO: 1988806 - DNA, 22 bp, Homo sapiens
ttccagggcatccgcagcccag

SEQ ID NO: 1988807 - DNA, 17 bp, Homo sapiens
ttccaggtatctccagg

SEQ ID NO: 1988808 - DNA, 16 bp, Homo sapiens
ttccagtgcaacaaaa

SEQ ID NO: 1988809 - DNA, 21 bp, Homo sapiens
ttccagttcatctatggcagt

SEQ ID NO: 1988810 - DNA, 15 bp, Homo sapiens
ttccataaacaccca

SEQ ID NO: 1988811 - DNA, 17 bp, Homo sapiens
ttccataaggaatgtag

SEQ ID NO: 1988812 - DNA, 13 bp, Homo sapiens
ttccataattatg

SEQ ID NO: 1988813 - DNA, 22 bp, Homo sapiens
ttccataattatgacagttata

SEQ ID NO: 1988814 - DNA, 15 bp, Homo sapiens
ttccatccccaaact

SEQ ID NO: 1988815 - DNA, 14 bp, Homo sapiens
ttccatctaggact

SEQ ID NO: 1988816 - DNA, 22 bp, Homo sapiens
ttccatgaagacacgcttaaaa

SEQ ID NO: 1988817 - DNA, 18 bp, Homo sapiens
ttccatgaagaccacatc

SEQ ID NO: 1988818 - DNA, 21 bp, Homo sapiens
ttccatgattttacagagaat

SEQ ID NO: 1988819 - DNA, 14 bp, Homo sapiens
ttccatgcctgagg

SEQ ID NO: 1988820 - DNA, 22 bp, Homo sapiens
ttccatgcctgagggtggagac

SEQ ID NO: 1988821 - DNA, 17 bp, Homo sapiens
ttccatgggatgttaag

SEQ ID NO: 1988822 - DNA, 21 bp, Homo sapiens
ttccatgtcgcctctgcattc

SEQ ID NO: 1988823 - DNA, 13 bp, Homo sapiens
ttccatttctcaa

SEQ ID NO: 1988824 - DNA, 23 bp, Homo sapiens
ttccatttctcaatcagtgcagt

SEQ ID NO: 1988825 - DNA, 19 bp, Homo sapiens
ttccatttttactaaagca

SEQ ID NO: 1988826 - DNA, 14 bp, Homo sapiens
ttcccaagaaatgc

SEQ ID NO: 1988827 - DNA, 16 bp, Homo sapiens
ttcccaagtattgcga

SEQ ID NO: 1988828 - DNA, 16 bp, Homo sapiens
ttcccaataaaagtga

SEQ ID NO: 1988829 - DNA, 18 bp, Homo sapiens
ttcccaatcagcactgaa

SEQ ID NO: 1988830 - DNA, 18 bp, Homo sapiens
ttcccacaccccagcgcc

SEQ ID NO: 1988831 - DNA, 17 bp, Homo sapiens
ttcccaccgccctccct

SEQ ID NO: 1988832 - DNA, 19 bp, Homo sapiens
ttcccactaagctttctcc

SEQ ID NO: 1988833 - DNA, 20 bp, Homo sapiens
ttcccactaagctttctcct

SEQ ID NO: 1988834 - DNA, 18 bp, Homo sapiens
ttcccagagcaaaataat

SEQ ID NO: 1988835 - DNA, 14 bp, Homo sapiens
ttcccagatacttc

SEQ ID NO: 1988836 - DNA, 23 bp, Homo sapiens
ttcccagcagctgggccggccag

SEQ ID NO: 1988837 - DNA, 21 bp, Homo sapiens
ttcccagcattcagtggtcct

SEQ ID NO: 1988838 - DNA, 14 bp, Homo sapiens
ttcccagctctccc

SEQ ID NO: 1988839 - DNA, 19 bp, Homo sapiens
ttcccagctctccctctgg

SEQ ID NO: 1988840 - DNA, 15 bp, Homo sapiens
ttcccaggagaccat

SEQ ID NO: 1988841 - DNA, 16 bp, Homo sapiens
ttcccaggagaccatt

SEQ ID NO: 1988842 - DNA, 23 bp, Homo sapiens
ttcccatcactggagcaccaggc

SEQ ID NO: 1988843 - DNA, 13 bp, Homo sapiens
ttcccatccccag

SEQ ID NO: 1988844 - DNA, 18 bp, Homo sapiens
ttcccatgctgaattatt

SEQ ID NO: 1988845 - DNA, 20 bp, Homo sapiens
ttcccatgctgaattatttt

SEQ ID NO: 1988846 - DNA, 14 bp, Homo sapiens
ttcccattcttgca

SEQ ID NO: 1988847 - DNA, 14 bp, Homo sapiens
ttcccatttgtaat

SEQ ID NO: 1988848 - DNA, 17 bp, Homo sapiens
ttcccattttgcaaaat

SEQ ID NO: 1988849 - DNA, 16 bp, Homo sapiens
ttccccacctcttcct

SEQ ID NO: 1988850 - DNA, 14 bp, Homo sapiens
ttccccagacacat

SEQ ID NO: 1988851 - DNA, 17 bp, Homo sapiens
ttccccagactcagctc

SEQ ID NO: 1988852 - DNA, 19 bp, Homo sapiens
ttccccagactcagctcca

SEQ ID NO: 1988853 - DNA, 18 bp, Homo sapiens
ttccccaggggaaaatga

SEQ ID NO: 1988854 - DNA, 11 bp, Homo sapiens
ttcccccaccc

SEQ ID NO: 1988855 - DNA, 18 bp, Homo sapiens
ttcccccaccccagagtt

SEQ ID NO: 1988856 - DNA, 21 bp, Homo sapiens
ttcccccacccctaacctggc

SEQ ID NO: 1988857 - DNA, 18 bp, Homo sapiens
ttcccccatgtggctgaa

SEQ ID NO: 1988858 - DNA, 19 bp, Homo sapiens
ttcccccgctggcagccac

SEQ ID NO: 1988859 - DNA, 19 bp, Homo sapiens
ttccccctccaatcccacc

SEQ ID NO: 1988860 - DNA, 15 bp, Homo sapiens
ttccccctcccaggg

SEQ ID NO: 1988861 - DNA, 16 bp, Homo sapiens
ttccccggtcccttga

SEQ ID NO: 1988862 - DNA, 19 bp, Homo sapiens
ttcccctcgctgtcctgct

SEQ ID NO: 1988863 - DNA, 21 bp, Homo sapiens
ttcccctcgctgtcctgctgt

SEQ ID NO: 1988864 - DNA, 22 bp, Homo sapiens
ttccccttgcccagggctcagc

SEQ ID NO: 1988865 - DNA, 17 bp, Homo sapiens
ttccccttttgcctggc

SEQ ID NO: 1988866 - DNA, 18 bp, Homo sapiens
ttccccttttgcctggct

SEQ ID NO: 1988867 - DNA, 14 bp, Homo sapiens
ttcccgctcagccc

SEQ ID NO: 1988868 - DNA, 18 bp, Homo sapiens
ttcccgctcagccctccc

SEQ ID NO: 1988869 - DNA, 21 bp, Homo sapiens
ttcccggactgcaagcagggc

SEQ ID NO: 1988870 - DNA, 22 bp, Homo sapiens
ttcccgtggtctccttgcactt

SEQ ID NO: 1988871 - DNA, 13 bp, Homo sapiens
ttccctacttcct

SEQ ID NO: 1988872 - DNA, 13 bp, Homo sapiens
ttccctcatcttg

SEQ ID NO: 1988873 - DNA, 20 bp, Homo sapiens
ttccctccccacagtcctca

SEQ ID NO: 1988874 - DNA, 23 bp, Homo sapiens
ttccctcccgggagaggagatca

SEQ ID NO: 1988875 - DNA, 11 bp, Homo sapiens
ttccctctgag

SEQ ID NO: 1988876 - DNA, 17 bp, Homo sapiens
ttccctctttccccacc

SEQ ID NO: 1988877 - DNA, 18 bp, Homo sapiens
ttccctgaacatctgtgt

SEQ ID NO: 1988878 - DNA, 20 bp, Homo sapiens
ttccctgaacatctgtgtgt

SEQ ID NO: 1988879 - DNA, 15 bp, Homo sapiens
ttccctgaatgtatt

SEQ ID NO: 1988880 - DNA, 18 bp, Homo sapiens
ttccctgactcctctaag

SEQ ID NO: 1988881 - DNA, 21 bp, Homo sapiens
ttccctgagaaacccaccagc

SEQ ID NO: 1988882 - DNA, 16 bp, Homo sapiens
ttccctgcaccctgga

SEQ ID NO: 1988883 - DNA, 19 bp, Homo sapiens
ttccctgcatttctgagtt

SEQ ID NO: 1988884 - DNA, 21 bp, Homo sapiens
ttccctggcctggctctcctg

SEQ ID NO: 1988885 - DNA, 23 bp, Homo sapiens
ttccctggcttgtaactccacca

SEQ ID NO: 1988886 - DNA, 12 bp, Homo sapiens
ttccctgtgctg

SEQ ID NO: 1988887 - DNA, 14 bp, Homo sapiens
ttcccttgaccatt

SEQ ID NO: 1988888 - DNA, 16 bp, Homo sapiens
ttccgtgaagggcacc

SEQ ID NO: 1988889 - DNA, 19 bp, Homo sapiens
ttcctaaaaataagcttta

SEQ ID NO: 1988890 - DNA, 16 bp, Homo sapiens
ttcctaaatgcagtga

SEQ ID NO: 1988891 - DNA, 15 bp, Homo sapiens
ttcctacaaaatgga

SEQ ID NO: 1988892 - DNA, 17 bp, Homo sapiens
ttcctacagatagtcaa

SEQ ID NO: 1988893 - DNA, 20 bp, Homo sapiens
ttcctagactaattaaaatc

SEQ ID NO: 1988894 - DNA, 23 bp, Homo sapiens
ttcctagactaattaaaatctgg

SEQ ID NO: 1988895 - DNA, 14 bp, Homo sapiens
ttcctagtatatta

SEQ ID NO: 1988896 - DNA, 22 bp, Homo sapiens
ttcctatctgtatgtctgccta

SEQ ID NO: 1988897 - DNA, 21 bp, Homo sapiens
ttcctatttgttttcatggtg

SEQ ID NO: 1988898 - DNA, 20 bp, Homo sapiens
ttcctattttaaaaccatgc

SEQ ID NO: 1988899 - DNA, 17 bp, Homo sapiens
ttcctattttcagccca

SEQ ID NO: 1988900 - DNA, 13 bp, Homo sapiens
ttcctcaccaata

SEQ ID NO: 1988901 - DNA, 15 bp, Homo sapiens
ttcctcaccaataac

SEQ ID NO: 1988902 - DNA, 17 bp, Homo sapiens
ttcctcaccaataactt

SEQ ID NO: 1988903 - DNA, 15 bp, Homo sapiens
ttcctcactatgaca

SEQ ID NO: 1988904 - DNA, 13 bp, Homo sapiens
ttcctcagctgcc

SEQ ID NO: 1988905 - DNA, 15 bp, Homo sapiens
ttcctcagtcctgga

SEQ ID NO: 1988906 - DNA, 16 bp, Homo sapiens
ttcctcattcctgaaa

SEQ ID NO: 1988907 - DNA, 17 bp, Homo sapiens
ttcctccaaactcctgc

SEQ ID NO: 1988908 - DNA, 21 bp, Homo sapiens
ttcctccaaactcctgcctgt

SEQ ID NO: 1988909 - DNA, 23 bp, Homo sapiens
ttcctccccaccttccccagact

SEQ ID NO: 1988910 - DNA, 21 bp, Homo sapiens
ttcctccccattagagtcagc

SEQ ID NO: 1988911 - DNA, 19 bp, Homo sapiens
ttcctccgtccacccaggc

SEQ ID NO: 1988912 - DNA, 21 bp, Homo sapiens
ttcctccgtccacccaggctg

SEQ ID NO: 1988913 - DNA, 18 bp, Homo sapiens
ttcctccgtctgcaatgt

SEQ ID NO: 1988914 - DNA, 20 bp, Homo sapiens
ttcctcctccacagtgctgc

SEQ ID NO: 1988915 - DNA, 17 bp, Homo sapiens
ttcctcctcctttgcct

SEQ ID NO: 1988916 - DNA, 23 bp, Homo sapiens
ttcctcctgaagcctctgccctg

SEQ ID NO: 1988917 - DNA, 17 bp, Homo sapiens
ttcctcctgtgtacagg

SEQ ID NO: 1988918 - DNA, 19 bp, Homo sapiens
ttcctctagtgccctccac

SEQ ID NO: 1988919 - DNA, 23 bp, Homo sapiens
ttcctctagtgccctccacagcc

SEQ ID NO: 1988920 - DNA, 13 bp, Homo sapiens
ttcctctccactg

SEQ ID NO: 1988921 - DNA, 16 bp, Homo sapiens
ttcctctccactgcct

SEQ ID NO: 1988922 - DNA, 13 bp, Homo sapiens
ttcctctccagcc

SEQ ID NO: 1988923 - DNA, 14 bp, Homo sapiens
ttcctctccagcct

SEQ ID NO: 1988924 - DNA, 21 bp, Homo sapiens
ttcctctgtttctccttctga

SEQ ID NO: 1988925 - DNA, 13 bp, Homo sapiens
ttcctcttcccca

SEQ ID NO: 1988926 - DNA, 18 bp, Homo sapiens
ttcctcttccccttgccc

SEQ ID NO: 1988927 - DNA, 19 bp, Homo sapiens
ttcctcttccccttgccct

SEQ ID NO: 1988928 - DNA, 15 bp, Homo sapiens
ttcctctttgcatgg

SEQ ID NO: 1988929 - DNA, 12 bp, Homo sapiens
ttcctgaaagaa

SEQ ID NO: 1988930 - DNA, 17 bp, Homo sapiens
ttcctgaaagaaacagt

SEQ ID NO: 1988931 - DNA, 16 bp, Homo sapiens
ttcctgaatgaaatat

SEQ ID NO: 1988932 - DNA, 14 bp, Homo sapiens
ttcctgaccctccc

SEQ ID NO: 1988933 - DNA, 17 bp, Homo sapiens
ttcctgactgacacagg

SEQ ID NO: 1988934 - DNA, 19 bp, Homo sapiens
ttcctgataataattgatc

SEQ ID NO: 1988935 - DNA, 19 bp, Homo sapiens
ttcctgatggtacaggaaa

SEQ ID NO: 1988936 - DNA, 22 bp, Homo sapiens
ttcctgatggtacaggaaagct

SEQ ID NO: 1988937 - DNA, 11 bp, Homo sapiens
ttcctgcaccc

SEQ ID NO: 1988938 - DNA, 17 bp, Homo sapiens
ttcctgcactccagaat

SEQ ID NO: 1988939 - DNA, 15 bp, Homo sapiens
ttcctgcatttgtga

SEQ ID NO: 1988940 - DNA, 16 bp, Homo sapiens
ttcctgcatttgtgaa

SEQ ID NO: 1988941 - DNA, 12 bp, Homo sapiens
ttcctgccacca

SEQ ID NO: 1988942 - DNA, 18 bp, Homo sapiens
ttcctgccaccagtcact

SEQ ID NO: 1988943 - DNA, 15 bp, Homo sapiens
ttcctggacagctgt

SEQ ID NO: 1988944 - DNA, 17 bp, Homo sapiens
ttcctggacagctgtgc

SEQ ID NO: 1988945 - DNA, 24 bp, Homo sapiens
ttcctggccccgggctctggccac

SEQ ID NO: 1988946 - DNA, 20 bp, Homo sapiens
ttcctggcctcactggctgg

SEQ ID NO: 1988947 - DNA, 21 bp, Homo sapiens
ttcctggcctcactggctggg

SEQ ID NO: 1988948 - DNA, 14 bp, Homo sapiens
ttcctggcttctta

SEQ ID NO: 1988949 - DNA, 14 bp, Homo sapiens
ttcctgggcaagaa

SEQ ID NO: 1988950 - DNA, 11 bp, Homo sapiens
ttcctgggcct

SEQ ID NO: 1988951 - DNA, 15 bp, Homo sapiens
ttcctggggccccgc

SEQ ID NO: 1988952 - DNA, 12 bp, Homo sapiens
ttcctggtgagg

SEQ ID NO: 1988953 - DNA, 19 bp, Homo sapiens
ttcctgtaacacaagccac

SEQ ID NO: 1988954 - DNA, 22 bp, Homo sapiens
ttcctgtaacacaagccacaga

SEQ ID NO: 1988955 - DNA, 18 bp, Homo sapiens
ttcctgtagcatcttctg

SEQ ID NO: 1988956 - DNA, 14 bp, Homo sapiens
ttcctgtggccagg

SEQ ID NO: 1988957 - DNA, 11 bp, Homo sapiens
ttcctgtgtct

SEQ ID NO: 1988958 - DNA, 19 bp, Homo sapiens
ttcctgttcaccttatgta

SEQ ID NO: 1988959 - DNA, 20 bp, Homo sapiens
ttccttaagtcagaacagca

SEQ ID NO: 1988960 - DNA, 21 bp, Homo sapiens
ttccttagcttagacctcagc

SEQ ID NO: 1988961 - DNA, 14 bp, Homo sapiens
ttccttataagaat

SEQ ID NO: 1988962 - DNA, 15 bp, Homo sapiens
ttccttataagaatt

SEQ ID NO: 1988963 - DNA, 12 bp, Homo sapiens
ttccttccctgg

SEQ ID NO: 1988964 - DNA, 14 bp, Homo sapiens
ttccttccctggct

SEQ ID NO: 1988965 - DNA, 16 bp, Homo sapiens
ttccttccttccctgg

SEQ ID NO: 1988966 - DNA, 15 bp, Homo sapiens
ttccttctgcaccca

SEQ ID NO: 1988967 - DNA, 18 bp, Homo sapiens
ttccttctttctcttccc

SEQ ID NO: 1988968 - DNA, 18 bp, Homo sapiens
ttccttgctgtcctaggc

SEQ ID NO: 1988969 - DNA, 17 bp, Homo sapiens
ttccttggactcatttt

SEQ ID NO: 1988970 - DNA, 20 bp, Homo sapiens
ttccttggactcattttaaa

SEQ ID NO: 1988971 - DNA, 14 bp, Homo sapiens
ttccttggtttgga

SEQ ID NO: 1988972 - DNA, 16 bp, Homo sapiens
ttccttgtcaccagca

SEQ ID NO: 1988973 - DNA, 16 bp, Homo sapiens
ttccttgtcactggta

SEQ ID NO: 1988974 - DNA, 12 bp, Homo sapiens
ttcctttctcag

SEQ ID NO: 1988975 - DNA, 21 bp, Homo sapiens
ttccttttaaaacacttccat

SEQ ID NO: 1988976 - DNA, 14 bp, Homo sapiens
ttccttttcttcct

SEQ ID NO: 1988977 - DNA, 16 bp, Homo sapiens
ttccttttcttccttc

SEQ ID NO: 1988978 - DNA, 18 bp, Homo sapiens
ttccttttcttccttctt

SEQ ID NO: 1988979 - DNA, 17 bp, Homo sapiens
ttccttttgtgtacagt

SEQ ID NO: 1988980 - DNA, 21 bp, Homo sapiens
ttcgaaacctgtccataaagt

SEQ ID NO: 1988981 - DNA, 16 bp, Homo sapiens
ttcgagaccagcctgg

SEQ ID NO: 1988982 - DNA, 17 bp, Homo sapiens
ttcgagaccagcctggc

SEQ ID NO: 1988983 - DNA, 15 bp, Homo sapiens
ttcgaggtgtcaccc

SEQ ID NO: 1988984 - DNA, 20 bp, Homo sapiens
ttcgatacaccgggcctgga

SEQ ID NO: 1988985 - DNA, 20 bp, Homo sapiens
ttcgatgggcccaattctta

SEQ ID NO: 1988986 - DNA, 11 bp, Homo sapiens
ttcgcagccac

SEQ ID NO: 1988987 - DNA, 14 bp, Homo sapiens
ttcgcagccaccct

SEQ ID NO: 1988988 - DNA, 15 bp, Homo sapiens
ttcgcagccaccctg

SEQ ID NO: 1988989 - DNA, 16 bp, Homo sapiens
ttcgcagccaccctga

SEQ ID NO: 1988990 - DNA, 18 bp, Homo sapiens
ttcgcagccaccctgagg

SEQ ID NO: 1988991 - DNA, 17 bp, Homo sapiens
ttcgcccccatgtgact

SEQ ID NO: 1988992 - DNA, 17 bp, Homo sapiens
ttcgcctgtgggaagag

SEQ ID NO: 1988993 - DNA, 15 bp, Homo sapiens
ttcgctgccaggaca

SEQ ID NO: 1988994 - DNA, 17 bp, Homo sapiens
ttcgctgccaggacacc

SEQ ID NO: 1988995 - DNA, 17 bp, Homo sapiens
ttcgctgctagagaagg

SEQ ID NO: 1988996 - DNA, 19 bp, Homo sapiens
ttcgctgctctagctggca

SEQ ID NO: 1988997 - DNA, 15 bp, Homo sapiens
ttcgcttgcttctgc

SEQ ID NO: 1988998 - DNA, 17 bp, Homo sapiens
ttcggaagggaaaacag

SEQ ID NO: 1988999 - DNA, 18 bp, Homo sapiens
ttcggaagggaaaacagt

SEQ ID NO: 1989000 - DNA, 18 bp, Homo sapiens
ttcggaagggggaagtct

SEQ ID NO: 1989001 - DNA, 16 bp, Homo sapiens
ttcggggcaagtgaga

SEQ ID NO: 1989002 - DNA, 17 bp, Homo sapiens
ttcggggctgggaagtc

SEQ ID NO: 1989003 - DNA, 14 bp, Homo sapiens
ttcggtgggacagc

SEQ ID NO: 1989004 - DNA, 19 bp, Homo sapiens
ttcgtagctttcccaaata

SEQ ID NO: 1989005 - DNA, 12 bp, Homo sapiens
ttcgtctgtccc

SEQ ID NO: 1989006 - DNA, 22 bp, Homo sapiens
ttcgtggtgatcaattaaatgt

SEQ ID NO: 1989007 - DNA, 17 bp, Homo sapiens
tgggcccaggctctggg

SEQ ID NO: 1989008 - DNA, 21 bp, Homo sapiens
tgggcccaggctctgggaagg

SEQ ID NO: 1989009 - DNA, 14 bp, Homo sapiens
tgggccccatgctc

SEQ ID NO: 1989010 - DNA, 16 bp, Homo sapiens
tgggccccatgctctg

SEQ ID NO: 1989011 - DNA, 20 bp, Homo sapiens
tgggccccatgctctgcccc

SEQ ID NO: 1989012 - DNA, 21 bp, Homo sapiens
tgggccccatgctctgcccca

SEQ ID NO: 1989013 - DNA, 14 bp, Homo sapiens
tgggccctggggcc

SEQ ID NO: 1989014 - DNA, 21 bp, Homo sapiens
tgggccgctgctttgcgctgg

SEQ ID NO: 1989015 - DNA, 17 bp, Homo sapiens
tgggcctatggagagcc

SEQ ID NO: 1989016 - DNA, 18 bp, Homo sapiens
tgggcctcctctgtccag

SEQ ID NO: 1989017 - DNA, 16 bp, Homo sapiens
tgggcctcctgtgtgt

SEQ ID NO: 1989018 - DNA, 16 bp, Homo sapiens
tgggcctgcccaatgc

SEQ ID NO: 1989019 - DNA, 20 bp, Homo sapiens
tgggcctgcccaatgctttg

SEQ ID NO: 1989020 - DNA, 12 bp, Homo sapiens
tgggcctgctgc

SEQ ID NO: 1989021 - DNA, 15 bp, Homo sapiens
tgggcctggcctgag

SEQ ID NO: 1989022 - DNA, 18 bp, Homo sapiens
tgggcctggcctgagctg

SEQ ID NO: 1989023 - DNA, 12 bp, Homo sapiens
tgggcctgtgca

SEQ ID NO: 1989024 - DNA, 13 bp, Homo sapiens
tgggcctgtgcag

SEQ ID NO: 1989025 - DNA, 15 bp, Homo sapiens
tgggcctgtgcagca

SEQ ID NO: 1989026 - DNA, 19 bp, Homo sapiens
tgggccttacctcccctgc

SEQ ID NO: 1989027 - DNA, 22 bp, Homo sapiens
tgggccttacctcccctgccag

SEQ ID NO: 1989028 - DNA, 23 bp, Homo sapiens
tgggccttacctcccctgccagg

SEQ ID NO: 1989029 - DNA, 16 bp, Homo sapiens
tgggccttgctttggg

SEQ ID NO: 1989030 - DNA, 18 bp, Homo sapiens
tgggccttgctttgggct

SEQ ID NO: 1989031 - DNA, 13 bp, Homo sapiens
tgggcctttcctg

SEQ ID NO: 1989032 - DNA, 23 bp, Homo sapiens
tgggcgaatctacagaacaaaga

SEQ ID NO: 1989033 - DNA, 14 bp, Homo sapiens
tgggcgtttgtaaa

SEQ ID NO: 1989034 - DNA, 16 bp, Homo sapiens
tgggcgtttgtaaatt

SEQ ID NO: 1989035 - DNA, 14 bp, Homo sapiens
tgggctactggcag

SEQ ID NO: 1989036 - DNA, 17 bp, Homo sapiens
tgggctactggcagctc

SEQ ID NO: 1989037 - DNA, 19 bp, Homo sapiens
tgggctagtgtgagtggca

SEQ ID NO: 1989038 - DNA, 16 bp, Homo sapiens
tgggctcagggctgga

SEQ ID NO: 1989039 - DNA, 11 bp, Homo sapiens
tgggctcctgg

SEQ ID NO: 1989040 - DNA, 19 bp, Homo sapiens
tgggctcctggaaccaatc

SEQ ID NO: 1989041 - DNA, 17 bp, Homo sapiens
tgggctcctggctgcca

SEQ ID NO: 1989042 - DNA, 18 bp, Homo sapiens
tgggctctccacctcagc

SEQ ID NO: 1989043 - DNA, 19 bp, Homo sapiens
tgggctctccacctcagcc

SEQ ID NO: 1989044 - DNA, 12 bp, Homo sapiens
tgggctgagccc

SEQ ID NO: 1989045 - DNA, 16 bp, Homo sapiens
tgggctgagccctggc

SEQ ID NO: 1989046 - DNA, 14 bp, Homo sapiens
tgggctgccctggt

SEQ ID NO: 1989047 - DNA, 16 bp, Homo sapiens
tgggctgccctggtgc

SEQ ID NO: 1989048 - DNA, 19 bp, Homo sapiens
tgggctgccctggtgctgc

SEQ ID NO: 1989049 - DNA, 20 bp, Homo sapiens
tgggctgccctggtgctgcc

SEQ ID NO: 1989050 - DNA, 15 bp, Homo sapiens
tgggcttggccttgt

SEQ ID NO: 1989051 - DNA, 18 bp, Homo sapiens
tgggctttctccggggtc

SEQ ID NO: 1989052 - DNA, 15 bp, Homo sapiens
tgggctttgcaggct

SEQ ID NO: 1989053 - DNA, 16 bp, Homo sapiens
tgggctttgcaggctc

SEQ ID NO: 1989054 - DNA, 19 bp, Homo sapiens
tgggctttgcaggctctgg

SEQ ID NO: 1989055 - DNA, 20 bp, Homo sapiens
tgggctttgcaggctctggg

SEQ ID NO: 1989056 - DNA, 22 bp, Homo sapiens
tggggaagtgctccccacacgt

SEQ ID NO: 1989057 - DNA, 20 bp, Homo sapiens
tggggacactaatgaagata

SEQ ID NO: 1989058 - DNA, 17 bp, Homo sapiens
tggggacagttggcaga

SEQ ID NO: 1989059 - DNA, 18 bp, Homo sapiens
tggggacagttggcagag

SEQ ID NO: 1989060 - DNA, 19 bp, Homo sapiens
tggggacagttggcagaga

SEQ ID NO: 1989061 - DNA, 23 bp, Homo sapiens
tggggagaaataaattttgtttc

SEQ ID NO: 1989062 - DNA, 20 bp, Homo sapiens
tggggagacggtgttgcaga

SEQ ID NO: 1989063 - DNA, 20 bp, Homo sapiens
tggggagcacttgcgtcctg

SEQ ID NO: 1989064 - DNA, 13 bp, Homo sapiens
tggggagcagagt

SEQ ID NO: 1989065 - DNA, 23 bp, Homo sapiens
tggggagcagagtataggatgga

SEQ ID NO: 1989066 - DNA, 14 bp, Homo sapiens
tggggagcaggtct

SEQ ID NO: 1989067 - DNA, 16 bp, Homo sapiens
tggggagccaacagaa

SEQ ID NO: 1989068 - DNA, 20 bp, Homo sapiens
tggggaggaagggccaggag

SEQ ID NO: 1989069 - DNA, 22 bp, Homo sapiens
tggggaggaagggccaggagag

SEQ ID NO: 1989070 - DNA, 16 bp, Homo sapiens
tggggagggggaagag

SEQ ID NO: 1989071 - DNA, 20 bp, Homo sapiens
tggggagggtggaggggtga

SEQ ID NO: 1989072 - DNA, 15 bp, Homo sapiens
tggggatgagaaagg

SEQ ID NO: 1989073 - DNA, 13 bp, Homo sapiens
tggggcagcttga

SEQ ID NO: 1989074 - DNA, 11 bp, Homo sapiens
tggggcagtgg

SEQ ID NO: 1989075 - DNA, 20 bp, Homo sapiens
tggggcatagaaactgagga

SEQ ID NO: 1989076 - DNA, 23 bp, Homo sapiens
tggggcatggttccttccctggg

SEQ ID NO: 1989077 - DNA, 22 bp, Homo sapiens
tggggcatgtgtgcctgtggca

SEQ ID NO: 1989078 - DNA, 21 bp, Homo sapiens
tggggccagtgtaaggcatag

SEQ ID NO: 1989079 - DNA, 22 bp, Homo sapiens
tggggccagtgtaaggcatagg

SEQ ID NO: 1989080 - DNA, 12 bp, Homo sapiens
tggggccctggg

SEQ ID NO: 1989081 - DNA, 18 bp, Homo sapiens
tggggcctagatccacac

SEQ ID NO: 1989082 - DNA, 14 bp, Homo sapiens
tggggcctggagag

SEQ ID NO: 1989083 - DNA, 17 bp, Homo sapiens
tggggcctggagagggg

SEQ ID NO: 1989084 - DNA, 18 bp, Homo sapiens
tggggcctggagaggggc

SEQ ID NO: 1989085 - DNA, 16 bp, Homo sapiens
tggggcctggcttgct

SEQ ID NO: 1989086 - DNA, 18 bp, Homo sapiens
tggggcggtgagagggga

SEQ ID NO: 1989087 - DNA, 18 bp, Homo sapiens
tggggctcgccccaccca

SEQ ID NO: 1989088 - DNA, 20 bp, Homo sapiens
tggggctcgccccacccagg

SEQ ID NO: 1989089 - DNA, 22 bp, Homo sapiens
tggggctcgccccacccagggc

SEQ ID NO: 1989090 - DNA, 18 bp, Homo sapiens
tggggctctaacgcctga

SEQ ID NO: 1989091 - DNA, 23 bp, Homo sapiens
tggggctctaacgcctgagccca

SEQ ID NO: 1989092 - DNA, 24 bp, Homo sapiens
tggggctctaacgcctgagcccag

SEQ ID NO: 1989093 - DNA, 13 bp, Homo sapiens
tggggctgcggga

SEQ ID NO: 1989094 - DNA, 16 bp, Homo sapiens
tggggcttctcctgac

SEQ ID NO: 1989095 - DNA, 18 bp, Homo sapiens
tggggcttctcctgaccc

SEQ ID NO: 1989096 - DNA, 17 bp, Homo sapiens
tggtctcaaactcttga

SEQ ID NO: 1989097 - DNA, 12 bp, Homo sapiens
tggtctcagaaa

SEQ ID NO: 1989098 - DNA, 19 bp, Homo sapiens
tggtctccctccagctgga

SEQ ID NO: 1989099 - DNA, 13 bp, Homo sapiens
tggtctcctccca

SEQ ID NO: 1989100 - DNA, 21 bp, Homo sapiens
tggtctctcgggccccccaca

SEQ ID NO: 1989101 - DNA, 22 bp, Homo sapiens
tggtctctgctgaaggttgtaa

SEQ ID NO: 1989102 - DNA, 17 bp, Homo sapiens
tggtctgacccactgct

SEQ ID NO: 1989103 - DNA, 16 bp, Homo sapiens
tggtctgagcaccccc

SEQ ID NO: 1989104 - DNA, 20 bp, Homo sapiens
tggtctgagcaccccctcat

SEQ ID NO: 1989105 - DNA, 14 bp, Homo sapiens
tggtctgccctggg

SEQ ID NO: 1989106 - DNA, 23 bp, Homo sapiens
tggtctgctcaggaattgaagat

SEQ ID NO: 1989107 - DNA, 12 bp, Homo sapiens
tggtctgtgtga

SEQ ID NO: 1989108 - DNA, 14 bp, Homo sapiens
tggtcttcactgcc

SEQ ID NO: 1989109 - DNA, 15 bp, Homo sapiens
tggtcttcactgcca

SEQ ID NO: 1989110 - DNA, 10 bp, Homo sapiens
tggtctttga

SEQ ID NO: 1989111 - DNA, 11 bp, Homo sapiens
tggtctttgaa

SEQ ID NO: 1989112 - DNA, 14 bp, Homo sapiens
tggtctttgaataa

SEQ ID NO: 1989113 - DNA, 15 bp, Homo sapiens
tggtctttgaataaa

SEQ ID NO: 1989114 - DNA, 21 bp, Homo sapiens
tggtctttgaataaagtctga

SEQ ID NO: 1989115 - DNA, 22 bp, Homo sapiens
tggtctttgaataaagtctgag

SEQ ID NO: 1989116 - DNA, 13 bp, Homo sapiens
tggtgaaattatg

SEQ ID NO: 1989117 - DNA, 18 bp, Homo sapiens
tggtgacatgtgcctgta

SEQ ID NO: 1989118 - DNA, 15 bp, Homo sapiens
tggtgacctctgcct

SEQ ID NO: 1989119 - DNA, 13 bp, Homo sapiens
tgtagaagatgga

SEQ ID NO: 1989120 - DNA, 14 bp, Homo sapiens
tgtagaataaatga

SEQ ID NO: 1989121 - DNA, 17 bp, Homo sapiens
tgtagaatgatttcatg

SEQ ID NO: 1989122 - DNA, 12 bp, Homo sapiens
tgtagactatat

SEQ ID NO: 1989123 - DNA, 15 bp, Homo sapiens
tgtagactatataca

SEQ ID NO: 1989124 - DNA, 17 bp, Homo sapiens
tgtagactatatacatg

SEQ ID NO: 1989125 - DNA, 23 bp, Homo sapiens
tgtagactatatacatgtgtgta

SEQ ID NO: 1989126 - DNA, 18 bp, Homo sapiens
tgtagagccagggtctca

SEQ ID NO: 1989127 - DNA, 21 bp, Homo sapiens
tgtagattaaggtgatgtgat

SEQ ID NO: 1989128 - DNA, 17 bp, Homo sapiens
tgtagattacctgccac

SEQ ID NO: 1989129 - DNA, 20 bp, Homo sapiens
tgtagcaaccttctgcattc

SEQ ID NO: 1989130 - DNA, 20 bp, Homo sapiens
tgtagcaactacagtctaaa

SEQ ID NO: 1989131 - DNA, 11 bp, Homo sapiens
tgtagcagtga

SEQ ID NO: 1989132 - DNA, 23 bp, Homo sapiens
tgtagcagtgagaaaaagctcct

SEQ ID NO: 1989133 - DNA, 16 bp, Homo sapiens
tgtagcatcttctgga

SEQ ID NO: 1989134 - DNA, 16 bp, Homo sapiens
tgtagccatggctcag

SEQ ID NO: 1989135 - DNA, 21 bp, Homo sapiens
tgtagccatggctcaggcaag

SEQ ID NO: 1989136 - DNA, 17 bp, Homo sapiens
tgtagcccggccagggc

SEQ ID NO: 1989137 - DNA, 15 bp, Homo sapiens
tgtcaactatgatat

SEQ ID NO: 1989138 - DNA, 13 bp, Homo sapiens
tgtcaagattttt

SEQ ID NO: 1989139 - DNA, 19 bp, Homo sapiens
tgtcaagtataaagtcagg

SEQ ID NO: 1989140 - DNA, 18 bp, Homo sapiens
tgtcaatattaaatacag

SEQ ID NO: 1989141 - DNA, 21 bp, Homo sapiens
tgtcaatattaaatacagaca

SEQ ID NO: 1989142 - DNA, 17 bp, Homo sapiens
tgtcaatgattattttc

SEQ ID NO: 1989143 - DNA, 13 bp, Homo sapiens
tgtcacacacttt

SEQ ID NO: 1989144 - DNA, 15 bp, Homo sapiens
tgtcacactgagctg

SEQ ID NO: 1989145 - DNA, 18 bp, Homo sapiens
tgtcacacttgtttcttg

SEQ ID NO: 1989146 - DNA, 15 bp, Homo sapiens
tgtcacagctctgta

SEQ ID NO: 1989147 - DNA, 18 bp, Homo sapiens
tgtcacagctctgtagaa

SEQ ID NO: 1989148 - DNA, 23 bp, Homo sapiens
tgtcaccaccttcccagctctcc

SEQ ID NO: 1989149 - DNA, 17 bp, Homo sapiens
tgtcaccagcaacatct

SEQ ID NO: 1989150 - DNA, 19 bp, Homo sapiens
tgtcaccagcaacatctcg

SEQ ID NO: 1989151 - DNA, 14 bp, Homo sapiens
tgtcaccagctatc

SEQ ID NO: 1989152 - DNA, 15 bp, Homo sapiens
tgtcaccagctatct

SEQ ID NO: 1989153 - DNA, 22 bp, Homo sapiens
tgtcaccagctgccaaaatcgt

SEQ ID NO: 1989154 - DNA, 20 bp, Homo sapiens
tgtcctctcgagcccagatg

SEQ ID NO: 1989155 - DNA, 15 bp, Homo sapiens
tgtcctcttgctcaa

SEQ ID NO: 1989156 - DNA, 17 bp, Homo sapiens
tgtcctgccagctgcct

SEQ ID NO: 1989157 - DNA, 13 bp, Homo sapiens
tgtcctgcctctc

SEQ ID NO: 1989158 - DNA, 13 bp, Homo sapiens
tgtcctgccttga

SEQ ID NO: 1989159 - DNA, 17 bp, Homo sapiens
tgtcctgctctcttcag

SEQ ID NO: 1989160 - DNA, 19 bp, Homo sapiens
tgtcctgctctcttcagga

SEQ ID NO: 1989161 - DNA, 19 bp, Homo sapiens
tgtcctgggagtgagctgg

SEQ ID NO: 1989162 - DNA, 20 bp, Homo sapiens
tgtcctgggagtgagctggt

SEQ ID NO: 1989163 - DNA, 15 bp, Homo sapiens
tgtcctggtacagca

SEQ ID NO: 1989164 - DNA, 15 bp, Homo sapiens
tgtccttgcacctgc

SEQ ID NO: 1989165 - DNA, 16 bp, Homo sapiens
tgtccttgcacctgca

SEQ ID NO: 1989166 - DNA, 18 bp, Homo sapiens
tgtccttggaagtttcat

SEQ ID NO: 1989167 - DNA, 15 bp, Homo sapiens
tgtccttgtgtgttt

SEQ ID NO: 1989168 - DNA, 19 bp, Homo sapiens
tgtcctttgagaaagaaat

SEQ ID NO: 1989169 - DNA, 20 bp, Homo sapiens
tgtcctttgagaaagaaata

SEQ ID NO: 1989170 - DNA, 17 bp, Homo sapiens
tgtccttttaggaatat

SEQ ID NO: 1989171 - DNA, 13 bp, Homo sapiens
tgtcgagacactt

SEQ ID NO: 1989172 - DNA, 18 bp, Homo sapiens
tgtcgattagactggaca

SEQ ID NO: 1989173 - DNA, 16 bp, Homo sapiens
tgtcgccccaggccct

SEQ ID NO: 1989174 - DNA, 17 bp, Homo sapiens
tgtcgccccaggccctc

SEQ ID NO: 1989175 - DNA, 17 bp, Homo sapiens
tgtcgctctgctggcct

SEQ ID NO: 1989176 - DNA, 19 bp, Homo sapiens
tgtcgctctgctggcctgg

SEQ ID NO: 1989177 - DNA, 16 bp, Homo sapiens
tgtcggagtagaaatt

SEQ ID NO: 1989178 - DNA, 17 bp, Homo sapiens
tgtcgtgtttacaaaag

SEQ ID NO: 1989179 - DNA, 23 bp, Homo sapiens
tgtcgtgtttacaaaaggcagcc

SEQ ID NO: 1989180 - DNA, 18 bp, Homo sapiens
tgtcgtttttttcttgtg

SEQ ID NO: 1989181 - DNA, 22 bp, Homo sapiens
tgtctaaggtcacacagtatta

SEQ ID NO: 1989182 - DNA, 20 bp, Homo sapiens
tgtctacctcacagaaatgt

SEQ ID NO: 1989183 - DNA, 22 bp, Homo sapiens
tgtctagaggtgagaccaaagg

SEQ ID NO: 1989184 - DNA, 22 bp, Homo sapiens
tgtctattagttttctttgtaa

SEQ ID NO: 1989185 - DNA, 14 bp, Homo sapiens
tgtctattctgagc

SEQ ID NO: 1989186 - DNA, 15 bp, Homo sapiens
tgtctattctgagcc

SEQ ID NO: 1989187 - DNA, 17 bp, Homo sapiens
tgtctccactaaatgag

SEQ ID NO: 1989188 - DNA, 21 bp, Homo sapiens
tgtctccactaaatgagctcc

SEQ ID NO: 1989189 - DNA, 20 bp, Homo sapiens
tgtctcgagcgccctgcaga

SEQ ID NO: 1989190 - DNA, 22 bp, Homo sapiens
tgtctctagtttctttctgtta

SEQ ID NO: 1989191 - DNA, 13 bp, Homo sapiens
tgtctctgaggac

SEQ ID NO: 1989192 - DNA, 20 bp, Homo sapiens
tgtctctgcatctcattgta

SEQ ID NO: 1989193 - DNA, 23 bp, Homo sapiens
tgtctctgggcttggggcttcct

SEQ ID NO: 1989194 - DNA, 15 bp, Homo sapiens
tgtctcttcctctgt

SEQ ID NO: 1989195 - DNA, 20 bp, Homo sapiens
tgtctcttcctctgttctat

SEQ ID NO: 1989196 - DNA, 18 bp, Homo sapiens
tgtctgaggcctcatccc

SEQ ID NO: 1989197 - DNA, 15 bp, Homo sapiens
tgtctgatgtttgtt

SEQ ID NO: 1989198 - DNA, 19 bp, Homo sapiens
tgtctgattggctcaccca

SEQ ID NO: 1989199 - DNA, 15 bp, Homo sapiens
tgtctgcattgttat

SEQ ID NO: 1989200 - DNA, 21 bp, Homo sapiens
tgtctgcgtggttcctttctc

SEQ ID NO: 1989201 - DNA, 14 bp, Homo sapiens
tgtctggctgtacg

SEQ ID NO: 1989202 - DNA, 21 bp, Homo sapiens
tgtctggtggtggcaccatct

SEQ ID NO: 1989203 - DNA, 14 bp, Homo sapiens
tgtctggtgtagct

SEQ ID NO: 1989204 - DNA, 14 bp, Homo sapiens
tgtctgtaagagaa

SEQ ID NO: 1989205 - DNA, 13 bp, Homo sapiens
tgtctgtacacgt

SEQ ID NO: 1989206 - DNA, 21 bp, Homo sapiens
tgtctgtacacgtgtcctgta

SEQ ID NO: 1989207 - DNA, 15 bp, Homo sapiens
tgtctgtctgtccca

SEQ ID NO: 1989208 - DNA, 19 bp, Homo sapiens
tgtcttataggtttccact

SEQ ID NO: 1989209 - DNA, 14 bp, Homo sapiens
tgtcttatatagca

SEQ ID NO: 1989210 - DNA, 14 bp, Homo sapiens
tgtcttcacaacct

SEQ ID NO: 1989211 - DNA, 15 bp, Homo sapiens
tgtcttcatagcaga

SEQ ID NO: 1989212 - DNA, 16 bp, Homo sapiens
tgtcttcatttcattg

SEQ ID NO: 1989213 - DNA, 21 bp, Homo sapiens
tgtcttcatttcattgtatga

SEQ ID NO: 1989214 - DNA, 19 bp, Homo sapiens
tgtcttccaaccccagctg

SEQ ID NO: 1989215 - DNA, 20 bp, Homo sapiens
tgtcttccaaccccagctgg

SEQ ID NO: 1989216 - DNA, 14 bp, Homo sapiens
tgtcttccataatg

SEQ ID NO: 1989217 - DNA, 15 bp, Homo sapiens
tgtcttccttggcct

SEQ ID NO: 1989218 - DNA, 13 bp, Homo sapiens
tgtcttctctcaa

SEQ ID NO: 1989219 - DNA, 17 bp, Homo sapiens
tgtcttgcaatggcagc

SEQ ID NO: 1989220 - DNA, 13 bp, Homo sapiens
tgtcttgtacatg

SEQ ID NO: 1989221 - DNA, 22 bp, Homo sapiens
tgtctttaaatcttcaatatga

SEQ ID NO: 1989222 - DNA, 19 bp, Homo sapiens
tgtctttaggcagcagctt

SEQ ID NO: 1989223 - DNA, 23 bp, Homo sapiens
tgtctttcagcattcagtccgcc

SEQ ID NO: 1989224 - DNA, 17 bp, Homo sapiens
tgtctttctccaaagtt

SEQ ID NO: 1989225 - DNA, 19 bp, Homo sapiens
tgtctttctccaaagttat

SEQ ID NO: 1989226 - DNA, 13 bp, Homo sapiens
tgtctttgtggga

SEQ ID NO: 1989227 - DNA, 16 bp, Homo sapiens
tgtcttttccactcct

SEQ ID NO: 1989228 - DNA, 13 bp, Homo sapiens
tgtgaaaatgggt

SEQ ID NO: 1989229 - DNA, 15 bp, Homo sapiens
tgtgaaaccacaggc

SEQ ID NO: 1989230 - DNA, 18 bp, Homo sapiens
tgtgaaagtatgtgatat

SEQ ID NO: 1989231 - DNA, 19 bp, Homo sapiens
tgtgaaattcaacctgtgt

SEQ ID NO: 1989232 - DNA, 21 bp, Homo sapiens
tgtgaaccaccacacccagcc

SEQ ID NO: 1989233 - DNA, 15 bp, Homo sapiens
tgtgaacccaggaca

SEQ ID NO: 1989234 - DNA, 21 bp, Homo sapiens
tgtgaacccaggacaagcatg

SEQ ID NO: 1989235 - DNA, 13 bp, Homo sapiens
tgtgaagggtggg

SEQ ID NO: 1989236 - DNA, 14 bp, Homo sapiens
tgtgaatagtctgt

SEQ ID NO: 1989237 - DNA, 22 bp, Homo sapiens
tgtgaattgcctgcagagagaa

SEQ ID NO: 1989238 - DNA, 14 bp, Homo sapiens
tgtgacaacctttg

SEQ ID NO: 1989239 - DNA, 16 bp, Homo sapiens
tgtgacaacctttgtg

SEQ ID NO: 1989240 - DNA, 17 bp, Homo sapiens
tgtgacaacctttgtgt

SEQ ID NO: 1989241 - DNA, 21 bp, Homo sapiens
tgtgacaaggattgctactgt

SEQ ID NO: 1989242 - DNA, 22 bp, Homo sapiens
tgtgacagaatcttgtatttgg

SEQ ID NO: 1989243 - DNA, 18 bp, Homo sapiens
tgtgacaggaaagccctc

SEQ ID NO: 1989244 - DNA, 19 bp, Homo sapiens
tgtgacaggaaagccctcc

SEQ ID NO: 1989245 - DNA, 23 bp, Homo sapiens
tgtgacaggaaagccctccccct

SEQ ID NO: 1989246 - DNA, 17 bp, Homo sapiens
tgtgaccaaaagttaca

SEQ ID NO: 1989247 - DNA, 15 bp, Homo sapiens
tgtgaccaggggtga

SEQ ID NO: 1989248 - DNA, 14 bp, Homo sapiens
tgtgaccctctgaa

SEQ ID NO: 1989249 - DNA, 13 bp, Homo sapiens
tgtgacctgctga

SEQ ID NO: 1989250 - DNA, 14 bp, Homo sapiens
tgtgacctgctgag

SEQ ID NO: 1989251 - DNA, 13 bp, Homo sapiens
tgtgaccttctct

SEQ ID NO: 1989252 - DNA, 18 bp, Homo sapiens
tgtgactatatagagatg

SEQ ID NO: 1989253 - DNA, 20 bp, Homo sapiens
tgtgactatatagagatgtt

SEQ ID NO: 1989254 - DNA, 13 bp, Homo sapiens
tgtgactcgctta

SEQ ID NO: 1989255 - DNA, 16 bp, Homo sapiens
tgtgactctaaattct

SEQ ID NO: 1989256 - DNA, 18 bp, Homo sapiens
tgtgacttcagctctgtt

SEQ ID NO: 1989257 - DNA, 11 bp, Homo sapiens
tgtggcctcag

SEQ ID NO: 1989258 - DNA, 16 bp, Homo sapiens
tgtggcctcagccctc

SEQ ID NO: 1989259 - DNA, 16 bp, Homo sapiens
tgtggcctgtgtccag

SEQ ID NO: 1989260 - DNA, 22 bp, Homo sapiens
tgtggcgttctgctgcccctgc

SEQ ID NO: 1989261 - DNA, 19 bp, Homo sapiens
tgtggctcctgccttgatg

SEQ ID NO: 1989262 - DNA, 19 bp, Homo sapiens
tgtggctgcagagaccttg

SEQ ID NO: 1989263 - DNA, 19 bp, Homo sapiens
tgtgggcagcaccctcccc

SEQ ID NO: 1989264 - DNA, 23 bp, Homo sapiens
tgtggggaagcaagacgtcctgg

SEQ ID NO: 1989265 - DNA, 14 bp, Homo sapiens
tgtggggaggcagc

SEQ ID NO: 1989266 - DNA, 20 bp, Homo sapiens
tgtgggggtggccatccctg

SEQ ID NO: 1989267 - DNA, 15 bp, Homo sapiens
tgtgggtcaaggaat

SEQ ID NO: 1989268 - DNA, 22 bp, Homo sapiens
tgtgggtgttaatttttgatac

SEQ ID NO: 1989269 - DNA, 16 bp, Homo sapiens
tgtggtacaatctcaa

SEQ ID NO: 1989270 - DNA, 22 bp, Homo sapiens
tgtggtagggacttaaaaaact

SEQ ID NO: 1989271 - DNA, 16 bp, Homo sapiens
tgtggtatatttgtgt

SEQ ID NO: 1989272 - DNA, 20 bp, Homo sapiens
tgtggtatatttgtgtatgt

SEQ ID NO: 1989273 - DNA, 17 bp, Homo sapiens
tgtggtggctgtctctg

SEQ ID NO: 1989274 - DNA, 23 bp, Homo sapiens
tgtggtgggttctttggaaggag

SEQ ID NO: 1989275 - DNA, 15 bp, Homo sapiens
tgtggttaatgccat

SEQ ID NO: 1989276 - DNA, 21 bp, Homo sapiens
tgtggttcctaagcctgttgc

SEQ ID NO: 1989277 - DNA, 9 bp, Homo sapiens
tgtgtaaat

SEQ ID NO: 1989278 - DNA, 15 bp, Homo sapiens
tgtgtaataagaaag

SEQ ID NO: 1989279 - DNA, 18 bp, Homo sapiens
tgtgtaataagaaagtat

SEQ ID NO: 1989280 - DNA, 20 bp, Homo sapiens
tgtgtacaaagtagagaagt

SEQ ID NO: 1989281 - DNA, 10 bp, Homo sapiens
tgtgtacagg

SEQ ID NO: 1989282 - DNA, 19 bp, Homo sapiens
tgtgtacagtgtgtaaagt

SEQ ID NO: 1989283 - DNA, 23 bp, Homo sapiens
tgtgtactctttatttctagcag

SEQ ID NO: 1989284 - DNA, 18 bp, Homo sapiens
tgtgtacttcagtcttgg

SEQ ID NO: 1989285 - DNA, 19 bp, Homo sapiens
tgtgtacttcagtcttgga

SEQ ID NO: 1989286 - DNA, 15 bp, Homo sapiens
tgtgtagcctgtgca

SEQ ID NO: 1989287 - DNA, 23 bp, Homo sapiens
tgtgtagcctgtgcatgtatgtc

SEQ ID NO: 1989288 - DNA, 14 bp, Homo sapiens
tgtgtagggaaagt

SEQ ID NO: 1989289 - DNA, 16 bp, Homo sapiens
tgtgtagggcgggagg

SEQ ID NO: 1989290 - DNA, 17 bp, Homo sapiens
tgtgtataagtgcacac

SEQ ID NO: 1989291 - DNA, 23 bp, Homo sapiens
tgtgtatatatgtgtatatatac

SEQ ID NO: 1989292 - DNA, 14 bp, Homo sapiens
tgtgtatgtatgtg

SEQ ID NO: 1989293 - DNA, 15 bp, Homo sapiens
tgtgtattctggctg

SEQ ID NO: 1989294 - DNA, 18 bp, Homo sapiens
tgtgtcaagattgcaaag

SEQ ID NO: 1989295 - DNA, 17 bp, Homo sapiens
tgtgtcacactgagctg

SEQ ID NO: 1989296 - DNA, 12 bp, Homo sapiens
tgtgtcatatta

SEQ ID NO: 1989297 - DNA, 22 bp, Homo sapiens
tgtgtcatattaaacttctgat

SEQ ID NO: 1989298 - DNA, 14 bp, Homo sapiens
tgtgtcatgatttc

SEQ ID NO: 1989299 - DNA, 12 bp, Homo sapiens
tgtgtcccctca

SEQ ID NO: 1989300 - DNA, 12 bp, Homo sapiens
tgtgtcctctcc

SEQ ID NO: 1989301 - DNA, 14 bp, Homo sapiens
tgtgtcctctcccc

SEQ ID NO: 1989302 - DNA, 14 bp, Homo sapiens
tgtgtccttccctg

SEQ ID NO: 1989303 - DNA, 14 bp, Homo sapiens
tgtgtccttgcacc

SEQ ID NO: 1989304 - DNA, 20 bp, Homo sapiens
tgtgtccttgcacctgcatc

SEQ ID NO: 1989305 - DNA, 12 bp, Homo sapiens
tgtgtctgtctt

SEQ ID NO: 1989306 - DNA, 15 bp, Homo sapiens
tgtgtctgtgtggta

SEQ ID NO: 1989307 - DNA, 20 bp, Homo sapiens
tgtgtctgtgtggtatattt

SEQ ID NO: 1989308 - DNA, 13 bp, Homo sapiens
tgtgtcttctatt

SEQ ID NO: 1989309 - DNA, 20 bp, Homo sapiens
tgtgtcttgcaatggcagcc

SEQ ID NO: 1989310 - DNA, 21 bp, Homo sapiens
tgtgtcttttataaaaagttt

SEQ ID NO: 1989311 - DNA, 20 bp, Homo sapiens
tgtgtgaaataccagtgtgg

SEQ ID NO: 1989312 - DNA, 19 bp, Homo sapiens
tgtgtgacagaatcttgta

SEQ ID NO: 1989313 - DNA, 19 bp, Homo sapiens
tgtgtgagcatctctgtgt

SEQ ID NO: 1989314 - DNA, 19 bp, Homo sapiens
tgtgtgcacgtacacacac

SEQ ID NO: 1989315 - DNA, 19 bp, Homo sapiens
tgtgtgcagactcaataaa

SEQ ID NO: 1989316 - DNA, 12 bp, Homo sapiens
tgtgtgcatgta

SEQ ID NO: 1989317 - DNA, 15 bp, Homo sapiens
tgtgtgcatgtatgt

SEQ ID NO: 1989318 - DNA, 19 bp, Homo sapiens
tgtgtgcatgtatgtgtgt

SEQ ID NO: 1989319 - DNA, 15 bp, Homo sapiens
tgtgtgcatgtgtgt

SEQ ID NO: 1989320 - DNA, 19 bp, Homo sapiens
tgtgtgcatgtgtgtataa

SEQ ID NO: 1989321 - DNA, 23 bp, Homo sapiens
tgtgtgccatagagtttaacaca

SEQ ID NO: 1989322 - DNA, 22 bp, Homo sapiens
tgtgtggggttcagcgtagaaa

SEQ ID NO: 1989323 - DNA, 16 bp, Homo sapiens
tgtgtggtgtgtgtgc

SEQ ID NO: 1989324 - DNA, 14 bp, Homo sapiens
tgtgtgtatatatg

SEQ ID NO: 1989325 - DNA, 15 bp, Homo sapiens
tgtgtgtatatatgt

SEQ ID NO: 1989326 - DNA, 12 bp, Homo sapiens
tgtgtgtatgta

SEQ ID NO: 1989327 - DNA, 14 bp, Homo sapiens
tgtgtgtcccccta

SEQ ID NO: 1989328 - DNA, 18 bp, Homo sapiens
tgtgtgtcttttataaaa

SEQ ID NO: 1989329 - DNA, 14 bp, Homo sapiens
tgtgtgtgtgcatg

SEQ ID NO: 1989330 - DNA, 14 bp, Homo sapiens
tgtgtgtgtgtttg

SEQ ID NO: 1989331 - DNA, 22 bp, Homo sapiens
tgtgtgttgatcccaagacaat

SEQ ID NO: 1989332 - DNA, 15 bp, Homo sapiens
tgtgtgtttaaataa

SEQ ID NO: 1989333 - DNA, 16 bp, Homo sapiens
tgtgtgtttaaataaa

SEQ ID NO: 1989334 - DNA, 22 bp, Homo sapiens
tgtgtgtttaaataaagtatca

SEQ ID NO: 1989335 - DNA, 10 bp, Homo sapiens
tgtgtgtttg

SEQ ID NO: 1989336 - DNA, 16 bp, Homo sapiens
tgtgttaaacatgcta

SEQ ID NO: 1989337 - DNA, 20 bp, Homo sapiens
tgtgttaaacatgctaaata

SEQ ID NO: 1989338 - DNA, 14 bp, Homo sapiens
tgtgttatttaaat

SEQ ID NO: 1989339 - DNA, 15 bp, Homo sapiens
tgtgttgtctgtgca

SEQ ID NO: 1989340 - DNA, 17 bp, Homo sapiens
tgtgtttatgtgagctg

SEQ ID NO: 1989341 - DNA, 11 bp, Homo sapiens
tgtgtttcctt

SEQ ID NO: 1989342 - DNA, 17 bp, Homo sapiens
tgtgtttggaagactat

SEQ ID NO: 1989343 - DNA, 13 bp, Homo sapiens
tgtgtttgtgtga

SEQ ID NO: 1989344 - DNA, 13 bp, Homo sapiens
tgtgttttctgaa

SEQ ID NO: 1989345 - DNA, 19 bp, Homo sapiens
tgttaaaaaaataagaaga

SEQ ID NO: 1989346 - DNA, 21 bp, Homo sapiens
tgttaaaaatattttctgaat

SEQ ID NO: 1989347 - DNA, 21 bp, Homo sapiens
tgttaaaagatgaaaatattt

SEQ ID NO: 1989348 - DNA, 12 bp, Homo sapiens
tgttaaaataac

SEQ ID NO: 1989349 - DNA, 20 bp, Homo sapiens
tgttaaaatattgatttcta

SEQ ID NO: 1989350 - DNA, 17 bp, Homo sapiens
tgttaaaatgtacactg

SEQ ID NO: 1989351 - DNA, 18 bp, Homo sapiens
tgttaaacacgtgtctat

SEQ ID NO: 1989352 - DNA, 22 bp, Homo sapiens
tgttaaagaggcgtcttgtatt

SEQ ID NO: 1989353 - DNA, 16 bp, Homo sapiens
tgttaaatatttacat

SEQ ID NO: 1989354 - DNA, 19 bp, Homo sapiens
tgttaaatgaaattgtaaa

SEQ ID NO: 1989355 - DNA, 17 bp, Homo sapiens
tgttaacctcagtgtca

SEQ ID NO: 1989356 - DNA, 18 bp, Homo sapiens
tgttaactattattaata

SEQ ID NO: 1989357 - DNA, 22 bp, Homo sapiens
tgttaacttaatagtatttatg

SEQ ID NO: 1989358 - DNA, 14 bp, Homo sapiens
tgttaacttagctt

SEQ ID NO: 1989359 - DNA, 15 bp, Homo sapiens
tgttaagacttgaca

SEQ ID NO: 1989360 - DNA, 17 bp, Homo sapiens
tgttaagacttgacagt

SEQ ID NO: 1989361 - DNA, 20 bp, Homo sapiens
tgttaagacttgacagtgga

SEQ ID NO: 1989362 - DNA, 19 bp, Homo sapiens
tgttaataataagataatg

SEQ ID NO: 1989363 - DNA, 17 bp, Homo sapiens
tgttaatgaaaatgtca

SEQ ID NO: 1989364 - DNA, 20 bp, Homo sapiens
tgttaatggtgcaaatccta

SEQ ID NO: 1989365 - DNA, 15 bp, Homo sapiens
tgttaattaaactga

SEQ ID NO: 1989366 - DNA, 15 bp, Homo sapiens
tgttaattcagcact

SEQ ID NO: 1989367 - DNA, 15 bp, Homo sapiens
tgttaatttagaaaa

SEQ ID NO: 1989368 - DNA, 17 bp, Homo sapiens
tgttaatttagaaaact

SEQ ID NO: 1989369 - DNA, 18 bp, Homo sapiens
tgttaatttagaaaactt

SEQ ID NO: 1989370 - DNA, 13 bp, Homo sapiens
tgttaatttttga

SEQ ID NO: 1989371 - DNA, 16 bp, Homo sapiens
tgttacaggtgtacta

SEQ ID NO: 1989372 - DNA, 17 bp, Homo sapiens
tgttacaggtgtactat

SEQ ID NO: 1989373 - DNA, 22 bp, Homo sapiens
tgttacctttcccatgctgaat

SEQ ID NO: 1989374 - DNA, 21 bp, Homo sapiens
tgttactattatctgtgcttt

SEQ ID NO: 1989375 - DNA, 23 bp, Homo sapiens
tgttactccacagcggaggagac

SEQ ID NO: 1989376 - DNA, 15 bp, Homo sapiens
tgttactgaaatgag

SEQ ID NO: 1989377 - DNA, 12 bp, Homo sapiens
tgttacttaaat

SEQ ID NO: 1989378 - DNA, 14 bp, Homo sapiens
tgttacttacctaa

SEQ ID NO: 1989379 - DNA, 21 bp, Homo sapiens
tgttagagaggtagcgagctg

SEQ ID NO: 1989380 - DNA, 17 bp, Homo sapiens
tgttagccccataattt

SEQ ID NO: 1989381 - DNA, 19 bp, Homo sapiens
tgttagcctcaatttctga

SEQ ID NO: 1989382 - DNA, 16 bp, Homo sapiens
tgttaggaaaatttca

SEQ ID NO: 1989383 - DNA, 15 bp, Homo sapiens
tgttagtcatttgct

SEQ ID NO: 1989384 - DNA, 15 bp, Homo sapiens
tgttatagaatactt

SEQ ID NO: 1989385 - DNA, 19 bp, Homo sapiens
tgttatccttttttaaaag

SEQ ID NO: 1989386 - DNA, 17 bp, Homo sapiens
tgttatgtatatagatg

SEQ ID NO: 1989387 - DNA, 16 bp, Homo sapiens
tgttattatcctgcat

SEQ ID NO: 1989388 - DNA, 22 bp, Homo sapiens
tgttattattacttatttttga

SEQ ID NO: 1989389 - DNA, 21 bp, Homo sapiens
tgttattgcactatgaaaatc

SEQ ID NO: 1989390 - DNA, 13 bp, Homo sapiens
tgttattgtggaa

SEQ ID NO: 1989391 - DNA, 15 bp, Homo sapiens
tgttattgtggaaga

SEQ ID NO: 1989392 - DNA, 14 bp, Homo sapiens
tgttatttatatat

SEQ ID NO: 1989393 - DNA, 16 bp, Homo sapiens
tgttatttgtacagtt

SEQ ID NO: 1989394 - DNA, 17 bp, Homo sapiens
tgttatttgtacagttc

SEQ ID NO: 1989395 - DNA, 14 bp, Homo sapiens
tgttattttcagta

SEQ ID NO: 1989396 - DNA, 16 bp, Homo sapiens
tgttatttttgtttct

SEQ ID NO: 1989397 - DNA, 18 bp, Homo sapiens
tgttattttttaattatt

SEQ ID NO: 1989398 - DNA, 21 bp, Homo sapiens
tgttattttttatttccacat

SEQ ID NO: 1989399 - DNA, 16 bp, Homo sapiens
tgttcaaatgcatttt

SEQ ID NO: 1989400 - DNA, 15 bp, Homo sapiens
tgttcaccttatgta

SEQ ID NO: 1989401 - DNA, 16 bp, Homo sapiens
tgttcaccttatgtat

SEQ ID NO: 1989402 - DNA, 18 bp, Homo sapiens
tgttcaccttatgtatta

SEQ ID NO: 1989403 - DNA, 18 bp, Homo sapiens
tgttcacgcaacttgaaa

SEQ ID NO: 1989404 - DNA, 16 bp, Homo sapiens
tgttcacttttcctcc

SEQ ID NO: 1989405 - DNA, 22 bp, Homo sapiens
tgttcagaagaaattctgtcat

SEQ ID NO: 1989406 - DNA, 18 bp, Homo sapiens
tgttcagaaggttgctct

SEQ ID NO: 1989407 - DNA, 14 bp, Homo sapiens
tgttcagctccagc

SEQ ID NO: 1989408 - DNA, 15 bp, Homo sapiens
tgttcagctccagct

SEQ ID NO: 1989409 - DNA, 21 bp, Homo sapiens
tgttcagctccagctcaccag

SEQ ID NO: 1989410 - DNA, 13 bp, Homo sapiens
tgttcaggagctg

SEQ ID NO: 1989411 - DNA, 19 bp, Homo sapiens
tgttcatgttaccaaagca

SEQ ID NO: 1989412 - DNA, 22 bp, Homo sapiens
tgttcattaaagcatgaatggt

SEQ ID NO: 1989413 - DNA, 17 bp, Homo sapiens
tgttccaaatgaatgtt

SEQ ID NO: 1989414 - DNA, 16 bp, Homo sapiens
tgttccagctgcctgg

SEQ ID NO: 1989415 - DNA, 17 bp, Homo sapiens
tgttccagctgcctggg

SEQ ID NO: 1989416 - DNA, 15 bp, Homo sapiens
tgttcccaaattgac

SEQ ID NO: 1989417 - DNA, 18 bp, Homo sapiens
tgttcccacacacaaacc

SEQ ID NO: 1989418 - DNA, 18 bp, Homo sapiens
tgttccccatggccactt

SEQ ID NO: 1989419 - DNA, 19 bp, Homo sapiens
tgttcccccgctggcagcc

SEQ ID NO: 1989420 - DNA, 12 bp, Homo sapiens
tgttccctgcac

SEQ ID NO: 1989421 - DNA, 13 bp, Homo sapiens
tgttccctgcacc

SEQ ID NO: 1989422 - DNA, 16 bp, Homo sapiens
tgttcccttgaccatt

SEQ ID NO: 1989423 - DNA, 14 bp, Homo sapiens
tgttcctagtgaaa

SEQ ID NO: 1989424 - DNA, 19 bp, Homo sapiens
tgttccttaagtcagaaca

SEQ ID NO: 1989425 - DNA, 21 bp, Homo sapiens
tgttctcaatgcttttctagc

SEQ ID NO: 1989426 - DNA, 21 bp, Homo sapiens
tgttctccgggtgtggcctca

SEQ ID NO: 1989427 - DNA, 23 bp, Homo sapiens
tgttctccgggtgtggcctcagc

SEQ ID NO: 1989428 - DNA, 16 bp, Homo sapiens
tgttctccgtccctgc

SEQ ID NO: 1989429 - DNA, 18 bp, Homo sapiens
tgttctctgaggacacta

SEQ ID NO: 1989430 - DNA, 15 bp, Homo sapiens
tgttctgagtacttg

SEQ ID NO: 1989431 - DNA, 19 bp, Homo sapiens
tgttctgagtacttgattt

SEQ ID NO: 1989432 - DNA, 23 bp, Homo sapiens
tgttctgcccaatgcctttttga

SEQ ID NO: 1989433 - DNA, 14 bp, Homo sapiens
tgttctggagctgc

SEQ ID NO: 1989434 - DNA, 20 bp, Homo sapiens
tgttctggattttcccctga

SEQ ID NO: 1989435 - DNA, 16 bp, Homo sapiens
tgttctggcctcagac

SEQ ID NO: 1989436 - DNA, 16 bp, Homo sapiens
tgttctgggacacagt

SEQ ID NO: 1989437 - DNA, 21 bp, Homo sapiens
tgttctgtccagtttccaaag

SEQ ID NO: 1989438 - DNA, 21 bp, Homo sapiens
tgttcttgctgagcaccctct

SEQ ID NO: 1989439 - DNA, 16 bp, Homo sapiens
tgttctttctggagtc

SEQ ID NO: 1989440 - DNA, 19 bp, Homo sapiens
tgttctttttaaaaagttg

SEQ ID NO: 1989441 - DNA, 23 bp, Homo sapiens
tgttgaaaaaaaagtttcagaga

SEQ ID NO: 1989442 - DNA, 13 bp, Homo sapiens
tgttgaaaatgag

SEQ ID NO: 1989443 - DNA, 17 bp, Homo sapiens
tgttgaaatcttaaaaa

SEQ ID NO: 1989444 - DNA, 22 bp, Homo sapiens
tgttgaaattatgtatgtttac

SEQ ID NO: 1989445 - DNA, 16 bp, Homo sapiens
tgttgaagaagagttt

SEQ ID NO: 1989446 - DNA, 14 bp, Homo sapiens
tgttgacatgtgct

SEQ ID NO: 1989447 - DNA, 16 bp, Homo sapiens
tgttgagtgcaacaag

SEQ ID NO: 1989448 - DNA, 20 bp, Homo sapiens
tgttgagttggacacactgt

SEQ ID NO: 1989449 - DNA, 12 bp, Homo sapiens
tgttgatcccaa

SEQ ID NO: 1989450 - DNA, 16 bp, Homo sapiens
tgttgatcccaagaca

SEQ ID NO: 1989451 - DNA, 20 bp, Homo sapiens
tgttgatcccacttcactgt

SEQ ID NO: 1989452 - DNA, 13 bp, Homo sapiens
tgttgattaaaac

SEQ ID NO: 1989453 - DNA, 17 bp, Homo sapiens
tgttgcaagtactgctg

SEQ ID NO: 1989454 - DNA, 19 bp, Homo sapiens
tgttgcaagtactgctgta

SEQ ID NO: 1989455 - DNA, 13 bp, Homo sapiens
tgttgcaagtcat

SEQ ID NO: 1989456 - DNA, 23 bp, Homo sapiens
tgttgcaccatggacttttctca

SEQ ID NO: 1989457 - DNA, 15 bp, Homo sapiens
tgttgccatttctct

SEQ ID NO: 1989458 - DNA, 18 bp, Homo sapiens
tgttgccatttctctgct

SEQ ID NO: 1989459 - DNA, 19 bp, Homo sapiens
tgttgccatttctctgctt

SEQ ID NO: 1989460 - DNA, 16 bp, Homo sapiens
tgttgcccaggcaggt

SEQ ID NO: 1989461 - DNA, 13 bp, Homo sapiens
tgttgcccaggct

SEQ ID NO: 1989462 - DNA, 14 bp, Homo sapiens
tgttgcccaggctg

SEQ ID NO: 1989463 - DNA, 14 bp, Homo sapiens
tgttgctccctgtg

SEQ ID NO: 1989464 - DNA, 18 bp, Homo sapiens
tgttgctcttggaaagct

SEQ ID NO: 1989465 - DNA, 13 bp, Homo sapiens
tgttgctgtcaag

SEQ ID NO: 1989466 - DNA, 15 bp, Homo sapiens
tgttgcttagatgag

SEQ ID NO: 1989467 - DNA, 23 bp, Homo sapiens
tgttgcttagatgagggtgactg

SEQ ID NO: 1989468 - DNA, 14 bp, Homo sapiens
tgttgcttggacta

SEQ ID NO: 1989469 - DNA, 13 bp, Homo sapiens
tgttggacccgct

SEQ ID NO: 1989470 - DNA, 18 bp, Homo sapiens
tgttggacccgctctgga

SEQ ID NO: 1989471 - DNA, 19 bp, Homo sapiens
tgttggacccgctctggac

SEQ ID NO: 1989472 - DNA, 23 bp, Homo sapiens
tgttggataataactagatctcc

SEQ ID NO: 1989473 - DNA, 11 bp, Homo sapiens
tgttggccagg

SEQ ID NO: 1989474 - DNA, 19 bp, Homo sapiens
tgttggcctcgcctgggcc

SEQ ID NO: 1989475 - DNA, 23 bp, Homo sapiens
tgttggcctcgcctgggcccagg

SEQ ID NO: 1989476 - DNA, 16 bp, Homo sapiens
tgttggctgtgtgaca

SEQ ID NO: 1989477 - DNA, 22 bp, Homo sapiens
tgttggttaccctcctagcttt

SEQ ID NO: 1989478 - DNA, 13 bp, Homo sapiens
tgttgtaaataaa

SEQ ID NO: 1989479 - DNA, 16 bp, Homo sapiens
tgttgtaaataaaagt

SEQ ID NO: 1989480 - DNA, 15 bp, Homo sapiens
tgttgtaaatgacca

SEQ ID NO: 1989481 - DNA, 15 bp, Homo sapiens
tgttgtaaattagga

SEQ ID NO: 1989482 - DNA, 22 bp, Homo sapiens
tgttgtacatacagaggtaact

SEQ ID NO: 1989483 - DNA, 23 bp, Homo sapiens
tgttgtacatacagaggtaacta

SEQ ID NO: 1989484 - DNA, 18 bp, Homo sapiens
tgttgtactttttattca

SEQ ID NO: 1989485 - DNA, 16 bp, Homo sapiens
tgttgtatacttcatt

SEQ ID NO: 1989486 - DNA, 13 bp, Homo sapiens
tgttgtctgtgca

SEQ ID NO: 1989487 - DNA, 17 bp, Homo sapiens
tgttgtctgtttgttct

SEQ ID NO: 1989488 - DNA, 17 bp, Homo sapiens
tgttgtgactggcaccc

SEQ ID NO: 1989489 - DNA, 15 bp, Homo sapiens
tgttgttaaacacgt

SEQ ID NO: 1989490 - DNA, 18 bp, Homo sapiens
tgttgttaatgaaaatgt

SEQ ID NO: 1989491 - DNA, 14 bp, Homo sapiens
tgttgttatgctat

SEQ ID NO: 1989492 - DNA, 19 bp, Homo sapiens
tgttgttccttcacattta

SEQ ID NO: 1989493 - DNA, 15 bp, Homo sapiens
tgttgttccttttga

SEQ ID NO: 1989494 - DNA, 21 bp, Homo sapiens
tgttgtttcttaaataagaaa

SEQ ID NO: 1989495 - DNA, 19 bp, Homo sapiens
tgtttaaaaacaggaaaaa

SEQ ID NO: 1989496 - DNA, 18 bp, Homo sapiens
tgtttaaaatcatttctg

SEQ ID NO: 1989497 - DNA, 12 bp, Homo sapiens
tgtttaaagttc

SEQ ID NO: 1989498 - DNA, 23 bp, Homo sapiens
tgtttaaagttcaacatgttatt

SEQ ID NO: 1989499 - DNA, 17 bp, Homo sapiens
tgtttaaataaagtatc

SEQ ID NO: 1989500 - DNA, 20 bp, Homo sapiens
tgtttaaataaagtatcatg

SEQ ID NO: 1989501 - DNA, 22 bp, Homo sapiens
tgtttaaataaagtatcatgca

SEQ ID NO: 1989502 - DNA, 16 bp, Homo sapiens
tgtttaaatataaatg

SEQ ID NO: 1989503 - DNA, 22 bp, Homo sapiens
tgtttaaatataaatgtttaaa

SEQ ID NO: 1989504 - DNA, 21 bp, Homo sapiens
tgtttaaattgtaaattttag

SEQ ID NO: 1989505 - DNA, 15 bp, Homo sapiens
tgtttaagtggcttt

SEQ ID NO: 1989506 - DNA, 21 bp, Homo sapiens
tgtttaagtgttgtaaatatt

SEQ ID NO: 1989507 - DNA, 17 bp, Homo sapiens
tgtttaatatttaaaca

SEQ ID NO: 1989508 - DNA, 20 bp, Homo sapiens
tgtttactttatccaatcct

SEQ ID NO: 1989509 - DNA, 17 bp, Homo sapiens
tgtttagaagagcctga

SEQ ID NO: 1989510 - DNA, 18 bp, Homo sapiens
tgtttagaagagcctgac

SEQ ID NO: 1989511 - DNA, 15 bp, Homo sapiens
tgtttatacagctca

SEQ ID NO: 1989512 - DNA, 14 bp, Homo sapiens
tgtttattaacaaa

SEQ ID NO: 1989513 - DNA, 13 bp, Homo sapiens
tgtttattcctga

SEQ ID NO: 1989514 - DNA, 22 bp, Homo sapiens
tgtttatttataagcagattta

SEQ ID NO: 1989515 - DNA, 15 bp, Homo sapiens
tgtttatttttcata

SEQ ID NO: 1989516 - DNA, 15 bp, Homo sapiens
tgtttcaaactgagt

SEQ ID NO: 1989517 - DNA, 19 bp, Homo sapiens
tgtttcaatgacctgtatt

SEQ ID NO: 1989518 - DNA, 18 bp, Homo sapiens
tgtttcacaacaggcatt

SEQ ID NO: 1989519 - DNA, 16 bp, Homo sapiens
tgtttcactatgattt

SEQ ID NO: 1989520 - DNA, 17 bp, Homo sapiens
tgtttcactatgatttt

SEQ ID NO: 1989521 - DNA, 16 bp, Homo sapiens
tgtttcatctgttcat

SEQ ID NO: 1989522 - DNA, 13 bp, Homo sapiens
tgtttcatgtttt

SEQ ID NO: 1989523 - DNA, 14 bp, Homo sapiens
tgtttcatgttttg

SEQ ID NO: 1989524 - DNA, 17 bp, Homo sapiens
tgtttccagaaaatata

SEQ ID NO: 1989525 - DNA, 20 bp, Homo sapiens
tgtttccagaaaatataaat

SEQ ID NO: 1989526 - DNA, 23 bp, Homo sapiens
tgtttccagaaaatataaatgca

SEQ ID NO: 1989527 - DNA, 17 bp, Homo sapiens
tgtttctactttgatat

SEQ ID NO: 1989528 - DNA, 24 bp, Homo sapiens
tgtttctattctctcctcagactg

SEQ ID NO: 1989529 - DNA, 15 bp, Homo sapiens
tgtttctccccctgg

SEQ ID NO: 1989530 - DNA, 17 bp, Homo sapiens
tgtttctccccctgggc

SEQ ID NO: 1989531 - DNA, 17 bp, Homo sapiens
tgtttcttccaaagcac

SEQ ID NO: 1989532 - DNA, 18 bp, Homo sapiens
tgtttcttccaaagcaca

SEQ ID NO: 1989533 - DNA, 15 bp, Homo sapiens
tgtttcttgcctcat

SEQ ID NO: 1989534 - DNA, 21 bp, Homo sapiens
tgtttctttttttatgactgt

SEQ ID NO: 1989535 - DNA, 22 bp, Homo sapiens
tgtttgacaaagaaacccaagt

SEQ ID NO: 1989536 - DNA, 14 bp, Homo sapiens
tgtttgaggttaaa

SEQ ID NO: 1989537 - DNA, 15 bp, Homo sapiens
tgtttgatcacacag

SEQ ID NO: 1989538 - DNA, 20 bp, Homo sapiens
tgtttgcacctttctagttg

SEQ ID NO: 1989539 - DNA, 16 bp, Homo sapiens
tgtttgggccactgcc

SEQ ID NO: 1989540 - DNA, 23 bp, Homo sapiens
tgtttggggtgtttcaaaagtgg

SEQ ID NO: 1989541 - DNA, 23 bp, Homo sapiens
tgtttggtgtaggtaaatctagt

SEQ ID NO: 1989542 - DNA, 18 bp, Homo sapiens
tgtttggttgtaaatgct

SEQ ID NO: 1989543 - DNA, 19 bp, Homo sapiens
tgtttgtaaattaatactt

SEQ ID NO: 1989544 - DNA, 15 bp, Homo sapiens
tgtttgtaagattta

SEQ ID NO: 1989545 - DNA, 19 bp, Homo sapiens
tgtttgtctgtcttcatag

SEQ ID NO: 1989546 - DNA, 14 bp, Homo sapiens
tgtttgtgtgcatg

SEQ ID NO: 1989547 - DNA, 16 bp, Homo sapiens
tgtttgtgtgcatgaa

SEQ ID NO: 1989548 - DNA, 20 bp, Homo sapiens
tgtttgtgtgcatgaaagag

SEQ ID NO: 1989549 - DNA, 20 bp, Homo sapiens
tgttttaaacatagaaagtt

SEQ ID NO: 1989550 - DNA, 12 bp, Homo sapiens
tgttttatcatg

SEQ ID NO: 1989551 - DNA, 14 bp, Homo sapiens
tgttttatgttcta

SEQ ID NO: 1989552 - DNA, 18 bp, Homo sapiens
tgttttattttttattgt

SEQ ID NO: 1989553 - DNA, 23 bp, Homo sapiens
tgttttctaaagttgttcacata

SEQ ID NO: 1989554 - DNA, 12 bp, Homo sapiens
tgttttcttcaa

SEQ ID NO: 1989555 - DNA, 15 bp, Homo sapiens
tgttttgcactgaca

SEQ ID NO: 1989556 - DNA, 18 bp, Homo sapiens
tgttttggtgcctgcctc

SEQ ID NO: 1989557 - DNA, 15 bp, Homo sapiens
tgttttgtacaatta

SEQ ID NO: 1989558 - DNA, 18 bp, Homo sapiens
tgttttgtatatgatcta

SEQ ID NO: 1989559 - DNA, 18 bp, Homo sapiens
tgttttgtcccatttcct

SEQ ID NO: 1989560 - DNA, 19 bp, Homo sapiens
tgtttttaaaagtttcaat

SEQ ID NO: 1989561 - DNA, 12 bp, Homo sapiens
tgtttttaactc

SEQ ID NO: 1989562 - DNA, 17 bp, Homo sapiens
tgtttttaagtcctgta

SEQ ID NO: 1989563 - DNA, 22 bp, Homo sapiens
tgtttttcaatctcatctgata

SEQ ID NO: 1989564 - DNA, 13 bp, Homo sapiens
tgtttttcttatc

SEQ ID NO: 1989565 - DNA, 19 bp, Homo sapiens
tgttttttgaaaacatggt

SEQ ID NO: 1989566 - DNA, 23 bp, Homo sapiens
ttaaaaaaatcacactctaagtt

SEQ ID NO: 1989567 - DNA, 14 bp, Homo sapiens
ttaaaaaaatgaca

SEQ ID NO: 1989568 - DNA, 23 bp, Homo sapiens
ttaaaaaacaaaaaccagcaggt

SEQ ID NO: 1989569 - DNA, 19 bp, Homo sapiens
ttaaaaaagcttaaaactt

SEQ ID NO: 1989570 - DNA, 11 bp, Homo sapiens
ttaaaaaataa

SEQ ID NO: 1989571 - DNA, 14 bp, Homo sapiens
ttaaaaaataaaaa

SEQ ID NO: 1989572 - DNA, 22 bp, Homo sapiens
ttaaaaaataaaaaaatacagt

SEQ ID NO: 1989573 - DNA, 14 bp, Homo sapiens
ttaaaaaataaata

SEQ ID NO: 1989574 - DNA, 19 bp, Homo sapiens
ttaaaaaataaatataatt

SEQ ID NO: 1989575 - DNA, 16 bp, Homo sapiens
ttaaaaaatgaaaata

SEQ ID NO: 1989576 - DNA, 16 bp, Homo sapiens
ttaaaaaatggaacat

SEQ ID NO: 1989577 - DNA, 13 bp, Homo sapiens
ttaaaaaatgtcc

SEQ ID NO: 1989578 - DNA, 18 bp, Homo sapiens
ttaaaaacatgagaaatg

SEQ ID NO: 1989579 - DNA, 20 bp, Homo sapiens
ttaaaaacatgagaaatgtg

SEQ ID NO: 1989580 - DNA, 21 bp, Homo sapiens
ttaaaaacatgagaaatgtga

SEQ ID NO: 1989581 - DNA, 22 bp, Homo sapiens
ttaaaaacattccccaattatc

SEQ ID NO: 1989582 - DNA, 19 bp, Homo sapiens
ttaaaaagttgcacattag

SEQ ID NO: 1989583 - DNA, 21 bp, Homo sapiens
ttaaaaataaagctactgaat

SEQ ID NO: 1989584 - DNA, 23 bp, Homo sapiens
ttaaaaatgcacacctcatgagt

SEQ ID NO: 1989585 - DNA, 17 bp, Homo sapiens
ttaaaacaacactcaca

SEQ ID NO: 1989586 - DNA, 22 bp, Homo sapiens
ttaaaacaaggcttaaaagagt

SEQ ID NO: 1989587 - DNA, 19 bp, Homo sapiens
ttaaaaccatgcagcttca

SEQ ID NO: 1989588 - DNA, 16 bp, Homo sapiens
ttaaaagaaatttatt

SEQ ID NO: 1989589 - DNA, 16 bp, Homo sapiens
ttaaaagaagactgga

SEQ ID NO: 1989590 - DNA, 17 bp, Homo sapiens
ttaaaagaagactggaa

SEQ ID NO: 1989591 - DNA, 23 bp, Homo sapiens
ttaaaagacatttttatttagtt

SEQ ID NO: 1989592 - DNA, 15 bp, Homo sapiens
ttaaaagatgaaaat

SEQ ID NO: 1989593 - DNA, 22 bp, Homo sapiens
ttaaaagcaattatattgtcct

SEQ ID NO: 1989594 - DNA, 18 bp, Homo sapiens
ttaaaatacacactcaaa

SEQ ID NO: 1989595 - DNA, 15 bp, Homo sapiens
ttaaaatagaaataa

SEQ ID NO: 1989596 - DNA, 23 bp, Homo sapiens
ttaaaatagcaaaagaagaagtt

SEQ ID NO: 1989597 - DNA, 17 bp, Homo sapiens
ttaaaatataaattaag

SEQ ID NO: 1989598 - DNA, 14 bp, Homo sapiens
ttaaaatatggcta

SEQ ID NO: 1989599 - DNA, 19 bp, Homo sapiens
ttaaaatattcctgcattt

SEQ ID NO: 1989600 - DNA, 17 bp, Homo sapiens
ttaaaatcattcaatat

SEQ ID NO: 1989601 - DNA, 14 bp, Homo sapiens
ttaaaatcatttct

SEQ ID NO: 1989602 - DNA, 14 bp, Homo sapiens
ttaaaatctgattt

SEQ ID NO: 1989603 - DNA, 18 bp, Homo sapiens
ttaaaatctgatttaatg

SEQ ID NO: 1989604 - DNA, 16 bp, Homo sapiens
ttaaaatgtacactgg

SEQ ID NO: 1989605 - DNA, 17 bp, Homo sapiens
ttaaaatgtaggaagaa

SEQ ID NO: 1989606 - DNA, 22 bp, Homo sapiens
ttaaaattaaagtatacatttt

SEQ ID NO: 1989607 - DNA, 17 bp, Homo sapiens
ttaaaattagtgagatt

SEQ ID NO: 1989608 - DNA, 14 bp, Homo sapiens
ttaaacagcagtgt

SEQ ID NO: 1989609 - DNA, 18 bp, Homo sapiens
ttaaacagtgagcctgaa

SEQ ID NO: 1989610 - DNA, 15 bp, Homo sapiens
ttaaaccagcagaaa

SEQ ID NO: 1989611 - DNA, 18 bp, Homo sapiens
ttaaaccagcagaaaagt

SEQ ID NO: 1989612 - DNA, 21 bp, Homo sapiens
ttaaaccagtttagatttcaa

SEQ ID NO: 1989613 - DNA, 16 bp, Homo sapiens
ttaaaccgctaaaaga

SEQ ID NO: 1989614 - DNA, 19 bp, Homo sapiens
ttaaaccgctaaaagaaac

SEQ ID NO: 1989615 - DNA, 15 bp, Homo sapiens
ttaaacctggatact

SEQ ID NO: 1989616 - DNA, 17 bp, Homo sapiens
ttaaactgaagaaggat

SEQ ID NO: 1989617 - DNA, 13 bp, Homo sapiens
ttaaactttgtgc

SEQ ID NO: 1989618 - DNA, 11 bp, Homo sapiens
ttaaagaaagt

SEQ ID NO: 1989619 - DNA, 18 bp, Homo sapiens
ttaaagaagtaaatttgt

SEQ ID NO: 1989620 - DNA, 22 bp, Homo sapiens
ttaaagaagtcataaacagcat

SEQ ID NO: 1989621 - DNA, 11 bp, Homo sapiens
ttaaagactta

SEQ ID NO: 1989622 - DNA, 16 bp, Homo sapiens
ttaaagagcatggaaa

SEQ ID NO: 1989623 - DNA, 12 bp, Homo sapiens
ttaaagatgtgt

SEQ ID NO: 1989624 - DNA, 18 bp, Homo sapiens
ttaaagcaacattttatt

SEQ ID NO: 1989625 - DNA, 15 bp, Homo sapiens
ttaaagcaccaaatt

SEQ ID NO: 1989626 - DNA, 17 bp, Homo sapiens
ttaaagcatttactttg

SEQ ID NO: 1989627 - DNA, 22 bp, Homo sapiens
ttaaagccacaaccacatacaa

SEQ ID NO: 1989628 - DNA, 15 bp, Homo sapiens
ttaaagctgcctgta

SEQ ID NO: 1989629 - DNA, 22 bp, Homo sapiens
ttaaagggcagaaggggaagat

SEQ ID NO: 1989630 - DNA, 16 bp, Homo sapiens
ttaaaggtagagatgt

SEQ ID NO: 1989631 - DNA, 18 bp, Homo sapiens
ttaaaggtagagatgtgt

SEQ ID NO: 1989632 - DNA, 16 bp, Homo sapiens
ttaaagtaaaggcctc

SEQ ID NO: 1989633 - DNA, 13 bp, Homo sapiens
ttaaagtatatat

SEQ ID NO: 1989634 - DNA, 16 bp, Homo sapiens
ttaaagtatatattta

SEQ ID NO: 1989635 - DNA, 12 bp, Homo sapiens
ttaaagtgccat

SEQ ID NO: 1989636 - DNA, 21 bp, Homo sapiens
ttaaagtgccatttcctgtct

SEQ ID NO: 1989637 - DNA, 17 bp, Homo sapiens
ttaaataaagtatcatg

SEQ ID NO: 1989638 - DNA, 19 bp, Homo sapiens
ttaaataaagtatcatgca

SEQ ID NO: 1989639 - DNA, 15 bp, Homo sapiens
ttaaataaatatttt

SEQ ID NO: 1989640 - DNA, 16 bp, Homo sapiens
ttaaataaattcaaac

SEQ ID NO: 1989641 - DNA, 15 bp, Homo sapiens
ttaaataagaaactt

SEQ ID NO: 1989642 - DNA, 18 bp, Homo sapiens
ttaaatacagacactaag

SEQ ID NO: 1989643 - DNA, 19 bp, Homo sapiens
ttaaatacgcactacatgt

SEQ ID NO: 1989644 - DNA, 17 bp, Homo sapiens
ttaaatatgaacaaaga

SEQ ID NO: 1989645 - DNA, 21 bp, Homo sapiens
ttaaatatgttagcaaagagt

SEQ ID NO: 1989646 - DNA, 14 bp, Homo sapiens
ttaaatatttacat

SEQ ID NO: 1989647 - DNA, 23 bp, Homo sapiens
ttaaatcaaaagctgcttgacta

SEQ ID NO: 1989648 - DNA, 23 bp, Homo sapiens
ttaaatgaaattgtaaaacctgt

SEQ ID NO: 1989649 - DNA, 15 bp, Homo sapiens
ttaaatgacattttt

SEQ ID NO: 1989650 - DNA, 17 bp, Homo sapiens
ttaaatgttgaaatctt

SEQ ID NO: 1989651 - DNA, 23 bp, Homo sapiens
ttaaattctctctcttgcaggaa

SEQ ID NO: 1989652 - DNA, 15 bp, Homo sapiens
ttaaattctttttca

SEQ ID NO: 1989653 - DNA, 16 bp, Homo sapiens
ttaaattgcttttgtt

SEQ ID NO: 1989654 - DNA, 16 bp, Homo sapiens
ttaaatttttgtcatt

SEQ ID NO: 1989655 - DNA, 18 bp, Homo sapiens
ttaacaaaacaagaaaga

SEQ ID NO: 1989656 - DNA, 18 bp, Homo sapiens
ttaacaaaagattctgta

SEQ ID NO: 1989657 - DNA, 18 bp, Homo sapiens
ttaacaaaatattctgta

SEQ ID NO: 1989658 - DNA, 16 bp, Homo sapiens
ttaacacaagtcctgt

SEQ ID NO: 1989659 - DNA, 19 bp, Homo sapiens
ttaacactgcttgtgtttt

SEQ ID NO: 1989660 - DNA, 14 bp, Homo sapiens
ttaacagagacaga

SEQ ID NO: 1989661 - DNA, 16 bp, Homo sapiens
ttaacagtcatttaaa

SEQ ID NO: 1989662 - DNA, 17 bp, Homo sapiens
ttaacagtcatttaaaa

SEQ ID NO: 1989663 - DNA, 17 bp, Homo sapiens
ttaacatatttactaag

SEQ ID NO: 1989664 - DNA, 10 bp, Homo sapiens
ttaacatttt

SEQ ID NO: 1989665 - DNA, 16 bp, Homo sapiens
ttaaccctctcttccc

SEQ ID NO: 1989666 - DNA, 17 bp, Homo sapiens
ttaaccctctcttccct

SEQ ID NO: 1989667 - DNA, 16 bp, Homo sapiens
ttaaccgtttttcaag

SEQ ID NO: 1989668 - DNA, 16 bp, Homo sapiens
ttaacctgaattattc

SEQ ID NO: 1989669 - DNA, 17 bp, Homo sapiens
ttaacctttccgctgtc

SEQ ID NO: 1989670 - DNA, 17 bp, Homo sapiens
ttaacgggcatgtatta

SEQ ID NO: 1989671 - DNA, 18 bp, Homo sapiens
ttaacgggcatgtattat

SEQ ID NO: 1989672 - DNA, 15 bp, Homo sapiens
ttaactaatttaaac

SEQ ID NO: 1989673 - DNA, 15 bp, Homo sapiens
ttaactatgtgatgt

SEQ ID NO: 1989674 - DNA, 13 bp, Homo sapiens
ttaactattatta

SEQ ID NO: 1989675 - DNA, 23 bp, Homo sapiens
ttaactcatctgttatcctgcta

SEQ ID NO: 1989676 - DNA, 17 bp, Homo sapiens
ttaactcattagactgg

SEQ ID NO: 1989677 - DNA, 18 bp, Homo sapiens
ttaactgtgtgaagaaat

SEQ ID NO: 1989678 - DNA, 13 bp, Homo sapiens
ttaacttaaatag

SEQ ID NO: 1989679 - DNA, 16 bp, Homo sapiens
ttaacttggagtttca

SEQ ID NO: 1989680 - DNA, 11 bp, Homo sapiens
ttaacttgtat

SEQ ID NO: 1989681 - DNA, 23 bp, Homo sapiens
ttaactttatcacattatttgca

SEQ ID NO: 1989682 - DNA, 17 bp, Homo sapiens
ttaactttgggcccaga

SEQ ID NO: 1989683 - DNA, 19 bp, Homo sapiens
ttaagacaagcctggcaac

SEQ ID NO: 1989684 - DNA, 16 bp, Homo sapiens
ttaagacacacctctg

SEQ ID NO: 1989685 - DNA, 21 bp, Homo sapiens
ttaagactgagcacctgcttc

SEQ ID NO: 1989686 - DNA, 13 bp, Homo sapiens
ttaagacttgaca

SEQ ID NO: 1989687 - DNA, 13 bp, Homo sapiens
ttaagagaaatgg

SEQ ID NO: 1989688 - DNA, 13 bp, Homo sapiens
ttaagagagaaat

SEQ ID NO: 1989689 - DNA, 14 bp, Homo sapiens
ttaagagagaaatc

SEQ ID NO: 1989690 - DNA, 14 bp, Homo sapiens
ttaagagatacatt

SEQ ID NO: 1989691 - DNA, 18 bp, Homo sapiens
ttaagagatacattccct

SEQ ID NO: 1989692 - DNA, 15 bp, Homo sapiens
ttaagaggcagggtc

SEQ ID NO: 1989693 - DNA, 12 bp, Homo sapiens
ttaagaggcttt

SEQ ID NO: 1989694 - DNA, 20 bp, Homo sapiens
ttaagagtagcaagttctag

SEQ ID NO: 1989695 - DNA, 16 bp, Homo sapiens
ttaagagtgaaataat

SEQ ID NO: 1989696 - DNA, 16 bp, Homo sapiens
ttaagataattataat

SEQ ID NO: 1989697 - DNA, 15 bp, Homo sapiens
ttaagatacactcct

SEQ ID NO: 1989698 - DNA, 14 bp, Homo sapiens
ttaagattgtaatt

SEQ ID NO: 1989699 - DNA, 15 bp, Homo sapiens
ttaagattgtaattc

SEQ ID NO: 1989700 - DNA, 22 bp, Homo sapiens
ttaagcattttactgtctgtaa

SEQ ID NO: 1989701 - DNA, 17 bp, Homo sapiens
ttaaggacttctgcagc

SEQ ID NO: 1989702 - DNA, 14 bp, Homo sapiens
ttaaggcagtgact

SEQ ID NO: 1989703 - DNA, 14 bp, Homo sapiens
ttaaggttactcag

SEQ ID NO: 1989704 - DNA, 15 bp, Homo sapiens
ttaagtatatagtat

SEQ ID NO: 1989705 - DNA, 19 bp, Homo sapiens
ttaagtatttatatattta

SEQ ID NO: 1989706 - DNA, 22 bp, Homo sapiens
ttaagtctctgactcttgcctt

SEQ ID NO: 1989707 - DNA, 13 bp, Homo sapiens
ttaagtgaatgtc

SEQ ID NO: 1989708 - DNA, 23 bp, Homo sapiens
ttaagttagagaatatatttttg

SEQ ID NO: 1989709 - DNA, 22 bp, Homo sapiens
ttaataatagtgtgtcaagatt

SEQ ID NO: 1989710 - DNA, 13 bp, Homo sapiens
ttaatacctttgg

SEQ ID NO: 1989711 - DNA, 21 bp, Homo sapiens
ttaatacctttggaaaaatct

SEQ ID NO: 1989712 - DNA, 19 bp, Homo sapiens
ttaatactataaataatat

SEQ ID NO: 1989713 - DNA, 15 bp, Homo sapiens
ttaatactcacctcc

SEQ ID NO: 1989714 - DNA, 16 bp, Homo sapiens
ttaatactcacctcct

SEQ ID NO: 1989715 - DNA, 18 bp, Homo sapiens
ttaatatcaatgaagatt

SEQ ID NO: 1989716 - DNA, 14 bp, Homo sapiens
ttaatatcctaaac

SEQ ID NO: 1989717 - DNA, 19 bp, Homo sapiens
ttaatatcctaaacatcat

SEQ ID NO: 1989718 - DNA, 14 bp, Homo sapiens
ttaatatctgagaa

SEQ ID NO: 1989719 - DNA, 16 bp, Homo sapiens
ttaatatggggatgca

SEQ ID NO: 1989720 - DNA, 17 bp, Homo sapiens
ttaatattttgtatttt

SEQ ID NO: 1989721 - DNA, 16 bp, Homo sapiens
ttaatcagacaaagta

SEQ ID NO: 1989722 - DNA, 14 bp, Homo sapiens
ttaatcccagccct

SEQ ID NO: 1989723 - DNA, 22 bp, Homo sapiens
ttaatcttcagttttatcttta

SEQ ID NO: 1989724 - DNA, 14 bp, Homo sapiens
ttaatctttcctga

SEQ ID NO: 1989725 - DNA, 21 bp, Homo sapiens
ttaatctttctttacctgaga

SEQ ID NO: 1989726 - DNA, 23 bp, Homo sapiens
ttaatctttctttacctgagacc

SEQ ID NO: 1989727 - DNA, 15 bp, Homo sapiens
ttaatgaactgtgac

SEQ ID NO: 1989728 - DNA, 23 bp, Homo sapiens
ttaatgcctctcccgcaccaggc

SEQ ID NO: 1989729 - DNA, 16 bp, Homo sapiens
ttaatgccttccacat

SEQ ID NO: 1989730 - DNA, 14 bp, Homo sapiens
ttaatggcactgat

SEQ ID NO: 1989731 - DNA, 19 bp, Homo sapiens
ttaatgtacaagttttgta

SEQ ID NO: 1989732 - DNA, 21 bp, Homo sapiens
ttaatgtacaagttttgtata

SEQ ID NO: 1989733 - DNA, 22 bp, Homo sapiens
ttaatgtgttgggaaaaaggcc

SEQ ID NO: 1989734 - DNA, 22 bp, Homo sapiens
ttaatgttgggatttatatcta

SEQ ID NO: 1989735 - DNA, 23 bp, Homo sapiens
ttaatgttgggatttatatctat

SEQ ID NO: 1989736 - DNA, 13 bp, Homo sapiens
ttaattaaatgca

SEQ ID NO: 1989737 - DNA, 19 bp, Homo sapiens
ttaattaggggttgctaag

SEQ ID NO: 1989738 - DNA, 13 bp, Homo sapiens
ttaattatctgat

SEQ ID NO: 1989739 - DNA, 16 bp, Homo sapiens
ttaattatctgatcgg

SEQ ID NO: 1989740 - DNA, 15 bp, Homo sapiens
ttaattatcttttct

SEQ ID NO: 1989741 - DNA, 17 bp, Homo sapiens
ttaattattattcttca

SEQ ID NO: 1989742 - DNA, 14 bp, Homo sapiens
ttaattattattta

SEQ ID NO: 1989743 - DNA, 22 bp, Homo sapiens
ttaattcagcactgatttcaca

SEQ ID NO: 1989744 - DNA, 13 bp, Homo sapiens
ttaattcattaaa

SEQ ID NO: 1989745 - DNA, 19 bp, Homo sapiens
ttaattccaatatgatgac

SEQ ID NO: 1989746 - DNA, 14 bp, Homo sapiens
ttaattctactaaa

SEQ ID NO: 1989747 - DNA, 20 bp, Homo sapiens
ttaattgtgtgtcttctatt

SEQ ID NO: 1989748 - DNA, 16 bp, Homo sapiens
ttaatttatatttgaa

SEQ ID NO: 1989749 - DNA, 14 bp, Homo sapiens
ttaatttatttcat

SEQ ID NO: 1989750 - DNA, 11 bp, Homo sapiens
ttaatttgtgt

SEQ ID NO: 1989751 - DNA, 15 bp, Homo sapiens
ttaatttgttatgta

SEQ ID NO: 1989752 - DNA, 13 bp, Homo sapiens
ttaatttttgcaa

SEQ ID NO: 1989753 - DNA, 16 bp, Homo sapiens
ttaattttttttaatg

SEQ ID NO: 1989754 - DNA, 15 bp, Homo sapiens
ttacaaaaggcagcc

SEQ ID NO: 1989755 - DNA, 13 bp, Homo sapiens
ttacaaatttaat

SEQ ID NO: 1989756 - DNA, 19 bp, Homo sapiens
ttacaacagtaacacatct

SEQ ID NO: 1989757 - DNA, 13 bp, Homo sapiens
ttacaacttccat

SEQ ID NO: 1989758 - DNA, 16 bp, Homo sapiens
ttacaagaattgtcca

SEQ ID NO: 1989759 - DNA, 20 bp, Homo sapiens
ttacaataattaatgtgtgt

SEQ ID NO: 1989760 - DNA, 17 bp, Homo sapiens
ttacacaattaattgtc

SEQ ID NO: 1989761 - DNA, 16 bp, Homo sapiens
ttacacacacagatgt

SEQ ID NO: 1989762 - DNA, 15 bp, Homo sapiens
ttacacagcccaaga

SEQ ID NO: 1989763 - DNA, 16 bp, Homo sapiens
ttacacagcccaagag

SEQ ID NO: 1989764 - DNA, 17 bp, Homo sapiens
ttacacattatgttaga

SEQ ID NO: 1989765 - DNA, 19 bp, Homo sapiens
ttacactctctgtacaaaa

SEQ ID NO: 1989766 - DNA, 20 bp, Homo sapiens
ttacactctctgtacaaaaa

SEQ ID NO: 1989767 - DNA, 15 bp, Homo sapiens
ttacactctttgtaa

SEQ ID NO: 1989768 - DNA, 21 bp, Homo sapiens
ttacacttggagcccgtgcag

SEQ ID NO: 1989769 - DNA, 11 bp, Homo sapiens
ttacagaactg

SEQ ID NO: 1989770 - DNA, 21 bp, Homo sapiens
ttacagagaatctgaagctat

SEQ ID NO: 1989771 - DNA, 22 bp, Homo sapiens
ttacagagaatctgaagctatt

SEQ ID NO: 1989772 - DNA, 17 bp, Homo sapiens
ttacagcctcacttgaa

SEQ ID NO: 1989773 - DNA, 20 bp, Homo sapiens
ttacagctatgcactgtaaa

SEQ ID NO: 1989774 - DNA, 14 bp, Homo sapiens
ttacagctgcctgc

SEQ ID NO: 1989775 - DNA, 15 bp, Homo sapiens
ttacagctttacaca

SEQ ID NO: 1989776 - DNA, 21 bp, Homo sapiens
ttacaggaggttgtggatgct

SEQ ID NO: 1989777 - DNA, 17 bp, Homo sapiens
ttacagtaaataaattg

SEQ ID NO: 1989778 - DNA, 18 bp, Homo sapiens
ttacagtaaataaattgt

SEQ ID NO: 1989779 - DNA, 22 bp, Homo sapiens
ttacatatcacctcatggccta

SEQ ID NO: 1989780 - DNA, 16 bp, Homo sapiens
ttacatccagaaagaa

SEQ ID NO: 1989781 - DNA, 16 bp, Homo sapiens
ttacatctaatgcttc

SEQ ID NO: 1989782 - DNA, 21 bp, Homo sapiens
ttacatctgttttaaatttat

SEQ ID NO: 1989783 - DNA, 22 bp, Homo sapiens
ttacatgcattactgcatgcac

SEQ ID NO: 1989784 - DNA, 18 bp, Homo sapiens
ttacattaaaacaaaaaa

SEQ ID NO: 1989785 - DNA, 14 bp, Homo sapiens
ttacattaatgtta

SEQ ID NO: 1989786 - DNA, 17 bp, Homo sapiens
ttacattgtttgtctgt

SEQ ID NO: 1989787 - DNA, 17 bp, Homo sapiens
ttacatttccaaatgaa

SEQ ID NO: 1989788 - DNA, 16 bp, Homo sapiens
ttaccaaaaaagtatt

SEQ ID NO: 1989789 - DNA, 14 bp, Homo sapiens
ttaccaactttctg

SEQ ID NO: 1989790 - DNA, 16 bp, Homo sapiens
ttaccaactttctgta

SEQ ID NO: 1989791 - DNA, 18 bp, Homo sapiens
ttaccaactttctgtaaa

SEQ ID NO: 1989792 - DNA, 24 bp, Homo sapiens
ttaccagatttttacacatgtatc

SEQ ID NO: 1989793 - DNA, 17 bp, Homo sapiens
ttaccagggatgtagat

SEQ ID NO: 1989794 - DNA, 11 bp, Homo sapiens
ttaccatgaga

SEQ ID NO: 1989795 - DNA, 21 bp, Homo sapiens
ttaccattacttgtataaata

SEQ ID NO: 1989796 - DNA, 23 bp, Homo sapiens
ttaccattttggggtacccactg

SEQ ID NO: 1989797 - DNA, 21 bp, Homo sapiens
ttacccttcacctttggtgca

SEQ ID NO: 1989798 - DNA, 15 bp, Homo sapiens
ttaccgtagcctccg

SEQ ID NO: 1989799 - DNA, 19 bp, Homo sapiens
ttacctaaacagatataaa

SEQ ID NO: 1989800 - DNA, 21 bp, Homo sapiens
ttacctaaacagatataaatg

SEQ ID NO: 1989801 - DNA, 17 bp, Homo sapiens
ttacctaccacagtgtc

SEQ ID NO: 1989802 - DNA, 18 bp, Homo sapiens
ttacctaccaccttccct

SEQ ID NO: 1989803 - DNA, 21 bp, Homo sapiens
ttacctaccaccttccctctt

SEQ ID NO: 1989804 - DNA, 17 bp, Homo sapiens
ttacctcccctgccagg

SEQ ID NO: 1989805 - DNA, 22 bp, Homo sapiens
ttacctcccctgccagggctcg

SEQ ID NO: 1989806 - DNA, 12 bp, Homo sapiens
ttacctcctgcc

SEQ ID NO: 1989807 - DNA, 14 bp, Homo sapiens
ttacctcctgccca

SEQ ID NO: 1989808 - DNA, 15 bp, Homo sapiens
ttacctcctgcccag

SEQ ID NO: 1989809 - DNA, 11 bp, Homo sapiens
ttacctctgat

SEQ ID NO: 1989810 - DNA, 21 bp, Homo sapiens
ttacctctgatacctcaaccc

SEQ ID NO: 1989811 - DNA, 12 bp, Homo sapiens
ttacctgacaca

SEQ ID NO: 1989812 - DNA, 13 bp, Homo sapiens
ttacctgacacaa

SEQ ID NO: 1989813 - DNA, 21 bp, Homo sapiens
ttacctgcatgtgttgtacaa

SEQ ID NO: 1989814 - DNA, 18 bp, Homo sapiens
ttacctgggcattcttgt

SEQ ID NO: 1989815 - DNA, 15 bp, Homo sapiens
ttaccttcaataaag

SEQ ID NO: 1989816 - DNA, 16 bp, Homo sapiens
ttaccttcaataaagt

SEQ ID NO: 1989817 - DNA, 15 bp, Homo sapiens
ttacctttaaaatca

SEQ ID NO: 1989818 - DNA, 16 bp, Homo sapiens
ttacctttacataatt

SEQ ID NO: 1989819 - DNA, 18 bp, Homo sapiens
ttaccttttctgttgtac

SEQ ID NO: 1989820 - DNA, 20 bp, Homo sapiens
ttacggagggaggacatcat

SEQ ID NO: 1989821 - DNA, 12 bp, Homo sapiens
ttacgtgagcca

SEQ ID NO: 1989822 - DNA, 15 bp, Homo sapiens
ttacgtgagccaggt

SEQ ID NO: 1989823 - DNA, 22 bp, Homo sapiens
ttactaaagatatcagagctct

SEQ ID NO: 1989824 - DNA, 13 bp, Homo sapiens
ttactaaagcagt

SEQ ID NO: 1989825 - DNA, 18 bp, Homo sapiens
ttactaagccacaagaaa

SEQ ID NO: 1989826 - DNA, 20 bp, Homo sapiens
ttactaagccacaagaaatt

SEQ ID NO: 1989827 - DNA, 16 bp, Homo sapiens
ttgcttgagcccagga

SEQ ID NO: 1989828 - DNA, 14 bp, Homo sapiens
ttgcttggcagaga

SEQ ID NO: 1989829 - DNA, 23 bp, Homo sapiens
ttgctttaaagtacctgtagtga

SEQ ID NO: 1989830 - DNA, 13 bp, Homo sapiens
ttgctttgccctt

SEQ ID NO: 1989831 - DNA, 15 bp, Homo sapiens
ttgctttgctgtctg

SEQ ID NO: 1989832 - DNA, 20 bp, Homo sapiens
ttgctttgggctttgcaggc

SEQ ID NO: 1989833 - DNA, 23 bp, Homo sapiens
ttgctttgggctttgcaggctct

SEQ ID NO: 1989834 - DNA, 16 bp, Homo sapiens
ttgctttgtatgcact

SEQ ID NO: 1989835 - DNA, 15 bp, Homo sapiens
ttgctttttcaccag

SEQ ID NO: 1989836 - DNA, 21 bp, Homo sapiens
ttggaaaaatccagaaagaaa

SEQ ID NO: 1989837 - DNA, 14 bp, Homo sapiens
ttggaaaagaatac

SEQ ID NO: 1989838 - DNA, 21 bp, Homo sapiens
ttggaaagcaggtggcatctc

SEQ ID NO: 1989839 - DNA, 22 bp, Homo sapiens
ttggaaagcatcacctcaggcc

SEQ ID NO: 1989840 - DNA, 16 bp, Homo sapiens
ttggaaagctgatgat

SEQ ID NO: 1989841 - DNA, 13 bp, Homo sapiens
ttggaaatattca

SEQ ID NO: 1989842 - DNA, 16 bp, Homo sapiens
ttggaagagaggcacc

SEQ ID NO: 1989843 - DNA, 17 bp, Homo sapiens
ttggaagtgttccctga

SEQ ID NO: 1989844 - DNA, 13 bp, Homo sapiens
ttggaagtttcat

SEQ ID NO: 1989845 - DNA, 13 bp, Homo sapiens
ttggacacagtgt

SEQ ID NO: 1989846 - DNA, 15 bp, Homo sapiens
ttggacactgtacaa

SEQ ID NO: 1989847 - DNA, 14 bp, Homo sapiens
ttggacctctgctc

SEQ ID NO: 1989848 - DNA, 15 bp, Homo sapiens
ttggacctctgctct

SEQ ID NO: 1989849 - DNA, 17 bp, Homo sapiens
ttggacctctgctctga

SEQ ID NO: 1989850 - DNA, 21 bp, Homo sapiens
ttggacctctgctctgaggct

SEQ ID NO: 1989851 - DNA, 14 bp, Homo sapiens
ttggactgacattt

SEQ ID NO: 1989852 - DNA, 20 bp, Homo sapiens
ttggacttcctggggccccg

SEQ ID NO: 1989853 - DNA, 12 bp, Homo sapiens
ttggacttcctt

SEQ ID NO: 1989854 - DNA, 12 bp, Homo sapiens
ttggagaaaatg

SEQ ID NO: 1989855 - DNA, 14 bp, Homo sapiens
ttggagaaattatt

SEQ ID NO: 1989856 - DNA, 13 bp, Homo sapiens
ttggagactctgt

SEQ ID NO: 1989857 - DNA, 22 bp, Homo sapiens
ttggagagctagaacctggaga

SEQ ID NO: 1989858 - DNA, 23 bp, Homo sapiens
ttggagggtgggagagcccagcc

SEQ ID NO: 1989859 - DNA, 20 bp, Homo sapiens
ttggatatgtaaaacattta

SEQ ID NO: 1989860 - DNA, 19 bp, Homo sapiens
ttggatctccaattgcctc

SEQ ID NO: 1989861 - DNA, 11 bp, Homo sapiens
ttggatgtggg

SEQ ID NO: 1989862 - DNA, 13 bp, Homo sapiens
ttggattattcat

SEQ ID NO: 1989863 - DNA, 20 bp, Homo sapiens
ttggcaccttcaatacttca

SEQ ID NO: 1989864 - DNA, 22 bp, Homo sapiens
ttggcactgagatatttattgt

SEQ ID NO: 1989865 - DNA, 16 bp, Homo sapiens
ttggcagaaaggatgt

SEQ ID NO: 1989866 - DNA, 14 bp, Homo sapiens
ttggccaggctggt

SEQ ID NO: 1989867 - DNA, 22 bp, Homo sapiens
ttggcccctgtgtgagttgagt

SEQ ID NO: 1989868 - DNA, 12 bp, Homo sapiens
ttggctcaccca

SEQ ID NO: 1989869 - DNA, 15 bp, Homo sapiens
ttggctcaggcagac

SEQ ID NO: 1989870 - DNA, 19 bp, Homo sapiens
ttggctgcgctaaccccca

SEQ ID NO: 1989871 - DNA, 14 bp, Homo sapiens
ttggcttctcctgt

SEQ ID NO: 1989872 - DNA, 20 bp, Homo sapiens
ttgggaattgcatgccatct

SEQ ID NO: 1989873 - DNA, 16 bp, Homo sapiens
ttgggagcactggagt

SEQ ID NO: 1989874 - DNA, 22 bp, Homo sapiens
ttgggagcactggagtgcaggg

SEQ ID NO: 1989875 - DNA, 17 bp, Homo sapiens
ttgggagcttgggaatg

SEQ ID NO: 1989876 - DNA, 16 bp, Homo sapiens
ttgggaggccaaggca

SEQ ID NO: 1989877 - DNA, 17 bp, Homo sapiens
ttgggaggccaaggcag

SEQ ID NO: 1989878 - DNA, 15 bp, Homo sapiens
ttgggaggctgaggc

SEQ ID NO: 1989879 - DNA, 19 bp, Homo sapiens
ttgggaggctgaggcagga

SEQ ID NO: 1989880 - DNA, 15 bp, Homo sapiens
ttgggagggacaggg

SEQ ID NO: 1989881 - DNA, 15 bp, Homo sapiens
ttgggatcagcctcc

SEQ ID NO: 1989882 - DNA, 17 bp, Homo sapiens
ttgggatcagcctccgc

SEQ ID NO: 1989883 - DNA, 17 bp, Homo sapiens
ttgggatgcggggcaga

SEQ ID NO: 1989884 - DNA, 21 bp, Homo sapiens
ttgggattttaaaaacatgag

SEQ ID NO: 1989885 - DNA, 18 bp, Homo sapiens
ttgggcacccccagcctg

SEQ ID NO: 1989886 - DNA, 19 bp, Homo sapiens
ttgggcacccccagcctgg

SEQ ID NO: 1989887 - DNA, 20 bp, Homo sapiens
ttgggcacccccagcctggg

SEQ ID NO: 1989888 - DNA, 16 bp, Homo sapiens
ttgggcatccacccag

SEQ ID NO: 1989889 - DNA, 20 bp, Homo sapiens
ttgggcatccacccagtgct

SEQ ID NO: 1989890 - DNA, 23 bp, Homo sapiens
ttgggcatccacccagtgctgcc

SEQ ID NO: 1989891 - DNA, 20 bp, Homo sapiens
ttgggccagctgtcgcatct

SEQ ID NO: 1989892 - DNA, 20 bp, Homo sapiens
ttgggcctccccccagcccc

SEQ ID NO: 1989893 - DNA, 18 bp, Homo sapiens
ttgggctttgcaggctct

SEQ ID NO: 1989894 - DNA, 21 bp, Homo sapiens
ttggggagaaataaattttgt

SEQ ID NO: 1989895 - DNA, 20 bp, Homo sapiens
ttgggggttggatgggaaga

SEQ ID NO: 1989896 - DNA, 22 bp, Homo sapiens
ttggggtacccactgctctggt

SEQ ID NO: 1989897 - DNA, 19 bp, Homo sapiens
ttggggtcaccaccctccc

SEQ ID NO: 1989898 - DNA, 13 bp, Homo sapiens
ttggggtcagcca

SEQ ID NO: 1989899 - DNA, 20 bp, Homo sapiens
ttggggttcccccagacaga

SEQ ID NO: 1989900 - DNA, 14 bp, Homo sapiens
ttgggtaggcggga

SEQ ID NO: 1989901 - DNA, 22 bp, Homo sapiens
ttgggtcctgcaatctccaggg

SEQ ID NO: 1989902 - DNA, 19 bp, Homo sapiens
ttgggtgtaacaggtctcc

SEQ ID NO: 1989903 - DNA, 22 bp, Homo sapiens
ttggtaaattgtaaacagctaa

SEQ ID NO: 1989904 - DNA, 19 bp, Homo sapiens
ttggtaacacaaattttca

SEQ ID NO: 1989905 - DNA, 21 bp, Homo sapiens
ttggtaacatcctttctattg

SEQ ID NO: 1989906 - DNA, 19 bp, Homo sapiens
ttggtcctgtcaccctggc

SEQ ID NO: 1989907 - DNA, 22 bp, Homo sapiens
ttggtcctgtcaccctggcccc

SEQ ID NO: 1989908 - DNA, 14 bp, Homo sapiens
ttggtctcagcttc

SEQ ID NO: 1989909 - DNA, 14 bp, Homo sapiens
ttggtctctatttc

SEQ ID NO: 1989910 - DNA, 18 bp, Homo sapiens
ttggtgataagtggaaaa

SEQ ID NO: 1989911 - DNA, 20 bp, Homo sapiens
ttggtgataagtggaaaaaa

SEQ ID NO: 1989912 - DNA, 13 bp, Homo sapiens
ttggtgcctggcc

SEQ ID NO: 1989913 - DNA, 20 bp, Homo sapiens
ttggtgcctggcctggcaca

SEQ ID NO: 1989914 - DNA, 22 bp, Homo sapiens
ttggtgcctggcctggcacaca

SEQ ID NO: 1989915 - DNA, 18 bp, Homo sapiens
ttggtgggctggcccagc

SEQ ID NO: 1989916 - DNA, 17 bp, Homo sapiens
ttggtgtaattaataaa

SEQ ID NO: 1989917 - DNA, 18 bp, Homo sapiens
ttggtgtggctgtattca

SEQ ID NO: 1989918 - DNA, 16 bp, Homo sapiens
ttggtgtgtggagatg

SEQ ID NO: 1989919 - DNA, 21 bp, Homo sapiens
ttggtgttacacagcccaaga

SEQ ID NO: 1989920 - DNA, 22 bp, Homo sapiens
ttggtgttacacagcccaagag

SEQ ID NO: 1989921 - DNA, 17 bp, Homo sapiens
ttggttagaacctccta

SEQ ID NO: 1989922 - DNA, 19 bp, Homo sapiens
ttggttctaatagaactca

SEQ ID NO: 1989923 - DNA, 22 bp, Homo sapiens
ttggttgtaaatgctcgtgtga

SEQ ID NO: 1989924 - DNA, 16 bp, Homo sapiens
ttggtttggggagaaa

SEQ ID NO: 1989925 - DNA, 17 bp, Homo sapiens
ttggtttggggagaaat

SEQ ID NO: 1989926 - DNA, 18 bp, Homo sapiens
ttgtaaaaacaaaaagac

SEQ ID NO: 1989927 - DNA, 19 bp, Homo sapiens
ttgtaaaaacaaaaagaca

SEQ ID NO: 1989928 - DNA, 22 bp, Homo sapiens
ttgtaaaaattaaaagttatgg

SEQ ID NO: 1989929 - DNA, 22 bp, Homo sapiens
ttgtaaactcaaaatatttgta

SEQ ID NO: 1989930 - DNA, 15 bp, Homo sapiens
ttgtaaactgtatca

SEQ ID NO: 1989931 - DNA, 14 bp, Homo sapiens
ttgtaaagagtgga

SEQ ID NO: 1989932 - DNA, 11 bp, Homo sapiens
ttgtaaataaa

SEQ ID NO: 1989933 - DNA, 13 bp, Homo sapiens
ttgtaaatacacc

SEQ ID NO: 1989934 - DNA, 17 bp, Homo sapiens
ttgtaaatagctcaggt

SEQ ID NO: 1989935 - DNA, 16 bp, Homo sapiens
ttgtaaatatttatgt

SEQ ID NO: 1989936 - DNA, 18 bp, Homo sapiens
ttgtaaatgaccaagaaa

SEQ ID NO: 1989937 - DNA, 11 bp, Homo sapiens
ttgtaaattat

SEQ ID NO: 1989938 - DNA, 15 bp, Homo sapiens
ttgtaacttcaaata

SEQ ID NO: 1989939 - DNA, 12 bp, Homo sapiens
ttgtaagtttat

SEQ ID NO: 1989940 - DNA, 11 bp, Homo sapiens
ttgtaatagtc

SEQ ID NO: 1989941 - DNA, 19 bp, Homo sapiens
ttgtaatcctgtatattat

SEQ ID NO: 1989942 - DNA, 15 bp, Homo sapiens
ttgtaatcgttatgt

SEQ ID NO: 1989943 - DNA, 20 bp, Homo sapiens
ttgtaatcgttatgtgtgta

SEQ ID NO: 1989944 - DNA, 14 bp, Homo sapiens
ttgtaatgtcacca

SEQ ID NO: 1989945 - DNA, 16 bp, Homo sapiens
ttgtaattagtaataa

SEQ ID NO: 1989946 - DNA, 17 bp, Homo sapiens
ttgtaattgcttacatt

SEQ ID NO: 1989947 - DNA, 19 bp, Homo sapiens
ttgtaattgcttacatttt

SEQ ID NO: 1989948 - DNA, 14 bp, Homo sapiens
ttgtacaaaataaa

SEQ ID NO: 1989949 - DNA, 15 bp, Homo sapiens
ttgtacaaagatatg

SEQ ID NO: 1989950 - DNA, 18 bp, Homo sapiens
ttgtacaaagatatgcta

SEQ ID NO: 1989951 - DNA, 15 bp, Homo sapiens
ttgtacaagctcagg

SEQ ID NO: 1989952 - DNA, 23 bp, Homo sapiens
ttgtacaattgaacttaaataaa

SEQ ID NO: 1989953 - DNA, 19 bp, Homo sapiens
ttgtacagacgtatgctta

SEQ ID NO: 1989954 - DNA, 17 bp, Homo sapiens
ttgtacagtggagaaat

SEQ ID NO: 1989955 - DNA, 11 bp, Homo sapiens
ttgtacagttc

SEQ ID NO: 1989956 - DNA, 22 bp, Homo sapiens
ttgtacatacagaggtaactat

SEQ ID NO: 1989957 - DNA, 15 bp, Homo sapiens
ttgtacatatggaaa

SEQ ID NO: 1989958 - DNA, 19 bp, Homo sapiens
ttgtacattcctgatactg

SEQ ID NO: 1989959 - DNA, 12 bp, Homo sapiens
ttgtaccccatc

SEQ ID NO: 1989960 - DNA, 16 bp, Homo sapiens
ttgtaccccatccctt

SEQ ID NO: 1989961 - DNA, 19 bp, Homo sapiens
ttgtaccccatcccttcct

SEQ ID NO: 1989962 - DNA, 20 bp, Homo sapiens
ttgtacctatgtgacagaca

SEQ ID NO: 1989963 - DNA, 20 bp, Homo sapiens
ttgtacgttatatattgtat

SEQ ID NO: 1989964 - DNA, 22 bp, Homo sapiens
ttgtagaagggttatattttac

SEQ ID NO: 1989965 - DNA, 19 bp, Homo sapiens
ttgtagagtggcccagaat

SEQ ID NO: 1989966 - DNA, 15 bp, Homo sapiens
ttgtagccagccggg

SEQ ID NO: 1989967 - DNA, 17 bp, Homo sapiens
ttgtagttcttgtgcat

SEQ ID NO: 1989968 - DNA, 14 bp, Homo sapiens
ttgtatagtgtaaa

SEQ ID NO: 1989969 - DNA, 12 bp, Homo sapiens
ttgtatatacat

SEQ ID NO: 1989970 - DNA, 19 bp, Homo sapiens
ttgtatatatctgcttcag

SEQ ID NO: 1989971 - DNA, 15 bp, Homo sapiens
ttgtatatcatgaaa

SEQ ID NO: 1989972 - DNA, 16 bp, Homo sapiens
ttgtatatgatctaat

SEQ ID NO: 1989973 - DNA, 18 bp, Homo sapiens
ttgtatattgtaggaatc

SEQ ID NO: 1989974 - DNA, 14 bp, Homo sapiens
ttgtatgatgtgtt

SEQ ID NO: 1989975 - DNA, 23 bp, Homo sapiens
ttgtattcccttttatttccaaa

SEQ ID NO: 1989976 - DNA, 18 bp, Homo sapiens
ttgtattttaaaacataa

SEQ ID NO: 1989977 - DNA, 16 bp, Homo sapiens
ttgtattttccataca

SEQ ID NO: 1989978 - DNA, 17 bp, Homo sapiens
ttgtcacacactttggc

SEQ ID NO: 1989979 - DNA, 15 bp, Homo sapiens
ttgtcactagcagct

SEQ ID NO: 1989980 - DNA, 16 bp, Homo sapiens
ttgtcactatgctatt

SEQ ID NO: 1989981 - DNA, 18 bp, Homo sapiens
ttgtcagactttaaagaa

SEQ ID NO: 1989982 - DNA, 20 bp, Homo sapiens
ttgtcagactttaaagaata

SEQ ID NO: 1989983 - DNA, 15 bp, Homo sapiens
ttgtcaggacccagg

SEQ ID NO: 1989984 - DNA, 16 bp, Homo sapiens
ttgtcaggacccaggc

SEQ ID NO: 1989985 - DNA, 16 bp, Homo sapiens
ttgtcatataaacctg

SEQ ID NO: 1989986 - DNA, 16 bp, Homo sapiens
ttgtcatatattcatg

SEQ ID NO: 1989987 - DNA, 17 bp, Homo sapiens
ttgtcatatattcatgt

SEQ ID NO: 1989988 - DNA, 22 bp, Homo sapiens
ttgtcatggaaaatgtcctgtg

SEQ ID NO: 1989989 - DNA, 23 bp, Homo sapiens
ttgtcatggaaaatgtcctgtgg

SEQ ID NO: 1989990 - DNA, 13 bp, Homo sapiens
ttgtcatttataa

SEQ ID NO: 1989991 - DNA, 20 bp, Homo sapiens
ttgtccaacaactccaggaa

SEQ ID NO: 1989992 - DNA, 22 bp, Homo sapiens
ttgtccaatggctgtaaactat

SEQ ID NO: 1989993 - DNA, 21 bp, Homo sapiens
ttgtccacagtctcccattct

SEQ ID NO: 1989994 - DNA, 20 bp, Homo sapiens
ttgtccatgcctacagataa

SEQ ID NO: 1989995 - DNA, 19 bp, Homo sapiens
ttgtcccatttccttggag

SEQ ID NO: 1989996 - DNA, 19 bp, Homo sapiens
ttgtccctgctcctcccaa

SEQ ID NO: 1989997 - DNA, 14 bp, Homo sapiens
ttgtccctgtttca

SEQ ID NO: 1989998 - DNA, 15 bp, Homo sapiens
ttgtcctgccagctg

SEQ ID NO: 1989999 - DNA, 16 bp, Homo sapiens
ttgtcctgccagctgc

SEQ ID NO: 1990000 - DNA, 19 bp, Homo sapiens
ttgtcctgccagctgcctt

SEQ ID NO: 1990001 - DNA, 16 bp, Homo sapiens
ttgtccttcctgtgcc

SEQ ID NO: 1990002 - DNA, 17 bp, Homo sapiens
ttgtctattctgagcct

SEQ ID NO: 1990003 - DNA, 23 bp, Homo sapiens
ttgtctcctacctgctgctgcta

SEQ ID NO: 1990004 - DNA, 21 bp, Homo sapiens
ttgtctgaagtcactgcacag

SEQ ID NO: 1990005 - DNA, 13 bp, Homo sapiens
ttgtctgaggcct

SEQ ID NO: 1990006 - DNA, 22 bp, Homo sapiens
ttgtcttccaaccccagctggc

SEQ ID NO: 1990007 - DNA, 13 bp, Homo sapiens
ttgtcttgtggag

SEQ ID NO: 1990008 - DNA, 23 bp, Homo sapiens
ttgtctttgtaatgtcaccacct

SEQ ID NO: 1990009 - DNA, 13 bp, Homo sapiens
ttgtgaaagaagg

SEQ ID NO: 1990010 - DNA, 22 bp, Homo sapiens
ttgtgacaggaaagccctcccc

SEQ ID NO: 1990011 - DNA, 22 bp, Homo sapiens
ttgtgacgattatttatttctg

SEQ ID NO: 1990012 - DNA, 12 bp, Homo sapiens
ttgtgactggca

SEQ ID NO: 1990013 - DNA, 16 bp, Homo sapiens
ttgtgagcactctact

SEQ ID NO: 1990014 - DNA, 23 bp, Homo sapiens
ttgtgaggattatgggtcctgca

SEQ ID NO: 1990015 - DNA, 20 bp, Homo sapiens
ttgtgatagctaacatttta

SEQ ID NO: 1990016 - DNA, 18 bp, Homo sapiens
ttgtgatgtcccaacttg

SEQ ID NO: 1990017 - DNA, 16 bp, Homo sapiens
ttgtgattttgtacag

SEQ ID NO: 1990018 - DNA, 22 bp, Homo sapiens
ttgtgattttgtacagaatttt

SEQ ID NO: 1990019 - DNA, 17 bp, Homo sapiens
ttgtgccaatatgtatt

SEQ ID NO: 1990020 - DNA, 22 bp, Homo sapiens
ttgtgccctgcccccatctccc

SEQ ID NO: 1990021 - DNA, 12 bp, Homo sapiens
ttgtgcctcagc

SEQ ID NO: 1990022 - DNA, 16 bp, Homo sapiens
ttgtgccttttatagc

SEQ ID NO: 1990023 - DNA, 13 bp, Homo sapiens
ttgtgggtgggag

SEQ ID NO: 1990024 - DNA, 23 bp, Homo sapiens
ttgtgtaataaaaatttgtttaa

SEQ ID NO: 1990025 - DNA, 23 bp, Homo sapiens
ttgtgtacaaagtagagaagtat

SEQ ID NO: 1990026 - DNA, 15 bp, Homo sapiens
ttgtgtacagtgtgt

SEQ ID NO: 1990027 - DNA, 14 bp, Homo sapiens
ttgtgtagattgtg

SEQ ID NO: 1990028 - DNA, 20 bp, Homo sapiens
ttgtgtagattgtgtaaatt

SEQ ID NO: 1990029 - DNA, 11 bp, Homo sapiens
ttgtgtatgtg

SEQ ID NO: 1990030 - DNA, 12 bp, Homo sapiens
ttgtgtatgtgt

SEQ ID NO: 1990031 - DNA, 13 bp, Homo sapiens
ttgtgtatgtgta

SEQ ID NO: 1990032 - DNA, 21 bp, Homo sapiens
ttgtgtcaatgggcaatgaca

SEQ ID NO: 1990033 - DNA, 13 bp, Homo sapiens
ttgtgtgattgaa

SEQ ID NO: 1990034 - DNA, 21 bp, Homo sapiens
ttgtgtgttatttaaatgagt

SEQ ID NO: 1990035 - DNA, 13 bp, Homo sapiens
ttgtgttctaata

SEQ ID NO: 1990036 - DNA, 15 bp, Homo sapiens
ttgtgtttagatttt

SEQ ID NO: 1990037 - DNA, 16 bp, Homo sapiens
ttgttaaaataactag

SEQ ID NO: 1990038 - DNA, 23 bp, Homo sapiens
ttgttaataataagataatgatg

SEQ ID NO: 1990039 - DNA, 17 bp, Homo sapiens
ttgttaatgaaaatgtc

SEQ ID NO: 1990040 - DNA, 21 bp, Homo sapiens
ttgttaatgttgggatttata

SEQ ID NO: 1990041 - DNA, 17 bp, Homo sapiens
ttgttaccatgaagata

SEQ ID NO: 1990042 - DNA, 22 bp, Homo sapiens
ttgttatgtatatagatgtgca

SEQ ID NO: 1990043 - DNA, 13 bp, Homo sapiens
ttgttattttcag

SEQ ID NO: 1990044 - DNA, 15 bp, Homo sapiens
ttgttcaaatgcatt

SEQ ID NO: 1990045 - DNA, 21 bp, Homo sapiens
ttgttcatgttaccaaagcaa

SEQ ID NO: 1990046 - DNA, 15 bp, Homo sapiens
ttgttcccacacaca

SEQ ID NO: 1990047 - DNA, 11 bp, Homo sapiens
ttgttcctgat

SEQ ID NO: 1990048 - DNA, 17 bp, Homo sapiens
ttgttccttcacattta

SEQ ID NO: 1990049 - DNA, 22 bp, Homo sapiens
ttgttctagttagcaggaaata

SEQ ID NO: 1990050 - DNA, 18 bp, Homo sapiens
ttgttgacatgagtggaa

SEQ ID NO: 1990051 - DNA, 18 bp, Homo sapiens
ttgttgcagagatttcct

SEQ ID NO: 1990052 - DNA, 12 bp, Homo sapiens
ttgttgtgactt

SEQ ID NO: 1990053 - DNA, 21 bp, Homo sapiens
ttgttgtgattttgtacagaa

SEQ ID NO: 1990054 - DNA, 20 bp, Homo sapiens
ttgttgttattttttgagaa

SEQ ID NO: 1990055 - DNA, 13 bp, Homo sapiens
ttgtttaaaaaca

SEQ ID NO: 1990056 - DNA, 20 bp, Homo sapiens
ttgtttaaatataaatgttt

SEQ ID NO: 1990057 - DNA, 13 bp, Homo sapiens
ttgtttaattgta

SEQ ID NO: 1990058 - DNA, 20 bp, Homo sapiens
ttgtttatttatcagtgaca

SEQ ID NO: 1990059 - DNA, 23 bp, Homo sapiens
ttgtttctactttgatatgactg

SEQ ID NO: 1990060 - DNA, 19 bp, Homo sapiens
ttgtttcttccaaagcaca

SEQ ID NO: 1990061 - DNA, 14 bp, Homo sapiens
ttgtttggcttcct

SEQ ID NO: 1990062 - DNA, 16 bp, Homo sapiens
ttgtttggtcactgct

SEQ ID NO: 1990063 - DNA, 22 bp, Homo sapiens
ttgttttaaccagtacttctaa

SEQ ID NO: 1990064 - DNA, 18 bp, Homo sapiens
ttgttttaagattgtaat

SEQ ID NO: 1990065 - DNA, 15 bp, Homo sapiens
ttgttttatgttcta

SEQ ID NO: 1990066 - DNA, 15 bp, Homo sapiens
ttgtttttgctacta

SEQ ID NO: 1990067 - DNA, 23 bp, Homo sapiens
tttaaaaaacaaaaaccagcagg

SEQ ID NO: 1990068 - DNA, 14 bp, Homo sapiens
tttaaaaaactaaa

SEQ ID NO: 1990069 - DNA, 11 bp, Homo sapiens
tttaaaaaagc

SEQ ID NO: 1990070 - DNA, 23 bp, Homo sapiens
tttaaaaaagcttaaaactttga

SEQ ID NO: 1990071 - DNA, 18 bp, Homo sapiens
tttaaaaaataaatataa

SEQ ID NO: 1990072 - DNA, 12 bp, Homo sapiens
tttaaaaaatac

SEQ ID NO: 1990073 - DNA, 14 bp, Homo sapiens
tttaaaaaatacac

SEQ ID NO: 1990074 - DNA, 19 bp, Homo sapiens
tttaaaaaccaatcatttt

SEQ ID NO: 1990075 - DNA, 17 bp, Homo sapiens
tttaaaaagttgcacat

SEQ ID NO: 1990076 - DNA, 13 bp, Homo sapiens
tttaaaaatcata

SEQ ID NO: 1990077 - DNA, 15 bp, Homo sapiens
tttaaaaatcataaa

SEQ ID NO: 1990078 - DNA, 16 bp, Homo sapiens
tttaaaaatcataaac

SEQ ID NO: 1990079 - DNA, 19 bp, Homo sapiens
tttaaaaatcataaactgt

SEQ ID NO: 1990080 - DNA, 14 bp, Homo sapiens
tttaaaaccatgca

SEQ ID NO: 1990081 - DNA, 22 bp, Homo sapiens
tttaaaagtataaaactgcttt

SEQ ID NO: 1990082 - DNA, 20 bp, Homo sapiens
tttaaaagttactcctttta

SEQ ID NO: 1990083 - DNA, 17 bp, Homo sapiens
tttaaaagtttcaatgt

SEQ ID NO: 1990084 - DNA, 16 bp, Homo sapiens
tttaaaatcatttctg

SEQ ID NO: 1990085 - DNA, 17 bp, Homo sapiens
tttaaaatttatattgt

SEQ ID NO: 1990086 - DNA, 20 bp, Homo sapiens
tttaaaatttatattgtaaa

SEQ ID NO: 1990087 - DNA, 13 bp, Homo sapiens
tttaaacagcagt

SEQ ID NO: 1990088 - DNA, 16 bp, Homo sapiens
tttaaaccagcagaaa

SEQ ID NO: 1990089 - DNA, 23 bp, Homo sapiens
tttaaaccagcagaaaagtgctt

SEQ ID NO: 1990090 - DNA, 12 bp, Homo sapiens
tttaaagaagta

SEQ ID NO: 1990091 - DNA, 14 bp, Homo sapiens
tttaaagaagtaaa

SEQ ID NO: 1990092 - DNA, 20 bp, Homo sapiens
tttaaagaagtaaatttgtc

SEQ ID NO: 1990093 - DNA, 12 bp, Homo sapiens
tttaaagaattg

SEQ ID NO: 1990094 - DNA, 17 bp, Homo sapiens
tttaaagcgtttgcaca

SEQ ID NO: 1990095 - DNA, 19 bp, Homo sapiens
tttaaaggtagagatgtgt

SEQ ID NO: 1990096 - DNA, 19 bp, Homo sapiens
tttaaagtctttccgtctc

SEQ ID NO: 1990097 - DNA, 13 bp, Homo sapiens
tttaaataaagta

SEQ ID NO: 1990098 - DNA, 16 bp, Homo sapiens
tttaaatatgaacaaa

SEQ ID NO: 1990099 - DNA, 12 bp, Homo sapiens
tttaaatcaaaa

SEQ ID NO: 1990100 - DNA, 14 bp, Homo sapiens
tttaaatcaaaagc

SEQ ID NO: 1990101 - DNA, 23 bp, Homo sapiens
tttaaatctatctatataatgta

SEQ ID NO: 1990102 - DNA, 20 bp, Homo sapiens
tttaaatgatgattccttga

SEQ ID NO: 1990103 - DNA, 18 bp, Homo sapiens
tttaaatgcataaatgca

SEQ ID NO: 1990104 - DNA, 16 bp, Homo sapiens
tttaaatgttgaaatc

SEQ ID NO: 1990105 - DNA, 18 bp, Homo sapiens
tttaaatgttgaaatctt

SEQ ID NO: 1990106 - DNA, 19 bp, Homo sapiens
tttaaattcacaatagaaa

SEQ ID NO: 1990107 - DNA, 12 bp, Homo sapiens
tttaaatttgaa

SEQ ID NO: 1990108 - DNA, 20 bp, Homo sapiens
tttaaatttttgtgaaccaa

SEQ ID NO: 1990109 - DNA, 20 bp, Homo sapiens
tttaacaaaacaagaaagaa

SEQ ID NO: 1990110 - DNA, 23 bp, Homo sapiens
tttaacaatttcctttatattta

SEQ ID NO: 1990111 - DNA, 14 bp, Homo sapiens
tttaacacataact

SEQ ID NO: 1990112 - DNA, 17 bp, Homo sapiens
tttaacagaaccagagg

SEQ ID NO: 1990113 - DNA, 17 bp, Homo sapiens
tttaacagtcatttaaa

SEQ ID NO: 1990114 - DNA, 20 bp, Homo sapiens
tttaacataggttttgattt

SEQ ID NO: 1990115 - DNA, 17 bp, Homo sapiens
tttaactaatttaaacc

SEQ ID NO: 1990116 - DNA, 19 bp, Homo sapiens
tttaactaatttaaaccag

SEQ ID NO: 1990117 - DNA, 13 bp, Homo sapiens
tttaacttaaata

SEQ ID NO: 1990118 - DNA, 16 bp, Homo sapiens
tttaagacgtgaatgt

SEQ ID NO: 1990119 - DNA, 14 bp, Homo sapiens
tttaagagagaaat

SEQ ID NO: 1990120 - DNA, 20 bp, Homo sapiens
tttaagaggctttggcccaa

SEQ ID NO: 1990121 - DNA, 15 bp, Homo sapiens
tttaagataattata

SEQ ID NO: 1990122 - DNA, 16 bp, Homo sapiens
tttaagcattcttaga

SEQ ID NO: 1990123 - DNA, 20 bp, Homo sapiens
tttaagccaaaacaatgttt

SEQ ID NO: 1990124 - DNA, 13 bp, Homo sapiens
tttaagctgtttc

SEQ ID NO: 1990125 - DNA, 18 bp, Homo sapiens
tttaagctgtttccatag

SEQ ID NO: 1990126 - DNA, 22 bp, Homo sapiens
tttaagcttatttaattaaaaa

SEQ ID NO: 1990127 - DNA, 21 bp, Homo sapiens
tttaaggagggacaagaatca

SEQ ID NO: 1990128 - DNA, 18 bp, Homo sapiens
tttaaggatgactttttt

SEQ ID NO: 1990129 - DNA, 23 bp, Homo sapiens
tttaaggatgactttttttctga

SEQ ID NO: 1990130 - DNA, 13 bp, Homo sapiens
tttaagtatttag

SEQ ID NO: 1990131 - DNA, 10 bp, Homo sapiens
tttaagtcct

SEQ ID NO: 1990132 - DNA, 13 bp, Homo sapiens
tttaagtctctga

SEQ ID NO: 1990133 - DNA, 18 bp, Homo sapiens
tttaagtgctttgtaatg

SEQ ID NO: 1990134 - DNA, 20 bp, Homo sapiens
tttaataattatgtgccatt

SEQ ID NO: 1990135 - DNA, 14 bp, Homo sapiens
tttaatacagcagt

SEQ ID NO: 1990136 - DNA, 20 bp, Homo sapiens
tttaatacctttggaaaaat

SEQ ID NO: 1990137 - DNA, 19 bp, Homo sapiens
tttaatagaatataattat

SEQ ID NO: 1990138 - DNA, 13 bp, Homo sapiens
tttaatagtttct

SEQ ID NO: 1990139 - DNA, 23 bp, Homo sapiens
tttaatatctgagaagtgtatat

SEQ ID NO: 1990140 - DNA, 15 bp, Homo sapiens
tttaatatttaaaca

SEQ ID NO: 1990141 - DNA, 17 bp, Homo sapiens
tttaatattttgtattt

SEQ ID NO: 1990142 - DNA, 12 bp, Homo sapiens
tttaatcattta

SEQ ID NO: 1990143 - DNA, 14 bp, Homo sapiens
tttaatccagaatt

SEQ ID NO: 1990144 - DNA, 21 bp, Homo sapiens
tttaatccagaattgaccttt

SEQ ID NO: 1990145 - DNA, 17 bp, Homo sapiens
tttaatctttgtgacag

SEQ ID NO: 1990146 - DNA, 22 bp, Homo sapiens
tttaatgttttctgctgtttaa

SEQ ID NO: 1990147 - DNA, 15 bp, Homo sapiens
tttaattaactatgt

SEQ ID NO: 1990148 - DNA, 20 bp, Homo sapiens
tttaattaactatgtgatgt

SEQ ID NO: 1990149 - DNA, 12 bp, Homo sapiens
tttaattcaaag

SEQ ID NO: 1990150 - DNA, 13 bp, Homo sapiens
tttaattcataat

SEQ ID NO: 1990151 - DNA, 18 bp, Homo sapiens
tttaattcataattagaa

SEQ ID NO: 1990152 - DNA, 16 bp, Homo sapiens
tttaattccaatatga

SEQ ID NO: 1990153 - DNA, 21 bp, Homo sapiens
tttaattccaatatgatgact

SEQ ID NO: 1990154 - DNA, 22 bp, Homo sapiens
tttaattcttatttctgtgtta

SEQ ID NO: 1990155 - DNA, 15 bp, Homo sapiens
tttacaaataaagat

SEQ ID NO: 1990156 - DNA, 17 bp, Homo sapiens
tttacaataaatattct

SEQ ID NO: 1990157 - DNA, 18 bp, Homo sapiens
tttacactctctgtacaa

SEQ ID NO: 1990158 - DNA, 13 bp, Homo sapiens
tttacagctgcct

SEQ ID NO: 1990159 - DNA, 15 bp, Homo sapiens
tttacagtaaataaa

SEQ ID NO: 1990160 - DNA, 13 bp, Homo sapiens
tttacataattgc

SEQ ID NO: 1990161 - DNA, 18 bp, Homo sapiens
tttacatagttcttacta

SEQ ID NO: 1990162 - DNA, 20 bp, Homo sapiens
tttacatgcaatttattaaa

SEQ ID NO: 1990163 - DNA, 19 bp, Homo sapiens
tttacatggggttttcaat

SEQ ID NO: 1990164 - DNA, 17 bp, Homo sapiens
tttacccagtgggacag

SEQ ID NO: 1990165 - DNA, 22 bp, Homo sapiens
tttacccagtgggacagaggag

SEQ ID NO: 1990166 - DNA, 15 bp, Homo sapiens
tttacccctgcacag

SEQ ID NO: 1990167 - DNA, 19 bp, Homo sapiens
tttacctaccacagtgtct

SEQ ID NO: 1990168 - DNA, 19 bp, Homo sapiens
tttacctaccaccttccct

SEQ ID NO: 1990169 - DNA, 18 bp, Homo sapiens
tttacctgggatatgaca

SEQ ID NO: 1990170 - DNA, 16 bp, Homo sapiens
tttacgactgaagaag

SEQ ID NO: 1990171 - DNA, 13 bp, Homo sapiens
tttactaaaagaa

SEQ ID NO: 1990172 - DNA, 15 bp, Homo sapiens
tttactaaagagaca

SEQ ID NO: 1990173 - DNA, 24 bp, Homo sapiens
tttactaaagagacatatttatca

SEQ ID NO: 1990174 - DNA, 14 bp, Homo sapiens
tttactaaagcagt

SEQ ID NO: 1990175 - DNA, 22 bp, Homo sapiens
tttactaagccacaagaaattt

SEQ ID NO: 1990176 - DNA, 18 bp, Homo sapiens
tttactactattctgtta

SEQ ID NO: 1990177 - DNA, 13 bp, Homo sapiens
tttactccagtgg

SEQ ID NO: 1990178 - DNA, 21 bp, Homo sapiens
tttactccagtggtgaagaaa

SEQ ID NO: 1990179 - DNA, 14 bp, Homo sapiens
tttactgacaagaa

SEQ ID NO: 1990180 - DNA, 14 bp, Homo sapiens
tttactgacagaaa

SEQ ID NO: 1990181 - DNA, 13 bp, Homo sapiens
tttactgctgtca

SEQ ID NO: 1990182 - DNA, 13 bp, Homo sapiens
tttactgtctgta

SEQ ID NO: 1990183 - DNA, 21 bp, Homo sapiens
tttacttgcattgaatatatt

SEQ ID NO: 1990184 - DNA, 14 bp, Homo sapiens
tttacttgtagaaa

SEQ ID NO: 1990185 - DNA, 13 bp, Homo sapiens
tttactttgaatt

SEQ ID NO: 1990186 - DNA, 15 bp, Homo sapiens
tttactttgtgttca

SEQ ID NO: 1990187 - DNA, 15 bp, Homo sapiens
tttacttttaaacag

SEQ ID NO: 1990188 - DNA, 14 bp, Homo sapiens
tttagaaaacttta

SEQ ID NO: 1990189 - DNA, 16 bp, Homo sapiens
tttagaaaactttaaa

SEQ ID NO: 1990190 - DNA, 23 bp, Homo sapiens
tttagagtatgcaagaagaatat

SEQ ID NO: 1990191 - DNA, 22 bp, Homo sapiens
tttagcagttaaaagtgtattt

SEQ ID NO: 1990192 - DNA, 13 bp, Homo sapiens
tttaggagcagtg

SEQ ID NO: 1990193 - DNA, 16 bp, Homo sapiens
tttaggcaagagaaaa

SEQ ID NO: 1990194 - DNA, 16 bp, Homo sapiens
tttagggaagcaggga

SEQ ID NO: 1990195 - DNA, 14 bp, Homo sapiens
tttagggccaggca

SEQ ID NO: 1990196 - DNA, 13 bp, Homo sapiens
tttaggtgcctcc

SEQ ID NO: 1990197 - DNA, 14 bp, Homo sapiens
tttaggtgcctcct

SEQ ID NO: 1990198 - DNA, 17 bp, Homo sapiens
tttaggtgcctcctgtc

SEQ ID NO: 1990199 - DNA, 18 bp, Homo sapiens
tttaggtgcctcctgtct

SEQ ID NO: 1990200 - DNA, 22 bp, Homo sapiens
tttaggtttttgtttgtttcct

SEQ ID NO: 1990201 - DNA, 22 bp, Homo sapiens
tttagtcttttactcctttgca

SEQ ID NO: 1990202 - DNA, 13 bp, Homo sapiens
tttagttatagtt

SEQ ID NO: 1990203 - DNA, 14 bp, Homo sapiens
tttagttatagttt

SEQ ID NO: 1990204 - DNA, 15 bp, Homo sapiens
tttagttatagtttc

SEQ ID NO: 1990205 - DNA, 14 bp, Homo sapiens
tttagttgaaaaat

SEQ ID NO: 1990206 - DNA, 17 bp, Homo sapiens
tttagttgtatctcttt

SEQ ID NO: 1990207 - DNA, 13 bp, Homo sapiens
tttataaaagcaa

SEQ ID NO: 1990208 - DNA, 16 bp, Homo sapiens
tttataaaattagaaa

SEQ ID NO: 1990209 - DNA, 16 bp, Homo sapiens
tttataactcatcata

SEQ ID NO: 1990210 - DNA, 18 bp, Homo sapiens
tttataactcatcataaa

SEQ ID NO: 1990211 - DNA, 19 bp, Homo sapiens
tttataactcatcataaaa

SEQ ID NO: 1990212 - DNA, 17 bp, Homo sapiens
tttataagcaaatttca

SEQ ID NO: 1990213 - DNA, 23 bp, Homo sapiens
tttataagcaaatttcaaaagac

SEQ ID NO: 1990214 - DNA, 20 bp, Homo sapiens
tttataagcagatttaacaa

SEQ ID NO: 1990215 - DNA, 19 bp, Homo sapiens
tttataatgtggatttcct

SEQ ID NO: 1990216 - DNA, 21 bp, Homo sapiens
tttataatgtggatttcctat

SEQ ID NO: 1990217 - DNA, 16 bp, Homo sapiens
tttatacaaaataatt

SEQ ID NO: 1990218 - DNA, 18 bp, Homo sapiens
tttatacaaaataattta

SEQ ID NO: 1990219 - DNA, 22 bp, Homo sapiens
tttatacatagtcacaaaaatg

SEQ ID NO: 1990220 - DNA, 15 bp, Homo sapiens
tttatacatatcaga

SEQ ID NO: 1990221 - DNA, 17 bp, Homo sapiens
tttatacatatcagaaa

SEQ ID NO: 1990222 - DNA, 18 bp, Homo sapiens
tttatacatatcagaaaa

SEQ ID NO: 1990223 - DNA, 20 bp, Homo sapiens
tttatacatatcagaaaagt

SEQ ID NO: 1990224 - DNA, 21 bp, Homo sapiens
tttatactctagaacatgcac

SEQ ID NO: 1990225 - DNA, 17 bp, Homo sapiens
tttatagctattactgt

SEQ ID NO: 1990226 - DNA, 17 bp, Homo sapiens
tttatagtttgtacatg

SEQ ID NO: 1990227 - DNA, 13 bp, Homo sapiens
tttatatatatat

SEQ ID NO: 1990228 - DNA, 19 bp, Homo sapiens
tttatatatatatgtatat

SEQ ID NO: 1990229 - DNA, 15 bp, Homo sapiens
tttatatatggcata

SEQ ID NO: 1990230 - DNA, 12 bp, Homo sapiens
tttatatatttg

SEQ ID NO: 1990231 - DNA, 17 bp, Homo sapiens
tttatatcagcctgagt

SEQ ID NO: 1990232 - DNA, 15 bp, Homo sapiens
tttatatccacatct

SEQ ID NO: 1990233 - DNA, 20 bp, Homo sapiens
tttatatgaaatgtttcact

SEQ ID NO: 1990234 - DNA, 23 bp, Homo sapiens
tttatattcagagatgtaccatg

SEQ ID NO: 1990235 - DNA, 12 bp, Homo sapiens
tttatatttctc

SEQ ID NO: 1990236 - DNA, 13 bp, Homo sapiens
tttatcagtgaca

SEQ ID NO: 1990237 - DNA, 18 bp, Homo sapiens
tttatcagtgacagagtt

SEQ ID NO: 1990238 - DNA, 21 bp, Homo sapiens
tttatcagtgcttaatgtgaa

SEQ ID NO: 1990239 - DNA, 15 bp, Homo sapiens
tttatcatgacatgt

SEQ ID NO: 1990240 - DNA, 12 bp, Homo sapiens
tttatcattttc

SEQ ID NO: 1990241 - DNA, 17 bp, Homo sapiens
tttatccaatcctcagg

SEQ ID NO: 1990242 - DNA, 19 bp, Homo sapiens
tttatcctgaaatttcaga

SEQ ID NO: 1990243 - DNA, 21 bp, Homo sapiens
tttatccttcaccagcaactc

SEQ ID NO: 1990244 - DNA, 20 bp, Homo sapiens
tttatctaatacctctgtgt

SEQ ID NO: 1990245 - DNA, 13 bp, Homo sapiens
tttatctctattt

SEQ ID NO: 1990246 - DNA, 14 bp, Homo sapiens
tttatctctattta

SEQ ID NO: 1990247 - DNA, 17 bp, Homo sapiens
tttatctctatttaata

SEQ ID NO: 1990248 - DNA, 16 bp, Homo sapiens
tttatctgaattttta

SEQ ID NO: 1990249 - DNA, 21 bp, Homo sapiens
tttatctgtattttttacagt

SEQ ID NO: 1990250 - DNA, 11 bp, Homo sapiens
tttatctttga

SEQ ID NO: 1990251 - DNA, 19 bp, Homo sapiens
tttatgaaaaagaagaatc

SEQ ID NO: 1990252 - DNA, 19 bp, Homo sapiens
tttatgaagaaaaaataca

SEQ ID NO: 1990253 - DNA, 17 bp, Homo sapiens
tttatgaaggcaaaaaa

SEQ ID NO: 1990254 - DNA, 21 bp, Homo sapiens
tttatgaatgtgcatttcttg

SEQ ID NO: 1990255 - DNA, 22 bp, Homo sapiens
tttatgaatgtgcatttcttga

SEQ ID NO: 1990256 - DNA, 20 bp, Homo sapiens
tttatgccttttatttctta

SEQ ID NO: 1990257 - DNA, 21 bp, Homo sapiens
tttatggcatgatttatatat

SEQ ID NO: 1990258 - DNA, 22 bp, Homo sapiens
tttatggggctgaacggggaga

SEQ ID NO: 1990259 - DNA, 21 bp, Homo sapiens
tttatgtgctctcatcagaaa

SEQ ID NO: 1990260 - DNA, 23 bp, Homo sapiens
tttattaaaatgattgtaaaata

SEQ ID NO: 1990261 - DNA, 20 bp, Homo sapiens
tttattaatgaactgtgaca

SEQ ID NO: 1990262 - DNA, 13 bp, Homo sapiens
tttattacctctg

SEQ ID NO: 1990263 - DNA, 17 bp, Homo sapiens
tttattcaattctgtat

SEQ ID NO: 1990264 - DNA, 15 bp, Homo sapiens
tttattcactgtaag

SEQ ID NO: 1990265 - DNA, 20 bp, Homo sapiens
tttattcatgccatctgttt

SEQ ID NO: 1990266 - DNA, 18 bp, Homo sapiens
tttattcattagctgtga

SEQ ID NO: 1990267 - DNA, 22 bp, Homo sapiens
tttattcctatatagtttattg

SEQ ID NO: 1990268 - DNA, 12 bp, Homo sapiens
tttattctgttt

SEQ ID NO: 1990269 - DNA, 17 bp, Homo sapiens
tttattctgttttcttg

SEQ ID NO: 1990270 - DNA, 18 bp, Homo sapiens
tttattctgttttcttgt

SEQ ID NO: 1990271 - DNA, 17 bp, Homo sapiens
tttattgcttgatactt

SEQ ID NO: 1990272 - DNA, 21 bp, Homo sapiens
tttattgtcattactgccttt

SEQ ID NO: 1990273 - DNA, 22 bp, Homo sapiens
tttattgtttaaaatcatttct

SEQ ID NO: 1990274 - DNA, 22 bp, Homo sapiens
tttatttaacttttagtaaagt

SEQ ID NO: 1990275 - DNA, 17 bp, Homo sapiens
tttatttaatgttatgt

SEQ ID NO: 1990276 - DNA, 15 bp, Homo sapiens
tttatttatcagtga

SEQ ID NO: 1990277 - DNA, 20 bp, Homo sapiens
tttatttgtttgtgcatttg

SEQ ID NO: 1990278 - DNA, 21 bp, Homo sapiens
tttattttaaaacagaagaat

SEQ ID NO: 1990279 - DNA, 15 bp, Homo sapiens
tttatttttcatatt

SEQ ID NO: 1990280 - DNA, 17 bp, Homo sapiens
tttattttttaagtatt

SEQ ID NO: 1990281 - DNA, 23 bp, Homo sapiens
tttcaaaacacatctttcctgtc

SEQ ID NO: 1990282 - DNA, 13 bp, Homo sapiens
tttcaaaagtgat

SEQ ID NO: 1990283 - DNA, 17 bp, Homo sapiens
tttcaaaagtgatctgt

SEQ ID NO: 1990284 - DNA, 17 bp, Homo sapiens
tttcaaaataaactggg

SEQ ID NO: 1990285 - DNA, 20 bp, Homo sapiens
tttcaaactcctgactttgt

SEQ ID NO: 1990286 - DNA, 13 bp, Homo sapiens
tttcaaccagcat

SEQ ID NO: 1990287 - DNA, 14 bp, Homo sapiens
tttcaacttaaatc

SEQ ID NO: 1990288 - DNA, 15 bp, Homo sapiens
tttcaacttaaatca

SEQ ID NO: 1990289 - DNA, 20 bp, Homo sapiens
tttcaacttggaaaaagaaa

SEQ ID NO: 1990290 - DNA, 18 bp, Homo sapiens
tttcaagaaaaaataaat

SEQ ID NO: 1990291 - DNA, 22 bp, Homo sapiens
tttcaagaaaaaataaatggaa

SEQ ID NO: 1990292 - DNA, 15 bp, Homo sapiens
tttcaaggaaagtga

SEQ ID NO: 1990293 - DNA, 14 bp, Homo sapiens
tttcaatgtgattc

SEQ ID NO: 1990294 - DNA, 14 bp, Homo sapiens
tttcaattctcaaa

SEQ ID NO: 1990295 - DNA, 18 bp, Homo sapiens
tttcaattgtattttata

SEQ ID NO: 1990296 - DNA, 22 bp, Homo sapiens
tttcaattgtattttatatgag

SEQ ID NO: 1990297 - DNA, 17 bp, Homo sapiens
tttcaattttgcatgct

SEQ ID NO: 1990298 - DNA, 20 bp, Homo sapiens
tttcacaggtgtggtgtaat

SEQ ID NO: 1990299 - DNA, 23 bp, Homo sapiens
tttcacctgtttttaagctgttt

SEQ ID NO: 1990300 - DNA, 24 bp, Homo sapiens
tttcactcttattgcccacgctgg

SEQ ID NO: 1990301 - DNA, 14 bp, Homo sapiens
tttcactgctggct

SEQ ID NO: 1990302 - DNA, 24 bp, Homo sapiens
tttcactgtgttggccaggctggt

SEQ ID NO: 1990303 - DNA, 20 bp, Homo sapiens
tttcagaaatatgtggtttc

SEQ ID NO: 1990304 - DNA, 21 bp, Homo sapiens
tttcagctattagcaactgtg

SEQ ID NO: 1990305 - DNA, 23 bp, Homo sapiens
tttcagctattagcaactgtgct

SEQ ID NO: 1990306 - DNA, 16 bp, Homo sapiens
tttcaggaccttttga

SEQ ID NO: 1990307 - DNA, 18 bp, Homo sapiens
tttcaggagggtccccag

SEQ ID NO: 1990308 - DNA, 19 bp, Homo sapiens
tttcaggatactctgtcag

SEQ ID NO: 1990309 - DNA, 21 bp, Homo sapiens
tttcaggatactctgtcagat

SEQ ID NO: 1990310 - DNA, 22 bp, Homo sapiens
tttcaggcaggcacctagcaat

SEQ ID NO: 1990311 - DNA, 21 bp, Homo sapiens
tttcagggaaatggagggtgg

SEQ ID NO: 1990312 - DNA, 23 bp, Homo sapiens
tttcagggcgataaaactaaata

SEQ ID NO: 1990313 - DNA, 16 bp, Homo sapiens
tttcaggtctggggct

SEQ ID NO: 1990314 - DNA, 16 bp, Homo sapiens
tttcaggtttcttaaa

SEQ ID NO: 1990315 - DNA, 19 bp, Homo sapiens
tttcaggttttgtaaagat

SEQ ID NO: 1990316 - DNA, 14 bp, Homo sapiens
tttcataaactgag

SEQ ID NO: 1990317 - DNA, 18 bp, Homo sapiens
tttcataaggcctgccct

SEQ ID NO: 1990318 - DNA, 13 bp, Homo sapiens
tttcatataaagt

SEQ ID NO: 1990319 - DNA, 17 bp, Homo sapiens
tttcatccagtttgttc

SEQ ID NO: 1990320 - DNA, 13 bp, Homo sapiens
tttcatcctggcc

SEQ ID NO: 1990321 - DNA, 17 bp, Homo sapiens
tttcatcctggcctcct

SEQ ID NO: 1990322 - DNA, 18 bp, Homo sapiens
tttcatctatttctgaga

SEQ ID NO: 1990323 - DNA, 12 bp, Homo sapiens
tttcatctcatt

SEQ ID NO: 1990324 - DNA, 22 bp, Homo sapiens
tttcatctcatttaagggaaaa

SEQ ID NO: 1990325 - DNA, 18 bp, Homo sapiens
tttcatctgctgctgaaa

SEQ ID NO: 1990326 - DNA, 22 bp, Homo sapiens
tttcatctgctgctgaaactgt

SEQ ID NO: 1990327 - DNA, 15 bp, Homo sapiens
tttcatggaggggaa

SEQ ID NO: 1990328 - DNA, 20 bp, Homo sapiens
tttcatggtgaaaatgtact

SEQ ID NO: 1990329 - DNA, 22 bp, Homo sapiens
tttcattgagggaaaacataat

SEQ ID NO: 1990330 - DNA, 20 bp, Homo sapiens
tttcattgtatgatgtgttg

SEQ ID NO: 1990331 - DNA, 22 bp, Homo sapiens
tttcattttgtaacaaatgaac

SEQ ID NO: 1990332 - DNA, 20 bp, Homo sapiens
tttcattttttgcatcagta

SEQ ID NO: 1990333 - DNA, 16 bp, Homo sapiens
tttccaagagctgagg

SEQ ID NO: 1990334 - DNA, 19 bp, Homo sapiens
tttccacaccatcaccctc

SEQ ID NO: 1990335 - DNA, 14 bp, Homo sapiens
tttccacataaagg

SEQ ID NO: 1990336 - DNA, 18 bp, Homo sapiens
tttccaccatcaaatgct

SEQ ID NO: 1990337 - DNA, 19 bp, Homo sapiens
tttccacctgctttctcct

SEQ ID NO: 1990338 - DNA, 15 bp, Homo sapiens
tttccagaaaatata

SEQ ID NO: 1990339 - DNA, 17 bp, Homo sapiens
tttccagaaaatataaa

SEQ ID NO: 1990340 - DNA, 22 bp, Homo sapiens
tttccagaaaatataaatgcat

SEQ ID NO: 1990341 - DNA, 19 bp, Homo sapiens
tttccagaggctattattt

SEQ ID NO: 1990342 - DNA, 21 bp, Homo sapiens
tttccagattcttccactggc

SEQ ID NO: 1990343 - DNA, 15 bp, Homo sapiens
tttccagtacctttg

SEQ ID NO: 1990344 - DNA, 13 bp, Homo sapiens
tttccatgtatct

SEQ ID NO: 1990345 - DNA, 14 bp, Homo sapiens
tttccatttctcaa

SEQ ID NO: 1990346 - DNA, 20 bp, Homo sapiens
tttcccaccagcatgtcact

SEQ ID NO: 1990347 - DNA, 12 bp, Homo sapiens
tttcccagaagg

SEQ ID NO: 1990348 - DNA, 13 bp, Homo sapiens
tttcccatgctga

SEQ ID NO: 1990349 - DNA, 14 bp, Homo sapiens
tttccccaaagtct

SEQ ID NO: 1990350 - DNA, 21 bp, Homo sapiens
tttccccaaagtcttaaaata

SEQ ID NO: 1990351 - DNA, 17 bp, Homo sapiens
tttccccacctcttcct

SEQ ID NO: 1990352 - DNA, 19 bp, Homo sapiens
tttccccaggggaaaatga

SEQ ID NO: 1990353 - DNA, 20 bp, Homo sapiens
tttcccctctgtgtcctctc

SEQ ID NO: 1990354 - DNA, 16 bp, Homo sapiens
tttcccctgaagactt

SEQ ID NO: 1990355 - DNA, 23 bp, Homo sapiens
tttcccgccaggaggtcctcctc

SEQ ID NO: 1990356 - DNA, 15 bp, Homo sapiens
tttccctcctgggag

SEQ ID NO: 1990357 - DNA, 13 bp, Homo sapiens
tttccctctcttg

SEQ ID NO: 1990358 - DNA, 14 bp, Homo sapiens
tttccctgactcct

SEQ ID NO: 1990359 - DNA, 12 bp, Homo sapiens
tttccctgtgct

SEQ ID NO: 1990360 - DNA, 23 bp, Homo sapiens
tttccctttgaggttgctttgtt

SEQ ID NO: 1990361 - DNA, 23 bp, Homo sapiens
tttccgtgaagggcaccgagaac

SEQ ID NO: 1990362 - DNA, 21 bp, Homo sapiens
tttcctaaaaataagctttat

SEQ ID NO: 1990363 - DNA, 15 bp, Homo sapiens
tttcctaaatgcagt

SEQ ID NO: 1990364 - DNA, 14 bp, Homo sapiens
tttcctaaatgttt

SEQ ID NO: 1990365 - DNA, 16 bp, Homo sapiens
tttcctacagaaatac

SEQ ID NO: 1990366 - DNA, 17 bp, Homo sapiens
tttcctacagaaatact

SEQ ID NO: 1990367 - DNA, 13 bp, Homo sapiens
tttcctattttaa

SEQ ID NO: 1990368 - DNA, 15 bp, Homo sapiens
tttcctattttaaaa

SEQ ID NO: 1990369 - DNA, 19 bp, Homo sapiens
tttcctattttaaaaccat

SEQ ID NO: 1990370 - DNA, 16 bp, Homo sapiens
tttcctccagacagat

SEQ ID NO: 1990371 - DNA, 17 bp, Homo sapiens
tttcctccccaccttcc

SEQ ID NO: 1990372 - DNA, 18 bp, Homo sapiens
tttcctcgcctaggcctg

SEQ ID NO: 1990373 - DNA, 22 bp, Homo sapiens
tttcctctccaattgtaaaaaa

SEQ ID NO: 1990374 - DNA, 22 bp, Homo sapiens
tttcctcttctattttgtaaac

SEQ ID NO: 1990375 - DNA, 12 bp, Homo sapiens
tttcctgtgtct

SEQ ID NO: 1990376 - DNA, 18 bp, Homo sapiens
tttccttcaaagtttaat

SEQ ID NO: 1990377 - DNA, 19 bp, Homo sapiens
tttccttgtctctcattct

SEQ ID NO: 1990378 - DNA, 23 bp, Homo sapiens
tttcctttgtcatcattgtatat

SEQ ID NO: 1990379 - DNA, 21 bp, Homo sapiens
tttccttttaaaacacttcca

SEQ ID NO: 1990380 - DNA, 20 bp, Homo sapiens
tttcgacgcttaacctttcc

SEQ ID NO: 1990381 - DNA, 19 bp, Homo sapiens
tttcgccgttgaagaggaa

SEQ ID NO: 1990382 - DNA, 14 bp, Homo sapiens
tttcggtgggacag

SEQ ID NO: 1990383 - DNA, 16 bp, Homo sapiens
tttcgtgcatttgtga

SEQ ID NO: 1990384 - DNA, 12 bp, Homo sapiens
tttctaaaagaa

SEQ ID NO: 1990385 - DNA, 14 bp, Homo sapiens
tttctaaagttgtt

SEQ ID NO: 1990386 - DNA, 23 bp, Homo sapiens
tttctaactgtaaatcacttgta

SEQ ID NO: 1990387 - DNA, 21 bp, Homo sapiens
tttctaggtaggaaatgtggt

SEQ ID NO: 1990388 - DNA, 13 bp, Homo sapiens
tttctagttgaaa

SEQ ID NO: 1990389 - DNA, 22 bp, Homo sapiens
tttctcaacaaagcacagtgtt

SEQ ID NO: 1990390 - DNA, 23 bp, Homo sapiens
tttctccatattagatttaccca

SEQ ID NO: 1990391 - DNA, 15 bp, Homo sapiens
tttctccccctgggc

SEQ ID NO: 1990392 - DNA, 18 bp, Homo sapiens
tttctcctactttacact

SEQ ID NO: 1990393 - DNA, 23 bp, Homo sapiens
tttctcgggtgcatttgagagaa

SEQ ID NO: 1990394 - DNA, 17 bp, Homo sapiens
tttctctggctccagaa

SEQ ID NO: 1990395 - DNA, 17 bp, Homo sapiens
tttctctgtatagtact

SEQ ID NO: 1990396 - DNA, 12 bp, Homo sapiens
tttctcttccct

SEQ ID NO: 1990397 - DNA, 15 bp, Homo sapiens
tttctgaagctttac

SEQ ID NO: 1990398 - DNA, 13 bp, Homo sapiens
tttctgagaaaga

SEQ ID NO: 1990399 - DNA, 16 bp, Homo sapiens
tttctgagcttttcat

SEQ ID NO: 1990400 - DNA, 18 bp, Homo sapiens
tttctggaatgtaatcaa

SEQ ID NO: 1990401 - DNA, 23 bp, Homo sapiens
tttctggtgcctatttattcatt

SEQ ID NO: 1990402 - DNA, 23 bp, Homo sapiens
tttctgtccttttggcactgaga

SEQ ID NO: 1990403 - DNA, 22 bp, Homo sapiens
tttctgtggagagtgagaataa

SEQ ID NO: 1990404 - DNA, 11 bp, Homo sapiens
tttctgtgtgc

SEQ ID NO: 1990405 - DNA, 15 bp, Homo sapiens
tttctgttctgttga

SEQ ID NO: 1990406 - DNA, 15 bp, Homo sapiens
tttctgttggtgtat

SEQ ID NO: 1990407 - DNA, 12 bp, Homo sapiens
tttcttaaataa

SEQ ID NO: 1990408 - DNA, 21 bp, Homo sapiens
tttcttaaataagaaactttt

SEQ ID NO: 1990409 - DNA, 18 bp, Homo sapiens
tttcttagtcgaatgtta

SEQ ID NO: 1990410 - DNA, 13 bp, Homo sapiens
tttcttatgattt

SEQ ID NO: 1990411 - DNA, 23 bp, Homo sapiens
tttcttatgatttttaaaagttg

SEQ ID NO: 1990412 - DNA, 17 bp, Homo sapiens
tttcttatttcatttct

SEQ ID NO: 1990413 - DNA, 17 bp, Homo sapiens
tttcttattttgtaata

SEQ ID NO: 1990414 - DNA, 18 bp, Homo sapiens
tttcttcaccaaatcttg

SEQ ID NO: 1990415 - DNA, 16 bp, Homo sapiens
tttcttcatgcaatga

SEQ ID NO: 1990416 - DNA, 15 bp, Homo sapiens
tttcttcccatttgt

SEQ ID NO: 1990417 - DNA, 22 bp, Homo sapiens
tttcttcccatttgtaatgtat

SEQ ID NO: 1990418 - DNA, 13 bp, Homo sapiens
tttcttcctctgc

SEQ ID NO: 1990419 - DNA, 22 bp, Homo sapiens
tttcttccttctttctcttccc

SEQ ID NO: 1990420 - DNA, 23 bp, Homo sapiens
tttcttgccaatgaggtctgaaa

SEQ ID NO: 1990421 - DNA, 12 bp, Homo sapiens
tttcttgcctca

SEQ ID NO: 1990422 - DNA, 18 bp, Homo sapiens
tttcttggtctcagcttc

SEQ ID NO: 1990423 - DNA, 15 bp, Homo sapiens
tttctttgtaaaggt

SEQ ID NO: 1990424 - DNA, 17 bp, Homo sapiens
tttctttgtgataacaa

SEQ ID NO: 1990425 - DNA, 15 bp, Homo sapiens
tttctttgtgtagct

SEQ ID NO: 1990426 - DNA, 15 bp, Homo sapiens
tttctttttctggaa

SEQ ID NO: 1990427 - DNA, 17 bp, Homo sapiens
tttctttttctggaaat

SEQ ID NO: 1990428 - DNA, 13 bp, Homo sapiens
tttctttttctgt

SEQ ID NO: 1990429 - DNA, 18 bp, Homo sapiens
tttctttttctgtctctc

SEQ ID NO: 1990430 - DNA, 15 bp, Homo sapiens
tttctttttgtaatt

SEQ ID NO: 1990431 - DNA, 23 bp, Homo sapiens
tttgaaaaagcgaaaaaatcagg

SEQ ID NO: 1990432 - DNA, 21 bp, Homo sapiens
tttgaaagtgaataaacttca

SEQ ID NO: 1990433 - DNA, 22 bp, Homo sapiens
tttgaacaactaggcttcagca

SEQ ID NO: 1990434 - DNA, 17 bp, Homo sapiens
tttgaagttagctttaa

SEQ ID NO: 1990435 - DNA, 21 bp, Homo sapiens
tttgaataaaaaacatttgta

SEQ ID NO: 1990436 - DNA, 16 bp, Homo sapiens
tttgaatacccccaga

SEQ ID NO: 1990437 - DNA, 19 bp, Homo sapiens
tttgacagtgttgaaaatg

SEQ ID NO: 1990438 - DNA, 18 bp, Homo sapiens
tttgacgggaggcctcag

SEQ ID NO: 1990439 - DNA, 12 bp, Homo sapiens
tttgactctttt

SEQ ID NO: 1990440 - DNA, 14 bp, Homo sapiens
tttgagaattattc

SEQ ID NO: 1990441 - DNA, 18 bp, Homo sapiens
tttgagacaagccctggc

SEQ ID NO: 1990442 - DNA, 19 bp, Homo sapiens
tttgagacaagccctggca

SEQ ID NO: 1990443 - DNA, 18 bp, Homo sapiens
tttgagagaagccacgct

SEQ ID NO: 1990444 - DNA, 18 bp, Homo sapiens
tttgagcaattcatttca

SEQ ID NO: 1990445 - DNA, 13 bp, Homo sapiens
tttgagcatgcac

SEQ ID NO: 1990446 - DNA, 19 bp, Homo sapiens
tttgagcgcagagtaaaat

SEQ ID NO: 1990447 - DNA, 21 bp, Homo sapiens
tttgagcgcagagtaaaataa

SEQ ID NO: 1990448 - DNA, 22 bp, Homo sapiens
tttgaggagcagcttcagttgt

SEQ ID NO: 1990449 - DNA, 19 bp, Homo sapiens
tttgagtcaaaagcctggg

SEQ ID NO: 1990450 - DNA, 22 bp, Homo sapiens
tttgataaattatgtttgtact

SEQ ID NO: 1990451 - DNA, 16 bp, Homo sapiens
tttgatactaagcatt

SEQ ID NO: 1990452 - DNA, 17 bp, Homo sapiens
tttgatactaagcattg

SEQ ID NO: 1990453 - DNA, 21 bp, Homo sapiens
tttgatactaagcattgaatg

SEQ ID NO: 1990454 - DNA, 18 bp, Homo sapiens
tttgatagtattgtgcat

SEQ ID NO: 1990455 - DNA, 18 bp, Homo sapiens
tttgatatgagtatacaa

SEQ ID NO: 1990456 - DNA, 19 bp, Homo sapiens
tttgatatgagtatacaat

SEQ ID NO: 1990457 - DNA, 19 bp, Homo sapiens
tttgatattaaaggagtta

SEQ ID NO: 1990458 - DNA, 14 bp, Homo sapiens
tttgatccaagctg

SEQ ID NO: 1990459 - DNA, 16 bp, Homo sapiens
tttgatgccaagaaag

SEQ ID NO: 1990460 - DNA, 12 bp, Homo sapiens
tttgatttatgc

SEQ ID NO: 1990461 - DNA, 12 bp, Homo sapiens
tttgcaaaattt

SEQ ID NO: 1990462 - DNA, 18 bp, Homo sapiens
tttgcaataaaaggtatt

SEQ ID NO: 1990463 - DNA, 18 bp, Homo sapiens
tttgcaattattctaatt

SEQ ID NO: 1990464 - DNA, 12 bp, Homo sapiens
tttgcacatgtg

SEQ ID NO: 1990465 - DNA, 16 bp, Homo sapiens
tttgcacctttctagt

SEQ ID NO: 1990466 - DNA, 17 bp, Homo sapiens
tttgcacctttctagtt

SEQ ID NO: 1990467 - DNA, 16 bp, Homo sapiens
tttgcactgagggcca

SEQ ID NO: 1990468 - DNA, 13 bp, Homo sapiens
tttgcactgtttt

SEQ ID NO: 1990469 - DNA, 12 bp, Homo sapiens
tttgcagagcct

SEQ ID NO: 1990470 - DNA, 21 bp, Homo sapiens
tttgcagcagtgagtctcttc

SEQ ID NO: 1990471 - DNA, 17 bp, Homo sapiens
tttgcaggctctgggct

SEQ ID NO: 1990472 - DNA, 21 bp, Homo sapiens
tttgcaggctctgggctcagg

SEQ ID NO: 1990473 - DNA, 17 bp, Homo sapiens
tttgcagttgagagggg

SEQ ID NO: 1990474 - DNA, 21 bp, Homo sapiens
tttgcatagattccctgagca

SEQ ID NO: 1990475 - DNA, 18 bp, Homo sapiens
tttgccaccactagagct

SEQ ID NO: 1990476 - DNA, 19 bp, Homo sapiens
tttgccaccactagagctg

SEQ ID NO: 1990477 - DNA, 18 bp, Homo sapiens
tttgccactttggcttct

SEQ ID NO: 1990478 - DNA, 16 bp, Homo sapiens
tttgccagacttaaat

SEQ ID NO: 1990479 - DNA, 19 bp, Homo sapiens
tttgcctaggaggccttct

SEQ ID NO: 1990480 - DNA, 20 bp, Homo sapiens
tttgcctaggaggccttctc

SEQ ID NO: 1990481 - DNA, 14 bp, Homo sapiens
tttgcctcaaataa

SEQ ID NO: 1990482 - DNA, 11 bp, Homo sapiens
tttgcctggct

SEQ ID NO: 1990483 - DNA, 12 bp, Homo sapiens
tttgcctggctg

SEQ ID NO: 1990484 - DNA, 13 bp, Homo sapiens
tttgcctggctgt

SEQ ID NO: 1990485 - DNA, 23 bp, Homo sapiens
tttgcctggctgtggaggcctga

SEQ ID NO: 1990486 - DNA, 12 bp, Homo sapiens
tttgcctgtaac

SEQ ID NO: 1990487 - DNA, 19 bp, Homo sapiens
tttgcctgtgtgagcatct

SEQ ID NO: 1990488 - DNA, 19 bp, Homo sapiens
tttgccttttgcaaacttt

SEQ ID NO: 1990489 - DNA, 15 bp, Homo sapiens
tttgctacaataaat

SEQ ID NO: 1990490 - DNA, 22 bp, Homo sapiens
tttgctacaataaatgctgaat

SEQ ID NO: 1990491 - DNA, 23 bp, Homo sapiens
tttgctattgacaagtcatttta

SEQ ID NO: 1990492 - DNA, 23 bp, Homo sapiens
tttgctcacacggggtattttag

SEQ ID NO: 1990493 - DNA, 12 bp, Homo sapiens
tttgctgctgct

SEQ ID NO: 1990494 - DNA, 13 bp, Homo sapiens
tttgctgtctttc

SEQ ID NO: 1990495 - DNA, 18 bp, Homo sapiens
tttgcttatttatattca

SEQ ID NO: 1990496 - DNA, 22 bp, Homo sapiens
tttgcttttcctttgtttttat

SEQ ID NO: 1990497 - DNA, 23 bp, Homo sapiens
tttggaagagaggcacctgctgg

SEQ ID NO: 1990498 - DNA, 13 bp, Homo sapiens
tttggacaaaatg

SEQ ID NO: 1990499 - DNA, 15 bp, Homo sapiens
tttggacaaaatgga

SEQ ID NO: 1990500 - DNA, 22 bp, Homo sapiens
tttggagaaattatttaataaa

SEQ ID NO: 1990501 - DNA, 15 bp, Homo sapiens
tttggataatatcca

SEQ ID NO: 1990502 - DNA, 19 bp, Homo sapiens
tttggatatgtaaaacatt

SEQ ID NO: 1990503 - DNA, 20 bp, Homo sapiens
tttggatctccaattgcctc

SEQ ID NO: 1990504 - DNA, 21 bp, Homo sapiens
tttggatgggagtgagacaga

SEQ ID NO: 1990505 - DNA, 20 bp, Homo sapiens
tttggatttacgactgaaga

SEQ ID NO: 1990506 - DNA, 19 bp, Homo sapiens
tttggcatgcttaaatatt

SEQ ID NO: 1990507 - DNA, 13 bp, Homo sapiens
tttggcatttctc

SEQ ID NO: 1990508 - DNA, 23 bp, Homo sapiens
tttggctctcctcagaagaaaga

SEQ ID NO: 1990509 - DNA, 14 bp, Homo sapiens
tttggctctttcag

SEQ ID NO: 1990510 - DNA, 17 bp, Homo sapiens
tttggcttctcctgtga

SEQ ID NO: 1990511 - DNA, 18 bp, Homo sapiens
tttggcttctcctgtgac

SEQ ID NO: 1990512 - DNA, 12 bp, Homo sapiens
tttgggaagggg

SEQ ID NO: 1990513 - DNA, 22 bp, Homo sapiens
tttgggggttggatgggaagat

SEQ ID NO: 1990514 - DNA, 22 bp, Homo sapiens
tttggggtacccactgctctgg

SEQ ID NO: 1990515 - DNA, 17 bp, Homo sapiens
tttgggttgtgacccag

SEQ ID NO: 1990516 - DNA, 19 bp, Homo sapiens
tttggtgtaggtaaatcta

SEQ ID NO: 1990517 - DNA, 19 bp, Homo sapiens
tttggtttcccaagagcta

SEQ ID NO: 1990518 - DNA, 22 bp, Homo sapiens
tttgtaaactcaaaatatttgt

SEQ ID NO: 1990519 - DNA, 17 bp, Homo sapiens
tttgtaaactgtatcaa

SEQ ID NO: 1990520 - DNA, 13 bp, Homo sapiens
tttgtaaaggtca

SEQ ID NO: 1990521 - DNA, 22 bp, Homo sapiens
tttgtaaattctggaaatgtct

SEQ ID NO: 1990522 - DNA, 13 bp, Homo sapiens
tttgtaacttcaa

SEQ ID NO: 1990523 - DNA, 20 bp, Homo sapiens
tttgtaagttgaagcaaatc

SEQ ID NO: 1990524 - DNA, 21 bp, Homo sapiens
tttgtaagtttatgtctaaag

SEQ ID NO: 1990525 - DNA, 12 bp, Homo sapiens
tttgtaataaac

SEQ ID NO: 1990526 - DNA, 21 bp, Homo sapiens
tttgtaataaaggtctttgca

SEQ ID NO: 1990527 - DNA, 18 bp, Homo sapiens
tttgtaattgcttacatt

SEQ ID NO: 1990528 - DNA, 20 bp, Homo sapiens
tttgtaattgcttacatttt

SEQ ID NO: 1990529 - DNA, 14 bp, Homo sapiens
tttgtacaaatact

SEQ ID NO: 1990530 - DNA, 12 bp, Homo sapiens
tttgtacagaat

SEQ ID NO: 1990531 - DNA, 13 bp, Homo sapiens
tttgtacagaatt

SEQ ID NO: 1990532 - DNA, 23 bp, Homo sapiens
tttgtacagaatttttaatgact

SEQ ID NO: 1990533 - DNA, 19 bp, Homo sapiens
tttgtacagacgtatgctt

SEQ ID NO: 1990534 - DNA, 22 bp, Homo sapiens
tttgtacagacgtatgcttatt

SEQ ID NO: 1990535 - DNA, 18 bp, Homo sapiens
tttgtacagtggagaaat

SEQ ID NO: 1990536 - DNA, 17 bp, Homo sapiens
tttgtaccatggtgtga

SEQ ID NO: 1990537 - DNA, 15 bp, Homo sapiens
tttgtacctatgtga

SEQ ID NO: 1990538 - DNA, 16 bp, Homo sapiens
tttgtatagtaaagtg

SEQ ID NO: 1990539 - DNA, 14 bp, Homo sapiens
tttgtatatcatga

SEQ ID NO: 1990540 - DNA, 20 bp, Homo sapiens
tttgtatctctgaagcatgt

SEQ ID NO: 1990541 - DNA, 16 bp, Homo sapiens
tttgtatgcactttgt

SEQ ID NO: 1990542 - DNA, 13 bp, Homo sapiens
tttgtatttatat

SEQ ID NO: 1990543 - DNA, 18 bp, Homo sapiens
tttgtatttttgaataaa

SEQ ID NO: 1990544 - DNA, 14 bp, Homo sapiens
tttgtcatatattc

SEQ ID NO: 1990545 - DNA, 22 bp, Homo sapiens
tttgtcatatattcatgtaata

SEQ ID NO: 1990546 - DNA, 12 bp, Homo sapiens
tttgtcatttta

SEQ ID NO: 1990547 - DNA, 12 bp, Homo sapiens
tttgtcccaggt

SEQ ID NO: 1990548 - DNA, 16 bp, Homo sapiens
tttgtccccagggccc

SEQ ID NO: 1990549 - DNA, 14 bp, Homo sapiens
tttgtgactatata

SEQ ID NO: 1990550 - DNA, 22 bp, Homo sapiens
tttgtgactatatagagatgtt

SEQ ID NO: 1990551 - DNA, 23 bp, Homo sapiens
tttgtgactatatagagatgttt

SEQ ID NO: 1990552 - DNA, 14 bp, Homo sapiens
tttgtgagaagaaa

SEQ ID NO: 1990553 - DNA, 22 bp, Homo sapiens
tttgtgagcatgggtgtgccct

SEQ ID NO: 1990554 - DNA, 17 bp, Homo sapiens
tttgtgatttagaactg

SEQ ID NO: 1990555 - DNA, 13 bp, Homo sapiens
tttgtgccagccg

SEQ ID NO: 1990556 - DNA, 16 bp, Homo sapiens
tttgtggaggactttg

SEQ ID NO: 1990557 - DNA, 16 bp, Homo sapiens
tttgtggaggtgagaa

SEQ ID NO: 1990558 - DNA, 19 bp, Homo sapiens
tttgtggtaaaaagattat

SEQ ID NO: 1990559 - DNA, 14 bp, Homo sapiens
tttgtggtcacagc

SEQ ID NO: 1990560 - DNA, 22 bp, Homo sapiens
tttgtgtcaatgggcaatgaca

SEQ ID NO: 1990561 - DNA, 12 bp, Homo sapiens
tttgttaattta

SEQ ID NO: 1990562 - DNA, 21 bp, Homo sapiens
tttgttaatttagaaaacttt

SEQ ID NO: 1990563 - DNA, 23 bp, Homo sapiens
tttgttaatttagaaaactttaa

SEQ ID NO: 1990564 - DNA, 19 bp, Homo sapiens
tttgttatagaatactttt

SEQ ID NO: 1990565 - DNA, 17 bp, Homo sapiens
tttgttatttgtacagt

SEQ ID NO: 1990566 - DNA, 20 bp, Homo sapiens
tttgttattttcagtatttt

SEQ ID NO: 1990567 - DNA, 20 bp, Homo sapiens
tttgttcatgagtggatgga

SEQ ID NO: 1990568 - DNA, 15 bp, Homo sapiens
tttgttcccaagagc

SEQ ID NO: 1990569 - DNA, 23 bp, Homo sapiens
tttgttggaaggtttggtgtgtg

SEQ ID NO: 1990570 - DNA, 22 bp, Homo sapiens
tttgttgtactttttattcaat

SEQ ID NO: 1990571 - DNA, 13 bp, Homo sapiens
tttgttgtgactt

SEQ ID NO: 1990572 - DNA, 22 bp, Homo sapiens
tttgttgtgattttgtacagaa

SEQ ID NO: 1990573 - DNA, 17 bp, Homo sapiens
tttgtttctgagaaaag

SEQ ID NO: 1990574 - DNA, 12 bp, Homo sapiens
tttgttttaatt

SEQ ID NO: 1990575 - DNA, 14 bp, Homo sapiens
ttttaaaaaagctt

SEQ ID NO: 1990576 - DNA, 15 bp, Homo sapiens
ttttaaaaaagctta

SEQ ID NO: 1990577 - DNA, 20 bp, Homo sapiens
ttttaaaaaagcttaaaact

SEQ ID NO: 1990578 - DNA, 21 bp, Homo sapiens
ttttaaaaaagcttaaaactt

SEQ ID NO: 1990579 - DNA, 23 bp, Homo sapiens
ttttaaaaaagcttaaaactttg

SEQ ID NO: 1990580 - DNA, 13 bp, Homo sapiens
ttttaaaaaatga

SEQ ID NO: 1990581 - DNA, 23 bp, Homo sapiens
ttttaaaaatcataaactgtgtg

SEQ ID NO: 1990582 - DNA, 22 bp, Homo sapiens
ttttaaaacacttccataatct

SEQ ID NO: 1990583 - DNA, 12 bp, Homo sapiens
ttttaaaaccat

SEQ ID NO: 1990584 - DNA, 13 bp, Homo sapiens
ttttaaaagaaaa

SEQ ID NO: 1990585 - DNA, 22 bp, Homo sapiens
ttttaaaagttactccttttag

SEQ ID NO: 1990586 - DNA, 19 bp, Homo sapiens
ttttaaaagtttcaatgtg

SEQ ID NO: 1990587 - DNA, 22 bp, Homo sapiens
ttttaaaatctgatttaatgtt

SEQ ID NO: 1990588 - DNA, 16 bp, Homo sapiens
ttttaaacaaaataga

SEQ ID NO: 1990589 - DNA, 17 bp, Homo sapiens
ttttaaagaagtaaatt

SEQ ID NO: 1990590 - DNA, 21 bp, Homo sapiens
ttttaaagaagtaaatttgtc

SEQ ID NO: 1990591 - DNA, 12 bp, Homo sapiens
ttttaaagaatt

SEQ ID NO: 1990592 - DNA, 13 bp, Homo sapiens
ttttaaagaattg

SEQ ID NO: 1990593 - DNA, 18 bp, Homo sapiens
ttttaaatatgaacaaag

SEQ ID NO: 1990594 - DNA, 21 bp, Homo sapiens
ttttaaatgaaaatgtaactt

SEQ ID NO: 1990595 - DNA, 12 bp, Homo sapiens
ttttaaatgttt

SEQ ID NO: 1990596 - DNA, 20 bp, Homo sapiens
ttttaaattatactgtagct

SEQ ID NO: 1990597 - DNA, 16 bp, Homo sapiens
ttttaacaaaagcaag

SEQ ID NO: 1990598 - DNA, 20 bp, Homo sapiens
ttttaacaaaagcaagactg

SEQ ID NO: 1990599 - DNA, 20 bp, Homo sapiens
ttttaacacataactagaaa

SEQ ID NO: 1990600 - DNA, 17 bp, Homo sapiens
ttttaagcttgaagatt

SEQ ID NO: 1990601 - DNA, 19 bp, Homo sapiens
ttttaagtatttatatatt

SEQ ID NO: 1990602 - DNA, 14 bp, Homo sapiens
ttttaagttgctga

SEQ ID NO: 1990603 - DNA, 21 bp, Homo sapiens
ttttaatagaatataattatc

SEQ ID NO: 1990604 - DNA, 16 bp, Homo sapiens
ttttaatctttgtgac

SEQ ID NO: 1990605 - DNA, 20 bp, Homo sapiens
ttttaatgtacaagttttgt

SEQ ID NO: 1990606 - DNA, 13 bp, Homo sapiens
ttttaattaaata

SEQ ID NO: 1990607 - DNA, 16 bp, Homo sapiens
ttttaattattattct

SEQ ID NO: 1990608 - DNA, 20 bp, Homo sapiens
ttttaattattatttatata

SEQ ID NO: 1990609 - DNA, 22 bp, Homo sapiens
ttttaattccaatatgatgact

SEQ ID NO: 1990610 - DNA, 13 bp, Homo sapiens
ttttaatttgata

SEQ ID NO: 1990611 - DNA, 21 bp, Homo sapiens
ttttacaaataaagatggcta

SEQ ID NO: 1990612 - DNA, 16 bp, Homo sapiens
ttttacattctgtctg

SEQ ID NO: 1990613 - DNA, 17 bp, Homo sapiens
ttttacccctgcacagt

SEQ ID NO: 1990614 - DNA, 19 bp, Homo sapiens
ttttacctaccacagtgtc

SEQ ID NO: 1990615 - DNA, 17 bp, Homo sapiens
ttttactaaagcagtgt

SEQ ID NO: 1990616 - DNA, 14 bp, Homo sapiens
ttttactactgtgg

SEQ ID NO: 1990617 - DNA, 15 bp, Homo sapiens
ttttactacttgtta

SEQ ID NO: 1990618 - DNA, 13 bp, Homo sapiens
ttttactgtgcat

SEQ ID NO: 1990619 - DNA, 22 bp, Homo sapiens
ttttacttgcattgaatatatt

SEQ ID NO: 1990620 - DNA, 21 bp, Homo sapiens
ttttacttggtgtaattaata

SEQ ID NO: 1990621 - DNA, 20 bp, Homo sapiens
ttttagaattttagaagaga

SEQ ID NO: 1990622 - DNA, 21 bp, Homo sapiens
ttttagagattaatttgtgta

SEQ ID NO: 1990623 - DNA, 18 bp, Homo sapiens
ttttagatactttgctag

SEQ ID NO: 1990624 - DNA, 20 bp, Homo sapiens
ttttagatgagattgtttta

SEQ ID NO: 1990625 - DNA, 18 bp, Homo sapiens
ttttaggcagggatttga

SEQ ID NO: 1990626 - DNA, 15 bp, Homo sapiens
ttttagtagagacag

SEQ ID NO: 1990627 - DNA, 21 bp, Homo sapiens
ttttagtcttttactcctttg

SEQ ID NO: 1990628 - DNA, 17 bp, Homo sapiens
ttttagttcctttattt

SEQ ID NO: 1990629 - DNA, 22 bp, Homo sapiens
ttttataatgtggatttcctat

SEQ ID NO: 1990630 - DNA, 12 bp, Homo sapiens
ttttatacatat

SEQ ID NO: 1990631 - DNA, 17 bp, Homo sapiens
ttttatacatatcagaa

SEQ ID NO: 1990632 - DNA, 19 bp, Homo sapiens
ttttatacatatcagaaaa

SEQ ID NO: 1990633 - DNA, 10 bp, Homo sapiens
ttttatacca

SEQ ID NO: 1990634 - DNA, 23 bp, Homo sapiens
ttttatatttagttatagtttca

SEQ ID NO: 1990635 - DNA, 23 bp, Homo sapiens
ttttatgaagaaaaaatacattt

SEQ ID NO: 1990636 - DNA, 12 bp, Homo sapiens
ttttatgactgt

SEQ ID NO: 1990637 - DNA, 19 bp, Homo sapiens
ttttatgatttaaaaaata

SEQ ID NO: 1990638 - DNA, 15 bp, Homo sapiens
ttttatggcatgatt

SEQ ID NO: 1990639 - DNA, 18 bp, Homo sapiens
ttttatggcatgatttat

SEQ ID NO: 1990640 - DNA, 18 bp, Homo sapiens
ttttatgtgcctttttgt

SEQ ID NO: 1990641 - DNA, 14 bp, Homo sapiens
ttttattaaatctt

SEQ ID NO: 1990642 - DNA, 18 bp, Homo sapiens
ttttattctgttttcttg

SEQ ID NO: 1990643 - DNA, 14 bp, Homo sapiens
ttttattgttttca

SEQ ID NO: 1990644 - DNA, 13 bp, Homo sapiens
ttttatttaaaaa

SEQ ID NO: 1990645 - DNA, 21 bp, Homo sapiens
ttttatttctcgggtgcattt

SEQ ID NO: 1990646 - DNA, 18 bp, Homo sapiens
ttttatttttagacagag

SEQ ID NO: 1990647 - DNA, 22 bp, Homo sapiens
ttttatttttgaacccctgtgt

SEQ ID NO: 1990648 - DNA, 18 bp, Homo sapiens
ttttcaaaaattgtgttt

SEQ ID NO: 1990649 - DNA, 14 bp, Homo sapiens
ttttcaaaatggag

SEQ ID NO: 1990650 - DNA, 17 bp, Homo sapiens
ttttcaacgcagccctg

SEQ ID NO: 1990651 - DNA, 21 bp, Homo sapiens
ttttcaacgcagccctgcttt

SEQ ID NO: 1990652 - DNA, 14 bp, Homo sapiens
ttttcaactggctg

SEQ ID NO: 1990653 - DNA, 21 bp, Homo sapiens
ttttcaagagaagaaaaaatt

SEQ ID NO: 1990654 - DNA, 16 bp, Homo sapiens
ttttcaatatttatta

SEQ ID NO: 1990655 - DNA, 14 bp, Homo sapiens
ttttcaattttgca

SEQ ID NO: 1990656 - DNA, 19 bp, Homo sapiens
ttttcaccagatttgctaa

SEQ ID NO: 1990657 - DNA, 21 bp, Homo sapiens
ttttcactggagttacattaa

SEQ ID NO: 1990658 - DNA, 24 bp, Homo sapiens
ttttcagaattgaaggagaaaatg

SEQ ID NO: 1990659 - DNA, 16 bp, Homo sapiens
ttttcagactcagact

SEQ ID NO: 1990660 - DNA, 21 bp, Homo sapiens
ttttcagattccacacaaaat

SEQ ID NO: 1990661 - DNA, 19 bp, Homo sapiens
ttttcagcccatatttcat

SEQ ID NO: 1990662 - DNA, 17 bp, Homo sapiens
ttttcagctctctgtat

SEQ ID NO: 1990663 - DNA, 20 bp, Homo sapiens
ttttcagtttcaattcagtg

SEQ ID NO: 1990664 - DNA, 16 bp, Homo sapiens
ttttcatattgtgcca

SEQ ID NO: 1990665 - DNA, 19 bp, Homo sapiens
ttttcatcaatttaaaatc

SEQ ID NO: 1990666 - DNA, 14 bp, Homo sapiens
ttttcatcctggcc

SEQ ID NO: 1990667 - DNA, 18 bp, Homo sapiens
ttttcatcctggcctcct

SEQ ID NO: 1990668 - DNA, 16 bp, Homo sapiens
ttttcattacaatgga

SEQ ID NO: 1990669 - DNA, 18 bp, Homo sapiens
ttttcattgaacagcaaa

SEQ ID NO: 1990670 - DNA, 18 bp, Homo sapiens
ttttcatttaactacaaa

SEQ ID NO: 1990671 - DNA, 13 bp, Homo sapiens
ttttccaagccct

SEQ ID NO: 1990672 - DNA, 18 bp, Homo sapiens
ttttccactgtgctatta

SEQ ID NO: 1990673 - DNA, 16 bp, Homo sapiens
ttttcccagtaatttg

SEQ ID NO: 1990674 - DNA, 23 bp, Homo sapiens
ttttccccggtcccttgagacct

SEQ ID NO: 1990675 - DNA, 17 bp, Homo sapiens
ttttccctctcttgcct

SEQ ID NO: 1990676 - DNA, 14 bp, Homo sapiens
ttttcctaaaaata

SEQ ID NO: 1990677 - DNA, 17 bp, Homo sapiens
ttttcctagccctctca

SEQ ID NO: 1990678 - DNA, 13 bp, Homo sapiens
ttttcctatttgt

SEQ ID NO: 1990679 - DNA, 18 bp, Homo sapiens
ttttcctcttctattttg

SEQ ID NO: 1990680 - DNA, 23 bp, Homo sapiens
ttttcgaacattctttgcctggt

SEQ ID NO: 1990681 - DNA, 20 bp, Homo sapiens
ttttcgcttgcttctgcagc

SEQ ID NO: 1990682 - DNA, 15 bp, Homo sapiens
ttttcgtgcatttgt

SEQ ID NO: 1990683 - DNA, 16 bp, Homo sapiens
ttttcgtgcatttgtg

SEQ ID NO: 1990684 - DNA, 12 bp, Homo sapiens
ttttctaactgg

SEQ ID NO: 1990685 - DNA, 15 bp, Homo sapiens
ttttctaactgtaaa

SEQ ID NO: 1990686 - DNA, 19 bp, Homo sapiens
ttttctaactgtaaatcac

SEQ ID NO: 1990687 - DNA, 21 bp, Homo sapiens
ttttctaactgtaaatcactt

SEQ ID NO: 1990688 - DNA, 22 bp, Homo sapiens
ttttctaactgtaaatcacttg

SEQ ID NO: 1990689 - DNA, 23 bp, Homo sapiens
ttttctaactgtaaatcacttgt

SEQ ID NO: 1990690 - DNA, 13 bp, Homo sapiens
ttttctacagtta

SEQ ID NO: 1990691 - DNA, 18 bp, Homo sapiens
ttttctagactttctgtt

SEQ ID NO: 1990692 - DNA, 19 bp, Homo sapiens
ttttctatttttcttctaa

SEQ ID NO: 1990693 - DNA, 17 bp, Homo sapiens
ttttctccactttgttg

SEQ ID NO: 1990694 - DNA, 12 bp, Homo sapiens
ttttctctttaa

SEQ ID NO: 1990695 - DNA, 22 bp, Homo sapiens
ttttctgatgacataataaaga

SEQ ID NO: 1990696 - DNA, 21 bp, Homo sapiens
ttttctggaaattttgtccat

SEQ ID NO: 1990697 - DNA, 13 bp, Homo sapiens
ttttcttatccaa

SEQ ID NO: 1990698 - DNA, 13 bp, Homo sapiens
ttttcttatttca

SEQ ID NO: 1990699 - DNA, 16 bp, Homo sapiens
ttttcttcatgcaatg

SEQ ID NO: 1990700 - DNA, 21 bp, Homo sapiens
ttttcttccttctttctcttc

SEQ ID NO: 1990701 - DNA, 21 bp, Homo sapiens
ttttcttgccaatgaggtctg

SEQ ID NO: 1990702 - DNA, 18 bp, Homo sapiens
ttttctttctttttctgg

SEQ ID NO: 1990703 - DNA, 17 bp, Homo sapiens
ttttctttgaatgcttt

SEQ ID NO: 1990704 - DNA, 15 bp, Homo sapiens
ttttgaagtcatctt

SEQ ID NO: 1990705 - DNA, 22 bp, Homo sapiens
ttttgaataaaaaacatttgta

SEQ ID NO: 1990706 - DNA, 14 bp, Homo sapiens
ttttgaatttagtg

SEQ ID NO: 1990707 - DNA, 23 bp, Homo sapiens
ttttgacagtgttgaaaatgttc

SEQ ID NO: 1990708 - DNA, 21 bp, Homo sapiens
ttttgagacagggtctcacta

SEQ ID NO: 1990709 - DNA, 18 bp, Homo sapiens
ttttgatactaagcattg

SEQ ID NO: 1990710 - DNA, 13 bp, Homo sapiens
ttttgatgtgaaa

SEQ ID NO: 1990711 - DNA, 18 bp, Homo sapiens
ttttgcaatcccttaata

SEQ ID NO: 1990712 - DNA, 17 bp, Homo sapiens
ttttgcaatggctatat

SEQ ID NO: 1990713 - DNA, 10 bp, Homo sapiens
ttttgcacaa

SEQ ID NO: 1990714 - DNA, 21 bp, Homo sapiens
ttttgcacgtcttgctatttg

SEQ ID NO: 1990715 - DNA, 13 bp, Homo sapiens
ttttgcactgaca

SEQ ID NO: 1990716 - DNA, 14 bp, Homo sapiens
ttttgcagcagtga

SEQ ID NO: 1990717 - DNA, 17 bp, Homo sapiens
ttttgcataagattaaa

SEQ ID NO: 1990718 - DNA, 22 bp, Homo sapiens
ttttgccactttggcttctcct

SEQ ID NO: 1990719 - DNA, 22 bp, Homo sapiens
ttttgcctggctgtggaggcct

SEQ ID NO: 1990720 - DNA, 15 bp, Homo sapiens
ttttgcttaaaattt

SEQ ID NO: 1990721 - DNA, 19 bp, Homo sapiens
ttttggcactgagatattt

SEQ ID NO: 1990722 - DNA, 15 bp, Homo sapiens
ttttggccaaagtgt

SEQ ID NO: 1990723 - DNA, 11 bp, Homo sapiens
ttttggccttg

SEQ ID NO: 1990724 - DNA, 23 bp, Homo sapiens
ttttggtattacactgtatttgt

SEQ ID NO: 1990725 - DNA, 15 bp, Homo sapiens
ttttggtctgtgtga

SEQ ID NO: 1990726 - DNA, 18 bp, Homo sapiens
ttttgtaaactcaaaata

SEQ ID NO: 1990727 - DNA, 15 bp, Homo sapiens
ttttgtaaagatgcc

SEQ ID NO: 1990728 - DNA, 21 bp, Homo sapiens
ttttgtaaagatgccgggttt

SEQ ID NO: 1990729 - DNA, 15 bp, Homo sapiens
ttttgtaacttcaaa

SEQ ID NO: 1990730 - DNA, 17 bp, Homo sapiens
ttttgtaacttcaaata

SEQ ID NO: 1990731 - DNA, 14 bp, Homo sapiens
ttttgtaagacaaa

SEQ ID NO: 1990732 - DNA, 16 bp, Homo sapiens
ttttgtaataaactct

SEQ ID NO: 1990733 - DNA, 13 bp, Homo sapiens
ttttgtacagaat

SEQ ID NO: 1990734 - DNA, 22 bp, Homo sapiens
ttttgtacagaatttttaatga

SEQ ID NO: 1990735 - DNA, 22 bp, Homo sapiens
ttttgtaggggtcaaagaaatg

SEQ ID NO: 1990736 - DNA, 21 bp, Homo sapiens
ttttgtagtagttgatgacca

SEQ ID NO: 1990737 - DNA, 17 bp, Homo sapiens
ttttgtcccatttcctt

SEQ ID NO: 1990738 - DNA, 16 bp, Homo sapiens
ttttgtccccagggcc

SEQ ID NO: 1990739 - DNA, 10 bp, Homo sapiens
ttttgtctct

SEQ ID NO: 1990740 - DNA, 18 bp, Homo sapiens
ttttgtgaaaatgtcaaa

SEQ ID NO: 1990741 - DNA, 13 bp, Homo sapiens
ttttgtgagatgt

SEQ ID NO: 1990742 - DNA, 16 bp, Homo sapiens
ttttgtgatttagaac

SEQ ID NO: 1990743 - DNA, 21 bp, Homo sapiens
ttttgtggtcattaagcattg

SEQ ID NO: 1990744 - DNA, 13 bp, Homo sapiens
ttttgtgtacagt

SEQ ID NO: 1990745 - DNA, 22 bp, Homo sapiens
ttttgttaataataagataatg

SEQ ID NO: 1990746 - DNA, 16 bp, Homo sapiens
ttttgttacctttatg

SEQ ID NO: 1990747 - DNA, 16 bp, Homo sapiens
ttttgttatagaatac

SEQ ID NO: 1990748 - DNA, 14 bp, Homo sapiens
ttttgttcaaagtt

SEQ ID NO: 1990749 - DNA, 14 bp, Homo sapiens
ttttgttgattaaa

SEQ ID NO: 1990750 - DNA, 12 bp, Homo sapiens
ttttgtttcaga

SEQ ID NO: 1990751 - DNA, 19 bp, Homo sapiens
ttttgtttttgtaaaaaag

SEQ ID NO: 1990752 - DNA, 19 bp, Homo sapiens
tttttaaaagtttcaatgt

SEQ ID NO: 1990753 - DNA, 14 bp, Homo sapiens
tttttaaaataatt

SEQ ID NO: 1990754 - DNA, 13 bp, Homo sapiens
tttttaaactagt

SEQ ID NO: 1990755 - DNA, 16 bp, Homo sapiens
tttttaaactagtaat

SEQ ID NO: 1990756 - DNA, 20 bp, Homo sapiens
tttttaaaggtagagatgtg

SEQ ID NO: 1990757 - DNA, 12 bp, Homo sapiens
tttttaaattat

SEQ ID NO: 1990758 - DNA, 15 bp, Homo sapiens
tttttaacctgttta

SEQ ID NO: 1990759 - DNA, 22 bp, Homo sapiens
aaacagccgtcagccaaatgta

SEQ ID NO: 1990760 - DNA, 23 bp, Homo sapiens
aaacagccgtcagccaaatgtaa

SEQ ID NO: 1990761 - DNA, 15 bp, Homo sapiens
aaacagcctcacaga

SEQ ID NO: 1990762 - DNA, 17 bp, Homo sapiens
aaacagctaatgggaca

SEQ ID NO: 1990763 - DNA, 16 bp, Homo sapiens
aaacaggagacaggaa

SEQ ID NO: 1990764 - DNA, 17 bp, Homo sapiens
aaacagtcgatcaaggg

SEQ ID NO: 1990765 - DNA, 14 bp, Homo sapiens
aaacagtgagcctg

SEQ ID NO: 1990766 - DNA, 14 bp, Homo sapiens
aaacagttaacttt

SEQ ID NO: 1990767 - DNA, 15 bp, Homo sapiens
aaacagttcttggac

SEQ ID NO: 1990768 - DNA, 16 bp, Homo sapiens
aaacataatataagaa

SEQ ID NO: 1990769 - DNA, 20 bp, Homo sapiens
aaacataatatcttgaagaa

SEQ ID NO: 1990770 - DNA, 14 bp, Homo sapiens
aaacatatcaattc

SEQ ID NO: 1990771 - DNA, 20 bp, Homo sapiens
aaacatatcaattcaacaca

SEQ ID NO: 1990772 - DNA, 22 bp, Homo sapiens
aaacatatcaattcaacacatt

SEQ ID NO: 1990773 - DNA, 22 bp, Homo sapiens
aaacatatttgttaaatattta

SEQ ID NO: 1990774 - DNA, 20 bp, Homo sapiens
aaacatccttcaagaactct

SEQ ID NO: 1990775 - DNA, 22 bp, Homo sapiens
aaacatgtggcaacctgttctt

SEQ ID NO: 1990776 - DNA, 15 bp, Homo sapiens
aaacattaaaagaag

SEQ ID NO: 1990777 - DNA, 13 bp, Homo sapiens
aaacattaaacac

SEQ ID NO: 1990778 - DNA, 18 bp, Homo sapiens
aaacattaaacactgtaa

SEQ ID NO: 1990779 - DNA, 21 bp, Homo sapiens
aaacattaaacactgtaatct

SEQ ID NO: 1990780 - DNA, 16 bp, Homo sapiens
aaacattaaatgtctt

SEQ ID NO: 1990781 - DNA, 22 bp, Homo sapiens
aaacatttacaataaatattct

SEQ ID NO: 1990782 - DNA, 16 bp, Homo sapiens
aaacatttactgacca

SEQ ID NO: 1990783 - DNA, 14 bp, Homo sapiens
aaacatttgtacat

SEQ ID NO: 1990784 - DNA, 22 bp, Homo sapiens
aaaccaaaaaggctagtttatt

SEQ ID NO: 1990785 - DNA, 13 bp, Homo sapiens
aaaccaaaggaca

SEQ ID NO: 1990786 - DNA, 14 bp, Homo sapiens
aaaccaagccgtgg

SEQ ID NO: 1990787 - DNA, 16 bp, Homo sapiens
aaaccaagccgtggct

SEQ ID NO: 1990788 - DNA, 18 bp, Homo sapiens
aaaccaagtctacttcac

SEQ ID NO: 1990789 - DNA, 12 bp, Homo sapiens
aaaccaatgatt

SEQ ID NO: 1990790 - DNA, 22 bp, Homo sapiens
aaaccacaactgacacaggaaa

SEQ ID NO: 1990791 - DNA, 12 bp, Homo sapiens
aaaccacagcag

SEQ ID NO: 1990792 - DNA, 15 bp, Homo sapiens
aaaccacagcagttg

SEQ ID NO: 1990793 - DNA, 21 bp, Homo sapiens
aaaccaccctaaaatgacagc

SEQ ID NO: 1990794 - DNA, 16 bp, Homo sapiens
aaaccactagaactct

SEQ ID NO: 1990795 - DNA, 13 bp, Homo sapiens
aaaccactgtaca

SEQ ID NO: 1990796 - DNA, 15 bp, Homo sapiens
aaaccactgtacata

SEQ ID NO: 1990797 - DNA, 16 bp, Homo sapiens
aaaccagaatcataat

SEQ ID NO: 1990798 - DNA, 15 bp, Homo sapiens
aaaccagcagaaaag

SEQ ID NO: 1990799 - DNA, 20 bp, Homo sapiens
aaaccagcagaaaagtgctt

SEQ ID NO: 1990800 - DNA, 21 bp, Homo sapiens
aaaccagcagaaaagtgctta

SEQ ID NO: 1990801 - DNA, 13 bp, Homo sapiens
aaaccagggatag

SEQ ID NO: 1990802 - DNA, 16 bp, Homo sapiens
aaaccagtatggaagg

SEQ ID NO: 1990803 - DNA, 22 bp, Homo sapiens
aaaccagtatggaagggagggg

SEQ ID NO: 1990804 - DNA, 19 bp, Homo sapiens
aaaccagtgtagccttgcc

SEQ ID NO: 1990805 - DNA, 19 bp, Homo sapiens
aaaccatccatctgtggaa

SEQ ID NO: 1990806 - DNA, 14 bp, Homo sapiens
aaaccatgtagttt

SEQ ID NO: 1990807 - DNA, 16 bp, Homo sapiens
aaaccatgtagtttta

SEQ ID NO: 1990808 - DNA, 22 bp, Homo sapiens
aaaccatgtagttttaacagaa

SEQ ID NO: 1990809 - DNA, 19 bp, Homo sapiens
aaaccatttaattcataat

SEQ ID NO: 1990810 - DNA, 20 bp, Homo sapiens
aaaccatttaattcataatt

SEQ ID NO: 1990811 - DNA, 15 bp, Homo sapiens
aaaccatttcaaatg

SEQ ID NO: 1990812 - DNA, 12 bp, Homo sapiens
aaaccccaagca

SEQ ID NO: 1990813 - DNA, 13 bp, Homo sapiens
aaaccccaagcag

SEQ ID NO: 1990814 - DNA, 16 bp, Homo sapiens
aaacccccgctccaga

SEQ ID NO: 1990815 - DNA, 17 bp, Homo sapiens
aaacccttctcttctcc

SEQ ID NO: 1990816 - DNA, 14 bp, Homo sapiens
aaaccgctaaaaga

SEQ ID NO: 1990817 - DNA, 16 bp, Homo sapiens
aaacctaaagaggaaa

SEQ ID NO: 1990818 - DNA, 16 bp, Homo sapiens
aaacctagaacttcaa

SEQ ID NO: 1990819 - DNA, 21 bp, Homo sapiens
aaacctagaacttcaaaatgt

SEQ ID NO: 1990820 - DNA, 22 bp, Homo sapiens
aaacctgaaaaaaagtttacaa

SEQ ID NO: 1990821 - DNA, 19 bp, Homo sapiens
aaacctgatgttaaaattc

SEQ ID NO: 1990822 - DNA, 12 bp, Homo sapiens
aaacctggagat

SEQ ID NO: 1990823 - DNA, 19 bp, Homo sapiens
aaacctggagatgatgatg

SEQ ID NO: 1990824 - DNA, 20 bp, Homo sapiens
aaacctggcatggtgctttc

SEQ ID NO: 1990825 - DNA, 13 bp, Homo sapiens
aaaccttgattta

SEQ ID NO: 1990826 - DNA, 19 bp, Homo sapiens
aaaccttgcagcattttta

SEQ ID NO: 1990827 - DNA, 17 bp, Homo sapiens
aaacctttcttcaccaa

SEQ ID NO: 1990828 - DNA, 19 bp, Homo sapiens
aaacgactccgagaacaac

SEQ ID NO: 1990829 - DNA, 14 bp, Homo sapiens
aaacgagataatgt

SEQ ID NO: 1990830 - DNA, 22 bp, Homo sapiens
aaacgcctcttttccctctcta

SEQ ID NO: 1990831 - DNA, 23 bp, Homo sapiens
aaacgtacttaactgtgtgaaga

SEQ ID NO: 1990832 - DNA, 19 bp, Homo sapiens
aaacgttgacccctttccc

SEQ ID NO: 1990833 - DNA, 15 bp, Homo sapiens
aaactaaatatatgt

SEQ ID NO: 1990834 - DNA, 12 bp, Homo sapiens
aaactactgtaa

SEQ ID NO: 1990835 - DNA, 14 bp, Homo sapiens
aaactactgtaatt

SEQ ID NO: 1990836 - DNA, 14 bp, Homo sapiens
aaactagtaatggg

SEQ ID NO: 1990837 - DNA, 15 bp, Homo sapiens
aaactagtttccagt

SEQ ID NO: 1990838 - DNA, 16 bp, Homo sapiens
aaactatcagtttgtc

SEQ ID NO: 1990839 - DNA, 17 bp, Homo sapiens
aaactatccaattaaaa

SEQ ID NO: 1990840 - DNA, 17 bp, Homo sapiens
aaactatgatcacagtg

SEQ ID NO: 1990841 - DNA, 16 bp, Homo sapiens
aaactatggttcccaa

SEQ ID NO: 1990842 - DNA, 17 bp, Homo sapiens
aaactatggttcccaat

SEQ ID NO: 1990843 - DNA, 18 bp, Homo sapiens
aaactatggttcccaata

SEQ ID NO: 1990844 - DNA, 23 bp, Homo sapiens
aaactatggttcccaataaaagt

SEQ ID NO: 1990845 - DNA, 22 bp, Homo sapiens
aaactcaaaacttaacatattt

SEQ ID NO: 1990846 - DNA, 15 bp, Homo sapiens
aaactcagttaaaat

SEQ ID NO: 1990847 - DNA, 17 bp, Homo sapiens
aaactcctgattttgta

SEQ ID NO: 1990848 - DNA, 11 bp, Homo sapiens
aaactcctgcc

SEQ ID NO: 1990849 - DNA, 14 bp, Homo sapiens
aaactctgccagcc

SEQ ID NO: 1990850 - DNA, 14 bp, Homo sapiens
aaactcttctactt

SEQ ID NO: 1990851 - DNA, 18 bp, Homo sapiens
aaactgaaaaattttatt

SEQ ID NO: 1990852 - DNA, 17 bp, Homo sapiens
aaactgaaaatctaata

SEQ ID NO: 1990853 - DNA, 13 bp, Homo sapiens
aaactgaagaagg

SEQ ID NO: 1990854 - DNA, 14 bp, Homo sapiens
aaactgaagccaga

SEQ ID NO: 1990855 - DNA, 19 bp, Homo sapiens
aaactgacaacctgtgcag

SEQ ID NO: 1990856 - DNA, 13 bp, Homo sapiens
aaactgagaaatg

SEQ ID NO: 1990857 - DNA, 20 bp, Homo sapiens
aaactgagaaatgaatgctg

SEQ ID NO: 1990858 - DNA, 19 bp, Homo sapiens
aaactgaggaattttcttt

SEQ ID NO: 1990859 - DNA, 13 bp, Homo sapiens
aaactgaggagta

SEQ ID NO: 1990860 - DNA, 19 bp, Homo sapiens
aaactgaggccattatttc

SEQ ID NO: 1990861 - DNA, 20 bp, Homo sapiens
aaactgaggccattatttca

SEQ ID NO: 1990862 - DNA, 13 bp, Homo sapiens
aaactgagtgact

SEQ ID NO: 1990863 - DNA, 20 bp, Homo sapiens
aaactgatcaaaaataaact

SEQ ID NO: 1990864 - DNA, 17 bp, Homo sapiens
aaactgatttctcacgg

SEQ ID NO: 1990865 - DNA, 14 bp, Homo sapiens
aaactgctgttaat

SEQ ID NO: 1990866 - DNA, 14 bp, Homo sapiens
aaactggaataaga

SEQ ID NO: 1990867 - DNA, 12 bp, Homo sapiens
aaactggccagg

SEQ ID NO: 1990868 - DNA, 18 bp, Homo sapiens
aaactgtaaatacaaaat

SEQ ID NO: 1990869 - DNA, 20 bp, Homo sapiens
aaactgtaaatatgtttgtg

SEQ ID NO: 1990870 - DNA, 17 bp, Homo sapiens
aaactgtgccctgcctt

SEQ ID NO: 1990871 - DNA, 17 bp, Homo sapiens
aaacttagaataaaatt

SEQ ID NO: 1990872 - DNA, 21 bp, Homo sapiens
aaacttagtgcggacaagttt

SEQ ID NO: 1990873 - DNA, 23 bp, Homo sapiens
aaacttatgctagtttattggaa

SEQ ID NO: 1990874 - DNA, 14 bp, Homo sapiens
aacagcccatttta

SEQ ID NO: 1990875 - DNA, 21 bp, Homo sapiens
aacagcccattttatctttga

SEQ ID NO: 1990876 - DNA, 19 bp, Homo sapiens
aacagccccccccttgaat

SEQ ID NO: 1990877 - DNA, 20 bp, Homo sapiens
aacagccgctcctgtctgcc

SEQ ID NO: 1990878 - DNA, 18 bp, Homo sapiens
aacagctcaagtcttccc

SEQ ID NO: 1990879 - DNA, 23 bp, Homo sapiens
aacagctccctagtggcttcctc

SEQ ID NO: 1990880 - DNA, 23 bp, Homo sapiens
aacagctcttcactcagccacac

SEQ ID NO: 1990881 - DNA, 15 bp, Homo sapiens
aacagcttgaccaga

SEQ ID NO: 1990882 - DNA, 17 bp, Homo sapiens
aacagcttgaccagacc

SEQ ID NO: 1990883 - DNA, 19 bp, Homo sapiens
aacagcttgaccagaccta

SEQ ID NO: 1990884 - DNA, 21 bp, Homo sapiens
aacagcttttcccaggagacc

SEQ ID NO: 1990885 - DNA, 19 bp, Homo sapiens
aacaggaatctcagagaca

SEQ ID NO: 1990886 - DNA, 23 bp, Homo sapiens
aacaggctgttctgcactgaaaa

SEQ ID NO: 1990887 - DNA, 13 bp, Homo sapiens
aacagggaaggca

SEQ ID NO: 1990888 - DNA, 22 bp, Homo sapiens
aacagggagactgcatctcaaa

SEQ ID NO: 1990889 - DNA, 24 bp, Homo sapiens
aacagggcagtgacaagtggaggg

SEQ ID NO: 1990890 - DNA, 22 bp, Homo sapiens
aacaggggatcaaagttcctgt

SEQ ID NO: 1990891 - DNA, 22 bp, Homo sapiens
aacaggtggcaggaccaggact

SEQ ID NO: 1990892 - DNA, 22 bp, Homo sapiens
aacagtatttgtacaaatactg

SEQ ID NO: 1990893 - DNA, 13 bp, Homo sapiens
aacagtcatttaa

SEQ ID NO: 1990894 - DNA, 13 bp, Homo sapiens
aacagtctcagga

SEQ ID NO: 1990895 - DNA, 17 bp, Homo sapiens
aacagtctcaggaaatc

SEQ ID NO: 1990896 - DNA, 19 bp, Homo sapiens
aacagtctcaggaaatcaa

SEQ ID NO: 1990897 - DNA, 13 bp, Homo sapiens
aacagtgagcctg

SEQ ID NO: 1990898 - DNA, 12 bp, Homo sapiens
aacagtgcctgc

SEQ ID NO: 1990899 - DNA, 13 bp, Homo sapiens
aacagtgcctgct

SEQ ID NO: 1990900 - DNA, 15 bp, Homo sapiens
aacagtgtttcccat

SEQ ID NO: 1990901 - DNA, 21 bp, Homo sapiens
aacagtgtttcccataatttt

SEQ ID NO: 1990902 - DNA, 23 bp, Homo sapiens
aacagtgtttcccataattttct

SEQ ID NO: 1990903 - DNA, 13 bp, Homo sapiens
aacagttaacttt

SEQ ID NO: 1990904 - DNA, 17 bp, Homo sapiens
aacagttaactttcaga

SEQ ID NO: 1990905 - DNA, 13 bp, Homo sapiens
aacagttcaaaga

SEQ ID NO: 1990906 - DNA, 13 bp, Homo sapiens
aacataaaaatga

SEQ ID NO: 1990907 - DNA, 21 bp, Homo sapiens
aacatagacagaagaaacaag

SEQ ID NO: 1990908 - DNA, 21 bp, Homo sapiens
aacatataatgttgttattta

SEQ ID NO: 1990909 - DNA, 22 bp, Homo sapiens
aacatataatgttgttatttaa

SEQ ID NO: 1990910 - DNA, 16 bp, Homo sapiens
aacatatcaattcaac

SEQ ID NO: 1990911 - DNA, 17 bp, Homo sapiens
aacatatcaattcaaca

SEQ ID NO: 1990912 - DNA, 22 bp, Homo sapiens
aacatatcaattcaacacatta

SEQ ID NO: 1990913 - DNA, 13 bp, Homo sapiens
aacatatcatttt

SEQ ID NO: 1990914 - DNA, 13 bp, Homo sapiens
aacatatgtatta

SEQ ID NO: 1990915 - DNA, 22 bp, Homo sapiens
aacatatgtattaagccaaaca

SEQ ID NO: 1990916 - DNA, 22 bp, Homo sapiens
aacatatttgttaaatatttac

SEQ ID NO: 1990917 - DNA, 19 bp, Homo sapiens
aacatccaaggagaaacag

SEQ ID NO: 1990918 - DNA, 19 bp, Homo sapiens
aacatcccattgccctggt

SEQ ID NO: 1990919 - DNA, 19 bp, Homo sapiens
aacatcctccaattccaca

SEQ ID NO: 1990920 - DNA, 20 bp, Homo sapiens
aacatctattataaaaccat

SEQ ID NO: 1990921 - DNA, 22 bp, Homo sapiens
aacatctattataaaaccatgt

SEQ ID NO: 1990922 - DNA, 15 bp, Homo sapiens
aacatctcactttgc

SEQ ID NO: 1990923 - DNA, 21 bp, Homo sapiens
aacatctcgagccccctggat

SEQ ID NO: 1990924 - DNA, 16 bp, Homo sapiens
aacatctgaaagccac

SEQ ID NO: 1990925 - DNA, 19 bp, Homo sapiens
aacatctttgaaaagaaaa

SEQ ID NO: 1990926 - DNA, 18 bp, Homo sapiens
aacatctttttcctccct

SEQ ID NO: 1990927 - DNA, 21 bp, Homo sapiens
aacatgaaaaacacggcagct

SEQ ID NO: 1990928 - DNA, 12 bp, Homo sapiens
aacatgagaaat

SEQ ID NO: 1990929 - DNA, 15 bp, Homo sapiens
aacatgagaaatgtg

SEQ ID NO: 1990930 - DNA, 17 bp, Homo sapiens
aacatgagaaatgtgaa

SEQ ID NO: 1990931 - DNA, 21 bp, Homo sapiens
aacatgagtgaatagctttca

SEQ ID NO: 1990932 - DNA, 14 bp, Homo sapiens
aacatgagtttatg

SEQ ID NO: 1990933 - DNA, 20 bp, Homo sapiens
aacatgcctgattttaaaag

SEQ ID NO: 1990934 - DNA, 20 bp, Homo sapiens
aacatggagaaaccctgtct

SEQ ID NO: 1990935 - DNA, 17 bp, Homo sapiens
aacatgtataatatttt

SEQ ID NO: 1990936 - DNA, 19 bp, Homo sapiens
aacatgtcggagtagaaat

SEQ ID NO: 1990937 - DNA, 20 bp, Homo sapiens
aacatgtcggagtagaaatt

SEQ ID NO: 1990938 - DNA, 16 bp, Homo sapiens
aacattaaacactgta

SEQ ID NO: 1990939 - DNA, 12 bp, Homo sapiens
aacattaaatgt

SEQ ID NO: 1990940 - DNA, 23 bp, Homo sapiens
aacattaaatgtcttatatagca

SEQ ID NO: 1990941 - DNA, 16 bp, Homo sapiens
aacattatttattcag

SEQ ID NO: 1990942 - DNA, 17 bp, Homo sapiens
aacattgacttcttggt

SEQ ID NO: 1990943 - DNA, 24 bp, Homo sapiens
aacatttacaataaatattctgca

SEQ ID NO: 1990944 - DNA, 22 bp, Homo sapiens
aacatttctatagccaaaaata

SEQ ID NO: 1990945 - DNA, 21 bp, Homo sapiens
aacatttgctttgttttctaa

SEQ ID NO: 1990946 - DNA, 20 bp, Homo sapiens
aacattttaaataaaagaaa

SEQ ID NO: 1990947 - DNA, 20 bp, Homo sapiens
aacattttggggttagacct

SEQ ID NO: 1990948 - DNA, 16 bp, Homo sapiens
aacatttttggtgtat

SEQ ID NO: 1990949 - DNA, 16 bp, Homo sapiens
aaccaaagagactgga

SEQ ID NO: 1990950 - DNA, 12 bp, Homo sapiens
aaccaaagccag

SEQ ID NO: 1990951 - DNA, 13 bp, Homo sapiens
aaccaaaggacat

SEQ ID NO: 1990952 - DNA, 14 bp, Homo sapiens
aaccaacctccccg

SEQ ID NO: 1990953 - DNA, 14 bp, Homo sapiens
aaccaagaagggct

SEQ ID NO: 1990954 - DNA, 20 bp, Homo sapiens
aaccaagcttcagagcctag

SEQ ID NO: 1990955 - DNA, 22 bp, Homo sapiens
aaccaagcttcagagcctagcc

SEQ ID NO: 1990956 - DNA, 14 bp, Homo sapiens
aaccaaggcagcct

SEQ ID NO: 1990957 - DNA, 23 bp, Homo sapiens
aaccaatgagctgtatctgtaat

SEQ ID NO: 1990958 - DNA, 19 bp, Homo sapiens
aaccaatgattcataacaa

SEQ ID NO: 1990959 - DNA, 16 bp, Homo sapiens
aaccacaactgacaca

SEQ ID NO: 1990960 - DNA, 17 bp, Homo sapiens
aaccacaactgacacag

SEQ ID NO: 1990961 - DNA, 17 bp, Homo sapiens
aaccacacttcttgaaa

SEQ ID NO: 1990962 - DNA, 12 bp, Homo sapiens
aaccacagcagt

SEQ ID NO: 1990963 - DNA, 13 bp, Homo sapiens
aaccacatcttgc

SEQ ID NO: 1990964 - DNA, 20 bp, Homo sapiens
aaccacatcttgctctgctg

SEQ ID NO: 1990965 - DNA, 19 bp, Homo sapiens
aaccaccacacccagccca

SEQ ID NO: 1990966 - DNA, 23 bp, Homo sapiens
aaccacgagtaagatattattta

SEQ ID NO: 1990967 - DNA, 14 bp, Homo sapiens
aaccactgcaacgg

SEQ ID NO: 1990968 - DNA, 20 bp, Homo sapiens
aaccactgtaaaatgaaatt

SEQ ID NO: 1990969 - DNA, 13 bp, Homo sapiens
aaccacttaaaaa

SEQ ID NO: 1990970 - DNA, 17 bp, Homo sapiens
aaccacttggctgctca

SEQ ID NO: 1990971 - DNA, 11 bp, Homo sapiens
aaccactttgc

SEQ ID NO: 1990972 - DNA, 18 bp, Homo sapiens
aaccagaataaagttctg

SEQ ID NO: 1990973 - DNA, 18 bp, Homo sapiens
aaccagagccccccacaa

SEQ ID NO: 1990974 - DNA, 20 bp, Homo sapiens
aaccagagccccccacaatg

SEQ ID NO: 1990975 - DNA, 13 bp, Homo sapiens
aaccagcagaaaa

SEQ ID NO: 1990976 - DNA, 15 bp, Homo sapiens
aaccagcagaaaagt

SEQ ID NO: 1990977 - DNA, 16 bp, Homo sapiens
aaccagcagaaaagtg

SEQ ID NO: 1990978 - DNA, 18 bp, Homo sapiens
aaccagcagaaaagtgct

SEQ ID NO: 1990979 - DNA, 11 bp, Homo sapiens
aaccagcaggt

SEQ ID NO: 1990980 - DNA, 16 bp, Homo sapiens
aaccagcattttacta

SEQ ID NO: 1990981 - DNA, 17 bp, Homo sapiens
aaccagcattttactac

SEQ ID NO: 1990982 - DNA, 11 bp, Homo sapiens
aaccagctgct

SEQ ID NO: 1990983 - DNA, 15 bp, Homo sapiens
aaccaggactctgcc

SEQ ID NO: 1990984 - DNA, 22 bp, Homo sapiens
aaccaggattttgtgttttttc

SEQ ID NO: 1990985 - DNA, 12 bp, Homo sapiens
aaccagggatag

SEQ ID NO: 1990986 - DNA, 15 bp, Homo sapiens
aaccagggtgcatgg

SEQ ID NO: 1990987 - DNA, 21 bp, Homo sapiens
aaccagtatggaagggagggg

SEQ ID NO: 1990988 - DNA, 13 bp, Homo sapiens
aagactgaaagaa

SEQ ID NO: 1990989 - DNA, 14 bp, Homo sapiens
aagactgaaagaat

SEQ ID NO: 1990990 - DNA, 15 bp, Homo sapiens
aagactgagcacctg

SEQ ID NO: 1990991 - DNA, 12 bp, Homo sapiens
aagactgcagct

SEQ ID NO: 1990992 - DNA, 14 bp, Homo sapiens
aagactgcagctgc

SEQ ID NO: 1990993 - DNA, 15 bp, Homo sapiens
aagactgcagctgct

SEQ ID NO: 1990994 - DNA, 17 bp, Homo sapiens
aagactgcagctgctga

SEQ ID NO: 1990995 - DNA, 13 bp, Homo sapiens
aagactggaagca

SEQ ID NO: 1990996 - DNA, 19 bp, Homo sapiens
aagacttctctttgcctca

SEQ ID NO: 1990997 - DNA, 13 bp, Homo sapiens
aagacttgacagt

SEQ ID NO: 1990998 - DNA, 14 bp, Homo sapiens
aagacttgacagtg

SEQ ID NO: 1990999 - DNA, 17 bp, Homo sapiens
aagacttggcaacagaa

SEQ ID NO: 1991000 - DNA, 18 bp, Homo sapiens
aagacttggcaacagaag

SEQ ID NO: 1991001 - DNA, 11 bp, Homo sapiens
aagagaaatct

SEQ ID NO: 1991002 - DNA, 12 bp, Homo sapiens
aagagaataaag

SEQ ID NO: 1991003 - DNA, 11 bp, Homo sapiens
aagagaattct

SEQ ID NO: 1991004 - DNA, 21 bp, Homo sapiens
aagagaattctaagattgtac

SEQ ID NO: 1991005 - DNA, 19 bp, Homo sapiens
aagagacaaacacctccca

SEQ ID NO: 1991006 - DNA, 16 bp, Homo sapiens
aagagacactgcttgg

SEQ ID NO: 1991007 - DNA, 18 bp, Homo sapiens
aagagacagagcccccaa

SEQ ID NO: 1991008 - DNA, 22 bp, Homo sapiens
aagagacaggagggcaagggcc

SEQ ID NO: 1991009 - DNA, 21 bp, Homo sapiens
aagagactaatagagacacag

SEQ ID NO: 1991010 - DNA, 23 bp, Homo sapiens
aagagactccaagattcaaagag

SEQ ID NO: 1991011 - DNA, 15 bp, Homo sapiens
aagagactctggcct

SEQ ID NO: 1991012 - DNA, 18 bp, Homo sapiens
aagagactggagcatctg

SEQ ID NO: 1991013 - DNA, 15 bp, Homo sapiens
aagagagaaacattt

SEQ ID NO: 1991014 - DNA, 13 bp, Homo sapiens
aagagagagagag

SEQ ID NO: 1991015 - DNA, 17 bp, Homo sapiens
aagagagagagagaggt

SEQ ID NO: 1991016 - DNA, 16 bp, Homo sapiens
aagagagatatatctg

SEQ ID NO: 1991017 - DNA, 22 bp, Homo sapiens
aagagagggccatgcaattcat

SEQ ID NO: 1991018 - DNA, 17 bp, Homo sapiens
aagagagtaccatgctg

SEQ ID NO: 1991019 - DNA, 17 bp, Homo sapiens
aagagatgggcttgttt

SEQ ID NO: 1991020 - DNA, 15 bp, Homo sapiens
aagagatttcaacat

SEQ ID NO: 1991021 - DNA, 17 bp, Homo sapiens
aagagcaatcaaagcag

SEQ ID NO: 1991022 - DNA, 15 bp, Homo sapiens
aagagcagcctgatg

SEQ ID NO: 1991023 - DNA, 21 bp, Homo sapiens
aagagcatcatgcctctgagg

SEQ ID NO: 1991024 - DNA, 22 bp, Homo sapiens
aagagcatcatgcctctgaggc

SEQ ID NO: 1991025 - DNA, 15 bp, Homo sapiens
aagagccctgagctc

SEQ ID NO: 1991026 - DNA, 21 bp, Homo sapiens
aagagccctgagctcaggctg

SEQ ID NO: 1991027 - DNA, 18 bp, Homo sapiens
aagagcctgactgtgttc

SEQ ID NO: 1991028 - DNA, 17 bp, Homo sapiens
aagagcctggagaagct

SEQ ID NO: 1991029 - DNA, 20 bp, Homo sapiens
aagagccttggtgtccacct

SEQ ID NO: 1991030 - DNA, 16 bp, Homo sapiens
aagagctacataattt

SEQ ID NO: 1991031 - DNA, 16 bp, Homo sapiens
aagagctagcgctgcc

SEQ ID NO: 1991032 - DNA, 13 bp, Homo sapiens
aagagctgctgtc

SEQ ID NO: 1991033 - DNA, 17 bp, Homo sapiens
aagagctgctgtccttt

SEQ ID NO: 1991034 - DNA, 12 bp, Homo sapiens
aagaggaaaaaa

SEQ ID NO: 1991035 - DNA, 19 bp, Homo sapiens
aagaggaaaagtgcaatgc

SEQ ID NO: 1991036 - DNA, 15 bp, Homo sapiens
aagaggactgagact

SEQ ID NO: 1991037 - DNA, 15 bp, Homo sapiens
aagaggagaccctgg

SEQ ID NO: 1991038 - DNA, 22 bp, Homo sapiens
aagaggagagaggaagctctct

SEQ ID NO: 1991039 - DNA, 20 bp, Homo sapiens
aagaggagtttcgaggtaga

SEQ ID NO: 1991040 - DNA, 17 bp, Homo sapiens
aagaggatgatttcaga

SEQ ID NO: 1991041 - DNA, 21 bp, Homo sapiens
aagaggatgatttcagaagga

SEQ ID NO: 1991042 - DNA, 11 bp, Homo sapiens
aagaggcaggg

SEQ ID NO: 1991043 - DNA, 14 bp, Homo sapiens
aagaggcagggtct

SEQ ID NO: 1991044 - DNA, 13 bp, Homo sapiens
aagaggcccaggg

SEQ ID NO: 1991045 - DNA, 18 bp, Homo sapiens
aagaggcccagggagcaa

SEQ ID NO: 1991046 - DNA, 17 bp, Homo sapiens
aagagggaggcttcctg

SEQ ID NO: 1991047 - DNA, 21 bp, Homo sapiens
aagagggaggcttcctgactg

SEQ ID NO: 1991048 - DNA, 24 bp, Homo sapiens
aagaggtgaccccagggcacagga

SEQ ID NO: 1991049 - DNA, 17 bp, Homo sapiens
aagaggtgttttttcta

SEQ ID NO: 1991050 - DNA, 14 bp, Homo sapiens
aagagtattccatt

SEQ ID NO: 1991051 - DNA, 15 bp, Homo sapiens
aagagtattccattt

SEQ ID NO: 1991052 - DNA, 14 bp, Homo sapiens
aagagttcaagaaa

SEQ ID NO: 1991053 - DNA, 16 bp, Homo sapiens
aagagttcaagaaata

SEQ ID NO: 1991054 - DNA, 22 bp, Homo sapiens
aagagtttaactttgggcccag

SEQ ID NO: 1991055 - DNA, 12 bp, Homo sapiens
aagataaagatg

SEQ ID NO: 1991056 - DNA, 14 bp, Homo sapiens
aagataaagatgat

SEQ ID NO: 1991057 - DNA, 19 bp, Homo sapiens
aagataacaagatctttca

SEQ ID NO: 1991058 - DNA, 20 bp, Homo sapiens
aagataacaagatctttcag

SEQ ID NO: 1991059 - DNA, 16 bp, Homo sapiens
aagataatgttcttta

SEQ ID NO: 1991060 - DNA, 23 bp, Homo sapiens
aagatacggttgcttcaccttgg

SEQ ID NO: 1991061 - DNA, 14 bp, Homo sapiens
aagatacttaagtg

SEQ ID NO: 1991062 - DNA, 14 bp, Homo sapiens
aagatagcagggca

SEQ ID NO: 1991063 - DNA, 17 bp, Homo sapiens
aagataggtttgagttc

SEQ ID NO: 1991064 - DNA, 22 bp, Homo sapiens
aagatatatatttactaaaaga

SEQ ID NO: 1991065 - DNA, 23 bp, Homo sapiens
aagatatatatttactaaaagaa

SEQ ID NO: 1991066 - DNA, 14 bp, Homo sapiens
aagatatattttga

SEQ ID NO: 1991067 - DNA, 21 bp, Homo sapiens
aagatcctgtctttaaggaaa

SEQ ID NO: 1991068 - DNA, 16 bp, Homo sapiens
aagatcgaatttttca

SEQ ID NO: 1991069 - DNA, 13 bp, Homo sapiens
aagatctttcagg

SEQ ID NO: 1991070 - DNA, 14 bp, Homo sapiens
aagatgaaaatatt

SEQ ID NO: 1991071 - DNA, 23 bp, Homo sapiens
aagatgaagagaagctgagaaga

SEQ ID NO: 1991072 - DNA, 17 bp, Homo sapiens
aagatgagagaactgga

SEQ ID NO: 1991073 - DNA, 18 bp, Homo sapiens
aagatgatctactcagaa

SEQ ID NO: 1991074 - DNA, 11 bp, Homo sapiens
aagatgccctc

SEQ ID NO: 1991075 - DNA, 22 bp, Homo sapiens
aagatggactctgaaaaacatt

SEQ ID NO: 1991076 - DNA, 19 bp, Homo sapiens
aagatggctattataatgg

SEQ ID NO: 1991077 - DNA, 23 bp, Homo sapiens
aagatggctgtgcctctgcctgt

SEQ ID NO: 1991078 - DNA, 21 bp, Homo sapiens
aagatggcttatttgtataat

SEQ ID NO: 1991079 - DNA, 13 bp, Homo sapiens
aagatgggcacat

SEQ ID NO: 1991080 - DNA, 14 bp, Homo sapiens
aagatggtagcaga

SEQ ID NO: 1991081 - DNA, 15 bp, Homo sapiens
aagatgtcaaatatc

SEQ ID NO: 1991082 - DNA, 13 bp, Homo sapiens
aagatgttgtcat

SEQ ID NO: 1991083 - DNA, 18 bp, Homo sapiens
aagattaaaattagtgag

SEQ ID NO: 1991084 - DNA, 12 bp, Homo sapiens
aagattaaagga

SEQ ID NO: 1991085 - DNA, 20 bp, Homo sapiens
aagattaaattatatctgag

SEQ ID NO: 1991086 - DNA, 18 bp, Homo sapiens
aagattagaatgaaaatt

SEQ ID NO: 1991087 - DNA, 21 bp, Homo sapiens
aagattaggtactatctgtga

SEQ ID NO: 1991088 - DNA, 23 bp, Homo sapiens
aagattaggtactatctgtgaag

SEQ ID NO: 1991089 - DNA, 15 bp, Homo sapiens
aagattatatatcat

SEQ ID NO: 1991090 - DNA, 16 bp, Homo sapiens
aagattatatatcata

SEQ ID NO: 1991091 - DNA, 15 bp, Homo sapiens
aagattcaaagagac

SEQ ID NO: 1991092 - DNA, 12 bp, Homo sapiens
aagattcccaga

SEQ ID NO: 1991093 - DNA, 13 bp, Homo sapiens
aagattcccagag

SEQ ID NO: 1991094 - DNA, 13 bp, Homo sapiens
aagattgcaaagt

SEQ ID NO: 1991095 - DNA, 23 bp, Homo sapiens
aagatttaccttttctgttgtac

SEQ ID NO: 1991096 - DNA, 21 bp, Homo sapiens
aagattttggaggagaaggac

SEQ ID NO: 1991097 - DNA, 23 bp, Homo sapiens
aagattttggagggtcctccaca

SEQ ID NO: 1991098 - DNA, 21 bp, Homo sapiens
aagatttttaattacaataat

SEQ ID NO: 1991099 - DNA, 17 bp, Homo sapiens
aagattttttaataatt

SEQ ID NO: 1991100 - DNA, 16 bp, Homo sapiens
aagattttttttgtaa

SEQ ID NO: 1991101 - DNA, 19 bp, Homo sapiens
aagattttttttgtaactt

SEQ ID NO: 1991102 - DNA, 14 bp, Homo sapiens
aagcaaagggctcc

SEQ ID NO: 1991103 - DNA, 22 bp, Homo sapiens
aagtgttccctgagaaacccac

SEQ ID NO: 1991104 - DNA, 14 bp, Homo sapiens
aagtgttgaagaag

SEQ ID NO: 1991105 - DNA, 16 bp, Homo sapiens
aagtgttgaagaagag

SEQ ID NO: 1991106 - DNA, 15 bp, Homo sapiens
aagtgtttatttttc

SEQ ID NO: 1991107 - DNA, 22 bp, Homo sapiens
aagtgttttctcagaacagctg

SEQ ID NO: 1991108 - DNA, 23 bp, Homo sapiens
aagtgttttgttctttctggagt

SEQ ID NO: 1991109 - DNA, 14 bp, Homo sapiens
aagttaaaaaaaag

SEQ ID NO: 1991110 - DNA, 13 bp, Homo sapiens
aagttaacagaga

SEQ ID NO: 1991111 - DNA, 20 bp, Homo sapiens
aagttaagcagcctttctgt

SEQ ID NO: 1991112 - DNA, 12 bp, Homo sapiens
aagttaatttaa

SEQ ID NO: 1991113 - DNA, 16 bp, Homo sapiens
aagttacacaattaat

SEQ ID NO: 1991114 - DNA, 18 bp, Homo sapiens
aagttagagaatatattt

SEQ ID NO: 1991115 - DNA, 14 bp, Homo sapiens
aagttagctgagcg

SEQ ID NO: 1991116 - DNA, 16 bp, Homo sapiens
aagttagctttaactt

SEQ ID NO: 1991117 - DNA, 17 bp, Homo sapiens
aagttaggttataagaa

SEQ ID NO: 1991118 - DNA, 21 bp, Homo sapiens
aagttagtgtgttgtctgtgc

SEQ ID NO: 1991119 - DNA, 22 bp, Homo sapiens
aagttagtgtgttgtctgtgca

SEQ ID NO: 1991120 - DNA, 19 bp, Homo sapiens
aagttataaatcaatgtca

SEQ ID NO: 1991121 - DNA, 14 bp, Homo sapiens
aagttatgagggtc

SEQ ID NO: 1991122 - DNA, 20 bp, Homo sapiens
aagttattaacgggcatgta

SEQ ID NO: 1991123 - DNA, 22 bp, Homo sapiens
aagttattaacgggcatgtatt

SEQ ID NO: 1991124 - DNA, 23 bp, Homo sapiens
aagttattccccatcttccaagg

SEQ ID NO: 1991125 - DNA, 12 bp, Homo sapiens
aagttattgtgt

SEQ ID NO: 1991126 - DNA, 12 bp, Homo sapiens
aagttattttaa

SEQ ID NO: 1991127 - DNA, 13 bp, Homo sapiens
aagttattttaaa

SEQ ID NO: 1991128 - DNA, 19 bp, Homo sapiens
aagttcagggaagcaggca

SEQ ID NO: 1991129 - DNA, 21 bp, Homo sapiens
aagttcagggaagcaggcaga

SEQ ID NO: 1991130 - DNA, 17 bp, Homo sapiens
aagttcatgtttgtaaa

SEQ ID NO: 1991131 - DNA, 17 bp, Homo sapiens
aagttccctacttcctg

SEQ ID NO: 1991132 - DNA, 20 bp, Homo sapiens
aagttccctacttcctgtga

SEQ ID NO: 1991133 - DNA, 19 bp, Homo sapiens
aagttcctgcactccagaa

SEQ ID NO: 1991134 - DNA, 22 bp, Homo sapiens
aagttcctgttcaccttatgta

SEQ ID NO: 1991135 - DNA, 21 bp, Homo sapiens
aagttctagagaagaggctgg

SEQ ID NO: 1991136 - DNA, 21 bp, Homo sapiens
aagttgaatggcctgccttga

SEQ ID NO: 1991137 - DNA, 16 bp, Homo sapiens
aagttgcagtgagctg

SEQ ID NO: 1991138 - DNA, 22 bp, Homo sapiens
aagttgcagtgagctgatatca

SEQ ID NO: 1991139 - DNA, 16 bp, Homo sapiens
aagttgccaagagttc

SEQ ID NO: 1991140 - DNA, 19 bp, Homo sapiens
aagttggaccagaggaagc

SEQ ID NO: 1991141 - DNA, 19 bp, Homo sapiens
aagttgtgccttttatagc

SEQ ID NO: 1991142 - DNA, 20 bp, Homo sapiens
aagttgtgccttttatagct

SEQ ID NO: 1991143 - DNA, 22 bp, Homo sapiens
aagttgtgttaacaatgcagta

SEQ ID NO: 1991144 - DNA, 20 bp, Homo sapiens
aagttgttcacatatatgta

SEQ ID NO: 1991145 - DNA, 15 bp, Homo sapiens
aagttgtttcattga

SEQ ID NO: 1991146 - DNA, 14 bp, Homo sapiens
aagtttaataaatt

SEQ ID NO: 1991147 - DNA, 17 bp, Homo sapiens
aagtttaataaatttat

SEQ ID NO: 1991148 - DNA, 20 bp, Homo sapiens
aagtttaatggtgccttcat

SEQ ID NO: 1991149 - DNA, 18 bp, Homo sapiens
aagtttacaagtgtatat

SEQ ID NO: 1991150 - DNA, 21 bp, Homo sapiens
aagtttacaagtgtatatcag

SEQ ID NO: 1991151 - DNA, 23 bp, Homo sapiens
aagtttacaagtgtatatcagaa

SEQ ID NO: 1991152 - DNA, 19 bp, Homo sapiens
aagtttacagtaaataaat

SEQ ID NO: 1991153 - DNA, 22 bp, Homo sapiens
aagtttacagtaaataaattgt

SEQ ID NO: 1991154 - DNA, 12 bp, Homo sapiens
aagtttataagc

SEQ ID NO: 1991155 - DNA, 16 bp, Homo sapiens
aagtttcaatgtgatt

SEQ ID NO: 1991156 - DNA, 22 bp, Homo sapiens
aagtttcaccttgggtttgtat

SEQ ID NO: 1991157 - DNA, 15 bp, Homo sapiens
aagtttcatcatttt

SEQ ID NO: 1991158 - DNA, 18 bp, Homo sapiens
aagtttcttggtctcagc

SEQ ID NO: 1991159 - DNA, 15 bp, Homo sapiens
aagtttgatcaaatc

SEQ ID NO: 1991160 - DNA, 15 bp, Homo sapiens
aagtttgatttcatt

SEQ ID NO: 1991161 - DNA, 19 bp, Homo sapiens
aagtttggcaatagtttgc

SEQ ID NO: 1991162 - DNA, 15 bp, Homo sapiens
aagttttgagtttct

SEQ ID NO: 1991163 - DNA, 19 bp, Homo sapiens
aagttttgatgaaattctt

SEQ ID NO: 1991164 - DNA, 15 bp, Homo sapiens
aagttttgcatttat

SEQ ID NO: 1991165 - DNA, 14 bp, Homo sapiens
aagttttgtacaga

SEQ ID NO: 1991166 - DNA, 19 bp, Homo sapiens
aagtttttacaaaatacta

SEQ ID NO: 1991167 - DNA, 17 bp, Homo sapiens
aataaaaaaatacagta

SEQ ID NO: 1991168 - DNA, 19 bp, Homo sapiens
aataaaaaaatacagtaaa

SEQ ID NO: 1991169 - DNA, 15 bp, Homo sapiens
aataaaaaacatttg

SEQ ID NO: 1991170 - DNA, 13 bp, Homo sapiens
aataaaaaatgga

SEQ ID NO: 1991171 - DNA, 13 bp, Homo sapiens
aataaaaaccaga

SEQ ID NO: 1991172 - DNA, 21 bp, Homo sapiens
aataaaaactgactccttaga

SEQ ID NO: 1991173 - DNA, 21 bp, Homo sapiens
aataaaaatttgtttaaagtt

SEQ ID NO: 1991174 - DNA, 13 bp, Homo sapiens
aataaaaccagct

SEQ ID NO: 1991175 - DNA, 20 bp, Homo sapiens
aataaaacccagcatgtaca

SEQ ID NO: 1991176 - DNA, 22 bp, Homo sapiens
aataaaacctttcaaatttcac

SEQ ID NO: 1991177 - DNA, 22 bp, Homo sapiens
aataaaacttatgctagtttat

SEQ ID NO: 1991178 - DNA, 16 bp, Homo sapiens
aataaaactttatgga

SEQ ID NO: 1991179 - DNA, 21 bp, Homo sapiens
aataaaagcagcatctgctaa

SEQ ID NO: 1991180 - DNA, 18 bp, Homo sapiens
aataaaatagtattgaaa

SEQ ID NO: 1991181 - DNA, 14 bp, Homo sapiens
aataaaattgcact

SEQ ID NO: 1991182 - DNA, 15 bp, Homo sapiens
aataaaattgcactt

SEQ ID NO: 1991183 - DNA, 13 bp, Homo sapiens
aataaacatcctt

SEQ ID NO: 1991184 - DNA, 16 bp, Homo sapiens
aataaaccaaaggaca

SEQ ID NO: 1991185 - DNA, 14 bp, Homo sapiens
aataaaccattttt

SEQ ID NO: 1991186 - DNA, 13 bp, Homo sapiens
aataaacctggag

SEQ ID NO: 1991187 - DNA, 17 bp, Homo sapiens
aataaacctggagatga

SEQ ID NO: 1991188 - DNA, 21 bp, Homo sapiens
aataaacctggagatgatgat

SEQ ID NO: 1991189 - DNA, 17 bp, Homo sapiens
aataaacttagaataaa

SEQ ID NO: 1991190 - DNA, 22 bp, Homo sapiens
aataaacttagaataaaattgt

SEQ ID NO: 1991191 - DNA, 12 bp, Homo sapiens
aataaagaaaaa

SEQ ID NO: 1991192 - DNA, 13 bp, Homo sapiens
aataaagaaaaac

SEQ ID NO: 1991193 - DNA, 21 bp, Homo sapiens
aataaagaactccttattttg

SEQ ID NO: 1991194 - DNA, 13 bp, Homo sapiens
aataaagagctca

SEQ ID NO: 1991195 - DNA, 15 bp, Homo sapiens
aataaagcctgcttt

SEQ ID NO: 1991196 - DNA, 19 bp, Homo sapiens
aataaagctactgaattta

SEQ ID NO: 1991197 - DNA, 23 bp, Homo sapiens
aataaagctactgaatttattgc

SEQ ID NO: 1991198 - DNA, 13 bp, Homo sapiens
aataaagctggac

SEQ ID NO: 1991199 - DNA, 21 bp, Homo sapiens
aataaagctggacaagaagct

SEQ ID NO: 1991200 - DNA, 19 bp, Homo sapiens
aataaagggaaacgaatgt

SEQ ID NO: 1991201 - DNA, 15 bp, Homo sapiens
aataaagtatcatgc

SEQ ID NO: 1991202 - DNA, 16 bp, Homo sapiens
aataaagtctgagtgg

SEQ ID NO: 1991203 - DNA, 16 bp, Homo sapiens
aataaagttagtgtgt

SEQ ID NO: 1991204 - DNA, 19 bp, Homo sapiens
aataaagttctgagtgttt

SEQ ID NO: 1991205 - DNA, 14 bp, Homo sapiens
aataaataaatgca

SEQ ID NO: 1991206 - DNA, 11 bp, Homo sapiens
aataaatataa

SEQ ID NO: 1991207 - DNA, 16 bp, Homo sapiens
aataaatattctgcat

SEQ ID NO: 1991208 - DNA, 13 bp, Homo sapiens
aataaatatttta

SEQ ID NO: 1991209 - DNA, 13 bp, Homo sapiens
aataaatgaatct

SEQ ID NO: 1991210 - DNA, 21 bp, Homo sapiens
aataaatgccaactggtcact

SEQ ID NO: 1991211 - DNA, 12 bp, Homo sapiens
aataaatgctga

SEQ ID NO: 1991212 - DNA, 15 bp, Homo sapiens
aataaatggaaatca

SEQ ID NO: 1991213 - DNA, 12 bp, Homo sapiens
aataaatgtgcc

SEQ ID NO: 1991214 - DNA, 14 bp, Homo sapiens
aataaatgtgtaaa

SEQ ID NO: 1991215 - DNA, 16 bp, Homo sapiens
aataaattgctccttg

SEQ ID NO: 1991216 - DNA, 18 bp, Homo sapiens
aataaattggtgataagt

SEQ ID NO: 1991217 - DNA, 23 bp, Homo sapiens
aataaattggtgataagtggaaa

SEQ ID NO: 1991218 - DNA, 20 bp, Homo sapiens
aatccacaaagccgtgcctt

SEQ ID NO: 1991219 - DNA, 21 bp, Homo sapiens
aatccacaaagccgtgccttt

SEQ ID NO: 1991220 - DNA, 13 bp, Homo sapiens
aatccagaaagaa

SEQ ID NO: 1991221 - DNA, 17 bp, Homo sapiens
aatccagaaagaaaaaa

SEQ ID NO: 1991222 - DNA, 17 bp, Homo sapiens
aatccagacccggctgc

SEQ ID NO: 1991223 - DNA, 19 bp, Homo sapiens
aatccaggtgggagagaca

SEQ ID NO: 1991224 - DNA, 21 bp, Homo sapiens
aatccaggtgggagagacact

SEQ ID NO: 1991225 - DNA, 17 bp, Homo sapiens
aatccagtgtgcacccc

SEQ ID NO: 1991226 - DNA, 17 bp, Homo sapiens
aatccatgttagttttt

SEQ ID NO: 1991227 - DNA, 13 bp, Homo sapiens
aatcccagctact

SEQ ID NO: 1991228 - DNA, 14 bp, Homo sapiens
aatcccagctactc

SEQ ID NO: 1991229 - DNA, 18 bp, Homo sapiens
aatcccagctactcagga

SEQ ID NO: 1991230 - DNA, 18 bp, Homo sapiens
aatcccattcataacttt

SEQ ID NO: 1991231 - DNA, 23 bp, Homo sapiens
aatccccccttcagaacagaggc

SEQ ID NO: 1991232 - DNA, 22 bp, Homo sapiens
aatccccggctgcttccttctg

SEQ ID NO: 1991233 - DNA, 17 bp, Homo sapiens
aatccgcctgcagagga

SEQ ID NO: 1991234 - DNA, 22 bp, Homo sapiens
aatcctagaaccaagcttcaga

SEQ ID NO: 1991235 - DNA, 23 bp, Homo sapiens
aatcctagaaccaagcttcagag

SEQ ID NO: 1991236 - DNA, 18 bp, Homo sapiens
aatcctattaaaacacag

SEQ ID NO: 1991237 - DNA, 18 bp, Homo sapiens
aatcctcaggatttcatt

SEQ ID NO: 1991238 - DNA, 11 bp, Homo sapiens
aatcctctggc

SEQ ID NO: 1991239 - DNA, 12 bp, Homo sapiens
aatcctgaagaa

SEQ ID NO: 1991240 - DNA, 18 bp, Homo sapiens
aatcctgagtctgggcaa

SEQ ID NO: 1991241 - DNA, 12 bp, Homo sapiens
aatcctgcctct

SEQ ID NO: 1991242 - DNA, 13 bp, Homo sapiens
aatcctgcctctc

SEQ ID NO: 1991243 - DNA, 13 bp, Homo sapiens
aatcctgtccctc

SEQ ID NO: 1991244 - DNA, 17 bp, Homo sapiens
aatccttgggagtcatt

SEQ ID NO: 1991245 - DNA, 20 bp, Homo sapiens
aatcctttttctttataaac

SEQ ID NO: 1991246 - DNA, 14 bp, Homo sapiens
aatcgaaatgaatt

SEQ ID NO: 1991247 - DNA, 21 bp, Homo sapiens
aatcggatctggggctctggg

SEQ ID NO: 1991248 - DNA, 16 bp, Homo sapiens
aatcgttatgtgtgta

SEQ ID NO: 1991249 - DNA, 14 bp, Homo sapiens
aatctaaaagcttt

SEQ ID NO: 1991250 - DNA, 20 bp, Homo sapiens
aatctaatattaaaaatatg

SEQ ID NO: 1991251 - DNA, 21 bp, Homo sapiens
aatctagatcaattaattctt

SEQ ID NO: 1991252 - DNA, 14 bp, Homo sapiens
aatctatattaaag

SEQ ID NO: 1991253 - DNA, 17 bp, Homo sapiens
aatctatattaaagtgt

SEQ ID NO: 1991254 - DNA, 15 bp, Homo sapiens
aatctatctatataa

SEQ ID NO: 1991255 - DNA, 18 bp, Homo sapiens
aatctattcagacaagca

SEQ ID NO: 1991256 - DNA, 20 bp, Homo sapiens
aatctcaaattctcaaccta

SEQ ID NO: 1991257 - DNA, 15 bp, Homo sapiens
aatctcagagacagg

SEQ ID NO: 1991258 - DNA, 11 bp, Homo sapiens
aatctccaggg

SEQ ID NO: 1991259 - DNA, 11 bp, Homo sapiens
aatctctgtga

SEQ ID NO: 1991260 - DNA, 13 bp, Homo sapiens
aatctctgtgact

SEQ ID NO: 1991261 - DNA, 20 bp, Homo sapiens
aatctctgtgactcgcttag

SEQ ID NO: 1991262 - DNA, 20 bp, Homo sapiens
aatctgaagctattgatgtt

SEQ ID NO: 1991263 - DNA, 15 bp, Homo sapiens
aatctgataggaaaa

SEQ ID NO: 1991264 - DNA, 23 bp, Homo sapiens
aatctgcagggagcaactctcca

SEQ ID NO: 1991265 - DNA, 16 bp, Homo sapiens
aatctgcattattgga

SEQ ID NO: 1991266 - DNA, 17 bp, Homo sapiens
aatctgcattattggaa

SEQ ID NO: 1991267 - DNA, 17 bp, Homo sapiens
aatctgcctttgtttct

SEQ ID NO: 1991268 - DNA, 15 bp, Homo sapiens
aatctggactcctct

SEQ ID NO: 1991269 - DNA, 18 bp, Homo sapiens
aatctggactcctctgtc

SEQ ID NO: 1991270 - DNA, 18 bp, Homo sapiens
aatctggcaaagttatat

SEQ ID NO: 1991271 - DNA, 21 bp, Homo sapiens
aatctggctcctgtttccatg

SEQ ID NO: 1991272 - DNA, 15 bp, Homo sapiens
aatctgtagggctgg

SEQ ID NO: 1991273 - DNA, 16 bp, Homo sapiens
aatctgtagggctgga

SEQ ID NO: 1991274 - DNA, 16 bp, Homo sapiens
aatctgtatatgttgt

SEQ ID NO: 1991275 - DNA, 17 bp, Homo sapiens
aatctgttttgtatatg

SEQ ID NO: 1991276 - DNA, 22 bp, Homo sapiens
aatctgttttgtatatgatcta

SEQ ID NO: 1991277 - DNA, 15 bp, Homo sapiens
aatcttaaaagtgta

SEQ ID NO: 1991278 - DNA, 13 bp, Homo sapiens
aatcttagcatgc

SEQ ID NO: 1991279 - DNA, 15 bp, Homo sapiens
aatcttatattccat

SEQ ID NO: 1991280 - DNA, 19 bp, Homo sapiens
aatcttcaaggtgtaaaat

SEQ ID NO: 1991281 - DNA, 13 bp, Homo sapiens
aatcttgaaaatg

SEQ ID NO: 1991282 - DNA, 17 bp, Homo sapiens
aatctttctttacctga

SEQ ID NO: 1991283 - DNA, 22 bp, Homo sapiens
aatctttcttttgattcttcct

SEQ ID NO: 1991284 - DNA, 16 bp, Homo sapiens
aatcttttataggatt

SEQ ID NO: 1991285 - DNA, 20 bp, Homo sapiens
aatctttttttaataatttc

SEQ ID NO: 1991286 - DNA, 22 bp, Homo sapiens
aatctttttttaataatttcat

SEQ ID NO: 1991287 - DNA, 21 bp, Homo sapiens
aatgaaaataagtgaataata

SEQ ID NO: 1991288 - DNA, 13 bp, Homo sapiens
aatgaaaatgtca

SEQ ID NO: 1991289 - DNA, 16 bp, Homo sapiens
aatgaaacaaagagtt

SEQ ID NO: 1991290 - DNA, 20 bp, Homo sapiens
aatgaaacaaataatcacat

SEQ ID NO: 1991291 - DNA, 19 bp, Homo sapiens
aatgaaacagatgataaat

SEQ ID NO: 1991292 - DNA, 14 bp, Homo sapiens
aatgaaaccaaagc

SEQ ID NO: 1991293 - DNA, 17 bp, Homo sapiens
aatgaaaccaaagccag

SEQ ID NO: 1991294 - DNA, 17 bp, Homo sapiens
aatgaaagcatgtctca

SEQ ID NO: 1991295 - DNA, 15 bp, Homo sapiens
aatgaaagcatgtgg

SEQ ID NO: 1991296 - DNA, 22 bp, Homo sapiens
aatgaaagcatgtggcatgttc

SEQ ID NO: 1991297 - DNA, 13 bp, Homo sapiens
aatgaaatatttg

SEQ ID NO: 1991298 - DNA, 15 bp, Homo sapiens
aatgaaatatttgct

SEQ ID NO: 1991299 - DNA, 18 bp, Homo sapiens
aatgaaatgctctccttt

SEQ ID NO: 1991300 - DNA, 13 bp, Homo sapiens
aatgaaatgtctt

SEQ ID NO: 1991301 - DNA, 15 bp, Homo sapiens
aatgaacagaacata

SEQ ID NO: 1991302 - DNA, 15 bp, Homo sapiens
aatgaacagcagaaa

SEQ ID NO: 1991303 - DNA, 17 bp, Homo sapiens
aatgaaccacatcttgc

SEQ ID NO: 1991304 - DNA, 15 bp, Homo sapiens
aatgaactgtgacag

SEQ ID NO: 1991305 - DNA, 14 bp, Homo sapiens
aatgaagacctaaa

SEQ ID NO: 1991306 - DNA, 20 bp, Homo sapiens
aatgaagacctaaatgacct

SEQ ID NO: 1991307 - DNA, 13 bp, Homo sapiens
aatgaagcatgta

SEQ ID NO: 1991308 - DNA, 15 bp, Homo sapiens
aatgaagcatgtagc

SEQ ID NO: 1991309 - DNA, 14 bp, Homo sapiens
aatgaatatctgct

SEQ ID NO: 1991310 - DNA, 12 bp, Homo sapiens
aatgaatgacct

SEQ ID NO: 1991311 - DNA, 21 bp, Homo sapiens
aatgaattctctctaaaaata

SEQ ID NO: 1991312 - DNA, 15 bp, Homo sapiens
aatgacaacagaagc

SEQ ID NO: 1991313 - DNA, 16 bp, Homo sapiens
aatgacaacagaagct

SEQ ID NO: 1991314 - DNA, 22 bp, Homo sapiens
aatgacagtccgtcaaaacaga

SEQ ID NO: 1991315 - DNA, 18 bp, Homo sapiens
aatgacatcttcaaagct

SEQ ID NO: 1991316 - DNA, 12 bp, Homo sapiens
aatgacatgcac

SEQ ID NO: 1991317 - DNA, 19 bp, Homo sapiens
aatgacatgcactgaccct

SEQ ID NO: 1991318 - DNA, 17 bp, Homo sapiens
aatgaccaagaaaaaga

SEQ ID NO: 1991319 - DNA, 19 bp, Homo sapiens
aatgaccacgggcctcagt

SEQ ID NO: 1991320 - DNA, 17 bp, Homo sapiens
aatgactaaaaatatta

SEQ ID NO: 1991321 - DNA, 24 bp, Homo sapiens
aatgactaaaaatattataactta

SEQ ID NO: 1991322 - DNA, 15 bp, Homo sapiens
aatgactttttataa

SEQ ID NO: 1991323 - DNA, 18 bp, Homo sapiens
aatgactttttataatgt

SEQ ID NO: 1991324 - DNA, 14 bp, Homo sapiens
aatgagaacattta

SEQ ID NO: 1991325 - DNA, 15 bp, Homo sapiens
aatgagaacatttac

SEQ ID NO: 1991326 - DNA, 16 bp, Homo sapiens
aatgagaacatttaca

SEQ ID NO: 1991327 - DNA, 14 bp, Homo sapiens
aatgagaacttcaa

SEQ ID NO: 1991328 - DNA, 16 bp, Homo sapiens
aatgagatagtagcat

SEQ ID NO: 1991329 - DNA, 13 bp, Homo sapiens
aatgagctcctgc

SEQ ID NO: 1991330 - DNA, 18 bp, Homo sapiens
aatgaggagagaaggaca

SEQ ID NO: 1991331 - DNA, 21 bp, Homo sapiens
aatgagggaaattgctatttt

SEQ ID NO: 1991332 - DNA, 21 bp, Homo sapiens
aatgagggactggaaccaggg

SEQ ID NO: 1991333 - DNA, 15 bp, Homo sapiens
aattcatttttttca

SEQ ID NO: 1991334 - DNA, 14 bp, Homo sapiens
aattccactggact

SEQ ID NO: 1991335 - DNA, 22 bp, Homo sapiens
aattcccattttgcaaaatttc

SEQ ID NO: 1991336 - DNA, 12 bp, Homo sapiens
aattccccagat

SEQ ID NO: 1991337 - DNA, 23 bp, Homo sapiens
aattccctatcttttagttttag

SEQ ID NO: 1991338 - DNA, 13 bp, Homo sapiens
aattcctctggga

SEQ ID NO: 1991339 - DNA, 14 bp, Homo sapiens
aattcctctgggaa

SEQ ID NO: 1991340 - DNA, 11 bp, Homo sapiens
aattcctgggc

SEQ ID NO: 1991341 - DNA, 23 bp, Homo sapiens
aattcctgggctcaagcagtcct

SEQ ID NO: 1991342 - DNA, 13 bp, Homo sapiens
aattccttagctt

SEQ ID NO: 1991343 - DNA, 12 bp, Homo sapiens
aattccttccca

SEQ ID NO: 1991344 - DNA, 12 bp, Homo sapiens
aattctaaaatg

SEQ ID NO: 1991345 - DNA, 13 bp, Homo sapiens
aattctaaatgaa

SEQ ID NO: 1991346 - DNA, 19 bp, Homo sapiens
aattctaagattgtacata

SEQ ID NO: 1991347 - DNA, 16 bp, Homo sapiens
aattctacaggatggg

SEQ ID NO: 1991348 - DNA, 22 bp, Homo sapiens
aattctacaggatggggacact

SEQ ID NO: 1991349 - DNA, 18 bp, Homo sapiens
aattctcgggaaattatt

SEQ ID NO: 1991350 - DNA, 20 bp, Homo sapiens
aattctgcaactagccaagg

SEQ ID NO: 1991351 - DNA, 20 bp, Homo sapiens
aattctgcaatgttttcctt

SEQ ID NO: 1991352 - DNA, 10 bp, Homo sapiens
aattctgctt

SEQ ID NO: 1991353 - DNA, 18 bp, Homo sapiens
aattctggaaatgtcttt

SEQ ID NO: 1991354 - DNA, 19 bp, Homo sapiens
aattctggaaatgtctttc

SEQ ID NO: 1991355 - DNA, 15 bp, Homo sapiens
aattctgtgaagaat

SEQ ID NO: 1991356 - DNA, 19 bp, Homo sapiens
aattcttattttttaaaaa

SEQ ID NO: 1991357 - DNA, 13 bp, Homo sapiens
aattcttggaata

SEQ ID NO: 1991358 - DNA, 19 bp, Homo sapiens
aattctttacaataaacat

SEQ ID NO: 1991359 - DNA, 15 bp, Homo sapiens
aattgactcaaatct

SEQ ID NO: 1991360 - DNA, 14 bp, Homo sapiens
aattgatacttcag

SEQ ID NO: 1991361 - DNA, 22 bp, Homo sapiens
aattgatcataggtatttcaaa

SEQ ID NO: 1991362 - DNA, 21 bp, Homo sapiens
aattgcctccttatttatcaa

SEQ ID NO: 1991363 - DNA, 18 bp, Homo sapiens
aattgctagtgatttcat

SEQ ID NO: 1991364 - DNA, 15 bp, Homo sapiens
aattgctattttatt

SEQ ID NO: 1991365 - DNA, 22 bp, Homo sapiens
aattgctattttatttgtattc

SEQ ID NO: 1991366 - DNA, 20 bp, Homo sapiens
aattgctcctaagcttcaaa

SEQ ID NO: 1991367 - DNA, 15 bp, Homo sapiens
aattgcttacatttt

SEQ ID NO: 1991368 - DNA, 15 bp, Homo sapiens
aattgcttattctag

SEQ ID NO: 1991369 - DNA, 16 bp, Homo sapiens
aattgcttttgttgtg

SEQ ID NO: 1991370 - DNA, 17 bp, Homo sapiens
aattgcttttgttgtga

SEQ ID NO: 1991371 - DNA, 23 bp, Homo sapiens
aattgggattttaaaaacatgag

SEQ ID NO: 1991372 - DNA, 18 bp, Homo sapiens
aattggtatcaagaaagt

SEQ ID NO: 1991373 - DNA, 21 bp, Homo sapiens
aattggtgacaatgtcacata

SEQ ID NO: 1991374 - DNA, 16 bp, Homo sapiens
aattggtgataagtgg

SEQ ID NO: 1991375 - DNA, 18 bp, Homo sapiens
aattgtaaaattgtatag

SEQ ID NO: 1991376 - DNA, 13 bp, Homo sapiens
aattgtatacatt

SEQ ID NO: 1991377 - DNA, 15 bp, Homo sapiens
aattgtatagagata

SEQ ID NO: 1991378 - DNA, 18 bp, Homo sapiens
aattgtatcatttgaaca

SEQ ID NO: 1991379 - DNA, 12 bp, Homo sapiens
aattgtatgtta

SEQ ID NO: 1991380 - DNA, 16 bp, Homo sapiens
aattgtccatgtgctt

SEQ ID NO: 1991381 - DNA, 21 bp, Homo sapiens
aattgtgcgacttcacaaaat

SEQ ID NO: 1991382 - DNA, 21 bp, Homo sapiens
aattgtgtacaaagtagagaa

SEQ ID NO: 1991383 - DNA, 17 bp, Homo sapiens
aattgtgtttagatttt

SEQ ID NO: 1991384 - DNA, 23 bp, Homo sapiens
aattgttgctaatcttcttatgc

SEQ ID NO: 1991385 - DNA, 15 bp, Homo sapiens
aattgtttaagtgtt

SEQ ID NO: 1991386 - DNA, 20 bp, Homo sapiens
aattgtttggcttcctcctg

SEQ ID NO: 1991387 - DNA, 21 bp, Homo sapiens
aattgtttggcttcctcctga

SEQ ID NO: 1991388 - DNA, 22 bp, Homo sapiens
aattgttttatctgaattttta

SEQ ID NO: 1991389 - DNA, 19 bp, Homo sapiens
aatttaaaccagcagaaaa

SEQ ID NO: 1991390 - DNA, 20 bp, Homo sapiens
aatttaaaccagcagaaaag

SEQ ID NO: 1991391 - DNA, 22 bp, Homo sapiens
aatttaaagttgtttgtgcctt

SEQ ID NO: 1991392 - DNA, 17 bp, Homo sapiens
aatttaactaatttaaa

SEQ ID NO: 1991393 - DNA, 18 bp, Homo sapiens
aatttaactaatttaaac

SEQ ID NO: 1991394 - DNA, 19 bp, Homo sapiens
aatttaactaatttaaacc

SEQ ID NO: 1991395 - DNA, 14 bp, Homo sapiens
aatttaatgcatgt

SEQ ID NO: 1991396 - DNA, 17 bp, Homo sapiens
aatttaattaatcgaaa

SEQ ID NO: 1991397 - DNA, 12 bp, Homo sapiens
aatttaattcca

SEQ ID NO: 1991398 - DNA, 12 bp, Homo sapiens
aatttagaaaac

SEQ ID NO: 1991399 - DNA, 18 bp, Homo sapiens
aatttagaaaacattcat

SEQ ID NO: 1991400 - DNA, 14 bp, Homo sapiens
aatttagaaatcat

SEQ ID NO: 1991401 - DNA, 15 bp, Homo sapiens
aatttagaaatcatt

SEQ ID NO: 1991402 - DNA, 17 bp, Homo sapiens
aatttagacttcaagca

SEQ ID NO: 1991403 - DNA, 21 bp, Homo sapiens
aatttagtttcatataaagta

SEQ ID NO: 1991404 - DNA, 14 bp, Homo sapiens
aatttataaaatta

SEQ ID NO: 1991405 - DNA, 15 bp, Homo sapiens
aatttataaaattag

SEQ ID NO: 1991406 - DNA, 12 bp, Homo sapiens
aatttatacaaa

SEQ ID NO: 1991407 - DNA, 13 bp, Homo sapiens
aatttatacaaaa

SEQ ID NO: 1991408 - DNA, 14 bp, Homo sapiens
aatttatacaaaat

SEQ ID NO: 1991409 - DNA, 17 bp, Homo sapiens
aatttatacaaaataat

SEQ ID NO: 1991410 - DNA, 20 bp, Homo sapiens
aatttatacaaaataattta

SEQ ID NO: 1991411 - DNA, 17 bp, Homo sapiens
aatttatatttgaaatt

SEQ ID NO: 1991412 - DNA, 18 bp, Homo sapiens
aatttatatttgaaattt

SEQ ID NO: 1991413 - DNA, 13 bp, Homo sapiens
aatttatctgaat

SEQ ID NO: 1991414 - DNA, 19 bp, Homo sapiens
aatttatcttgtctctggg

SEQ ID NO: 1991415 - DNA, 19 bp, Homo sapiens
aatttatgagtttttgata

SEQ ID NO: 1991416 - DNA, 14 bp, Homo sapiens
aatttatggtttct

SEQ ID NO: 1991417 - DNA, 16 bp, Homo sapiens
aatttattaagtctgg

SEQ ID NO: 1991418 - DNA, 17 bp, Homo sapiens
aatttattagttaatat

SEQ ID NO: 1991419 - DNA, 12 bp, Homo sapiens
aatttattcaat

SEQ ID NO: 1991420 - DNA, 13 bp, Homo sapiens
aatttattttgta

SEQ ID NO: 1991421 - DNA, 16 bp, Homo sapiens
aatttcaggcattttg

SEQ ID NO: 1991422 - DNA, 17 bp, Homo sapiens
aatttcaggcattttgt

SEQ ID NO: 1991423 - DNA, 24 bp, Homo sapiens
aatttccagtgagcttatcatgct

SEQ ID NO: 1991424 - DNA, 22 bp, Homo sapiens
aatttcccacaccccagcgcct

SEQ ID NO: 1991425 - DNA, 14 bp, Homo sapiens
aatttcctatctgt

SEQ ID NO: 1991426 - DNA, 16 bp, Homo sapiens
aatttcctatctgtat

SEQ ID NO: 1991427 - DNA, 16 bp, Homo sapiens
aatttcctttatattt

SEQ ID NO: 1991428 - DNA, 18 bp, Homo sapiens
aatttctaccatttcaga

SEQ ID NO: 1991429 - DNA, 21 bp, Homo sapiens
aatttcttactaaacattttg

SEQ ID NO: 1991430 - DNA, 21 bp, Homo sapiens
aatttcttcactgttgaaaat

SEQ ID NO: 1991431 - DNA, 17 bp, Homo sapiens
aatttcttggtaagaag

SEQ ID NO: 1991432 - DNA, 20 bp, Homo sapiens
aatttcttggtaagaagccg

SEQ ID NO: 1991433 - DNA, 18 bp, Homo sapiens
aatttgaaaataattgtt

SEQ ID NO: 1991434 - DNA, 16 bp, Homo sapiens
aatttgagcaattcat

SEQ ID NO: 1991435 - DNA, 18 bp, Homo sapiens
aatttgagcaattcattt

SEQ ID NO: 1991436 - DNA, 22 bp, Homo sapiens
aatttgagcaattcatttcact

SEQ ID NO: 1991437 - DNA, 21 bp, Homo sapiens
aatttgatagtattgtgcata

SEQ ID NO: 1991438 - DNA, 14 bp, Homo sapiens
aatttgcactgtta

SEQ ID NO: 1991439 - DNA, 22 bp, Homo sapiens
aatttgccaccactagagctga

SEQ ID NO: 1991440 - DNA, 16 bp, Homo sapiens
aatttgcctgtaacaa

SEQ ID NO: 1991441 - DNA, 22 bp, Homo sapiens
aatttgcctgtaacaagccaga

SEQ ID NO: 1991442 - DNA, 22 bp, Homo sapiens
aatttggatttacgactgaaga

SEQ ID NO: 1991443 - DNA, 18 bp, Homo sapiens
aatttggcctgcactaat

SEQ ID NO: 1991444 - DNA, 16 bp, Homo sapiens
aatttgggaattgtgt

SEQ ID NO: 1991445 - DNA, 23 bp, Homo sapiens
aatttggtgtggctgtattcaga

SEQ ID NO: 1991446 - DNA, 16 bp, Homo sapiens
aatttggttctaatag

SEQ ID NO: 1991447 - DNA, 17 bp, Homo sapiens
aatttggttctaggccg

SEQ ID NO: 1991448 - DNA, 17 bp, Homo sapiens
acacctgccctgccctg

SEQ ID NO: 1991449 - DNA, 18 bp, Homo sapiens
acacctgccctgccctgc

SEQ ID NO: 1991450 - DNA, 18 bp, Homo sapiens
acacctggccgcctccag

SEQ ID NO: 1991451 - DNA, 19 bp, Homo sapiens
acacctgtcagcccaagca

SEQ ID NO: 1991452 - DNA, 16 bp, Homo sapiens
acaccttagcagctct

SEQ ID NO: 1991453 - DNA, 16 bp, Homo sapiens
acaccttgacagggca

SEQ ID NO: 1991454 - DNA, 18 bp, Homo sapiens
acaccttttgtatttaaa

SEQ ID NO: 1991455 - DNA, 22 bp, Homo sapiens
acaccttttgtatttaaaacct

SEQ ID NO: 1991456 - DNA, 16 bp, Homo sapiens
acacgcaagggcatca

SEQ ID NO: 1991457 - DNA, 21 bp, Homo sapiens
acacgcaagggcatcaggcac

SEQ ID NO: 1991458 - DNA, 23 bp, Homo sapiens
acacgcaagggcatcaggcactg

SEQ ID NO: 1991459 - DNA, 17 bp, Homo sapiens
acacggccctgccccat

SEQ ID NO: 1991460 - DNA, 19 bp, Homo sapiens
acacggccctgccccatcc

SEQ ID NO: 1991461 - DNA, 16 bp, Homo sapiens
acacggggtattttag

SEQ ID NO: 1991462 - DNA, 17 bp, Homo sapiens
acacggggtattttagg

SEQ ID NO: 1991463 - DNA, 15 bp, Homo sapiens
acacggtaggccaag

SEQ ID NO: 1991464 - DNA, 16 bp, Homo sapiens
acacggtaggccaagc

SEQ ID NO: 1991465 - DNA, 15 bp, Homo sapiens
acacggtgaaatcca

SEQ ID NO: 1991466 - DNA, 23 bp, Homo sapiens
acacgtacttaaatgaaagcatg

SEQ ID NO: 1991467 - DNA, 20 bp, Homo sapiens
acacgtgctcgcagcctggc

SEQ ID NO: 1991468 - DNA, 21 bp, Homo sapiens
acacgtggaggtgaagtccct

SEQ ID NO: 1991469 - DNA, 16 bp, Homo sapiens
acacgtggcctgcacc

SEQ ID NO: 1991470 - DNA, 12 bp, Homo sapiens
acacgtgtcctg

SEQ ID NO: 1991471 - DNA, 15 bp, Homo sapiens
acactaaccacgctg

SEQ ID NO: 1991472 - DNA, 16 bp, Homo sapiens
acactaaccacgctgg

SEQ ID NO: 1991473 - DNA, 19 bp, Homo sapiens
acactaaccacgctggacc

SEQ ID NO: 1991474 - DNA, 14 bp, Homo sapiens
acactaagggtgta

SEQ ID NO: 1991475 - DNA, 23 bp, Homo sapiens
acactaagttatagtatatctgg

SEQ ID NO: 1991476 - DNA, 15 bp, Homo sapiens
acactaatgaagata

SEQ ID NO: 1991477 - DNA, 12 bp, Homo sapiens
acactaattcct

SEQ ID NO: 1991478 - DNA, 20 bp, Homo sapiens
acactaccttatcaggcaaa

SEQ ID NO: 1991479 - DNA, 18 bp, Homo sapiens
acactatggtatttgagt

SEQ ID NO: 1991480 - DNA, 15 bp, Homo sapiens
acactcagaagcctg

SEQ ID NO: 1991481 - DNA, 19 bp, Homo sapiens
acactcagaagcctggggg

SEQ ID NO: 1991482 - DNA, 14 bp, Homo sapiens
acactcagcagccc

SEQ ID NO: 1991483 - DNA, 20 bp, Homo sapiens
acactccaccccctccagct

SEQ ID NO: 1991484 - DNA, 12 bp, Homo sapiens
acactccagcct

SEQ ID NO: 1991485 - DNA, 19 bp, Homo sapiens
acactctagtgacttcctg

SEQ ID NO: 1991486 - DNA, 22 bp, Homo sapiens
acactctagtgacttcctggtg

SEQ ID NO: 1991487 - DNA, 18 bp, Homo sapiens
acactgaagtgcttgcag

SEQ ID NO: 1991488 - DNA, 22 bp, Homo sapiens
acactgaccttggagagacaca

SEQ ID NO: 1991489 - DNA, 23 bp, Homo sapiens
acactgaccttggagagacacag

SEQ ID NO: 1991490 - DNA, 17 bp, Homo sapiens
acactgagctgggcacc

SEQ ID NO: 1991491 - DNA, 14 bp, Homo sapiens
acactgctgcacca

SEQ ID NO: 1991492 - DNA, 21 bp, Homo sapiens
acactgtatttgtatctctga

SEQ ID NO: 1991493 - DNA, 16 bp, Homo sapiens
acactgtcagagctgt

SEQ ID NO: 1991494 - DNA, 22 bp, Homo sapiens
acactgtgcgttttagagtatg

SEQ ID NO: 1991495 - DNA, 13 bp, Homo sapiens
acactgtgctata

SEQ ID NO: 1991496 - DNA, 22 bp, Homo sapiens
acactgtgtcccccccagtgca

SEQ ID NO: 1991497 - DNA, 16 bp, Homo sapiens
acactgttactccaca

SEQ ID NO: 1991498 - DNA, 20 bp, Homo sapiens
acacttaagggttttagaaa

SEQ ID NO: 1991499 - DNA, 15 bp, Homo sapiens
acacttcaggctctt

SEQ ID NO: 1991500 - DNA, 22 bp, Homo sapiens
acacttcaggctcttctccttt

SEQ ID NO: 1991501 - DNA, 14 bp, Homo sapiens
acacttctcaggac

SEQ ID NO: 1991502 - DNA, 14 bp, Homo sapiens
acacttctcatcat

SEQ ID NO: 1991503 - DNA, 22 bp, Homo sapiens
acacttcttcttggtcttattt

SEQ ID NO: 1991504 - DNA, 16 bp, Homo sapiens
acacttgtataaatgt

SEQ ID NO: 1991505 - DNA, 20 bp, Homo sapiens
acacttgtataaatgtatat

SEQ ID NO: 1991506 - DNA, 21 bp, Homo sapiens
acactttggccaagcaagagg

SEQ ID NO: 1991507 - DNA, 18 bp, Homo sapiens
acagaaaaaaataaaaac

SEQ ID NO: 1991508 - DNA, 21 bp, Homo sapiens
acagaaaacaaaagagagaat

SEQ ID NO: 1991509 - DNA, 15 bp, Homo sapiens
acagaaacagagaga

SEQ ID NO: 1991510 - DNA, 22 bp, Homo sapiens
acagaaacagagagagacagag

SEQ ID NO: 1991511 - DNA, 18 bp, Homo sapiens
acagaaatactgctctga

SEQ ID NO: 1991512 - DNA, 22 bp, Homo sapiens
acagaacaattaaacagccaaa

SEQ ID NO: 1991513 - DNA, 13 bp, Homo sapiens
acagaaccagagg

SEQ ID NO: 1991514 - DNA, 20 bp, Homo sapiens
acagaaccagagggttgtac

SEQ ID NO: 1991515 - DNA, 20 bp, Homo sapiens
acagaactgctaaatactgt

SEQ ID NO: 1991516 - DNA, 16 bp, Homo sapiens
acagaagaaggcagca

SEQ ID NO: 1991517 - DNA, 15 bp, Homo sapiens
acagaagccaggagc

SEQ ID NO: 1991518 - DNA, 13 bp, Homo sapiens
acagaagcttcag

SEQ ID NO: 1991519 - DNA, 14 bp, Homo sapiens
acagaagcttcaga

SEQ ID NO: 1991520 - DNA, 19 bp, Homo sapiens
acagaagcttcagaagttt

SEQ ID NO: 1991521 - DNA, 16 bp, Homo sapiens
acagaatgatgccaaa

SEQ ID NO: 1991522 - DNA, 15 bp, Homo sapiens
acagaattctgctac

SEQ ID NO: 1991523 - DNA, 13 bp, Homo sapiens
acagaatttttaa

SEQ ID NO: 1991524 - DNA, 14 bp, Homo sapiens
acagaatttttaat

SEQ ID NO: 1991525 - DNA, 16 bp, Homo sapiens
acagaatttttaatga

SEQ ID NO: 1991526 - DNA, 18 bp, Homo sapiens
acagaatttttaatgact

SEQ ID NO: 1991527 - DNA, 19 bp, Homo sapiens
acagacaaaaacagcctca

SEQ ID NO: 1991528 - DNA, 14 bp, Homo sapiens
acagacaacagaag

SEQ ID NO: 1991529 - DNA, 11 bp, Homo sapiens
acagacacagg

SEQ ID NO: 1991530 - DNA, 15 bp, Homo sapiens
acagacacaggcccg

SEQ ID NO: 1991531 - DNA, 18 bp, Homo sapiens
acagacacaggcccggct

SEQ ID NO: 1991532 - DNA, 23 bp, Homo sapiens
acagacacaggcccggctccagg

SEQ ID NO: 1991533 - DNA, 18 bp, Homo sapiens
acagacactaagttatag

SEQ ID NO: 1991534 - DNA, 15 bp, Homo sapiens
acagacaggagaaat

SEQ ID NO: 1991535 - DNA, 19 bp, Homo sapiens
acagacagggcctagcttt

SEQ ID NO: 1991536 - DNA, 16 bp, Homo sapiens
acagactccctcccct

SEQ ID NO: 1991537 - DNA, 23 bp, Homo sapiens
acagactccctcccctgccccca

SEQ ID NO: 1991538 - DNA, 17 bp, Homo sapiens
acagactggaagcacag

SEQ ID NO: 1991539 - DNA, 19 bp, Homo sapiens
acagactggaagcacagct

SEQ ID NO: 1991540 - DNA, 15 bp, Homo sapiens
acagacttctccaga

SEQ ID NO: 1991541 - DNA, 16 bp, Homo sapiens
acagacttctccagac

SEQ ID NO: 1991542 - DNA, 22 bp, Homo sapiens
acagacttctggaaggctggct

SEQ ID NO: 1991543 - DNA, 23 bp, Homo sapiens
acagacttctggaaggctggctg

SEQ ID NO: 1991544 - DNA, 14 bp, Homo sapiens
acagactttagctt

SEQ ID NO: 1991545 - DNA, 12 bp, Homo sapiens
acagagaatctg

SEQ ID NO: 1991546 - DNA, 18 bp, Homo sapiens
acagagaatctgaagcta

SEQ ID NO: 1991547 - DNA, 17 bp, Homo sapiens
acagagacacctgcacc

SEQ ID NO: 1991548 - DNA, 23 bp, Homo sapiens
acagagacagaaacagagagaga

SEQ ID NO: 1991549 - DNA, 23 bp, Homo sapiens
acagagacaggcccaagagatga

SEQ ID NO: 1991550 - DNA, 20 bp, Homo sapiens
acagagacccagatctcatg

SEQ ID NO: 1991551 - DNA, 14 bp, Homo sapiens
acagagagagactg

SEQ ID NO: 1991552 - DNA, 20 bp, Homo sapiens
acagagcactaggttcaatt

SEQ ID NO: 1991553 - DNA, 14 bp, Homo sapiens
acagagcccccaag

SEQ ID NO: 1991554 - DNA, 15 bp, Homo sapiens
acagagcccccaagc

SEQ ID NO: 1991555 - DNA, 22 bp, Homo sapiens
acagagcctgaatttgtaagca

SEQ ID NO: 1991556 - DNA, 12 bp, Homo sapiens
acagagcctgcc

SEQ ID NO: 1991557 - DNA, 17 bp, Homo sapiens
acagagcctgcctcagc

SEQ ID NO: 1991558 - DNA, 22 bp, Homo sapiens
acagagcgggcctcttccctca

SEQ ID NO: 1991559 - DNA, 22 bp, Homo sapiens
acagagcgtggctgtgctctca

SEQ ID NO: 1991560 - DNA, 19 bp, Homo sapiens
acagagctggctgtcttcc

SEQ ID NO: 1991561 - DNA, 21 bp, Homo sapiens
acagagctgggatgtttctgt

SEQ ID NO: 1991562 - DNA, 17 bp, Homo sapiens
acattccaaagaacagc

SEQ ID NO: 1991563 - DNA, 21 bp, Homo sapiens
acattccctatcaaaacatat

SEQ ID NO: 1991564 - DNA, 22 bp, Homo sapiens
acattcctagagagcagaaata

SEQ ID NO: 1991565 - DNA, 22 bp, Homo sapiens
acattcctcagctgccaagcac

SEQ ID NO: 1991566 - DNA, 14 bp, Homo sapiens
acattcctggcccc

SEQ ID NO: 1991567 - DNA, 18 bp, Homo sapiens
acattctcacaattgtaa

SEQ ID NO: 1991568 - DNA, 19 bp, Homo sapiens
acattctcacaattgtaaa

SEQ ID NO: 1991569 - DNA, 14 bp, Homo sapiens
acattctgtaaaat

SEQ ID NO: 1991570 - DNA, 16 bp, Homo sapiens
acattcttaaaggaaa

SEQ ID NO: 1991571 - DNA, 16 bp, Homo sapiens
acattgacttcttggt

SEQ ID NO: 1991572 - DNA, 21 bp, Homo sapiens
acattgatttattttttaatc

SEQ ID NO: 1991573 - DNA, 23 bp, Homo sapiens
acattgcctccacctctccttgg

SEQ ID NO: 1991574 - DNA, 17 bp, Homo sapiens
acattgggaaatcttat

SEQ ID NO: 1991575 - DNA, 11 bp, Homo sapiens
acattgtgcca

SEQ ID NO: 1991576 - DNA, 16 bp, Homo sapiens
acattgtgcttggccc

SEQ ID NO: 1991577 - DNA, 15 bp, Homo sapiens
acattgttgctccct

SEQ ID NO: 1991578 - DNA, 13 bp, Homo sapiens
acatttaagtggt

SEQ ID NO: 1991579 - DNA, 14 bp, Homo sapiens
acatttaagtggtt

SEQ ID NO: 1991580 - DNA, 16 bp, Homo sapiens
acatttaatacagcag

SEQ ID NO: 1991581 - DNA, 17 bp, Homo sapiens
acatttaatacagcagt

SEQ ID NO: 1991582 - DNA, 14 bp, Homo sapiens
acatttactgacca

SEQ ID NO: 1991583 - DNA, 18 bp, Homo sapiens
acatttataatgtttgct

SEQ ID NO: 1991584 - DNA, 18 bp, Homo sapiens
acatttatatatatatgt

SEQ ID NO: 1991585 - DNA, 14 bp, Homo sapiens
acatttattctgct

SEQ ID NO: 1991586 - DNA, 19 bp, Homo sapiens
acatttatttcaaactatt

SEQ ID NO: 1991587 - DNA, 14 bp, Homo sapiens
acatttcaaagctg

SEQ ID NO: 1991588 - DNA, 22 bp, Homo sapiens
acatttcataaggcctgccctc

SEQ ID NO: 1991589 - DNA, 11 bp, Homo sapiens
acatttccctc

SEQ ID NO: 1991590 - DNA, 20 bp, Homo sapiens
acatttctatagccaaaaat

SEQ ID NO: 1991591 - DNA, 17 bp, Homo sapiens
acatttgatgtacatgt

SEQ ID NO: 1991592 - DNA, 19 bp, Homo sapiens
acatttgatgtacatgtgt

SEQ ID NO: 1991593 - DNA, 13 bp, Homo sapiens
acatttgccttgc

SEQ ID NO: 1991594 - DNA, 16 bp, Homo sapiens
acatttgtacattcct

SEQ ID NO: 1991595 - DNA, 14 bp, Homo sapiens
acattttaaataaa

SEQ ID NO: 1991596 - DNA, 18 bp, Homo sapiens
acattttatatctggatt

SEQ ID NO: 1991597 - DNA, 10 bp, Homo sapiens
acattttatt

SEQ ID NO: 1991598 - DNA, 20 bp, Homo sapiens
acattttctcctaggagaag

SEQ ID NO: 1991599 - DNA, 19 bp, Homo sapiens
acattttctctttaaaaga

SEQ ID NO: 1991600 - DNA, 23 bp, Homo sapiens
acattttctttctttttctggaa

SEQ ID NO: 1991601 - DNA, 22 bp, Homo sapiens
accaaactgcacacacagctcc

SEQ ID NO: 1991602 - DNA, 17 bp, Homo sapiens
accaaagagactggagc

SEQ ID NO: 1991603 - DNA, 15 bp, Homo sapiens
accaaagcaatattt

SEQ ID NO: 1991604 - DNA, 14 bp, Homo sapiens
accaaatattttag

SEQ ID NO: 1991605 - DNA, 15 bp, Homo sapiens
accaaatattttagc

SEQ ID NO: 1991606 - DNA, 13 bp, Homo sapiens
accaaattgcttc

SEQ ID NO: 1991607 - DNA, 15 bp, Homo sapiens
accaaattgcttcta

SEQ ID NO: 1991608 - DNA, 22 bp, Homo sapiens
accaacacccaaagcatggact

SEQ ID NO: 1991609 - DNA, 15 bp, Homo sapiens
accaacataaaaatg

SEQ ID NO: 1991610 - DNA, 23 bp, Homo sapiens
accaacataaaaatgatctaaac

SEQ ID NO: 1991611 - DNA, 21 bp, Homo sapiens
accaacatcccattgccctgg

SEQ ID NO: 1991612 - DNA, 15 bp, Homo sapiens
accaaccctcagagc

SEQ ID NO: 1991613 - DNA, 13 bp, Homo sapiens
accaacctgacca

SEQ ID NO: 1991614 - DNA, 19 bp, Homo sapiens
accaactatttttgaggaa

SEQ ID NO: 1991615 - DNA, 12 bp, Homo sapiens
accaactttctg

SEQ ID NO: 1991616 - DNA, 14 bp, Homo sapiens
accaactttctgta

SEQ ID NO: 1991617 - DNA, 20 bp, Homo sapiens
accaagaattacaagtagaa

SEQ ID NO: 1991618 - DNA, 13 bp, Homo sapiens
accaagagagaaa

SEQ ID NO: 1991619 - DNA, 20 bp, Homo sapiens
accaagatacttaagtgctg

SEQ ID NO: 1991620 - DNA, 21 bp, Homo sapiens
accaagatacttaagtgctgc

SEQ ID NO: 1991621 - DNA, 14 bp, Homo sapiens
accaagccgtggct

SEQ ID NO: 1991622 - DNA, 16 bp, Homo sapiens
accaagccgtggcttc

SEQ ID NO: 1991623 - DNA, 17 bp, Homo sapiens
accaagccgtggcttcc

SEQ ID NO: 1991624 - DNA, 17 bp, Homo sapiens
accaagctcacagttcc

SEQ ID NO: 1991625 - DNA, 14 bp, Homo sapiens
accaagcttcagag

SEQ ID NO: 1991626 - DNA, 15 bp, Homo sapiens
accaagcttcagagc

SEQ ID NO: 1991627 - DNA, 16 bp, Homo sapiens
accaagcttcagagcc

SEQ ID NO: 1991628 - DNA, 19 bp, Homo sapiens
accaagcttcagagcctag

SEQ ID NO: 1991629 - DNA, 18 bp, Homo sapiens
accaaggcagcctccaga

SEQ ID NO: 1991630 - DNA, 22 bp, Homo sapiens
accaaggcagcctccagagcca

SEQ ID NO: 1991631 - DNA, 24 bp, Homo sapiens
accaaggcagcctccagagccagc

SEQ ID NO: 1991632 - DNA, 15 bp, Homo sapiens
accaaggcccagcta

SEQ ID NO: 1991633 - DNA, 15 bp, Homo sapiens
accaagtatttatta

SEQ ID NO: 1991634 - DNA, 16 bp, Homo sapiens
accaagttacttgaaa

SEQ ID NO: 1991635 - DNA, 23 bp, Homo sapiens
accaagttataaatcaatgtcac

SEQ ID NO: 1991636 - DNA, 12 bp, Homo sapiens
accaataaaaat

SEQ ID NO: 1991637 - DNA, 16 bp, Homo sapiens
accaataacttcagag

SEQ ID NO: 1991638 - DNA, 16 bp, Homo sapiens
accaatactactgtaa

SEQ ID NO: 1991639 - DNA, 21 bp, Homo sapiens
accaatactactgtaaatgta

SEQ ID NO: 1991640 - DNA, 12 bp, Homo sapiens
accaatcatttt

SEQ ID NO: 1991641 - DNA, 13 bp, Homo sapiens
accaatcatttta

SEQ ID NO: 1991642 - DNA, 18 bp, Homo sapiens
accaatcccgtgaaagaa

SEQ ID NO: 1991643 - DNA, 22 bp, Homo sapiens
accaatcccgtgaaagaattat

SEQ ID NO: 1991644 - DNA, 15 bp, Homo sapiens
accaatctctgtgac

SEQ ID NO: 1991645 - DNA, 16 bp, Homo sapiens
accaatctctgtgact

SEQ ID NO: 1991646 - DNA, 22 bp, Homo sapiens
accaatgcatgcagccactgtg

SEQ ID NO: 1991647 - DNA, 16 bp, Homo sapiens
accaatgccaagataa

SEQ ID NO: 1991648 - DNA, 14 bp, Homo sapiens
accaatgtacccac

SEQ ID NO: 1991649 - DNA, 21 bp, Homo sapiens
accaatgtacccaccgggcca

SEQ ID NO: 1991650 - DNA, 17 bp, Homo sapiens
accacaccaaacctctc

SEQ ID NO: 1991651 - DNA, 15 bp, Homo sapiens
accacacccagccca

SEQ ID NO: 1991652 - DNA, 15 bp, Homo sapiens
accacacctccctga

SEQ ID NO: 1991653 - DNA, 11 bp, Homo sapiens
accacactgaa

SEQ ID NO: 1991654 - DNA, 23 bp, Homo sapiens
accacaggcatctacacagcctg

SEQ ID NO: 1991655 - DNA, 15 bp, Homo sapiens
accacaggcccttgg

SEQ ID NO: 1991656 - DNA, 23 bp, Homo sapiens
accacaggctgcctcatgaccct

SEQ ID NO: 1991657 - DNA, 13 bp, Homo sapiens
accacagtgtctg

SEQ ID NO: 1991658 - DNA, 14 bp, Homo sapiens
accacatctacaat

SEQ ID NO: 1991659 - DNA, 14 bp, Homo sapiens
accacatcttgctc

SEQ ID NO: 1991660 - DNA, 13 bp, Homo sapiens
accaccaaatgac

SEQ ID NO: 1991661 - DNA, 20 bp, Homo sapiens
accaccacacccagcccact

SEQ ID NO: 1991662 - DNA, 17 bp, Homo sapiens
accaccgaagaggaagc

SEQ ID NO: 1991663 - DNA, 16 bp, Homo sapiens
accacctaggccactc

SEQ ID NO: 1991664 - DNA, 18 bp, Homo sapiens
accacctaggccactcct

SEQ ID NO: 1991665 - DNA, 21 bp, Homo sapiens
accacctaggccactcctcca

SEQ ID NO: 1991666 - DNA, 23 bp, Homo sapiens
accacctctcaatattcaataaa

SEQ ID NO: 1991667 - DNA, 19 bp, Homo sapiens
accacctgccagccatcac

SEQ ID NO: 1991668 - DNA, 20 bp, Homo sapiens
accacctgccagccatcaca

SEQ ID NO: 1991669 - DNA, 20 bp, Homo sapiens
accacctgcttctgaactca

SEQ ID NO: 1991670 - DNA, 16 bp, Homo sapiens
accaccttcccagctc

SEQ ID NO: 1991671 - DNA, 17 bp, Homo sapiens
accaccttcccagctct

SEQ ID NO: 1991672 - DNA, 22 bp, Homo sapiens
accaccttcccagctctccctc

SEQ ID NO: 1991673 - DNA, 21 bp, Homo sapiens
accaccttggactcctcccac

SEQ ID NO: 1991674 - DNA, 22 bp, Homo sapiens
accaccttggactcctcccaca

SEQ ID NO: 1991675 - DNA, 16 bp, Homo sapiens
accacgatgtggccct

SEQ ID NO: 1991676 - DNA, 18 bp, Homo sapiens
accacgatgtggccctgg

SEQ ID NO: 1991677 - DNA, 14 bp, Homo sapiens
accacgctggacct

SEQ ID NO: 1991678 - DNA, 16 bp, Homo sapiens
accacgctggaccttg

SEQ ID NO: 1991679 - DNA, 16 bp, Homo sapiens
accacgggcctcagtt

SEQ ID NO: 1991680 - DNA, 13 bp, Homo sapiens
accacgtctgcca

SEQ ID NO: 1991681 - DNA, 15 bp, Homo sapiens
accacgtctgccagg

SEQ ID NO: 1991682 - DNA, 13 bp, Homo sapiens
accactagagctg

SEQ ID NO: 1991683 - DNA, 14 bp, Homo sapiens
accactagagctga

SEQ ID NO: 1991684 - DNA, 12 bp, Homo sapiens
accactctggca

SEQ ID NO: 1991685 - DNA, 15 bp, Homo sapiens
accactctggcagcc

SEQ ID NO: 1991686 - DNA, 13 bp, Homo sapiens
accactgccctgc

SEQ ID NO: 1991687 - DNA, 15 bp, Homo sapiens
accactgccctgcct

SEQ ID NO: 1991688 - DNA, 16 bp, Homo sapiens
accactggttaaaata

SEQ ID NO: 1991689 - DNA, 19 bp, Homo sapiens
accactgtaaaatgaaatt

SEQ ID NO: 1991690 - DNA, 21 bp, Homo sapiens
accactgtggcgttctgctgc

SEQ ID NO: 1991691 - DNA, 22 bp, Homo sapiens
accactgtggcgttctgctgcc

SEQ ID NO: 1991692 - DNA, 18 bp, Homo sapiens
accacttaaaaaatgtcc

SEQ ID NO: 1991693 - DNA, 14 bp, Homo sapiens
accacttacttcgt

SEQ ID NO: 1991694 - DNA, 14 bp, Homo sapiens
accacttggctgct

SEQ ID NO: 1991695 - DNA, 15 bp, Homo sapiens
accagaatcataatt

SEQ ID NO: 1991696 - DNA, 23 bp, Homo sapiens
accagaatcataattttcaagag

SEQ ID NO: 1991697 - DNA, 14 bp, Homo sapiens
accagacaccttga

SEQ ID NO: 1991698 - DNA, 17 bp, Homo sapiens
accagacaccttgacag

SEQ ID NO: 1991699 - DNA, 19 bp, Homo sapiens
accagacctagacctgggc

SEQ ID NO: 1991700 - DNA, 20 bp, Homo sapiens
accagacctagacctgggcc

SEQ ID NO: 1991701 - DNA, 21 bp, Homo sapiens
accagactgtggagaaataaa

SEQ ID NO: 1991702 - DNA, 15 bp, Homo sapiens
accagagcagagagc

SEQ ID NO: 1991703 - DNA, 10 bp, Homo sapiens
accagagccc

SEQ ID NO: 1991704 - DNA, 16 bp, Homo sapiens
accagagcccaccttg

SEQ ID NO: 1991705 - DNA, 12 bp, Homo sapiens
accagagcccat

SEQ ID NO: 1991706 - DNA, 16 bp, Homo sapiens
accagagcccatgctc

SEQ ID NO: 1991707 - DNA, 15 bp, Homo sapiens
accagaggctgcaga

SEQ ID NO: 1991708 - DNA, 17 bp, Homo sapiens
accagagggaacacggc

SEQ ID NO: 1991709 - DNA, 24 bp, Homo sapiens
accagatgagaagttaagcagcct

SEQ ID NO: 1991710 - DNA, 14 bp, Homo sapiens
accagcagaaaagt

SEQ ID NO: 1991711 - DNA, 15 bp, Homo sapiens
accagcagaaaagtg

SEQ ID NO: 1991712 - DNA, 22 bp, Homo sapiens
accagcagaaaagtgcttagaa

SEQ ID NO: 1991713 - DNA, 21 bp, Homo sapiens
accagcaggtgtggtggctca

SEQ ID NO: 1991714 - DNA, 22 bp, Homo sapiens
accagcaggtgtggtggctcat

SEQ ID NO: 1991715 - DNA, 20 bp, Homo sapiens
accagcatgtcactcccaga

SEQ ID NO: 1991716 - DNA, 13 bp, Homo sapiens
accagcattttac

SEQ ID NO: 1991717 - DNA, 16 bp, Homo sapiens
accagccacacagagc

SEQ ID NO: 1991718 - DNA, 22 bp, Homo sapiens
accagccatcatgtgcctggaa

SEQ ID NO: 1991719 - DNA, 20 bp, Homo sapiens
accagccccagtgcccacag

SEQ ID NO: 1991720 - DNA, 14 bp, Homo sapiens
accagccccctgga

SEQ ID NO: 1991721 - DNA, 15 bp, Homo sapiens
accagccccctggat

SEQ ID NO: 1991722 - DNA, 21 bp, Homo sapiens
accagccccctggatgggcat

SEQ ID NO: 1991723 - DNA, 13 bp, Homo sapiens
accagcccttccc

SEQ ID NO: 1991724 - DNA, 20 bp, Homo sapiens
accagccgaccggccctgcc

SEQ ID NO: 1991725 - DNA, 15 bp, Homo sapiens
accagctatctgtca

SEQ ID NO: 1991726 - DNA, 17 bp, Homo sapiens
accagctatctgtcatc

SEQ ID NO: 1991727 - DNA, 21 bp, Homo sapiens
accagctatctgtcatctctc

SEQ ID NO: 1991728 - DNA, 23 bp, Homo sapiens
accagctatctgtcatctctctg

SEQ ID NO: 1991729 - DNA, 13 bp, Homo sapiens
accagctctgtgg

SEQ ID NO: 1991730 - DNA, 16 bp, Homo sapiens
accagctctgtggcct

SEQ ID NO: 1991731 - DNA, 12 bp, Homo sapiens
accagctgaaag

SEQ ID NO: 1991732 - DNA, 20 bp, Homo sapiens
accagctgccaaaatcgtag

SEQ ID NO: 1991733 - DNA, 10 bp, Homo sapiens
accagctgct

SEQ ID NO: 1991734 - DNA, 17 bp, Homo sapiens
accagctgctctgcccc

SEQ ID NO: 1991735 - DNA, 17 bp, Homo sapiens
accagctgctgctctga

SEQ ID NO: 1991736 - DNA, 17 bp, Homo sapiens
accagctgtaacacagc

SEQ ID NO: 1991737 - DNA, 20 bp, Homo sapiens
accaggaatgttaaagtcag

SEQ ID NO: 1991738 - DNA, 21 bp, Homo sapiens
accaggactatagcccaggtc

SEQ ID NO: 1991739 - DNA, 17 bp, Homo sapiens
accaggagtccctggta

SEQ ID NO: 1991740 - DNA, 18 bp, Homo sapiens
accaggatcgctttgtac

SEQ ID NO: 1991741 - DNA, 14 bp, Homo sapiens
accaggatgaaggc

SEQ ID NO: 1991742 - DNA, 14 bp, Homo sapiens
accaggatggccct

SEQ ID NO: 1991743 - DNA, 21 bp, Homo sapiens
accaggcacgaacccacctgc

SEQ ID NO: 1991744 - DNA, 23 bp, Homo sapiens
accaggcacgaacccacctgctg

SEQ ID NO: 1991745 - DNA, 14 bp, Homo sapiens
accaggccgggctt

SEQ ID NO: 1991746 - DNA, 21 bp, Homo sapiens
accagggagaccgagcgcttt

SEQ ID NO: 1991747 - DNA, 14 bp, Homo sapiens
accagggaggagag

SEQ ID NO: 1991748 - DNA, 20 bp, Homo sapiens
accagggcactgtctgcgtg

SEQ ID NO: 1991749 - DNA, 20 bp, Homo sapiens
accagggtccgcaccagctg

SEQ ID NO: 1991750 - DNA, 21 bp, Homo sapiens
accagggtccgcaccagctgc

SEQ ID NO: 1991751 - DNA, 23 bp, Homo sapiens
accagggtccgcaccagctgctc

SEQ ID NO: 1991752 - DNA, 22 bp, Homo sapiens
accagggtgcatggcttgggga

SEQ ID NO: 1991753 - DNA, 14 bp, Homo sapiens
accaggttgaaaga

SEQ ID NO: 1991754 - DNA, 21 bp, Homo sapiens
accagtatggaagggaggggt

SEQ ID NO: 1991755 - DNA, 15 bp, Homo sapiens
accagtcaagagcaa

SEQ ID NO: 1991756 - DNA, 17 bp, Homo sapiens
accagtgaaccaaagag

SEQ ID NO: 1991757 - DNA, 23 bp, Homo sapiens
accagtgcccaaagtctgtgtga

SEQ ID NO: 1991758 - DNA, 19 bp, Homo sapiens
accagtgccgcctgtgccc

SEQ ID NO: 1991759 - DNA, 15 bp, Homo sapiens
accagtgtactgctt

SEQ ID NO: 1991760 - DNA, 16 bp, Homo sapiens
accataaaaagaggat

SEQ ID NO: 1991761 - DNA, 14 bp, Homo sapiens
accatacattatca

SEQ ID NO: 1991762 - DNA, 17 bp, Homo sapiens
accatactcatttctaa

SEQ ID NO: 1991763 - DNA, 19 bp, Homo sapiens
accatactcatttctaaaa

SEQ ID NO: 1991764 - DNA, 22 bp, Homo sapiens
accatagcacaggctaattttt

SEQ ID NO: 1991765 - DNA, 19 bp, Homo sapiens
accatattcagtgctgtgg

SEQ ID NO: 1991766 - DNA, 12 bp, Homo sapiens
accatcaccctc

SEQ ID NO: 1991767 - DNA, 14 bp, Homo sapiens
accatcaccctctg

SEQ ID NO: 1991768 - DNA, 18 bp, Homo sapiens
accatcaccctctgggca

SEQ ID NO: 1991769 - DNA, 13 bp, Homo sapiens
accatcagttact

SEQ ID NO: 1991770 - DNA, 17 bp, Homo sapiens
accatcagttactggtt

SEQ ID NO: 1991771 - DNA, 23 bp, Homo sapiens
accatcagttactggtttcagtt

SEQ ID NO: 1991772 - DNA, 17 bp, Homo sapiens
accatcatgtctggcta

SEQ ID NO: 1991773 - DNA, 16 bp, Homo sapiens
accatcctatttaact

SEQ ID NO: 1991774 - DNA, 15 bp, Homo sapiens
accatcctttactat

SEQ ID NO: 1991775 - DNA, 20 bp, Homo sapiens
accatctgtcttgccagcca

SEQ ID NO: 1991776 - DNA, 23 bp, Homo sapiens
accatctgtcttgccagccagaa

SEQ ID NO: 1991777 - DNA, 13 bp, Homo sapiens
accatgaagctgg

SEQ ID NO: 1991778 - DNA, 17 bp, Homo sapiens
accatgcagcttcatca

SEQ ID NO: 1991779 - DNA, 16 bp, Homo sapiens
accatgcgctgctcaa

SEQ ID NO: 1991780 - DNA, 19 bp, Homo sapiens
accatgcgctgctcaacct

SEQ ID NO: 1991781 - DNA, 21 bp, Homo sapiens
accatgctgctttttggcaca

SEQ ID NO: 1991782 - DNA, 23 bp, Homo sapiens
accatgctgctttttggcacagt

SEQ ID NO: 1991783 - DNA, 14 bp, Homo sapiens
accatggacacatt

SEQ ID NO: 1991784 - DNA, 16 bp, Homo sapiens
accatggagacaagaa

SEQ ID NO: 1991785 - DNA, 15 bp, Homo sapiens
accatggaggcaggc

SEQ ID NO: 1991786 - DNA, 20 bp, Homo sapiens
accatgtagttttaacagaa

SEQ ID NO: 1991787 - DNA, 21 bp, Homo sapiens
accatgtagttttaacagaac

SEQ ID NO: 1991788 - DNA, 19 bp, Homo sapiens
accatgtttgagctcagac

SEQ ID NO: 1991789 - DNA, 17 bp, Homo sapiens
accattacatgtttaaa

SEQ ID NO: 1991790 - DNA, 18 bp, Homo sapiens
accattacatgtttaaat

SEQ ID NO: 1991791 - DNA, 22 bp, Homo sapiens
accattcacatttgatgtacat

SEQ ID NO: 1991792 - DNA, 17 bp, Homo sapiens
acctcagctgcacattc

SEQ ID NO: 1991793 - DNA, 13 bp, Homo sapiens
acctcaggccagg

SEQ ID NO: 1991794 - DNA, 21 bp, Homo sapiens
acctcaggccaggtgcagtgg

SEQ ID NO: 1991795 - DNA, 16 bp, Homo sapiens
acctcagggacaacat

SEQ ID NO: 1991796 - DNA, 21 bp, Homo sapiens
acctcagtaatttagaaatca

SEQ ID NO: 1991797 - DNA, 19 bp, Homo sapiens
acctcagtgtcatttatga

SEQ ID NO: 1991798 - DNA, 12 bp, Homo sapiens
acctcagtttcc

SEQ ID NO: 1991799 - DNA, 17 bp, Homo sapiens
acctcagttttatcatt

SEQ ID NO: 1991800 - DNA, 18 bp, Homo sapiens
acctcagttttatcattt

SEQ ID NO: 1991801 - DNA, 23 bp, Homo sapiens
acctcatgcctggcccccctcca

SEQ ID NO: 1991802 - DNA, 17 bp, Homo sapiens
acctccacccccgccac

SEQ ID NO: 1991803 - DNA, 20 bp, Homo sapiens
acctccacccccgccacggc

SEQ ID NO: 1991804 - DNA, 22 bp, Homo sapiens
acctccacccccgccacggcca

SEQ ID NO: 1991805 - DNA, 17 bp, Homo sapiens
acctccacctcctgagt

SEQ ID NO: 1991806 - DNA, 16 bp, Homo sapiens
acctccagctttcctg

SEQ ID NO: 1991807 - DNA, 18 bp, Homo sapiens
acctccagctttcctgta

SEQ ID NO: 1991808 - DNA, 16 bp, Homo sapiens
acctcccaccccactc

SEQ ID NO: 1991809 - DNA, 18 bp, Homo sapiens
acctcccaccccactcca

SEQ ID NO: 1991810 - DNA, 14 bp, Homo sapiens
acctcccagcccta

SEQ ID NO: 1991811 - DNA, 22 bp, Homo sapiens
acctcccagccctatggatgtg

SEQ ID NO: 1991812 - DNA, 13 bp, Homo sapiens
acctccccccact

SEQ ID NO: 1991813 - DNA, 15 bp, Homo sapiens
acctccccccactgc

SEQ ID NO: 1991814 - DNA, 13 bp, Homo sapiens
acctccccctctt

SEQ ID NO: 1991815 - DNA, 16 bp, Homo sapiens
acctccccctcttggt

SEQ ID NO: 1991816 - DNA, 18 bp, Homo sapiens
acctcccctatccaccca

SEQ ID NO: 1991817 - DNA, 14 bp, Homo sapiens
acctccctgaacca

SEQ ID NO: 1991818 - DNA, 15 bp, Homo sapiens
acctcctagaggtgg

SEQ ID NO: 1991819 - DNA, 16 bp, Homo sapiens
acctcctatccttgga

SEQ ID NO: 1991820 - DNA, 21 bp, Homo sapiens
acctcctatccttggagagca

SEQ ID NO: 1991821 - DNA, 22 bp, Homo sapiens
acctcctattttaattggaatt

SEQ ID NO: 1991822 - DNA, 13 bp, Homo sapiens
acctcctgcccag

SEQ ID NO: 1991823 - DNA, 16 bp, Homo sapiens
acctcctgcccaggag

SEQ ID NO: 1991824 - DNA, 18 bp, Homo sapiens
acctcctgcccaggagag

SEQ ID NO: 1991825 - DNA, 13 bp, Homo sapiens
acctcctgggcta

SEQ ID NO: 1991826 - DNA, 19 bp, Homo sapiens
acctccttgctttgctgtt

SEQ ID NO: 1991827 - DNA, 20 bp, Homo sapiens
acctcgtcctccccctgcca

SEQ ID NO: 1991828 - DNA, 15 bp, Homo sapiens
acctctccttggaaa

SEQ ID NO: 1991829 - DNA, 23 bp, Homo sapiens
acctctcttatagaatatttatt

SEQ ID NO: 1991830 - DNA, 12 bp, Homo sapiens
acctctgctctg

SEQ ID NO: 1991831 - DNA, 15 bp, Homo sapiens
acctctgctgcctcc

SEQ ID NO: 1991832 - DNA, 11 bp, Homo sapiens
acctctgggct

SEQ ID NO: 1991833 - DNA, 21 bp, Homo sapiens
acctctgtgaggaaagcacac

SEQ ID NO: 1991834 - DNA, 15 bp, Homo sapiens
acctcttcctcctgg

SEQ ID NO: 1991835 - DNA, 18 bp, Homo sapiens
acctgaaaaaaagtttac

SEQ ID NO: 1991836 - DNA, 21 bp, Homo sapiens
acctgaaccccatgggcttgg

SEQ ID NO: 1991837 - DNA, 11 bp, Homo sapiens
acctgaagaat

SEQ ID NO: 1991838 - DNA, 14 bp, Homo sapiens
acctgaagaatcac

SEQ ID NO: 1991839 - DNA, 16 bp, Homo sapiens
acctgaagaatcacaa

SEQ ID NO: 1991840 - DNA, 19 bp, Homo sapiens
acctgacaatggcagctag

SEQ ID NO: 1991841 - DNA, 20 bp, Homo sapiens
acctgacaccgtccctcagt

SEQ ID NO: 1991842 - DNA, 22 bp, Homo sapiens
acctgacaccgtccctcagtga

SEQ ID NO: 1991843 - DNA, 19 bp, Homo sapiens
acctgaccaacatggagaa

SEQ ID NO: 1991844 - DNA, 18 bp, Homo sapiens
acctgaccggcacctgcg

SEQ ID NO: 1991845 - DNA, 19 bp, Homo sapiens
acctgacggacgtcctgct

SEQ ID NO: 1991846 - DNA, 23 bp, Homo sapiens
acctgagaccagttgggagcact

SEQ ID NO: 1991847 - DNA, 14 bp, Homo sapiens
acctgagcattcag

SEQ ID NO: 1991848 - DNA, 16 bp, Homo sapiens
acctgagcctgccgag

SEQ ID NO: 1991849 - DNA, 19 bp, Homo sapiens
acctgagccttttcttata

SEQ ID NO: 1991850 - DNA, 21 bp, Homo sapiens
acctgagtcggccccacatgg

SEQ ID NO: 1991851 - DNA, 18 bp, Homo sapiens
acctgatcatggtcagct

SEQ ID NO: 1991852 - DNA, 21 bp, Homo sapiens
acctgcaagccccagggcctg

SEQ ID NO: 1991853 - DNA, 14 bp, Homo sapiens
acctgcaagtgccc

SEQ ID NO: 1991854 - DNA, 20 bp, Homo sapiens
acctgcaagtgcccgccctg

SEQ ID NO: 1991855 - DNA, 21 bp, Homo sapiens
acctgcaagtgcccgccctgc

SEQ ID NO: 1991856 - DNA, 14 bp, Homo sapiens
acctgcacctcccc

SEQ ID NO: 1991857 - DNA, 15 bp, Homo sapiens
acctgcacctccccc

SEQ ID NO: 1991858 - DNA, 17 bp, Homo sapiens
acctgcacctcccccca

SEQ ID NO: 1991859 - DNA, 22 bp, Homo sapiens
acctgcacctccccccactgca

SEQ ID NO: 1991860 - DNA, 17 bp, Homo sapiens
acctgcagttcctgagt

SEQ ID NO: 1991861 - DNA, 12 bp, Homo sapiens
acctgccaccgc

SEQ ID NO: 1991862 - DNA, 13 bp, Homo sapiens
acctgccaccgcc

SEQ ID NO: 1991863 - DNA, 18 bp, Homo sapiens
acctgccaccgccagagg

SEQ ID NO: 1991864 - DNA, 15 bp, Homo sapiens
acctgccagcctggc

SEQ ID NO: 1991865 - DNA, 21 bp, Homo sapiens
acctgccagcctggcttctgg

SEQ ID NO: 1991866 - DNA, 11 bp, Homo sapiens
acctgccccag

SEQ ID NO: 1991867 - DNA, 13 bp, Homo sapiens
acctgccccagcg

SEQ ID NO: 1991868 - DNA, 14 bp, Homo sapiens
acctgccccagcgc

SEQ ID NO: 1991869 - DNA, 15 bp, Homo sapiens
acctgccccctggtg

SEQ ID NO: 1991870 - DNA, 17 bp, Homo sapiens
acctgccctctctcagt

SEQ ID NO: 1991871 - DNA, 17 bp, Homo sapiens
acctgccctgcccccac

SEQ ID NO: 1991872 - DNA, 16 bp, Homo sapiens
acctgccctgccctgc

SEQ ID NO: 1991873 - DNA, 12 bp, Homo sapiens
acctgccgacct

SEQ ID NO: 1991874 - DNA, 13 bp, Homo sapiens
acctgccgacctc

SEQ ID NO: 1991875 - DNA, 17 bp, Homo sapiens
acctgccgacctcgtcc

SEQ ID NO: 1991876 - DNA, 18 bp, Homo sapiens
acctgcctatccatcctg

SEQ ID NO: 1991877 - DNA, 15 bp, Homo sapiens
acctgcctctcacac

SEQ ID NO: 1991878 - DNA, 16 bp, Homo sapiens
acctgcggctgctgtg

SEQ ID NO: 1991879 - DNA, 17 bp, Homo sapiens
acctgctctcctcttgc

SEQ ID NO: 1991880 - DNA, 11 bp, Homo sapiens
acctgctgagc

SEQ ID NO: 1991881 - DNA, 12 bp, Homo sapiens
acctgctgagct

SEQ ID NO: 1991882 - DNA, 19 bp, Homo sapiens
acctgctgagctctgagag

SEQ ID NO: 1991883 - DNA, 21 bp, Homo sapiens
acctgctgagctctgagaggc

SEQ ID NO: 1991884 - DNA, 19 bp, Homo sapiens
acctgctggaaaccacact

SEQ ID NO: 1991885 - DNA, 16 bp, Homo sapiens
acctgcttctgaactc

SEQ ID NO: 1991886 - DNA, 21 bp, Homo sapiens
acctgcttctgaactcaagct

SEQ ID NO: 1991887 - DNA, 16 bp, Homo sapiens
acctgctttctcctgg

SEQ ID NO: 1991888 - DNA, 20 bp, Homo sapiens
acctggagagctagaacctg

SEQ ID NO: 1991889 - DNA, 14 bp, Homo sapiens
acctggagatgatg

SEQ ID NO: 1991890 - DNA, 15 bp, Homo sapiens
acctggagatgatga

SEQ ID NO: 1991891 - DNA, 16 bp, Homo sapiens
acctggagatgatgat

SEQ ID NO: 1991892 - DNA, 23 bp, Homo sapiens
acctggagggctagaacctggag

SEQ ID NO: 1991893 - DNA, 14 bp, Homo sapiens
acctggaggggcta

SEQ ID NO: 1991894 - DNA, 22 bp, Homo sapiens
acctggaggggctagaacctag

SEQ ID NO: 1991895 - DNA, 20 bp, Homo sapiens
acctggcaagctagaacctg

SEQ ID NO: 1991896 - DNA, 19 bp, Homo sapiens
acctggccgcctccaggag

SEQ ID NO: 1991897 - DNA, 20 bp, Homo sapiens
acctggccgcctccaggagc

SEQ ID NO: 1991898 - DNA, 12 bp, Homo sapiens
acctggcctgct

SEQ ID NO: 1991899 - DNA, 16 bp, Homo sapiens
acctggcctgctggga

SEQ ID NO: 1991900 - DNA, 15 bp, Homo sapiens
acctgggaaaggacc

SEQ ID NO: 1991901 - DNA, 14 bp, Homo sapiens
acctgggccctggg

SEQ ID NO: 1991902 - DNA, 18 bp, Homo sapiens
acctgggccctggggcct

SEQ ID NO: 1991903 - DNA, 21 bp, Homo sapiens
acctgggccctggggcctgta

SEQ ID NO: 1991904 - DNA, 23 bp, Homo sapiens
acctgggccctggggcctgtact

SEQ ID NO: 1991905 - DNA, 23 bp, Homo sapiens
acctgggcgccaactgctgatca

SEQ ID NO: 1991906 - DNA, 21 bp, Homo sapiens
acctggggtcatcgattcaaa

SEQ ID NO: 1991907 - DNA, 17 bp, Homo sapiens
actctcaggaggcgcag

SEQ ID NO: 1991908 - DNA, 22 bp, Homo sapiens
actctcaggaggcgcagcccga

SEQ ID NO: 1991909 - DNA, 19 bp, Homo sapiens
actctcaggatcaagaaag

SEQ ID NO: 1991910 - DNA, 15 bp, Homo sapiens
actctcattccccag

SEQ ID NO: 1991911 - DNA, 19 bp, Homo sapiens
actctccaacctggacaac

SEQ ID NO: 1991912 - DNA, 14 bp, Homo sapiens
actctccccctttc

SEQ ID NO: 1991913 - DNA, 13 bp, Homo sapiens
actctcccctccc

SEQ ID NO: 1991914 - DNA, 14 bp, Homo sapiens
actctcccctccct

SEQ ID NO: 1991915 - DNA, 19 bp, Homo sapiens
actctcccctccctcttcc

SEQ ID NO: 1991916 - DNA, 22 bp, Homo sapiens
actctcctcggccccctccatc

SEQ ID NO: 1991917 - DNA, 16 bp, Homo sapiens
actctcctctgcctca

SEQ ID NO: 1991918 - DNA, 22 bp, Homo sapiens
actctccttcgtgtctctccca

SEQ ID NO: 1991919 - DNA, 23 bp, Homo sapiens
actctccttcgtgtctctcccac

SEQ ID NO: 1991920 - DNA, 23 bp, Homo sapiens
actctcggggcccttggggcctg

SEQ ID NO: 1991921 - DNA, 19 bp, Homo sapiens
actctctaaatcttccttg

SEQ ID NO: 1991922 - DNA, 17 bp, Homo sapiens
actctctgagatgtgtt

SEQ ID NO: 1991923 - DNA, 12 bp, Homo sapiens
actctctgctct

SEQ ID NO: 1991924 - DNA, 16 bp, Homo sapiens
actctctgctctagcc

SEQ ID NO: 1991925 - DNA, 18 bp, Homo sapiens
actctctgctctagccag

SEQ ID NO: 1991926 - DNA, 20 bp, Homo sapiens
actctctgctctagccagga

SEQ ID NO: 1991927 - DNA, 10 bp, Homo sapiens
actctgaaaa

SEQ ID NO: 1991928 - DNA, 15 bp, Homo sapiens
actctgaaaaacatt

SEQ ID NO: 1991929 - DNA, 22 bp, Homo sapiens
actctgaaaagcaattgccctg

SEQ ID NO: 1991930 - DNA, 23 bp, Homo sapiens
actctgaaaagcaattgccctgt

SEQ ID NO: 1991931 - DNA, 11 bp, Homo sapiens
actctgagccc

SEQ ID NO: 1991932 - DNA, 17 bp, Homo sapiens
actctgagcccaggccg

SEQ ID NO: 1991933 - DNA, 23 bp, Homo sapiens
actctgaggctctttctgggcca

SEQ ID NO: 1991934 - DNA, 19 bp, Homo sapiens
actctgcacatgtcttgta

SEQ ID NO: 1991935 - DNA, 22 bp, Homo sapiens
actctgcacatgtcttgtacat

SEQ ID NO: 1991936 - DNA, 13 bp, Homo sapiens
actctgcactcca

SEQ ID NO: 1991937 - DNA, 21 bp, Homo sapiens
actctgcactccatggccacc

SEQ ID NO: 1991938 - DNA, 22 bp, Homo sapiens
actctgcactccatggccaccc

SEQ ID NO: 1991939 - DNA, 23 bp, Homo sapiens
actctgcactccatggccacccc

SEQ ID NO: 1991940 - DNA, 16 bp, Homo sapiens
actctgcattctagta

SEQ ID NO: 1991941 - DNA, 20 bp, Homo sapiens
actctgcggtggtgccagag

SEQ ID NO: 1991942 - DNA, 21 bp, Homo sapiens
actctgcggtggtgccagagg

SEQ ID NO: 1991943 - DNA, 13 bp, Homo sapiens
actctgctctgat

SEQ ID NO: 1991944 - DNA, 16 bp, Homo sapiens
actctgctctgatgca

SEQ ID NO: 1991945 - DNA, 14 bp, Homo sapiens
actctggcacccag

SEQ ID NO: 1991946 - DNA, 13 bp, Homo sapiens
actctggcagcca

SEQ ID NO: 1991947 - DNA, 17 bp, Homo sapiens
actctggcctctcgagt

SEQ ID NO: 1991948 - DNA, 19 bp, Homo sapiens
actctgggtttcatatcca

SEQ ID NO: 1991949 - DNA, 16 bp, Homo sapiens
actctgtcagccagcc

SEQ ID NO: 1991950 - DNA, 18 bp, Homo sapiens
actctgtccaggccactg

SEQ ID NO: 1991951 - DNA, 19 bp, Homo sapiens
actctgtccaggccactgt

SEQ ID NO: 1991952 - DNA, 23 bp, Homo sapiens
actctgtccaggccactgtggcc

SEQ ID NO: 1991953 - DNA, 19 bp, Homo sapiens
actctgtctcaaaaaaaca

SEQ ID NO: 1991954 - DNA, 14 bp, Homo sapiens
actctgtgccagag

SEQ ID NO: 1991955 - DNA, 15 bp, Homo sapiens
actctgtgccagagc

SEQ ID NO: 1991956 - DNA, 16 bp, Homo sapiens
actctgtgccagagcc

SEQ ID NO: 1991957 - DNA, 16 bp, Homo sapiens
actctgtggggccttg

SEQ ID NO: 1991958 - DNA, 21 bp, Homo sapiens
actctgtgtcaggtggggcag

SEQ ID NO: 1991959 - DNA, 16 bp, Homo sapiens
actcttatgaaatggg

SEQ ID NO: 1991960 - DNA, 19 bp, Homo sapiens
actcttcaaggtctgcttt

SEQ ID NO: 1991961 - DNA, 13 bp, Homo sapiens
actcttcattttg

SEQ ID NO: 1991962 - DNA, 23 bp, Homo sapiens
actcttcattttgagtctcaggc

SEQ ID NO: 1991963 - DNA, 15 bp, Homo sapiens
actcttcctgcaagg

SEQ ID NO: 1991964 - DNA, 16 bp, Homo sapiens
actcttcctgcaagga

SEQ ID NO: 1991965 - DNA, 23 bp, Homo sapiens
actcttctgagcacctacttaca

SEQ ID NO: 1991966 - DNA, 17 bp, Homo sapiens
actcttgcctttccacc

SEQ ID NO: 1991967 - DNA, 22 bp, Homo sapiens
actcttgcctttccacctgctt

SEQ ID NO: 1991968 - DNA, 20 bp, Homo sapiens
actctttatttctagcagag

SEQ ID NO: 1991969 - DNA, 21 bp, Homo sapiens
actctttatttctagcagagt

SEQ ID NO: 1991970 - DNA, 22 bp, Homo sapiens
actctttatttctagcagagtg

SEQ ID NO: 1991971 - DNA, 22 bp, Homo sapiens
actctttgacgggaggcctcag

SEQ ID NO: 1991972 - DNA, 15 bp, Homo sapiens
actctttgctacaat

SEQ ID NO: 1991973 - DNA, 14 bp, Homo sapiens
actctttgtaagag

SEQ ID NO: 1991974 - DNA, 17 bp, Homo sapiens
actgaaaaatgtcagtc

SEQ ID NO: 1991975 - DNA, 16 bp, Homo sapiens
actgaaaaattttatt

SEQ ID NO: 1991976 - DNA, 19 bp, Homo sapiens
actgaaaactgtaaataca

SEQ ID NO: 1991977 - DNA, 23 bp, Homo sapiens
actgaaaatctaatattaaaaat

SEQ ID NO: 1991978 - DNA, 17 bp, Homo sapiens
actgaaaattatttaaa

SEQ ID NO: 1991979 - DNA, 19 bp, Homo sapiens
actgaaagcagcagctagg

SEQ ID NO: 1991980 - DNA, 14 bp, Homo sapiens
actgaaagtggttt

SEQ ID NO: 1991981 - DNA, 17 bp, Homo sapiens
actgaacgtcctgcagc

SEQ ID NO: 1991982 - DNA, 12 bp, Homo sapiens
actgaagaagga

SEQ ID NO: 1991983 - DNA, 15 bp, Homo sapiens
actgaagaaggatat

SEQ ID NO: 1991984 - DNA, 18 bp, Homo sapiens
actgaagagaccacagca

SEQ ID NO: 1991985 - DNA, 21 bp, Homo sapiens
actgaaggagaaggtgcccca

SEQ ID NO: 1991986 - DNA, 17 bp, Homo sapiens
actgaagttaacagaga

SEQ ID NO: 1991987 - DNA, 21 bp, Homo sapiens
actgaagttaacagagacaga

SEQ ID NO: 1991988 - DNA, 14 bp, Homo sapiens
actgaatcatgtta

SEQ ID NO: 1991989 - DNA, 19 bp, Homo sapiens
actgaatgtttattccttg

SEQ ID NO: 1991990 - DNA, 16 bp, Homo sapiens
actgaattaagttatt

SEQ ID NO: 1991991 - DNA, 17 bp, Homo sapiens
actgaattgtccccagt

SEQ ID NO: 1991992 - DNA, 16 bp, Homo sapiens
actgaatttgggcctc

SEQ ID NO: 1991993 - DNA, 21 bp, Homo sapiens
actgaattttaaatgttcaca

SEQ ID NO: 1991994 - DNA, 20 bp, Homo sapiens
actgacaagaagctcccaga

SEQ ID NO: 1991995 - DNA, 20 bp, Homo sapiens
actgacacaggaaaccaaca

SEQ ID NO: 1991996 - DNA, 16 bp, Homo sapiens
actgacacaggccagc

SEQ ID NO: 1991997 - DNA, 16 bp, Homo sapiens
actgacacctcactga

SEQ ID NO: 1991998 - DNA, 20 bp, Homo sapiens
actgacacctcactgaggaa

SEQ ID NO: 1991999 - DNA, 21 bp, Homo sapiens
actgacacctcactgaggaag

SEQ ID NO: 1992000 - DNA, 18 bp, Homo sapiens
actgacatgtttcacaac

SEQ ID NO: 1992001 - DNA, 17 bp, Homo sapiens
actgacattgttggcca

SEQ ID NO: 1992002 - DNA, 18 bp, Homo sapiens
actgacattgttggccaa

SEQ ID NO: 1992003 - DNA, 13 bp, Homo sapiens
actgaccagcctc

SEQ ID NO: 1992004 - DNA, 23 bp, Homo sapiens
actgaccagcctccatgctgcct

SEQ ID NO: 1992005 - DNA, 16 bp, Homo sapiens
actgaccccctcccct

SEQ ID NO: 1992006 - DNA, 13 bp, Homo sapiens
actgacttctaag

SEQ ID NO: 1992007 - DNA, 22 bp, Homo sapiens
actgacttctaagtaaaaccac

SEQ ID NO: 1992008 - DNA, 16 bp, Homo sapiens
actgagaaatgaatgc

SEQ ID NO: 1992009 - DNA, 13 bp, Homo sapiens
actgagaattttc

SEQ ID NO: 1992010 - DNA, 17 bp, Homo sapiens
actgagacggcagagac

SEQ ID NO: 1992011 - DNA, 13 bp, Homo sapiens
actgagcaagatc

SEQ ID NO: 1992012 - DNA, 19 bp, Homo sapiens
actgagccaaacacactgt

SEQ ID NO: 1992013 - DNA, 23 bp, Homo sapiens
actgagccaaacacactgtaaat

SEQ ID NO: 1992014 - DNA, 20 bp, Homo sapiens
actgaggaattttctttgtg

SEQ ID NO: 1992015 - DNA, 15 bp, Homo sapiens
actgaggaccagcca

SEQ ID NO: 1992016 - DNA, 14 bp, Homo sapiens
actgaggatgtgag

SEQ ID NO: 1992017 - DNA, 16 bp, Homo sapiens
actgaggatgtgagcc

SEQ ID NO: 1992018 - DNA, 23 bp, Homo sapiens
actgaggcagacagcagctcagg

SEQ ID NO: 1992019 - DNA, 15 bp, Homo sapiens
actgaggccattatt

SEQ ID NO: 1992020 - DNA, 13 bp, Homo sapiens
actgagggagaga

SEQ ID NO: 1992021 - DNA, 16 bp, Homo sapiens
agacagagaaatgtga

SEQ ID NO: 1992022 - DNA, 12 bp, Homo sapiens
agacagagacag

SEQ ID NO: 1992023 - DNA, 13 bp, Homo sapiens
agacagagagaga

SEQ ID NO: 1992024 - DNA, 17 bp, Homo sapiens
agacagagagagactga

SEQ ID NO: 1992025 - DNA, 19 bp, Homo sapiens
agacagagcccccaagcct

SEQ ID NO: 1992026 - DNA, 22 bp, Homo sapiens
agacagagcccccaagcctctg

SEQ ID NO: 1992027 - DNA, 20 bp, Homo sapiens
agacagagtctcactgttgc

SEQ ID NO: 1992028 - DNA, 12 bp, Homo sapiens
agacagatacag

SEQ ID NO: 1992029 - DNA, 19 bp, Homo sapiens
agacagcgaactagaagaa

SEQ ID NO: 1992030 - DNA, 21 bp, Homo sapiens
agacagcgaactagaagaaag

SEQ ID NO: 1992031 - DNA, 18 bp, Homo sapiens
agacagctgacagataca

SEQ ID NO: 1992032 - DNA, 20 bp, Homo sapiens
agacaggaaaatcctctggc

SEQ ID NO: 1992033 - DNA, 14 bp, Homo sapiens
agacaggaaagaat

SEQ ID NO: 1992034 - DNA, 21 bp, Homo sapiens
agacaggacagtgcttcagcc

SEQ ID NO: 1992035 - DNA, 18 bp, Homo sapiens
agacaggacctgactatt

SEQ ID NO: 1992036 - DNA, 19 bp, Homo sapiens
agacaggagggcaagggcc

SEQ ID NO: 1992037 - DNA, 20 bp, Homo sapiens
agacaggcaagcacctcctg

SEQ ID NO: 1992038 - DNA, 23 bp, Homo sapiens
agacaggcaagcacctcctgcct

SEQ ID NO: 1992039 - DNA, 16 bp, Homo sapiens
agacaggcccaagaga

SEQ ID NO: 1992040 - DNA, 15 bp, Homo sapiens
agacagtatatttat

SEQ ID NO: 1992041 - DNA, 18 bp, Homo sapiens
agacagtgatctccatat

SEQ ID NO: 1992042 - DNA, 21 bp, Homo sapiens
agacagtgatctccatatgtt

SEQ ID NO: 1992043 - DNA, 13 bp, Homo sapiens
agacagtgtgtgt

SEQ ID NO: 1992044 - DNA, 16 bp, Homo sapiens
agacatacgaaacaca

SEQ ID NO: 1992045 - DNA, 17 bp, Homo sapiens
agacatccatgtttgta

SEQ ID NO: 1992046 - DNA, 20 bp, Homo sapiens
agacatgaaaactattttaa

SEQ ID NO: 1992047 - DNA, 17 bp, Homo sapiens
agacatgaatgcacact

SEQ ID NO: 1992048 - DNA, 19 bp, Homo sapiens
agacatgcagcctaaggct

SEQ ID NO: 1992049 - DNA, 18 bp, Homo sapiens
agacatggagactcctgc

SEQ ID NO: 1992050 - DNA, 20 bp, Homo sapiens
agacattaactcattagact

SEQ ID NO: 1992051 - DNA, 13 bp, Homo sapiens
agacattgcctcc

SEQ ID NO: 1992052 - DNA, 13 bp, Homo sapiens
agaccaaaataaa

SEQ ID NO: 1992053 - DNA, 23 bp, Homo sapiens
agaccaaggcgggagcatctctt

SEQ ID NO: 1992054 - DNA, 18 bp, Homo sapiens
agaccacctccctgccct

SEQ ID NO: 1992055 - DNA, 14 bp, Homo sapiens
agaccacctgccag

SEQ ID NO: 1992056 - DNA, 19 bp, Homo sapiens
agaccacctgccagccatc

SEQ ID NO: 1992057 - DNA, 21 bp, Homo sapiens
agaccacctgccagccatcac

SEQ ID NO: 1992058 - DNA, 18 bp, Homo sapiens
agaccagcccagccaaca

SEQ ID NO: 1992059 - DNA, 20 bp, Homo sapiens
agaccagcccagccaacatg

SEQ ID NO: 1992060 - DNA, 18 bp, Homo sapiens
agaccagttgggagcact

SEQ ID NO: 1992061 - DNA, 22 bp, Homo sapiens
agaccagttgggagcactggag

SEQ ID NO: 1992062 - DNA, 15 bp, Homo sapiens
agaccatcctggccc

SEQ ID NO: 1992063 - DNA, 18 bp, Homo sapiens
agaccatcctggcccctc

SEQ ID NO: 1992064 - DNA, 19 bp, Homo sapiens
agaccatcctggcccctcc

SEQ ID NO: 1992065 - DNA, 16 bp, Homo sapiens
agaccattgtcttcca

SEQ ID NO: 1992066 - DNA, 17 bp, Homo sapiens
agaccattgtcttccaa

SEQ ID NO: 1992067 - DNA, 18 bp, Homo sapiens
agaccattgtcttccaac

SEQ ID NO: 1992068 - DNA, 21 bp, Homo sapiens
agaccattgtcttccaacccc

SEQ ID NO: 1992069 - DNA, 22 bp, Homo sapiens
agaccattgtcttccaacccca

SEQ ID NO: 1992070 - DNA, 23 bp, Homo sapiens
agaccattgtcttccaaccccag

SEQ ID NO: 1992071 - DNA, 13 bp, Homo sapiens
agacccacacatg

SEQ ID NO: 1992072 - DNA, 16 bp, Homo sapiens
agacccagcaggaagc

SEQ ID NO: 1992073 - DNA, 20 bp, Homo sapiens
agacccagtgtaaagaataa

SEQ ID NO: 1992074 - DNA, 16 bp, Homo sapiens
agacccattcctattt

SEQ ID NO: 1992075 - DNA, 12 bp, Homo sapiens
agacccccactc

SEQ ID NO: 1992076 - DNA, 14 bp, Homo sapiens
agacccctggcttt

SEQ ID NO: 1992077 - DNA, 13 bp, Homo sapiens
agacccctgtggc

SEQ ID NO: 1992078 - DNA, 14 bp, Homo sapiens
agacccggctgcgt

SEQ ID NO: 1992079 - DNA, 17 bp, Homo sapiens
agaccctgaagatttca

SEQ ID NO: 1992080 - DNA, 12 bp, Homo sapiens
agaccctgccct

SEQ ID NO: 1992081 - DNA, 14 bp, Homo sapiens
agaccctgcctgag

SEQ ID NO: 1992082 - DNA, 22 bp, Homo sapiens
agaccctgcctgagcccaggag

SEQ ID NO: 1992083 - DNA, 20 bp, Homo sapiens
agaccctggaattcagcacc

SEQ ID NO: 1992084 - DNA, 17 bp, Homo sapiens
agacccttgcattagaa

SEQ ID NO: 1992085 - DNA, 20 bp, Homo sapiens
agaccgcttcacccctgcac

SEQ ID NO: 1992086 - DNA, 19 bp, Homo sapiens
agaccgggggccagacaca

SEQ ID NO: 1992087 - DNA, 17 bp, Homo sapiens
agacctaaatgacctca

SEQ ID NO: 1992088 - DNA, 20 bp, Homo sapiens
agacctaaatgacctcagca

SEQ ID NO: 1992089 - DNA, 16 bp, Homo sapiens
agacctagacctgggc

SEQ ID NO: 1992090 - DNA, 12 bp, Homo sapiens
agacctcagcca

SEQ ID NO: 1992091 - DNA, 16 bp, Homo sapiens
agacctcagcctgtgc

SEQ ID NO: 1992092 - DNA, 17 bp, Homo sapiens
agacctcagcctgtgct

SEQ ID NO: 1992093 - DNA, 13 bp, Homo sapiens
agacctccacatt

SEQ ID NO: 1992094 - DNA, 19 bp, Homo sapiens
agacctctactgccttgga

SEQ ID NO: 1992095 - DNA, 22 bp, Homo sapiens
agacctctcaacagatctgtgg

SEQ ID NO: 1992096 - DNA, 12 bp, Homo sapiens
agacctctgatc

SEQ ID NO: 1992097 - DNA, 17 bp, Homo sapiens
agacctgacaagcactg

SEQ ID NO: 1992098 - DNA, 12 bp, Homo sapiens
agacctgggcca

SEQ ID NO: 1992099 - DNA, 19 bp, Homo sapiens
agaccttctgaagatctca

SEQ ID NO: 1992100 - DNA, 13 bp, Homo sapiens
agacgcagccctg

SEQ ID NO: 1992101 - DNA, 22 bp, Homo sapiens
agacggcagagaccccaggatc

SEQ ID NO: 1992102 - DNA, 13 bp, Homo sapiens
agacggctggacc

SEQ ID NO: 1992103 - DNA, 14 bp, Homo sapiens
agacggctggacct

SEQ ID NO: 1992104 - DNA, 17 bp, Homo sapiens
agacggctggacctgca

SEQ ID NO: 1992105 - DNA, 19 bp, Homo sapiens
agacgtatgcttattttaa

SEQ ID NO: 1992106 - DNA, 14 bp, Homo sapiens
agacgtcctggaat

SEQ ID NO: 1992107 - DNA, 22 bp, Homo sapiens
agacgtcctggaatgaagcatg

SEQ ID NO: 1992108 - DNA, 19 bp, Homo sapiens
agacgtctcaagactgaaa

SEQ ID NO: 1992109 - DNA, 18 bp, Homo sapiens
agacgtgaatgtctcagc

SEQ ID NO: 1992110 - DNA, 12 bp, Homo sapiens
agactaaatgaa

SEQ ID NO: 1992111 - DNA, 13 bp, Homo sapiens
agactaagccctg

SEQ ID NO: 1992112 - DNA, 18 bp, Homo sapiens
agactaattaaaatctgg

SEQ ID NO: 1992113 - DNA, 19 bp, Homo sapiens
agactaattcctgccctgc

SEQ ID NO: 1992114 - DNA, 14 bp, Homo sapiens
agactaatttaaaa

SEQ ID NO: 1992115 - DNA, 15 bp, Homo sapiens
agactagtgctttac

SEQ ID NO: 1992116 - DNA, 23 bp, Homo sapiens
agactagttgaacatctcacttt

SEQ ID NO: 1992117 - DNA, 19 bp, Homo sapiens
agactataaagcagtagac

SEQ ID NO: 1992118 - DNA, 13 bp, Homo sapiens
agactatatacat

SEQ ID NO: 1992119 - DNA, 17 bp, Homo sapiens
agactatatacatgtgt

SEQ ID NO: 1992120 - DNA, 18 bp, Homo sapiens
agactatatacatgtgtg

SEQ ID NO: 1992121 - DNA, 17 bp, Homo sapiens
agactatattgtacaca

SEQ ID NO: 1992122 - DNA, 16 bp, Homo sapiens
agactatggagcctgg

SEQ ID NO: 1992123 - DNA, 21 bp, Homo sapiens
agactatggagcctggcacag

SEQ ID NO: 1992124 - DNA, 14 bp, Homo sapiens
agactattcaaaca

SEQ ID NO: 1992125 - DNA, 18 bp, Homo sapiens
agactattcaaacagtct

SEQ ID NO: 1992126 - DNA, 14 bp, Homo sapiens
agactcacctctgc

SEQ ID NO: 1992127 - DNA, 15 bp, Homo sapiens
agactcagactccat

SEQ ID NO: 1992128 - DNA, 17 bp, Homo sapiens
agactcagggccccagc

SEQ ID NO: 1992129 - DNA, 16 bp, Homo sapiens
agactcagtttgtcag

SEQ ID NO: 1992130 - DNA, 17 bp, Homo sapiens
agactcagtttgtcaga

SEQ ID NO: 1992131 - DNA, 21 bp, Homo sapiens
agactcagtttgtcagacttt

SEQ ID NO: 1992132 - DNA, 15 bp, Homo sapiens
agactcattcttctg

SEQ ID NO: 1992133 - DNA, 23 bp, Homo sapiens
agactccaagattcaaagagact

SEQ ID NO: 1992134 - DNA, 14 bp, Homo sapiens
agactcctgccctg

SEQ ID NO: 1992135 - DNA, 16 bp, Homo sapiens
agactcctgccctgtt

SEQ ID NO: 1992136 - DNA, 16 bp, Homo sapiens
agagttcactataaat

SEQ ID NO: 1992137 - DNA, 14 bp, Homo sapiens
agagttcatcccag

SEQ ID NO: 1992138 - DNA, 14 bp, Homo sapiens
agagttctgctcta

SEQ ID NO: 1992139 - DNA, 20 bp, Homo sapiens
agagttctttaggtgcctcc

SEQ ID NO: 1992140 - DNA, 12 bp, Homo sapiens
agagttgaacct

SEQ ID NO: 1992141 - DNA, 15 bp, Homo sapiens
agagttggctcaggc

SEQ ID NO: 1992142 - DNA, 17 bp, Homo sapiens
agagttggctcaggcag

SEQ ID NO: 1992143 - DNA, 19 bp, Homo sapiens
agagtttgaaggaggtgag

SEQ ID NO: 1992144 - DNA, 14 bp, Homo sapiens
agagtttgcaaatg

SEQ ID NO: 1992145 - DNA, 14 bp, Homo sapiens
agataaagacagct

SEQ ID NO: 1992146 - DNA, 11 bp, Homo sapiens
agataaagatg

SEQ ID NO: 1992147 - DNA, 13 bp, Homo sapiens
agataaagatgat

SEQ ID NO: 1992148 - DNA, 13 bp, Homo sapiens
agataaattataa

SEQ ID NO: 1992149 - DNA, 22 bp, Homo sapiens
agataagaatgctggttttcct

SEQ ID NO: 1992150 - DNA, 18 bp, Homo sapiens
agataatatctgtgaggt

SEQ ID NO: 1992151 - DNA, 19 bp, Homo sapiens
agataatatctgtgaggtg

SEQ ID NO: 1992152 - DNA, 20 bp, Homo sapiens
agataatgttctttaatgtt

SEQ ID NO: 1992153 - DNA, 12 bp, Homo sapiens
agataattataa

SEQ ID NO: 1992154 - DNA, 20 bp, Homo sapiens
agataatttattttgtattt

SEQ ID NO: 1992155 - DNA, 20 bp, Homo sapiens
agatacaggaaaagctgctg

SEQ ID NO: 1992156 - DNA, 15 bp, Homo sapiens
agatacatagatgga

SEQ ID NO: 1992157 - DNA, 17 bp, Homo sapiens
agatacatggggaactg

SEQ ID NO: 1992158 - DNA, 19 bp, Homo sapiens
agatacattccctatcaaa

SEQ ID NO: 1992159 - DNA, 19 bp, Homo sapiens
agataccatactcatttct

SEQ ID NO: 1992160 - DNA, 15 bp, Homo sapiens
agatacggttgcttc

SEQ ID NO: 1992161 - DNA, 19 bp, Homo sapiens
agatactggaagttttgca

SEQ ID NO: 1992162 - DNA, 21 bp, Homo sapiens
agatactggaagttttgcatt

SEQ ID NO: 1992163 - DNA, 18 bp, Homo sapiens
agatagaaagcaataaaa

SEQ ID NO: 1992164 - DNA, 20 bp, Homo sapiens
agatagacagtgctgccctg

SEQ ID NO: 1992165 - DNA, 23 bp, Homo sapiens
agatagacagtgctgccctgcga

SEQ ID NO: 1992166 - DNA, 17 bp, Homo sapiens
agatagccagacacatg

SEQ ID NO: 1992167 - DNA, 18 bp, Homo sapiens
agatagtacataaaggtg

SEQ ID NO: 1992168 - DNA, 20 bp, Homo sapiens
agatagtgctttattttgtt

SEQ ID NO: 1992169 - DNA, 21 bp, Homo sapiens
agatagttaaaagactgcagc

SEQ ID NO: 1992170 - DNA, 17 bp, Homo sapiens
agatatataactttaga

SEQ ID NO: 1992171 - DNA, 13 bp, Homo sapiens
agatatatatcat

SEQ ID NO: 1992172 - DNA, 15 bp, Homo sapiens
agatatatctgaaaa

SEQ ID NO: 1992173 - DNA, 17 bp, Homo sapiens
agatatatctgaaaact

SEQ ID NO: 1992174 - DNA, 18 bp, Homo sapiens
agatatatctgaaaactg

SEQ ID NO: 1992175 - DNA, 21 bp, Homo sapiens
agatatatctgaaaactggaa

SEQ ID NO: 1992176 - DNA, 15 bp, Homo sapiens
agatatatttttcac

SEQ ID NO: 1992177 - DNA, 15 bp, Homo sapiens
agatatcacttactc

SEQ ID NO: 1992178 - DNA, 18 bp, Homo sapiens
agatattcctattgtgca

SEQ ID NO: 1992179 - DNA, 22 bp, Homo sapiens
agatattgtcagagttctgctc

SEQ ID NO: 1992180 - DNA, 23 bp, Homo sapiens
agatatttacatgaattgcattt

SEQ ID NO: 1992181 - DNA, 16 bp, Homo sapiens
agatatttccatttct

SEQ ID NO: 1992182 - DNA, 23 bp, Homo sapiens
agatatttccatttcttcctcac

SEQ ID NO: 1992183 - DNA, 12 bp, Homo sapiens
agatatttttgt

SEQ ID NO: 1992184 - DNA, 19 bp, Homo sapiens
agatattttttcagaaata

SEQ ID NO: 1992185 - DNA, 21 bp, Homo sapiens
agatattttttcagaaatatg

SEQ ID NO: 1992186 - DNA, 23 bp, Homo sapiens
agatcaaatttcacgtcgtcttc

SEQ ID NO: 1992187 - DNA, 16 bp, Homo sapiens
agatcaaggagcccag

SEQ ID NO: 1992188 - DNA, 19 bp, Homo sapiens
agatcaaggagcccagaaa

SEQ ID NO: 1992189 - DNA, 14 bp, Homo sapiens
agatcaatttgtaa

SEQ ID NO: 1992190 - DNA, 15 bp, Homo sapiens
agatcaccagcccgg

SEQ ID NO: 1992191 - DNA, 16 bp, Homo sapiens
agatcaccagcccggc

SEQ ID NO: 1992192 - DNA, 21 bp, Homo sapiens
agatcagccacggagcctgga

SEQ ID NO: 1992193 - DNA, 13 bp, Homo sapiens
agatcatcttgaa

SEQ ID NO: 1992194 - DNA, 14 bp, Homo sapiens
agatccacacacag

SEQ ID NO: 1992195 - DNA, 16 bp, Homo sapiens
agatccacacacagag

SEQ ID NO: 1992196 - DNA, 17 bp, Homo sapiens
agatccacacacagagg

SEQ ID NO: 1992197 - DNA, 21 bp, Homo sapiens
agatcccatccatcagctccc

SEQ ID NO: 1992198 - DNA, 13 bp, Homo sapiens
agatcccatctct

SEQ ID NO: 1992199 - DNA, 22 bp, Homo sapiens
agatcccatgtcacctcagctg

SEQ ID NO: 1992200 - DNA, 17 bp, Homo sapiens
agatcgcttgagcccag

SEQ ID NO: 1992201 - DNA, 18 bp, Homo sapiens
agatcgcttgagcccagg

SEQ ID NO: 1992202 - DNA, 21 bp, Homo sapiens
agatcgtgccgttactctcca

SEQ ID NO: 1992203 - DNA, 13 bp, Homo sapiens
agatctagaaagt

SEQ ID NO: 1992204 - DNA, 13 bp, Homo sapiens
agatctcctattt

SEQ ID NO: 1992205 - DNA, 13 bp, Homo sapiens
agatctcctgtaa

SEQ ID NO: 1992206 - DNA, 19 bp, Homo sapiens
agatctgaacacagtttag

SEQ ID NO: 1992207 - DNA, 19 bp, Homo sapiens
agatctgatggtgagctgg

SEQ ID NO: 1992208 - DNA, 14 bp, Homo sapiens
agatctgcctgggc

SEQ ID NO: 1992209 - DNA, 21 bp, Homo sapiens
agatctgcctgggcctgtgca

SEQ ID NO: 1992210 - DNA, 24 bp, Homo sapiens
agatctgcctgggcctgtgcagca

SEQ ID NO: 1992211 - DNA, 17 bp, Homo sapiens
agatcttacatctgcag

SEQ ID NO: 1992212 - DNA, 15 bp, Homo sapiens
agatcttctgaaatg

SEQ ID NO: 1992213 - DNA, 12 bp, Homo sapiens
agatctttcagg

SEQ ID NO: 1992214 - DNA, 21 bp, Homo sapiens
agatctttcaggaaagacgga

SEQ ID NO: 1992215 - DNA, 15 bp, Homo sapiens
agatgaagagaagct

SEQ ID NO: 1992216 - DNA, 20 bp, Homo sapiens
agatgaagagtgagagggca

SEQ ID NO: 1992217 - DNA, 15 bp, Homo sapiens
agatgacagctcttc

SEQ ID NO: 1992218 - DNA, 21 bp, Homo sapiens
agatgacagctcttctaagga

SEQ ID NO: 1992219 - DNA, 20 bp, Homo sapiens
agatgagaagttaagcagcc

SEQ ID NO: 1992220 - DNA, 23 bp, Homo sapiens
agatgagaagttaagcagccttt

SEQ ID NO: 1992221 - DNA, 20 bp, Homo sapiens
agatgagatttgccagcaca

SEQ ID NO: 1992222 - DNA, 21 bp, Homo sapiens
agatgagatttgccagcacag

SEQ ID NO: 1992223 - DNA, 16 bp, Homo sapiens
agatgataaatattta

SEQ ID NO: 1992224 - DNA, 21 bp, Homo sapiens
agatgatcgtgcctataaata

SEQ ID NO: 1992225 - DNA, 19 bp, Homo sapiens
agatgatgatgatctttaa

SEQ ID NO: 1992226 - DNA, 23 bp, Homo sapiens
agatgcacacacaccgatgctga

SEQ ID NO: 1992227 - DNA, 19 bp, Homo sapiens
agatgcacacacagatgca

SEQ ID NO: 1992228 - DNA, 14 bp, Homo sapiens
agatgcaccagccc

SEQ ID NO: 1992229 - DNA, 19 bp, Homo sapiens
agatgcaccccaacattga

SEQ ID NO: 1992230 - DNA, 15 bp, Homo sapiens
agatgccattcatag

SEQ ID NO: 1992231 - DNA, 21 bp, Homo sapiens
agatgcccagagggcccaggc

SEQ ID NO: 1992232 - DNA, 17 bp, Homo sapiens
agatgcctccaccgctg

SEQ ID NO: 1992233 - DNA, 17 bp, Homo sapiens
agatggaccagtagaca

SEQ ID NO: 1992234 - DNA, 14 bp, Homo sapiens
agatggacccctcc

SEQ ID NO: 1992235 - DNA, 17 bp, Homo sapiens
agatggacccctccctt

SEQ ID NO: 1992236 - DNA, 15 bp, Homo sapiens
agatggactctgaaa

SEQ ID NO: 1992237 - DNA, 21 bp, Homo sapiens
agatggccgggacatgcagct

SEQ ID NO: 1992238 - DNA, 22 bp, Homo sapiens
agatggctgactttgctctttc

SEQ ID NO: 1992239 - DNA, 14 bp, Homo sapiens
agatgggcacatga

SEQ ID NO: 1992240 - DNA, 15 bp, Homo sapiens
agatgggcacatgag

SEQ ID NO: 1992241 - DNA, 18 bp, Homo sapiens
agatgggcacatgaggag

SEQ ID NO: 1992242 - DNA, 16 bp, Homo sapiens
agatgggcttgttttc

SEQ ID NO: 1992243 - DNA, 17 bp, Homo sapiens
agatgggcttgttttct

SEQ ID NO: 1992244 - DNA, 19 bp, Homo sapiens
agatgggcttgttttcttg

SEQ ID NO: 1992245 - DNA, 21 bp, Homo sapiens
agatgggtctggctgagctga

SEQ ID NO: 1992246 - DNA, 15 bp, Homo sapiens
agatggtagcagata

SEQ ID NO: 1992247 - DNA, 22 bp, Homo sapiens
agatggtagcagataaagacag

SEQ ID NO: 1992248 - DNA, 23 bp, Homo sapiens
agatggtcacacagagatacgca

SEQ ID NO: 1992249 - DNA, 23 bp, Homo sapiens
agatggtcagtgtggagaggggt

SEQ ID NO: 1992250 - DNA, 21 bp, Homo sapiens
agccacatagagtgactccaa

SEQ ID NO: 1992251 - DNA, 14 bp, Homo sapiens
agccaccccctccc

SEQ ID NO: 1992252 - DNA, 22 bp, Homo sapiens
agccaccctgaggagtctgagg

SEQ ID NO: 1992253 - DNA, 20 bp, Homo sapiens
agccacctcccaccccactc

SEQ ID NO: 1992254 - DNA, 23 bp, Homo sapiens
agccacctcccaccccactccag

SEQ ID NO: 1992255 - DNA, 12 bp, Homo sapiens
agccacctcttg

SEQ ID NO: 1992256 - DNA, 14 bp, Homo sapiens
agccacgctgtcct

SEQ ID NO: 1992257 - DNA, 20 bp, Homo sapiens
agccacgctgtcctctcgag

SEQ ID NO: 1992258 - DNA, 15 bp, Homo sapiens
agccacggccaggcc

SEQ ID NO: 1992259 - DNA, 18 bp, Homo sapiens
agccacggccaggccaga

SEQ ID NO: 1992260 - DNA, 17 bp, Homo sapiens
agccacgttccttactg

SEQ ID NO: 1992261 - DNA, 23 bp, Homo sapiens
agccacgttccttactgcagaat

SEQ ID NO: 1992262 - DNA, 17 bp, Homo sapiens
agccactaccttctgac

SEQ ID NO: 1992263 - DNA, 16 bp, Homo sapiens
agccactatgtccagc

SEQ ID NO: 1992264 - DNA, 16 bp, Homo sapiens
agccactcctgtcccg

SEQ ID NO: 1992265 - DNA, 23 bp, Homo sapiens
agccactcgcagtcgcaggatcc

SEQ ID NO: 1992266 - DNA, 12 bp, Homo sapiens
agccactgaagc

SEQ ID NO: 1992267 - DNA, 19 bp, Homo sapiens
agccactgcaccgggccac

SEQ ID NO: 1992268 - DNA, 20 bp, Homo sapiens
agccactgcaccgggccaca

SEQ ID NO: 1992269 - DNA, 22 bp, Homo sapiens
agccactgcaccgggccacaga

SEQ ID NO: 1992270 - DNA, 18 bp, Homo sapiens
agccactggtttctcaga

SEQ ID NO: 1992271 - DNA, 19 bp, Homo sapiens
agccactggtttctcagaa

SEQ ID NO: 1992272 - DNA, 14 bp, Homo sapiens
agccactgtgctga

SEQ ID NO: 1992273 - DNA, 15 bp, Homo sapiens
agccacttaccttca

SEQ ID NO: 1992274 - DNA, 16 bp, Homo sapiens
agccacttaccttcaa

SEQ ID NO: 1992275 - DNA, 22 bp, Homo sapiens
agccacttaccttcaataaagt

SEQ ID NO: 1992276 - DNA, 23 bp, Homo sapiens
agccacttaccttcaataaagta

SEQ ID NO: 1992277 - DNA, 23 bp, Homo sapiens
agccagaaataaagttggtgaca

SEQ ID NO: 1992278 - DNA, 22 bp, Homo sapiens
agccagaatcttcgtcctgccc

SEQ ID NO: 1992279 - DNA, 17 bp, Homo sapiens
agccagagaggagcacc

SEQ ID NO: 1992280 - DNA, 18 bp, Homo sapiens
agccagagaggagcacct

SEQ ID NO: 1992281 - DNA, 12 bp, Homo sapiens
agccagagcctg

SEQ ID NO: 1992282 - DNA, 19 bp, Homo sapiens
agccagagggtgggagcct

SEQ ID NO: 1992283 - DNA, 11 bp, Homo sapiens
agccagcagcc

SEQ ID NO: 1992284 - DNA, 14 bp, Homo sapiens
agccagcccagccc

SEQ ID NO: 1992285 - DNA, 13 bp, Homo sapiens
agccagccctgcc

SEQ ID NO: 1992286 - DNA, 14 bp, Homo sapiens
agccagccctgcct

SEQ ID NO: 1992287 - DNA, 20 bp, Homo sapiens
agccagccctgcctggagga

SEQ ID NO: 1992288 - DNA, 14 bp, Homo sapiens
agccagccgccctg

SEQ ID NO: 1992289 - DNA, 16 bp, Homo sapiens
agccagcctgggactc

SEQ ID NO: 1992290 - DNA, 20 bp, Homo sapiens
agccagcctgggactcccag

SEQ ID NO: 1992291 - DNA, 23 bp, Homo sapiens
agccagcctgggactcccagtga

SEQ ID NO: 1992292 - DNA, 14 bp, Homo sapiens
agccagcgcctccc

SEQ ID NO: 1992293 - DNA, 17 bp, Homo sapiens
agccagcgcctccctcc

SEQ ID NO: 1992294 - DNA, 18 bp, Homo sapiens
agccagcgcctccctcca

SEQ ID NO: 1992295 - DNA, 22 bp, Homo sapiens
agccagcgcctccctccacccc

SEQ ID NO: 1992296 - DNA, 23 bp, Homo sapiens
agccagcgcctccctccacccca

SEQ ID NO: 1992297 - DNA, 14 bp, Homo sapiens
agccagctctcagc

SEQ ID NO: 1992298 - DNA, 18 bp, Homo sapiens
agccagctgcaggaatca

SEQ ID NO: 1992299 - DNA, 16 bp, Homo sapiens
agccagctgccgacca

SEQ ID NO: 1992300 - DNA, 18 bp, Homo sapiens
agccaggagtctgtgctc

SEQ ID NO: 1992301 - DNA, 21 bp, Homo sapiens
agccaggagttgacgcatcct

SEQ ID NO: 1992302 - DNA, 22 bp, Homo sapiens
agccaggctgagtgagccacag

SEQ ID NO: 1992303 - DNA, 17 bp, Homo sapiens
agccagggccaggggtc

SEQ ID NO: 1992304 - DNA, 16 bp, Homo sapiens
agccaggggctgctca

SEQ ID NO: 1992305 - DNA, 23 bp, Homo sapiens
agccaggggctgctcatcaccca

SEQ ID NO: 1992306 - DNA, 18 bp, Homo sapiens
agccaggtaatgagggac

SEQ ID NO: 1992307 - DNA, 17 bp, Homo sapiens
agccagtcttgcctagg

SEQ ID NO: 1992308 - DNA, 12 bp, Homo sapiens
agccagtgactt

SEQ ID NO: 1992309 - DNA, 13 bp, Homo sapiens
agccagtgacttt

SEQ ID NO: 1992310 - DNA, 15 bp, Homo sapiens
agccagtgacttttt

SEQ ID NO: 1992311 - DNA, 18 bp, Homo sapiens
agccatcaacaagagttg

SEQ ID NO: 1992312 - DNA, 14 bp, Homo sapiens
agccatcacaaggg

SEQ ID NO: 1992313 - DNA, 15 bp, Homo sapiens
agccatcacaagggg

SEQ ID NO: 1992314 - DNA, 20 bp, Homo sapiens
agccatcccttccctgtcca

SEQ ID NO: 1992315 - DNA, 18 bp, Homo sapiens
agccatgaggagttgctg

SEQ ID NO: 1992316 - DNA, 22 bp, Homo sapiens
agccatgatcgagccactgcac

SEQ ID NO: 1992317 - DNA, 13 bp, Homo sapiens
agccatgggcctg

SEQ ID NO: 1992318 - DNA, 15 bp, Homo sapiens
agccatgggcctggg

SEQ ID NO: 1992319 - DNA, 22 bp, Homo sapiens
agccatgggcctgggcctgctt

SEQ ID NO: 1992320 - DNA, 22 bp, Homo sapiens
agccatgtaccagtgtactgct

SEQ ID NO: 1992321 - DNA, 23 bp, Homo sapiens
agccatgtaccagtgtactgctt

SEQ ID NO: 1992322 - DNA, 16 bp, Homo sapiens
agcccaaatggctctg

SEQ ID NO: 1992323 - DNA, 18 bp, Homo sapiens
agcccaagaggtctgagc

SEQ ID NO: 1992324 - DNA, 22 bp, Homo sapiens
agcccaagggcggggctatgcc

SEQ ID NO: 1992325 - DNA, 13 bp, Homo sapiens
agcccaagtgcca

SEQ ID NO: 1992326 - DNA, 18 bp, Homo sapiens
agcccaagtgccatccca

SEQ ID NO: 1992327 - DNA, 21 bp, Homo sapiens
agcccaagtgccatcccacat

SEQ ID NO: 1992328 - DNA, 22 bp, Homo sapiens
agcccaagtgccatcccacatt

SEQ ID NO: 1992329 - DNA, 20 bp, Homo sapiens
agcccaatattataattttt

SEQ ID NO: 1992330 - DNA, 16 bp, Homo sapiens
agcccacacccctcca

SEQ ID NO: 1992331 - DNA, 16 bp, Homo sapiens
agcccaccttggctca

SEQ ID NO: 1992332 - DNA, 22 bp, Homo sapiens
agcccacgcccgactagcaggc

SEQ ID NO: 1992333 - DNA, 23 bp, Homo sapiens
agcccagagggccaagagagaca

SEQ ID NO: 1992334 - DNA, 15 bp, Homo sapiens
agcccagccacctcc

SEQ ID NO: 1992335 - DNA, 21 bp, Homo sapiens
agcccagccacctcccaagga

SEQ ID NO: 1992336 - DNA, 21 bp, Homo sapiens
agcccagccattaccatggag

SEQ ID NO: 1992337 - DNA, 20 bp, Homo sapiens
agcccagcctagcccacttg

SEQ ID NO: 1992338 - DNA, 17 bp, Homo sapiens
agcccagctacattcct

SEQ ID NO: 1992339 - DNA, 19 bp, Homo sapiens
agcccagctacattcctca

SEQ ID NO: 1992340 - DNA, 22 bp, Homo sapiens
agcccagctacattcctcagct

SEQ ID NO: 1992341 - DNA, 19 bp, Homo sapiens
agcccagctctttgttcag

SEQ ID NO: 1992342 - DNA, 12 bp, Homo sapiens
agcccaggagct

SEQ ID NO: 1992343 - DNA, 16 bp, Homo sapiens
agcccaggagctgagt

SEQ ID NO: 1992344 - DNA, 11 bp, Homo sapiens
agcccaggagt

SEQ ID NO: 1992345 - DNA, 20 bp, Homo sapiens
agcccaggagtttgagacaa

SEQ ID NO: 1992346 - DNA, 16 bp, Homo sapiens
agcccaggctgaagag

SEQ ID NO: 1992347 - DNA, 14 bp, Homo sapiens
agcccaggtcctcc

SEQ ID NO: 1992348 - DNA, 17 bp, Homo sapiens
agcccagtttcccttct

SEQ ID NO: 1992349 - DNA, 23 bp, Homo sapiens
agcccagtttcccttctatgcag

SEQ ID NO: 1992350 - DNA, 14 bp, Homo sapiens
agcccatggagcag

SEQ ID NO: 1992351 - DNA, 22 bp, Homo sapiens
agcccatggcctctggccaggc

SEQ ID NO: 1992352 - DNA, 15 bp, Homo sapiens
agcccattctctctc

SEQ ID NO: 1992353 - DNA, 22 bp, Homo sapiens
agcccattctctctcctgtcca

SEQ ID NO: 1992354 - DNA, 15 bp, Homo sapiens
agccccaaaccaggg

SEQ ID NO: 1992355 - DNA, 18 bp, Homo sapiens
agccccaaaccagggtgc

SEQ ID NO: 1992356 - DNA, 22 bp, Homo sapiens
agccccaaaccagggtgcatgg

SEQ ID NO: 1992357 - DNA, 15 bp, Homo sapiens
agccccacagcaccc

SEQ ID NO: 1992358 - DNA, 20 bp, Homo sapiens
agccccacagcacccaggct

SEQ ID NO: 1992359 - DNA, 22 bp, Homo sapiens
agccccacagcacccaggctcc

SEQ ID NO: 1992360 - DNA, 23 bp, Homo sapiens
agccccacagcacccaggctcca

SEQ ID NO: 1992361 - DNA, 12 bp, Homo sapiens
agccccagcact

SEQ ID NO: 1992362 - DNA, 21 bp, Homo sapiens
agccccaggcctctgtgtcct

SEQ ID NO: 1992363 - DNA, 13 bp, Homo sapiens
agccccagggcct

SEQ ID NO: 1992364 - DNA, 17 bp, Homo sapiens
agctattgcatgtaaaa

SEQ ID NO: 1992365 - DNA, 21 bp, Homo sapiens
agctattgcatgtaaaatgca

SEQ ID NO: 1992366 - DNA, 19 bp, Homo sapiens
agctcaagatgacagctct

SEQ ID NO: 1992367 - DNA, 18 bp, Homo sapiens
agctcaagtcttccctga

SEQ ID NO: 1992368 - DNA, 16 bp, Homo sapiens
agctcacaagcccagg

SEQ ID NO: 1992369 - DNA, 19 bp, Homo sapiens
agctcacaagcccaggctg

SEQ ID NO: 1992370 - DNA, 14 bp, Homo sapiens
agctcacaaggcag

SEQ ID NO: 1992371 - DNA, 15 bp, Homo sapiens
agctcacaaggcagc

SEQ ID NO: 1992372 - DNA, 16 bp, Homo sapiens
agctcacaaggcagca

SEQ ID NO: 1992373 - DNA, 19 bp, Homo sapiens
agctcacaaggcagcaagg

SEQ ID NO: 1992374 - DNA, 20 bp, Homo sapiens
agctcacagttcctcgccct

SEQ ID NO: 1992375 - DNA, 14 bp, Homo sapiens
agctcaccagcccc

SEQ ID NO: 1992376 - DNA, 19 bp, Homo sapiens
agctcaccagccccagtgc

SEQ ID NO: 1992377 - DNA, 20 bp, Homo sapiens
agctcaccagccccagtgcc

SEQ ID NO: 1992378 - DNA, 22 bp, Homo sapiens
agctcaccagccccagtgccca

SEQ ID NO: 1992379 - DNA, 15 bp, Homo sapiens
agctcagacccccac

SEQ ID NO: 1992380 - DNA, 16 bp, Homo sapiens
agctcagacccccact

SEQ ID NO: 1992381 - DNA, 17 bp, Homo sapiens
agctcagacccccactc

SEQ ID NO: 1992382 - DNA, 14 bp, Homo sapiens
agctcagcctcccc

SEQ ID NO: 1992383 - DNA, 16 bp, Homo sapiens
agctcagcctccccct

SEQ ID NO: 1992384 - DNA, 22 bp, Homo sapiens
agctcaggaggcgaataaatgt

SEQ ID NO: 1992385 - DNA, 17 bp, Homo sapiens
agctcaggctgagccca

SEQ ID NO: 1992386 - DNA, 20 bp, Homo sapiens
agctcaggctgagcccagcc

SEQ ID NO: 1992387 - DNA, 21 bp, Homo sapiens
agctcaggctgagcccagcca

SEQ ID NO: 1992388 - DNA, 18 bp, Homo sapiens
agctcaggtgtccctgca

SEQ ID NO: 1992389 - DNA, 20 bp, Homo sapiens
agctcaggtgtccctgcact

SEQ ID NO: 1992390 - DNA, 21 bp, Homo sapiens
agctcaggtgtccctgcactt

SEQ ID NO: 1992391 - DNA, 14 bp, Homo sapiens
agctcatattttgt

SEQ ID NO: 1992392 - DNA, 17 bp, Homo sapiens
agctccaacagcttgac

SEQ ID NO: 1992393 - DNA, 19 bp, Homo sapiens
agctccacggtgcgtggct

SEQ ID NO: 1992394 - DNA, 21 bp, Homo sapiens
agctccactgtcaccctccac

SEQ ID NO: 1992395 - DNA, 23 bp, Homo sapiens
agctccactgtcaccctccacct

SEQ ID NO: 1992396 - DNA, 13 bp, Homo sapiens
agctccagctcac

SEQ ID NO: 1992397 - DNA, 19 bp, Homo sapiens
agctccagctcaccagccc

SEQ ID NO: 1992398 - DNA, 13 bp, Homo sapiens
agctccagttcga

SEQ ID NO: 1992399 - DNA, 15 bp, Homo sapiens
agctccatctccact

SEQ ID NO: 1992400 - DNA, 13 bp, Homo sapiens
agctcccacccca

SEQ ID NO: 1992401 - DNA, 17 bp, Homo sapiens
agctcccaccccacccc

SEQ ID NO: 1992402 - DNA, 23 bp, Homo sapiens
agctcccaccccacccccttcag

SEQ ID NO: 1992403 - DNA, 17 bp, Homo sapiens
agctcccagcactcaac

SEQ ID NO: 1992404 - DNA, 20 bp, Homo sapiens
agctcccatagcgctggctc

SEQ ID NO: 1992405 - DNA, 12 bp, Homo sapiens
agctccccagga

SEQ ID NO: 1992406 - DNA, 20 bp, Homo sapiens
agctccccaggactcaccct

SEQ ID NO: 1992407 - DNA, 22 bp, Homo sapiens
agctccccaggactcaccctca

SEQ ID NO: 1992408 - DNA, 12 bp, Homo sapiens
agctcccttccc

SEQ ID NO: 1992409 - DNA, 16 bp, Homo sapiens
agctcccttcttccct

SEQ ID NO: 1992410 - DNA, 20 bp, Homo sapiens
agctccgctttctacccagc

SEQ ID NO: 1992411 - DNA, 15 bp, Homo sapiens
agctccgtggagcag

SEQ ID NO: 1992412 - DNA, 19 bp, Homo sapiens
agctcctctccttgggctc

SEQ ID NO: 1992413 - DNA, 21 bp, Homo sapiens
agctcctctccttgggctcct

SEQ ID NO: 1992414 - DNA, 23 bp, Homo sapiens
agctcctctccttgggctcctgg

SEQ ID NO: 1992415 - DNA, 24 bp, Homo sapiens
agctcctctccttgggctcctggc

SEQ ID NO: 1992416 - DNA, 17 bp, Homo sapiens
agctcctctgctgctcc

SEQ ID NO: 1992417 - DNA, 18 bp, Homo sapiens
agctcctctgtctcgagc

SEQ ID NO: 1992418 - DNA, 22 bp, Homo sapiens
agctcctggtcttgagatgtct

SEQ ID NO: 1992419 - DNA, 18 bp, Homo sapiens
agctcctgtccctaccca

SEQ ID NO: 1992420 - DNA, 21 bp, Homo sapiens
agctcctgtccctacccactc

SEQ ID NO: 1992421 - DNA, 14 bp, Homo sapiens
agctcctgtcctcc

SEQ ID NO: 1992422 - DNA, 15 bp, Homo sapiens
agctccttctgtcct

SEQ ID NO: 1992423 - DNA, 19 bp, Homo sapiens
agctccttttgtccccagg

SEQ ID NO: 1992424 - DNA, 12 bp, Homo sapiens
agctcggtggac

SEQ ID NO: 1992425 - DNA, 17 bp, Homo sapiens
agctcggtggacccagg

SEQ ID NO: 1992426 - DNA, 20 bp, Homo sapiens
agctcggtggacccagggat

SEQ ID NO: 1992427 - DNA, 23 bp, Homo sapiens
agctctccctctggccctgcctt

SEQ ID NO: 1992428 - DNA, 18 bp, Homo sapiens
agctctctgtataaacat

SEQ ID NO: 1992429 - DNA, 19 bp, Homo sapiens
agctctctgtataaacatt

SEQ ID NO: 1992430 - DNA, 16 bp, Homo sapiens
agctctctttggaatg

SEQ ID NO: 1992431 - DNA, 13 bp, Homo sapiens
agctctgcatgtg

SEQ ID NO: 1992432 - DNA, 12 bp, Homo sapiens
agctctggacca

SEQ ID NO: 1992433 - DNA, 17 bp, Homo sapiens
agctctggaccagcctg

SEQ ID NO: 1992434 - DNA, 22 bp, Homo sapiens
agctctggccccaggcttgtca

SEQ ID NO: 1992435 - DNA, 12 bp, Homo sapiens
agctctgtccac

SEQ ID NO: 1992436 - DNA, 12 bp, Homo sapiens
agctctgtcctg

SEQ ID NO: 1992437 - DNA, 14 bp, Homo sapiens
agctctgtcctggg

SEQ ID NO: 1992438 - DNA, 12 bp, Homo sapiens
agctctgtggcc

SEQ ID NO: 1992439 - DNA, 16 bp, Homo sapiens
agctctgtggcctgtg

SEQ ID NO: 1992440 - DNA, 19 bp, Homo sapiens
agctctgtggcctgtgtcc

SEQ ID NO: 1992441 - DNA, 19 bp, Homo sapiens
agctctgtttataaaaaca

SEQ ID NO: 1992442 - DNA, 16 bp, Homo sapiens
agctcttaactacagt

SEQ ID NO: 1992443 - DNA, 20 bp, Homo sapiens
agctcttcactcagccacac

SEQ ID NO: 1992444 - DNA, 16 bp, Homo sapiens
agctcttcccctttcc

SEQ ID NO: 1992445 - DNA, 20 bp, Homo sapiens
agctcttcggtttctgagca

SEQ ID NO: 1992446 - DNA, 15 bp, Homo sapiens
agctcttctaaggaa

SEQ ID NO: 1992447 - DNA, 12 bp, Homo sapiens
agctcttctatt

SEQ ID NO: 1992448 - DNA, 13 bp, Homo sapiens
agctcttctattt

SEQ ID NO: 1992449 - DNA, 14 bp, Homo sapiens
agctcttctattta

SEQ ID NO: 1992450 - DNA, 16 bp, Homo sapiens
agctcttctatttaaa

SEQ ID NO: 1992451 - DNA, 22 bp, Homo sapiens
agctcttctatttaaaaaataa

SEQ ID NO: 1992452 - DNA, 15 bp, Homo sapiens
agctcttctccaggc

SEQ ID NO: 1992453 - DNA, 18 bp, Homo sapiens
agctcttctccaggctgt

SEQ ID NO: 1992454 - DNA, 20 bp, Homo sapiens
agctcttggaagagctcttc

SEQ ID NO: 1992455 - DNA, 20 bp, Homo sapiens
agctcttggcccctgtgtga

SEQ ID NO: 1992456 - DNA, 22 bp, Homo sapiens
agctgaaacattccgaagaggg

SEQ ID NO: 1992457 - DNA, 22 bp, Homo sapiens
agctgaacagccaaatgcatgg

SEQ ID NO: 1992458 - DNA, 18 bp, Homo sapiens
agctgaagcctatttatt

SEQ ID NO: 1992459 - DNA, 15 bp, Homo sapiens
agctgaagtgaagga

SEQ ID NO: 1992460 - DNA, 21 bp, Homo sapiens
agctgaagtgaaggagaaagg

SEQ ID NO: 1992461 - DNA, 17 bp, Homo sapiens
agctgacccagagtgga

SEQ ID NO: 1992462 - DNA, 23 bp, Homo sapiens
agctgacccagccccttgagaaa

SEQ ID NO: 1992463 - DNA, 18 bp, Homo sapiens
agctgagaagaagctgag

SEQ ID NO: 1992464 - DNA, 19 bp, Homo sapiens
agctgagaagaagctgagg

SEQ ID NO: 1992465 - DNA, 22 bp, Homo sapiens
agctgagagccctgctgtggga

SEQ ID NO: 1992466 - DNA, 17 bp, Homo sapiens
agctgagagtctgaaag

SEQ ID NO: 1992467 - DNA, 23 bp, Homo sapiens
agctgagagtctgaaagacagaa

SEQ ID NO: 1992468 - DNA, 13 bp, Homo sapiens
agctgagcaggcc

SEQ ID NO: 1992469 - DNA, 13 bp, Homo sapiens
agctgagcagggc

SEQ ID NO: 1992470 - DNA, 17 bp, Homo sapiens
agctgagctcacaaggc

SEQ ID NO: 1992471 - DNA, 22 bp, Homo sapiens
agctgagctcacaaggcagcaa

SEQ ID NO: 1992472 - DNA, 12 bp, Homo sapiens
agctgaggtgcc

SEQ ID NO: 1992473 - DNA, 18 bp, Homo sapiens
agctgaggtgcccaggag

SEQ ID NO: 1992474 - DNA, 22 bp, Homo sapiens
agctgaggtgcccaggagaaga

SEQ ID NO: 1992475 - DNA, 18 bp, Homo sapiens
agctgagtcacctcctcc

SEQ ID NO: 1992476 - DNA, 19 bp, Homo sapiens
agctgagtcacctcctcca

SEQ ID NO: 1992477 - DNA, 23 bp, Homo sapiens
agctgagtgactgtaggcaggga

SEQ ID NO: 1992478 - DNA, 16 bp, Homo sapiens
aggagcaaagcctgtt

SEQ ID NO: 1992479 - DNA, 15 bp, Homo sapiens
aggagcacacggccc

SEQ ID NO: 1992480 - DNA, 21 bp, Homo sapiens
aggagcacacggccctgcccc

SEQ ID NO: 1992481 - DNA, 20 bp, Homo sapiens
aggagcaggaacagagactc

SEQ ID NO: 1992482 - DNA, 21 bp, Homo sapiens
aggagcatttggagagaaggc

SEQ ID NO: 1992483 - DNA, 13 bp, Homo sapiens
aggagcctgtgaa

SEQ ID NO: 1992484 - DNA, 21 bp, Homo sapiens
aggagcctgtgaacccaggac

SEQ ID NO: 1992485 - DNA, 17 bp, Homo sapiens
aggagctacctgtgtgg

SEQ ID NO: 1992486 - DNA, 18 bp, Homo sapiens
aggagctacctgtgtgga

SEQ ID NO: 1992487 - DNA, 22 bp, Homo sapiens
aggagctacctgtgtggacagg

SEQ ID NO: 1992488 - DNA, 23 bp, Homo sapiens
aggagctacctgtgtggacagga

SEQ ID NO: 1992489 - DNA, 23 bp, Homo sapiens
aggagctcttaactacagtggct

SEQ ID NO: 1992490 - DNA, 18 bp, Homo sapiens
aggagctgagtcacctcc

SEQ ID NO: 1992491 - DNA, 19 bp, Homo sapiens
aggagctgatttccaggcc

SEQ ID NO: 1992492 - DNA, 21 bp, Homo sapiens
aggagctgatttccaggcccc

SEQ ID NO: 1992493 - DNA, 22 bp, Homo sapiens
aggagctgatttccaggcccct

SEQ ID NO: 1992494 - DNA, 22 bp, Homo sapiens
aggagctgccgcaaggccctgt

SEQ ID NO: 1992495 - DNA, 16 bp, Homo sapiens
aggaggaaggcaaagc

SEQ ID NO: 1992496 - DNA, 16 bp, Homo sapiens
aggaggagaggaaagg

SEQ ID NO: 1992497 - DNA, 15 bp, Homo sapiens
aggaggagctgccgc

SEQ ID NO: 1992498 - DNA, 23 bp, Homo sapiens
aggaggagctgccgcaaggccct

SEQ ID NO: 1992499 - DNA, 14 bp, Homo sapiens
aggaggaggaaggc

SEQ ID NO: 1992500 - DNA, 15 bp, Homo sapiens
aggaggaggaaggca

SEQ ID NO: 1992501 - DNA, 12 bp, Homo sapiens
aggaggaggagg

SEQ ID NO: 1992502 - DNA, 15 bp, Homo sapiens
aggaggaggaggagg

SEQ ID NO: 1992503 - DNA, 22 bp, Homo sapiens
aggaggcagaataagaaaacaa

SEQ ID NO: 1992504 - DNA, 19 bp, Homo sapiens
aggaggccctggtgtcagg

SEQ ID NO: 1992505 - DNA, 20 bp, Homo sapiens
aggaggccctggtgtcaggc

SEQ ID NO: 1992506 - DNA, 13 bp, Homo sapiens
aggaggcctggcc

SEQ ID NO: 1992507 - DNA, 14 bp, Homo sapiens
aggaggcctggcct

SEQ ID NO: 1992508 - DNA, 15 bp, Homo sapiens
aggaggcgaataaat

SEQ ID NO: 1992509 - DNA, 17 bp, Homo sapiens
aggaggcgaataaatgt

SEQ ID NO: 1992510 - DNA, 16 bp, Homo sapiens
aggaggcgcagcccga

SEQ ID NO: 1992511 - DNA, 20 bp, Homo sapiens
aggaggcggaggttgcagtg

SEQ ID NO: 1992512 - DNA, 17 bp, Homo sapiens
aggaggctgaggcagaa

SEQ ID NO: 1992513 - DNA, 18 bp, Homo sapiens
aggaggctgcatgctctg

SEQ ID NO: 1992514 - DNA, 14 bp, Homo sapiens
aggaggctgcggcc

SEQ ID NO: 1992515 - DNA, 21 bp, Homo sapiens
aggagggacaaaggagcctgt

SEQ ID NO: 1992516 - DNA, 19 bp, Homo sapiens
aggagggatgctgcctgag

SEQ ID NO: 1992517 - DNA, 15 bp, Homo sapiens
aggagggcagagcca

SEQ ID NO: 1992518 - DNA, 23 bp, Homo sapiens
aggagggcagagccatgggcctg

SEQ ID NO: 1992519 - DNA, 14 bp, Homo sapiens
aggagggcgcccat

SEQ ID NO: 1992520 - DNA, 22 bp, Homo sapiens
aggagggcgtgactcacccaag

SEQ ID NO: 1992521 - DNA, 17 bp, Homo sapiens
aggaggggcacctgcca

SEQ ID NO: 1992522 - DNA, 20 bp, Homo sapiens
aggagggggtcgtggagagc

SEQ ID NO: 1992523 - DNA, 19 bp, Homo sapiens
aggagggtccccagctggt

SEQ ID NO: 1992524 - DNA, 14 bp, Homo sapiens
aggagggtgccctc

SEQ ID NO: 1992525 - DNA, 14 bp, Homo sapiens
aggagggtggagga

SEQ ID NO: 1992526 - DNA, 15 bp, Homo sapiens
aggagggtggaggaa

SEQ ID NO: 1992527 - DNA, 18 bp, Homo sapiens
aggagggttagggagggg

SEQ ID NO: 1992528 - DNA, 14 bp, Homo sapiens
aggaggtagctccc

SEQ ID NO: 1992529 - DNA, 20 bp, Homo sapiens
aggaggtggaggttgcagtg

SEQ ID NO: 1992530 - DNA, 21 bp, Homo sapiens
aggaggtggcagccctgtagg

SEQ ID NO: 1992531 - DNA, 16 bp, Homo sapiens
aggaggtgtcccaagc

SEQ ID NO: 1992532 - DNA, 17 bp, Homo sapiens
aggaggttggtgactga

SEQ ID NO: 1992533 - DNA, 15 bp, Homo sapiens
aggaggttgtggatg

SEQ ID NO: 1992534 - DNA, 14 bp, Homo sapiens
aggaggtttggatg

SEQ ID NO: 1992535 - DNA, 23 bp, Homo sapiens
aggaggtttggggtctgccacca

SEQ ID NO: 1992536 - DNA, 13 bp, Homo sapiens
aggagtagctgag

SEQ ID NO: 1992537 - DNA, 14 bp, Homo sapiens
aggagtagctgaga

SEQ ID NO: 1992538 - DNA, 14 bp, Homo sapiens
aggagtagctgagc

SEQ ID NO: 1992539 - DNA, 16 bp, Homo sapiens
aggagtagctgagctc

SEQ ID NO: 1992540 - DNA, 15 bp, Homo sapiens
aggagtcaactggct

SEQ ID NO: 1992541 - DNA, 17 bp, Homo sapiens
aggagtccagggcggga

SEQ ID NO: 1992542 - DNA, 18 bp, Homo sapiens
aggagtctgaggtcctga

SEQ ID NO: 1992543 - DNA, 19 bp, Homo sapiens
aggagtctgaggtcctgag

SEQ ID NO: 1992544 - DNA, 21 bp, Homo sapiens
aggagtctgaggtcctgagca

SEQ ID NO: 1992545 - DNA, 14 bp, Homo sapiens
aggagtgagatcat

SEQ ID NO: 1992546 - DNA, 21 bp, Homo sapiens
aggagtgagatcattttctta

SEQ ID NO: 1992547 - DNA, 14 bp, Homo sapiens
aggagtgagcacta

SEQ ID NO: 1992548 - DNA, 23 bp, Homo sapiens
aggagtggcagctgtcccctctc

SEQ ID NO: 1992549 - DNA, 19 bp, Homo sapiens
aggagtggccggggaagct

SEQ ID NO: 1992550 - DNA, 23 bp, Homo sapiens
aggagtggccggggaagctggca

SEQ ID NO: 1992551 - DNA, 16 bp, Homo sapiens
aggagtgtgagaatca

SEQ ID NO: 1992552 - DNA, 23 bp, Homo sapiens
aggagttagaaatctccagtgtg

SEQ ID NO: 1992553 - DNA, 20 bp, Homo sapiens
aggagttcaagaccagcctg

SEQ ID NO: 1992554 - DNA, 19 bp, Homo sapiens
aggagttcctaaccagcct

SEQ ID NO: 1992555 - DNA, 14 bp, Homo sapiens
aggagttgccaggg

SEQ ID NO: 1992556 - DNA, 23 bp, Homo sapiens
aggagtttgagacaagccctggc

SEQ ID NO: 1992557 - DNA, 19 bp, Homo sapiens
aggagtttgagaccagcct

SEQ ID NO: 1992558 - DNA, 21 bp, Homo sapiens
aggagtttgtgtgtcttttat

SEQ ID NO: 1992559 - DNA, 15 bp, Homo sapiens
aggataccatataca

SEQ ID NO: 1992560 - DNA, 23 bp, Homo sapiens
aggatactgcgggcaccagaatg

SEQ ID NO: 1992561 - DNA, 18 bp, Homo sapiens
aggatcacagtgctgaga

SEQ ID NO: 1992562 - DNA, 18 bp, Homo sapiens
aggatcactggagcccag

SEQ ID NO: 1992563 - DNA, 22 bp, Homo sapiens
aggatcactggagcccaggagt

SEQ ID NO: 1992564 - DNA, 13 bp, Homo sapiens
aggatcagtctga

SEQ ID NO: 1992565 - DNA, 20 bp, Homo sapiens
aggatcatttgttggaatga

SEQ ID NO: 1992566 - DNA, 12 bp, Homo sapiens
aggatccgctgc

SEQ ID NO: 1992567 - DNA, 21 bp, Homo sapiens
aggatcctattctcaccagga

SEQ ID NO: 1992568 - DNA, 14 bp, Homo sapiens
aggatcctgcagga

SEQ ID NO: 1992569 - DNA, 16 bp, Homo sapiens
aggatctatgcaattt

SEQ ID NO: 1992570 - DNA, 21 bp, Homo sapiens
aggatctatgcaatttttaaa

SEQ ID NO: 1992571 - DNA, 14 bp, Homo sapiens
aggatctctcagga

SEQ ID NO: 1992572 - DNA, 22 bp, Homo sapiens
aggatctctcaggagcacaggc

SEQ ID NO: 1992573 - DNA, 16 bp, Homo sapiens
aggatgaaagtctgag

SEQ ID NO: 1992574 - DNA, 22 bp, Homo sapiens
aggatgaatgaggtcccaggca

SEQ ID NO: 1992575 - DNA, 16 bp, Homo sapiens
aggatgaccaggacta

SEQ ID NO: 1992576 - DNA, 13 bp, Homo sapiens
aggatgcagaggg

SEQ ID NO: 1992577 - DNA, 12 bp, Homo sapiens
aggatgccacag

SEQ ID NO: 1992578 - DNA, 17 bp, Homo sapiens
aggatgccacagcccca

SEQ ID NO: 1992579 - DNA, 18 bp, Homo sapiens
aggatgccacagccccac

SEQ ID NO: 1992580 - DNA, 14 bp, Homo sapiens
aggatggagagagg

SEQ ID NO: 1992581 - DNA, 15 bp, Homo sapiens
aggatggagagaggg

SEQ ID NO: 1992582 - DNA, 16 bp, Homo sapiens
aggatggagagagggg

SEQ ID NO: 1992583 - DNA, 14 bp, Homo sapiens
aggatgtggcactg

SEQ ID NO: 1992584 - DNA, 18 bp, Homo sapiens
aggatgttctgggacaca

SEQ ID NO: 1992585 - DNA, 23 bp, Homo sapiens
aggatgttttgtcccatttcctt

SEQ ID NO: 1992586 - DNA, 18 bp, Homo sapiens
aggattatgggtcctgca

SEQ ID NO: 1992587 - DNA, 19 bp, Homo sapiens
aggattatgggtcctgcaa

SEQ ID NO: 1992588 - DNA, 21 bp, Homo sapiens
aggattatgggtcctgcaatt

SEQ ID NO: 1992589 - DNA, 13 bp, Homo sapiens
aggattgaagagc

SEQ ID NO: 1992590 - DNA, 18 bp, Homo sapiens
aggattgctactgtccta

SEQ ID NO: 1992591 - DNA, 18 bp, Homo sapiens
aggattgcttgagcccag

SEQ ID NO: 1992592 - DNA, 17 bp, Homo sapiens
agggagtgacagaggca

SEQ ID NO: 1992593 - DNA, 19 bp, Homo sapiens
agggagtgacagaggcagc

SEQ ID NO: 1992594 - DNA, 19 bp, Homo sapiens
agggagttgctcactcagg

SEQ ID NO: 1992595 - DNA, 23 bp, Homo sapiens
agggagttgctcactcaggactt

SEQ ID NO: 1992596 - DNA, 15 bp, Homo sapiens
agggatcacagggcc

SEQ ID NO: 1992597 - DNA, 17 bp, Homo sapiens
agggatcacagggcccc

SEQ ID NO: 1992598 - DNA, 22 bp, Homo sapiens
agggatcacagggccccagaag

SEQ ID NO: 1992599 - DNA, 20 bp, Homo sapiens
agggatcttgcattcccagt

SEQ ID NO: 1992600 - DNA, 15 bp, Homo sapiens
agggatgactaaaat

SEQ ID NO: 1992601 - DNA, 16 bp, Homo sapiens
agggatgctgcctgag

SEQ ID NO: 1992602 - DNA, 17 bp, Homo sapiens
agggatggagaggcggc

SEQ ID NO: 1992603 - DNA, 23 bp, Homo sapiens
agggatgtgaattgcctgcagag

SEQ ID NO: 1992604 - DNA, 16 bp, Homo sapiens
agggatgttctagccc

SEQ ID NO: 1992605 - DNA, 20 bp, Homo sapiens
agggattagggagagaagat

SEQ ID NO: 1992606 - DNA, 21 bp, Homo sapiens
agggattctggtcttcactgc

SEQ ID NO: 1992607 - DNA, 18 bp, Homo sapiens
agggcaaaccatttcaaa

SEQ ID NO: 1992608 - DNA, 20 bp, Homo sapiens
agggcaaatgacatgcactg

SEQ ID NO: 1992609 - DNA, 22 bp, Homo sapiens
agggcaataaatgccctctctg

SEQ ID NO: 1992610 - DNA, 12 bp, Homo sapiens
agggcacaggag

SEQ ID NO: 1992611 - DNA, 13 bp, Homo sapiens
agggcacaggagc

SEQ ID NO: 1992612 - DNA, 20 bp, Homo sapiens
agggcacaggagctacctgt

SEQ ID NO: 1992613 - DNA, 23 bp, Homo sapiens
agggcacaggagctacctgtgtg

SEQ ID NO: 1992614 - DNA, 17 bp, Homo sapiens
agggcactcacatgccg

SEQ ID NO: 1992615 - DNA, 14 bp, Homo sapiens
agggcactggtggc

SEQ ID NO: 1992616 - DNA, 15 bp, Homo sapiens
agggcagagccatgg

SEQ ID NO: 1992617 - DNA, 23 bp, Homo sapiens
agggcagagccatgggcctgggc

SEQ ID NO: 1992618 - DNA, 15 bp, Homo sapiens
agggcagaggctgga

SEQ ID NO: 1992619 - DNA, 20 bp, Homo sapiens
agggcagaggctggaggcag

SEQ ID NO: 1992620 - DNA, 22 bp, Homo sapiens
agggcagaggctggaggcaggg

SEQ ID NO: 1992621 - DNA, 22 bp, Homo sapiens
agggcagagggaatgttccctg

SEQ ID NO: 1992622 - DNA, 15 bp, Homo sapiens
agggcagagtgggct

SEQ ID NO: 1992623 - DNA, 22 bp, Homo sapiens
agggcagagtgggctgcctggg

SEQ ID NO: 1992624 - DNA, 16 bp, Homo sapiens
agggcagcagccagcc

SEQ ID NO: 1992625 - DNA, 17 bp, Homo sapiens
agggcagcagccagccc

SEQ ID NO: 1992626 - DNA, 21 bp, Homo sapiens
agggcagcagccagccctgcc

SEQ ID NO: 1992627 - DNA, 15 bp, Homo sapiens
agggcagccaggggc

SEQ ID NO: 1992628 - DNA, 19 bp, Homo sapiens
agggcagccaggggctgct

SEQ ID NO: 1992629 - DNA, 21 bp, Homo sapiens
agggcagccaggggctgctca

SEQ ID NO: 1992630 - DNA, 23 bp, Homo sapiens
agggcagttcgcagccaccctga

SEQ ID NO: 1992631 - DNA, 16 bp, Homo sapiens
agggcatattaaaggc

SEQ ID NO: 1992632 - DNA, 19 bp, Homo sapiens
agggcatccgcagcccagg

SEQ ID NO: 1992633 - DNA, 18 bp, Homo sapiens
agggcatccttctgcctt

SEQ ID NO: 1992634 - DNA, 17 bp, Homo sapiens
agggcatgcgcacaagg

SEQ ID NO: 1992635 - DNA, 15 bp, Homo sapiens
agggccacgtgccag

SEQ ID NO: 1992636 - DNA, 20 bp, Homo sapiens
agggccacgtgccaggcccg

SEQ ID NO: 1992637 - DNA, 20 bp, Homo sapiens
agggccagaaggagggcaga

SEQ ID NO: 1992638 - DNA, 21 bp, Homo sapiens
agggccagaaggagggcagag

SEQ ID NO: 1992639 - DNA, 18 bp, Homo sapiens
agggccagagttccacaa

SEQ ID NO: 1992640 - DNA, 11 bp, Homo sapiens
agggccagccc

SEQ ID NO: 1992641 - DNA, 10 bp, Homo sapiens
agggccaggc

SEQ ID NO: 1992642 - DNA, 13 bp, Homo sapiens
agggccaggcagg

SEQ ID NO: 1992643 - DNA, 14 bp, Homo sapiens
agggccaggcaggt

SEQ ID NO: 1992644 - DNA, 19 bp, Homo sapiens
agggccagggccctgcaga

SEQ ID NO: 1992645 - DNA, 22 bp, Homo sapiens
agggccagggccctgcagaggg

SEQ ID NO: 1992646 - DNA, 23 bp, Homo sapiens
agggcccagctgtagccatggct

SEQ ID NO: 1992647 - DNA, 14 bp, Homo sapiens
agggcccaggcagg

SEQ ID NO: 1992648 - DNA, 15 bp, Homo sapiens
agggcccaggcaggc

SEQ ID NO: 1992649 - DNA, 13 bp, Homo sapiens
agggcccccacag

SEQ ID NO: 1992650 - DNA, 13 bp, Homo sapiens
agggcccctccct

SEQ ID NO: 1992651 - DNA, 16 bp, Homo sapiens
agggcccctccctctg

SEQ ID NO: 1992652 - DNA, 16 bp, Homo sapiens
agggccctgagctcgg

SEQ ID NO: 1992653 - DNA, 19 bp, Homo sapiens
agggccggggaactggcca

SEQ ID NO: 1992654 - DNA, 20 bp, Homo sapiens
agggccggggaactggccaa

SEQ ID NO: 1992655 - DNA, 22 bp, Homo sapiens
agggccggggaactggccaagc

SEQ ID NO: 1992656 - DNA, 13 bp, Homo sapiens
agggcctgctgga

SEQ ID NO: 1992657 - DNA, 17 bp, Homo sapiens
agggcctgggggcagtg

SEQ ID NO: 1992658 - DNA, 18 bp, Homo sapiens
agggcctgtgggagcctg

SEQ ID NO: 1992659 - DNA, 15 bp, Homo sapiens
agggccttgcccaga

SEQ ID NO: 1992660 - DNA, 17 bp, Homo sapiens
agggccttgcccagaga

SEQ ID NO: 1992661 - DNA, 19 bp, Homo sapiens
agggccttgcccagagatg

SEQ ID NO: 1992662 - DNA, 16 bp, Homo sapiens
agggccttttgtggat

SEQ ID NO: 1992663 - DNA, 21 bp, Homo sapiens
agggcgcccattcgtctgtcc

SEQ ID NO: 1992664 - DNA, 22 bp, Homo sapiens
agggcgcccattcgtctgtccc

SEQ ID NO: 1992665 - DNA, 23 bp, Homo sapiens
agggcgcccattcgtctgtccca

SEQ ID NO: 1992666 - DNA, 15 bp, Homo sapiens
agggcgggagtgggg

SEQ ID NO: 1992667 - DNA, 21 bp, Homo sapiens
agggcggggctatgccttgtc

SEQ ID NO: 1992668 - DNA, 16 bp, Homo sapiens
agggcgtgactcaccc

SEQ ID NO: 1992669 - DNA, 13 bp, Homo sapiens
agggctaagagct

SEQ ID NO: 1992670 - DNA, 23 bp, Homo sapiens
agggctaagagctagcgctgccg

SEQ ID NO: 1992671 - DNA, 17 bp, Homo sapiens
agggctagaacctggaa

SEQ ID NO: 1992672 - DNA, 22 bp, Homo sapiens
agggctagaacctggagggcta

SEQ ID NO: 1992673 - DNA, 18 bp, Homo sapiens
agggctagaacctggcag

SEQ ID NO: 1992674 - DNA, 18 bp, Homo sapiens
agggctagaactggagag

SEQ ID NO: 1992675 - DNA, 18 bp, Homo sapiens
agggctagaatctggaga

SEQ ID NO: 1992676 - DNA, 20 bp, Homo sapiens
agggctagaatctggagagc

SEQ ID NO: 1992677 - DNA, 14 bp, Homo sapiens
agggctatggcaag

SEQ ID NO: 1992678 - DNA, 22 bp, Homo sapiens
agggctcagcggggacagctcc

SEQ ID NO: 1992679 - DNA, 13 bp, Homo sapiens
agggctccagcat

SEQ ID NO: 1992680 - DNA, 18 bp, Homo sapiens
agggctccctcctggagc

SEQ ID NO: 1992681 - DNA, 19 bp, Homo sapiens
agggctccctcctggagca

SEQ ID NO: 1992682 - DNA, 20 bp, Homo sapiens
agggctccctcctggagcat

SEQ ID NO: 1992683 - DNA, 22 bp, Homo sapiens
agggctccctcctggagcatcc

SEQ ID NO: 1992684 - DNA, 14 bp, Homo sapiens
agggctcgggcgct

SEQ ID NO: 1992685 - DNA, 22 bp, Homo sapiens
agggctcgggcgctgtggctcc

SEQ ID NO: 1992686 - DNA, 23 bp, Homo sapiens
agggctcgggcgctgtggctcct

SEQ ID NO: 1992687 - DNA, 15 bp, Homo sapiens
agggctctcctggct

SEQ ID NO: 1992688 - DNA, 14 bp, Homo sapiens
agggctctgaggcg

SEQ ID NO: 1992689 - DNA, 15 bp, Homo sapiens
agggctgacctgcct

SEQ ID NO: 1992690 - DNA, 19 bp, Homo sapiens
agggctgacctgcctctca

SEQ ID NO: 1992691 - DNA, 23 bp, Homo sapiens
agggctgccactaacctgtagaa

SEQ ID NO: 1992692 - DNA, 14 bp, Homo sapiens
agggctgcccctgt

SEQ ID NO: 1992693 - DNA, 21 bp, Homo sapiens
agggctggaaaagtcacacag

SEQ ID NO: 1992694 - DNA, 19 bp, Homo sapiens
agggctggagtgcgctctt

SEQ ID NO: 1992695 - DNA, 14 bp, Homo sapiens
agggctgggcagct

SEQ ID NO: 1992696 - DNA, 12 bp, Homo sapiens
agggctgggccc

SEQ ID NO: 1992697 - DNA, 16 bp, Homo sapiens
agggctgttggacagc

SEQ ID NO: 1992698 - DNA, 20 bp, Homo sapiens
agggctgttggacagctgct

SEQ ID NO: 1992699 - DNA, 22 bp, Homo sapiens
agggctgttggacagctgcttg

SEQ ID NO: 1992700 - DNA, 24 bp, Homo sapiens
agggctgttggacagctgcttgtg

SEQ ID NO: 1992701 - DNA, 19 bp, Homo sapiens
agggcttggtaaaacacag

SEQ ID NO: 1992702 - DNA, 19 bp, Homo sapiens
aggggaatgtttgcctctg

SEQ ID NO: 1992703 - DNA, 13 bp, Homo sapiens
aggggacatttcc

SEQ ID NO: 1992704 - DNA, 14 bp, Homo sapiens
aggggacatttccc

SEQ ID NO: 1992705 - DNA, 20 bp, Homo sapiens
aggggacatttccctcctgg

SEQ ID NO: 1992706 - DNA, 13 bp, Homo sapiens
agtcctcacagcc

SEQ ID NO: 1992707 - DNA, 14 bp, Homo sapiens
agtcctcacagcct

SEQ ID NO: 1992708 - DNA, 22 bp, Homo sapiens
agtcctctcttctctattcctg

SEQ ID NO: 1992709 - DNA, 19 bp, Homo sapiens
agtcctcttttctgagagg

SEQ ID NO: 1992710 - DNA, 19 bp, Homo sapiens
agtcctggtctgctcagga

SEQ ID NO: 1992711 - DNA, 17 bp, Homo sapiens
agtcctgtctctgcctg

SEQ ID NO: 1992712 - DNA, 14 bp, Homo sapiens
agtcctgtgaattt

SEQ ID NO: 1992713 - DNA, 16 bp, Homo sapiens
agtcctgtgaatttct

SEQ ID NO: 1992714 - DNA, 18 bp, Homo sapiens
agtcctttgattccattt

SEQ ID NO: 1992715 - DNA, 17 bp, Homo sapiens
agtcgacatactcattt

SEQ ID NO: 1992716 - DNA, 17 bp, Homo sapiens
agtcgagagggctgttg

SEQ ID NO: 1992717 - DNA, 16 bp, Homo sapiens
agtcgaggacagggag

SEQ ID NO: 1992718 - DNA, 17 bp, Homo sapiens
agtcgcaggatccgctg

SEQ ID NO: 1992719 - DNA, 19 bp, Homo sapiens
agtcgctgtggttgtttta

SEQ ID NO: 1992720 - DNA, 13 bp, Homo sapiens
agtcgtaagggtt

SEQ ID NO: 1992721 - DNA, 22 bp, Homo sapiens
agtcgtcatcacttttcagtga

SEQ ID NO: 1992722 - DNA, 20 bp, Homo sapiens
agtcgtccttactcctgtgg

SEQ ID NO: 1992723 - DNA, 21 bp, Homo sapiens
agtcgtccttactcctgtggg

SEQ ID NO: 1992724 - DNA, 22 bp, Homo sapiens
agtcgtccttactcctgtggga

SEQ ID NO: 1992725 - DNA, 20 bp, Homo sapiens
agtctaaagtttacagtaaa

SEQ ID NO: 1992726 - DNA, 17 bp, Homo sapiens
agtctacctcttcagta

SEQ ID NO: 1992727 - DNA, 14 bp, Homo sapiens
agtctacgctctcc

SEQ ID NO: 1992728 - DNA, 17 bp, Homo sapiens
agtctacgctctccttt

SEQ ID NO: 1992729 - DNA, 22 bp, Homo sapiens
agtctacttcactaatgacgat

SEQ ID NO: 1992730 - DNA, 18 bp, Homo sapiens
agtctaggagctgggagg

SEQ ID NO: 1992731 - DNA, 19 bp, Homo sapiens
agtctagtgaagatgttgt

SEQ ID NO: 1992732 - DNA, 23 bp, Homo sapiens
agtctatcaaccccagacactgg

SEQ ID NO: 1992733 - DNA, 15 bp, Homo sapiens
agtctattgtttgtt

SEQ ID NO: 1992734 - DNA, 18 bp, Homo sapiens
agtctcactgttgcccag

SEQ ID NO: 1992735 - DNA, 20 bp, Homo sapiens
agtctcactgttgcccaggc

SEQ ID NO: 1992736 - DNA, 19 bp, Homo sapiens
agtctcagaaagccttcca

SEQ ID NO: 1992737 - DNA, 13 bp, Homo sapiens
agtctcaggaaat

SEQ ID NO: 1992738 - DNA, 16 bp, Homo sapiens
agtctcaggaaatcaa

SEQ ID NO: 1992739 - DNA, 13 bp, Homo sapiens
agtctcagtccag

SEQ ID NO: 1992740 - DNA, 17 bp, Homo sapiens
agtctcattctgttgcc

SEQ ID NO: 1992741 - DNA, 22 bp, Homo sapiens
agtctccagtggttgctgttga

SEQ ID NO: 1992742 - DNA, 15 bp, Homo sapiens
agtctcccattctca

SEQ ID NO: 1992743 - DNA, 17 bp, Homo sapiens
agtctcctttgcactga

SEQ ID NO: 1992744 - DNA, 23 bp, Homo sapiens
agtctcctttgcactgagggcca

SEQ ID NO: 1992745 - DNA, 15 bp, Homo sapiens
agtctctctctccct

SEQ ID NO: 1992746 - DNA, 17 bp, Homo sapiens
agtctctgactcttgcc

SEQ ID NO: 1992747 - DNA, 11 bp, Homo sapiens
agtctctggga

SEQ ID NO: 1992748 - DNA, 12 bp, Homo sapiens
agtctcttcaga

SEQ ID NO: 1992749 - DNA, 19 bp, Homo sapiens
agtctcttctccactggat

SEQ ID NO: 1992750 - DNA, 15 bp, Homo sapiens
agtctctttaatctt

SEQ ID NO: 1992751 - DNA, 18 bp, Homo sapiens
agtctcttttttattctg

SEQ ID NO: 1992752 - DNA, 17 bp, Homo sapiens
agtctgaacccttgtgc

SEQ ID NO: 1992753 - DNA, 19 bp, Homo sapiens
agtctgaacccttgtgctt

SEQ ID NO: 1992754 - DNA, 12 bp, Homo sapiens
agtctgagcccc

SEQ ID NO: 1992755 - DNA, 23 bp, Homo sapiens
agtctgagctgtaggtaaccggc

SEQ ID NO: 1992756 - DNA, 15 bp, Homo sapiens
agtctgaggtcctga

SEQ ID NO: 1992757 - DNA, 16 bp, Homo sapiens
agtctgaggtcctgag

SEQ ID NO: 1992758 - DNA, 17 bp, Homo sapiens
agtctgaggtcctgagc

SEQ ID NO: 1992759 - DNA, 19 bp, Homo sapiens
agtctgagtcctgtctctg

SEQ ID NO: 1992760 - DNA, 23 bp, Homo sapiens
agtctgagtcctgtctctgcctg

SEQ ID NO: 1992761 - DNA, 14 bp, Homo sapiens
agtctgagtctgag

SEQ ID NO: 1992762 - DNA, 15 bp, Homo sapiens
agtctgagtctgagt

SEQ ID NO: 1992763 - DNA, 16 bp, Homo sapiens
agtctgattcccaagc

SEQ ID NO: 1992764 - DNA, 21 bp, Homo sapiens
agtctgattcccaagctctgc

SEQ ID NO: 1992765 - DNA, 19 bp, Homo sapiens
agtctgcataaacttcatc

SEQ ID NO: 1992766 - DNA, 23 bp, Homo sapiens
agtctgcataaacttcatcttca

SEQ ID NO: 1992767 - DNA, 17 bp, Homo sapiens
agtctggaatgcagtgg

SEQ ID NO: 1992768 - DNA, 15 bp, Homo sapiens
agtctggatctggga

SEQ ID NO: 1992769 - DNA, 17 bp, Homo sapiens
agtctgggatgtagaac

SEQ ID NO: 1992770 - DNA, 21 bp, Homo sapiens
agtctgggcaatgaaaccaaa

SEQ ID NO: 1992771 - DNA, 22 bp, Homo sapiens
agtctgggcaatgaaaccaaag

SEQ ID NO: 1992772 - DNA, 14 bp, Homo sapiens
agtctgggtgtctc

SEQ ID NO: 1992773 - DNA, 13 bp, Homo sapiens
agtctgtcatcca

SEQ ID NO: 1992774 - DNA, 19 bp, Homo sapiens
agtctgtgtgatgaacttt

SEQ ID NO: 1992775 - DNA, 21 bp, Homo sapiens
agtctgtgtgatgaactttct

SEQ ID NO: 1992776 - DNA, 17 bp, Homo sapiens
agtctgtgtgcacaatg

SEQ ID NO: 1992777 - DNA, 13 bp, Homo sapiens
agtcttaaaataa

SEQ ID NO: 1992778 - DNA, 17 bp, Homo sapiens
agtcttcttcacccgct

SEQ ID NO: 1992779 - DNA, 21 bp, Homo sapiens
agtcttcttcacccgctgcag

SEQ ID NO: 1992780 - DNA, 14 bp, Homo sapiens
agtcttgcagctga

SEQ ID NO: 1992781 - DNA, 13 bp, Homo sapiens
agtcttgcctagg

SEQ ID NO: 1992782 - DNA, 12 bp, Homo sapiens
agtcttgtgctt

SEQ ID NO: 1992783 - DNA, 15 bp, Homo sapiens
agtcttgtgcttttc

SEQ ID NO: 1992784 - DNA, 16 bp, Homo sapiens
agtctttaatcccagt

SEQ ID NO: 1992785 - DNA, 12 bp, Homo sapiens
agtcttttactc

SEQ ID NO: 1992786 - DNA, 22 bp, Homo sapiens
agtgaaaaatatgttgagtgtt

SEQ ID NO: 1992787 - DNA, 14 bp, Homo sapiens
agtgaaaataggta

SEQ ID NO: 1992788 - DNA, 22 bp, Homo sapiens
agtgaaagaggcagcttgaaac

SEQ ID NO: 1992789 - DNA, 18 bp, Homo sapiens
agtgaaagggctatggca

SEQ ID NO: 1992790 - DNA, 15 bp, Homo sapiens
agtgaaccaaagaga

SEQ ID NO: 1992791 - DNA, 21 bp, Homo sapiens
agtgaaccatcattataaacg

SEQ ID NO: 1992792 - DNA, 23 bp, Homo sapiens
agtgaacctttaaagtaaaggcc

SEQ ID NO: 1992793 - DNA, 16 bp, Homo sapiens
agtgaagacttcttgg

SEQ ID NO: 1992794 - DNA, 18 bp, Homo sapiens
agtgaagccccttgtcct

SEQ ID NO: 1992795 - DNA, 21 bp, Homo sapiens
agtgaagccccttgtcctctc

SEQ ID NO: 1992796 - DNA, 17 bp, Homo sapiens
agtgaaggagccacgtg

SEQ ID NO: 1992797 - DNA, 21 bp, Homo sapiens
agtgaagttcttttactgtaa

SEQ ID NO: 1992798 - DNA, 22 bp, Homo sapiens
agtgaagttcttttactgtaat

SEQ ID NO: 1992799 - DNA, 19 bp, Homo sapiens
agtgaagttgcttcttcta

SEQ ID NO: 1992800 - DNA, 13 bp, Homo sapiens
agtgaataaactt

SEQ ID NO: 1992801 - DNA, 14 bp, Homo sapiens
agtgaataaacttc

SEQ ID NO: 1992802 - DNA, 19 bp, Homo sapiens
agtgaataaacttcagcac

SEQ ID NO: 1992803 - DNA, 23 bp, Homo sapiens
agtgaatctaaaagcttttgctt

SEQ ID NO: 1992804 - DNA, 14 bp, Homo sapiens
agtgaatttgcctg

SEQ ID NO: 1992805 - DNA, 19 bp, Homo sapiens
agtgacaaaattggccaga

SEQ ID NO: 1992806 - DNA, 15 bp, Homo sapiens
agtgacaagtggagg

SEQ ID NO: 1992807 - DNA, 19 bp, Homo sapiens
agtgacacccaagagggct

SEQ ID NO: 1992808 - DNA, 20 bp, Homo sapiens
agtgacacccaagagggctg

SEQ ID NO: 1992809 - DNA, 20 bp, Homo sapiens
agtgacagagacccagatct

SEQ ID NO: 1992810 - DNA, 22 bp, Homo sapiens
agtgacatctctttgatgtcat

SEQ ID NO: 1992811 - DNA, 21 bp, Homo sapiens
agtgaccccagcctcctgcct

SEQ ID NO: 1992812 - DNA, 21 bp, Homo sapiens
agtgacccttcccaatcagca

SEQ ID NO: 1992813 - DNA, 12 bp, Homo sapiens
agtgacctgacc

SEQ ID NO: 1992814 - DNA, 20 bp, Homo sapiens
agtgacctgaccggcacctg

SEQ ID NO: 1992815 - DNA, 14 bp, Homo sapiens
agtgacgtgcacct

SEQ ID NO: 1992816 - DNA, 14 bp, Homo sapiens
agtgactcgagggt

SEQ ID NO: 1992817 - DNA, 15 bp, Homo sapiens
agtgactcggtgtaa

SEQ ID NO: 1992818 - DNA, 17 bp, Homo sapiens
agtgactcggtgtaaaa

SEQ ID NO: 1992819 - DNA, 23 bp, Homo sapiens
agtgactcggtgtaaaaccatgt

SEQ ID NO: 1992820 - DNA, 21 bp, Homo sapiens
agttcaacctggtggcaccag

SEQ ID NO: 1992821 - DNA, 15 bp, Homo sapiens
agttcaagcctgtgg

SEQ ID NO: 1992822 - DNA, 16 bp, Homo sapiens
agttcaagcctgtggg

SEQ ID NO: 1992823 - DNA, 16 bp, Homo sapiens
agttcactataaatgg

SEQ ID NO: 1992824 - DNA, 19 bp, Homo sapiens
agttcaggagtcccaagga

SEQ ID NO: 1992825 - DNA, 20 bp, Homo sapiens
agttcaggtaacaggcagat

SEQ ID NO: 1992826 - DNA, 15 bp, Homo sapiens
agttcagttctgttt

SEQ ID NO: 1992827 - DNA, 18 bp, Homo sapiens
agttccaaaatgccaaat

SEQ ID NO: 1992828 - DNA, 16 bp, Homo sapiens
agttccagctggtctt

SEQ ID NO: 1992829 - DNA, 13 bp, Homo sapiens
agttccatgaaga

SEQ ID NO: 1992830 - DNA, 19 bp, Homo sapiens
agttcccggagcacagccc

SEQ ID NO: 1992831 - DNA, 15 bp, Homo sapiens
agttccctacttcct

SEQ ID NO: 1992832 - DNA, 16 bp, Homo sapiens
agttcctcgccctggg

SEQ ID NO: 1992833 - DNA, 15 bp, Homo sapiens
agttcctctttgcat

SEQ ID NO: 1992834 - DNA, 21 bp, Homo sapiens
agttcctctttgcatggaatt

SEQ ID NO: 1992835 - DNA, 17 bp, Homo sapiens
agttcctgcactccaga

SEQ ID NO: 1992836 - DNA, 18 bp, Homo sapiens
agttcgagaccaacctga

SEQ ID NO: 1992837 - DNA, 14 bp, Homo sapiens
agttcgagaccagc

SEQ ID NO: 1992838 - DNA, 19 bp, Homo sapiens
agttcgagaccagcctggc

SEQ ID NO: 1992839 - DNA, 22 bp, Homo sapiens
agttctaagttcatgtttgtaa

SEQ ID NO: 1992840 - DNA, 18 bp, Homo sapiens
agttctacaagcatattt

SEQ ID NO: 1992841 - DNA, 23 bp, Homo sapiens
agttctacaagcatatttgagaa

SEQ ID NO: 1992842 - DNA, 15 bp, Homo sapiens
agttctagagaagag

SEQ ID NO: 1992843 - DNA, 16 bp, Homo sapiens
agttctagagaagagg

SEQ ID NO: 1992844 - DNA, 15 bp, Homo sapiens
agttctgacattcat

SEQ ID NO: 1992845 - DNA, 15 bp, Homo sapiens
agttctgagtgtttt

SEQ ID NO: 1992846 - DNA, 17 bp, Homo sapiens
agttctgctcctctcca

SEQ ID NO: 1992847 - DNA, 21 bp, Homo sapiens
agttctgctcctctccaggca

SEQ ID NO: 1992848 - DNA, 12 bp, Homo sapiens
agttctgctcta

SEQ ID NO: 1992849 - DNA, 15 bp, Homo sapiens
agttctggtccacaa

SEQ ID NO: 1992850 - DNA, 18 bp, Homo sapiens
agttctggtccacaaacc

SEQ ID NO: 1992851 - DNA, 22 bp, Homo sapiens
agttcttgagtagatctgcttc

SEQ ID NO: 1992852 - DNA, 13 bp, Homo sapiens
agttcttgtgcat

SEQ ID NO: 1992853 - DNA, 17 bp, Homo sapiens
agttcttgtgcatgttt

SEQ ID NO: 1992854 - DNA, 18 bp, Homo sapiens
agttcttgtgcatgttta

SEQ ID NO: 1992855 - DNA, 20 bp, Homo sapiens
agttcttgtgcatgtttact

SEQ ID NO: 1992856 - DNA, 21 bp, Homo sapiens
agttcttgtgcatgtttactt

SEQ ID NO: 1992857 - DNA, 12 bp, Homo sapiens
agttcttgtgcc

SEQ ID NO: 1992858 - DNA, 13 bp, Homo sapiens
agttcttgtgcca

SEQ ID NO: 1992859 - DNA, 18 bp, Homo sapiens
agttgaaaagactccaaa

SEQ ID NO: 1992860 - DNA, 19 bp, Homo sapiens
agttgaaaagactccaaag

SEQ ID NO: 1992861 - DNA, 18 bp, Homo sapiens
agttgaaaataaagtgta

SEQ ID NO: 1992862 - DNA, 16 bp, Homo sapiens
agttgaaatcagaagc

SEQ ID NO: 1992863 - DNA, 19 bp, Homo sapiens
agttgaatgacaacagaag

SEQ ID NO: 1992864 - DNA, 19 bp, Homo sapiens
agttgaccgttttcatcct

SEQ ID NO: 1992865 - DNA, 17 bp, Homo sapiens
agttgacgcatcctgca

SEQ ID NO: 1992866 - DNA, 16 bp, Homo sapiens
agttgacttactgttt

SEQ ID NO: 1992867 - DNA, 20 bp, Homo sapiens
agttgacttactgtttctta

SEQ ID NO: 1992868 - DNA, 22 bp, Homo sapiens
agttgacttactgtttcttacc

SEQ ID NO: 1992869 - DNA, 20 bp, Homo sapiens
agttgagtacagtgaggagg

SEQ ID NO: 1992870 - DNA, 19 bp, Homo sapiens
agttgagtctcctctctga

SEQ ID NO: 1992871 - DNA, 23 bp, Homo sapiens
agttgagtctcctctctgagact

SEQ ID NO: 1992872 - DNA, 21 bp, Homo sapiens
agttgataaagattttttaat

SEQ ID NO: 1992873 - DNA, 20 bp, Homo sapiens
agttgatgaccaatctctgt

SEQ ID NO: 1992874 - DNA, 15 bp, Homo sapiens
agttgcaataaaata

SEQ ID NO: 1992875 - DNA, 13 bp, Homo sapiens
agttgcagtctca

SEQ ID NO: 1992876 - DNA, 20 bp, Homo sapiens
agttgcagtctcagaaagcc

SEQ ID NO: 1992877 - DNA, 20 bp, Homo sapiens
agttgctagtactggggaga

SEQ ID NO: 1992878 - DNA, 22 bp, Homo sapiens
agttgctttaaagtacctgtag

SEQ ID NO: 1992879 - DNA, 18 bp, Homo sapiens
agttggaaccgtgtccag

SEQ ID NO: 1992880 - DNA, 15 bp, Homo sapiens
agttggagaccaggc

SEQ ID NO: 1992881 - DNA, 20 bp, Homo sapiens
agttggcagagaaggcctct

SEQ ID NO: 1992882 - DNA, 16 bp, Homo sapiens
agttggctaggacccc

SEQ ID NO: 1992883 - DNA, 18 bp, Homo sapiens
agttggctggatgaaatt

SEQ ID NO: 1992884 - DNA, 13 bp, Homo sapiens
agttgggagcact

SEQ ID NO: 1992885 - DNA, 15 bp, Homo sapiens
agttgggagcactgg

SEQ ID NO: 1992886 - DNA, 22 bp, Homo sapiens
agttgggatgcggggcagagcc

SEQ ID NO: 1992887 - DNA, 19 bp, Homo sapiens
agttgggcttcctcatagt

SEQ ID NO: 1992888 - DNA, 17 bp, Homo sapiens
agttgggtggatgcctg

SEQ ID NO: 1992889 - DNA, 18 bp, Homo sapiens
agttgtacgtaatgtatt

SEQ ID NO: 1992890 - DNA, 20 bp, Homo sapiens
agttgtacgtaatgtattta

SEQ ID NO: 1992891 - DNA, 15 bp, Homo sapiens
agttgtactgtatgc

SEQ ID NO: 1992892 - DNA, 15 bp, Homo sapiens
agttgtatctctttt

SEQ ID NO: 1992893 - DNA, 18 bp, Homo sapiens
agttgtctattctgagcc

SEQ ID NO: 1992894 - DNA, 13 bp, Homo sapiens
agttgtgatcatc

SEQ ID NO: 1992895 - DNA, 15 bp, Homo sapiens
agttgtgccttttat

SEQ ID NO: 1992896 - DNA, 17 bp, Homo sapiens
agttgtgggtgggagag

SEQ ID NO: 1992897 - DNA, 19 bp, Homo sapiens
agttgtgttaacaatgcag

SEQ ID NO: 1992898 - DNA, 21 bp, Homo sapiens
agttgttcgccgcgtggaatg

SEQ ID NO: 1992899 - DNA, 15 bp, Homo sapiens
agttgtttgtgcctt

SEQ ID NO: 1992900 - DNA, 19 bp, Homo sapiens
agttgttttcagactcaga

SEQ ID NO: 1992901 - DNA, 16 bp, Homo sapiens
agtttaaaaaatacac

SEQ ID NO: 1992902 - DNA, 20 bp, Homo sapiens
agtttaatggtgccttcatt

SEQ ID NO: 1992903 - DNA, 20 bp, Homo sapiens
agtttaattaactatgtgat

SEQ ID NO: 1992904 - DNA, 21 bp, Homo sapiens
agtttacaagtgtatatcaga

SEQ ID NO: 1992905 - DNA, 13 bp, Homo sapiens
agtttacagtaaa

SEQ ID NO: 1992906 - DNA, 20 bp, Homo sapiens
agtttactagcttttcaaac

SEQ ID NO: 1992907 - DNA, 14 bp, Homo sapiens
agtttactatttta

SEQ ID NO: 1992908 - DNA, 15 bp, Homo sapiens
agtttactattttac

SEQ ID NO: 1992909 - DNA, 13 bp, Homo sapiens
agtttagaacaga

SEQ ID NO: 1992910 - DNA, 17 bp, Homo sapiens
agtttagaacagaggga

SEQ ID NO: 1992911 - DNA, 19 bp, Homo sapiens
agtttagaggaaaaaaatg

SEQ ID NO: 1992912 - DNA, 18 bp, Homo sapiens
agtttagcagttaaaagt

SEQ ID NO: 1992913 - DNA, 22 bp, Homo sapiens
agtttattgacaataatttcag

SEQ ID NO: 1992914 - DNA, 22 bp, Homo sapiens
agtttatttccaaataaaatga

SEQ ID NO: 1992915 - DNA, 18 bp, Homo sapiens
agtttatttgttgagagt

SEQ ID NO: 1992916 - DNA, 23 bp, Homo sapiens
agtttatttgttgagagtgtgac

SEQ ID NO: 1992917 - DNA, 17 bp, Homo sapiens
agtttattttgttacac

SEQ ID NO: 1992918 - DNA, 12 bp, Homo sapiens
agtttcagagaa

SEQ ID NO: 1992919 - DNA, 17 bp, Homo sapiens
agtttcagatatatatc

SEQ ID NO: 1992920 - DNA, 18 bp, Homo sapiens
agtttcaggtgtttagtt

SEQ ID NO: 1992921 - DNA, 17 bp, Homo sapiens
agtttcctcatctgcag

SEQ ID NO: 1992922 - DNA, 15 bp, Homo sapiens
agtttctagaggcct

SEQ ID NO: 1992923 - DNA, 16 bp, Homo sapiens
agtttctagctagaaa

SEQ ID NO: 1992924 - DNA, 21 bp, Homo sapiens
agtttctagctagaaatatga

SEQ ID NO: 1992925 - DNA, 17 bp, Homo sapiens
agtttctattgtaaatt

SEQ ID NO: 1992926 - DNA, 15 bp, Homo sapiens
agtttctcagctccc

SEQ ID NO: 1992927 - DNA, 19 bp, Homo sapiens
agtttcttggtctcagctt

SEQ ID NO: 1992928 - DNA, 15 bp, Homo sapiens
agtttctttctgtta

SEQ ID NO: 1992929 - DNA, 13 bp, Homo sapiens
agtttctttggga

SEQ ID NO: 1992930 - DNA, 22 bp, Homo sapiens
agtttgagaccagcctggccaa

SEQ ID NO: 1992931 - DNA, 19 bp, Homo sapiens
agtttgcaaatgcaacaaa

SEQ ID NO: 1992932 - DNA, 14 bp, Homo sapiens
agtttgcagaaaag

SEQ ID NO: 1992933 - DNA, 22 bp, Homo sapiens
agtttgcagaaaagcacctgcc

SEQ ID NO: 1992934 - DNA, 17 bp, Homo sapiens
atactccaagcttcaag

SEQ ID NO: 1992935 - DNA, 21 bp, Homo sapiens
atactccaagcttcaagtgat

SEQ ID NO: 1992936 - DNA, 15 bp, Homo sapiens
atactccatacataa

SEQ ID NO: 1992937 - DNA, 16 bp, Homo sapiens
atactccatacataac

SEQ ID NO: 1992938 - DNA, 18 bp, Homo sapiens
atactctagaacatgcac

SEQ ID NO: 1992939 - DNA, 19 bp, Homo sapiens
atactctagaacatgcaca

SEQ ID NO: 1992940 - DNA, 13 bp, Homo sapiens
atactctgtcaga

SEQ ID NO: 1992941 - DNA, 21 bp, Homo sapiens
atactcttaggaagagaaacc

SEQ ID NO: 1992942 - DNA, 22 bp, Homo sapiens
atactcttaggaagagaaacca

SEQ ID NO: 1992943 - DNA, 21 bp, Homo sapiens
atactgcgggcaccagaatgc

SEQ ID NO: 1992944 - DNA, 12 bp, Homo sapiens
atactgctctga

SEQ ID NO: 1992945 - DNA, 13 bp, Homo sapiens
atactgctctgaa

SEQ ID NO: 1992946 - DNA, 17 bp, Homo sapiens
atactggaagttttgca

SEQ ID NO: 1992947 - DNA, 14 bp, Homo sapiens
atactgtacataga

SEQ ID NO: 1992948 - DNA, 22 bp, Homo sapiens
atactgtacatagatgtatcat

SEQ ID NO: 1992949 - DNA, 15 bp, Homo sapiens
atacttaacattgat

SEQ ID NO: 1992950 - DNA, 18 bp, Homo sapiens
atacttcaggtgcttttg

SEQ ID NO: 1992951 - DNA, 18 bp, Homo sapiens
atacttgagctgtatata

SEQ ID NO: 1992952 - DNA, 19 bp, Homo sapiens
atacttgagctgtatatat

SEQ ID NO: 1992953 - DNA, 15 bp, Homo sapiens
atactttttttcaca

SEQ ID NO: 1992954 - DNA, 14 bp, Homo sapiens
atagaaacatgaca

SEQ ID NO: 1992955 - DNA, 21 bp, Homo sapiens
atagaaactgaggagtagctg

SEQ ID NO: 1992956 - DNA, 14 bp, Homo sapiens
atagaagctgtagt

SEQ ID NO: 1992957 - DNA, 19 bp, Homo sapiens
atagaagttcaatggctgc

SEQ ID NO: 1992958 - DNA, 22 bp, Homo sapiens
atagaatacttttttctagttt

SEQ ID NO: 1992959 - DNA, 19 bp, Homo sapiens
atagaatataattatcgga

SEQ ID NO: 1992960 - DNA, 12 bp, Homo sapiens
atagaatattta

SEQ ID NO: 1992961 - DNA, 13 bp, Homo sapiens
atagacagaagaa

SEQ ID NO: 1992962 - DNA, 14 bp, Homo sapiens
atagacagaagaaa

SEQ ID NO: 1992963 - DNA, 18 bp, Homo sapiens
atagacagaagaaacaag

SEQ ID NO: 1992964 - DNA, 22 bp, Homo sapiens
atagacagtagccaagttatat

SEQ ID NO: 1992965 - DNA, 17 bp, Homo sapiens
atagagagggggctctc

SEQ ID NO: 1992966 - DNA, 16 bp, Homo sapiens
atagagtatactaaaa

SEQ ID NO: 1992967 - DNA, 22 bp, Homo sapiens
atagagtgactccaagaacaat

SEQ ID NO: 1992968 - DNA, 14 bp, Homo sapiens
atagagtgttatca

SEQ ID NO: 1992969 - DNA, 17 bp, Homo sapiens
atagatcacggcatgtt

SEQ ID NO: 1992970 - DNA, 18 bp, Homo sapiens
atagatcacggcatgttt

SEQ ID NO: 1992971 - DNA, 19 bp, Homo sapiens
atagatgaatactaaatgg

SEQ ID NO: 1992972 - DNA, 20 bp, Homo sapiens
atagatgaatactaaatggt

SEQ ID NO: 1992973 - DNA, 23 bp, Homo sapiens
atagatggaccagtagacaactg

SEQ ID NO: 1992974 - DNA, 22 bp, Homo sapiens
atagatgggtctggctgagctg

SEQ ID NO: 1992975 - DNA, 14 bp, Homo sapiens
atagatgtatcatt

SEQ ID NO: 1992976 - DNA, 18 bp, Homo sapiens
atagattaatggcactga

SEQ ID NO: 1992977 - DNA, 17 bp, Homo sapiens
atagatttgtattttaa

SEQ ID NO: 1992978 - DNA, 18 bp, Homo sapiens
atagcaaaagaagaagtt

SEQ ID NO: 1992979 - DNA, 13 bp, Homo sapiens
atagcaaagaatt

SEQ ID NO: 1992980 - DNA, 17 bp, Homo sapiens
atagcaagattgcttaa

SEQ ID NO: 1992981 - DNA, 21 bp, Homo sapiens
atagcactgggaactctggct

SEQ ID NO: 1992982 - DNA, 18 bp, Homo sapiens
atagccaaaaatagctaa

SEQ ID NO: 1992983 - DNA, 21 bp, Homo sapiens
atagccacttaccttcaataa

SEQ ID NO: 1992984 - DNA, 16 bp, Homo sapiens
atagccagacacatgg

SEQ ID NO: 1992985 - DNA, 15 bp, Homo sapiens
atagccagagaggag

SEQ ID NO: 1992986 - DNA, 14 bp, Homo sapiens
atagcccaggtcct

SEQ ID NO: 1992987 - DNA, 15 bp, Homo sapiens
atagcctaggtgaca

SEQ ID NO: 1992988 - DNA, 15 bp, Homo sapiens
atagcgctggctcag

SEQ ID NO: 1992989 - DNA, 15 bp, Homo sapiens
atagctaacatttta

SEQ ID NO: 1992990 - DNA, 22 bp, Homo sapiens
atagctaacattttaaataaaa

SEQ ID NO: 1992991 - DNA, 16 bp, Homo sapiens
atagctatcatttctt

SEQ ID NO: 1992992 - DNA, 14 bp, Homo sapiens
atagctattactgt

SEQ ID NO: 1992993 - DNA, 18 bp, Homo sapiens
atagctattactgtctgg

SEQ ID NO: 1992994 - DNA, 18 bp, Homo sapiens
atagctattgcatgtaaa

SEQ ID NO: 1992995 - DNA, 22 bp, Homo sapiens
atagctattgcatgtaaaatgc

SEQ ID NO: 1992996 - DNA, 20 bp, Homo sapiens
atagctatttttatggaatt

SEQ ID NO: 1992997 - DNA, 16 bp, Homo sapiens
atagctcttctattta

SEQ ID NO: 1992998 - DNA, 18 bp, Homo sapiens
atagctcttctatttaaa

SEQ ID NO: 1992999 - DNA, 22 bp, Homo sapiens
atagctcttctatttaaaaaat

SEQ ID NO: 1993000 - DNA, 21 bp, Homo sapiens
atagctgagattcctggttcg

SEQ ID NO: 1993001 - DNA, 14 bp, Homo sapiens
atagctgatcagtt

SEQ ID NO: 1993002 - DNA, 12 bp, Homo sapiens
atagctgggact

SEQ ID NO: 1993003 - DNA, 17 bp, Homo sapiens
atagctgggactacagg

SEQ ID NO: 1993004 - DNA, 10 bp, Homo sapiens
atagctttat

SEQ ID NO: 1993005 - DNA, 18 bp, Homo sapiens
atagctttattttttaag

SEQ ID NO: 1993006 - DNA, 19 bp, Homo sapiens
atagctttattttttaagt

SEQ ID NO: 1993007 - DNA, 22 bp, Homo sapiens
atagctttattttttaagtatt

SEQ ID NO: 1993008 - DNA, 23 bp, Homo sapiens
atagctttattttttaagtattt

SEQ ID NO: 1993009 - DNA, 16 bp, Homo sapiens
ataggaattgcattag

SEQ ID NO: 1993010 - DNA, 22 bp, Homo sapiens
ataggatttatttaaaatagca

SEQ ID NO: 1993011 - DNA, 23 bp, Homo sapiens
ataggatttatttaaaatagcaa

SEQ ID NO: 1993012 - DNA, 16 bp, Homo sapiens
ataggcggtcatgtgt

SEQ ID NO: 1993013 - DNA, 19 bp, Homo sapiens
ataggcggtcatgtgtgca

SEQ ID NO: 1993014 - DNA, 21 bp, Homo sapiens
ataggcggtcatgtgtgcatg

SEQ ID NO: 1993015 - DNA, 13 bp, Homo sapiens
ataggctggagaa

SEQ ID NO: 1993016 - DNA, 14 bp, Homo sapiens
ataggctggagaag

SEQ ID NO: 1993017 - DNA, 21 bp, Homo sapiens
ataggctggagaagctcaccc

SEQ ID NO: 1993018 - DNA, 17 bp, Homo sapiens
ataggtcagagatgggc

SEQ ID NO: 1993019 - DNA, 21 bp, Homo sapiens
ataggtgctacaaaaacacag

SEQ ID NO: 1993020 - DNA, 20 bp, Homo sapiens
ataggttgccaataatacac

SEQ ID NO: 1993021 - DNA, 23 bp, Homo sapiens
atagtagcagagtcattgttaca

SEQ ID NO: 1993022 - DNA, 18 bp, Homo sapiens
atagtagtcaattagtac

SEQ ID NO: 1993023 - DNA, 21 bp, Homo sapiens
atagtagtcaattagtacagt

SEQ ID NO: 1993024 - DNA, 22 bp, Homo sapiens
atagtagtcaattagtacagta

SEQ ID NO: 1993025 - DNA, 22 bp, Homo sapiens
atagtcaagaaaaattattgta

SEQ ID NO: 1993026 - DNA, 19 bp, Homo sapiens
atagtctgtgtgcacaatg

SEQ ID NO: 1993027 - DNA, 16 bp, Homo sapiens
atagtgcacacttgta

SEQ ID NO: 1993028 - DNA, 14 bp, Homo sapiens
atagtgctatatat

SEQ ID NO: 1993029 - DNA, 16 bp, Homo sapiens
atagtgctatatatat

SEQ ID NO: 1993030 - DNA, 19 bp, Homo sapiens
atagttaaaagactgcagc

SEQ ID NO: 1993031 - DNA, 14 bp, Homo sapiens
atagttagccctca

SEQ ID NO: 1993032 - DNA, 13 bp, Homo sapiens
atagttattctat

SEQ ID NO: 1993033 - DNA, 22 bp, Homo sapiens
atagttatttacttgaaagatg

SEQ ID NO: 1993034 - DNA, 15 bp, Homo sapiens
atagtttactatttt

SEQ ID NO: 1993035 - DNA, 19 bp, Homo sapiens
atagtttggatatgtaaaa

SEQ ID NO: 1993036 - DNA, 13 bp, Homo sapiens
atagtttgtacat

SEQ ID NO: 1993037 - DNA, 15 bp, Homo sapiens
atagtttgtacatgc

SEQ ID NO: 1993038 - DNA, 16 bp, Homo sapiens
atagttttaaatatga

SEQ ID NO: 1993039 - DNA, 17 bp, Homo sapiens
atagttttaaatatgaa

SEQ ID NO: 1993040 - DNA, 14 bp, Homo sapiens
atataaaatagttg

SEQ ID NO: 1993041 - DNA, 13 bp, Homo sapiens
atataaacactat

SEQ ID NO: 1993042 - DNA, 15 bp, Homo sapiens
atataaacactatat

SEQ ID NO: 1993043 - DNA, 13 bp, Homo sapiens
atataaagttaaa

SEQ ID NO: 1993044 - DNA, 11 bp, Homo sapiens
atataaatgca

SEQ ID NO: 1993045 - DNA, 13 bp, Homo sapiens
atataaatgcatg

SEQ ID NO: 1993046 - DNA, 18 bp, Homo sapiens
atataaatgcatgatttt

SEQ ID NO: 1993047 - DNA, 18 bp, Homo sapiens
atataaatggctggtttt

SEQ ID NO: 1993048 - DNA, 16 bp, Homo sapiens
atataaattaagactt

SEQ ID NO: 1993049 - DNA, 18 bp, Homo sapiens
atcagacttcacactgca

SEQ ID NO: 1993050 - DNA, 14 bp, Homo sapiens
atcagagctcttaa

SEQ ID NO: 1993051 - DNA, 12 bp, Homo sapiens
atcagcaccatg

SEQ ID NO: 1993052 - DNA, 14 bp, Homo sapiens
atcagcactgaaaa

SEQ ID NO: 1993053 - DNA, 20 bp, Homo sapiens
atcagcccaacgggaagcaa

SEQ ID NO: 1993054 - DNA, 23 bp, Homo sapiens
atcagccccgctcctcccctctt

SEQ ID NO: 1993055 - DNA, 13 bp, Homo sapiens
atcagcctcttaa

SEQ ID NO: 1993056 - DNA, 12 bp, Homo sapiens
atcagcctgagt

SEQ ID NO: 1993057 - DNA, 12 bp, Homo sapiens
atcagcgtggcc

SEQ ID NO: 1993058 - DNA, 13 bp, Homo sapiens
atcagcgtggcct

SEQ ID NO: 1993059 - DNA, 19 bp, Homo sapiens
atcagctacttaagagaaa

SEQ ID NO: 1993060 - DNA, 17 bp, Homo sapiens
atcagctgctgaaacaa

SEQ ID NO: 1993061 - DNA, 13 bp, Homo sapiens
atcaggcacaggc

SEQ ID NO: 1993062 - DNA, 17 bp, Homo sapiens
atcaggcacaggcagga

SEQ ID NO: 1993063 - DNA, 19 bp, Homo sapiens
atcaggcacaggcaggaag

SEQ ID NO: 1993064 - DNA, 16 bp, Homo sapiens
atcaggcactggtggc

SEQ ID NO: 1993065 - DNA, 17 bp, Homo sapiens
atcaggcactggtggca

SEQ ID NO: 1993066 - DNA, 12 bp, Homo sapiens
atcaggccaaga

SEQ ID NO: 1993067 - DNA, 19 bp, Homo sapiens
atcaggcctaatctcatac

SEQ ID NO: 1993068 - DNA, 13 bp, Homo sapiens
atcaggctgaggt

SEQ ID NO: 1993069 - DNA, 17 bp, Homo sapiens
atcaggcttggaatgaa

SEQ ID NO: 1993070 - DNA, 18 bp, Homo sapiens
atcagggaggtcattttg

SEQ ID NO: 1993071 - DNA, 20 bp, Homo sapiens
atcagggtgggccactctcc

SEQ ID NO: 1993072 - DNA, 19 bp, Homo sapiens
atcaggtgctgccatccag

SEQ ID NO: 1993073 - DNA, 16 bp, Homo sapiens
atcaggttgttaatgt

SEQ ID NO: 1993074 - DNA, 22 bp, Homo sapiens
atcagtattaatactaaaatat

SEQ ID NO: 1993075 - DNA, 17 bp, Homo sapiens
atcagtgtcctcttgct

SEQ ID NO: 1993076 - DNA, 18 bp, Homo sapiens
atcagttactcagccctg

SEQ ID NO: 1993077 - DNA, 19 bp, Homo sapiens
atcagttataattattcca

SEQ ID NO: 1993078 - DNA, 14 bp, Homo sapiens
atcataaactgtgt

SEQ ID NO: 1993079 - DNA, 16 bp, Homo sapiens
atcataaactgtgtgc

SEQ ID NO: 1993080 - DNA, 12 bp, Homo sapiens
atcataaagtat

SEQ ID NO: 1993081 - DNA, 14 bp, Homo sapiens
atcataattttcaa

SEQ ID NO: 1993082 - DNA, 15 bp, Homo sapiens
atcataattttcaag

SEQ ID NO: 1993083 - DNA, 12 bp, Homo sapiens
atcatagaaatg

SEQ ID NO: 1993084 - DNA, 16 bp, Homo sapiens
atcataggtatttcaa

SEQ ID NO: 1993085 - DNA, 15 bp, Homo sapiens
atcatattgtatgta

SEQ ID NO: 1993086 - DNA, 16 bp, Homo sapiens
atcatattgtatgtaa

SEQ ID NO: 1993087 - DNA, 22 bp, Homo sapiens
atcatcaccacaccgtgagcag

SEQ ID NO: 1993088 - DNA, 20 bp, Homo sapiens
atcatcagcatacctttatt

SEQ ID NO: 1993089 - DNA, 15 bp, Homo sapiens
atcatcatagaaaaa

SEQ ID NO: 1993090 - DNA, 21 bp, Homo sapiens
atcatccactgtgccatgtgc

SEQ ID NO: 1993091 - DNA, 23 bp, Homo sapiens
atcatccactgtgccatgtgcca

SEQ ID NO: 1993092 - DNA, 23 bp, Homo sapiens
atcatcccatctaagctgcagct

SEQ ID NO: 1993093 - DNA, 19 bp, Homo sapiens
atcatcttgaatatttgct

SEQ ID NO: 1993094 - DNA, 17 bp, Homo sapiens
atcatgaaaagaggaac

SEQ ID NO: 1993095 - DNA, 13 bp, Homo sapiens
atcatgaaacact

SEQ ID NO: 1993096 - DNA, 16 bp, Homo sapiens
atcatgaaacacttct

SEQ ID NO: 1993097 - DNA, 13 bp, Homo sapiens
atcatgacatgtt

SEQ ID NO: 1993098 - DNA, 16 bp, Homo sapiens
atcatgacatgttata

SEQ ID NO: 1993099 - DNA, 14 bp, Homo sapiens
atcatgctttaaag

SEQ ID NO: 1993100 - DNA, 15 bp, Homo sapiens
atcatggctatctgt

SEQ ID NO: 1993101 - DNA, 17 bp, Homo sapiens
atcatggtcagctcaca

SEQ ID NO: 1993102 - DNA, 19 bp, Homo sapiens
atcatggtcagctcacacc

SEQ ID NO: 1993103 - DNA, 20 bp, Homo sapiens
atcatggtcagctcacaccc

SEQ ID NO: 1993104 - DNA, 15 bp, Homo sapiens
atcatgtaaggaagg

SEQ ID NO: 1993105 - DNA, 14 bp, Homo sapiens
atcatgtctggcta

SEQ ID NO: 1993106 - DNA, 20 bp, Homo sapiens
atcatgttggccaggctggt

SEQ ID NO: 1993107 - DNA, 16 bp, Homo sapiens
atcattaaattggaat

SEQ ID NO: 1993108 - DNA, 23 bp, Homo sapiens
atcattaaattggaattttctta

SEQ ID NO: 1993109 - DNA, 18 bp, Homo sapiens
atcattcaatatctgaca

SEQ ID NO: 1993110 - DNA, 15 bp, Homo sapiens
atcattcatttttgt

SEQ ID NO: 1993111 - DNA, 18 bp, Homo sapiens
atcattgtatatatgtgt

SEQ ID NO: 1993112 - DNA, 17 bp, Homo sapiens
atcatttgaacaactag

SEQ ID NO: 1993113 - DNA, 23 bp, Homo sapiens
atccaaacagaaaagtgcaaagt

SEQ ID NO: 1993114 - DNA, 21 bp, Homo sapiens
atccaaaggaatcagctgcag

SEQ ID NO: 1993115 - DNA, 21 bp, Homo sapiens
atccaagctggtcccactcag

SEQ ID NO: 1993116 - DNA, 21 bp, Homo sapiens
atccaaggaacctaattgaaa

SEQ ID NO: 1993117 - DNA, 22 bp, Homo sapiens
atccaagtattttatctgtgtt

SEQ ID NO: 1993118 - DNA, 12 bp, Homo sapiens
atccaatcctca

SEQ ID NO: 1993119 - DNA, 15 bp, Homo sapiens
atccaatcctcagga

SEQ ID NO: 1993120 - DNA, 16 bp, Homo sapiens
atccaattatgtgaca

SEQ ID NO: 1993121 - DNA, 22 bp, Homo sapiens
atccaattatgtgacaaccttt

SEQ ID NO: 1993122 - DNA, 17 bp, Homo sapiens
atccacaaagccgtgcc

SEQ ID NO: 1993123 - DNA, 22 bp, Homo sapiens
atccacaaagccgtgcctttct

SEQ ID NO: 1993124 - DNA, 15 bp, Homo sapiens
atccacacacagagg

SEQ ID NO: 1993125 - DNA, 23 bp, Homo sapiens
atccacacacagaggaagagcag

SEQ ID NO: 1993126 - DNA, 19 bp, Homo sapiens
atccaccactttaacctta

SEQ ID NO: 1993127 - DNA, 20 bp, Homo sapiens
atccacccacctcagcctcc

SEQ ID NO: 1993128 - DNA, 14 bp, Homo sapiens
atccacccagccca

SEQ ID NO: 1993129 - DNA, 15 bp, Homo sapiens
atccacccagcccat

SEQ ID NO: 1993130 - DNA, 22 bp, Homo sapiens
atccaccctatccctgtacaga

SEQ ID NO: 1993131 - DNA, 18 bp, Homo sapiens
atccacgcagcagcccct

SEQ ID NO: 1993132 - DNA, 16 bp, Homo sapiens
atccactgcaatacta

SEQ ID NO: 1993133 - DNA, 15 bp, Homo sapiens
atccacttcttaatg

SEQ ID NO: 1993134 - DNA, 12 bp, Homo sapiens
atccactttgca

SEQ ID NO: 1993135 - DNA, 14 bp, Homo sapiens
atccagaaagaaaa

SEQ ID NO: 1993136 - DNA, 15 bp, Homo sapiens
atccagaaagaaaaa

SEQ ID NO: 1993137 - DNA, 15 bp, Homo sapiens
atccagacccggctg

SEQ ID NO: 1993138 - DNA, 19 bp, Homo sapiens
atccagacccggctgcgtg

SEQ ID NO: 1993139 - DNA, 19 bp, Homo sapiens
atccagtgatgtgctggag

SEQ ID NO: 1993140 - DNA, 14 bp, Homo sapiens
atccagttgcaata

SEQ ID NO: 1993141 - DNA, 15 bp, Homo sapiens
atccagttgcaataa

SEQ ID NO: 1993142 - DNA, 11 bp, Homo sapiens
atccatcctgc

SEQ ID NO: 1993143 - DNA, 14 bp, Homo sapiens
atccatttcagttt

SEQ ID NO: 1993144 - DNA, 22 bp, Homo sapiens
atccatttcagtttgtttactt

SEQ ID NO: 1993145 - DNA, 20 bp, Homo sapiens
atccatttcatctatttctg

SEQ ID NO: 1993146 - DNA, 17 bp, Homo sapiens
atccatttggacaaaat

SEQ ID NO: 1993147 - DNA, 19 bp, Homo sapiens
atccatttggacaaaatgg

SEQ ID NO: 1993148 - DNA, 15 bp, Homo sapiens
atcccaaacttcgga

SEQ ID NO: 1993149 - DNA, 14 bp, Homo sapiens
atcccacatgatct

SEQ ID NO: 1993150 - DNA, 20 bp, Homo sapiens
atcccacccacatgtgacac

SEQ ID NO: 1993151 - DNA, 12 bp, Homo sapiens
atcccacttcac

SEQ ID NO: 1993152 - DNA, 17 bp, Homo sapiens
atcccacttcactgtga

SEQ ID NO: 1993153 - DNA, 22 bp, Homo sapiens
atcccactttctatagcagatt

SEQ ID NO: 1993154 - DNA, 21 bp, Homo sapiens
atcccagagcttcccaggatc

SEQ ID NO: 1993155 - DNA, 17 bp, Homo sapiens
atcccagctactcagga

SEQ ID NO: 1993156 - DNA, 23 bp, Homo sapiens
atcccaggaggggcctctgaaat

SEQ ID NO: 1993157 - DNA, 15 bp, Homo sapiens
atcccatcatggctg

SEQ ID NO: 1993158 - DNA, 15 bp, Homo sapiens
atcccatccatcagc

SEQ ID NO: 1993159 - DNA, 19 bp, Homo sapiens
atcccatctaagctgcagc

SEQ ID NO: 1993160 - DNA, 20 bp, Homo sapiens
atcccatctaagctgcagct

SEQ ID NO: 1993161 - DNA, 13 bp, Homo sapiens
atcccatgagcct

SEQ ID NO: 1993162 - DNA, 22 bp, Homo sapiens
atcccatgggggtgctgcagcc

SEQ ID NO: 1993163 - DNA, 15 bp, Homo sapiens
atcccatgtatttat

SEQ ID NO: 1993164 - DNA, 20 bp, Homo sapiens
atctgcagggggtgtgtctg

SEQ ID NO: 1993165 - DNA, 16 bp, Homo sapiens
atctgcattccccgct

SEQ ID NO: 1993166 - DNA, 20 bp, Homo sapiens
atctgcatttataaatgtgt

SEQ ID NO: 1993167 - DNA, 24 bp, Homo sapiens
atctgcatttataaatgtgtggtg

SEQ ID NO: 1993168 - DNA, 15 bp, Homo sapiens
atctgcctggcctgg

SEQ ID NO: 1993169 - DNA, 19 bp, Homo sapiens
atctgcctggcctggctcc

SEQ ID NO: 1993170 - DNA, 11 bp, Homo sapiens
atctgcctggg

SEQ ID NO: 1993171 - DNA, 13 bp, Homo sapiens
atctgcctgggcc

SEQ ID NO: 1993172 - DNA, 18 bp, Homo sapiens
atctgcctgggcctgtgc

SEQ ID NO: 1993173 - DNA, 16 bp, Homo sapiens
atctgcggggcttctg

SEQ ID NO: 1993174 - DNA, 14 bp, Homo sapiens
atctgctaataaaa

SEQ ID NO: 1993175 - DNA, 15 bp, Homo sapiens
atctgctcagcaggc

SEQ ID NO: 1993176 - DNA, 12 bp, Homo sapiens
atctgctgcccc

SEQ ID NO: 1993177 - DNA, 17 bp, Homo sapiens
atctgctgctgaaactg

SEQ ID NO: 1993178 - DNA, 12 bp, Homo sapiens
atctgcttcagt

SEQ ID NO: 1993179 - DNA, 18 bp, Homo sapiens
atctgcttgtattttcca

SEQ ID NO: 1993180 - DNA, 16 bp, Homo sapiens
atctggaaggcccctc

SEQ ID NO: 1993181 - DNA, 16 bp, Homo sapiens
atctggactcctctgt

SEQ ID NO: 1993182 - DNA, 18 bp, Homo sapiens
atctggactcctctgtcc

SEQ ID NO: 1993183 - DNA, 15 bp, Homo sapiens
atctggagagctaga

SEQ ID NO: 1993184 - DNA, 20 bp, Homo sapiens
atctggagagctagaacctg

SEQ ID NO: 1993185 - DNA, 17 bp, Homo sapiens
atctggctcctgtttcc

SEQ ID NO: 1993186 - DNA, 23 bp, Homo sapiens
atctggcttttcgcttgcttctg

SEQ ID NO: 1993187 - DNA, 17 bp, Homo sapiens
atctgggaccctttcct

SEQ ID NO: 1993188 - DNA, 20 bp, Homo sapiens
atctgggaccctttccttcc

SEQ ID NO: 1993189 - DNA, 22 bp, Homo sapiens
atctgggaccctttccttcctt

SEQ ID NO: 1993190 - DNA, 20 bp, Homo sapiens
atctgggaggcagaacaggc

SEQ ID NO: 1993191 - DNA, 22 bp, Homo sapiens
atctgggaggctggtctccctc

SEQ ID NO: 1993192 - DNA, 24 bp, Homo sapiens
atctgggaggctggtctccctcca

SEQ ID NO: 1993193 - DNA, 14 bp, Homo sapiens
atctgggtccttgc

SEQ ID NO: 1993194 - DNA, 19 bp, Homo sapiens
atctgggttcactgcaacc

SEQ ID NO: 1993195 - DNA, 14 bp, Homo sapiens
atctgtactgtaat

SEQ ID NO: 1993196 - DNA, 14 bp, Homo sapiens
atctgtagggctgg

SEQ ID NO: 1993197 - DNA, 15 bp, Homo sapiens
atctgtagggctgga

SEQ ID NO: 1993198 - DNA, 14 bp, Homo sapiens
atctgtatatacaa

SEQ ID NO: 1993199 - DNA, 21 bp, Homo sapiens
atctgtatatacaataacata

SEQ ID NO: 1993200 - DNA, 12 bp, Homo sapiens
atctgtcatttg

SEQ ID NO: 1993201 - DNA, 17 bp, Homo sapiens
atctgtcatttgagcag

SEQ ID NO: 1993202 - DNA, 16 bp, Homo sapiens
atctgtcccctctccc

SEQ ID NO: 1993203 - DNA, 18 bp, Homo sapiens
atctgtcccctctcccct

SEQ ID NO: 1993204 - DNA, 16 bp, Homo sapiens
atctgtccctgcctca

SEQ ID NO: 1993205 - DNA, 22 bp, Homo sapiens
atctgtcttgccagccagaagc

SEQ ID NO: 1993206 - DNA, 23 bp, Homo sapiens
atctgtcttgccagccagaagcc

SEQ ID NO: 1993207 - DNA, 17 bp, Homo sapiens
atctgtgaattgagctg

SEQ ID NO: 1993208 - DNA, 13 bp, Homo sapiens
atctgtgggccca

SEQ ID NO: 1993209 - DNA, 19 bp, Homo sapiens
atctgtgtaacctccacag

SEQ ID NO: 1993210 - DNA, 17 bp, Homo sapiens
atctgtgtgaaaatggg

SEQ ID NO: 1993211 - DNA, 15 bp, Homo sapiens
atctgttactgaaat

SEQ ID NO: 1993212 - DNA, 22 bp, Homo sapiens
atctgttttaaatttatttcaa

SEQ ID NO: 1993213 - DNA, 18 bp, Homo sapiens
atctgttttgtatatgat

SEQ ID NO: 1993214 - DNA, 15 bp, Homo sapiens
atcttaaaattcttg

SEQ ID NO: 1993215 - DNA, 12 bp, Homo sapiens
atcttaattttg

SEQ ID NO: 1993216 - DNA, 13 bp, Homo sapiens
atcttacatctgc

SEQ ID NO: 1993217 - DNA, 16 bp, Homo sapiens
atcttacctgtaaagt

SEQ ID NO: 1993218 - DNA, 11 bp, Homo sapiens
atcttagcatg

SEQ ID NO: 1993219 - DNA, 16 bp, Homo sapiens
atcttagctttccaca

SEQ ID NO: 1993220 - DNA, 17 bp, Homo sapiens
atcttatgttaaaggag

SEQ ID NO: 1993221 - DNA, 14 bp, Homo sapiens
atcttatttatata

SEQ ID NO: 1993222 - DNA, 16 bp, Homo sapiens
atcttattttcatgta

SEQ ID NO: 1993223 - DNA, 12 bp, Homo sapiens
atcttcaaggtg

SEQ ID NO: 1993224 - DNA, 19 bp, Homo sapiens
atcttcaaggtgtaaaata

SEQ ID NO: 1993225 - DNA, 16 bp, Homo sapiens
atcttcagaaggctag

SEQ ID NO: 1993226 - DNA, 14 bp, Homo sapiens
atcttcagagcagg

SEQ ID NO: 1993227 - DNA, 18 bp, Homo sapiens
atcttcagagcaggggtc

SEQ ID NO: 1993228 - DNA, 13 bp, Homo sapiens
atcttcctcatca

SEQ ID NO: 1993229 - DNA, 14 bp, Homo sapiens
atcttcctgctgct

SEQ ID NO: 1993230 - DNA, 18 bp, Homo sapiens
atcttcggggtgtgatga

SEQ ID NO: 1993231 - DNA, 15 bp, Homo sapiens
atcttctccatctgg

SEQ ID NO: 1993232 - DNA, 14 bp, Homo sapiens
atcttctccattct

SEQ ID NO: 1993233 - DNA, 20 bp, Homo sapiens
atcttctggagtctccagtg

SEQ ID NO: 1993234 - DNA, 12 bp, Homo sapiens
atcttctggctt

SEQ ID NO: 1993235 - DNA, 20 bp, Homo sapiens
atcttctgttgtagaataat

SEQ ID NO: 1993236 - DNA, 12 bp, Homo sapiens
atcttgaagaat

SEQ ID NO: 1993237 - DNA, 17 bp, Homo sapiens
atcttgacatgtaatga

SEQ ID NO: 1993238 - DNA, 13 bp, Homo sapiens
atcttgccccctc

SEQ ID NO: 1993239 - DNA, 21 bp, Homo sapiens
atcttgctggattaatgtttt

SEQ ID NO: 1993240 - DNA, 14 bp, Homo sapiens
atcttggactgaca

SEQ ID NO: 1993241 - DNA, 16 bp, Homo sapiens
atcttggactgacatt

SEQ ID NO: 1993242 - DNA, 21 bp, Homo sapiens
atcttggactgacatttagcg

SEQ ID NO: 1993243 - DNA, 21 bp, Homo sapiens
atcttggtcctgtcaccctgg

SEQ ID NO: 1993244 - DNA, 14 bp, Homo sapiens
atcttgtccacagt

SEQ ID NO: 1993245 - DNA, 20 bp, Homo sapiens
atctttaaaaagcagtcctc

SEQ ID NO: 1993246 - DNA, 15 bp, Homo sapiens
atctttaaaatacac

SEQ ID NO: 1993247 - DNA, 19 bp, Homo sapiens
atctttcagcactcagaaa

SEQ ID NO: 1993248 - DNA, 22 bp, Homo sapiens
atctttcctccaaactcctgcc

SEQ ID NO: 1993249 - DNA, 11 bp, Homo sapiens
atctttcctgt

SEQ ID NO: 1993250 - DNA, 16 bp, Homo sapiens
atctttccttgtctct

SEQ ID NO: 1993251 - DNA, 19 bp, Homo sapiens
atctttcttctattttatt

SEQ ID NO: 1993252 - DNA, 22 bp, Homo sapiens
atctttcttctattttattccc

SEQ ID NO: 1993253 - DNA, 20 bp, Homo sapiens
atctttctttacctgagacc

SEQ ID NO: 1993254 - DNA, 19 bp, Homo sapiens
atctttgaatggtcttctg

SEQ ID NO: 1993255 - DNA, 17 bp, Homo sapiens
atctttgcagacaggca

SEQ ID NO: 1993256 - DNA, 22 bp, Homo sapiens
atcttttaaaatgaaatgtttt

SEQ ID NO: 1993257 - DNA, 14 bp, Homo sapiens
atcttttaatatgc

SEQ ID NO: 1993258 - DNA, 24 bp, Homo sapiens
atcttttataatgtcttatgccta

SEQ ID NO: 1993259 - DNA, 15 bp, Homo sapiens
atctttttcctccct

SEQ ID NO: 1993260 - DNA, 12 bp, Homo sapiens
atgaaaactcat

SEQ ID NO: 1993261 - DNA, 14 bp, Homo sapiens
atgaaaagaataaa

SEQ ID NO: 1993262 - DNA, 14 bp, Homo sapiens
atgaaaagaggaac

SEQ ID NO: 1993263 - DNA, 18 bp, Homo sapiens
atgaaaagctagaattga

SEQ ID NO: 1993264 - DNA, 20 bp, Homo sapiens
atgaaaatgcaacaacatgt

SEQ ID NO: 1993265 - DNA, 23 bp, Homo sapiens
atgaaaattatctcccttagtaa

SEQ ID NO: 1993266 - DNA, 14 bp, Homo sapiens
atgaaaattgtatg

SEQ ID NO: 1993267 - DNA, 16 bp, Homo sapiens
atgaaacaaataatca

SEQ ID NO: 1993268 - DNA, 17 bp, Homo sapiens
atgaaacacttctcatc

SEQ ID NO: 1993269 - DNA, 17 bp, Homo sapiens
atgaaacagatgataaa

SEQ ID NO: 1993270 - DNA, 14 bp, Homo sapiens
atgaaaccaaagcc

SEQ ID NO: 1993271 - DNA, 20 bp, Homo sapiens
atgaaagggaaagtcagctt

SEQ ID NO: 1993272 - DNA, 18 bp, Homo sapiens
atgaaagggcccagagag

SEQ ID NO: 1993273 - DNA, 14 bp, Homo sapiens
atgaaagtgcaaag

SEQ ID NO: 1993274 - DNA, 14 bp, Homo sapiens
atgaaatgaggtca

SEQ ID NO: 1993275 - DNA, 15 bp, Homo sapiens
atgaaattgagaagg

SEQ ID NO: 1993276 - DNA, 17 bp, Homo sapiens
atgaaatttaatatagc

SEQ ID NO: 1993277 - DNA, 22 bp, Homo sapiens
atgaacaaagaaaaaaatatat

SEQ ID NO: 1993278 - DNA, 12 bp, Homo sapiens
atgaacaaatgg

SEQ ID NO: 1993279 - DNA, 22 bp, Homo sapiens
atgaacacacatggatgcacac

SEQ ID NO: 1993280 - DNA, 16 bp, Homo sapiens
atgggagatggtcagt

SEQ ID NO: 1993281 - DNA, 15 bp, Homo sapiens
atgggagggggctcc

SEQ ID NO: 1993282 - DNA, 16 bp, Homo sapiens
atgggagggggctcca

SEQ ID NO: 1993283 - DNA, 17 bp, Homo sapiens
atgggagggggctccat

SEQ ID NO: 1993284 - DNA, 16 bp, Homo sapiens
atgggagtgagacaga

SEQ ID NO: 1993285 - DNA, 19 bp, Homo sapiens
atgggatcccaggccaggg

SEQ ID NO: 1993286 - DNA, 23 bp, Homo sapiens
atgggattcagtgcttcttaaag

SEQ ID NO: 1993287 - DNA, 13 bp, Homo sapiens
atgggatttcatg

SEQ ID NO: 1993288 - DNA, 19 bp, Homo sapiens
atgggcaacccccagcctg

SEQ ID NO: 1993289 - DNA, 21 bp, Homo sapiens
atgggcaacccccagcctgct

SEQ ID NO: 1993290 - DNA, 20 bp, Homo sapiens
atgggcacatgaggagggtg

SEQ ID NO: 1993291 - DNA, 15 bp, Homo sapiens
atgggcagtgcctcc

SEQ ID NO: 1993292 - DNA, 16 bp, Homo sapiens
atgggcagtgcctcct

SEQ ID NO: 1993293 - DNA, 17 bp, Homo sapiens
atgggcagtgcctcctg

SEQ ID NO: 1993294 - DNA, 16 bp, Homo sapiens
atgggcattgggctga

SEQ ID NO: 1993295 - DNA, 11 bp, Homo sapiens
atgggccaggg

SEQ ID NO: 1993296 - DNA, 21 bp, Homo sapiens
atgggcctgcccaatgctttg

SEQ ID NO: 1993297 - DNA, 13 bp, Homo sapiens
atgggcctgctgc

SEQ ID NO: 1993298 - DNA, 11 bp, Homo sapiens
atgggcctggg

SEQ ID NO: 1993299 - DNA, 12 bp, Homo sapiens
atgggcctgggc

SEQ ID NO: 1993300 - DNA, 15 bp, Homo sapiens
atgggcctgggcctg

SEQ ID NO: 1993301 - DNA, 17 bp, Homo sapiens
atgggcctgggcctgct

SEQ ID NO: 1993302 - DNA, 18 bp, Homo sapiens
atgggcctgggcctgctt

SEQ ID NO: 1993303 - DNA, 15 bp, Homo sapiens
atgggccttgctttg

SEQ ID NO: 1993304 - DNA, 19 bp, Homo sapiens
atgggccttgctttgggct

SEQ ID NO: 1993305 - DNA, 21 bp, Homo sapiens
atgggccttgctttgggcttt

SEQ ID NO: 1993306 - DNA, 13 bp, Homo sapiens
atgggcttggact

SEQ ID NO: 1993307 - DNA, 18 bp, Homo sapiens
atggggaagtgctcccca

SEQ ID NO: 1993308 - DNA, 19 bp, Homo sapiens
atggggagaggcaaatgca

SEQ ID NO: 1993309 - DNA, 21 bp, Homo sapiens
atggggcgatcaagtccagag

SEQ ID NO: 1993310 - DNA, 22 bp, Homo sapiens
atggggctgaacggggagaaaa

SEQ ID NO: 1993311 - DNA, 16 bp, Homo sapiens
atgggggatgggccag

SEQ ID NO: 1993312 - DNA, 22 bp, Homo sapiens
atgggggtgctgcagccaggag

SEQ ID NO: 1993313 - DNA, 14 bp, Homo sapiens
atggggtgggcagg

SEQ ID NO: 1993314 - DNA, 17 bp, Homo sapiens
atggggtgggcagggct

SEQ ID NO: 1993315 - DNA, 20 bp, Homo sapiens
atggggtgggcagggctggg

SEQ ID NO: 1993316 - DNA, 20 bp, Homo sapiens
atgggtacccagactctaaa

SEQ ID NO: 1993317 - DNA, 13 bp, Homo sapiens
atgggtcctgcaa

SEQ ID NO: 1993318 - DNA, 17 bp, Homo sapiens
atgggtctggctgagct

SEQ ID NO: 1993319 - DNA, 12 bp, Homo sapiens
atgggtgctggc

SEQ ID NO: 1993320 - DNA, 20 bp, Homo sapiens
atgggtgtgcccttggggta

SEQ ID NO: 1993321 - DNA, 12 bp, Homo sapiens
atgggtgtgtgt

SEQ ID NO: 1993322 - DNA, 22 bp, Homo sapiens
atggtaagactgtaattaagta

SEQ ID NO: 1993323 - DNA, 14 bp, Homo sapiens
atggtaattgttgc

SEQ ID NO: 1993324 - DNA, 19 bp, Homo sapiens
atggtataatggttgactg

SEQ ID NO: 1993325 - DNA, 18 bp, Homo sapiens
atggtattgtaatgaata

SEQ ID NO: 1993326 - DNA, 12 bp, Homo sapiens
atggtattttcg

SEQ ID NO: 1993327 - DNA, 19 bp, Homo sapiens
atggtattttcgtgcattt

SEQ ID NO: 1993328 - DNA, 22 bp, Homo sapiens
atggtattttcgtgcatttgtg

SEQ ID NO: 1993329 - DNA, 23 bp, Homo sapiens
atggtattttcgtgcatttgtga

SEQ ID NO: 1993330 - DNA, 20 bp, Homo sapiens
atggtcaacacttaagggtt

SEQ ID NO: 1993331 - DNA, 19 bp, Homo sapiens
atggtcccacatccctggg

SEQ ID NO: 1993332 - DNA, 20 bp, Homo sapiens
atggtcctggggctctgtgc

SEQ ID NO: 1993333 - DNA, 14 bp, Homo sapiens
atggtcgcccagga

SEQ ID NO: 1993334 - DNA, 16 bp, Homo sapiens
atggtcgcccaggaga

SEQ ID NO: 1993335 - DNA, 14 bp, Homo sapiens
atggtctcagaaac

SEQ ID NO: 1993336 - DNA, 18 bp, Homo sapiens
atggtctcagaaaccaaa

SEQ ID NO: 1993337 - DNA, 22 bp, Homo sapiens
atggtctcctctgattatcagg

SEQ ID NO: 1993338 - DNA, 17 bp, Homo sapiens
atggtgaaatttattag

SEQ ID NO: 1993339 - DNA, 16 bp, Homo sapiens
atggtgacacacagca

SEQ ID NO: 1993340 - DNA, 17 bp, Homo sapiens
atggtgacacacagcag

SEQ ID NO: 1993341 - DNA, 22 bp, Homo sapiens
atggtgcagaaaaaaaaaaaga

SEQ ID NO: 1993342 - DNA, 16 bp, Homo sapiens
atggtgccttcatttg

SEQ ID NO: 1993343 - DNA, 20 bp, Homo sapiens
atggtgctcacgactcttcc

SEQ ID NO: 1993344 - DNA, 13 bp, Homo sapiens
atggtgctcccct

SEQ ID NO: 1993345 - DNA, 16 bp, Homo sapiens
atggtggcgcgcacct

SEQ ID NO: 1993346 - DNA, 13 bp, Homo sapiens
atggtggctgggt

SEQ ID NO: 1993347 - DNA, 17 bp, Homo sapiens
atggtggctgggttgga

SEQ ID NO: 1993348 - DNA, 16 bp, Homo sapiens
atggtgggaaccctcc

SEQ ID NO: 1993349 - DNA, 17 bp, Homo sapiens
atggtgggaaccctccc

SEQ ID NO: 1993350 - DNA, 18 bp, Homo sapiens
atggtgggaaccctcccc

SEQ ID NO: 1993351 - DNA, 22 bp, Homo sapiens
atggtggtttgtcatatattca

SEQ ID NO: 1993352 - DNA, 17 bp, Homo sapiens
atggtgtaatgcacaat

SEQ ID NO: 1993353 - DNA, 22 bp, Homo sapiens
atggtgtaatgcacaatttaga

SEQ ID NO: 1993354 - DNA, 17 bp, Homo sapiens
atggttccatgcctgag

SEQ ID NO: 1993355 - DNA, 22 bp, Homo sapiens
atggttccatgcctgagggtgg

SEQ ID NO: 1993356 - DNA, 17 bp, Homo sapiens
atggttgattcccagca

SEQ ID NO: 1993357 - DNA, 12 bp, Homo sapiens
atggtttactgc

SEQ ID NO: 1993358 - DNA, 13 bp, Homo sapiens
atggtttactgct

SEQ ID NO: 1993359 - DNA, 20 bp, Homo sapiens
atggtttttatttctcgggt

SEQ ID NO: 1993360 - DNA, 23 bp, Homo sapiens
atggtttttgcaagatttaacac

SEQ ID NO: 1993361 - DNA, 20 bp, Homo sapiens
atgtaaaacatttattttga

SEQ ID NO: 1993362 - DNA, 15 bp, Homo sapiens
atgtaaaataagtat

SEQ ID NO: 1993363 - DNA, 14 bp, Homo sapiens
atgtaaaatgcagt

SEQ ID NO: 1993364 - DNA, 15 bp, Homo sapiens
atgtaaaatgcagtc

SEQ ID NO: 1993365 - DNA, 21 bp, Homo sapiens
atgtaaaatgcagtccagaat

SEQ ID NO: 1993366 - DNA, 23 bp, Homo sapiens
atgtaaaatgcagtccagaataa

SEQ ID NO: 1993367 - DNA, 14 bp, Homo sapiens
atgtaaagcttgtc

SEQ ID NO: 1993368 - DNA, 17 bp, Homo sapiens
atgtaaagtatgtaaac

SEQ ID NO: 1993369 - DNA, 18 bp, Homo sapiens
atgtaaagtatgtaaaca

SEQ ID NO: 1993370 - DNA, 12 bp, Homo sapiens
atgtaaatagtg

SEQ ID NO: 1993371 - DNA, 15 bp, Homo sapiens
atgtaaatattttaa

SEQ ID NO: 1993372 - DNA, 19 bp, Homo sapiens
atgtaaatattttaaagaa

SEQ ID NO: 1993373 - DNA, 20 bp, Homo sapiens
atgtaaattttgtatgaaaa

SEQ ID NO: 1993374 - DNA, 21 bp, Homo sapiens
atgtaacaaccagagatgact

SEQ ID NO: 1993375 - DNA, 14 bp, Homo sapiens
atgtaactattgaa

SEQ ID NO: 1993376 - DNA, 17 bp, Homo sapiens
atgtaactattgaattg

SEQ ID NO: 1993377 - DNA, 22 bp, Homo sapiens
atgtaactctatagttattgtt

SEQ ID NO: 1993378 - DNA, 23 bp, Homo sapiens
atgtaacttttcttacagcacat

SEQ ID NO: 1993379 - DNA, 14 bp, Homo sapiens
atgtaacttttgta

SEQ ID NO: 1993380 - DNA, 17 bp, Homo sapiens
atgtaacttttgtaaga

SEQ ID NO: 1993381 - DNA, 14 bp, Homo sapiens
atgtaaggaattga

SEQ ID NO: 1993382 - DNA, 19 bp, Homo sapiens
atgtaagggaaactgccag

SEQ ID NO: 1993383 - DNA, 19 bp, Homo sapiens
atgtaagggtctgttgtaa

SEQ ID NO: 1993384 - DNA, 18 bp, Homo sapiens
atgtaaggtaatttctgt

SEQ ID NO: 1993385 - DNA, 17 bp, Homo sapiens
atgtacaaaagtaccat

SEQ ID NO: 1993386 - DNA, 21 bp, Homo sapiens
atgtacaaaatcgattggctt

SEQ ID NO: 1993387 - DNA, 21 bp, Homo sapiens
atgtacaagttttgtataaat

SEQ ID NO: 1993388 - DNA, 22 bp, Homo sapiens
atgtacattggtctttctacat

SEQ ID NO: 1993389 - DNA, 19 bp, Homo sapiens
atgtactctacgccaaagt

SEQ ID NO: 1993390 - DNA, 20 bp, Homo sapiens
atgtactctacgccaaagtg

SEQ ID NO: 1993391 - DNA, 17 bp, Homo sapiens
atgtagaataaatgaag

SEQ ID NO: 1993392 - DNA, 18 bp, Homo sapiens
atgtagaataaatgaaga

SEQ ID NO: 1993393 - DNA, 16 bp, Homo sapiens
atgtagactatataca

SEQ ID NO: 1993394 - DNA, 21 bp, Homo sapiens
attataactgaaggagaaggt

SEQ ID NO: 1993395 - DNA, 15 bp, Homo sapiens
attataacttaaaaa

SEQ ID NO: 1993396 - DNA, 22 bp, Homo sapiens
attataacttaaaaaaatgaca

SEQ ID NO: 1993397 - DNA, 20 bp, Homo sapiens
attataacttaaaatatttt

SEQ ID NO: 1993398 - DNA, 14 bp, Homo sapiens
attataagatgtca

SEQ ID NO: 1993399 - DNA, 17 bp, Homo sapiens
attataggatcatttgt

SEQ ID NO: 1993400 - DNA, 20 bp, Homo sapiens
attatagtatgatttttaca

SEQ ID NO: 1993401 - DNA, 13 bp, Homo sapiens
attatataggttg

SEQ ID NO: 1993402 - DNA, 23 bp, Homo sapiens
attatatagtaatgcactctcag

SEQ ID NO: 1993403 - DNA, 22 bp, Homo sapiens
attatatctaatttatacaaaa

SEQ ID NO: 1993404 - DNA, 16 bp, Homo sapiens
attatcatgggaaaag

SEQ ID NO: 1993405 - DNA, 16 bp, Homo sapiens
attatcggaagcagtg

SEQ ID NO: 1993406 - DNA, 16 bp, Homo sapiens
attatcgggaacagtg

SEQ ID NO: 1993407 - DNA, 18 bp, Homo sapiens
attatcgggaacagtgtt

SEQ ID NO: 1993408 - DNA, 14 bp, Homo sapiens
attatgacagttat

SEQ ID NO: 1993409 - DNA, 15 bp, Homo sapiens
attatgacagttata

SEQ ID NO: 1993410 - DNA, 18 bp, Homo sapiens
attatgaggctattaaaa

SEQ ID NO: 1993411 - DNA, 13 bp, Homo sapiens
attatgcactggc

SEQ ID NO: 1993412 - DNA, 17 bp, Homo sapiens
attatgcactggccacc

SEQ ID NO: 1993413 - DNA, 20 bp, Homo sapiens
attatgcactggccacccaa

SEQ ID NO: 1993414 - DNA, 15 bp, Homo sapiens
attatggtgaaatta

SEQ ID NO: 1993415 - DNA, 16 bp, Homo sapiens
attatgtatgtttaca

SEQ ID NO: 1993416 - DNA, 17 bp, Homo sapiens
attatgtatgtttacat

SEQ ID NO: 1993417 - DNA, 20 bp, Homo sapiens
attatgtgacaacctttgtg

SEQ ID NO: 1993418 - DNA, 23 bp, Homo sapiens
attatgtgacaacctttgtgtaa

SEQ ID NO: 1993419 - DNA, 13 bp, Homo sapiens
attatgtgtgcat

SEQ ID NO: 1993420 - DNA, 19 bp, Homo sapiens
attatgtgtgcatgtgtgt

SEQ ID NO: 1993421 - DNA, 18 bp, Homo sapiens
attattaataccaaatat

SEQ ID NO: 1993422 - DNA, 21 bp, Homo sapiens
attattacttatttttgacag

SEQ ID NO: 1993423 - DNA, 15 bp, Homo sapiens
attattattcttcat

SEQ ID NO: 1993424 - DNA, 16 bp, Homo sapiens
attattattcttcata

SEQ ID NO: 1993425 - DNA, 14 bp, Homo sapiens
attattcatttaaa

SEQ ID NO: 1993426 - DNA, 15 bp, Homo sapiens
attattcatttaaaa

SEQ ID NO: 1993427 - DNA, 20 bp, Homo sapiens
attattcatttaaaatgatt

SEQ ID NO: 1993428 - DNA, 21 bp, Homo sapiens
attattcatttaaaatgatta

SEQ ID NO: 1993429 - DNA, 21 bp, Homo sapiens
attattccctgtacaatattt

SEQ ID NO: 1993430 - DNA, 21 bp, Homo sapiens
attattgagctctatttcccc

SEQ ID NO: 1993431 - DNA, 13 bp, Homo sapiens
attattgctgttg

SEQ ID NO: 1993432 - DNA, 22 bp, Homo sapiens
attatttaaaccgctaaaagaa

SEQ ID NO: 1993433 - DNA, 22 bp, Homo sapiens
attatttaaatgttgaaatctt

SEQ ID NO: 1993434 - DNA, 13 bp, Homo sapiens
attatttaataaa

SEQ ID NO: 1993435 - DNA, 13 bp, Homo sapiens
attatttaatgtt

SEQ ID NO: 1993436 - DNA, 16 bp, Homo sapiens
attatttatatatgta

SEQ ID NO: 1993437 - DNA, 13 bp, Homo sapiens
attatttatttct

SEQ ID NO: 1993438 - DNA, 15 bp, Homo sapiens
attattttaaacaaa

SEQ ID NO: 1993439 - DNA, 14 bp, Homo sapiens
attattttcattac

SEQ ID NO: 1993440 - DNA, 17 bp, Homo sapiens
attattttcattacaat

SEQ ID NO: 1993441 - DNA, 16 bp, Homo sapiens
attattttctatagct

SEQ ID NO: 1993442 - DNA, 20 bp, Homo sapiens
attattttctatagctcttc

SEQ ID NO: 1993443 - DNA, 16 bp, Homo sapiens
attattttgttgtgat

SEQ ID NO: 1993444 - DNA, 18 bp, Homo sapiens
attattttgttgtgattt

SEQ ID NO: 1993445 - DNA, 14 bp, Homo sapiens
attatttttgtgtt

SEQ ID NO: 1993446 - DNA, 18 bp, Homo sapiens
attatttttgtgtttcta

SEQ ID NO: 1993447 - DNA, 14 bp, Homo sapiens
attcaaacagtctc

SEQ ID NO: 1993448 - DNA, 15 bp, Homo sapiens
attcaaacagtctca

SEQ ID NO: 1993449 - DNA, 12 bp, Homo sapiens
attcaaaccatt

SEQ ID NO: 1993450 - DNA, 13 bp, Homo sapiens
attcaaaccattt

SEQ ID NO: 1993451 - DNA, 18 bp, Homo sapiens
attcaaaccatttaattc

SEQ ID NO: 1993452 - DNA, 21 bp, Homo sapiens
attcaacacattacttgcaca

SEQ ID NO: 1993453 - DNA, 23 bp, Homo sapiens
attcaacacattacttgcacaag

SEQ ID NO: 1993454 - DNA, 17 bp, Homo sapiens
attcaagaaacagaagt

SEQ ID NO: 1993455 - DNA, 16 bp, Homo sapiens
attcaagcctgtgaat

SEQ ID NO: 1993456 - DNA, 19 bp, Homo sapiens
attcaaggagatataaaat

SEQ ID NO: 1993457 - DNA, 15 bp, Homo sapiens
attcaaggtggccaa

SEQ ID NO: 1993458 - DNA, 12 bp, Homo sapiens
attcaagtatta

SEQ ID NO: 1993459 - DNA, 15 bp, Homo sapiens
attcaagttattgta

SEQ ID NO: 1993460 - DNA, 15 bp, Homo sapiens
attcaatatctgaca

SEQ ID NO: 1993461 - DNA, 17 bp, Homo sapiens
attcaattcctctggga

SEQ ID NO: 1993462 - DNA, 15 bp, Homo sapiens
attcaattctgtata

SEQ ID NO: 1993463 - DNA, 23 bp, Homo sapiens
attcaatttaattcttatttctg

SEQ ID NO: 1993464 - DNA, 12 bp, Homo sapiens
attcacacaccc

SEQ ID NO: 1993465 - DNA, 16 bp, Homo sapiens
attcacacacccctca

SEQ ID NO: 1993466 - DNA, 20 bp, Homo sapiens
attcacacacccctcaaaaa

SEQ ID NO: 1993467 - DNA, 22 bp, Homo sapiens
attcacacacccctcaaaaaaa

SEQ ID NO: 1993468 - DNA, 18 bp, Homo sapiens
attcacacagggctcttt

SEQ ID NO: 1993469 - DNA, 19 bp, Homo sapiens
attcacacctcacgctctg

SEQ ID NO: 1993470 - DNA, 12 bp, Homo sapiens
attcacacctta

SEQ ID NO: 1993471 - DNA, 22 bp, Homo sapiens
attcacatccaatgcatagttt

SEQ ID NO: 1993472 - DNA, 15 bp, Homo sapiens
attcacatctcattt

SEQ ID NO: 1993473 - DNA, 18 bp, Homo sapiens
attcacatttgatgtaca

SEQ ID NO: 1993474 - DNA, 19 bp, Homo sapiens
attcacatttgatgtacat

SEQ ID NO: 1993475 - DNA, 22 bp, Homo sapiens
attcactcactcactcattcct

SEQ ID NO: 1993476 - DNA, 17 bp, Homo sapiens
attcagaacatcctcca

SEQ ID NO: 1993477 - DNA, 14 bp, Homo sapiens
attcagagatgtac

SEQ ID NO: 1993478 - DNA, 20 bp, Homo sapiens
attcagagatgtaccatgtt

SEQ ID NO: 1993479 - DNA, 18 bp, Homo sapiens
attcagatcgtattaatt

SEQ ID NO: 1993480 - DNA, 18 bp, Homo sapiens
attcagcacaccccaagg

SEQ ID NO: 1993481 - DNA, 18 bp, Homo sapiens
attcagcaccctgggtgc

SEQ ID NO: 1993482 - DNA, 21 bp, Homo sapiens
attcagcactgatttcacaac

SEQ ID NO: 1993483 - DNA, 17 bp, Homo sapiens
attcagcctggccatcc

SEQ ID NO: 1993484 - DNA, 19 bp, Homo sapiens
attcagcctggccatcccc

SEQ ID NO: 1993485 - DNA, 22 bp, Homo sapiens
attcaggaaaactgacagagga

SEQ ID NO: 1993486 - DNA, 19 bp, Homo sapiens
attcaggaaaaggcctggg

SEQ ID NO: 1993487 - DNA, 20 bp, Homo sapiens
attcaggaaaaggcctgggg

SEQ ID NO: 1993488 - DNA, 16 bp, Homo sapiens
attcaggaagatgaaa

SEQ ID NO: 1993489 - DNA, 19 bp, Homo sapiens
attcaggactggctcaccc

SEQ ID NO: 1993490 - DNA, 21 bp, Homo sapiens
attcaggacttaacggctcca

SEQ ID NO: 1993491 - DNA, 13 bp, Homo sapiens
attcaggcactga

SEQ ID NO: 1993492 - DNA, 15 bp, Homo sapiens
attcaggcactgaga

SEQ ID NO: 1993493 - DNA, 19 bp, Homo sapiens
attcaggtgaaaatgttca

SEQ ID NO: 1993494 - DNA, 18 bp, Homo sapiens
attcagtccgcctggccg

SEQ ID NO: 1993495 - DNA, 17 bp, Homo sapiens
attcagtgctgtggcct

SEQ ID NO: 1993496 - DNA, 18 bp, Homo sapiens
attcataacaatgtatgt

SEQ ID NO: 1993497 - DNA, 23 bp, Homo sapiens
attcataacaatgtatgtgaaag

SEQ ID NO: 1993498 - DNA, 12 bp, Homo sapiens
attcataataaa

SEQ ID NO: 1993499 - DNA, 14 bp, Homo sapiens
attcataataaact

SEQ ID NO: 1993500 - DNA, 15 bp, Homo sapiens
attcataataaacta

SEQ ID NO: 1993501 - DNA, 14 bp, Homo sapiens
attcataattagaa

SEQ ID NO: 1993502 - DNA, 13 bp, Homo sapiens
attcatcatatga

SEQ ID NO: 1993503 - DNA, 18 bp, Homo sapiens
attcatccagttgcaata

SEQ ID NO: 1993504 - DNA, 19 bp, Homo sapiens
attcatccagttgcaataa

SEQ ID NO: 1993505 - DNA, 21 bp, Homo sapiens
attcatccagttgcaataaaa

SEQ ID NO: 1993506 - DNA, 20 bp, Homo sapiens
attcatctgtttttcttttt

SEQ ID NO: 1993507 - DNA, 21 bp, Homo sapiens
attcatgccaaagcaaaagaa

SEQ ID NO: 1993508 - DNA, 15 bp, Homo sapiens
attcatgccatctgt

SEQ ID NO: 1993509 - DNA, 21 bp, Homo sapiens
atttgaacccccgccatcctt

SEQ ID NO: 1993510 - DNA, 16 bp, Homo sapiens
atttgaagcaaagcac

SEQ ID NO: 1993511 - DNA, 14 bp, Homo sapiens
atttgacagtgtgg

SEQ ID NO: 1993512 - DNA, 15 bp, Homo sapiens
atttgagaattattc

SEQ ID NO: 1993513 - DNA, 13 bp, Homo sapiens
atttgagcaattc

SEQ ID NO: 1993514 - DNA, 14 bp, Homo sapiens
atttgagcaattca

SEQ ID NO: 1993515 - DNA, 16 bp, Homo sapiens
atttgagcagggctca

SEQ ID NO: 1993516 - DNA, 22 bp, Homo sapiens
atttgaggacaaccattccaga

SEQ ID NO: 1993517 - DNA, 19 bp, Homo sapiens
atttgaggagcagcttcag

SEQ ID NO: 1993518 - DNA, 12 bp, Homo sapiens
atttgagtgttt

SEQ ID NO: 1993519 - DNA, 19 bp, Homo sapiens
atttgagtgttttaagata

SEQ ID NO: 1993520 - DNA, 13 bp, Homo sapiens
atttgatacaaaa

SEQ ID NO: 1993521 - DNA, 20 bp, Homo sapiens
atttgatagtattgtgcata

SEQ ID NO: 1993522 - DNA, 18 bp, Homo sapiens
atttgatgtacatgtgta

SEQ ID NO: 1993523 - DNA, 20 bp, Homo sapiens
atttgattgtaaaaacaaaa

SEQ ID NO: 1993524 - DNA, 21 bp, Homo sapiens
atttgattgtaaaaacaaaaa

SEQ ID NO: 1993525 - DNA, 19 bp, Homo sapiens
atttgcagagacaggacct

SEQ ID NO: 1993526 - DNA, 11 bp, Homo sapiens
atttgccagca

SEQ ID NO: 1993527 - DNA, 13 bp, Homo sapiens
atttgccagcaca

SEQ ID NO: 1993528 - DNA, 16 bp, Homo sapiens
atttgccagcacaggg

SEQ ID NO: 1993529 - DNA, 17 bp, Homo sapiens
atttgctatcaaaataa

SEQ ID NO: 1993530 - DNA, 24 bp, Homo sapiens
atttgcttaaaattgctagtgatt

SEQ ID NO: 1993531 - DNA, 16 bp, Homo sapiens
atttggaagagaggca

SEQ ID NO: 1993532 - DNA, 14 bp, Homo sapiens
atttggacaaaatg

SEQ ID NO: 1993533 - DNA, 17 bp, Homo sapiens
atttggagactctgtgg

SEQ ID NO: 1993534 - DNA, 22 bp, Homo sapiens
atttggatacactctctagctt

SEQ ID NO: 1993535 - DNA, 21 bp, Homo sapiens
atttggtgcacttttctgtgt

SEQ ID NO: 1993536 - DNA, 18 bp, Homo sapiens
atttggtgtggctgtatt

SEQ ID NO: 1993537 - DNA, 18 bp, Homo sapiens
atttgtaagcaacttgct

SEQ ID NO: 1993538 - DNA, 21 bp, Homo sapiens
atttgtaagcaacttgcttct

SEQ ID NO: 1993539 - DNA, 16 bp, Homo sapiens
atttgtaatgtatctt

SEQ ID NO: 1993540 - DNA, 23 bp, Homo sapiens
atttgtaatgtatcttatttata

SEQ ID NO: 1993541 - DNA, 23 bp, Homo sapiens
atttgtaattgcttacattttta

SEQ ID NO: 1993542 - DNA, 13 bp, Homo sapiens
atttgtacagttc

SEQ ID NO: 1993543 - DNA, 15 bp, Homo sapiens
atttgtacagttcag

SEQ ID NO: 1993544 - DNA, 21 bp, Homo sapiens
atttgtacatagttatttatt

SEQ ID NO: 1993545 - DNA, 18 bp, Homo sapiens
atttgtacatatgtaaaa

SEQ ID NO: 1993546 - DNA, 19 bp, Homo sapiens
atttgtacatatgtaaaat

SEQ ID NO: 1993547 - DNA, 22 bp, Homo sapiens
atttgtacattcctgatactgg

SEQ ID NO: 1993548 - DNA, 21 bp, Homo sapiens
atttgtataatgggaagcctg

SEQ ID NO: 1993549 - DNA, 14 bp, Homo sapiens
atttgtatatcatg

SEQ ID NO: 1993550 - DNA, 15 bp, Homo sapiens
atttgtatatcatga

SEQ ID NO: 1993551 - DNA, 16 bp, Homo sapiens
atttgtatatcatgaa

SEQ ID NO: 1993552 - DNA, 14 bp, Homo sapiens
atttgtatttatat

SEQ ID NO: 1993553 - DNA, 15 bp, Homo sapiens
atttgtatttatatt

SEQ ID NO: 1993554 - DNA, 18 bp, Homo sapiens
atttgtgagccaaagaga

SEQ ID NO: 1993555 - DNA, 19 bp, Homo sapiens
atttgtgagccaaagagaa

SEQ ID NO: 1993556 - DNA, 22 bp, Homo sapiens
atttgtgagccaaagagaaaag

SEQ ID NO: 1993557 - DNA, 13 bp, Homo sapiens
atttgtgtaatag

SEQ ID NO: 1993558 - DNA, 13 bp, Homo sapiens
atttgtgtatgtg

SEQ ID NO: 1993559 - DNA, 15 bp, Homo sapiens
atttgttaaatattt

SEQ ID NO: 1993560 - DNA, 19 bp, Homo sapiens
atttgttaatttagaaaac

SEQ ID NO: 1993561 - DNA, 16 bp, Homo sapiens
atttgttcacatgcat

SEQ ID NO: 1993562 - DNA, 17 bp, Homo sapiens
atttgttcccaagagca

SEQ ID NO: 1993563 - DNA, 18 bp, Homo sapiens
atttgttgaaattatgta

SEQ ID NO: 1993564 - DNA, 12 bp, Homo sapiens
atttgttgtact

SEQ ID NO: 1993565 - DNA, 14 bp, Homo sapiens
atttgttgtacttt

SEQ ID NO: 1993566 - DNA, 22 bp, Homo sapiens
atttgttgtactttttattcaa

SEQ ID NO: 1993567 - DNA, 18 bp, Homo sapiens
atttgttttgacggatga

SEQ ID NO: 1993568 - DNA, 19 bp, Homo sapiens
atttgtttttcttatccaa

SEQ ID NO: 1993569 - DNA, 22 bp, Homo sapiens
attttaaaaaaattcatcatat

SEQ ID NO: 1993570 - DNA, 18 bp, Homo sapiens
attttaaaaacatgagaa

SEQ ID NO: 1993571 - DNA, 20 bp, Homo sapiens
attttaaaaacatgagaaat

SEQ ID NO: 1993572 - DNA, 22 bp, Homo sapiens
attttaaaaacatgagaaatgt

SEQ ID NO: 1993573 - DNA, 15 bp, Homo sapiens
attttaaaaccatgc

SEQ ID NO: 1993574 - DNA, 23 bp, Homo sapiens
attttaaaatctgatttaatgtt

SEQ ID NO: 1993575 - DNA, 17 bp, Homo sapiens
attttaaaattttatct

SEQ ID NO: 1993576 - DNA, 22 bp, Homo sapiens
attttaaagctgactttgttgc

SEQ ID NO: 1993577 - DNA, 11 bp, Homo sapiens
attttaaatgt

SEQ ID NO: 1993578 - DNA, 15 bp, Homo sapiens
attttaaatgttcac

SEQ ID NO: 1993579 - DNA, 16 bp, Homo sapiens
attttaaatgttttac

SEQ ID NO: 1993580 - DNA, 16 bp, Homo sapiens
attttaacaaaagcaa

SEQ ID NO: 1993581 - DNA, 15 bp, Homo sapiens
attttaactgtgtga

SEQ ID NO: 1993582 - DNA, 18 bp, Homo sapiens
attttaagcttgaagatt

SEQ ID NO: 1993583 - DNA, 20 bp, Homo sapiens
attttaagtgctttgtaatg

SEQ ID NO: 1993584 - DNA, 20 bp, Homo sapiens
attttaataaaatgaaaggg

SEQ ID NO: 1993585 - DNA, 14 bp, Homo sapiens
attttaatttatat

SEQ ID NO: 1993586 - DNA, 19 bp, Homo sapiens
attttaatttgatacaaaa

SEQ ID NO: 1993587 - DNA, 19 bp, Homo sapiens
attttacagagaatctgaa

SEQ ID NO: 1993588 - DNA, 16 bp, Homo sapiens
attttactacttgtta

SEQ ID NO: 1993589 - DNA, 19 bp, Homo sapiens
attttactgacagaaatgc

SEQ ID NO: 1993590 - DNA, 18 bp, Homo sapiens
attttactgtctgtaaga

SEQ ID NO: 1993591 - DNA, 21 bp, Homo sapiens
attttactttaaaaggagcca

SEQ ID NO: 1993592 - DNA, 21 bp, Homo sapiens
attttagccttctctgttcat

SEQ ID NO: 1993593 - DNA, 18 bp, Homo sapiens
attttagtctgtcatcca

SEQ ID NO: 1993594 - DNA, 15 bp, Homo sapiens
attttagtgactgta

SEQ ID NO: 1993595 - DNA, 12 bp, Homo sapiens
attttataattt

SEQ ID NO: 1993596 - DNA, 18 bp, Homo sapiens
attttatagctcagttta

SEQ ID NO: 1993597 - DNA, 18 bp, Homo sapiens
attttatatatagagaaa

SEQ ID NO: 1993598 - DNA, 13 bp, Homo sapiens
attttatatgaga

SEQ ID NO: 1993599 - DNA, 15 bp, Homo sapiens
attttatattacact

SEQ ID NO: 1993600 - DNA, 14 bp, Homo sapiens
attttatctgtgtt

SEQ ID NO: 1993601 - DNA, 17 bp, Homo sapiens
attttatgatttaaaaa

SEQ ID NO: 1993602 - DNA, 20 bp, Homo sapiens
attttatgccttttatttct

SEQ ID NO: 1993603 - DNA, 21 bp, Homo sapiens
attttatgccttttatttctt

SEQ ID NO: 1993604 - DNA, 19 bp, Homo sapiens
attttattaaagcaacatt

SEQ ID NO: 1993605 - DNA, 22 bp, Homo sapiens
attttatttattagctgtaaat

SEQ ID NO: 1993606 - DNA, 14 bp, Homo sapiens
attttatttgacaa

SEQ ID NO: 1993607 - DNA, 15 bp, Homo sapiens
attttcaaaaattgt

SEQ ID NO: 1993608 - DNA, 18 bp, Homo sapiens
attttcaacgcagccctg

SEQ ID NO: 1993609 - DNA, 15 bp, Homo sapiens
attttcaagagaaga

SEQ ID NO: 1993610 - DNA, 17 bp, Homo sapiens
attttcaagagaagaaa

SEQ ID NO: 1993611 - DNA, 15 bp, Homo sapiens
attttcaagatacat

SEQ ID NO: 1993612 - DNA, 16 bp, Homo sapiens
attttcacttgcttaa

SEQ ID NO: 1993613 - DNA, 12 bp, Homo sapiens
attttcagaccc

SEQ ID NO: 1993614 - DNA, 12 bp, Homo sapiens
attttcagagtg

SEQ ID NO: 1993615 - DNA, 23 bp, Homo sapiens
attttcagcccatatttcatcgt

SEQ ID NO: 1993616 - DNA, 23 bp, Homo sapiens
attttcaggtttcttaaaaacag

SEQ ID NO: 1993617 - DNA, 12 bp, Homo sapiens
attttcagtatt

SEQ ID NO: 1993618 - DNA, 16 bp, Homo sapiens
attttcattacaatgg

SEQ ID NO: 1993619 - DNA, 14 bp, Homo sapiens
attttccaataaaa

SEQ ID NO: 1993620 - DNA, 21 bp, Homo sapiens
attttcctcctaaacaaaaac

SEQ ID NO: 1993621 - DNA, 19 bp, Homo sapiens
attttcctgaatattaatc

SEQ ID NO: 1993622 - DNA, 14 bp, Homo sapiens
attttcgtgcattt

SEQ ID NO: 1993623 - DNA, 20 bp, Homo sapiens
attttctagacttcagaaca

SEQ ID NO: 1993624 - DNA, 17 bp, Homo sapiens
caacaataaagagctca

SEQ ID NO: 1993625 - DNA, 11 bp, Homo sapiens
caacaataaca

SEQ ID NO: 1993626 - DNA, 21 bp, Homo sapiens
caacaatggtttacatgaaca

SEQ ID NO: 1993627 - DNA, 22 bp, Homo sapiens
caacaatggtttacatgaacac

SEQ ID NO: 1993628 - DNA, 13 bp, Homo sapiens
caacacaaagaga

SEQ ID NO: 1993629 - DNA, 16 bp, Homo sapiens
caacacaaagagaaaa

SEQ ID NO: 1993630 - DNA, 17 bp, Homo sapiens
caacacaagctggaagc

SEQ ID NO: 1993631 - DNA, 20 bp, Homo sapiens
caacacaagctggaagcaca

SEQ ID NO: 1993632 - DNA, 21 bp, Homo sapiens
caacacaatctttccttgtct

SEQ ID NO: 1993633 - DNA, 11 bp, Homo sapiens
caacacagagc

SEQ ID NO: 1993634 - DNA, 18 bp, Homo sapiens
caacacctccttgctttg

SEQ ID NO: 1993635 - DNA, 12 bp, Homo sapiens
caacaccttctt

SEQ ID NO: 1993636 - DNA, 20 bp, Homo sapiens
caacaccttcttggcttctg

SEQ ID NO: 1993637 - DNA, 15 bp, Homo sapiens
caacacgagcaggct

SEQ ID NO: 1993638 - DNA, 18 bp, Homo sapiens
caacacgtggaggtgaag

SEQ ID NO: 1993639 - DNA, 22 bp, Homo sapiens
caacactcacatttattctgct

SEQ ID NO: 1993640 - DNA, 15 bp, Homo sapiens
caacactcttcttga

SEQ ID NO: 1993641 - DNA, 20 bp, Homo sapiens
caacactcttcttgagcaga

SEQ ID NO: 1993642 - DNA, 10 bp, Homo sapiens
caacagaaaa

SEQ ID NO: 1993643 - DNA, 22 bp, Homo sapiens
caacagaagtcatgaagcccaa

SEQ ID NO: 1993644 - DNA, 13 bp, Homo sapiens
caacagagcaaga

SEQ ID NO: 1993645 - DNA, 17 bp, Homo sapiens
caacagatcaatttgta

SEQ ID NO: 1993646 - DNA, 18 bp, Homo sapiens
caacagcagatggcacca

SEQ ID NO: 1993647 - DNA, 12 bp, Homo sapiens
caacagctcaga

SEQ ID NO: 1993648 - DNA, 16 bp, Homo sapiens
caacagcttgaccaga

SEQ ID NO: 1993649 - DNA, 21 bp, Homo sapiens
caacagcttgaccagacctag

SEQ ID NO: 1993650 - DNA, 18 bp, Homo sapiens
caacagcttttcccagga

SEQ ID NO: 1993651 - DNA, 20 bp, Homo sapiens
caacagcttttcccaggaga

SEQ ID NO: 1993652 - DNA, 17 bp, Homo sapiens
caacaggaatctcagag

SEQ ID NO: 1993653 - DNA, 20 bp, Homo sapiens
caacaggcattccagaatta

SEQ ID NO: 1993654 - DNA, 12 bp, Homo sapiens
caacaggctggg

SEQ ID NO: 1993655 - DNA, 23 bp, Homo sapiens
caacaggctgttctgcactgaaa

SEQ ID NO: 1993656 - DNA, 24 bp, Homo sapiens
caacaggctgttctgcactgaaaa

SEQ ID NO: 1993657 - DNA, 18 bp, Homo sapiens
caacaggtggcaggacca

SEQ ID NO: 1993658 - DNA, 21 bp, Homo sapiens
caacaggtggcaggaccagga

SEQ ID NO: 1993659 - DNA, 22 bp, Homo sapiens
caacaggtggcaggaccaggac

SEQ ID NO: 1993660 - DNA, 14 bp, Homo sapiens
caacagttccttca

SEQ ID NO: 1993661 - DNA, 23 bp, Homo sapiens
caacatagtaagaccccatctct

SEQ ID NO: 1993662 - DNA, 21 bp, Homo sapiens
caacatccatgtcctatgtgt

SEQ ID NO: 1993663 - DNA, 16 bp, Homo sapiens
caacatcccacagtgg

SEQ ID NO: 1993664 - DNA, 17 bp, Homo sapiens
caacatcccattgccct

SEQ ID NO: 1993665 - DNA, 15 bp, Homo sapiens
caacatctttttcct

SEQ ID NO: 1993666 - DNA, 13 bp, Homo sapiens
caacatggagaaa

SEQ ID NO: 1993667 - DNA, 22 bp, Homo sapiens
caacatggagaaaccctgtctc

SEQ ID NO: 1993668 - DNA, 23 bp, Homo sapiens
caacatggagaaaccctgtctct

SEQ ID NO: 1993669 - DNA, 18 bp, Homo sapiens
caacatggtgaaaccccg

SEQ ID NO: 1993670 - DNA, 17 bp, Homo sapiens
caacatgtataatattt

SEQ ID NO: 1993671 - DNA, 15 bp, Homo sapiens
caacatgttatttgt

SEQ ID NO: 1993672 - DNA, 23 bp, Homo sapiens
caacatgttatttgtaatagatg

SEQ ID NO: 1993673 - DNA, 19 bp, Homo sapiens
caacattcccccaacatta

SEQ ID NO: 1993674 - DNA, 24 bp, Homo sapiens
caaccaacctccccgcagagctcc

SEQ ID NO: 1993675 - DNA, 20 bp, Homo sapiens
caaccaagagcacattctta

SEQ ID NO: 1993676 - DNA, 14 bp, Homo sapiens
caaccacaaaccac

SEQ ID NO: 1993677 - DNA, 12 bp, Homo sapiens
caaccagagccc

SEQ ID NO: 1993678 - DNA, 18 bp, Homo sapiens
caaccagcattttactac

SEQ ID NO: 1993679 - DNA, 18 bp, Homo sapiens
caaccagccacacagagc

SEQ ID NO: 1993680 - DNA, 12 bp, Homo sapiens
caaccatcaatg

SEQ ID NO: 1993681 - DNA, 16 bp, Homo sapiens
caaccattccagactg

SEQ ID NO: 1993682 - DNA, 22 bp, Homo sapiens
caaccattccagactgcttcca

SEQ ID NO: 1993683 - DNA, 16 bp, Homo sapiens
caaccccagacactgg

SEQ ID NO: 1993684 - DNA, 23 bp, Homo sapiens
caaccccagctggcctctagaac

SEQ ID NO: 1993685 - DNA, 23 bp, Homo sapiens
caaccccagggcccccacaggcc

SEQ ID NO: 1993686 - DNA, 23 bp, Homo sapiens
caaccccatcatatgacatgcca

SEQ ID NO: 1993687 - DNA, 14 bp, Homo sapiens
caacccccagcctg

SEQ ID NO: 1993688 - DNA, 17 bp, Homo sapiens
caaccccccacctgcca

SEQ ID NO: 1993689 - DNA, 14 bp, Homo sapiens
caacccctgtaccc

SEQ ID NO: 1993690 - DNA, 22 bp, Homo sapiens
caacccctgtacccagctcctt

SEQ ID NO: 1993691 - DNA, 17 bp, Homo sapiens
caaccccttcgctcctg

SEQ ID NO: 1993692 - DNA, 22 bp, Homo sapiens
caaccccttcgctcctgtgtct

SEQ ID NO: 1993693 - DNA, 18 bp, Homo sapiens
caacccgtggaggctgct

SEQ ID NO: 1993694 - DNA, 16 bp, Homo sapiens
caaccctgtttcctga

SEQ ID NO: 1993695 - DNA, 17 bp, Homo sapiens
caaccctgtttcctgag

SEQ ID NO: 1993696 - DNA, 17 bp, Homo sapiens
caaccctgttttatact

SEQ ID NO: 1993697 - DNA, 19 bp, Homo sapiens
caaccgtggcccttcctgg

SEQ ID NO: 1993698 - DNA, 21 bp, Homo sapiens
caaccgtggcccttcctggac

SEQ ID NO: 1993699 - DNA, 18 bp, Homo sapiens
caacctaacccctttcct

SEQ ID NO: 1993700 - DNA, 15 bp, Homo sapiens
caacctaagcaacag

SEQ ID NO: 1993701 - DNA, 22 bp, Homo sapiens
caacctaccaccccttcctgtc

SEQ ID NO: 1993702 - DNA, 14 bp, Homo sapiens
caacctcaatgccc

SEQ ID NO: 1993703 - DNA, 18 bp, Homo sapiens
caacctcatcctccttct

SEQ ID NO: 1993704 - DNA, 17 bp, Homo sapiens
caacctcccaacccaga

SEQ ID NO: 1993705 - DNA, 17 bp, Homo sapiens
caacctccgtgctgggc

SEQ ID NO: 1993706 - DNA, 20 bp, Homo sapiens
caacctgaccaacatggaga

SEQ ID NO: 1993707 - DNA, 21 bp, Homo sapiens
caacctgaccaacatggagaa

SEQ ID NO: 1993708 - DNA, 19 bp, Homo sapiens
caacctgatgccccttccc

SEQ ID NO: 1993709 - DNA, 23 bp, Homo sapiens
caacctgatgccccttccccaag

SEQ ID NO: 1993710 - DNA, 18 bp, Homo sapiens
caacctgcctgtgcatga

SEQ ID NO: 1993711 - DNA, 23 bp, Homo sapiens
caacctgctctcctcttgccact

SEQ ID NO: 1993712 - DNA, 16 bp, Homo sapiens
caacctggtcacagga

SEQ ID NO: 1993713 - DNA, 16 bp, Homo sapiens
caaccttctgtggctc

SEQ ID NO: 1993714 - DNA, 19 bp, Homo sapiens
caaccttctgtggctcaca

SEQ ID NO: 1993715 - DNA, 13 bp, Homo sapiens
caacctttgtgta

SEQ ID NO: 1993716 - DNA, 13 bp, Homo sapiens
caacgacaaagcc

SEQ ID NO: 1993717 - DNA, 14 bp, Homo sapiens
caacgcacaggaaa

SEQ ID NO: 1993718 - DNA, 13 bp, Homo sapiens
caacgcagccctg

SEQ ID NO: 1993719 - DNA, 17 bp, Homo sapiens
caacgggaagcaacctc

SEQ ID NO: 1993720 - DNA, 21 bp, Homo sapiens
caacgggaccccctggccctg

SEQ ID NO: 1993721 - DNA, 22 bp, Homo sapiens
caactactcagctctcctgctg

SEQ ID NO: 1993722 - DNA, 15 bp, Homo sapiens
caactaggacctcat

SEQ ID NO: 1993723 - DNA, 17 bp, Homo sapiens
caactaggcttcagcat

SEQ ID NO: 1993724 - DNA, 22 bp, Homo sapiens
caactatgatatggtaaaagtt

SEQ ID NO: 1993725 - DNA, 17 bp, Homo sapiens
caactattaaagtgcca

SEQ ID NO: 1993726 - DNA, 17 bp, Homo sapiens
caactatttataaacta

SEQ ID NO: 1993727 - DNA, 11 bp, Homo sapiens
caactccagaa

SEQ ID NO: 1993728 - DNA, 18 bp, Homo sapiens
caactccaggaaaactgt

SEQ ID NO: 1993729 - DNA, 17 bp, Homo sapiens
caactcccacgactgtt

SEQ ID NO: 1993730 - DNA, 21 bp, Homo sapiens
caactccctgaacctcagttt

SEQ ID NO: 1993731 - DNA, 12 bp, Homo sapiens
caactcctcctt

SEQ ID NO: 1993732 - DNA, 22 bp, Homo sapiens
caactcctggagatttcagtta

SEQ ID NO: 1993733 - DNA, 14 bp, Homo sapiens
caactctgactctt

SEQ ID NO: 1993734 - DNA, 12 bp, Homo sapiens
caactctgcact

SEQ ID NO: 1993735 - DNA, 23 bp, Homo sapiens
caactctgcactccatggccacc

SEQ ID NO: 1993736 - DNA, 18 bp, Homo sapiens
caactgacaatatgattt

SEQ ID NO: 1993737 - DNA, 21 bp, Homo sapiens
caactgacaatatgattttaa

SEQ ID NO: 1993738 - DNA, 14 bp, Homo sapiens
caagtcctcttttc

SEQ ID NO: 1993739 - DNA, 21 bp, Homo sapiens
caagtcctcttttctgagagg

SEQ ID NO: 1993740 - DNA, 15 bp, Homo sapiens
caagtcctgtgaatt

SEQ ID NO: 1993741 - DNA, 14 bp, Homo sapiens
caagtctccttccc

SEQ ID NO: 1993742 - DNA, 13 bp, Homo sapiens
caagtctgcagcc

SEQ ID NO: 1993743 - DNA, 19 bp, Homo sapiens
caagtctggatctgggacc

SEQ ID NO: 1993744 - DNA, 17 bp, Homo sapiens
caagtgatatatgtatt

SEQ ID NO: 1993745 - DNA, 18 bp, Homo sapiens
caagtgatatatgtattt

SEQ ID NO: 1993746 - DNA, 19 bp, Homo sapiens
caagtgatatatgtattta

SEQ ID NO: 1993747 - DNA, 21 bp, Homo sapiens
caagtgatatcacctctcttc

SEQ ID NO: 1993748 - DNA, 16 bp, Homo sapiens
caagtgattctcctgc

SEQ ID NO: 1993749 - DNA, 20 bp, Homo sapiens
caagtgattctcctgcctca

SEQ ID NO: 1993750 - DNA, 17 bp, Homo sapiens
caagtgcatgctctctg

SEQ ID NO: 1993751 - DNA, 13 bp, Homo sapiens
caagtgccatccc

SEQ ID NO: 1993752 - DNA, 14 bp, Homo sapiens
caagtgccatccca

SEQ ID NO: 1993753 - DNA, 16 bp, Homo sapiens
caagtgccatcccaca

SEQ ID NO: 1993754 - DNA, 17 bp, Homo sapiens
caagtgcccgccctgcc

SEQ ID NO: 1993755 - DNA, 15 bp, Homo sapiens
caagtgcctcttgtt

SEQ ID NO: 1993756 - DNA, 16 bp, Homo sapiens
caagtgcctcttgttg

SEQ ID NO: 1993757 - DNA, 11 bp, Homo sapiens
caagtggaggg

SEQ ID NO: 1993758 - DNA, 14 bp, Homo sapiens
caagtggagggggt

SEQ ID NO: 1993759 - DNA, 19 bp, Homo sapiens
caagtggctcccacaccct

SEQ ID NO: 1993760 - DNA, 22 bp, Homo sapiens
caagtggtgggaatcagatctg

SEQ ID NO: 1993761 - DNA, 16 bp, Homo sapiens
caagtgtatatcagaa

SEQ ID NO: 1993762 - DNA, 18 bp, Homo sapiens
caagtgtatatcagaaaa

SEQ ID NO: 1993763 - DNA, 23 bp, Homo sapiens
caagtgtggtagggacttaaaaa

SEQ ID NO: 1993764 - DNA, 16 bp, Homo sapiens
caagttataaatcaat

SEQ ID NO: 1993765 - DNA, 17 bp, Homo sapiens
caagttatattgaatat

SEQ ID NO: 1993766 - DNA, 20 bp, Homo sapiens
caagttattgtacagctgtt

SEQ ID NO: 1993767 - DNA, 17 bp, Homo sapiens
caagttcagggaagcag

SEQ ID NO: 1993768 - DNA, 14 bp, Homo sapiens
caagttccagctgg

SEQ ID NO: 1993769 - DNA, 15 bp, Homo sapiens
caagttccagctggt

SEQ ID NO: 1993770 - DNA, 15 bp, Homo sapiens
caagttcctgcactc

SEQ ID NO: 1993771 - DNA, 19 bp, Homo sapiens
caagttctagagaagaggc

SEQ ID NO: 1993772 - DNA, 16 bp, Homo sapiens
caagttgtttcattga

SEQ ID NO: 1993773 - DNA, 12 bp, Homo sapiens
caagttttgtat

SEQ ID NO: 1993774 - DNA, 14 bp, Homo sapiens
caagttttgtataa

SEQ ID NO: 1993775 - DNA, 19 bp, Homo sapiens
caagttttgtataaataat

SEQ ID NO: 1993776 - DNA, 20 bp, Homo sapiens
caataaaaaaaagaaatgaa

SEQ ID NO: 1993777 - DNA, 21 bp, Homo sapiens
caataaaaaaaagaaatgaaa

SEQ ID NO: 1993778 - DNA, 12 bp, Homo sapiens
caataaaacatt

SEQ ID NO: 1993779 - DNA, 12 bp, Homo sapiens
caataaaagtga

SEQ ID NO: 1993780 - DNA, 19 bp, Homo sapiens
caataaaagtgactctcag

SEQ ID NO: 1993781 - DNA, 14 bp, Homo sapiens
caataaaatagtat

SEQ ID NO: 1993782 - DNA, 15 bp, Homo sapiens
caataaaatcatgta

SEQ ID NO: 1993783 - DNA, 20 bp, Homo sapiens
caataaaatcatgtacattt

SEQ ID NO: 1993784 - DNA, 20 bp, Homo sapiens
caataaaatcttgaaaatgc

SEQ ID NO: 1993785 - DNA, 11 bp, Homo sapiens
caataaagctg

SEQ ID NO: 1993786 - DNA, 17 bp, Homo sapiens
caataaagctgctgaga

SEQ ID NO: 1993787 - DNA, 13 bp, Homo sapiens
caataaagctgga

SEQ ID NO: 1993788 - DNA, 12 bp, Homo sapiens
caataaagtatc

SEQ ID NO: 1993789 - DNA, 15 bp, Homo sapiens
caataaatgccctct

SEQ ID NO: 1993790 - DNA, 13 bp, Homo sapiens
caataaatgctga

SEQ ID NO: 1993791 - DNA, 23 bp, Homo sapiens
caataaattatttttaagaaatc

SEQ ID NO: 1993792 - DNA, 14 bp, Homo sapiens
caataacaacaatg

SEQ ID NO: 1993793 - DNA, 22 bp, Homo sapiens
caataacaacaatggtttacat

SEQ ID NO: 1993794 - DNA, 12 bp, Homo sapiens
caataacttcag

SEQ ID NO: 1993795 - DNA, 18 bp, Homo sapiens
caataacttcagagaagt

SEQ ID NO: 1993796 - DNA, 19 bp, Homo sapiens
caataacttcagagaagtc

SEQ ID NO: 1993797 - DNA, 20 bp, Homo sapiens
caataacttcagagaagtca

SEQ ID NO: 1993798 - DNA, 21 bp, Homo sapiens
caataacttcagagaagtcag

SEQ ID NO: 1993799 - DNA, 18 bp, Homo sapiens
caataaggtcaatgccag

SEQ ID NO: 1993800 - DNA, 20 bp, Homo sapiens
caataatgtgcaaattttgc

SEQ ID NO: 1993801 - DNA, 22 bp, Homo sapiens
caataattaggatctatgcaat

SEQ ID NO: 1993802 - DNA, 22 bp, Homo sapiens
caataatttcaggttttgtaaa

SEQ ID NO: 1993803 - DNA, 13 bp, Homo sapiens
caataattttcta

SEQ ID NO: 1993804 - DNA, 15 bp, Homo sapiens
caatacaacaagaac

SEQ ID NO: 1993805 - DNA, 17 bp, Homo sapiens
caatacatgctgctaat

SEQ ID NO: 1993806 - DNA, 18 bp, Homo sapiens
caataccagatcactcaa

SEQ ID NO: 1993807 - DNA, 15 bp, Homo sapiens
caatactactgtaaa

SEQ ID NO: 1993808 - DNA, 17 bp, Homo sapiens
caatactactgtaaatg

SEQ ID NO: 1993809 - DNA, 18 bp, Homo sapiens
caatactactgtaaatgt

SEQ ID NO: 1993810 - DNA, 23 bp, Homo sapiens
caatactgccttaatgagaacat

SEQ ID NO: 1993811 - DNA, 19 bp, Homo sapiens
caatagcagacagtgtttt

SEQ ID NO: 1993812 - DNA, 16 bp, Homo sapiens
caatagctattgcatg

SEQ ID NO: 1993813 - DNA, 22 bp, Homo sapiens
caatagctattgcatgtaaaat

SEQ ID NO: 1993814 - DNA, 17 bp, Homo sapiens
caatagtccccatcagc

SEQ ID NO: 1993815 - DNA, 16 bp, Homo sapiens
caatagtttgcataga

SEQ ID NO: 1993816 - DNA, 16 bp, Homo sapiens
caatatataaaaatat

SEQ ID NO: 1993817 - DNA, 17 bp, Homo sapiens
caatatataaaaatata

SEQ ID NO: 1993818 - DNA, 18 bp, Homo sapiens
caatatataaaaatatat

SEQ ID NO: 1993819 - DNA, 21 bp, Homo sapiens
caatatgtaaatagtgcagaa

SEQ ID NO: 1993820 - DNA, 16 bp, Homo sapiens
caatatgtattaatat

SEQ ID NO: 1993821 - DNA, 22 bp, Homo sapiens
caatatgtattgtaaacatgtg

SEQ ID NO: 1993822 - DNA, 17 bp, Homo sapiens
caatatgtgatttttgt

SEQ ID NO: 1993823 - DNA, 15 bp, Homo sapiens
caatattaaatacag

SEQ ID NO: 1993824 - DNA, 22 bp, Homo sapiens
caatattaaatacagacactaa

SEQ ID NO: 1993825 - DNA, 13 bp, Homo sapiens
caatattataatt

SEQ ID NO: 1993826 - DNA, 14 bp, Homo sapiens
caatattataattt

SEQ ID NO: 1993827 - DNA, 20 bp, Homo sapiens
caatattcctggtattattt

SEQ ID NO: 1993828 - DNA, 16 bp, Homo sapiens
caatatttactcatca

SEQ ID NO: 1993829 - DNA, 22 bp, Homo sapiens
caatatttccctggaatttaat

SEQ ID NO: 1993830 - DNA, 13 bp, Homo sapiens
caatatttgttct

SEQ ID NO: 1993831 - DNA, 11 bp, Homo sapiens
caatattttcc

SEQ ID NO: 1993832 - DNA, 13 bp, Homo sapiens
caatattttccat

SEQ ID NO: 1993833 - DNA, 15 bp, Homo sapiens
caatcactgctcccc

SEQ ID NO: 1993834 - DNA, 13 bp, Homo sapiens
caatcagcactga

SEQ ID NO: 1993835 - DNA, 17 bp, Homo sapiens
caatcatctgtgtgaaa

SEQ ID NO: 1993836 - DNA, 19 bp, Homo sapiens
caatcatctgtgtgaaaat

SEQ ID NO: 1993837 - DNA, 17 bp, Homo sapiens
caatcattttaattatt

SEQ ID NO: 1993838 - DNA, 14 bp, Homo sapiens
caatccaggtggga

SEQ ID NO: 1993839 - DNA, 19 bp, Homo sapiens
caatccaggtgggagagac

SEQ ID NO: 1993840 - DNA, 18 bp, Homo sapiens
caatcccaaaagtcacca

SEQ ID NO: 1993841 - DNA, 17 bp, Homo sapiens
caatcccaccaaccctc

SEQ ID NO: 1993842 - DNA, 22 bp, Homo sapiens
caatcccctcattcaggaaaac

SEQ ID NO: 1993843 - DNA, 15 bp, Homo sapiens
caatcccgtgaaaga

SEQ ID NO: 1993844 - DNA, 18 bp, Homo sapiens
caatcctagaaccaagct

SEQ ID NO: 1993845 - DNA, 18 bp, Homo sapiens
caatcctgaagaaaccac

SEQ ID NO: 1993846 - DNA, 14 bp, Homo sapiens
caatcctgccccca

SEQ ID NO: 1993847 - DNA, 20 bp, Homo sapiens
caatcctgcccccagccatg

SEQ ID NO: 1993848 - DNA, 13 bp, Homo sapiens
caatcctgtccct

SEQ ID NO: 1993849 - DNA, 21 bp, Homo sapiens
caatccttcttatgtttgctt

SEQ ID NO: 1993850 - DNA, 15 bp, Homo sapiens
caatcctttgagtta

SEQ ID NO: 1993851 - DNA, 14 bp, Homo sapiens
caatctctgtgact

SEQ ID NO: 1993852 - DNA, 15 bp, Homo sapiens
caatcttgtccacag

SEQ ID NO: 1993853 - DNA, 18 bp, Homo sapiens
cacagttcttggtgactg

SEQ ID NO: 1993854 - DNA, 22 bp, Homo sapiens
cacagttcttggtgactgtccc

SEQ ID NO: 1993855 - DNA, 19 bp, Homo sapiens
cacagttttctgagaaaga

SEQ ID NO: 1993856 - DNA, 20 bp, Homo sapiens
cacagttttctgagaaagac

SEQ ID NO: 1993857 - DNA, 21 bp, Homo sapiens
cacagttttctgagaaagact

SEQ ID NO: 1993858 - DNA, 22 bp, Homo sapiens
cacagttttctgagaaagacta

SEQ ID NO: 1993859 - DNA, 15 bp, Homo sapiens
cacagttttgaaaga

SEQ ID NO: 1993860 - DNA, 12 bp, Homo sapiens
cacatacataca

SEQ ID NO: 1993861 - DNA, 13 bp, Homo sapiens
cacatacatacat

SEQ ID NO: 1993862 - DNA, 14 bp, Homo sapiens
cacatacatacata

SEQ ID NO: 1993863 - DNA, 15 bp, Homo sapiens
cacatacatacatac

SEQ ID NO: 1993864 - DNA, 16 bp, Homo sapiens
cacatacatacataca

SEQ ID NO: 1993865 - DNA, 17 bp, Homo sapiens
cacatacatacatacat

SEQ ID NO: 1993866 - DNA, 23 bp, Homo sapiens
cacatacgtgttaggaggctgca

SEQ ID NO: 1993867 - DNA, 15 bp, Homo sapiens
cacatactagaaagc

SEQ ID NO: 1993868 - DNA, 19 bp, Homo sapiens
cacatactcatttttcatg

SEQ ID NO: 1993869 - DNA, 14 bp, Homo sapiens
cacatagagatatg

SEQ ID NO: 1993870 - DNA, 18 bp, Homo sapiens
cacatagattaatggcac

SEQ ID NO: 1993871 - DNA, 22 bp, Homo sapiens
cacatatacaaaagcaagactt

SEQ ID NO: 1993872 - DNA, 13 bp, Homo sapiens
cacatatacatat

SEQ ID NO: 1993873 - DNA, 14 bp, Homo sapiens
cacatatacatata

SEQ ID NO: 1993874 - DNA, 15 bp, Homo sapiens
cacatatacatatat

SEQ ID NO: 1993875 - DNA, 17 bp, Homo sapiens
cacatatacatatatat

SEQ ID NO: 1993876 - DNA, 22 bp, Homo sapiens
cacatatacctataatgtgtgt

SEQ ID NO: 1993877 - DNA, 12 bp, Homo sapiens
cacatatatgta

SEQ ID NO: 1993878 - DNA, 15 bp, Homo sapiens
cacatatatgtatat

SEQ ID NO: 1993879 - DNA, 20 bp, Homo sapiens
cacatatgcaccttgtgtct

SEQ ID NO: 1993880 - DNA, 17 bp, Homo sapiens
cacatatggcacaactg

SEQ ID NO: 1993881 - DNA, 16 bp, Homo sapiens
cacatatgtctgtatc

SEQ ID NO: 1993882 - DNA, 13 bp, Homo sapiens
cacatccattccc

SEQ ID NO: 1993883 - DNA, 14 bp, Homo sapiens
cacatccattccca

SEQ ID NO: 1993884 - DNA, 23 bp, Homo sapiens
cacatccatttcatctatttctg

SEQ ID NO: 1993885 - DNA, 21 bp, Homo sapiens
cacatcccggcctcttccacc

SEQ ID NO: 1993886 - DNA, 17 bp, Homo sapiens
cacatccctaacatcat

SEQ ID NO: 1993887 - DNA, 16 bp, Homo sapiens
cacatccctgccctcc

SEQ ID NO: 1993888 - DNA, 14 bp, Homo sapiens
cacatccctgggcc

SEQ ID NO: 1993889 - DNA, 15 bp, Homo sapiens
cacatccctgggcct

SEQ ID NO: 1993890 - DNA, 18 bp, Homo sapiens
cacatccctgggcctgct

SEQ ID NO: 1993891 - DNA, 20 bp, Homo sapiens
cacatccctgggcctgctgc

SEQ ID NO: 1993892 - DNA, 14 bp, Homo sapiens
cacatctctgcagt

SEQ ID NO: 1993893 - DNA, 16 bp, Homo sapiens
cacatcttgctctgct

SEQ ID NO: 1993894 - DNA, 17 bp, Homo sapiens
cacatcttgctctgctg

SEQ ID NO: 1993895 - DNA, 22 bp, Homo sapiens
cacatcttgctctgctgacaga

SEQ ID NO: 1993896 - DNA, 15 bp, Homo sapiens
cacatctttcctgtc

SEQ ID NO: 1993897 - DNA, 20 bp, Homo sapiens
cacatgaggagggtgccctc

SEQ ID NO: 1993898 - DNA, 19 bp, Homo sapiens
cacatgcatcatcagccta

SEQ ID NO: 1993899 - DNA, 18 bp, Homo sapiens
cacatggctatgttttag

SEQ ID NO: 1993900 - DNA, 23 bp, Homo sapiens
cacatgtcaccgtggaccttcct

SEQ ID NO: 1993901 - DNA, 17 bp, Homo sapiens
cacattaagtggctttt

SEQ ID NO: 1993902 - DNA, 18 bp, Homo sapiens
cacattaatggtctaaaa

SEQ ID NO: 1993903 - DNA, 20 bp, Homo sapiens
cacattacatcatcctcctt

SEQ ID NO: 1993904 - DNA, 16 bp, Homo sapiens
cacattacttgcacaa

SEQ ID NO: 1993905 - DNA, 20 bp, Homo sapiens
cacattatcgggagcagtgt

SEQ ID NO: 1993906 - DNA, 22 bp, Homo sapiens
cacattatcgggagcagtgtct

SEQ ID NO: 1993907 - DNA, 18 bp, Homo sapiens
cacattatgttagagagg

SEQ ID NO: 1993908 - DNA, 14 bp, Homo sapiens
cacattcctggccc

SEQ ID NO: 1993909 - DNA, 14 bp, Homo sapiens
cacattctcctgtg

SEQ ID NO: 1993910 - DNA, 16 bp, Homo sapiens
cacattctcctgtgcc

SEQ ID NO: 1993911 - DNA, 20 bp, Homo sapiens
cacattttgtacaaagatat

SEQ ID NO: 1993912 - DNA, 21 bp, Homo sapiens
caccaaactgcacacacagct

SEQ ID NO: 1993913 - DNA, 19 bp, Homo sapiens
caccaacccatcagaagga

SEQ ID NO: 1993914 - DNA, 13 bp, Homo sapiens
caccaaccctcag

SEQ ID NO: 1993915 - DNA, 18 bp, Homo sapiens
caccaactctgcactcca

SEQ ID NO: 1993916 - DNA, 22 bp, Homo sapiens
caccaactctgcactccatggc

SEQ ID NO: 1993917 - DNA, 13 bp, Homo sapiens
caccaagcccagt

SEQ ID NO: 1993918 - DNA, 15 bp, Homo sapiens
caccaagcccagtta

SEQ ID NO: 1993919 - DNA, 14 bp, Homo sapiens
caccaagctcacag

SEQ ID NO: 1993920 - DNA, 19 bp, Homo sapiens
caccaagctcacagttcct

SEQ ID NO: 1993921 - DNA, 16 bp, Homo sapiens
caccaataaaaatcct

SEQ ID NO: 1993922 - DNA, 20 bp, Homo sapiens
caccaataacttcagagaag

SEQ ID NO: 1993923 - DNA, 24 bp, Homo sapiens
caccaataacttcagagaagtcag

SEQ ID NO: 1993924 - DNA, 22 bp, Homo sapiens
caccaatgtacccaccgggcca

SEQ ID NO: 1993925 - DNA, 23 bp, Homo sapiens
caccaatgtacccaccgggccac

SEQ ID NO: 1993926 - DNA, 24 bp, Homo sapiens
caccaattgtacattccctgcatc

SEQ ID NO: 1993927 - DNA, 15 bp, Homo sapiens
caccacaggctgcct

SEQ ID NO: 1993928 - DNA, 22 bp, Homo sapiens
caccaccagatgagaagttaag

SEQ ID NO: 1993929 - DNA, 22 bp, Homo sapiens
caccacctaggccactcctcca

SEQ ID NO: 1993930 - DNA, 12 bp, Homo sapiens
caccacctctcc

SEQ ID NO: 1993931 - DNA, 22 bp, Homo sapiens
caccaccttcccagctctccct

SEQ ID NO: 1993932 - DNA, 19 bp, Homo sapiens
caccaccttggactcctcc

SEQ ID NO: 1993933 - DNA, 20 bp, Homo sapiens
caccaccttggactcctccc

SEQ ID NO: 1993934 - DNA, 15 bp, Homo sapiens
caccacgatgtggcc

SEQ ID NO: 1993935 - DNA, 20 bp, Homo sapiens
caccacgatgtggccctggc

SEQ ID NO: 1993936 - DNA, 16 bp, Homo sapiens
caccacggcgtttttt

SEQ ID NO: 1993937 - DNA, 14 bp, Homo sapiens
caccacgtctgcca

SEQ ID NO: 1993938 - DNA, 16 bp, Homo sapiens
caccacgtctgccagg

SEQ ID NO: 1993939 - DNA, 14 bp, Homo sapiens
caccactagagctg

SEQ ID NO: 1993940 - DNA, 13 bp, Homo sapiens
caccactagggtc

SEQ ID NO: 1993941 - DNA, 23 bp, Homo sapiens
caccactagggtcctggccctct

SEQ ID NO: 1993942 - DNA, 13 bp, Homo sapiens
caccactctggca

SEQ ID NO: 1993943 - DNA, 15 bp, Homo sapiens
caccactctggcagc

SEQ ID NO: 1993944 - DNA, 18 bp, Homo sapiens
caccactctggcagccac

SEQ ID NO: 1993945 - DNA, 19 bp, Homo sapiens
caccactctggcagccaca

SEQ ID NO: 1993946 - DNA, 16 bp, Homo sapiens
caccactgccctgcct

SEQ ID NO: 1993947 - DNA, 17 bp, Homo sapiens
caccactgccctgcctg

SEQ ID NO: 1993948 - DNA, 22 bp, Homo sapiens
caccactgccctgcctgcccac

SEQ ID NO: 1993949 - DNA, 22 bp, Homo sapiens
caccactttgtctctgagaaca

SEQ ID NO: 1993950 - DNA, 18 bp, Homo sapiens
caccagagcccaccttgg

SEQ ID NO: 1993951 - DNA, 14 bp, Homo sapiens
caccagagcccatg

SEQ ID NO: 1993952 - DNA, 19 bp, Homo sapiens
caccagagcccatgctcaa

SEQ ID NO: 1993953 - DNA, 16 bp, Homo sapiens
caccagaggctgcaga

SEQ ID NO: 1993954 - DNA, 17 bp, Homo sapiens
caccagaggtcaggagt

SEQ ID NO: 1993955 - DNA, 23 bp, Homo sapiens
caccagagtgaaagggctatggc

SEQ ID NO: 1993956 - DNA, 16 bp, Homo sapiens
caccagatgagaagtt

SEQ ID NO: 1993957 - DNA, 16 bp, Homo sapiens
caccagccccctggat

SEQ ID NO: 1993958 - DNA, 22 bp, Homo sapiens
caccagccccctggatgggcat

SEQ ID NO: 1993959 - DNA, 15 bp, Homo sapiens
caccagcccggcctg

SEQ ID NO: 1993960 - DNA, 17 bp, Homo sapiens
caccagcccggcctgct

SEQ ID NO: 1993961 - DNA, 19 bp, Homo sapiens
caccagcccttccctgctt

SEQ ID NO: 1993962 - DNA, 14 bp, Homo sapiens
caccagctctgtgg

SEQ ID NO: 1993963 - DNA, 19 bp, Homo sapiens
caccagctctgtggcctgt

SEQ ID NO: 1993964 - DNA, 22 bp, Homo sapiens
caccagctctgtggcctgtgtc

SEQ ID NO: 1993965 - DNA, 20 bp, Homo sapiens
caccagctgccaaaatcgta

SEQ ID NO: 1993966 - DNA, 12 bp, Homo sapiens
caccagctgctc

SEQ ID NO: 1993967 - DNA, 17 bp, Homo sapiens
cactcaaccaacctccc

SEQ ID NO: 1993968 - DNA, 13 bp, Homo sapiens
cactcacatgccg

SEQ ID NO: 1993969 - DNA, 20 bp, Homo sapiens
cactcacatttattctgctc

SEQ ID NO: 1993970 - DNA, 12 bp, Homo sapiens
cactcaccaggg

SEQ ID NO: 1993971 - DNA, 15 bp, Homo sapiens
cactcaccagggtcc

SEQ ID NO: 1993972 - DNA, 22 bp, Homo sapiens
cactcaccagggtccgcaccag

SEQ ID NO: 1993973 - DNA, 13 bp, Homo sapiens
cactcactccagc

SEQ ID NO: 1993974 - DNA, 15 bp, Homo sapiens
cactcactccagccc

SEQ ID NO: 1993975 - DNA, 16 bp, Homo sapiens
cactcagaagacactg

SEQ ID NO: 1993976 - DNA, 17 bp, Homo sapiens
cactcagccacacccca

SEQ ID NO: 1993977 - DNA, 20 bp, Homo sapiens
cactcaggaggctgaggcag

SEQ ID NO: 1993978 - DNA, 14 bp, Homo sapiens
cactcagggctgcc

SEQ ID NO: 1993979 - DNA, 17 bp, Homo sapiens
cactcagtcccccacca

SEQ ID NO: 1993980 - DNA, 23 bp, Homo sapiens
cactcagtcccccaccacactga

SEQ ID NO: 1993981 - DNA, 13 bp, Homo sapiens
cactcatttcatc

SEQ ID NO: 1993982 - DNA, 16 bp, Homo sapiens
cactcatttcatctca

SEQ ID NO: 1993983 - DNA, 17 bp, Homo sapiens
cactcatttcatctcat

SEQ ID NO: 1993984 - DNA, 18 bp, Homo sapiens
cactcatttcatctcatt

SEQ ID NO: 1993985 - DNA, 22 bp, Homo sapiens
cactcatttcatctcatttaag

SEQ ID NO: 1993986 - DNA, 18 bp, Homo sapiens
cactccaccacccaaaag

SEQ ID NO: 1993987 - DNA, 19 bp, Homo sapiens
cactccaccccctccagct

SEQ ID NO: 1993988 - DNA, 14 bp, Homo sapiens
cactccagacccct

SEQ ID NO: 1993989 - DNA, 12 bp, Homo sapiens
cactccagagaa

SEQ ID NO: 1993990 - DNA, 13 bp, Homo sapiens
cactccagcccaa

SEQ ID NO: 1993991 - DNA, 14 bp, Homo sapiens
cactccagccctgt

SEQ ID NO: 1993992 - DNA, 12 bp, Homo sapiens
cactccagcctg

SEQ ID NO: 1993993 - DNA, 15 bp, Homo sapiens
cactccagcctgggc

SEQ ID NO: 1993994 - DNA, 17 bp, Homo sapiens
cactccatggccacccc

SEQ ID NO: 1993995 - DNA, 15 bp, Homo sapiens
cactccattcccaac

SEQ ID NO: 1993996 - DNA, 13 bp, Homo sapiens
cactcccagggac

SEQ ID NO: 1993997 - DNA, 15 bp, Homo sapiens
cactcccccacctga

SEQ ID NO: 1993998 - DNA, 17 bp, Homo sapiens
cactccccgcctgtcct

SEQ ID NO: 1993999 - DNA, 22 bp, Homo sapiens
cactccccgcctgtcctgcctc

SEQ ID NO: 1994000 - DNA, 13 bp, Homo sapiens
cactccctgagct

SEQ ID NO: 1994001 - DNA, 20 bp, Homo sapiens
cactccggtgtgcctgcagc

SEQ ID NO: 1994002 - DNA, 15 bp, Homo sapiens
cactcctcactgccc

SEQ ID NO: 1994003 - DNA, 15 bp, Homo sapiens
cactcctccaaagga

SEQ ID NO: 1994004 - DNA, 16 bp, Homo sapiens
cactcctctgtctctg

SEQ ID NO: 1994005 - DNA, 16 bp, Homo sapiens
cactcctgctgtgccc

SEQ ID NO: 1994006 - DNA, 12 bp, Homo sapiens
cactcctgtccc

SEQ ID NO: 1994007 - DNA, 12 bp, Homo sapiens
cactccttcctg

SEQ ID NO: 1994008 - DNA, 19 bp, Homo sapiens
cactcgagaccatcctggc

SEQ ID NO: 1994009 - DNA, 21 bp, Homo sapiens
cactcgagaccatcctggccc

SEQ ID NO: 1994010 - DNA, 17 bp, Homo sapiens
cactctaggggtcaggc

SEQ ID NO: 1994011 - DNA, 18 bp, Homo sapiens
cactctagtgacttcctg

SEQ ID NO: 1994012 - DNA, 12 bp, Homo sapiens
cactctcaggag

SEQ ID NO: 1994013 - DNA, 13 bp, Homo sapiens
cactctcccctcc

SEQ ID NO: 1994014 - DNA, 19 bp, Homo sapiens
cactctctaaatcttcctt

SEQ ID NO: 1994015 - DNA, 14 bp, Homo sapiens
cactctgctctgat

SEQ ID NO: 1994016 - DNA, 15 bp, Homo sapiens
cactctggcagccac

SEQ ID NO: 1994017 - DNA, 18 bp, Homo sapiens
cactctggcagccacact

SEQ ID NO: 1994018 - DNA, 14 bp, Homo sapiens
cactctgtcagcca

SEQ ID NO: 1994019 - DNA, 15 bp, Homo sapiens
cactctgtcgcccag

SEQ ID NO: 1994020 - DNA, 16 bp, Homo sapiens
cactctgtcgcccagt

SEQ ID NO: 1994021 - DNA, 17 bp, Homo sapiens
cactcttattgcccacg

SEQ ID NO: 1994022 - DNA, 19 bp, Homo sapiens
cactcttattgcccacgct

SEQ ID NO: 1994023 - DNA, 20 bp, Homo sapiens
cactcttattgcccacgctg

SEQ ID NO: 1994024 - DNA, 16 bp, Homo sapiens
cactcttcttgagcag

SEQ ID NO: 1994025 - DNA, 20 bp, Homo sapiens
cactctttgctacaataaat

SEQ ID NO: 1994026 - DNA, 22 bp, Homo sapiens
cactctttgctacaataaatgc

SEQ ID NO: 1994027 - DNA, 21 bp, Homo sapiens
cactgaaaaggttcttcatcc

SEQ ID NO: 1994028 - DNA, 22 bp, Homo sapiens
cactgaaaaggttcttcatccc

SEQ ID NO: 1994029 - DNA, 19 bp, Homo sapiens
cactgaagaaaccttcaga

SEQ ID NO: 1994030 - DNA, 14 bp, Homo sapiens
cactgacccacagc

SEQ ID NO: 1994031 - DNA, 17 bp, Homo sapiens
cactgaccctggagcgg

SEQ ID NO: 1994032 - DNA, 14 bp, Homo sapiens
cactgacccttcca

SEQ ID NO: 1994033 - DNA, 18 bp, Homo sapiens
cactgacccttccagaca

SEQ ID NO: 1994034 - DNA, 13 bp, Homo sapiens
cactgacctcacc

SEQ ID NO: 1994035 - DNA, 22 bp, Homo sapiens
cactgacctcaccggcatgctg

SEQ ID NO: 1994036 - DNA, 13 bp, Homo sapiens
cactgagtggctt

SEQ ID NO: 1994037 - DNA, 22 bp, Homo sapiens
cactgatgttgttactgattct

SEQ ID NO: 1994038 - DNA, 13 bp, Homo sapiens
cactgatttcaca

SEQ ID NO: 1994039 - DNA, 18 bp, Homo sapiens
cactgatttcacaacaga

SEQ ID NO: 1994040 - DNA, 16 bp, Homo sapiens
cactgatttggagata

SEQ ID NO: 1994041 - DNA, 13 bp, Homo sapiens
cactgcaacctcc

SEQ ID NO: 1994042 - DNA, 14 bp, Homo sapiens
cactgcaacctccg

SEQ ID NO: 1994043 - DNA, 16 bp, Homo sapiens
cactgcaagagccttg

SEQ ID NO: 1994044 - DNA, 19 bp, Homo sapiens
cactgcaagagccttggtg

SEQ ID NO: 1994045 - DNA, 19 bp, Homo sapiens
cactgcacagtgcatctca

SEQ ID NO: 1994046 - DNA, 14 bp, Homo sapiens
cactgcaccgggcc

SEQ ID NO: 1994047 - DNA, 16 bp, Homo sapiens
cactgcactccagcct

SEQ ID NO: 1994048 - DNA, 17 bp, Homo sapiens
cactgcactccagcctg

SEQ ID NO: 1994049 - DNA, 14 bp, Homo sapiens
cactgcagcctcaa

SEQ ID NO: 1994050 - DNA, 20 bp, Homo sapiens
cactgcagcctcaacctcct

SEQ ID NO: 1994051 - DNA, 23 bp, Homo sapiens
cactgcagcctcaacctcctggg

SEQ ID NO: 1994052 - DNA, 23 bp, Homo sapiens
cactgcagtccgcagtctggcct

SEQ ID NO: 1994053 - DNA, 19 bp, Homo sapiens
cactgccacaccctcccca

SEQ ID NO: 1994054 - DNA, 14 bp, Homo sapiens
cactgccagcagct

SEQ ID NO: 1994055 - DNA, 15 bp, Homo sapiens
cactgccagcagctg

SEQ ID NO: 1994056 - DNA, 14 bp, Homo sapiens
cactgccaggaggg

SEQ ID NO: 1994057 - DNA, 17 bp, Homo sapiens
cactgccaggagggaca

SEQ ID NO: 1994058 - DNA, 11 bp, Homo sapiens
cactgccaggc

SEQ ID NO: 1994059 - DNA, 13 bp, Homo sapiens
cactgccaggcac

SEQ ID NO: 1994060 - DNA, 14 bp, Homo sapiens
cactgccaggcacc

SEQ ID NO: 1994061 - DNA, 17 bp, Homo sapiens
cactgccaggcacctgg

SEQ ID NO: 1994062 - DNA, 11 bp, Homo sapiens
cactgccatgc

SEQ ID NO: 1994063 - DNA, 15 bp, Homo sapiens
cactgccccaccagc

SEQ ID NO: 1994064 - DNA, 13 bp, Homo sapiens
cactgccctgcct

SEQ ID NO: 1994065 - DNA, 15 bp, Homo sapiens
cactgccctgcctgc

SEQ ID NO: 1994066 - DNA, 20 bp, Homo sapiens
cactgccttcgatacaccgg

SEQ ID NO: 1994067 - DNA, 21 bp, Homo sapiens
cactgctaggcgagtgccagg

SEQ ID NO: 1994068 - DNA, 13 bp, Homo sapiens
cactgctctcagc

SEQ ID NO: 1994069 - DNA, 12 bp, Homo sapiens
cactgctctggt

SEQ ID NO: 1994070 - DNA, 15 bp, Homo sapiens
cactgctgcccagcc

SEQ ID NO: 1994071 - DNA, 17 bp, Homo sapiens
cactgctgcccagcctc

SEQ ID NO: 1994072 - DNA, 15 bp, Homo sapiens
cactgctggctgcct

SEQ ID NO: 1994073 - DNA, 19 bp, Homo sapiens
cactgcttgaggaggggca

SEQ ID NO: 1994074 - DNA, 20 bp, Homo sapiens
cactgcttttggtctgtgtg

SEQ ID NO: 1994075 - DNA, 21 bp, Homo sapiens
cactgcttttggtctgtgtga

SEQ ID NO: 1994076 - DNA, 17 bp, Homo sapiens
cactggaaaataaattt

SEQ ID NO: 1994077 - DNA, 13 bp, Homo sapiens
cactggagcccag

SEQ ID NO: 1994078 - DNA, 20 bp, Homo sapiens
cactggagtgcagggaggag

SEQ ID NO: 1994079 - DNA, 23 bp, Homo sapiens
cactggatcttcagaaggctaga

SEQ ID NO: 1994080 - DNA, 15 bp, Homo sapiens
cactggcaatatttg

SEQ ID NO: 1994081 - DNA, 14 bp, Homo sapiens
cactggccacccaa

SEQ ID NO: 1994082 - DNA, 11 bp, Homo sapiens
cactggccaga

SEQ ID NO: 1994083 - DNA, 17 bp, Homo sapiens
cagagcccccaagcctc

SEQ ID NO: 1994084 - DNA, 18 bp, Homo sapiens
cagagcccccaagcctct

SEQ ID NO: 1994085 - DNA, 14 bp, Homo sapiens
cagagcccccaagg

SEQ ID NO: 1994086 - DNA, 23 bp, Homo sapiens
cagagccgcaaatcaaccccaga

SEQ ID NO: 1994087 - DNA, 13 bp, Homo sapiens
cagagcctagcca

SEQ ID NO: 1994088 - DNA, 14 bp, Homo sapiens
cagagcctagccac

SEQ ID NO: 1994089 - DNA, 15 bp, Homo sapiens
cagagcctagccacc

SEQ ID NO: 1994090 - DNA, 17 bp, Homo sapiens
cagagcctagccacctc

SEQ ID NO: 1994091 - DNA, 18 bp, Homo sapiens
cagagcctagccacctcc

SEQ ID NO: 1994092 - DNA, 14 bp, Homo sapiens
cagagcctgaattt

SEQ ID NO: 1994093 - DNA, 13 bp, Homo sapiens
cagagcctgcagt

SEQ ID NO: 1994094 - DNA, 14 bp, Homo sapiens
cagagcctgcagtt

SEQ ID NO: 1994095 - DNA, 19 bp, Homo sapiens
cagagcctgcctcagctgc

SEQ ID NO: 1994096 - DNA, 14 bp, Homo sapiens
cagagcctggggct

SEQ ID NO: 1994097 - DNA, 16 bp, Homo sapiens
cagagcctggggctct

SEQ ID NO: 1994098 - DNA, 20 bp, Homo sapiens
cagagcctggggtgttctct

SEQ ID NO: 1994099 - DNA, 23 bp, Homo sapiens
cagagccttcacaaccagccaca

SEQ ID NO: 1994100 - DNA, 20 bp, Homo sapiens
cagagccttctcctgcctac

SEQ ID NO: 1994101 - DNA, 16 bp, Homo sapiens
cagagcctttggatga

SEQ ID NO: 1994102 - DNA, 18 bp, Homo sapiens
cagagcctttggatgacc

SEQ ID NO: 1994103 - DNA, 20 bp, Homo sapiens
cagagccttttacccctgca

SEQ ID NO: 1994104 - DNA, 13 bp, Homo sapiens
cagagcgggagtg

SEQ ID NO: 1994105 - DNA, 14 bp, Homo sapiens
cagagcgggagtga

SEQ ID NO: 1994106 - DNA, 15 bp, Homo sapiens
cagagcgggcctctt

SEQ ID NO: 1994107 - DNA, 18 bp, Homo sapiens
cagagcgggcctcttccc

SEQ ID NO: 1994108 - DNA, 16 bp, Homo sapiens
cagagcggggaggtgc

SEQ ID NO: 1994109 - DNA, 21 bp, Homo sapiens
cagagcgtggctgtgctctca

SEQ ID NO: 1994110 - DNA, 15 bp, Homo sapiens
cagagctcttatgtg

SEQ ID NO: 1994111 - DNA, 17 bp, Homo sapiens
cagagctcttcaagctg

SEQ ID NO: 1994112 - DNA, 21 bp, Homo sapiens
cagagctcttcaagctgtccc

SEQ ID NO: 1994113 - DNA, 22 bp, Homo sapiens
cagagctcttcaagctgtcccc

SEQ ID NO: 1994114 - DNA, 13 bp, Homo sapiens
cagagctgaccca

SEQ ID NO: 1994115 - DNA, 22 bp, Homo sapiens
cagagctgatggagaaggaagg

SEQ ID NO: 1994116 - DNA, 19 bp, Homo sapiens
cagagctgctattaaatta

SEQ ID NO: 1994117 - DNA, 13 bp, Homo sapiens
cagagctggaaca

SEQ ID NO: 1994118 - DNA, 14 bp, Homo sapiens
cagagctggaaggc

SEQ ID NO: 1994119 - DNA, 18 bp, Homo sapiens
cagagctggaaggcaggg

SEQ ID NO: 1994120 - DNA, 15 bp, Homo sapiens
cagagctgggaggca

SEQ ID NO: 1994121 - DNA, 20 bp, Homo sapiens
cagagctgggaggcatggcc

SEQ ID NO: 1994122 - DNA, 16 bp, Homo sapiens
cagagctgttggcctc

SEQ ID NO: 1994123 - DNA, 17 bp, Homo sapiens
cagagctgttggcctcg

SEQ ID NO: 1994124 - DNA, 18 bp, Homo sapiens
cagagcttattggccact

SEQ ID NO: 1994125 - DNA, 19 bp, Homo sapiens
cagagcttattggccactg

SEQ ID NO: 1994126 - DNA, 21 bp, Homo sapiens
cagagcttattggccactggg

SEQ ID NO: 1994127 - DNA, 16 bp, Homo sapiens
cagaggaagagcaggc

SEQ ID NO: 1994128 - DNA, 14 bp, Homo sapiens
cagaggacagagct

SEQ ID NO: 1994129 - DNA, 22 bp, Homo sapiens
cagaggacagagctggctgtct

SEQ ID NO: 1994130 - DNA, 13 bp, Homo sapiens
cagaggaccacag

SEQ ID NO: 1994131 - DNA, 18 bp, Homo sapiens
cagaggaccacagtgggt

SEQ ID NO: 1994132 - DNA, 12 bp, Homo sapiens
cagaggagaaga

SEQ ID NO: 1994133 - DNA, 16 bp, Homo sapiens
cagaggagtccagggc

SEQ ID NO: 1994134 - DNA, 17 bp, Homo sapiens
cagaggagtccagggcg

SEQ ID NO: 1994135 - DNA, 20 bp, Homo sapiens
cagaggagtccagggcggga

SEQ ID NO: 1994136 - DNA, 12 bp, Homo sapiens
cagaggcagccc

SEQ ID NO: 1994137 - DNA, 13 bp, Homo sapiens
cagaggcagcccc

SEQ ID NO: 1994138 - DNA, 14 bp, Homo sapiens
cagaggcagcccca

SEQ ID NO: 1994139 - DNA, 18 bp, Homo sapiens
cagaggcagccccattct

SEQ ID NO: 1994140 - DNA, 23 bp, Homo sapiens
cagaggcagccccattctgcctg

SEQ ID NO: 1994141 - DNA, 16 bp, Homo sapiens
cagaggcaggagtggc

SEQ ID NO: 1994142 - DNA, 14 bp, Homo sapiens
cagaggccaggaat

SEQ ID NO: 1994143 - DNA, 20 bp, Homo sapiens
cagaggccaggaatctgcca

SEQ ID NO: 1994144 - DNA, 17 bp, Homo sapiens
cagaggcggaaaccttg

SEQ ID NO: 1994145 - DNA, 23 bp, Homo sapiens
cagaggcggaaaccttgcagcat

SEQ ID NO: 1994146 - DNA, 13 bp, Homo sapiens
cagaggctgcagg

SEQ ID NO: 1994147 - DNA, 14 bp, Homo sapiens
cagaggctggaggc

SEQ ID NO: 1994148 - DNA, 16 bp, Homo sapiens
cagaggctggaggcag

SEQ ID NO: 1994149 - DNA, 18 bp, Homo sapiens
cagaggctggaggcaggg

SEQ ID NO: 1994150 - DNA, 20 bp, Homo sapiens
cagaggctggaggcagggcc

SEQ ID NO: 1994151 - DNA, 18 bp, Homo sapiens
cagagggaaggggcctac

SEQ ID NO: 1994152 - DNA, 20 bp, Homo sapiens
cagagggaaggggcctacac

SEQ ID NO: 1994153 - DNA, 18 bp, Homo sapiens
cagagggaatgttccctg

SEQ ID NO: 1994154 - DNA, 13 bp, Homo sapiens
cagagggacaggg

SEQ ID NO: 1994155 - DNA, 19 bp, Homo sapiens
cagagggactttgtataga

SEQ ID NO: 1994156 - DNA, 14 bp, Homo sapiens
cagagggagtgaca

SEQ ID NO: 1994157 - DNA, 16 bp, Homo sapiens
cagagggagtgacaga

SEQ ID NO: 1994158 - DNA, 19 bp, Homo sapiens
cagagggagtgacagaggc

SEQ ID NO: 1994159 - DNA, 21 bp, Homo sapiens
cagagggagtgacagaggcag

SEQ ID NO: 1994160 - DNA, 16 bp, Homo sapiens
cagagggcagaggctg

SEQ ID NO: 1994161 - DNA, 17 bp, Homo sapiens
cagagggcagaggctgg

SEQ ID NO: 1994162 - DNA, 18 bp, Homo sapiens
cagagggcagaggctgga

SEQ ID NO: 1994163 - DNA, 18 bp, Homo sapiens
cagagggcccaggcaggc

SEQ ID NO: 1994164 - DNA, 14 bp, Homo sapiens
cagagggctaggga

SEQ ID NO: 1994165 - DNA, 13 bp, Homo sapiens
cagaggggcagcc

SEQ ID NO: 1994166 - DNA, 16 bp, Homo sapiens
cagaggggcagccgct

SEQ ID NO: 1994167 - DNA, 12 bp, Homo sapiens
cagaggggcagg

SEQ ID NO: 1994168 - DNA, 17 bp, Homo sapiens
cagaggggcaggggagt

SEQ ID NO: 1994169 - DNA, 20 bp, Homo sapiens
cagaggggtaggcagagcct

SEQ ID NO: 1994170 - DNA, 23 bp, Homo sapiens
cagaggggtgggttcctcttccc

SEQ ID NO: 1994171 - DNA, 22 bp, Homo sapiens
cagagggttgtactattgttta

SEQ ID NO: 1994172 - DNA, 18 bp, Homo sapiens
cagaggtaaaagtgtgag

SEQ ID NO: 1994173 - DNA, 22 bp, Homo sapiens
cagaggtaactatcaatattta

SEQ ID NO: 1994174 - DNA, 15 bp, Homo sapiens
cagaggtgacagtgg

SEQ ID NO: 1994175 - DNA, 18 bp, Homo sapiens
cagaggtgagcagaggag

SEQ ID NO: 1994176 - DNA, 17 bp, Homo sapiens
cagaggtggccagagct

SEQ ID NO: 1994177 - DNA, 21 bp, Homo sapiens
cagaggtggccagagctggga

SEQ ID NO: 1994178 - DNA, 12 bp, Homo sapiens
cagaggtggtgg

SEQ ID NO: 1994179 - DNA, 17 bp, Homo sapiens
cagaggttatctgcctg

SEQ ID NO: 1994180 - DNA, 19 bp, Homo sapiens
cagaggttatctgcctggc

SEQ ID NO: 1994181 - DNA, 14 bp, Homo sapiens
cagaggtttcttga

SEQ ID NO: 1994182 - DNA, 16 bp, Homo sapiens
cagaggtttcttgaat

SEQ ID NO: 1994183 - DNA, 18 bp, Homo sapiens
cagagtaacatgccagct

SEQ ID NO: 1994184 - DNA, 19 bp, Homo sapiens
cagagtagagggcttggga

SEQ ID NO: 1994185 - DNA, 18 bp, Homo sapiens
cagagtataggatggatt

SEQ ID NO: 1994186 - DNA, 22 bp, Homo sapiens
cagagtataggatggattgcag

SEQ ID NO: 1994187 - DNA, 14 bp, Homo sapiens
cagagtatatatgt

SEQ ID NO: 1994188 - DNA, 15 bp, Homo sapiens
cagagtatatatgta

SEQ ID NO: 1994189 - DNA, 23 bp, Homo sapiens
cagagtatatatgtacagttata

SEQ ID NO: 1994190 - DNA, 13 bp, Homo sapiens
cagagtctcactg

SEQ ID NO: 1994191 - DNA, 13 bp, Homo sapiens
cagagtctgagcc

SEQ ID NO: 1994192 - DNA, 15 bp, Homo sapiens
cagagtgaaagggct

SEQ ID NO: 1994193 - DNA, 22 bp, Homo sapiens
cagagtgacacccaagagggct

SEQ ID NO: 1994194 - DNA, 23 bp, Homo sapiens
cagagtgacacccaagagggctg

SEQ ID NO: 1994195 - DNA, 20 bp, Homo sapiens
cagagtgacatccaggagga

SEQ ID NO: 1994196 - DNA, 20 bp, Homo sapiens
cagagtgagaccctgtctct

SEQ ID NO: 1994197 - DNA, 16 bp, Homo sapiens
cagagtgagactctgt

SEQ ID NO: 1994198 - DNA, 21 bp, Homo sapiens
cagcctctcccggctgcctgc

SEQ ID NO: 1994199 - DNA, 14 bp, Homo sapiens
cagcctctctgcta

SEQ ID NO: 1994200 - DNA, 17 bp, Homo sapiens
cagcctctgtccctctt

SEQ ID NO: 1994201 - DNA, 16 bp, Homo sapiens
cagcctcttccccacc

SEQ ID NO: 1994202 - DNA, 12 bp, Homo sapiens
cagcctgaggct

SEQ ID NO: 1994203 - DNA, 16 bp, Homo sapiens
cagcctgagtctcctg

SEQ ID NO: 1994204 - DNA, 19 bp, Homo sapiens
cagcctgagtctcctgtgc

SEQ ID NO: 1994205 - DNA, 20 bp, Homo sapiens
cagcctgagtctcctgtgcc

SEQ ID NO: 1994206 - DNA, 14 bp, Homo sapiens
cagcctgatggcca

SEQ ID NO: 1994207 - DNA, 21 bp, Homo sapiens
cagcctgctccttcccaggag

SEQ ID NO: 1994208 - DNA, 16 bp, Homo sapiens
cagcctggactttggt

SEQ ID NO: 1994209 - DNA, 20 bp, Homo sapiens
cagcctggcacagggcagtg

SEQ ID NO: 1994210 - DNA, 15 bp, Homo sapiens
cagcctggccatccc

SEQ ID NO: 1994211 - DNA, 11 bp, Homo sapiens
cagcctggcct

SEQ ID NO: 1994212 - DNA, 20 bp, Homo sapiens
cagcctggcctcctgcctct

SEQ ID NO: 1994213 - DNA, 16 bp, Homo sapiens
cagcctggcggggcag

SEQ ID NO: 1994214 - DNA, 17 bp, Homo sapiens
cagcctggcggggcagg

SEQ ID NO: 1994215 - DNA, 19 bp, Homo sapiens
cagcctggcggggcaggag

SEQ ID NO: 1994216 - DNA, 21 bp, Homo sapiens
cagcctggcggggcaggaggc

SEQ ID NO: 1994217 - DNA, 18 bp, Homo sapiens
cagcctgggaccagggca

SEQ ID NO: 1994218 - DNA, 20 bp, Homo sapiens
cagcctgggactcccagtga

SEQ ID NO: 1994219 - DNA, 21 bp, Homo sapiens
cagcctgggactcccagtgaa

SEQ ID NO: 1994220 - DNA, 20 bp, Homo sapiens
cagcctgggcagcatagcaa

SEQ ID NO: 1994221 - DNA, 16 bp, Homo sapiens
cagcctgggcctatgg

SEQ ID NO: 1994222 - DNA, 20 bp, Homo sapiens
cagcctgggcctatggagag

SEQ ID NO: 1994223 - DNA, 18 bp, Homo sapiens
cagcctggtagaattggg

SEQ ID NO: 1994224 - DNA, 15 bp, Homo sapiens
cagcctggtgcccat

SEQ ID NO: 1994225 - DNA, 14 bp, Homo sapiens
cagcctgtgctgcc

SEQ ID NO: 1994226 - DNA, 16 bp, Homo sapiens
cagcctgtgctgcccg

SEQ ID NO: 1994227 - DNA, 22 bp, Homo sapiens
cagcctgtggcggtgcctgggt

SEQ ID NO: 1994228 - DNA, 14 bp, Homo sapiens
cagccttccccctc

SEQ ID NO: 1994229 - DNA, 20 bp, Homo sapiens
cagccttccccctcccaggg

SEQ ID NO: 1994230 - DNA, 17 bp, Homo sapiens
cagccttctctctctgg

SEQ ID NO: 1994231 - DNA, 20 bp, Homo sapiens
cagccttctctctctggtca

SEQ ID NO: 1994232 - DNA, 18 bp, Homo sapiens
cagccttgcactgtgggg

SEQ ID NO: 1994233 - DNA, 22 bp, Homo sapiens
cagccttgcactgtgggggctg

SEQ ID NO: 1994234 - DNA, 13 bp, Homo sapiens
cagcctttctgtg

SEQ ID NO: 1994235 - DNA, 14 bp, Homo sapiens
cagcctttctgtgg

SEQ ID NO: 1994236 - DNA, 21 bp, Homo sapiens
cagcgaaaggatgtaaacagt

SEQ ID NO: 1994237 - DNA, 23 bp, Homo sapiens
cagcgagacccttgcattagaaa

SEQ ID NO: 1994238 - DNA, 13 bp, Homo sapiens
cagcgagccctgg

SEQ ID NO: 1994239 - DNA, 16 bp, Homo sapiens
cagcgagccctggtgg

SEQ ID NO: 1994240 - DNA, 19 bp, Homo sapiens
cagcgagccctggtggcag

SEQ ID NO: 1994241 - DNA, 22 bp, Homo sapiens
cagcgattccctctcccaggcc

SEQ ID NO: 1994242 - DNA, 22 bp, Homo sapiens
cagcgcctagtggggtctccct

SEQ ID NO: 1994243 - DNA, 23 bp, Homo sapiens
cagcgcctagtggggtctccctc

SEQ ID NO: 1994244 - DNA, 14 bp, Homo sapiens
cagcgcctccctcc

SEQ ID NO: 1994245 - DNA, 18 bp, Homo sapiens
cagcgcctccctccaccc

SEQ ID NO: 1994246 - DNA, 22 bp, Homo sapiens
cagcgcctccctccaccccagg

SEQ ID NO: 1994247 - DNA, 18 bp, Homo sapiens
cagcgcctgccctccctg

SEQ ID NO: 1994248 - DNA, 21 bp, Homo sapiens
cagcgcctgccctccctgggg

SEQ ID NO: 1994249 - DNA, 22 bp, Homo sapiens
cagcgcctgccctccctggggt

SEQ ID NO: 1994250 - DNA, 19 bp, Homo sapiens
cagcgcctgtgctgaggac

SEQ ID NO: 1994251 - DNA, 19 bp, Homo sapiens
cagcgcggcttggccgcca

SEQ ID NO: 1994252 - DNA, 20 bp, Homo sapiens
cagcgcggcttggccgccat

SEQ ID NO: 1994253 - DNA, 23 bp, Homo sapiens
cagcgcggcttggccgccatccg

SEQ ID NO: 1994254 - DNA, 19 bp, Homo sapiens
cagcgcgggcggaggcggc

SEQ ID NO: 1994255 - DNA, 20 bp, Homo sapiens
cagcgcgggcggaggcggct

SEQ ID NO: 1994256 - DNA, 19 bp, Homo sapiens
cagcgcgtgcacagcgcgg

SEQ ID NO: 1994257 - DNA, 16 bp, Homo sapiens
cagcggggacagctcc

SEQ ID NO: 1994258 - DNA, 21 bp, Homo sapiens
cagcggggacagctccttctg

SEQ ID NO: 1994259 - DNA, 18 bp, Homo sapiens
cagcggggccccagggct

SEQ ID NO: 1994260 - DNA, 14 bp, Homo sapiens
cagcgtcccctgct

SEQ ID NO: 1994261 - DNA, 18 bp, Homo sapiens
cagcgtccctagcagtga

SEQ ID NO: 1994262 - DNA, 18 bp, Homo sapiens
cagcgtggccttgttctg

SEQ ID NO: 1994263 - DNA, 22 bp, Homo sapiens
cagcgtttagtttctagaggcc

SEQ ID NO: 1994264 - DNA, 16 bp, Homo sapiens
cagctaatctgtaggg

SEQ ID NO: 1994265 - DNA, 19 bp, Homo sapiens
cagctaatctgtagggctg

SEQ ID NO: 1994266 - DNA, 14 bp, Homo sapiens
cagctacattcctc

SEQ ID NO: 1994267 - DNA, 18 bp, Homo sapiens
cagctacattcctcagct

SEQ ID NO: 1994268 - DNA, 23 bp, Homo sapiens
cagctactcaagaggctgaggca

SEQ ID NO: 1994269 - DNA, 16 bp, Homo sapiens
cagctactcagaagcc

SEQ ID NO: 1994270 - DNA, 19 bp, Homo sapiens
cagctactcagaagcctga

SEQ ID NO: 1994271 - DNA, 13 bp, Homo sapiens
cagctactcagga

SEQ ID NO: 1994272 - DNA, 18 bp, Homo sapiens
cagctactcaggaggctg

SEQ ID NO: 1994273 - DNA, 14 bp, Homo sapiens
cagctactctgtcc

SEQ ID NO: 1994274 - DNA, 20 bp, Homo sapiens
cagctactctgtccaggcca

SEQ ID NO: 1994275 - DNA, 21 bp, Homo sapiens
cagctactctgtccaggccac

SEQ ID NO: 1994276 - DNA, 19 bp, Homo sapiens
cagctactgatttttgtga

SEQ ID NO: 1994277 - DNA, 17 bp, Homo sapiens
cagctacttaagagaaa

SEQ ID NO: 1994278 - DNA, 16 bp, Homo sapiens
cagctagactggagtg

SEQ ID NO: 1994279 - DNA, 21 bp, Homo sapiens
cagctagactggagtgaggct

SEQ ID NO: 1994280 - DNA, 16 bp, Homo sapiens
cagctaggactgagga

SEQ ID NO: 1994281 - DNA, 14 bp, Homo sapiens
cagctagggctgga

SEQ ID NO: 1994282 - DNA, 13 bp, Homo sapiens
cagctagtgaccc

SEQ ID NO: 1994283 - DNA, 18 bp, Homo sapiens
cagctagtgacccacatg

SEQ ID NO: 1994284 - DNA, 22 bp, Homo sapiens
cagctagtgacccacatgccat

SEQ ID NO: 1994285 - DNA, 22 bp, Homo sapiens
cagctatctgtcatctctctgg

SEQ ID NO: 1994286 - DNA, 21 bp, Homo sapiens
cagctatgcgcaatgtggcat

SEQ ID NO: 1994287 - DNA, 15 bp, Homo sapiens
cagctcaccagcccc

SEQ ID NO: 1994288 - DNA, 21 bp, Homo sapiens
cagctcaccagccccagtgcc

SEQ ID NO: 1994289 - DNA, 22 bp, Homo sapiens
cagctcagaagtttcttcttta

SEQ ID NO: 1994290 - DNA, 11 bp, Homo sapiens
cagctcagaga

SEQ ID NO: 1994291 - DNA, 14 bp, Homo sapiens
cagctcagaggccc

SEQ ID NO: 1994292 - DNA, 14 bp, Homo sapiens
cagctcagcctccc

SEQ ID NO: 1994293 - DNA, 16 bp, Homo sapiens
cagctcagcctccccc

SEQ ID NO: 1994294 - DNA, 17 bp, Homo sapiens
cagctcagcctcccccc

SEQ ID NO: 1994295 - DNA, 23 bp, Homo sapiens
cagctcagcctccccctgctgct

SEQ ID NO: 1994296 - DNA, 21 bp, Homo sapiens
cagctcaggcacacttcttct

SEQ ID NO: 1994297 - DNA, 13 bp, Homo sapiens
cagctcaggtgac

SEQ ID NO: 1994298 - DNA, 20 bp, Homo sapiens
cagctcaggtgactggagcc

SEQ ID NO: 1994299 - DNA, 12 bp, Homo sapiens
cagctcagtccc

SEQ ID NO: 1994300 - DNA, 20 bp, Homo sapiens
cagctccaacagcttgacca

SEQ ID NO: 1994301 - DNA, 14 bp, Homo sapiens
cagctccagctcac

SEQ ID NO: 1994302 - DNA, 15 bp, Homo sapiens
cagctccagctcacc

SEQ ID NO: 1994303 - DNA, 17 bp, Homo sapiens
cagctccagctcaccag

SEQ ID NO: 1994304 - DNA, 22 bp, Homo sapiens
cagctccagctcaccagcccca

SEQ ID NO: 1994305 - DNA, 23 bp, Homo sapiens
cagctccagtttccaagttcctg

SEQ ID NO: 1994306 - DNA, 12 bp, Homo sapiens
cagctcccaccc

SEQ ID NO: 1994307 - DNA, 14 bp, Homo sapiens
cagctcccacccca

SEQ ID NO: 1994308 - DNA, 19 bp, Homo sapiens
cagctcccaccccaccccc

SEQ ID NO: 1994309 - DNA, 20 bp, Homo sapiens
cagctcccaccccaccccct

SEQ ID NO: 1994310 - DNA, 17 bp, Homo sapiens
cagctcccatagcgctg

SEQ ID NO: 1994311 - DNA, 20 bp, Homo sapiens
cagctcccatagcgctggct

SEQ ID NO: 1994312 - DNA, 13 bp, Homo sapiens
caggcccctgcca

SEQ ID NO: 1994313 - DNA, 15 bp, Homo sapiens
caggcccgacagaga

SEQ ID NO: 1994314 - DNA, 20 bp, Homo sapiens
caggcccgacagagagatga

SEQ ID NO: 1994315 - DNA, 18 bp, Homo sapiens
caggcccggcgcggtggc

SEQ ID NO: 1994316 - DNA, 13 bp, Homo sapiens
caggcccggctcc

SEQ ID NO: 1994317 - DNA, 15 bp, Homo sapiens
caggcccggggctgg

SEQ ID NO: 1994318 - DNA, 23 bp, Homo sapiens
caggccctccctgactccctgtg

SEQ ID NO: 1994319 - DNA, 21 bp, Homo sapiens
caggcccttcctctccactgc

SEQ ID NO: 1994320 - DNA, 12 bp, Homo sapiens
caggcccttggg

SEQ ID NO: 1994321 - DNA, 13 bp, Homo sapiens
caggcccttgggg

SEQ ID NO: 1994322 - DNA, 15 bp, Homo sapiens
caggccgcctgccat

SEQ ID NO: 1994323 - DNA, 24 bp, Homo sapiens
caggccgcctgccataccgctggg

SEQ ID NO: 1994324 - DNA, 19 bp, Homo sapiens
caggccgttccccttggct

SEQ ID NO: 1994325 - DNA, 11 bp, Homo sapiens
caggcctccag

SEQ ID NO: 1994326 - DNA, 16 bp, Homo sapiens
caggcctccagcctct

SEQ ID NO: 1994327 - DNA, 17 bp, Homo sapiens
caggcctccagcctctc

SEQ ID NO: 1994328 - DNA, 20 bp, Homo sapiens
caggcctccagcctctcccg

SEQ ID NO: 1994329 - DNA, 14 bp, Homo sapiens
caggcctctgtgtc

SEQ ID NO: 1994330 - DNA, 11 bp, Homo sapiens
caggcctggga

SEQ ID NO: 1994331 - DNA, 13 bp, Homo sapiens
caggcctgggacc

SEQ ID NO: 1994332 - DNA, 16 bp, Homo sapiens
caggcctgtgtagctg

SEQ ID NO: 1994333 - DNA, 19 bp, Homo sapiens
caggcctgtgtagctgtga

SEQ ID NO: 1994334 - DNA, 22 bp, Homo sapiens
caggcctgtgtagctgtgacct

SEQ ID NO: 1994335 - DNA, 12 bp, Homo sapiens
caggccttccgg

SEQ ID NO: 1994336 - DNA, 19 bp, Homo sapiens
caggcgggagatggacccc

SEQ ID NO: 1994337 - DNA, 12 bp, Homo sapiens
caggcggggagg

SEQ ID NO: 1994338 - DNA, 15 bp, Homo sapiens
caggcggggaggagg

SEQ ID NO: 1994339 - DNA, 16 bp, Homo sapiens
caggcggggtgctgtg

SEQ ID NO: 1994340 - DNA, 19 bp, Homo sapiens
caggcggggtgctgtggtg

SEQ ID NO: 1994341 - DNA, 18 bp, Homo sapiens
caggctactctcctcggc

SEQ ID NO: 1994342 - DNA, 14 bp, Homo sapiens
caggctactgtcag

SEQ ID NO: 1994343 - DNA, 16 bp, Homo sapiens
caggctagactaggag

SEQ ID NO: 1994344 - DNA, 12 bp, Homo sapiens
caggctccatgg

SEQ ID NO: 1994345 - DNA, 23 bp, Homo sapiens
caggctccatggggaagtgctcc

SEQ ID NO: 1994346 - DNA, 16 bp, Homo sapiens
caggctccctttctct

SEQ ID NO: 1994347 - DNA, 16 bp, Homo sapiens
caggctctgcctggag

SEQ ID NO: 1994348 - DNA, 21 bp, Homo sapiens
caggctctgcctggaggatcc

SEQ ID NO: 1994349 - DNA, 20 bp, Homo sapiens
caggctctgggaaggggtgc

SEQ ID NO: 1994350 - DNA, 13 bp, Homo sapiens
caggctctgggct

SEQ ID NO: 1994351 - DNA, 17 bp, Homo sapiens
caggctctgggctcagg

SEQ ID NO: 1994352 - DNA, 14 bp, Homo sapiens
caggctcttcctgg

SEQ ID NO: 1994353 - DNA, 21 bp, Homo sapiens
caggctcttcctggacctgag

SEQ ID NO: 1994354 - DNA, 14 bp, Homo sapiens
caggctcttctcct

SEQ ID NO: 1994355 - DNA, 14 bp, Homo sapiens
caggctgcactgca

SEQ ID NO: 1994356 - DNA, 20 bp, Homo sapiens
caggctgcactgcagtgatg

SEQ ID NO: 1994357 - DNA, 21 bp, Homo sapiens
caggctgcctcatgaccctcc

SEQ ID NO: 1994358 - DNA, 15 bp, Homo sapiens
caggctggagatcct

SEQ ID NO: 1994359 - DNA, 15 bp, Homo sapiens
caggctggcgtgcag

SEQ ID NO: 1994360 - DNA, 21 bp, Homo sapiens
caggctgggcttcagtggcag

SEQ ID NO: 1994361 - DNA, 12 bp, Homo sapiens
caggctggtctc

SEQ ID NO: 1994362 - DNA, 22 bp, Homo sapiens
caggctgtaagcattctgagct

SEQ ID NO: 1994363 - DNA, 23 bp, Homo sapiens
caggctgtaagcattctgagctg

SEQ ID NO: 1994364 - DNA, 14 bp, Homo sapiens
caggctgtatccca

SEQ ID NO: 1994365 - DNA, 20 bp, Homo sapiens
caggctgtatcccatgagcc

SEQ ID NO: 1994366 - DNA, 22 bp, Homo sapiens
caggctgtatcccatgagcctc

SEQ ID NO: 1994367 - DNA, 23 bp, Homo sapiens
caggctgtatcccatgagcctca

SEQ ID NO: 1994368 - DNA, 17 bp, Homo sapiens
caggctgttctgcactg

SEQ ID NO: 1994369 - DNA, 20 bp, Homo sapiens
caggcttctttcaaagtgta

SEQ ID NO: 1994370 - DNA, 14 bp, Homo sapiens
caggcttgccaccg

SEQ ID NO: 1994371 - DNA, 21 bp, Homo sapiens
caggcttgtcactagcagctg

SEQ ID NO: 1994372 - DNA, 23 bp, Homo sapiens
caggcttgtcactagcagctgca

SEQ ID NO: 1994373 - DNA, 16 bp, Homo sapiens
cagggaaacagctaat

SEQ ID NO: 1994374 - DNA, 16 bp, Homo sapiens
cagggaaagctccacg

SEQ ID NO: 1994375 - DNA, 17 bp, Homo sapiens
cagggaaagctccacgg

SEQ ID NO: 1994376 - DNA, 17 bp, Homo sapiens
cagggaaatggagggtg

SEQ ID NO: 1994377 - DNA, 18 bp, Homo sapiens
cagggaaatggagggtgg

SEQ ID NO: 1994378 - DNA, 19 bp, Homo sapiens
cagggaaatggagggtggg

SEQ ID NO: 1994379 - DNA, 19 bp, Homo sapiens
cagggaaccctgcttgcac

SEQ ID NO: 1994380 - DNA, 22 bp, Homo sapiens
cagggaaccctgcttgcacttt

SEQ ID NO: 1994381 - DNA, 22 bp, Homo sapiens
cagggaagagcagaacggagcc

SEQ ID NO: 1994382 - DNA, 16 bp, Homo sapiens
cagggaagagggcagt

SEQ ID NO: 1994383 - DNA, 13 bp, Homo sapiens
cagggaagcaggc

SEQ ID NO: 1994384 - DNA, 14 bp, Homo sapiens
cagggaagcaggca

SEQ ID NO: 1994385 - DNA, 15 bp, Homo sapiens
cagggaagcaggcag

SEQ ID NO: 1994386 - DNA, 16 bp, Homo sapiens
cagggaagcaggcaga

SEQ ID NO: 1994387 - DNA, 17 bp, Homo sapiens
cagggaagcaggcagag

SEQ ID NO: 1994388 - DNA, 15 bp, Homo sapiens
cagggaaggcaggca

SEQ ID NO: 1994389 - DNA, 22 bp, Homo sapiens
cagggaagtcttacttaaaaaa

SEQ ID NO: 1994390 - DNA, 21 bp, Homo sapiens
cagggacaaaacactgtgtcc

SEQ ID NO: 1994391 - DNA, 13 bp, Homo sapiens
cagggacaaagag

SEQ ID NO: 1994392 - DNA, 17 bp, Homo sapiens
cagggacaaagaggcct

SEQ ID NO: 1994393 - DNA, 18 bp, Homo sapiens
cagggacaaagaggcctt

SEQ ID NO: 1994394 - DNA, 14 bp, Homo sapiens
cagggacagagaca

SEQ ID NO: 1994395 - DNA, 16 bp, Homo sapiens
cagggacagagatgga

SEQ ID NO: 1994396 - DNA, 23 bp, Homo sapiens
cagggagcaactctccactccat

SEQ ID NO: 1994397 - DNA, 13 bp, Homo sapiens
cagggagcaatgg

SEQ ID NO: 1994398 - DNA, 19 bp, Homo sapiens
cagggagcatggctgtgag

SEQ ID NO: 1994399 - DNA, 16 bp, Homo sapiens
cagggagcccctagga

SEQ ID NO: 1994400 - DNA, 22 bp, Homo sapiens
cagggaggagaggggaagggcc

SEQ ID NO: 1994401 - DNA, 19 bp, Homo sapiens
cagggaggaggtggcagcc

SEQ ID NO: 1994402 - DNA, 22 bp, Homo sapiens
cagggaggaggtggcagccctg

SEQ ID NO: 1994403 - DNA, 23 bp, Homo sapiens
cagggaggaggtggcagccctgt

SEQ ID NO: 1994404 - DNA, 17 bp, Homo sapiens
cagggaggatgccacag

SEQ ID NO: 1994405 - DNA, 18 bp, Homo sapiens
cagggaggatgccacagc

SEQ ID NO: 1994406 - DNA, 20 bp, Homo sapiens
cagggaggatgccacagccc

SEQ ID NO: 1994407 - DNA, 22 bp, Homo sapiens
cagggaggatgccacagcccca

SEQ ID NO: 1994408 - DNA, 12 bp, Homo sapiens
cagggaggccga

SEQ ID NO: 1994409 - DNA, 15 bp, Homo sapiens
cagggaggccgaagc

SEQ ID NO: 1994410 - DNA, 17 bp, Homo sapiens
cagggatcttgcattcc

SEQ ID NO: 1994411 - DNA, 19 bp, Homo sapiens
cagggatcttgcattccca

SEQ ID NO: 1994412 - DNA, 13 bp, Homo sapiens
cagggatggggga

SEQ ID NO: 1994413 - DNA, 17 bp, Homo sapiens
cagggatgggggatggg

SEQ ID NO: 1994414 - DNA, 21 bp, Homo sapiens
cagggatgggggatgggccag

SEQ ID NO: 1994415 - DNA, 21 bp, Homo sapiens
cagggatgtagattaaggtga

SEQ ID NO: 1994416 - DNA, 13 bp, Homo sapiens
cagggatttgagg

SEQ ID NO: 1994417 - DNA, 23 bp, Homo sapiens
cagggcaaatgacatgcactgac

SEQ ID NO: 1994418 - DNA, 17 bp, Homo sapiens
cagggcacaccgggcac

SEQ ID NO: 1994419 - DNA, 21 bp, Homo sapiens
cagggcacaccgggcactcag

SEQ ID NO: 1994420 - DNA, 22 bp, Homo sapiens
cagggcacaccgggcactcaga

SEQ ID NO: 1994421 - DNA, 23 bp, Homo sapiens
cagggcacaccgggcactcagaa

SEQ ID NO: 1994422 - DNA, 13 bp, Homo sapiens
cagggcacaggag

SEQ ID NO: 1994423 - DNA, 19 bp, Homo sapiens
cagggcacaggagctacct

SEQ ID NO: 1994424 - DNA, 22 bp, Homo sapiens
cagggcacaggagctacctgtg

SEQ ID NO: 1994425 - DNA, 12 bp, Homo sapiens
cagggcagcctc

SEQ ID NO: 1994426 - DNA, 18 bp, Homo sapiens
cagggcaggctacccctt

SEQ ID NO: 1994427 - DNA, 19 bp, Homo sapiens
cataccttctggttgcttc

SEQ ID NO: 1994428 - DNA, 15 bp, Homo sapiens
cataccttggactga

SEQ ID NO: 1994429 - DNA, 22 bp, Homo sapiens
catactcatttttcatgataat

SEQ ID NO: 1994430 - DNA, 17 bp, Homo sapiens
catacttttgagagggg

SEQ ID NO: 1994431 - DNA, 18 bp, Homo sapiens
catagaaacatgacactg

SEQ ID NO: 1994432 - DNA, 22 bp, Homo sapiens
catagagatatgcacacacaga

SEQ ID NO: 1994433 - DNA, 23 bp, Homo sapiens
catagagtgactccaagaacaat

SEQ ID NO: 1994434 - DNA, 14 bp, Homo sapiens
catagagtttaaca

SEQ ID NO: 1994435 - DNA, 14 bp, Homo sapiens
catagatggaccag

SEQ ID NO: 1994436 - DNA, 18 bp, Homo sapiens
catagatgtatcattaat

SEQ ID NO: 1994437 - DNA, 21 bp, Homo sapiens
catagatgtatcattaatgta

SEQ ID NO: 1994438 - DNA, 19 bp, Homo sapiens
catagcagagaatgaaagg

SEQ ID NO: 1994439 - DNA, 22 bp, Homo sapiens
catagcagagaatgaaagggcc

SEQ ID NO: 1994440 - DNA, 15 bp, Homo sapiens
catagcgctggctca

SEQ ID NO: 1994441 - DNA, 23 bp, Homo sapiens
catagctggttatttctcccttg

SEQ ID NO: 1994442 - DNA, 12 bp, Homo sapiens
cataggaaaagt

SEQ ID NO: 1994443 - DNA, 19 bp, Homo sapiens
cataggaaaagtacattta

SEQ ID NO: 1994444 - DNA, 23 bp, Homo sapiens
cataggaaaagtacatttaatac

SEQ ID NO: 1994445 - DNA, 15 bp, Homo sapiens
catagggtctcttca

SEQ ID NO: 1994446 - DNA, 23 bp, Homo sapiens
cataggtagaatgtaaagcttgt

SEQ ID NO: 1994447 - DNA, 22 bp, Homo sapiens
cataggttcacaccattttgtt

SEQ ID NO: 1994448 - DNA, 15 bp, Homo sapiens
cataggttttgattt

SEQ ID NO: 1994449 - DNA, 18 bp, Homo sapiens
catagtaccaatcatttt

SEQ ID NO: 1994450 - DNA, 15 bp, Homo sapiens
catagtatggtggct

SEQ ID NO: 1994451 - DNA, 14 bp, Homo sapiens
catagtcacaaaaa

SEQ ID NO: 1994452 - DNA, 18 bp, Homo sapiens
catagtgatggttcccct

SEQ ID NO: 1994453 - DNA, 23 bp, Homo sapiens
catagtgctaagaaagcaagcca

SEQ ID NO: 1994454 - DNA, 22 bp, Homo sapiens
catagtggcttaaaacaacact

SEQ ID NO: 1994455 - DNA, 19 bp, Homo sapiens
catagttatttacttgaaa

SEQ ID NO: 1994456 - DNA, 16 bp, Homo sapiens
catagtttgttcaaat

SEQ ID NO: 1994457 - DNA, 17 bp, Homo sapiens
catataatgttgttatt

SEQ ID NO: 1994458 - DNA, 15 bp, Homo sapiens
catatacaaataaac

SEQ ID NO: 1994459 - DNA, 17 bp, Homo sapiens
catatacagctcagaag

SEQ ID NO: 1994460 - DNA, 18 bp, Homo sapiens
catatataactagctaga

SEQ ID NO: 1994461 - DNA, 14 bp, Homo sapiens
catatatatataca

SEQ ID NO: 1994462 - DNA, 20 bp, Homo sapiens
catatatatatacacataca

SEQ ID NO: 1994463 - DNA, 23 bp, Homo sapiens
catatatatgttttaagaggcag

SEQ ID NO: 1994464 - DNA, 15 bp, Homo sapiens
catatatattaaaat

SEQ ID NO: 1994465 - DNA, 21 bp, Homo sapiens
catatatgtatatgtatatct

SEQ ID NO: 1994466 - DNA, 14 bp, Homo sapiens
catatattcatgta

SEQ ID NO: 1994467 - DNA, 21 bp, Homo sapiens
catatattcatgtaataaatc

SEQ ID NO: 1994468 - DNA, 23 bp, Homo sapiens
catatcaaaaagtattaaaacta

SEQ ID NO: 1994469 - DNA, 14 bp, Homo sapiens
catatcagaaaagt

SEQ ID NO: 1994470 - DNA, 18 bp, Homo sapiens
catatcagaaaagtagaa

SEQ ID NO: 1994471 - DNA, 17 bp, Homo sapiens
catatcagacctctgat

SEQ ID NO: 1994472 - DNA, 18 bp, Homo sapiens
catatcagacctctgatc

SEQ ID NO: 1994473 - DNA, 18 bp, Homo sapiens
catatcctttgccccaag

SEQ ID NO: 1994474 - DNA, 14 bp, Homo sapiens
catatcggaggtgg

SEQ ID NO: 1994475 - DNA, 15 bp, Homo sapiens
catatcggaggtggt

SEQ ID NO: 1994476 - DNA, 17 bp, Homo sapiens
catatcttcctcatcag

SEQ ID NO: 1994477 - DNA, 13 bp, Homo sapiens
catatgacatgcc

SEQ ID NO: 1994478 - DNA, 18 bp, Homo sapiens
catatgcaccttgtgtct

SEQ ID NO: 1994479 - DNA, 20 bp, Homo sapiens
catatgcaccttgtgtctgt

SEQ ID NO: 1994480 - DNA, 21 bp, Homo sapiens
catatgcaccttgtgtctgta

SEQ ID NO: 1994481 - DNA, 15 bp, Homo sapiens
catatgcctacttgt

SEQ ID NO: 1994482 - DNA, 20 bp, Homo sapiens
catatgcgtcccaagcagcc

SEQ ID NO: 1994483 - DNA, 22 bp, Homo sapiens
catatggaaatcctgttactta

SEQ ID NO: 1994484 - DNA, 15 bp, Homo sapiens
catatggactctgca

SEQ ID NO: 1994485 - DNA, 20 bp, Homo sapiens
catatggactctgcacatga

SEQ ID NO: 1994486 - DNA, 21 bp, Homo sapiens
catatgtagactatatacatg

SEQ ID NO: 1994487 - DNA, 17 bp, Homo sapiens
catatgtagccctcatg

SEQ ID NO: 1994488 - DNA, 15 bp, Homo sapiens
catatgtctgcttct

SEQ ID NO: 1994489 - DNA, 13 bp, Homo sapiens
catattataaata

SEQ ID NO: 1994490 - DNA, 15 bp, Homo sapiens
catattataaataaa

SEQ ID NO: 1994491 - DNA, 21 bp, Homo sapiens
catattataaataaatgccaa

SEQ ID NO: 1994492 - DNA, 13 bp, Homo sapiens
catattcttggag

SEQ ID NO: 1994493 - DNA, 19 bp, Homo sapiens
catattcttggagaacttt

SEQ ID NO: 1994494 - DNA, 21 bp, Homo sapiens
catattgagcacttgctgtat

SEQ ID NO: 1994495 - DNA, 17 bp, Homo sapiens
catattggcatggattt

SEQ ID NO: 1994496 - DNA, 16 bp, Homo sapiens
catattggtattcact

SEQ ID NO: 1994497 - DNA, 15 bp, Homo sapiens
catattgtatgtaag

SEQ ID NO: 1994498 - DNA, 16 bp, Homo sapiens
catattgtatgtaagt

SEQ ID NO: 1994499 - DNA, 20 bp, Homo sapiens
catattgtgccaatatgtat

SEQ ID NO: 1994500 - DNA, 22 bp, Homo sapiens
catattgtgccaatatgtattg

SEQ ID NO: 1994501 - DNA, 14 bp, Homo sapiens
catatttctttggc

SEQ ID NO: 1994502 - DNA, 12 bp, Homo sapiens
catatttgagaa

SEQ ID NO: 1994503 - DNA, 14 bp, Homo sapiens
catatttgttaaat

SEQ ID NO: 1994504 - DNA, 19 bp, Homo sapiens
catatttgttaaatattta

SEQ ID NO: 1994505 - DNA, 20 bp, Homo sapiens
catatttgttaaatatttac

SEQ ID NO: 1994506 - DNA, 13 bp, Homo sapiens
catattttcacag

SEQ ID NO: 1994507 - DNA, 17 bp, Homo sapiens
catcaagagactgagtc

SEQ ID NO: 1994508 - DNA, 20 bp, Homo sapiens
catcaatggaaacagggcag

SEQ ID NO: 1994509 - DNA, 16 bp, Homo sapiens
catcaatttttataca

SEQ ID NO: 1994510 - DNA, 19 bp, Homo sapiens
catcaatttttatacatat

SEQ ID NO: 1994511 - DNA, 19 bp, Homo sapiens
catcacacccttttaacat

SEQ ID NO: 1994512 - DNA, 18 bp, Homo sapiens
catcacagcagaatgaag

SEQ ID NO: 1994513 - DNA, 14 bp, Homo sapiens
catcaccatgcatg

SEQ ID NO: 1994514 - DNA, 13 bp, Homo sapiens
catcacccagtcc

SEQ ID NO: 1994515 - DNA, 18 bp, Homo sapiens
catcacccagtcctggcc

SEQ ID NO: 1994516 - DNA, 17 bp, Homo sapiens
catcaccctctgggcag

SEQ ID NO: 1994517 - DNA, 21 bp, Homo sapiens
catcaccctctgggcagctgt

SEQ ID NO: 1994518 - DNA, 14 bp, Homo sapiens
catcacctactcac

SEQ ID NO: 1994519 - DNA, 20 bp, Homo sapiens
catcacctactcacacaggc

SEQ ID NO: 1994520 - DNA, 21 bp, Homo sapiens
catcacctactcacacaggca

SEQ ID NO: 1994521 - DNA, 12 bp, Homo sapiens
catcacctcagg

SEQ ID NO: 1994522 - DNA, 15 bp, Homo sapiens
catcactccctggat

SEQ ID NO: 1994523 - DNA, 17 bp, Homo sapiens
catcactccctggatgt

SEQ ID NO: 1994524 - DNA, 16 bp, Homo sapiens
catcactgagtggctt

SEQ ID NO: 1994525 - DNA, 19 bp, Homo sapiens
catcactggagcaccaggc

SEQ ID NO: 1994526 - DNA, 14 bp, Homo sapiens
catcacttggggtc

SEQ ID NO: 1994527 - DNA, 20 bp, Homo sapiens
catcacttggggtcaccacc

SEQ ID NO: 1994528 - DNA, 15 bp, Homo sapiens
catcacttgtacaaa

SEQ ID NO: 1994529 - DNA, 15 bp, Homo sapiens
catcacttttcagtg

SEQ ID NO: 1994530 - DNA, 17 bp, Homo sapiens
catcacttttcagtgat

SEQ ID NO: 1994531 - DNA, 17 bp, Homo sapiens
catcagaaagggagggc

SEQ ID NO: 1994532 - DNA, 21 bp, Homo sapiens
catcagacaggtaaatgggca

SEQ ID NO: 1994533 - DNA, 13 bp, Homo sapiens
catcagcaccatg

SEQ ID NO: 1994534 - DNA, 13 bp, Homo sapiens
catcagcatacct

SEQ ID NO: 1994535 - DNA, 18 bp, Homo sapiens
catcagctgctgaaacaa

SEQ ID NO: 1994536 - DNA, 20 bp, Homo sapiens
catcagcttgccctgttaaa

SEQ ID NO: 1994537 - DNA, 11 bp, Homo sapiens
catcaggcact

SEQ ID NO: 1994538 - DNA, 23 bp, Homo sapiens
catcagggtgggccactctcccc

SEQ ID NO: 1994539 - DNA, 18 bp, Homo sapiens
catcaggtcccccccagg

SEQ ID NO: 1994540 - DNA, 19 bp, Homo sapiens
catcaggtcccccccaggt

SEQ ID NO: 1994541 - DNA, 21 bp, Homo sapiens
catggtctctcgggcccccca

SEQ ID NO: 1994542 - DNA, 21 bp, Homo sapiens
catggtgaaaatgtactgaga

SEQ ID NO: 1994543 - DNA, 14 bp, Homo sapiens
catggtgacacaca

SEQ ID NO: 1994544 - DNA, 21 bp, Homo sapiens
catggtgacacacagcagcac

SEQ ID NO: 1994545 - DNA, 16 bp, Homo sapiens
catggtgactaacagt

SEQ ID NO: 1994546 - DNA, 12 bp, Homo sapiens
catggtggcgca

SEQ ID NO: 1994547 - DNA, 17 bp, Homo sapiens
catggtggcgcaagcct

SEQ ID NO: 1994548 - DNA, 18 bp, Homo sapiens
catggtggcgcaagcctg

SEQ ID NO: 1994549 - DNA, 16 bp, Homo sapiens
catggtgtccagacag

SEQ ID NO: 1994550 - DNA, 23 bp, Homo sapiens
catggtgtgaaagtcagatgccc

SEQ ID NO: 1994551 - DNA, 16 bp, Homo sapiens
catggttccttccctg

SEQ ID NO: 1994552 - DNA, 13 bp, Homo sapiens
catgtaaaatgca

SEQ ID NO: 1994553 - DNA, 15 bp, Homo sapiens
catgtaaaatgcagt

SEQ ID NO: 1994554 - DNA, 17 bp, Homo sapiens
catgtaaaatgcagtcc

SEQ ID NO: 1994555 - DNA, 20 bp, Homo sapiens
catgtaaaatgcagtccaga

SEQ ID NO: 1994556 - DNA, 17 bp, Homo sapiens
catgtaaggaagggact

SEQ ID NO: 1994557 - DNA, 19 bp, Homo sapiens
catgtaaggaagggactga

SEQ ID NO: 1994558 - DNA, 14 bp, Homo sapiens
catgtaataaatct

SEQ ID NO: 1994559 - DNA, 18 bp, Homo sapiens
catgtaatcccagctact

SEQ ID NO: 1994560 - DNA, 21 bp, Homo sapiens
catgtacaaaatcgattggct

SEQ ID NO: 1994561 - DNA, 15 bp, Homo sapiens
catgtacagcatgca

SEQ ID NO: 1994562 - DNA, 16 bp, Homo sapiens
catgtacagcatgcat

SEQ ID NO: 1994563 - DNA, 23 bp, Homo sapiens
catgtaccagtgtactgctttca

SEQ ID NO: 1994564 - DNA, 15 bp, Homo sapiens
catgtaccatcaata

SEQ ID NO: 1994565 - DNA, 14 bp, Homo sapiens
catgtactataatg

SEQ ID NO: 1994566 - DNA, 23 bp, Homo sapiens
catgtactgagccttgtaattct

SEQ ID NO: 1994567 - DNA, 15 bp, Homo sapiens
catgtacttcctgtg

SEQ ID NO: 1994568 - DNA, 20 bp, Homo sapiens
catgtataatatttttaatt

SEQ ID NO: 1994569 - DNA, 21 bp, Homo sapiens
catgtatcccaactcctataa

SEQ ID NO: 1994570 - DNA, 18 bp, Homo sapiens
catgtatgtcttggacac

SEQ ID NO: 1994571 - DNA, 17 bp, Homo sapiens
catgtatgtgcacatgt

SEQ ID NO: 1994572 - DNA, 21 bp, Homo sapiens
catgtatgtgcacatgtgtct

SEQ ID NO: 1994573 - DNA, 15 bp, Homo sapiens
catgtatgtgtgtgt

SEQ ID NO: 1994574 - DNA, 15 bp, Homo sapiens
catgtatttatctct

SEQ ID NO: 1994575 - DNA, 23 bp, Homo sapiens
catgtatttatctctatttaata

SEQ ID NO: 1994576 - DNA, 15 bp, Homo sapiens
catgtcaaacaaata

SEQ ID NO: 1994577 - DNA, 14 bp, Homo sapiens
catgtcactcccag

SEQ ID NO: 1994578 - DNA, 13 bp, Homo sapiens
catgtcagagcca

SEQ ID NO: 1994579 - DNA, 19 bp, Homo sapiens
catgtccaagtccaacctg

SEQ ID NO: 1994580 - DNA, 24 bp, Homo sapiens
catgtccaagtccaacctgcctgt

SEQ ID NO: 1994581 - DNA, 22 bp, Homo sapiens
catgtccctaccgagtctcttc

SEQ ID NO: 1994582 - DNA, 23 bp, Homo sapiens
catgtccctaccgagtctcttct

SEQ ID NO: 1994583 - DNA, 15 bp, Homo sapiens
catgtcctatgtgtg

SEQ ID NO: 1994584 - DNA, 18 bp, Homo sapiens
catgtcgcctctgcattc

SEQ ID NO: 1994585 - DNA, 18 bp, Homo sapiens
catgtcgcctgcccccag

SEQ ID NO: 1994586 - DNA, 17 bp, Homo sapiens
catgtcggagtagaaat

SEQ ID NO: 1994587 - DNA, 19 bp, Homo sapiens
catgtctcagcctcctcag

SEQ ID NO: 1994588 - DNA, 23 bp, Homo sapiens
catgtcttgtacatgtgtagcct

SEQ ID NO: 1994589 - DNA, 13 bp, Homo sapiens
catgtgacacata

SEQ ID NO: 1994590 - DNA, 16 bp, Homo sapiens
catgtgacacatatgc

SEQ ID NO: 1994591 - DNA, 21 bp, Homo sapiens
catgtgcatggaaatgtcctc

SEQ ID NO: 1994592 - DNA, 22 bp, Homo sapiens
catgtgccaggtttttggtctg

SEQ ID NO: 1994593 - DNA, 14 bp, Homo sapiens
catgtgcctggaaa

SEQ ID NO: 1994594 - DNA, 22 bp, Homo sapiens
catgtgctattgaactgagcca

SEQ ID NO: 1994595 - DNA, 12 bp, Homo sapiens
catgtggagtgg

SEQ ID NO: 1994596 - DNA, 19 bp, Homo sapiens
catgtggccccaggtgcca

SEQ ID NO: 1994597 - DNA, 14 bp, Homo sapiens
catgtggtatgagt

SEQ ID NO: 1994598 - DNA, 17 bp, Homo sapiens
catgtgtcccctcactc

SEQ ID NO: 1994599 - DNA, 24 bp, Homo sapiens
catgtgtcccctcactctgtcagc

SEQ ID NO: 1994600 - DNA, 13 bp, Homo sapiens
catgtgtgactcc

SEQ ID NO: 1994601 - DNA, 19 bp, Homo sapiens
catgtgtgcctgtggcaga

SEQ ID NO: 1994602 - DNA, 12 bp, Homo sapiens
catgtgtgtata

SEQ ID NO: 1994603 - DNA, 14 bp, Homo sapiens
catgtgtgtataag

SEQ ID NO: 1994604 - DNA, 13 bp, Homo sapiens
catgtgtgtatat

SEQ ID NO: 1994605 - DNA, 16 bp, Homo sapiens
catgtgtgtatatatg

SEQ ID NO: 1994606 - DNA, 20 bp, Homo sapiens
catgtgttttaattccaata

SEQ ID NO: 1994607 - DNA, 21 bp, Homo sapiens
catgttaattaaactgaagaa

SEQ ID NO: 1994608 - DNA, 18 bp, Homo sapiens
catgttaccaaagcaata

SEQ ID NO: 1994609 - DNA, 22 bp, Homo sapiens
catgttaccaaagcaatatttc

SEQ ID NO: 1994610 - DNA, 23 bp, Homo sapiens
catgttaccaaagcaatatttcc

SEQ ID NO: 1994611 - DNA, 14 bp, Homo sapiens
catgttaggaaaat

SEQ ID NO: 1994612 - DNA, 13 bp, Homo sapiens
catgttatatatt

SEQ ID NO: 1994613 - DNA, 20 bp, Homo sapiens
catgttatatattttttgta

SEQ ID NO: 1994614 - DNA, 22 bp, Homo sapiens
catgttatatattttttgtagg

SEQ ID NO: 1994615 - DNA, 13 bp, Homo sapiens
catgttcctcaaa

SEQ ID NO: 1994616 - DNA, 21 bp, Homo sapiens
catgttcctcaaaagcaccct

SEQ ID NO: 1994617 - DNA, 22 bp, Homo sapiens
catgttgccatgaggcctttcc

SEQ ID NO: 1994618 - DNA, 17 bp, Homo sapiens
catgttggccaggctgg

SEQ ID NO: 1994619 - DNA, 20 bp, Homo sapiens
catgttggccaggctggtct

SEQ ID NO: 1994620 - DNA, 14 bp, Homo sapiens
catgtttcacaaca

SEQ ID NO: 1994621 - DNA, 22 bp, Homo sapiens
catgtttcatgttttgtgacta

SEQ ID NO: 1994622 - DNA, 19 bp, Homo sapiens
catgtttgagctcagaccc

SEQ ID NO: 1994623 - DNA, 20 bp, Homo sapiens
catgtttgcacctttctagt

SEQ ID NO: 1994624 - DNA, 12 bp, Homo sapiens
catgttttgtat

SEQ ID NO: 1994625 - DNA, 21 bp, Homo sapiens
cattaaacactgtaatcttaa

SEQ ID NO: 1994626 - DNA, 13 bp, Homo sapiens
cattaaacctgga

SEQ ID NO: 1994627 - DNA, 22 bp, Homo sapiens
cattaaagcatttactttgaat

SEQ ID NO: 1994628 - DNA, 12 bp, Homo sapiens
cattaaatttct

SEQ ID NO: 1994629 - DNA, 13 bp, Homo sapiens
cattaaattttct

SEQ ID NO: 1994630 - DNA, 20 bp, Homo sapiens
cattaagacacacctctgga

SEQ ID NO: 1994631 - DNA, 15 bp, Homo sapiens
cattaagtggctttt

SEQ ID NO: 1994632 - DNA, 16 bp, Homo sapiens
cattaatcaccaaagt

SEQ ID NO: 1994633 - DNA, 19 bp, Homo sapiens
cattaatgtaggtttagat

SEQ ID NO: 1994634 - DNA, 13 bp, Homo sapiens
cattaatgtgttg

SEQ ID NO: 1994635 - DNA, 15 bp, Homo sapiens
cattaattattaata

SEQ ID NO: 1994636 - DNA, 16 bp, Homo sapiens
cattaattattaatac

SEQ ID NO: 1994637 - DNA, 20 bp, Homo sapiens
cattaattattattgctgtt

SEQ ID NO: 1994638 - DNA, 13 bp, Homo sapiens
cattaattctact

SEQ ID NO: 1994639 - DNA, 17 bp, Homo sapiens
cattaattctactaaat

SEQ ID NO: 1994640 - DNA, 18 bp, Homo sapiens
cattaattctactaaata

SEQ ID NO: 1994641 - DNA, 20 bp, Homo sapiens
cattaattctactaaatatt

SEQ ID NO: 1994642 - DNA, 18 bp, Homo sapiens
cattacatcatcctcctt

SEQ ID NO: 1994643 - DNA, 14 bp, Homo sapiens
cattacatggctgt

SEQ ID NO: 1994644 - DNA, 15 bp, Homo sapiens
cattacatggctgtg

SEQ ID NO: 1994645 - DNA, 14 bp, Homo sapiens
cattacatgtttaa

SEQ ID NO: 1994646 - DNA, 20 bp, Homo sapiens
cattacatgtttaaattgta

SEQ ID NO: 1994647 - DNA, 21 bp, Homo sapiens
cattacatgtttaaattgtaa

SEQ ID NO: 1994648 - DNA, 17 bp, Homo sapiens
cattacgtgagccaggt

SEQ ID NO: 1994649 - DNA, 15 bp, Homo sapiens
cattacttgtataaa

SEQ ID NO: 1994650 - DNA, 17 bp, Homo sapiens
cattagcagtttgcttt

SEQ ID NO: 1994651 - DNA, 19 bp, Homo sapiens
cattagctacttttcagaa

SEQ ID NO: 1994652 - DNA, 13 bp, Homo sapiens
cattataaacgtg

SEQ ID NO: 1994653 - DNA, 17 bp, Homo sapiens
cattatcgggagcagtg

SEQ ID NO: 1994654 - DNA, 23 bp, Homo sapiens
cattatgatgtgggtcaaggaat

SEQ ID NO: 1994655 - DNA, 22 bp, Homo sapiens
ccaaggcagcctccagagccag

SEQ ID NO: 1994656 - DNA, 22 bp, Homo sapiens
ccaaggggaatgtttgcctctg

SEQ ID NO: 1994657 - DNA, 13 bp, Homo sapiens
ccaaggggcccac

SEQ ID NO: 1994658 - DNA, 14 bp, Homo sapiens
ccaaggggcccaca

SEQ ID NO: 1994659 - DNA, 22 bp, Homo sapiens
ccaaggggtctgtatatacatt

SEQ ID NO: 1994660 - DNA, 20 bp, Homo sapiens
ccaagggttcagagactcag

SEQ ID NO: 1994661 - DNA, 19 bp, Homo sapiens
ccaaggtcttcagccatca

SEQ ID NO: 1994662 - DNA, 20 bp, Homo sapiens
ccaaggtgctaggattacag

SEQ ID NO: 1994663 - DNA, 17 bp, Homo sapiens
ccaaggtgggctgagcc

SEQ ID NO: 1994664 - DNA, 23 bp, Homo sapiens
ccaaggtgggctgagccctggca

SEQ ID NO: 1994665 - DNA, 17 bp, Homo sapiens
ccaaggttactcagcag

SEQ ID NO: 1994666 - DNA, 22 bp, Homo sapiens
ccaaggttactcagcagcagag

SEQ ID NO: 1994667 - DNA, 15 bp, Homo sapiens
ccaaggttgtcctgg

SEQ ID NO: 1994668 - DNA, 17 bp, Homo sapiens
ccaagtcaacactcttc

SEQ ID NO: 1994669 - DNA, 23 bp, Homo sapiens
ccaagtcaacactcttcttgagc

SEQ ID NO: 1994670 - DNA, 19 bp, Homo sapiens
ccaagtccaacctgcctgt

SEQ ID NO: 1994671 - DNA, 17 bp, Homo sapiens
ccaagtccaggtcctgg

SEQ ID NO: 1994672 - DNA, 11 bp, Homo sapiens
ccaagtgccat

SEQ ID NO: 1994673 - DNA, 16 bp, Homo sapiens
ccaagtgccatcccac

SEQ ID NO: 1994674 - DNA, 16 bp, Homo sapiens
ccaagtggctcccaca

SEQ ID NO: 1994675 - DNA, 16 bp, Homo sapiens
ccaagtgggggcagag

SEQ ID NO: 1994676 - DNA, 21 bp, Homo sapiens
ccaagtgtgttgggaattgca

SEQ ID NO: 1994677 - DNA, 15 bp, Homo sapiens
ccaagttataaatca

SEQ ID NO: 1994678 - DNA, 12 bp, Homo sapiens
ccaagttatatt

SEQ ID NO: 1994679 - DNA, 18 bp, Homo sapiens
ccaagttcctgcactcca

SEQ ID NO: 1994680 - DNA, 14 bp, Homo sapiens
ccaataaaagtgac

SEQ ID NO: 1994681 - DNA, 15 bp, Homo sapiens
ccaataaaagtgact

SEQ ID NO: 1994682 - DNA, 21 bp, Homo sapiens
ccaataaaagtgactctcagc

SEQ ID NO: 1994683 - DNA, 14 bp, Homo sapiens
ccaataaagctgga

SEQ ID NO: 1994684 - DNA, 15 bp, Homo sapiens
ccaatatgtattgta

SEQ ID NO: 1994685 - DNA, 22 bp, Homo sapiens
ccaatattggagcatatcaaaa

SEQ ID NO: 1994686 - DNA, 14 bp, Homo sapiens
ccaatatttgtaga

SEQ ID NO: 1994687 - DNA, 18 bp, Homo sapiens
ccaatcagcactgaaaat

SEQ ID NO: 1994688 - DNA, 14 bp, Homo sapiens
ccaatcattttaat

SEQ ID NO: 1994689 - DNA, 22 bp, Homo sapiens
ccaatcattttaattattattc

SEQ ID NO: 1994690 - DNA, 13 bp, Homo sapiens
ccaatccaggtgg

SEQ ID NO: 1994691 - DNA, 21 bp, Homo sapiens
ccaatccaggtgggagagaca

SEQ ID NO: 1994692 - DNA, 14 bp, Homo sapiens
ccaatcccgtgaaa

SEQ ID NO: 1994693 - DNA, 22 bp, Homo sapiens
ccaatcctttccaccctattcc

SEQ ID NO: 1994694 - DNA, 18 bp, Homo sapiens
ccaatgcacctaaagaaa

SEQ ID NO: 1994695 - DNA, 17 bp, Homo sapiens
ccaatgcatgcagccac

SEQ ID NO: 1994696 - DNA, 14 bp, Homo sapiens
ccaatgctcctgga

SEQ ID NO: 1994697 - DNA, 17 bp, Homo sapiens
ccaatgctttgggaggc

SEQ ID NO: 1994698 - DNA, 16 bp, Homo sapiens
ccaattaaaatatata

SEQ ID NO: 1994699 - DNA, 19 bp, Homo sapiens
ccaattatgtgacaacctt

SEQ ID NO: 1994700 - DNA, 11 bp, Homo sapiens
ccaattcttac

SEQ ID NO: 1994701 - DNA, 19 bp, Homo sapiens
ccaattcttacaaacatgt

SEQ ID NO: 1994702 - DNA, 18 bp, Homo sapiens
ccaattgcctcttgcagg

SEQ ID NO: 1994703 - DNA, 17 bp, Homo sapiens
ccaattgtacattccct

SEQ ID NO: 1994704 - DNA, 16 bp, Homo sapiens
ccacaaaggggagaag

SEQ ID NO: 1994705 - DNA, 16 bp, Homo sapiens
ccacaaataatgaaca

SEQ ID NO: 1994706 - DNA, 19 bp, Homo sapiens
ccacaaatcaaagcaaggg

SEQ ID NO: 1994707 - DNA, 20 bp, Homo sapiens
ccacaaatcaaagcaagggc

SEQ ID NO: 1994708 - DNA, 21 bp, Homo sapiens
ccacaaatcaaagcaagggct

SEQ ID NO: 1994709 - DNA, 15 bp, Homo sapiens
ccacaaccaggaaga

SEQ ID NO: 1994710 - DNA, 20 bp, Homo sapiens
ccacaagattcccagagaca

SEQ ID NO: 1994711 - DNA, 24 bp, Homo sapiens
ccacaagattcccagagacaggaa

SEQ ID NO: 1994712 - DNA, 20 bp, Homo sapiens
ccacaagccttactcacctc

SEQ ID NO: 1994713 - DNA, 21 bp, Homo sapiens
ccacaatgatgattaaacacc

SEQ ID NO: 1994714 - DNA, 17 bp, Homo sapiens
ccacaatgcctctccca

SEQ ID NO: 1994715 - DNA, 21 bp, Homo sapiens
ccacaatgcctctcccacgat

SEQ ID NO: 1994716 - DNA, 15 bp, Homo sapiens
ccacacacgcaggaa

SEQ ID NO: 1994717 - DNA, 23 bp, Homo sapiens
ccacacacgcaggaactcccagc

SEQ ID NO: 1994718 - DNA, 21 bp, Homo sapiens
ccacacatgaaccatccttcc

SEQ ID NO: 1994719 - DNA, 15 bp, Homo sapiens
ccacaccaaacctct

SEQ ID NO: 1994720 - DNA, 21 bp, Homo sapiens
ccacaccatcaccctctgggc

SEQ ID NO: 1994721 - DNA, 15 bp, Homo sapiens
ccacaccccagcgcc

SEQ ID NO: 1994722 - DNA, 21 bp, Homo sapiens
ccacacccctccaaagcccca

SEQ ID NO: 1994723 - DNA, 14 bp, Homo sapiens
ccacaccgcagaag

SEQ ID NO: 1994724 - DNA, 18 bp, Homo sapiens
ccacactattaccatgag

SEQ ID NO: 1994725 - DNA, 13 bp, Homo sapiens
ccacactccccgc

SEQ ID NO: 1994726 - DNA, 18 bp, Homo sapiens
ccacactgtcagagctgt

SEQ ID NO: 1994727 - DNA, 21 bp, Homo sapiens
ccacacttctcaggacacagg

SEQ ID NO: 1994728 - DNA, 22 bp, Homo sapiens
ccacacttcttgaaacagcctg

SEQ ID NO: 1994729 - DNA, 22 bp, Homo sapiens
ccacactttgagaacctgtgct

SEQ ID NO: 1994730 - DNA, 18 bp, Homo sapiens
ccacagaagccaggagca

SEQ ID NO: 1994731 - DNA, 15 bp, Homo sapiens
ccacagacagatccc

SEQ ID NO: 1994732 - DNA, 20 bp, Homo sapiens
ccacagaccacctgcttctg

SEQ ID NO: 1994733 - DNA, 22 bp, Homo sapiens
ccacagagaaagtacttctcca

SEQ ID NO: 1994734 - DNA, 18 bp, Homo sapiens
ccacagataactgaaaat

SEQ ID NO: 1994735 - DNA, 17 bp, Homo sapiens
ccacagcaattggctcc

SEQ ID NO: 1994736 - DNA, 19 bp, Homo sapiens
ccacagcaattggctcctc

SEQ ID NO: 1994737 - DNA, 15 bp, Homo sapiens
ccacagcacccaggc

SEQ ID NO: 1994738 - DNA, 17 bp, Homo sapiens
ccacagcagttgaaaag

SEQ ID NO: 1994739 - DNA, 14 bp, Homo sapiens
ccacagccccacag

SEQ ID NO: 1994740 - DNA, 17 bp, Homo sapiens
ccacagccccacagcac

SEQ ID NO: 1994741 - DNA, 19 bp, Homo sapiens
ccacagcggaggagaccag

SEQ ID NO: 1994742 - DNA, 21 bp, Homo sapiens
ccacagcggaggagaccagct

SEQ ID NO: 1994743 - DNA, 17 bp, Homo sapiens
ccacagctcccacccca

SEQ ID NO: 1994744 - DNA, 22 bp, Homo sapiens
ccacaggcccttcctctccact

SEQ ID NO: 1994745 - DNA, 23 bp, Homo sapiens
ccacaggcccttcctctccactg

SEQ ID NO: 1994746 - DNA, 17 bp, Homo sapiens
ccacaggcccttggggt

SEQ ID NO: 1994747 - DNA, 16 bp, Homo sapiens
ccacagggaaccctgc

SEQ ID NO: 1994748 - DNA, 14 bp, Homo sapiens
ccacaggggcaggc

SEQ ID NO: 1994749 - DNA, 17 bp, Homo sapiens
ccacaggggcaggcctg

SEQ ID NO: 1994750 - DNA, 19 bp, Homo sapiens
ccacaggggcaggcctggg

SEQ ID NO: 1994751 - DNA, 16 bp, Homo sapiens
ccacagtcaaagaagg

SEQ ID NO: 1994752 - DNA, 15 bp, Homo sapiens
ccacagtcctcacag

SEQ ID NO: 1994753 - DNA, 18 bp, Homo sapiens
ccacagtcctcacagcct

SEQ ID NO: 1994754 - DNA, 17 bp, Homo sapiens
ccacagtctcccattct

SEQ ID NO: 1994755 - DNA, 14 bp, Homo sapiens
ccacagtctctggg

SEQ ID NO: 1994756 - DNA, 18 bp, Homo sapiens
ccacagtgctgcttctct

SEQ ID NO: 1994757 - DNA, 22 bp, Homo sapiens
ccacagtgggtggcacctcctg

SEQ ID NO: 1994758 - DNA, 23 bp, Homo sapiens
ccacatagtgatggttcccctgt

SEQ ID NO: 1994759 - DNA, 14 bp, Homo sapiens
ccacatccctgggc

SEQ ID NO: 1994760 - DNA, 16 bp, Homo sapiens
ccacatccctgggcct

SEQ ID NO: 1994761 - DNA, 17 bp, Homo sapiens
ccacatccctgggcctg

SEQ ID NO: 1994762 - DNA, 18 bp, Homo sapiens
ccacatccctgggcctgc

SEQ ID NO: 1994763 - DNA, 21 bp, Homo sapiens
ccacatccctgggcctgctgc

SEQ ID NO: 1994764 - DNA, 17 bp, Homo sapiens
ccacatctgtgtctctg

SEQ ID NO: 1994765 - DNA, 14 bp, Homo sapiens
ccacatcttgctct

SEQ ID NO: 1994766 - DNA, 16 bp, Homo sapiens
ccaccaaactgcacac

SEQ ID NO: 1994767 - DNA, 12 bp, Homo sapiens
ccaccaactctg

SEQ ID NO: 1994768 - DNA, 15 bp, Homo sapiens
ccaccaataaaaatc

SEQ ID NO: 1994769 - DNA, 19 bp, Homo sapiens
ccagcatccagcctgtgtg

SEQ ID NO: 1994770 - DNA, 21 bp, Homo sapiens
ccagcatccttttctgcagag

SEQ ID NO: 1994771 - DNA, 15 bp, Homo sapiens
ccagcattcatgccg

SEQ ID NO: 1994772 - DNA, 14 bp, Homo sapiens
ccagcatttgccat

SEQ ID NO: 1994773 - DNA, 21 bp, Homo sapiens
ccagccaacatttaatgagca

SEQ ID NO: 1994774 - DNA, 12 bp, Homo sapiens
ccagccacctcc

SEQ ID NO: 1994775 - DNA, 13 bp, Homo sapiens
ccagccacctccc

SEQ ID NO: 1994776 - DNA, 14 bp, Homo sapiens
ccagccacctccca

SEQ ID NO: 1994777 - DNA, 20 bp, Homo sapiens
ccagccactcgggaggctga

SEQ ID NO: 1994778 - DNA, 21 bp, Homo sapiens
ccagccactcgggaggctgag

SEQ ID NO: 1994779 - DNA, 22 bp, Homo sapiens
ccagccactcgggaggctgaga

SEQ ID NO: 1994780 - DNA, 13 bp, Homo sapiens
ccagccagcagcc

SEQ ID NO: 1994781 - DNA, 14 bp, Homo sapiens
ccagccagcgcctc

SEQ ID NO: 1994782 - DNA, 20 bp, Homo sapiens
ccagccagcgcctccctcca

SEQ ID NO: 1994783 - DNA, 18 bp, Homo sapiens
ccagccatcaagagactg

SEQ ID NO: 1994784 - DNA, 20 bp, Homo sapiens
ccagccatcacaaggggaac

SEQ ID NO: 1994785 - DNA, 21 bp, Homo sapiens
ccagccatcatgtgcctggaa

SEQ ID NO: 1994786 - DNA, 19 bp, Homo sapiens
ccagccatggtgaggaagc

SEQ ID NO: 1994787 - DNA, 16 bp, Homo sapiens
ccagcccacagagcct

SEQ ID NO: 1994788 - DNA, 12 bp, Homo sapiens
ccagcccagccc

SEQ ID NO: 1994789 - DNA, 14 bp, Homo sapiens
ccagcccagcccag

SEQ ID NO: 1994790 - DNA, 14 bp, Homo sapiens
ccagccccagcaag

SEQ ID NO: 1994791 - DNA, 23 bp, Homo sapiens
ccagccccaggggtgcctgtggg

SEQ ID NO: 1994792 - DNA, 19 bp, Homo sapiens
ccagccccatcttggtcct

SEQ ID NO: 1994793 - DNA, 23 bp, Homo sapiens
ccagccccatcttggtcctgtca

SEQ ID NO: 1994794 - DNA, 23 bp, Homo sapiens
ccagcccccacctccgccccaga

SEQ ID NO: 1994795 - DNA, 15 bp, Homo sapiens
ccagccccctggatg

SEQ ID NO: 1994796 - DNA, 20 bp, Homo sapiens
ccagccccgactccagccag

SEQ ID NO: 1994797 - DNA, 13 bp, Homo sapiens
ccagcccctcctc

SEQ ID NO: 1994798 - DNA, 13 bp, Homo sapiens
ccagcccggcctg

SEQ ID NO: 1994799 - DNA, 18 bp, Homo sapiens
ccagccctacatcttcag

SEQ ID NO: 1994800 - DNA, 19 bp, Homo sapiens
ccagccctacatcttcagc

SEQ ID NO: 1994801 - DNA, 16 bp, Homo sapiens
ccagccctcaggccag

SEQ ID NO: 1994802 - DNA, 17 bp, Homo sapiens
ccagccctcaggccagt

SEQ ID NO: 1994803 - DNA, 18 bp, Homo sapiens
ccagccctcaggccagtg

SEQ ID NO: 1994804 - DNA, 21 bp, Homo sapiens
ccagccctcaggccagtgcca

SEQ ID NO: 1994805 - DNA, 23 bp, Homo sapiens
ccagccctcaggccagtgccagg

SEQ ID NO: 1994806 - DNA, 13 bp, Homo sapiens
ccagccctccctg

SEQ ID NO: 1994807 - DNA, 18 bp, Homo sapiens
ccagccctccctgtcctc

SEQ ID NO: 1994808 - DNA, 19 bp, Homo sapiens
ccagccctccctgtcctcc

SEQ ID NO: 1994809 - DNA, 20 bp, Homo sapiens
ccagccctccctgtcctcct

SEQ ID NO: 1994810 - DNA, 21 bp, Homo sapiens
ccagccctccctgtcctcctc

SEQ ID NO: 1994811 - DNA, 19 bp, Homo sapiens
ccagccctgccaggaggct

SEQ ID NO: 1994812 - DNA, 18 bp, Homo sapiens
ccagccctgcctggagga

SEQ ID NO: 1994813 - DNA, 13 bp, Homo sapiens
ccagccctggctc

SEQ ID NO: 1994814 - DNA, 12 bp, Homo sapiens
ccagccctgggg

SEQ ID NO: 1994815 - DNA, 16 bp, Homo sapiens
ccagcccttagcaggg

SEQ ID NO: 1994816 - DNA, 17 bp, Homo sapiens
ccagcccttagcaggga

SEQ ID NO: 1994817 - DNA, 15 bp, Homo sapiens
ccagcccttccctgc

SEQ ID NO: 1994818 - DNA, 16 bp, Homo sapiens
ccagcccttccctgct

SEQ ID NO: 1994819 - DNA, 15 bp, Homo sapiens
ccagcccttctgcct

SEQ ID NO: 1994820 - DNA, 19 bp, Homo sapiens
ccagcccttctgcctttct

SEQ ID NO: 1994821 - DNA, 20 bp, Homo sapiens
ccagcccttgagctccccaa

SEQ ID NO: 1994822 - DNA, 15 bp, Homo sapiens
ccagccgccctgggc

SEQ ID NO: 1994823 - DNA, 17 bp, Homo sapiens
ccagccgccctgggctg

SEQ ID NO: 1994824 - DNA, 21 bp, Homo sapiens
ccagccggggcgagtggcacg

SEQ ID NO: 1994825 - DNA, 22 bp, Homo sapiens
ccagccggtacctgggaagggg

SEQ ID NO: 1994826 - DNA, 20 bp, Homo sapiens
ccagccgtgatgctcaggct

SEQ ID NO: 1994827 - DNA, 21 bp, Homo sapiens
ccagccgtgatgctcaggctt

SEQ ID NO: 1994828 - DNA, 23 bp, Homo sapiens
ccagccgtgatgctcaggcttga

SEQ ID NO: 1994829 - DNA, 16 bp, Homo sapiens
ccagcctaagaagctc

SEQ ID NO: 1994830 - DNA, 11 bp, Homo sapiens
ccagcctcagc

SEQ ID NO: 1994831 - DNA, 15 bp, Homo sapiens
ccagcctccatgctg

SEQ ID NO: 1994832 - DNA, 18 bp, Homo sapiens
ccagcctcgcatgccaga

SEQ ID NO: 1994833 - DNA, 23 bp, Homo sapiens
ccagcctctcccggctgcctgcc

SEQ ID NO: 1994834 - DNA, 12 bp, Homo sapiens
ccagcctgagca

SEQ ID NO: 1994835 - DNA, 17 bp, Homo sapiens
ccagcctggcctcctgc

SEQ ID NO: 1994836 - DNA, 19 bp, Homo sapiens
ccagcctggcctcctgcct

SEQ ID NO: 1994837 - DNA, 22 bp, Homo sapiens
ccagcctgggcctatggagagc

SEQ ID NO: 1994838 - DNA, 19 bp, Homo sapiens
ccagcctgggcgacagagc

SEQ ID NO: 1994839 - DNA, 13 bp, Homo sapiens
ccagcctgtgtgt

SEQ ID NO: 1994840 - DNA, 20 bp, Homo sapiens
ccagcctgttggacccgctc

SEQ ID NO: 1994841 - DNA, 19 bp, Homo sapiens
ccagccttctctctctggt

SEQ ID NO: 1994842 - DNA, 21 bp, Homo sapiens
ccagcgagccctggtggcagt

SEQ ID NO: 1994843 - DNA, 18 bp, Homo sapiens
ccagcgattccctctccc

SEQ ID NO: 1994844 - DNA, 23 bp, Homo sapiens
ccagcgattccctctcccaggcc

SEQ ID NO: 1994845 - DNA, 14 bp, Homo sapiens
ccagcgcctccctc

SEQ ID NO: 1994846 - DNA, 19 bp, Homo sapiens
ccagcgcctccctccaccc

SEQ ID NO: 1994847 - DNA, 20 bp, Homo sapiens
ccagcgcctccctccacccc

SEQ ID NO: 1994848 - DNA, 21 bp, Homo sapiens
ccagcgcctccctccacccca

SEQ ID NO: 1994849 - DNA, 22 bp, Homo sapiens
ccagcgcctccctccaccccag

SEQ ID NO: 1994850 - DNA, 15 bp, Homo sapiens
ccagcgcctgccctc

SEQ ID NO: 1994851 - DNA, 21 bp, Homo sapiens
ccagctaatctgtagggctgg

SEQ ID NO: 1994852 - DNA, 22 bp, Homo sapiens
ccagctaatctgtagggctgga

SEQ ID NO: 1994853 - DNA, 17 bp, Homo sapiens
ccagctacattcctcag

SEQ ID NO: 1994854 - DNA, 20 bp, Homo sapiens
ccagctacattcctcagctg

SEQ ID NO: 1994855 - DNA, 20 bp, Homo sapiens
ccagctactcaagaggctga

SEQ ID NO: 1994856 - DNA, 14 bp, Homo sapiens
ccagctactcagga

SEQ ID NO: 1994857 - DNA, 17 bp, Homo sapiens
ccagctactcaggaggc

SEQ ID NO: 1994858 - DNA, 14 bp, Homo sapiens
ccagctagtgaccc

SEQ ID NO: 1994859 - DNA, 22 bp, Homo sapiens
ccagctagtgacccacatgcca

SEQ ID NO: 1994860 - DNA, 15 bp, Homo sapiens
ccagctcacaagccc

SEQ ID NO: 1994861 - DNA, 17 bp, Homo sapiens
ccagctcacaagcccag

SEQ ID NO: 1994862 - DNA, 15 bp, Homo sapiens
ccagctcaccagccc

SEQ ID NO: 1994863 - DNA, 16 bp, Homo sapiens
ccagctcaccagcccc

SEQ ID NO: 1994864 - DNA, 17 bp, Homo sapiens
ccagctcagaggcccag

SEQ ID NO: 1994865 - DNA, 14 bp, Homo sapiens
ccagctcaggtgac

SEQ ID NO: 1994866 - DNA, 21 bp, Homo sapiens
ccagctcaggtgactggagcc

SEQ ID NO: 1994867 - DNA, 15 bp, Homo sapiens
ccagctcagtcccat

SEQ ID NO: 1994868 - DNA, 14 bp, Homo sapiens
ccagctccagtttc

SEQ ID NO: 1994869 - DNA, 13 bp, Homo sapiens
ccagctccccagg

SEQ ID NO: 1994870 - DNA, 17 bp, Homo sapiens
ccagctccccaggactc

SEQ ID NO: 1994871 - DNA, 22 bp, Homo sapiens
ccagctccttttgtccccaggg

SEQ ID NO: 1994872 - DNA, 23 bp, Homo sapiens
ccagctccttttgtccccagggc

SEQ ID NO: 1994873 - DNA, 14 bp, Homo sapiens
ccagctctccctct

SEQ ID NO: 1994874 - DNA, 17 bp, Homo sapiens
ccagctctccctctggc

SEQ ID NO: 1994875 - DNA, 21 bp, Homo sapiens
ccagctctccctctggccctg

SEQ ID NO: 1994876 - DNA, 16 bp, Homo sapiens
ccagctctctctaccc

SEQ ID NO: 1994877 - DNA, 11 bp, Homo sapiens
ccagctctgtg

SEQ ID NO: 1994878 - DNA, 12 bp, Homo sapiens
ccagctctgtgg

SEQ ID NO: 1994879 - DNA, 14 bp, Homo sapiens
ccagctctgtggcc

SEQ ID NO: 1994880 - DNA, 18 bp, Homo sapiens
ccagctctgtggcctgtg

SEQ ID NO: 1994881 - DNA, 20 bp, Homo sapiens
ccagctctgtggcctgtgtc

SEQ ID NO: 1994882 - DNA, 16 bp, Homo sapiens
ccagctcttggcccct

SEQ ID NO: 1994883 - DNA, 22 bp, Homo sapiens
cccaaacattaatcaccaaagt

SEQ ID NO: 1994884 - DNA, 12 bp, Homo sapiens
cccaaagaagga

SEQ ID NO: 1994885 - DNA, 16 bp, Homo sapiens
cccaaagtctgtgtga

SEQ ID NO: 1994886 - DNA, 19 bp, Homo sapiens
cccaaataaatgtgtaaat

SEQ ID NO: 1994887 - DNA, 18 bp, Homo sapiens
cccaaattccctggacct

SEQ ID NO: 1994888 - DNA, 17 bp, Homo sapiens
cccaaattggtgtttct

SEQ ID NO: 1994889 - DNA, 17 bp, Homo sapiens
cccaacacaatctttcc

SEQ ID NO: 1994890 - DNA, 15 bp, Homo sapiens
cccaaccccagggcc

SEQ ID NO: 1994891 - DNA, 21 bp, Homo sapiens
cccaaccccgcggtgctctgg

SEQ ID NO: 1994892 - DNA, 17 bp, Homo sapiens
cccaacccgtggaggct

SEQ ID NO: 1994893 - DNA, 18 bp, Homo sapiens
cccaacccgtggaggctg

SEQ ID NO: 1994894 - DNA, 22 bp, Homo sapiens
cccaacccgtggaggctgctcg

SEQ ID NO: 1994895 - DNA, 15 bp, Homo sapiens
cccaacctcaatgcc

SEQ ID NO: 1994896 - DNA, 13 bp, Homo sapiens
cccaacctgctct

SEQ ID NO: 1994897 - DNA, 17 bp, Homo sapiens
cccaacctttccctcac

SEQ ID NO: 1994898 - DNA, 15 bp, Homo sapiens
cccaacgcacaggaa

SEQ ID NO: 1994899 - DNA, 13 bp, Homo sapiens
cccaactcctgga

SEQ ID NO: 1994900 - DNA, 23 bp, Homo sapiens
cccaactcctggaagctgtgtcc

SEQ ID NO: 1994901 - DNA, 15 bp, Homo sapiens
cccaactccttccag

SEQ ID NO: 1994902 - DNA, 16 bp, Homo sapiens
cccaactgctctgccc

SEQ ID NO: 1994903 - DNA, 15 bp, Homo sapiens
cccaagagatgaaga

SEQ ID NO: 1994904 - DNA, 12 bp, Homo sapiens
cccaagagggct

SEQ ID NO: 1994905 - DNA, 13 bp, Homo sapiens
cccaagagggctg

SEQ ID NO: 1994906 - DNA, 16 bp, Homo sapiens
cccaagaggtctgagc

SEQ ID NO: 1994907 - DNA, 13 bp, Homo sapiens
cccaagcagccag

SEQ ID NO: 1994908 - DNA, 14 bp, Homo sapiens
cccaagcagccagc

SEQ ID NO: 1994909 - DNA, 14 bp, Homo sapiens
cccaagcctctgcc

SEQ ID NO: 1994910 - DNA, 17 bp, Homo sapiens
cccaagctctgctcctc

SEQ ID NO: 1994911 - DNA, 14 bp, Homo sapiens
cccaaggactctgg

SEQ ID NO: 1994912 - DNA, 18 bp, Homo sapiens
cccaaggactctggcctc

SEQ ID NO: 1994913 - DNA, 14 bp, Homo sapiens
cccaaggagctgat

SEQ ID NO: 1994914 - DNA, 23 bp, Homo sapiens
cccaaggagctgatttccaggcc

SEQ ID NO: 1994915 - DNA, 17 bp, Homo sapiens
cccaaggctctgagcaa

SEQ ID NO: 1994916 - DNA, 12 bp, Homo sapiens
cccaaggctgct

SEQ ID NO: 1994917 - DNA, 15 bp, Homo sapiens
cccaaggctgctcag

SEQ ID NO: 1994918 - DNA, 18 bp, Homo sapiens
cccaaggggcccacaaag

SEQ ID NO: 1994919 - DNA, 17 bp, Homo sapiens
cccaaggggtttctgtt

SEQ ID NO: 1994920 - DNA, 21 bp, Homo sapiens
cccaagtattgcgaatgtgca

SEQ ID NO: 1994921 - DNA, 11 bp, Homo sapiens
cccaagtgcca

SEQ ID NO: 1994922 - DNA, 19 bp, Homo sapiens
cccaagtgggggcagaggg

SEQ ID NO: 1994923 - DNA, 23 bp, Homo sapiens
cccaagtgggggcagagggcaga

SEQ ID NO: 1994924 - DNA, 11 bp, Homo sapiens
cccaatattat

SEQ ID NO: 1994925 - DNA, 16 bp, Homo sapiens
cccaatcagcactgaa

SEQ ID NO: 1994926 - DNA, 16 bp, Homo sapiens
cccaatgcacatccat

SEQ ID NO: 1994927 - DNA, 20 bp, Homo sapiens
cccaatgcacatccattccc

SEQ ID NO: 1994928 - DNA, 16 bp, Homo sapiens
cccaatgctcctggag

SEQ ID NO: 1994929 - DNA, 24 bp, Homo sapiens
cccaatgctttgggaggccaaggc

SEQ ID NO: 1994930 - DNA, 14 bp, Homo sapiens
cccaattcaggact

SEQ ID NO: 1994931 - DNA, 16 bp, Homo sapiens
cccaattcaggactgg

SEQ ID NO: 1994932 - DNA, 20 bp, Homo sapiens
cccaattcaggactggctca

SEQ ID NO: 1994933 - DNA, 12 bp, Homo sapiens
cccaatttaatt

SEQ ID NO: 1994934 - DNA, 13 bp, Homo sapiens
cccaatttatttt

SEQ ID NO: 1994935 - DNA, 13 bp, Homo sapiens
cccacaaactgat

SEQ ID NO: 1994936 - DNA, 12 bp, Homo sapiens
cccacaaagggg

SEQ ID NO: 1994937 - DNA, 23 bp, Homo sapiens
cccacaaaggggagaagggccag

SEQ ID NO: 1994938 - DNA, 21 bp, Homo sapiens
cccacaagccttactcacctc

SEQ ID NO: 1994939 - DNA, 14 bp, Homo sapiens
cccacaatgatgat

SEQ ID NO: 1994940 - DNA, 23 bp, Homo sapiens
cccacacggaggcatctgcaccc

SEQ ID NO: 1994941 - DNA, 13 bp, Homo sapiens
cccacacgtgctc

SEQ ID NO: 1994942 - DNA, 12 bp, Homo sapiens
cccacagagcct

SEQ ID NO: 1994943 - DNA, 14 bp, Homo sapiens
cccacagcacccag

SEQ ID NO: 1994944 - DNA, 15 bp, Homo sapiens
cccacagcacccagg

SEQ ID NO: 1994945 - DNA, 16 bp, Homo sapiens
cccacagcacccaggc

SEQ ID NO: 1994946 - DNA, 17 bp, Homo sapiens
cccacagcacccaggct

SEQ ID NO: 1994947 - DNA, 15 bp, Homo sapiens
cccacagcagcaata

SEQ ID NO: 1994948 - DNA, 14 bp, Homo sapiens
cccacagcctctgc

SEQ ID NO: 1994949 - DNA, 17 bp, Homo sapiens
cccacagctcccacccc

SEQ ID NO: 1994950 - DNA, 14 bp, Homo sapiens
cccacagggccaga

SEQ ID NO: 1994951 - DNA, 22 bp, Homo sapiens
cccacagtcctcacagcctctc

SEQ ID NO: 1994952 - DNA, 16 bp, Homo sapiens
cccacatatggcacaa

SEQ ID NO: 1994953 - DNA, 23 bp, Homo sapiens
cccacatattcacatacgtgtct

SEQ ID NO: 1994954 - DNA, 13 bp, Homo sapiens
cccacatcccagg

SEQ ID NO: 1994955 - DNA, 14 bp, Homo sapiens
cccacatcccaggc

SEQ ID NO: 1994956 - DNA, 20 bp, Homo sapiens
cccacatcccaggcttcacc

SEQ ID NO: 1994957 - DNA, 20 bp, Homo sapiens
cccacatccctgggcctgct

SEQ ID NO: 1994958 - DNA, 22 bp, Homo sapiens
cccacatccctgggcctgctgc

SEQ ID NO: 1994959 - DNA, 23 bp, Homo sapiens
cccacatccctgggcctgctgct

SEQ ID NO: 1994960 - DNA, 19 bp, Homo sapiens
cccacattggacttccttg

SEQ ID NO: 1994961 - DNA, 21 bp, Homo sapiens
cccaccaacatcccattgccc

SEQ ID NO: 1994962 - DNA, 15 bp, Homo sapiens
cccaccaactctgca

SEQ ID NO: 1994963 - DNA, 20 bp, Homo sapiens
cccaccaccctcccaccatg

SEQ ID NO: 1994964 - DNA, 23 bp, Homo sapiens
cccaccaccctcccaccatgcgc

SEQ ID NO: 1994965 - DNA, 13 bp, Homo sapiens
cccaccacctagg

SEQ ID NO: 1994966 - DNA, 16 bp, Homo sapiens
cccaccacctaggcca

SEQ ID NO: 1994967 - DNA, 19 bp, Homo sapiens
cccaccacgatgtggccct

SEQ ID NO: 1994968 - DNA, 21 bp, Homo sapiens
cccaccagcatgtcactccca

SEQ ID NO: 1994969 - DNA, 19 bp, Homo sapiens
cccaccatgcgctgctcaa

SEQ ID NO: 1994970 - DNA, 20 bp, Homo sapiens
cccacccatcttcctgctgc

SEQ ID NO: 1994971 - DNA, 15 bp, Homo sapiens
cccaccccaccccct

SEQ ID NO: 1994972 - DNA, 17 bp, Homo sapiens
cccaccccactccagcc

SEQ ID NO: 1994973 - DNA, 19 bp, Homo sapiens
cccaccccactccagccct

SEQ ID NO: 1994974 - DNA, 15 bp, Homo sapiens
cccaccccagagttg

SEQ ID NO: 1994975 - DNA, 18 bp, Homo sapiens
cccacccccagccccgac

SEQ ID NO: 1994976 - DNA, 17 bp, Homo sapiens
cccaccccctccccagg

SEQ ID NO: 1994977 - DNA, 23 bp, Homo sapiens
cccacccccttcagtgcccacca

SEQ ID NO: 1994978 - DNA, 21 bp, Homo sapiens
cccaccctcaaaccctgtggg

SEQ ID NO: 1994979 - DNA, 20 bp, Homo sapiens
cccaccctcgtggacacctg

SEQ ID NO: 1994980 - DNA, 17 bp, Homo sapiens
cccaccgaagagccctg

SEQ ID NO: 1994981 - DNA, 18 bp, Homo sapiens
cccaccgaagagccctga

SEQ ID NO: 1994982 - DNA, 22 bp, Homo sapiens
cccaccgaagagccctgagctc

SEQ ID NO: 1994983 - DNA, 17 bp, Homo sapiens
cccaccgggccactcct

SEQ ID NO: 1994984 - DNA, 23 bp, Homo sapiens
cccaccgggctgggagctctgca

SEQ ID NO: 1994985 - DNA, 18 bp, Homo sapiens
cccacctacttgtgactg

SEQ ID NO: 1994986 - DNA, 15 bp, Homo sapiens
cccacctcagcctcc

SEQ ID NO: 1994987 - DNA, 21 bp, Homo sapiens
cccacctcagcctcccaaagt

SEQ ID NO: 1994988 - DNA, 17 bp, Homo sapiens
cccacctcagcctcccg

SEQ ID NO: 1994989 - DNA, 19 bp, Homo sapiens
cccacctccgccccagaca

SEQ ID NO: 1994990 - DNA, 16 bp, Homo sapiens
cccacctccgctggga

SEQ ID NO: 1994991 - DNA, 12 bp, Homo sapiens
cccacctcttct

SEQ ID NO: 1994992 - DNA, 21 bp, Homo sapiens
cccacctgacaatggcagcta

SEQ ID NO: 1994993 - DNA, 20 bp, Homo sapiens
cccacctgcacgtgatctgc

SEQ ID NO: 1994994 - DNA, 19 bp, Homo sapiens
cccacctgctgagagaccc

SEQ ID NO: 1994995 - DNA, 12 bp, Homo sapiens
cccaccttggct

SEQ ID NO: 1994996 - DNA, 15 bp, Homo sapiens
cccaccttggctcaa

SEQ ID NO: 1994997 - DNA, 20 bp, Homo sapiens
cccaccttggctgcagggag

SEQ ID NO: 1994998 - DNA, 17 bp, Homo sapiens
cccctcacctgggcctt

SEQ ID NO: 1994999 - DNA, 20 bp, Homo sapiens
cccctcacctgggcctttcc

SEQ ID NO: 1995000 - DNA, 12 bp, Homo sapiens
cccctcactctg

SEQ ID NO: 1995001 - DNA, 13 bp, Homo sapiens
cccctcagagctc

SEQ ID NO: 1995002 - DNA, 15 bp, Homo sapiens
cccctcagcccttgc

SEQ ID NO: 1995003 - DNA, 12 bp, Homo sapiens
cccctcagtgct

SEQ ID NO: 1995004 - DNA, 19 bp, Homo sapiens
cccctcagtgctcggcagt

SEQ ID NO: 1995005 - DNA, 23 bp, Homo sapiens
cccctcatggagaaacatcctaa

SEQ ID NO: 1995006 - DNA, 19 bp, Homo sapiens
cccctccacgcctcctggc

SEQ ID NO: 1995007 - DNA, 13 bp, Homo sapiens
cccctccagaccc

SEQ ID NO: 1995008 - DNA, 16 bp, Homo sapiens
cccctccagaccctgc

SEQ ID NO: 1995009 - DNA, 23 bp, Homo sapiens
cccctccagaccctgcctgagcc

SEQ ID NO: 1995010 - DNA, 15 bp, Homo sapiens
cccctccagctccag

SEQ ID NO: 1995011 - DNA, 11 bp, Homo sapiens
cccctccaggc

SEQ ID NO: 1995012 - DNA, 16 bp, Homo sapiens
cccctccaggcatgct

SEQ ID NO: 1995013 - DNA, 12 bp, Homo sapiens
cccctcccaccc

SEQ ID NO: 1995014 - DNA, 15 bp, Homo sapiens
cccctcccccctgta

SEQ ID NO: 1995015 - DNA, 12 bp, Homo sapiens
cccctcccctcc

SEQ ID NO: 1995016 - DNA, 14 bp, Homo sapiens
cccctccctctgcc

SEQ ID NO: 1995017 - DNA, 20 bp, Homo sapiens
cccctccctcttccttcccc

SEQ ID NO: 1995018 - DNA, 12 bp, Homo sapiens
cccctcccttgc

SEQ ID NO: 1995019 - DNA, 12 bp, Homo sapiens
cccctcctcccc

SEQ ID NO: 1995020 - DNA, 14 bp, Homo sapiens
cccctcctctgcca

SEQ ID NO: 1995021 - DNA, 14 bp, Homo sapiens
cccctccttgctct

SEQ ID NO: 1995022 - DNA, 13 bp, Homo sapiens
cccctcgctgctg

SEQ ID NO: 1995023 - DNA, 17 bp, Homo sapiens
cccctcgtcctgtccca

SEQ ID NO: 1995024 - DNA, 17 bp, Homo sapiens
cccctctgccctgtata

SEQ ID NO: 1995025 - DNA, 21 bp, Homo sapiens
cccctctgtcatcactccctg

SEQ ID NO: 1995026 - DNA, 22 bp, Homo sapiens
cccctctgtcatcactccctgg

SEQ ID NO: 1995027 - DNA, 11 bp, Homo sapiens
cccctctgtgt

SEQ ID NO: 1995028 - DNA, 16 bp, Homo sapiens
cccctctgtgtcctct

SEQ ID NO: 1995029 - DNA, 15 bp, Homo sapiens
cccctgaggactgga

SEQ ID NO: 1995030 - DNA, 13 bp, Homo sapiens
cccctgcacagtt

SEQ ID NO: 1995031 - DNA, 22 bp, Homo sapiens
cccctgcagcttgtagccagcc

SEQ ID NO: 1995032 - DNA, 14 bp, Homo sapiens
cccctgccaccctg

SEQ ID NO: 1995033 - DNA, 22 bp, Homo sapiens
cccctgcccgaccccatctcat

SEQ ID NO: 1995034 - DNA, 14 bp, Homo sapiens
cccctgccctgctg

SEQ ID NO: 1995035 - DNA, 14 bp, Homo sapiens
cccctgcctgggtt

SEQ ID NO: 1995036 - DNA, 15 bp, Homo sapiens
cccctgctggttcag

SEQ ID NO: 1995037 - DNA, 20 bp, Homo sapiens
cccctgctggttcagggttg

SEQ ID NO: 1995038 - DNA, 19 bp, Homo sapiens
cccctggaccaccagcccc

SEQ ID NO: 1995039 - DNA, 20 bp, Homo sapiens
cccctggatgtcccctgtcc

SEQ ID NO: 1995040 - DNA, 21 bp, Homo sapiens
cccctggatgtcccctgtccc

SEQ ID NO: 1995041 - DNA, 20 bp, Homo sapiens
cccctggcttttcactgctg

SEQ ID NO: 1995042 - DNA, 22 bp, Homo sapiens
cccctggcttttcactgctggc

SEQ ID NO: 1995043 - DNA, 20 bp, Homo sapiens
cccctgggcatcttctggct

SEQ ID NO: 1995044 - DNA, 20 bp, Homo sapiens
cccctgggggctagcagaag

SEQ ID NO: 1995045 - DNA, 16 bp, Homo sapiens
cccctggtaagcagag

SEQ ID NO: 1995046 - DNA, 23 bp, Homo sapiens
cccctggtgcactggccccaccc

SEQ ID NO: 1995047 - DNA, 21 bp, Homo sapiens
cccctggtggacagtcctggg

SEQ ID NO: 1995048 - DNA, 19 bp, Homo sapiens
cccctgtaaacacagtgct

SEQ ID NO: 1995049 - DNA, 23 bp, Homo sapiens
cccctgtaaatagttttaaatat

SEQ ID NO: 1995050 - DNA, 17 bp, Homo sapiens
cccctgtacccagctcc

SEQ ID NO: 1995051 - DNA, 14 bp, Homo sapiens
cccctgtactccag

SEQ ID NO: 1995052 - DNA, 12 bp, Homo sapiens
cccctgtcccac

SEQ ID NO: 1995053 - DNA, 17 bp, Homo sapiens
cccctgtcccaccaact

SEQ ID NO: 1995054 - DNA, 20 bp, Homo sapiens
cccctgtcccaccaactctg

SEQ ID NO: 1995055 - DNA, 22 bp, Homo sapiens
cccctgtcccaccaactctgca

SEQ ID NO: 1995056 - DNA, 13 bp, Homo sapiens
cccctgtgccagc

SEQ ID NO: 1995057 - DNA, 22 bp, Homo sapiens
cccctgtgtgagttgagtctcc

SEQ ID NO: 1995058 - DNA, 15 bp, Homo sapiens
ccccttatccaggac

SEQ ID NO: 1995059 - DNA, 13 bp, Homo sapiens
ccccttcagtgcc

SEQ ID NO: 1995060 - DNA, 15 bp, Homo sapiens
ccccttccccatctc

SEQ ID NO: 1995061 - DNA, 16 bp, Homo sapiens
ccccttcctgcacccg

SEQ ID NO: 1995062 - DNA, 20 bp, Homo sapiens
ccccttcctgcacccgtacc

SEQ ID NO: 1995063 - DNA, 14 bp, Homo sapiens
ccccttcctttcct

SEQ ID NO: 1995064 - DNA, 19 bp, Homo sapiens
ccccttcgaggttgcccct

SEQ ID NO: 1995065 - DNA, 14 bp, Homo sapiens
ccccttcgctcctg

SEQ ID NO: 1995066 - DNA, 15 bp, Homo sapiens
ccccttcgctcctgt

SEQ ID NO: 1995067 - DNA, 17 bp, Homo sapiens
ccccttcgctcctgtgt

SEQ ID NO: 1995068 - DNA, 17 bp, Homo sapiens
ccccttctgtgtcacag

SEQ ID NO: 1995069 - DNA, 20 bp, Homo sapiens
ccccttgccaaattccatgt

SEQ ID NO: 1995070 - DNA, 18 bp, Homo sapiens
ccccttgcccttgccctg

SEQ ID NO: 1995071 - DNA, 24 bp, Homo sapiens
ccccttgcccttgccctgacctcc

SEQ ID NO: 1995072 - DNA, 16 bp, Homo sapiens
ccccttgtcctctccc

SEQ ID NO: 1995073 - DNA, 13 bp, Homo sapiens
cccctttccccca

SEQ ID NO: 1995074 - DNA, 21 bp, Homo sapiens
cccctttcccccaccccagag

SEQ ID NO: 1995075 - DNA, 19 bp, Homo sapiens
ccccttttgcctggctgtg

SEQ ID NO: 1995076 - DNA, 20 bp, Homo sapiens
ccccttttgcctggctgtgg

SEQ ID NO: 1995077 - DNA, 11 bp, Homo sapiens
cccgaagccca

SEQ ID NO: 1995078 - DNA, 13 bp, Homo sapiens
cccgaatgcctgt

SEQ ID NO: 1995079 - DNA, 18 bp, Homo sapiens
cccgacactgctgcacca

SEQ ID NO: 1995080 - DNA, 17 bp, Homo sapiens
cccgactccagccagcg

SEQ ID NO: 1995081 - DNA, 20 bp, Homo sapiens
cccgactccagccagcgcct

SEQ ID NO: 1995082 - DNA, 21 bp, Homo sapiens
cccgagcagctgagcagggcc

SEQ ID NO: 1995083 - DNA, 12 bp, Homo sapiens
cccgagcccagc

SEQ ID NO: 1995084 - DNA, 22 bp, Homo sapiens
cccgagctactctcttgccagc

SEQ ID NO: 1995085 - DNA, 15 bp, Homo sapiens
cccgaggccttctct

SEQ ID NO: 1995086 - DNA, 20 bp, Homo sapiens
cccgaggccttctctgaagg

SEQ ID NO: 1995087 - DNA, 14 bp, Homo sapiens
cccgaggctgccca

SEQ ID NO: 1995088 - DNA, 19 bp, Homo sapiens
cccgaggctgcccactatg

SEQ ID NO: 1995089 - DNA, 13 bp, Homo sapiens
cccgagtagctgg

SEQ ID NO: 1995090 - DNA, 22 bp, Homo sapiens
cccgagtagctgggactacagg

SEQ ID NO: 1995091 - DNA, 19 bp, Homo sapiens
cccgcagcaccctgcagag

SEQ ID NO: 1995092 - DNA, 19 bp, Homo sapiens
cccgccacggccaccctcc

SEQ ID NO: 1995093 - DNA, 13 bp, Homo sapiens
cccgccagcctca

SEQ ID NO: 1995094 - DNA, 15 bp, Homo sapiens
cccgccctctgcgtc

SEQ ID NO: 1995095 - DNA, 16 bp, Homo sapiens
cccgccctgcccctgc

SEQ ID NO: 1995096 - DNA, 19 bp, Homo sapiens
cccgccttcctcctccaca

SEQ ID NO: 1995097 - DNA, 16 bp, Homo sapiens
cccgcggtgctctggc

SEQ ID NO: 1995098 - DNA, 15 bp, Homo sapiens
cccgctcagccctcc

SEQ ID NO: 1995099 - DNA, 19 bp, Homo sapiens
cccgctcagccctccctgc

SEQ ID NO: 1995100 - DNA, 11 bp, Homo sapiens
cccgctctgga

SEQ ID NO: 1995101 - DNA, 15 bp, Homo sapiens
cccgcttccccacag

SEQ ID NO: 1995102 - DNA, 19 bp, Homo sapiens
cccgcttccccacagaact

SEQ ID NO: 1995103 - DNA, 15 bp, Homo sapiens
cccgcttgtccagcg

SEQ ID NO: 1995104 - DNA, 18 bp, Homo sapiens
cccgcttgtccagcgcct

SEQ ID NO: 1995105 - DNA, 16 bp, Homo sapiens
cccggaaagactgaaa

SEQ ID NO: 1995106 - DNA, 18 bp, Homo sapiens
cccggagcacagccctgg

SEQ ID NO: 1995107 - DNA, 20 bp, Homo sapiens
cccggagcacagccctggga

SEQ ID NO: 1995108 - DNA, 21 bp, Homo sapiens
cccggagcacagccctgggag

SEQ ID NO: 1995109 - DNA, 17 bp, Homo sapiens
cccggaggggcctggca

SEQ ID NO: 1995110 - DNA, 19 bp, Homo sapiens
cccggagtaatcaggcagc

SEQ ID NO: 1995111 - DNA, 18 bp, Homo sapiens
cccggatgtgtgtctcac

SEQ ID NO: 1995112 - DNA, 14 bp, Homo sapiens
cccggattctggga

SEQ ID NO: 1995113 - DNA, 13 bp, Homo sapiens
ccgacagcccagc

SEQ ID NO: 1995114 - DNA, 14 bp, Homo sapiens
ccgacagcccagcc

SEQ ID NO: 1995115 - DNA, 16 bp, Homo sapiens
ccgacagcccagccta

SEQ ID NO: 1995116 - DNA, 14 bp, Homo sapiens
ccgacagcctggca

SEQ ID NO: 1995117 - DNA, 22 bp, Homo sapiens
ccgacagcctggcacagggcag

SEQ ID NO: 1995118 - DNA, 13 bp, Homo sapiens
ccgaccagacacc

SEQ ID NO: 1995119 - DNA, 13 bp, Homo sapiens
ccgaccagagccc

SEQ ID NO: 1995120 - DNA, 13 bp, Homo sapiens
ccgacctcagcct

SEQ ID NO: 1995121 - DNA, 16 bp, Homo sapiens
ccgacgcgtctcctgt

SEQ ID NO: 1995122 - DNA, 17 bp, Homo sapiens
ccgacgcgtctcctgtt

SEQ ID NO: 1995123 - DNA, 14 bp, Homo sapiens
ccgactagcaggca

SEQ ID NO: 1995124 - DNA, 13 bp, Homo sapiens
ccgactccagcca

SEQ ID NO: 1995125 - DNA, 17 bp, Homo sapiens
ccgagacggctggacct

SEQ ID NO: 1995126 - DNA, 20 bp, Homo sapiens
ccgagagcctgctcccccac

SEQ ID NO: 1995127 - DNA, 21 bp, Homo sapiens
ccgagatcacgccactgcact

SEQ ID NO: 1995128 - DNA, 16 bp, Homo sapiens
ccgagcaaccgtggcc

SEQ ID NO: 1995129 - DNA, 23 bp, Homo sapiens
ccgagcaaccgtggcccttcctg

SEQ ID NO: 1995130 - DNA, 17 bp, Homo sapiens
ccgagcagctgagcagg

SEQ ID NO: 1995131 - DNA, 12 bp, Homo sapiens
ccgagcccagct

SEQ ID NO: 1995132 - DNA, 18 bp, Homo sapiens
ccgagcgctttctggaaa

SEQ ID NO: 1995133 - DNA, 21 bp, Homo sapiens
ccgagctactctcttgccagc

SEQ ID NO: 1995134 - DNA, 23 bp, Homo sapiens
ccgagctactctcttgccagcat

SEQ ID NO: 1995135 - DNA, 21 bp, Homo sapiens
ccgaggaccgggctggggttt

SEQ ID NO: 1995136 - DNA, 14 bp, Homo sapiens
ccgaggccttctct

SEQ ID NO: 1995137 - DNA, 20 bp, Homo sapiens
ccgagtagctgggactacag

SEQ ID NO: 1995138 - DNA, 19 bp, Homo sapiens
ccgagtctcttctccactg

SEQ ID NO: 1995139 - DNA, 16 bp, Homo sapiens
ccgattaatttatggt

SEQ ID NO: 1995140 - DNA, 14 bp, Homo sapiens
ccgcaagcgcaggg

SEQ ID NO: 1995141 - DNA, 12 bp, Homo sapiens
ccgcaaggccct

SEQ ID NO: 1995142 - DNA, 15 bp, Homo sapiens
ccgcaaggccctgtc

SEQ ID NO: 1995143 - DNA, 22 bp, Homo sapiens
ccgcaaggccctgtcccagcag

SEQ ID NO: 1995144 - DNA, 18 bp, Homo sapiens
ccgcaccagctgctctgc

SEQ ID NO: 1995145 - DNA, 15 bp, Homo sapiens
ccgcagagctccctt

SEQ ID NO: 1995146 - DNA, 18 bp, Homo sapiens
ccgcagagctcccttcct

SEQ ID NO: 1995147 - DNA, 13 bp, Homo sapiens
ccgcagcatgtgg

SEQ ID NO: 1995148 - DNA, 22 bp, Homo sapiens
ccgcagccagccggtgcctggc

SEQ ID NO: 1995149 - DNA, 22 bp, Homo sapiens
ccgcagggacggggactggccc

SEQ ID NO: 1995150 - DNA, 13 bp, Homo sapiens
ccgcagtccccag

SEQ ID NO: 1995151 - DNA, 16 bp, Homo sapiens
ccgcatcttctccatc

SEQ ID NO: 1995152 - DNA, 13 bp, Homo sapiens
ccgcattccctga

SEQ ID NO: 1995153 - DNA, 14 bp, Homo sapiens
ccgccacggccacc

SEQ ID NO: 1995154 - DNA, 21 bp, Homo sapiens
ccgccatccgggacgcttcca

SEQ ID NO: 1995155 - DNA, 18 bp, Homo sapiens
ccgccatccttcaccaga

SEQ ID NO: 1995156 - DNA, 20 bp, Homo sapiens
ccgccatccttcaccagagc

SEQ ID NO: 1995157 - DNA, 22 bp, Homo sapiens
ccgccatccttcaccagagccc

SEQ ID NO: 1995158 - DNA, 13 bp, Homo sapiens
ccgccccagacac

SEQ ID NO: 1995159 - DNA, 18 bp, Homo sapiens
ccgccctgggctgtctgt

SEQ ID NO: 1995160 - DNA, 17 bp, Homo sapiens
ccgcccttcccacagca

SEQ ID NO: 1995161 - DNA, 17 bp, Homo sapiens
ccgcctcccagccccag

SEQ ID NO: 1995162 - DNA, 13 bp, Homo sapiens
ccgcctggccggc

SEQ ID NO: 1995163 - DNA, 14 bp, Homo sapiens
ccgcctggccggct

SEQ ID NO: 1995164 - DNA, 19 bp, Homo sapiens
ccgcctgtgcccacgtgtg

SEQ ID NO: 1995165 - DNA, 22 bp, Homo sapiens
ccgccttaatctggaaggcccc

SEQ ID NO: 1995166 - DNA, 14 bp, Homo sapiens
ccgccttcctcctc

SEQ ID NO: 1995167 - DNA, 20 bp, Homo sapiens
ccgcggtaggtaagggccgc

SEQ ID NO: 1995168 - DNA, 12 bp, Homo sapiens
ccgcggtgctct

SEQ ID NO: 1995169 - DNA, 15 bp, Homo sapiens
ccgcggtgctctggc

SEQ ID NO: 1995170 - DNA, 13 bp, Homo sapiens
ccgcgtctaccct

SEQ ID NO: 1995171 - DNA, 16 bp, Homo sapiens
ccgcgtctaccctggg

SEQ ID NO: 1995172 - DNA, 16 bp, Homo sapiens
ccgctacaccactctg

SEQ ID NO: 1995173 - DNA, 17 bp, Homo sapiens
ccgctacaccactctgg

SEQ ID NO: 1995174 - DNA, 21 bp, Homo sapiens
ccgctacaccactctggcagc

SEQ ID NO: 1995175 - DNA, 21 bp, Homo sapiens
ccgctaggagagactgaaagc

SEQ ID NO: 1995176 - DNA, 19 bp, Homo sapiens
ccgctcagccctccctgcc

SEQ ID NO: 1995177 - DNA, 11 bp, Homo sapiens
ccgctccagat

SEQ ID NO: 1995178 - DNA, 19 bp, Homo sapiens
ccgctcctcccctcttgag

SEQ ID NO: 1995179 - DNA, 14 bp, Homo sapiens
ccgctcctgtctgc

SEQ ID NO: 1995180 - DNA, 17 bp, Homo sapiens
ccgctcctgtctgccag

SEQ ID NO: 1995181 - DNA, 19 bp, Homo sapiens
ccgctcctttacctaccac

SEQ ID NO: 1995182 - DNA, 22 bp, Homo sapiens
ccgctcctttacctaccacctt

SEQ ID NO: 1995183 - DNA, 20 bp, Homo sapiens
ccgctgccaccacgtctgcc

SEQ ID NO: 1995184 - DNA, 23 bp, Homo sapiens
ccgctgccaccacgtctgccagg

SEQ ID NO: 1995185 - DNA, 16 bp, Homo sapiens
ccgctgccccagcccc

SEQ ID NO: 1995186 - DNA, 17 bp, Homo sapiens
ccgctgccgctgcacca

SEQ ID NO: 1995187 - DNA, 18 bp, Homo sapiens
ccgctggcagccaccccc

SEQ ID NO: 1995188 - DNA, 12 bp, Homo sapiens
ccgctggcccag

SEQ ID NO: 1995189 - DNA, 16 bp, Homo sapiens
ccgctggcccagggta

SEQ ID NO: 1995190 - DNA, 20 bp, Homo sapiens
ccgctggctcctccaggcac

SEQ ID NO: 1995191 - DNA, 16 bp, Homo sapiens
ccgctgtcgccccagg

SEQ ID NO: 1995192 - DNA, 21 bp, Homo sapiens
ccgctgtcgccccaggccctc

SEQ ID NO: 1995193 - DNA, 15 bp, Homo sapiens
ccgctgtgagcccct

SEQ ID NO: 1995194 - DNA, 15 bp, Homo sapiens
ccgctgttcacccac

SEQ ID NO: 1995195 - DNA, 14 bp, Homo sapiens
ccgcttccccacag

SEQ ID NO: 1995196 - DNA, 18 bp, Homo sapiens
ccgcttccccacagaact

SEQ ID NO: 1995197 - DNA, 16 bp, Homo sapiens
ccgcttgtccagcgcc

SEQ ID NO: 1995198 - DNA, 17 bp, Homo sapiens
ccgcttgtccagcgcct

SEQ ID NO: 1995199 - DNA, 14 bp, Homo sapiens
ccggagcacagccc

SEQ ID NO: 1995200 - DNA, 15 bp, Homo sapiens
ccggagcacagccct

SEQ ID NO: 1995201 - DNA, 18 bp, Homo sapiens
ccggagcacagccctggg

SEQ ID NO: 1995202 - DNA, 21 bp, Homo sapiens
ccggagcacagccctgggagg

SEQ ID NO: 1995203 - DNA, 14 bp, Homo sapiens
ccggaggggcctgg

SEQ ID NO: 1995204 - DNA, 16 bp, Homo sapiens
ccggatcgaggacaag

SEQ ID NO: 1995205 - DNA, 15 bp, Homo sapiens
ccggcaccccctgca

SEQ ID NO: 1995206 - DNA, 16 bp, Homo sapiens
ccggcaccccctgcag

SEQ ID NO: 1995207 - DNA, 19 bp, Homo sapiens
ccggcaccccctgcagctt

SEQ ID NO: 1995208 - DNA, 19 bp, Homo sapiens
ccggcacctacatccccag

SEQ ID NO: 1995209 - DNA, 16 bp, Homo sapiens
ccggcatgctggcctg

SEQ ID NO: 1995210 - DNA, 18 bp, Homo sapiens
ccggcatgctggcctgtg

SEQ ID NO: 1995211 - DNA, 15 bp, Homo sapiens
ccggccagggcctgg

SEQ ID NO: 1995212 - DNA, 17 bp, Homo sapiens
ccggccagggcctggtg

SEQ ID NO: 1995213 - DNA, 16 bp, Homo sapiens
ccggcccagagacccc

SEQ ID NO: 1995214 - DNA, 18 bp, Homo sapiens
ccggcccagagacccctt

SEQ ID NO: 1995215 - DNA, 19 bp, Homo sapiens
ccggcccagagaccccttc

SEQ ID NO: 1995216 - DNA, 18 bp, Homo sapiens
ccggcccagcctaggccc

SEQ ID NO: 1995217 - DNA, 14 bp, Homo sapiens
ccggcccctgctgg

SEQ ID NO: 1995218 - DNA, 23 bp, Homo sapiens
ccggcctcagcacccctgtctct

SEQ ID NO: 1995219 - DNA, 23 bp, Homo sapiens
ccggcctccactcccccacctga

SEQ ID NO: 1995220 - DNA, 14 bp, Homo sapiens
ccggcctcttccac

SEQ ID NO: 1995221 - DNA, 16 bp, Homo sapiens
ccggcctcttccaccc

SEQ ID NO: 1995222 - DNA, 20 bp, Homo sapiens
ccggcctgctcccagcagcc

SEQ ID NO: 1995223 - DNA, 13 bp, Homo sapiens
ccggcgctgcagg

SEQ ID NO: 1995224 - DNA, 13 bp, Homo sapiens
ccggctaactctg

SEQ ID NO: 1995225 - DNA, 22 bp, Homo sapiens
ccggctatgggggcactgagga

SEQ ID NO: 1995226 - DNA, 12 bp, Homo sapiens
ccggctccccct

SEQ ID NO: 1995227 - DNA, 18 bp, Homo sapiens
ccggctcccttctacagc

SEQ ID NO: 1995228 - DNA, 15 bp, Homo sapiens
cctcccagccccagg

SEQ ID NO: 1995229 - DNA, 18 bp, Homo sapiens
cctcccagccctatggat

SEQ ID NO: 1995230 - DNA, 20 bp, Homo sapiens
cctcccagccctatggatgt

SEQ ID NO: 1995231 - DNA, 14 bp, Homo sapiens
cctcccagccctgc

SEQ ID NO: 1995232 - DNA, 14 bp, Homo sapiens
cctcccagggccag

SEQ ID NO: 1995233 - DNA, 21 bp, Homo sapiens
cctcccagggccagggccctg

SEQ ID NO: 1995234 - DNA, 19 bp, Homo sapiens
cctcccaggggctccacct

SEQ ID NO: 1995235 - DNA, 19 bp, Homo sapiens
cctccccacccccgctggg

SEQ ID NO: 1995236 - DNA, 15 bp, Homo sapiens
cctccccaccttccc

SEQ ID NO: 1995237 - DNA, 22 bp, Homo sapiens
cctccccaggggagagggtctg

SEQ ID NO: 1995238 - DNA, 13 bp, Homo sapiens
cctccccagtcta

SEQ ID NO: 1995239 - DNA, 18 bp, Homo sapiens
cctccccccactgcaggc

SEQ ID NO: 1995240 - DNA, 19 bp, Homo sapiens
cctccccccagcccctcct

SEQ ID NO: 1995241 - DNA, 22 bp, Homo sapiens
cctccccccagcccctcctccc

SEQ ID NO: 1995242 - DNA, 17 bp, Homo sapiens
cctccccctcttggtcc

SEQ ID NO: 1995243 - DNA, 13 bp, Homo sapiens
cctccccctgcca

SEQ ID NO: 1995244 - DNA, 18 bp, Homo sapiens
cctccccctgccagtgcc

SEQ ID NO: 1995245 - DNA, 14 bp, Homo sapiens
cctcccccttcccc

SEQ ID NO: 1995246 - DNA, 13 bp, Homo sapiens
cctcccctgccag

SEQ ID NO: 1995247 - DNA, 14 bp, Homo sapiens
cctcccctgccagg

SEQ ID NO: 1995248 - DNA, 16 bp, Homo sapiens
cctcccctgccagggc

SEQ ID NO: 1995249 - DNA, 16 bp, Homo sapiens
cctccccttcctgcac

SEQ ID NO: 1995250 - DNA, 19 bp, Homo sapiens
cctcccgaatagctgggac

SEQ ID NO: 1995251 - DNA, 19 bp, Homo sapiens
cctcccgagtagctgggac

SEQ ID NO: 1995252 - DNA, 15 bp, Homo sapiens
cctcccgggagcaca

SEQ ID NO: 1995253 - DNA, 16 bp, Homo sapiens
cctcccggtgcccaag

SEQ ID NO: 1995254 - DNA, 12 bp, Homo sapiens
cctccctccacc

SEQ ID NO: 1995255 - DNA, 16 bp, Homo sapiens
cctccctccaccccag

SEQ ID NO: 1995256 - DNA, 17 bp, Homo sapiens
cctccctccaccccagg

SEQ ID NO: 1995257 - DNA, 13 bp, Homo sapiens
cctccctcctctg

SEQ ID NO: 1995258 - DNA, 17 bp, Homo sapiens
cctccctcctctggccc

SEQ ID NO: 1995259 - DNA, 15 bp, Homo sapiens
cctccctctgcccca

SEQ ID NO: 1995260 - DNA, 14 bp, Homo sapiens
cctccctctgctgt

SEQ ID NO: 1995261 - DNA, 17 bp, Homo sapiens
cctccctcttccttccc

SEQ ID NO: 1995262 - DNA, 18 bp, Homo sapiens
cctccctgactccctgtg

SEQ ID NO: 1995263 - DNA, 13 bp, Homo sapiens
cctccctgcccct

SEQ ID NO: 1995264 - DNA, 21 bp, Homo sapiens
cctccctgccctgtcctccag

SEQ ID NO: 1995265 - DNA, 13 bp, Homo sapiens
cctccgccccaga

SEQ ID NO: 1995266 - DNA, 14 bp, Homo sapiens
cctccggggagagc

SEQ ID NO: 1995267 - DNA, 14 bp, Homo sapiens
cctccgtgctgggc

SEQ ID NO: 1995268 - DNA, 17 bp, Homo sapiens
cctccgtttatgggcct

SEQ ID NO: 1995269 - DNA, 19 bp, Homo sapiens
cctccgtttatgggccttg

SEQ ID NO: 1995270 - DNA, 18 bp, Homo sapiens
cctcctaagcagctggga

SEQ ID NO: 1995271 - DNA, 23 bp, Homo sapiens
cctcctaatttgatcacagtggc

SEQ ID NO: 1995272 - DNA, 22 bp, Homo sapiens
cctcctagaggtgggcagctgg

SEQ ID NO: 1995273 - DNA, 19 bp, Homo sapiens
cctcctagctccaccctca

SEQ ID NO: 1995274 - DNA, 18 bp, Homo sapiens
cctcctccacagtgctgc

SEQ ID NO: 1995275 - DNA, 13 bp, Homo sapiens
cctcctccactca

SEQ ID NO: 1995276 - DNA, 12 bp, Homo sapiens
cctcctcccacc

SEQ ID NO: 1995277 - DNA, 13 bp, Homo sapiens
cctcctcccacca

SEQ ID NO: 1995278 - DNA, 20 bp, Homo sapiens
cctcctccccttcctgcacc

SEQ ID NO: 1995279 - DNA, 15 bp, Homo sapiens
cctcctcctttgcct

SEQ ID NO: 1995280 - DNA, 15 bp, Homo sapiens
cctcctctctgccac

SEQ ID NO: 1995281 - DNA, 18 bp, Homo sapiens
cctcctctctgccaccac

SEQ ID NO: 1995282 - DNA, 15 bp, Homo sapiens
cctcctctgcttgca

SEQ ID NO: 1995283 - DNA, 15 bp, Homo sapiens
cctcctctgtccagg

SEQ ID NO: 1995284 - DNA, 16 bp, Homo sapiens
cctcctctgtccaggg

SEQ ID NO: 1995285 - DNA, 15 bp, Homo sapiens
cctcctgaagcctct

SEQ ID NO: 1995286 - DNA, 12 bp, Homo sapiens
cctcctgcccag

SEQ ID NO: 1995287 - DNA, 21 bp, Homo sapiens
cctcctgcccaggagagccag

SEQ ID NO: 1995288 - DNA, 23 bp, Homo sapiens
cctcctgcccaggagagccagcc

SEQ ID NO: 1995289 - DNA, 12 bp, Homo sapiens
cctcctgcctct

SEQ ID NO: 1995290 - DNA, 13 bp, Homo sapiens
cctcctgcctcta

SEQ ID NO: 1995291 - DNA, 14 bp, Homo sapiens
cctcctggccagac

SEQ ID NO: 1995292 - DNA, 17 bp, Homo sapiens
cctcctggccagacgct

SEQ ID NO: 1995293 - DNA, 14 bp, Homo sapiens
cctcctgtccagca

SEQ ID NO: 1995294 - DNA, 16 bp, Homo sapiens
cctccttataagccca

SEQ ID NO: 1995295 - DNA, 16 bp, Homo sapiens
cctccttatttatcaa

SEQ ID NO: 1995296 - DNA, 16 bp, Homo sapiens
cctccttcccgccgcc

SEQ ID NO: 1995297 - DNA, 13 bp, Homo sapiens
cctccttcccttc

SEQ ID NO: 1995298 - DNA, 19 bp, Homo sapiens
cctccttcccttctctcct

SEQ ID NO: 1995299 - DNA, 14 bp, Homo sapiens
cctccttctgctgc

SEQ ID NO: 1995300 - DNA, 18 bp, Homo sapiens
cctccttcttcagggact

SEQ ID NO: 1995301 - DNA, 17 bp, Homo sapiens
cctccttggtgcctggc

SEQ ID NO: 1995302 - DNA, 19 bp, Homo sapiens
cctcctttgcctaggaggc

SEQ ID NO: 1995303 - DNA, 15 bp, Homo sapiens
cctcgaaccaaggca

SEQ ID NO: 1995304 - DNA, 20 bp, Homo sapiens
cctcgaaccaaggcagcctc

SEQ ID NO: 1995305 - DNA, 22 bp, Homo sapiens
cctcgaaccaaggcagcctcca

SEQ ID NO: 1995306 - DNA, 23 bp, Homo sapiens
cctcgaaccaaggcagcctccag

SEQ ID NO: 1995307 - DNA, 15 bp, Homo sapiens
cctcgaactggctgc

SEQ ID NO: 1995308 - DNA, 22 bp, Homo sapiens
cctcgaggcaccggcgctgcag

SEQ ID NO: 1995309 - DNA, 15 bp, Homo sapiens
cctcgcaggtctcag

SEQ ID NO: 1995310 - DNA, 19 bp, Homo sapiens
cctcgcaggtctcagcccg

SEQ ID NO: 1995311 - DNA, 18 bp, Homo sapiens
cctcgcatgccagagcct

SEQ ID NO: 1995312 - DNA, 22 bp, Homo sapiens
cctcgcatgccagagcctgggg

SEQ ID NO: 1995313 - DNA, 17 bp, Homo sapiens
cctcgccacggggaggg

SEQ ID NO: 1995314 - DNA, 12 bp, Homo sapiens
cctcgccctggg

SEQ ID NO: 1995315 - DNA, 14 bp, Homo sapiens
cctcgccctgggtc

SEQ ID NO: 1995316 - DNA, 17 bp, Homo sapiens
cctcgccggccttgttt

SEQ ID NO: 1995317 - DNA, 13 bp, Homo sapiens
cctcgcctgggcc

SEQ ID NO: 1995318 - DNA, 19 bp, Homo sapiens
cctcgccttttaggctcag

SEQ ID NO: 1995319 - DNA, 21 bp, Homo sapiens
cctcgctccccactctgctct

SEQ ID NO: 1995320 - DNA, 23 bp, Homo sapiens
cctcgctccccactctgctctga

SEQ ID NO: 1995321 - DNA, 22 bp, Homo sapiens
cctcggaagccgtctgactcca

SEQ ID NO: 1995322 - DNA, 17 bp, Homo sapiens
cctcggatcaccgagag

SEQ ID NO: 1995323 - DNA, 15 bp, Homo sapiens
cctcggtactcccat

SEQ ID NO: 1995324 - DNA, 20 bp, Homo sapiens
cctcggtgatgcggacatct

SEQ ID NO: 1995325 - DNA, 20 bp, Homo sapiens
cctcggtggccatgcttctt

SEQ ID NO: 1995326 - DNA, 17 bp, Homo sapiens
cctcgtaccagccagga

SEQ ID NO: 1995327 - DNA, 18 bp, Homo sapiens
cctcgtaccagccaggat

SEQ ID NO: 1995328 - DNA, 17 bp, Homo sapiens
cctcgtccacaggggca

SEQ ID NO: 1995329 - DNA, 18 bp, Homo sapiens
cctcgtccacaggggcag

SEQ ID NO: 1995330 - DNA, 22 bp, Homo sapiens
cctcgtccacaggggcaggcct

SEQ ID NO: 1995331 - DNA, 15 bp, Homo sapiens
cctcgtcctccccct

SEQ ID NO: 1995332 - DNA, 16 bp, Homo sapiens
cctcgtcctccccctg

SEQ ID NO: 1995333 - DNA, 21 bp, Homo sapiens
cctctaacccccagtgccaca

SEQ ID NO: 1995334 - DNA, 23 bp, Homo sapiens
cctctaacccccagtgccacaga

SEQ ID NO: 1995335 - DNA, 21 bp, Homo sapiens
cctctaattctcttacccaga

SEQ ID NO: 1995336 - DNA, 22 bp, Homo sapiens
cctctaattctcttacccagaa

SEQ ID NO: 1995337 - DNA, 14 bp, Homo sapiens
cctctactgggaag

SEQ ID NO: 1995338 - DNA, 16 bp, Homo sapiens
cctctactgggaaggc

SEQ ID NO: 1995339 - DNA, 22 bp, Homo sapiens
cctctactgggaaggctacttc

SEQ ID NO: 1995340 - DNA, 21 bp, Homo sapiens
cctctagaacacccactggcc

SEQ ID NO: 1995341 - DNA, 13 bp, Homo sapiens
cctctagtgccct

SEQ ID NO: 1995342 - DNA, 17 bp, Homo sapiens
cctctagtgctactgct

SEQ ID NO: 1995343 - DNA, 19 bp, Homo sapiens
cctggcctgagctggggcc

SEQ ID NO: 1995344 - DNA, 12 bp, Homo sapiens
cctggcctgctg

SEQ ID NO: 1995345 - DNA, 13 bp, Homo sapiens
cctggcctgctgg

SEQ ID NO: 1995346 - DNA, 12 bp, Homo sapiens
cctggcctggca

SEQ ID NO: 1995347 - DNA, 19 bp, Homo sapiens
cctggcctggcacacatca

SEQ ID NO: 1995348 - DNA, 16 bp, Homo sapiens
cctggcctggctcccc

SEQ ID NO: 1995349 - DNA, 14 bp, Homo sapiens
cctggcctggctct

SEQ ID NO: 1995350 - DNA, 16 bp, Homo sapiens
cctggcctggctctcc

SEQ ID NO: 1995351 - DNA, 18 bp, Homo sapiens
cctggccttcagtgtacc

SEQ ID NO: 1995352 - DNA, 18 bp, Homo sapiens
cctggccttgtcaggacc

SEQ ID NO: 1995353 - DNA, 19 bp, Homo sapiens
cctggccttgtcaggaccc

SEQ ID NO: 1995354 - DNA, 21 bp, Homo sapiens
cctggccttgtcaggacccag

SEQ ID NO: 1995355 - DNA, 23 bp, Homo sapiens
cctggccttgtcaggacccaggc

SEQ ID NO: 1995356 - DNA, 18 bp, Homo sapiens
cctggcggggcaggaggc

SEQ ID NO: 1995357 - DNA, 22 bp, Homo sapiens
cctggctccccacgagtcacct

SEQ ID NO: 1995358 - DNA, 16 bp, Homo sapiens
cctggctctcagaagg

SEQ ID NO: 1995359 - DNA, 23 bp, Homo sapiens
cctggctgaccccaaagagcctg

SEQ ID NO: 1995360 - DNA, 16 bp, Homo sapiens
cctggctgccaggcgt

SEQ ID NO: 1995361 - DNA, 19 bp, Homo sapiens
cctggctgctctcatgcct

SEQ ID NO: 1995362 - DNA, 22 bp, Homo sapiens
cctggctgctctcatgcctgcc

SEQ ID NO: 1995363 - DNA, 17 bp, Homo sapiens
cctggctggctgagggc

SEQ ID NO: 1995364 - DNA, 16 bp, Homo sapiens
cctggctgtggaggcc

SEQ ID NO: 1995365 - DNA, 21 bp, Homo sapiens
cctggctgtggaggcctgatg

SEQ ID NO: 1995366 - DNA, 14 bp, Homo sapiens
cctggcttctggag

SEQ ID NO: 1995367 - DNA, 21 bp, Homo sapiens
cctggcttgcttgccgagcct

SEQ ID NO: 1995368 - DNA, 18 bp, Homo sapiens
cctggcttttcactgctg

SEQ ID NO: 1995369 - DNA, 18 bp, Homo sapiens
cctgggaaaacagaggaa

SEQ ID NO: 1995370 - DNA, 19 bp, Homo sapiens
cctgggaaaacagaggaat

SEQ ID NO: 1995371 - DNA, 21 bp, Homo sapiens
cctgggaaaggaaaaccaggg

SEQ ID NO: 1995372 - DNA, 23 bp, Homo sapiens
cctgggaaaggacccacccatct

SEQ ID NO: 1995373 - DNA, 17 bp, Homo sapiens
cctgggaaatttctact

SEQ ID NO: 1995374 - DNA, 16 bp, Homo sapiens
cctgggaccagggcat

SEQ ID NO: 1995375 - DNA, 13 bp, Homo sapiens
cctgggacccagc

SEQ ID NO: 1995376 - DNA, 17 bp, Homo sapiens
cctgggactcccagtga

SEQ ID NO: 1995377 - DNA, 14 bp, Homo sapiens
cctgggaggcggag

SEQ ID NO: 1995378 - DNA, 23 bp, Homo sapiens
cctgggaggcggagagtacagtg

SEQ ID NO: 1995379 - DNA, 18 bp, Homo sapiens
cctgggagtgagctggtt

SEQ ID NO: 1995380 - DNA, 16 bp, Homo sapiens
cctgggatgggaccag

SEQ ID NO: 1995381 - DNA, 18 bp, Homo sapiens
cctgggattcaggaaaag

SEQ ID NO: 1995382 - DNA, 19 bp, Homo sapiens
cctgggcacccacctccac

SEQ ID NO: 1995383 - DNA, 13 bp, Homo sapiens
cctgggcagaaag

SEQ ID NO: 1995384 - DNA, 13 bp, Homo sapiens
cctgggccagaga

SEQ ID NO: 1995385 - DNA, 19 bp, Homo sapiens
cctgggcccaggctctggg

SEQ ID NO: 1995386 - DNA, 20 bp, Homo sapiens
cctgggcccaggctctggga

SEQ ID NO: 1995387 - DNA, 15 bp, Homo sapiens
cctgggccccaccac

SEQ ID NO: 1995388 - DNA, 22 bp, Homo sapiens
cctgggcccgctttgcctgctt

SEQ ID NO: 1995389 - DNA, 20 bp, Homo sapiens
cctgggccctggggcctgta

SEQ ID NO: 1995390 - DNA, 19 bp, Homo sapiens
cctgggcctatggagagcc

SEQ ID NO: 1995391 - DNA, 15 bp, Homo sapiens
cctgggcctgctgct

SEQ ID NO: 1995392 - DNA, 12 bp, Homo sapiens
cctgggcctgtc

SEQ ID NO: 1995393 - DNA, 13 bp, Homo sapiens
cctgggcctgtcc

SEQ ID NO: 1995394 - DNA, 15 bp, Homo sapiens
cctgggcctgtcccc

SEQ ID NO: 1995395 - DNA, 15 bp, Homo sapiens
cctgggcctgtgcag

SEQ ID NO: 1995396 - DNA, 21 bp, Homo sapiens
cctgggcctgtgcagcagccc

SEQ ID NO: 1995397 - DNA, 15 bp, Homo sapiens
cctgggccttacctc

SEQ ID NO: 1995398 - DNA, 12 bp, Homo sapiens
cctgggctctgc

SEQ ID NO: 1995399 - DNA, 17 bp, Homo sapiens
cctgggctgtctgtcac

SEQ ID NO: 1995400 - DNA, 23 bp, Homo sapiens
cctggggattgggagggacaggg

SEQ ID NO: 1995401 - DNA, 17 bp, Homo sapiens
cctggggccccgctggg

SEQ ID NO: 1995402 - DNA, 22 bp, Homo sapiens
cctggggcctcggagcctcatc

SEQ ID NO: 1995403 - DNA, 20 bp, Homo sapiens
cctggggcctgtactgcctg

SEQ ID NO: 1995404 - DNA, 21 bp, Homo sapiens
cctggggcctgtactgcctgc

SEQ ID NO: 1995405 - DNA, 23 bp, Homo sapiens
cctggggcctgtactgcctgctt

SEQ ID NO: 1995406 - DNA, 15 bp, Homo sapiens
cctggggctcctttc

SEQ ID NO: 1995407 - DNA, 22 bp, Homo sapiens
cctggggctctaacgcctgagc

SEQ ID NO: 1995408 - DNA, 18 bp, Homo sapiens
cctggggctctgtgcagg

SEQ ID NO: 1995409 - DNA, 18 bp, Homo sapiens
cctggggcttctcctgac

SEQ ID NO: 1995410 - DNA, 16 bp, Homo sapiens
cctgggggaagccctg

SEQ ID NO: 1995411 - DNA, 17 bp, Homo sapiens
cctgggggaagccctgg

SEQ ID NO: 1995412 - DNA, 14 bp, Homo sapiens
cctgggggcagtga

SEQ ID NO: 1995413 - DNA, 19 bp, Homo sapiens
cctgggggcagtgactggc

SEQ ID NO: 1995414 - DNA, 22 bp, Homo sapiens
cctgggggcagtgactggcagg

SEQ ID NO: 1995415 - DNA, 21 bp, Homo sapiens
cctgggggccagctggtgctg

SEQ ID NO: 1995416 - DNA, 22 bp, Homo sapiens
cctgggggccagctggtgctgc

SEQ ID NO: 1995417 - DNA, 14 bp, Homo sapiens
cctgggggcctggc

SEQ ID NO: 1995418 - DNA, 17 bp, Homo sapiens
cctgggggcctggctgg

SEQ ID NO: 1995419 - DNA, 19 bp, Homo sapiens
cctgggggcctggctggct

SEQ ID NO: 1995420 - DNA, 18 bp, Homo sapiens
cctgggggttctttcttc

SEQ ID NO: 1995421 - DNA, 21 bp, Homo sapiens
cctgggggttctttcttcctc

SEQ ID NO: 1995422 - DNA, 20 bp, Homo sapiens
cctgggtcctgttccctacc

SEQ ID NO: 1995423 - DNA, 19 bp, Homo sapiens
cctgggtgacttcaggtgg

SEQ ID NO: 1995424 - DNA, 21 bp, Homo sapiens
cctgggtgagaatcctgcctc

SEQ ID NO: 1995425 - DNA, 23 bp, Homo sapiens
cctgggtgagaatcctgcctctc

SEQ ID NO: 1995426 - DNA, 22 bp, Homo sapiens
cctgggtgccattcccagcgtt

SEQ ID NO: 1995427 - DNA, 19 bp, Homo sapiens
cctgggtggctactctgtg

SEQ ID NO: 1995428 - DNA, 20 bp, Homo sapiens
cctgggtggctactctgtgc

SEQ ID NO: 1995429 - DNA, 21 bp, Homo sapiens
cctgggtggctactctgtgcc

SEQ ID NO: 1995430 - DNA, 23 bp, Homo sapiens
cctgggtggctactctgtgccag

SEQ ID NO: 1995431 - DNA, 16 bp, Homo sapiens
cctgggtggggctgct

SEQ ID NO: 1995432 - DNA, 17 bp, Homo sapiens
cctgggtggggctgctc

SEQ ID NO: 1995433 - DNA, 20 bp, Homo sapiens
cctgggtggggctgctcctc

SEQ ID NO: 1995434 - DNA, 18 bp, Homo sapiens
cctgggttttctaactgt

SEQ ID NO: 1995435 - DNA, 15 bp, Homo sapiens
cctggtacagcaggg

SEQ ID NO: 1995436 - DNA, 16 bp, Homo sapiens
cctggtaggaaagcac

SEQ ID NO: 1995437 - DNA, 19 bp, Homo sapiens
cctggtccctcgtccacag

SEQ ID NO: 1995438 - DNA, 16 bp, Homo sapiens
cctggtctgctcagga

SEQ ID NO: 1995439 - DNA, 16 bp, Homo sapiens
cctggtcttgagatgt

SEQ ID NO: 1995440 - DNA, 16 bp, Homo sapiens
cctggtctttcctctg

SEQ ID NO: 1995441 - DNA, 20 bp, Homo sapiens
cctggtgaggcccagcctgt

SEQ ID NO: 1995442 - DNA, 20 bp, Homo sapiens
cctggtgcactggccccacc

SEQ ID NO: 1995443 - DNA, 21 bp, Homo sapiens
cctggtgcccccgcccctggt

SEQ ID NO: 1995444 - DNA, 15 bp, Homo sapiens
cctggtgctgccaca

SEQ ID NO: 1995445 - DNA, 12 bp, Homo sapiens
cctggtggacag

SEQ ID NO: 1995446 - DNA, 20 bp, Homo sapiens
cctggtggacagtcctggga

SEQ ID NO: 1995447 - DNA, 18 bp, Homo sapiens
cctggtggcaccagatgc

SEQ ID NO: 1995448 - DNA, 15 bp, Homo sapiens
cctggtggcagctgc

SEQ ID NO: 1995449 - DNA, 14 bp, Homo sapiens
cctggtgggcctcc

SEQ ID NO: 1995450 - DNA, 15 bp, Homo sapiens
cctggtggggcagct

SEQ ID NO: 1995451 - DNA, 14 bp, Homo sapiens
cctggtgtcaggca

SEQ ID NO: 1995452 - DNA, 23 bp, Homo sapiens
cctggtgtgaggctgggccagcc

SEQ ID NO: 1995453 - DNA, 18 bp, Homo sapiens
cctggtttctgttctgtt

SEQ ID NO: 1995454 - DNA, 19 bp, Homo sapiens
cctgtaacacaagccacag

SEQ ID NO: 1995455 - DNA, 21 bp, Homo sapiens
cctgtaacacaagccacagaa

SEQ ID NO: 1995456 - DNA, 18 bp, Homo sapiens
cctgtaatcccagcactt

SEQ ID NO: 1995457 - DNA, 21 bp, Homo sapiens
cgattccctctcccaggcccc

SEQ ID NO: 1995458 - DNA, 19 bp, Homo sapiens
cgattcttctgcttcagcc

SEQ ID NO: 1995459 - DNA, 18 bp, Homo sapiens
cgattcttgtgcctcagc

SEQ ID NO: 1995460 - DNA, 13 bp, Homo sapiens
cgattggctttaa

SEQ ID NO: 1995461 - DNA, 19 bp, Homo sapiens
cgcaaagggctgaaagcca

SEQ ID NO: 1995462 - DNA, 20 bp, Homo sapiens
cgcaacccttgctgctgccc

SEQ ID NO: 1995463 - DNA, 13 bp, Homo sapiens
cgcaaggccctgt

SEQ ID NO: 1995464 - DNA, 14 bp, Homo sapiens
cgcaaggccctgtc

SEQ ID NO: 1995465 - DNA, 15 bp, Homo sapiens
cgcaaggccctgtcc

SEQ ID NO: 1995466 - DNA, 16 bp, Homo sapiens
cgcaaggccctgtccc

SEQ ID NO: 1995467 - DNA, 17 bp, Homo sapiens
cgcaaggccctgtccca

SEQ ID NO: 1995468 - DNA, 16 bp, Homo sapiens
cgcaagggagaagaaa

SEQ ID NO: 1995469 - DNA, 22 bp, Homo sapiens
cgcaagggagaagaaatccata

SEQ ID NO: 1995470 - DNA, 18 bp, Homo sapiens
cgcaagggcatcaggcac

SEQ ID NO: 1995471 - DNA, 19 bp, Homo sapiens
cgcaagggcatcaggcact

SEQ ID NO: 1995472 - DNA, 20 bp, Homo sapiens
cgcaagggcatcaggcactg

SEQ ID NO: 1995473 - DNA, 16 bp, Homo sapiens
cgcacaaggctgacca

SEQ ID NO: 1995474 - DNA, 21 bp, Homo sapiens
cgcacagattacttcagggct

SEQ ID NO: 1995475 - DNA, 16 bp, Homo sapiens
cgcaccagctgctctg

SEQ ID NO: 1995476 - DNA, 23 bp, Homo sapiens
cgcaccagctgctctgccccttg

SEQ ID NO: 1995477 - DNA, 16 bp, Homo sapiens
cgcacctgccccctgg

SEQ ID NO: 1995478 - DNA, 22 bp, Homo sapiens
cgcaccttgtcatgtaccatca

SEQ ID NO: 1995479 - DNA, 16 bp, Homo sapiens
cgcaccttttatacca

SEQ ID NO: 1995480 - DNA, 12 bp, Homo sapiens
cgcactgtggat

SEQ ID NO: 1995481 - DNA, 12 bp, Homo sapiens
cgcagagcccac

SEQ ID NO: 1995482 - DNA, 19 bp, Homo sapiens
cgcagaggcggaaaccttg

SEQ ID NO: 1995483 - DNA, 15 bp, Homo sapiens
cgcagcaggtgcaag

SEQ ID NO: 1995484 - DNA, 13 bp, Homo sapiens
cgcagcatgtggg

SEQ ID NO: 1995485 - DNA, 11 bp, Homo sapiens
cgcagccaccc

SEQ ID NO: 1995486 - DNA, 17 bp, Homo sapiens
cgcagccaccctgagga

SEQ ID NO: 1995487 - DNA, 22 bp, Homo sapiens
cgcagccaccctgaggagtctg

SEQ ID NO: 1995488 - DNA, 16 bp, Homo sapiens
cgcagcccgaagccca

SEQ ID NO: 1995489 - DNA, 17 bp, Homo sapiens
cgcagcccgaagcccag

SEQ ID NO: 1995490 - DNA, 18 bp, Homo sapiens
cgcagcccgaagcccagt

SEQ ID NO: 1995491 - DNA, 21 bp, Homo sapiens
cgcagccctgggggccagctg

SEQ ID NO: 1995492 - DNA, 24 bp, Homo sapiens
cgcagcctggcggggcaggaggcc

SEQ ID NO: 1995493 - DNA, 15 bp, Homo sapiens
cgcaggaactcccag

SEQ ID NO: 1995494 - DNA, 13 bp, Homo sapiens
cgcaggaaggcag

SEQ ID NO: 1995495 - DNA, 18 bp, Homo sapiens
cgcaggcccccaggtgcc

SEQ ID NO: 1995496 - DNA, 16 bp, Homo sapiens
cgcagggacagaactg

SEQ ID NO: 1995497 - DNA, 16 bp, Homo sapiens
cgcagggaggatgcca

SEQ ID NO: 1995498 - DNA, 21 bp, Homo sapiens
cgcagggaggatgccacagcc

SEQ ID NO: 1995499 - DNA, 22 bp, Homo sapiens
cgcagggaggatgccacagccc

SEQ ID NO: 1995500 - DNA, 16 bp, Homo sapiens
cgcagtccccagccct

SEQ ID NO: 1995501 - DNA, 17 bp, Homo sapiens
cgcagtccccagccctt

SEQ ID NO: 1995502 - DNA, 13 bp, Homo sapiens
cgcatcttctcca

SEQ ID NO: 1995503 - DNA, 15 bp, Homo sapiens
cgcatcttctccatc

SEQ ID NO: 1995504 - DNA, 16 bp, Homo sapiens
cgcatcttctccatct

SEQ ID NO: 1995505 - DNA, 15 bp, Homo sapiens
cgcatgccctcaatc

SEQ ID NO: 1995506 - DNA, 12 bp, Homo sapiens
cgcattgtacac

SEQ ID NO: 1995507 - DNA, 20 bp, Homo sapiens
cgccaaagtgcagcccttcc

SEQ ID NO: 1995508 - DNA, 14 bp, Homo sapiens
cgccaacagccccc

SEQ ID NO: 1995509 - DNA, 21 bp, Homo sapiens
cgccacacccggctccccctg

SEQ ID NO: 1995510 - DNA, 13 bp, Homo sapiens
cgccaccatcctg

SEQ ID NO: 1995511 - DNA, 23 bp, Homo sapiens
cgccaccatcctgcagcctcctc

SEQ ID NO: 1995512 - DNA, 14 bp, Homo sapiens
cgccacgaggagct

SEQ ID NO: 1995513 - DNA, 15 bp, Homo sapiens
cgccacggccaccct

SEQ ID NO: 1995514 - DNA, 17 bp, Homo sapiens
cgccactcatttcatct

SEQ ID NO: 1995515 - DNA, 21 bp, Homo sapiens
cgccactcatttcatctcatt

SEQ ID NO: 1995516 - DNA, 22 bp, Homo sapiens
cgccactgcactccagcctggg

SEQ ID NO: 1995517 - DNA, 19 bp, Homo sapiens
cgccagcctcagtgccact

SEQ ID NO: 1995518 - DNA, 20 bp, Homo sapiens
cgccagcctcagtgccactt

SEQ ID NO: 1995519 - DNA, 17 bp, Homo sapiens
cgccaggaggtcctcct

SEQ ID NO: 1995520 - DNA, 18 bp, Homo sapiens
cgccaggaggtcctcctc

SEQ ID NO: 1995521 - DNA, 20 bp, Homo sapiens
cgccatccgggacgcttcca

SEQ ID NO: 1995522 - DNA, 21 bp, Homo sapiens
cgccatccgggacgcttccag

SEQ ID NO: 1995523 - DNA, 22 bp, Homo sapiens
cgccatccgggacgcttccaga

SEQ ID NO: 1995524 - DNA, 20 bp, Homo sapiens
cgccatccttcaccagagcc

SEQ ID NO: 1995525 - DNA, 14 bp, Homo sapiens
cgcccaaggggact

SEQ ID NO: 1995526 - DNA, 22 bp, Homo sapiens
cgcccacaagccttactcacct

SEQ ID NO: 1995527 - DNA, 21 bp, Homo sapiens
cgcccacctagtgcttccact

SEQ ID NO: 1995528 - DNA, 18 bp, Homo sapiens
cgcccagctgcacctgcc

SEQ ID NO: 1995529 - DNA, 12 bp, Homo sapiens
cgcccagtctgg

SEQ ID NO: 1995530 - DNA, 19 bp, Homo sapiens
cgcccattcgtctgtccca

SEQ ID NO: 1995531 - DNA, 23 bp, Homo sapiens
cgcccattcgtctgtcccagagc

SEQ ID NO: 1995532 - DNA, 13 bp, Homo sapiens
cgccccccacctt

SEQ ID NO: 1995533 - DNA, 18 bp, Homo sapiens
cgcccctcgctgctgcta

SEQ ID NO: 1995534 - DNA, 16 bp, Homo sapiens
cgccctaccctcactc

SEQ ID NO: 1995535 - DNA, 22 bp, Homo sapiens
cgccctctgcgtcccccagccc

SEQ ID NO: 1995536 - DNA, 12 bp, Homo sapiens
cgccctgcagac

SEQ ID NO: 1995537 - DNA, 19 bp, Homo sapiens
cgccctgcgttggagccac

SEQ ID NO: 1995538 - DNA, 21 bp, Homo sapiens
cgccctgcgttggagccactc

SEQ ID NO: 1995539 - DNA, 21 bp, Homo sapiens
cgccctggagtcccctgggcc

SEQ ID NO: 1995540 - DNA, 18 bp, Homo sapiens
cgccctgggctgtctgtc

SEQ ID NO: 1995541 - DNA, 16 bp, Homo sapiens
cgccgggcaggcctgc

SEQ ID NO: 1995542 - DNA, 22 bp, Homo sapiens
cgccgtgttactgttgcactga

SEQ ID NO: 1995543 - DNA, 11 bp, Homo sapiens
cgcctcccagc

SEQ ID NO: 1995544 - DNA, 12 bp, Homo sapiens
cgcctcccagcc

SEQ ID NO: 1995545 - DNA, 13 bp, Homo sapiens
cgcctccctccac

SEQ ID NO: 1995546 - DNA, 21 bp, Homo sapiens
cgcctgagcccaggaggtgga

SEQ ID NO: 1995547 - DNA, 15 bp, Homo sapiens
cgcctgagcccaggg

SEQ ID NO: 1995548 - DNA, 16 bp, Homo sapiens
cgcctgagcccaggga

SEQ ID NO: 1995549 - DNA, 18 bp, Homo sapiens
cgcctgagcccagggagg

SEQ ID NO: 1995550 - DNA, 19 bp, Homo sapiens
cgcctgccataccgctggg

SEQ ID NO: 1995551 - DNA, 23 bp, Homo sapiens
cgcctgccataccgctggggaac

SEQ ID NO: 1995552 - DNA, 17 bp, Homo sapiens
cgcctggccggctccag

SEQ ID NO: 1995553 - DNA, 23 bp, Homo sapiens
cgcctgggcccaggctctgggaa

SEQ ID NO: 1995554 - DNA, 16 bp, Homo sapiens
cgcctgtaatcccagc

SEQ ID NO: 1995555 - DNA, 18 bp, Homo sapiens
cgcctgtaatcccagcag

SEQ ID NO: 1995556 - DNA, 15 bp, Homo sapiens
cgcctgtagtcccag

SEQ ID NO: 1995557 - DNA, 20 bp, Homo sapiens
cgcctgtagtcctagccact

SEQ ID NO: 1995558 - DNA, 15 bp, Homo sapiens
cgcctgtgcccacgt

SEQ ID NO: 1995559 - DNA, 18 bp, Homo sapiens
cgcctgtgctgaggactc

SEQ ID NO: 1995560 - DNA, 22 bp, Homo sapiens
cgccttcactccggtgtgcctg

SEQ ID NO: 1995561 - DNA, 22 bp, Homo sapiens
cgccttcctcctccacagtgct

SEQ ID NO: 1995562 - DNA, 18 bp, Homo sapiens
cgcgaagtgggcattgca

SEQ ID NO: 1995563 - DNA, 12 bp, Homo sapiens
cgcgcacacaca

SEQ ID NO: 1995564 - DNA, 22 bp, Homo sapiens
cgcgcagcgcgtgcacagcgcg

SEQ ID NO: 1995565 - DNA, 18 bp, Homo sapiens
cgcgcatgtaatcccagc

SEQ ID NO: 1995566 - DNA, 22 bp, Homo sapiens
cgcgcatgtaatcccagctact

SEQ ID NO: 1995567 - DNA, 22 bp, Homo sapiens
cgcgccactacactccagcctg

SEQ ID NO: 1995568 - DNA, 23 bp, Homo sapiens
cgcgccactacactccagcctga

SEQ ID NO: 1995569 - DNA, 15 bp, Homo sapiens
cgcggcttggccgcc

SEQ ID NO: 1995570 - DNA, 16 bp, Homo sapiens
cgcggcttggccgcca

SEQ ID NO: 1995571 - DNA, 14 bp, Homo sapiens
cgtggagggtaggg

SEQ ID NO: 1995572 - DNA, 21 bp, Homo sapiens
cgtggagggtaggggagtgtg

SEQ ID NO: 1995573 - DNA, 22 bp, Homo sapiens
cgtggcagataatcagcctctt

SEQ ID NO: 1995574 - DNA, 15 bp, Homo sapiens
cgtggccctgccctc

SEQ ID NO: 1995575 - DNA, 18 bp, Homo sapiens
cgtggccctgccctctcc

SEQ ID NO: 1995576 - DNA, 14 bp, Homo sapiens
cgtggcccttcctg

SEQ ID NO: 1995577 - DNA, 15 bp, Homo sapiens
cgtggcccttcctgg

SEQ ID NO: 1995578 - DNA, 18 bp, Homo sapiens
cgtggcccttcctggaca

SEQ ID NO: 1995579 - DNA, 20 bp, Homo sapiens
cgtggcccttcctggacagc

SEQ ID NO: 1995580 - DNA, 22 bp, Homo sapiens
cgtggcctgcggccgggctgcc

SEQ ID NO: 1995581 - DNA, 23 bp, Homo sapiens
cgtggctgtgctctcaccagctg

SEQ ID NO: 1995582 - DNA, 17 bp, Homo sapiens
cgtggctgtggcacaga

SEQ ID NO: 1995583 - DNA, 20 bp, Homo sapiens
cgtggcttcccgctcagccc

SEQ ID NO: 1995584 - DNA, 17 bp, Homo sapiens
cgtgggtatttcctgct

SEQ ID NO: 1995585 - DNA, 14 bp, Homo sapiens
cgtggtagaagcca

SEQ ID NO: 1995586 - DNA, 17 bp, Homo sapiens
cgtggtagaagccagta

SEQ ID NO: 1995587 - DNA, 13 bp, Homo sapiens
cgtggtccagctc

SEQ ID NO: 1995588 - DNA, 14 bp, Homo sapiens
cgtggtctttgaat

SEQ ID NO: 1995589 - DNA, 23 bp, Homo sapiens
cgtgtagtggaagagcagcctga

SEQ ID NO: 1995590 - DNA, 22 bp, Homo sapiens
cgtgtcaatgaatgccggggac

SEQ ID NO: 1995591 - DNA, 21 bp, Homo sapiens
cgtgtccagcacagaaggaat

SEQ ID NO: 1995592 - DNA, 17 bp, Homo sapiens
cgtgtccgactcttctg

SEQ ID NO: 1995593 - DNA, 17 bp, Homo sapiens
cgtgtcctacagcctca

SEQ ID NO: 1995594 - DNA, 13 bp, Homo sapiens
cgtgtcctgcctt

SEQ ID NO: 1995595 - DNA, 14 bp, Homo sapiens
cgtgtctctcccac

SEQ ID NO: 1995596 - DNA, 19 bp, Homo sapiens
cgtgtgcagactgtggctg

SEQ ID NO: 1995597 - DNA, 19 bp, Homo sapiens
cgtgttactgttgcactga

SEQ ID NO: 1995598 - DNA, 21 bp, Homo sapiens
cgtgttaggaggctgcatgct

SEQ ID NO: 1995599 - DNA, 18 bp, Homo sapiens
cgtgttagtgtgtgtgca

SEQ ID NO: 1995600 - DNA, 13 bp, Homo sapiens
cgtgtttacaaaa

SEQ ID NO: 1995601 - DNA, 14 bp, Homo sapiens
cgtgtttacaaaag

SEQ ID NO: 1995602 - DNA, 15 bp, Homo sapiens
cgttaaaagacagtg

SEQ ID NO: 1995603 - DNA, 20 bp, Homo sapiens
cgttaacactacttaaaagt

SEQ ID NO: 1995604 - DNA, 20 bp, Homo sapiens
cgttaagggaaggaactctg

SEQ ID NO: 1995605 - DNA, 22 bp, Homo sapiens
cgttatgtgtgtatatgtatgt

SEQ ID NO: 1995606 - DNA, 19 bp, Homo sapiens
cgttccccttggcttcctc

SEQ ID NO: 1995607 - DNA, 21 bp, Homo sapiens
cgttccccttggcttcctccg

SEQ ID NO: 1995608 - DNA, 19 bp, Homo sapiens
cgttccgtcccaaacagag

SEQ ID NO: 1995609 - DNA, 15 bp, Homo sapiens
cgttctccagcccac

SEQ ID NO: 1995610 - DNA, 19 bp, Homo sapiens
cgttctccagcccacaccc

SEQ ID NO: 1995611 - DNA, 20 bp, Homo sapiens
cgttctccagcccacacccc

SEQ ID NO: 1995612 - DNA, 18 bp, Homo sapiens
cgttctgctgcccctgca

SEQ ID NO: 1995613 - DNA, 20 bp, Homo sapiens
cgttctgctgcccctgcagt

SEQ ID NO: 1995614 - DNA, 16 bp, Homo sapiens
cgttgacccctttccc

SEQ ID NO: 1995615 - DNA, 19 bp, Homo sapiens
cgttggaatcacctggagg

SEQ ID NO: 1995616 - DNA, 17 bp, Homo sapiens
cgtttaagccaaaacaa

SEQ ID NO: 1995617 - DNA, 20 bp, Homo sapiens
cgtttattaatgcctctccc

SEQ ID NO: 1995618 - DNA, 18 bp, Homo sapiens
cgtttattgcttaatccc

SEQ ID NO: 1995619 - DNA, 16 bp, Homo sapiens
cgtttgtgagaagaaa

SEQ ID NO: 1995620 - DNA, 20 bp, Homo sapiens
cgttttcatcctggcctcct

SEQ ID NO: 1995621 - DNA, 23 bp, Homo sapiens
cgttttgtgtggtggcacctcct

SEQ ID NO: 1995622 - DNA, 16 bp, Homo sapiens
cgtttttcaagaaaac

SEQ ID NO: 1995623 - DNA, 21 bp, Homo sapiens
cgtttttcaagaaaactggaa

SEQ ID NO: 1995624 - DNA, 15 bp, Homo sapiens
cgtttttgtgctgtg

SEQ ID NO: 1995625 - DNA, 19 bp, Homo sapiens
cgtttttgtgctgtgggca

SEQ ID NO: 1995626 - DNA, 11 bp, Homo sapiens
ctaaaaaacag

SEQ ID NO: 1995627 - DNA, 16 bp, Homo sapiens
ctaaaaataaaatgat

SEQ ID NO: 1995628 - DNA, 15 bp, Homo sapiens
ctaaaaataaaccaa

SEQ ID NO: 1995629 - DNA, 14 bp, Homo sapiens
ctaaaagaaacttt

SEQ ID NO: 1995630 - DNA, 19 bp, Homo sapiens
ctaaaagtggtttttattt

SEQ ID NO: 1995631 - DNA, 12 bp, Homo sapiens
ctaaaataaaaa

SEQ ID NO: 1995632 - DNA, 17 bp, Homo sapiens
ctaaaataaaaaccaga

SEQ ID NO: 1995633 - DNA, 13 bp, Homo sapiens
ctaaaatagccac

SEQ ID NO: 1995634 - DNA, 13 bp, Homo sapiens
ctaaaatgacagc

SEQ ID NO: 1995635 - DNA, 12 bp, Homo sapiens
ctaaacagatat

SEQ ID NO: 1995636 - DNA, 13 bp, Homo sapiens
ctaaacatcattc

SEQ ID NO: 1995637 - DNA, 23 bp, Homo sapiens
ctaaacatcattcatttttgttg

SEQ ID NO: 1995638 - DNA, 14 bp, Homo sapiens
ctaaacccaaataa

SEQ ID NO: 1995639 - DNA, 19 bp, Homo sapiens
ctaaacccaaataaatgtg

SEQ ID NO: 1995640 - DNA, 19 bp, Homo sapiens
ctaaacccccgctccagat

SEQ ID NO: 1995641 - DNA, 22 bp, Homo sapiens
ctaaacgactccgagaacaaca

SEQ ID NO: 1995642 - DNA, 20 bp, Homo sapiens
ctaaacgagtcaatcccctc

SEQ ID NO: 1995643 - DNA, 20 bp, Homo sapiens
ctaaagaaaaacaaactcgt

SEQ ID NO: 1995644 - DNA, 21 bp, Homo sapiens
ctaaagagttattcaaatgaa

SEQ ID NO: 1995645 - DNA, 20 bp, Homo sapiens
ctaaagatatcagagctctt

SEQ ID NO: 1995646 - DNA, 22 bp, Homo sapiens
ctaaagatatcagagctcttaa

SEQ ID NO: 1995647 - DNA, 22 bp, Homo sapiens
ctaaagctctgaacaaaagctt

SEQ ID NO: 1995648 - DNA, 22 bp, Homo sapiens
ctaaagtgtctattagttttct

SEQ ID NO: 1995649 - DNA, 18 bp, Homo sapiens
ctaaagtttacagtaaat

SEQ ID NO: 1995650 - DNA, 24 bp, Homo sapiens
ctaaagtttacagtaaataaattg

SEQ ID NO: 1995651 - DNA, 18 bp, Homo sapiens
ctaaatactgtacataga

SEQ ID NO: 1995652 - DNA, 13 bp, Homo sapiens
ctaaatatttcat

SEQ ID NO: 1995653 - DNA, 11 bp, Homo sapiens
ctaaatccaaa

SEQ ID NO: 1995654 - DNA, 17 bp, Homo sapiens
ctaaatcctttactgtt

SEQ ID NO: 1995655 - DNA, 11 bp, Homo sapiens
ctaaatgaagt

SEQ ID NO: 1995656 - DNA, 15 bp, Homo sapiens
ctaaatgaatgttta

SEQ ID NO: 1995657 - DNA, 16 bp, Homo sapiens
ctaaatgacctcagca

SEQ ID NO: 1995658 - DNA, 17 bp, Homo sapiens
ctaaatgcctaataaac

SEQ ID NO: 1995659 - DNA, 23 bp, Homo sapiens
ctaaatgctggtctaggagctgt

SEQ ID NO: 1995660 - DNA, 20 bp, Homo sapiens
ctaaatggctttaattatat

SEQ ID NO: 1995661 - DNA, 15 bp, Homo sapiens
ctaaattctttattt

SEQ ID NO: 1995662 - DNA, 19 bp, Homo sapiens
ctaaattctttatttctgt

SEQ ID NO: 1995663 - DNA, 14 bp, Homo sapiens
ctaacacccagtct

SEQ ID NO: 1995664 - DNA, 19 bp, Homo sapiens
ctaacactcagaagcctgg

SEQ ID NO: 1995665 - DNA, 18 bp, Homo sapiens
ctaacagggaaggcaggc

SEQ ID NO: 1995666 - DNA, 21 bp, Homo sapiens
ctaacagggaaggcaggcagg

SEQ ID NO: 1995667 - DNA, 15 bp, Homo sapiens
ctaacatatgtatta

SEQ ID NO: 1995668 - DNA, 18 bp, Homo sapiens
ctaacattttaaataaaa

SEQ ID NO: 1995669 - DNA, 21 bp, Homo sapiens
ctaacattttaaataaaagaa

SEQ ID NO: 1995670 - DNA, 12 bp, Homo sapiens
ctaaccacgctg

SEQ ID NO: 1995671 - DNA, 14 bp, Homo sapiens
ctaaccacgctgga

SEQ ID NO: 1995672 - DNA, 19 bp, Homo sapiens
ctaaccccaacgcacagga

SEQ ID NO: 1995673 - DNA, 19 bp, Homo sapiens
ctaacccccagcccacaga

SEQ ID NO: 1995674 - DNA, 19 bp, Homo sapiens
ctaacccccagtgccacag

SEQ ID NO: 1995675 - DNA, 16 bp, Homo sapiens
ctaacccctttcctgc

SEQ ID NO: 1995676 - DNA, 12 bp, Homo sapiens
ctaacctcagcc

SEQ ID NO: 1995677 - DNA, 13 bp, Homo sapiens
ctaacctcagcca

SEQ ID NO: 1995678 - DNA, 21 bp, Homo sapiens
ctaacctcagccaaacacaga

SEQ ID NO: 1995679 - DNA, 13 bp, Homo sapiens
ctaacgcctgagc

SEQ ID NO: 1995680 - DNA, 22 bp, Homo sapiens
ctaacgcctgagcccagggagg

SEQ ID NO: 1995681 - DNA, 22 bp, Homo sapiens
ctaactaaggtcccataataaa

SEQ ID NO: 1995682 - DNA, 15 bp, Homo sapiens
ctaactccttatgtt

SEQ ID NO: 1995683 - DNA, 17 bp, Homo sapiens
ctaactccttatgtttg

SEQ ID NO: 1995684 - DNA, 13 bp, Homo sapiens
ctaactggaagca

SEQ ID NO: 1995685 - DNA, 18 bp, Homo sapiens
ctatttctggcctcagca

SEQ ID NO: 1995686 - DNA, 16 bp, Homo sapiens
ctatttgttttcatgg

SEQ ID NO: 1995687 - DNA, 18 bp, Homo sapiens
ctattttaaaaccatgca

SEQ ID NO: 1995688 - DNA, 19 bp, Homo sapiens
ctattttaaaaccatgcag

SEQ ID NO: 1995689 - DNA, 12 bp, Homo sapiens
ctattttattcc

SEQ ID NO: 1995690 - DNA, 17 bp, Homo sapiens
ctattttatttgtattc

SEQ ID NO: 1995691 - DNA, 21 bp, Homo sapiens
ctattttcttacagtggagtg

SEQ ID NO: 1995692 - DNA, 22 bp, Homo sapiens
ctattttggtgaccaatactac

SEQ ID NO: 1995693 - DNA, 17 bp, Homo sapiens
ctatttttcttctaaaa

SEQ ID NO: 1995694 - DNA, 12 bp, Homo sapiens
ctatttttgtag

SEQ ID NO: 1995695 - DNA, 13 bp, Homo sapiens
ctatttttgtaga

SEQ ID NO: 1995696 - DNA, 17 bp, Homo sapiens
ctcaaaaaaagccttta

SEQ ID NO: 1995697 - DNA, 12 bp, Homo sapiens
ctcaaaaagttt

SEQ ID NO: 1995698 - DNA, 20 bp, Homo sapiens
ctcaaaacttaacatattta

SEQ ID NO: 1995699 - DNA, 20 bp, Homo sapiens
ctcaaaagcacccttgacgt

SEQ ID NO: 1995700 - DNA, 19 bp, Homo sapiens
ctcaaacatggaagatgaa

SEQ ID NO: 1995701 - DNA, 19 bp, Homo sapiens
ctcaaagcaagcattcaga

SEQ ID NO: 1995702 - DNA, 21 bp, Homo sapiens
ctcaaataaaaagtgcttttg

SEQ ID NO: 1995703 - DNA, 13 bp, Homo sapiens
ctcaaatctattc

SEQ ID NO: 1995704 - DNA, 17 bp, Homo sapiens
ctcaaatgctaaatgca

SEQ ID NO: 1995705 - DNA, 18 bp, Homo sapiens
ctcaaatgtcagagctat

SEQ ID NO: 1995706 - DNA, 16 bp, Homo sapiens
ctcaaattaatctttc

SEQ ID NO: 1995707 - DNA, 17 bp, Homo sapiens
ctcaaattgttaggaag

SEQ ID NO: 1995708 - DNA, 15 bp, Homo sapiens
ctcaacaaagcacag

SEQ ID NO: 1995709 - DNA, 17 bp, Homo sapiens
ctcaacaacaaaccaaa

SEQ ID NO: 1995710 - DNA, 12 bp, Homo sapiens
ctcaacaataaa

SEQ ID NO: 1995711 - DNA, 14 bp, Homo sapiens
ctcaacaataaaac

SEQ ID NO: 1995712 - DNA, 19 bp, Homo sapiens
ctcaacagatctgtgggcc

SEQ ID NO: 1995713 - DNA, 20 bp, Homo sapiens
ctcaacctaccaccccttcc

SEQ ID NO: 1995714 - DNA, 17 bp, Homo sapiens
ctcaacctcctgggcta

SEQ ID NO: 1995715 - DNA, 14 bp, Homo sapiens
ctcaacctctctcc

SEQ ID NO: 1995716 - DNA, 20 bp, Homo sapiens
ctcaagaagacatggagact

SEQ ID NO: 1995717 - DNA, 14 bp, Homo sapiens
ctcaagaggcccag

SEQ ID NO: 1995718 - DNA, 17 bp, Homo sapiens
ctcaagaggcccaggga

SEQ ID NO: 1995719 - DNA, 18 bp, Homo sapiens
ctcaagaggcccagggag

SEQ ID NO: 1995720 - DNA, 17 bp, Homo sapiens
ctcaagagggcactggt

SEQ ID NO: 1995721 - DNA, 15 bp, Homo sapiens
ctcaagatgacagct

SEQ ID NO: 1995722 - DNA, 20 bp, Homo sapiens
ctcaagattatattataata

SEQ ID NO: 1995723 - DNA, 13 bp, Homo sapiens
ctcaagctagcca

SEQ ID NO: 1995724 - DNA, 20 bp, Homo sapiens
ctcaagctcttccttactcc

SEQ ID NO: 1995725 - DNA, 18 bp, Homo sapiens
ctcaagtcttccctgatc

SEQ ID NO: 1995726 - DNA, 18 bp, Homo sapiens
ctcaagtgatccacctgc

SEQ ID NO: 1995727 - DNA, 19 bp, Homo sapiens
ctcaagtgatccacctgcc

SEQ ID NO: 1995728 - DNA, 22 bp, Homo sapiens
ctcaagtgggaacgactgggca

SEQ ID NO: 1995729 - DNA, 14 bp, Homo sapiens
ctcaagtttttaca

SEQ ID NO: 1995730 - DNA, 13 bp, Homo sapiens
ctcaataaaatca

SEQ ID NO: 1995731 - DNA, 23 bp, Homo sapiens
ctcaataaaatcatgtacatttc

SEQ ID NO: 1995732 - DNA, 16 bp, Homo sapiens
ctcaatattcaataaa

SEQ ID NO: 1995733 - DNA, 17 bp, Homo sapiens
ctcaatattcaataaag

SEQ ID NO: 1995734 - DNA, 18 bp, Homo sapiens
ctcaatattcaataaagc

SEQ ID NO: 1995735 - DNA, 18 bp, Homo sapiens
ctcaatattttccatgaa

SEQ ID NO: 1995736 - DNA, 22 bp, Homo sapiens
ctcaatattttccatgaaaatg

SEQ ID NO: 1995737 - DNA, 23 bp, Homo sapiens
ctcaatcactgctcccccgtgtg

SEQ ID NO: 1995738 - DNA, 16 bp, Homo sapiens
ctcaatcagtctcaga

SEQ ID NO: 1995739 - DNA, 14 bp, Homo sapiens
ctcaatcagtgcag

SEQ ID NO: 1995740 - DNA, 18 bp, Homo sapiens
ctcaatcccagctactca

SEQ ID NO: 1995741 - DNA, 21 bp, Homo sapiens
ctcaatcttcggggtgtgatg

SEQ ID NO: 1995742 - DNA, 21 bp, Homo sapiens
ctcaatgcattgtcttgtgga

SEQ ID NO: 1995743 - DNA, 22 bp, Homo sapiens
ctcaatgcattgtcttgtggag

SEQ ID NO: 1995744 - DNA, 17 bp, Homo sapiens
ctcaatgccctgccatt

SEQ ID NO: 1995745 - DNA, 15 bp, Homo sapiens
ctcaatgcttttcta

SEQ ID NO: 1995746 - DNA, 17 bp, Homo sapiens
ctcaatgcttttctagc

SEQ ID NO: 1995747 - DNA, 16 bp, Homo sapiens
ctcaatggacttcaaa

SEQ ID NO: 1995748 - DNA, 18 bp, Homo sapiens
ctcaatggacttcaaatt

SEQ ID NO: 1995749 - DNA, 14 bp, Homo sapiens
ctcaatgtgaccag

SEQ ID NO: 1995750 - DNA, 21 bp, Homo sapiens
ctcaatgtgcaagttgtactg

SEQ ID NO: 1995751 - DNA, 16 bp, Homo sapiens
ctcaatttctgaacac

SEQ ID NO: 1995752 - DNA, 19 bp, Homo sapiens
ctcacaactgtttttgaag

SEQ ID NO: 1995753 - DNA, 17 bp, Homo sapiens
ctcacaagaagaccaga

SEQ ID NO: 1995754 - DNA, 14 bp, Homo sapiens
ctcacaagcccagg

SEQ ID NO: 1995755 - DNA, 13 bp, Homo sapiens
ctcacaaggcagc

SEQ ID NO: 1995756 - DNA, 14 bp, Homo sapiens
ctcacaaggcagca

SEQ ID NO: 1995757 - DNA, 16 bp, Homo sapiens
ctcacaaggcagcaag

SEQ ID NO: 1995758 - DNA, 17 bp, Homo sapiens
ctcacaaggcagcaagg

SEQ ID NO: 1995759 - DNA, 21 bp, Homo sapiens
ctcacaaggcagcaaggcccg

SEQ ID NO: 1995760 - DNA, 23 bp, Homo sapiens
ctcacaagtagggagctcactcc

SEQ ID NO: 1995761 - DNA, 23 bp, Homo sapiens
ctcacacttgggcgctctgccct

SEQ ID NO: 1995762 - DNA, 17 bp, Homo sapiens
ctcacagaacccttgga

SEQ ID NO: 1995763 - DNA, 15 bp, Homo sapiens
ctcacagcctctccc

SEQ ID NO: 1995764 - DNA, 18 bp, Homo sapiens
ctcacagcctctccctta

SEQ ID NO: 1995765 - DNA, 20 bp, Homo sapiens
ctcacagcctctcccttaat

SEQ ID NO: 1995766 - DNA, 18 bp, Homo sapiens
ctcacaggagcagacaga

SEQ ID NO: 1995767 - DNA, 16 bp, Homo sapiens
ctcacagtgacccttc

SEQ ID NO: 1995768 - DNA, 18 bp, Homo sapiens
ctcacagtgacccttccc

SEQ ID NO: 1995769 - DNA, 13 bp, Homo sapiens
ctcacagttcctc

SEQ ID NO: 1995770 - DNA, 16 bp, Homo sapiens
ctcacagttcctcgcc

SEQ ID NO: 1995771 - DNA, 17 bp, Homo sapiens
ctcacagttcctcgccc

SEQ ID NO: 1995772 - DNA, 21 bp, Homo sapiens
ctcacagttcctcgccctggg

SEQ ID NO: 1995773 - DNA, 22 bp, Homo sapiens
ctcacagttcctcgccctgggt

SEQ ID NO: 1995774 - DNA, 16 bp, Homo sapiens
ctcacatcagagtgac

SEQ ID NO: 1995775 - DNA, 16 bp, Homo sapiens
ctcacattacacacac

SEQ ID NO: 1995776 - DNA, 22 bp, Homo sapiens
ctcacatttattctgctcacat

SEQ ID NO: 1995777 - DNA, 14 bp, Homo sapiens
ctcaccaataactt

SEQ ID NO: 1995778 - DNA, 15 bp, Homo sapiens
ctcaccagccccagt

SEQ ID NO: 1995779 - DNA, 19 bp, Homo sapiens
ctcaccagccccagtgccc

SEQ ID NO: 1995780 - DNA, 20 bp, Homo sapiens
ctcaccagccccagtgccca

SEQ ID NO: 1995781 - DNA, 13 bp, Homo sapiens
ctcaccaggaagg

SEQ ID NO: 1995782 - DNA, 10 bp, Homo sapiens
ctcaccaggg

SEQ ID NO: 1995783 - DNA, 22 bp, Homo sapiens
ctcaccaggggtgctatgacat

SEQ ID NO: 1995784 - DNA, 12 bp, Homo sapiens
ctcaccagggtc

SEQ ID NO: 1995785 - DNA, 21 bp, Homo sapiens
ctcaccagggtccgcaccagc

SEQ ID NO: 1995786 - DNA, 23 bp, Homo sapiens
ctcaccagtgtcccctccactgt

SEQ ID NO: 1995787 - DNA, 17 bp, Homo sapiens
ctcacccccagctttgc

SEQ ID NO: 1995788 - DNA, 18 bp, Homo sapiens
ctcacccccagctttgct

SEQ ID NO: 1995789 - DNA, 17 bp, Homo sapiens
ctcacccccaggtgttg

SEQ ID NO: 1995790 - DNA, 18 bp, Homo sapiens
ctcacccctctcccccgc

SEQ ID NO: 1995791 - DNA, 23 bp, Homo sapiens
ctcaccggcatgctggcctgtgg

SEQ ID NO: 1995792 - DNA, 14 bp, Homo sapiens
ctcacctctgcctc

SEQ ID NO: 1995793 - DNA, 12 bp, Homo sapiens
ctcacctgacct

SEQ ID NO: 1995794 - DNA, 15 bp, Homo sapiens
ctcacctgggccttt

SEQ ID NO: 1995795 - DNA, 17 bp, Homo sapiens
ctcacctgggcctttcc

SEQ ID NO: 1995796 - DNA, 13 bp, Homo sapiens
ctcacctggttga

SEQ ID NO: 1995797 - DNA, 16 bp, Homo sapiens
ctcacgactcttcctg

SEQ ID NO: 1995798 - DNA, 17 bp, Homo sapiens
ctcacgactcttcctgc

SEQ ID NO: 1995799 - DNA, 23 bp, Homo sapiens
ctcacgatgaaattgaacctggt

SEQ ID NO: 1995800 - DNA, 18 bp, Homo sapiens
ctcacgcccagcctcctc

SEQ ID NO: 1995801 - DNA, 21 bp, Homo sapiens
ctcacgcctgtaatcccagca

SEQ ID NO: 1995802 - DNA, 23 bp, Homo sapiens
ctcacgcctgtaatcccagcact

SEQ ID NO: 1995803 - DNA, 20 bp, Homo sapiens
ctcactatggtatgctggcc

SEQ ID NO: 1995804 - DNA, 21 bp, Homo sapiens
ctcactatggtatgctggcca

SEQ ID NO: 1995805 - DNA, 19 bp, Homo sapiens
ctcactatgttgcccaggc

SEQ ID NO: 1995806 - DNA, 20 bp, Homo sapiens
ctcactattacttgaacttt

SEQ ID NO: 1995807 - DNA, 12 bp, Homo sapiens
ctcactcaggac

SEQ ID NO: 1995808 - DNA, 15 bp, Homo sapiens
ctcactccacactgg

SEQ ID NO: 1995809 - DNA, 16 bp, Homo sapiens
ctcactccaccaccca

SEQ ID NO: 1995810 - DNA, 17 bp, Homo sapiens
ctcactccaccacccaa

SEQ ID NO: 1995811 - DNA, 20 bp, Homo sapiens
ctcactccaccacccaaaag

SEQ ID NO: 1995812 - DNA, 15 bp, Homo sapiens
ctcactccctgggaa

SEQ ID NO: 1995813 - DNA, 13 bp, Homo sapiens
ctcactcctacct

SEQ ID NO: 1995814 - DNA, 15 bp, Homo sapiens
ctcactcctacctgg

SEQ ID NO: 1995815 - DNA, 16 bp, Homo sapiens
ctcactcctacctggt

SEQ ID NO: 1995816 - DNA, 13 bp, Homo sapiens
ctcactcctgagt

SEQ ID NO: 1995817 - DNA, 11 bp, Homo sapiens
ctcactcctgt

SEQ ID NO: 1995818 - DNA, 12 bp, Homo sapiens
ctcactctgtca

SEQ ID NO: 1995819 - DNA, 14 bp, Homo sapiens
ctcactctgtcagc

SEQ ID NO: 1995820 - DNA, 19 bp, Homo sapiens
ctcactctgtcagccagcc

SEQ ID NO: 1995821 - DNA, 21 bp, Homo sapiens
ctcactctgtcgcccagtctg

SEQ ID NO: 1995822 - DNA, 22 bp, Homo sapiens
ctcactgatatattttccaggg

SEQ ID NO: 1995823 - DNA, 13 bp, Homo sapiens
ctcactgcagcct

SEQ ID NO: 1995824 - DNA, 15 bp, Homo sapiens
ctcactgcagcctca

SEQ ID NO: 1995825 - DNA, 22 bp, Homo sapiens
ctcactgccccaccagccacct

SEQ ID NO: 1995826 - DNA, 19 bp, Homo sapiens
ctcactgctcaagaagaca

SEQ ID NO: 1995827 - DNA, 13 bp, Homo sapiens
ctcactggctggg

SEQ ID NO: 1995828 - DNA, 14 bp, Homo sapiens
ctcactggctgggg

SEQ ID NO: 1995829 - DNA, 16 bp, Homo sapiens
ctcactggctggggca

SEQ ID NO: 1995830 - DNA, 22 bp, Homo sapiens
ctcactggctggggcagagggg

SEQ ID NO: 1995831 - DNA, 22 bp, Homo sapiens
ctcactgttgcccaggctggcg

SEQ ID NO: 1995832 - DNA, 13 bp, Homo sapiens
ctcacttatacca

SEQ ID NO: 1995833 - DNA, 16 bp, Homo sapiens
ctcacttccctgggaa

SEQ ID NO: 1995834 - DNA, 17 bp, Homo sapiens
ctcacttccctgggaac

SEQ ID NO: 1995835 - DNA, 22 bp, Homo sapiens
ctcacttttctttattgctgtg

SEQ ID NO: 1995836 - DNA, 15 bp, Homo sapiens
ctcagaaagccttcc

SEQ ID NO: 1995837 - DNA, 13 bp, Homo sapiens
ctcagaagaaaga

SEQ ID NO: 1995838 - DNA, 15 bp, Homo sapiens
ctcagaagcctgagg

SEQ ID NO: 1995839 - DNA, 15 bp, Homo sapiens
ctcagaagcctgggg

SEQ ID NO: 1995840 - DNA, 19 bp, Homo sapiens
ctcagaagtttcttcttta

SEQ ID NO: 1995841 - DNA, 15 bp, Homo sapiens
ctcagaatccaaaga

SEQ ID NO: 1995842 - DNA, 15 bp, Homo sapiens
ctcagaatgctctac

SEQ ID NO: 1995843 - DNA, 17 bp, Homo sapiens
ctcagacaatccactct

SEQ ID NO: 1995844 - DNA, 13 bp, Homo sapiens
ctcagaccaactc

SEQ ID NO: 1995845 - DNA, 15 bp, Homo sapiens
ctcagacccccactc

SEQ ID NO: 1995846 - DNA, 16 bp, Homo sapiens
ctcagacccccactct

SEQ ID NO: 1995847 - DNA, 22 bp, Homo sapiens
ctcagacccccactctcattcc

SEQ ID NO: 1995848 - DNA, 16 bp, Homo sapiens
ctcagagacaggtggc

SEQ ID NO: 1995849 - DNA, 17 bp, Homo sapiens
ctcagagatgaaactat

SEQ ID NO: 1995850 - DNA, 13 bp, Homo sapiens
ctcagagcagagc

SEQ ID NO: 1995851 - DNA, 15 bp, Homo sapiens
ctcagagcaggctca

SEQ ID NO: 1995852 - DNA, 23 bp, Homo sapiens
ctcagagcaggctcagactctgg

SEQ ID NO: 1995853 - DNA, 12 bp, Homo sapiens
ctcagaggccca

SEQ ID NO: 1995854 - DNA, 20 bp, Homo sapiens
ctcagaggctatagctggga

SEQ ID NO: 1995855 - DNA, 22 bp, Homo sapiens
ctcagaggctatagctgggaac

SEQ ID NO: 1995856 - DNA, 16 bp, Homo sapiens
ctcagatagaatgaca

SEQ ID NO: 1995857 - DNA, 17 bp, Homo sapiens
ctcagcaaatcctcttc

SEQ ID NO: 1995858 - DNA, 14 bp, Homo sapiens
ctcagcagcagaga

SEQ ID NO: 1995859 - DNA, 11 bp, Homo sapiens
ctcagcagccc

SEQ ID NO: 1995860 - DNA, 13 bp, Homo sapiens
ctcagcagccccc

SEQ ID NO: 1995861 - DNA, 14 bp, Homo sapiens
ctcagcagccccct

SEQ ID NO: 1995862 - DNA, 16 bp, Homo sapiens
ctcagcagccctcctc

SEQ ID NO: 1995863 - DNA, 19 bp, Homo sapiens
ctcagcagccctcctcacc

SEQ ID NO: 1995864 - DNA, 16 bp, Homo sapiens
ctcagcatacctgctg

SEQ ID NO: 1995865 - DNA, 15 bp, Homo sapiens
ctcagcatcctggca

SEQ ID NO: 1995866 - DNA, 16 bp, Homo sapiens
ctcagcatcctggcac

SEQ ID NO: 1995867 - DNA, 17 bp, Homo sapiens
ctcagcatcctggcacc

SEQ ID NO: 1995868 - DNA, 22 bp, Homo sapiens
ctcagcatcctggcacccggcc

SEQ ID NO: 1995869 - DNA, 15 bp, Homo sapiens
ctcagccacacccca

SEQ ID NO: 1995870 - DNA, 21 bp, Homo sapiens
ctcagccatgaggagttgctg

SEQ ID NO: 1995871 - DNA, 19 bp, Homo sapiens
ctcagcccacatagtgatg

SEQ ID NO: 1995872 - DNA, 21 bp, Homo sapiens
ctcagcccacatagtgatggt

SEQ ID NO: 1995873 - DNA, 21 bp, Homo sapiens
ctcagccccgggcctgcctct

SEQ ID NO: 1995874 - DNA, 12 bp, Homo sapiens
ctcagccctcag

SEQ ID NO: 1995875 - DNA, 17 bp, Homo sapiens
ctcagccctcagaacaa

SEQ ID NO: 1995876 - DNA, 19 bp, Homo sapiens
ctcagccctccctgcccct

SEQ ID NO: 1995877 - DNA, 18 bp, Homo sapiens
ctcagccctgactggtgc

SEQ ID NO: 1995878 - DNA, 21 bp, Homo sapiens
ctcagcctcccaaagtgctgg

SEQ ID NO: 1995879 - DNA, 20 bp, Homo sapiens
ctcagcctcccaaccccagg

SEQ ID NO: 1995880 - DNA, 15 bp, Homo sapiens
ctcagcctcccagag

SEQ ID NO: 1995881 - DNA, 16 bp, Homo sapiens
ctcagcctcccagagt

SEQ ID NO: 1995882 - DNA, 13 bp, Homo sapiens
ctcagcctccccc

SEQ ID NO: 1995883 - DNA, 15 bp, Homo sapiens
ctcagcctccccccg

SEQ ID NO: 1995884 - DNA, 21 bp, Homo sapiens
ctcagcctcccgaatagctgg

SEQ ID NO: 1995885 - DNA, 22 bp, Homo sapiens
ctcagcctcccgaatagctggg

SEQ ID NO: 1995886 - DNA, 12 bp, Homo sapiens
ctcagcctccta

SEQ ID NO: 1995887 - DNA, 13 bp, Homo sapiens
ctcagcctcctaa

SEQ ID NO: 1995888 - DNA, 13 bp, Homo sapiens
ctcagcctcctca

SEQ ID NO: 1995889 - DNA, 14 bp, Homo sapiens
ctcagcctgtgctg

SEQ ID NO: 1995890 - DNA, 16 bp, Homo sapiens
ctcagcctgtgctgcc

SEQ ID NO: 1995891 - DNA, 18 bp, Homo sapiens
ctcagcctgtgctgcccg

SEQ ID NO: 1995892 - DNA, 21 bp, Homo sapiens
ctcagccttgaaaaacaagtc

SEQ ID NO: 1995893 - DNA, 15 bp, Homo sapiens
ctcagccttggataa

SEQ ID NO: 1995894 - DNA, 13 bp, Homo sapiens
ctcagcggggaca

SEQ ID NO: 1995895 - DNA, 14 bp, Homo sapiens
ctcagcggggacag

SEQ ID NO: 1995896 - DNA, 23 bp, Homo sapiens
ctcagctccagaataccttcttc

SEQ ID NO: 1995897 - DNA, 19 bp, Homo sapiens
ctcagctccgtcatctgcg

SEQ ID NO: 1995898 - DNA, 23 bp, Homo sapiens
ctcagctgacacataatttgaat

SEQ ID NO: 1995899 - DNA, 14 bp, Homo sapiens
ctcagctgcacatt

SEQ ID NO: 1995900 - DNA, 20 bp, Homo sapiens
ctcagctgcacattcctggc

SEQ ID NO: 1995901 - DNA, 23 bp, Homo sapiens
ctcagctgcacattcctggcccc

SEQ ID NO: 1995902 - DNA, 17 bp, Homo sapiens
ctcagctgccaagcact

SEQ ID NO: 1995903 - DNA, 16 bp, Homo sapiens
ctcagctgctcgcaca

SEQ ID NO: 1995904 - DNA, 23 bp, Homo sapiens
ctcagcttcatttccgtgaaggg

SEQ ID NO: 1995905 - DNA, 17 bp, Homo sapiens
ctcagctttttgtcttt

SEQ ID NO: 1995906 - DNA, 18 bp, Homo sapiens
ctcaggaagaaaccccaa

SEQ ID NO: 1995907 - DNA, 18 bp, Homo sapiens
ctcaggacacaggcctgt

SEQ ID NO: 1995908 - DNA, 14 bp, Homo sapiens
ctcaggacccaggc

SEQ ID NO: 1995909 - DNA, 12 bp, Homo sapiens
ctcaggagcaca

SEQ ID NO: 1995910 - DNA, 15 bp, Homo sapiens
ctcaggagcacaggc

SEQ ID NO: 1995911 - DNA, 17 bp, Homo sapiens
ctcaggagcacaggcag

SEQ ID NO: 1995912 - DNA, 13 bp, Homo sapiens
ctcaggaggcgaa

SEQ ID NO: 1995913 - DNA, 17 bp, Homo sapiens
ctcaggaggctgaggca

SEQ ID NO: 1995914 - DNA, 23 bp, Homo sapiens
ctcaggaggctgaggcaggagga

SEQ ID NO: 1995915 - DNA, 23 bp, Homo sapiens
ctcctgggcagcttgagagggca

SEQ ID NO: 1995916 - DNA, 20 bp, Homo sapiens
ctcctgggcccgctttgcct

SEQ ID NO: 1995917 - DNA, 22 bp, Homo sapiens
ctcctgggcccgctttgcctgc

SEQ ID NO: 1995918 - DNA, 18 bp, Homo sapiens
ctcctgggctaagtgatc

SEQ ID NO: 1995919 - DNA, 15 bp, Homo sapiens
ctcctgggggtggca

SEQ ID NO: 1995920 - DNA, 17 bp, Homo sapiens
ctcctgtagctctcctg

SEQ ID NO: 1995921 - DNA, 13 bp, Homo sapiens
ctcctgtcccgcc

SEQ ID NO: 1995922 - DNA, 14 bp, Homo sapiens
ctcctgtccctacc

SEQ ID NO: 1995923 - DNA, 22 bp, Homo sapiens
ctcctgtccctacccactcttt

SEQ ID NO: 1995924 - DNA, 15 bp, Homo sapiens
ctcctgtctgccagc

SEQ ID NO: 1995925 - DNA, 17 bp, Homo sapiens
ctcctgtctgccagcca

SEQ ID NO: 1995926 - DNA, 14 bp, Homo sapiens
ctcctgtcttatgg

SEQ ID NO: 1995927 - DNA, 17 bp, Homo sapiens
ctcctgtgcccctcaga

SEQ ID NO: 1995928 - DNA, 13 bp, Homo sapiens
ctcctgtgtacag

SEQ ID NO: 1995929 - DNA, 11 bp, Homo sapiens
ctcctgtgtgt

SEQ ID NO: 1995930 - DNA, 14 bp, Homo sapiens
ctcctgtgtgtgcg

SEQ ID NO: 1995931 - DNA, 16 bp, Homo sapiens
ctcctgtgtgtgcgcc

SEQ ID NO: 1995932 - DNA, 20 bp, Homo sapiens
ctcctgtgtgtgcgcctaca

SEQ ID NO: 1995933 - DNA, 23 bp, Homo sapiens
ctcctgtgtgtgcgcctacagga

SEQ ID NO: 1995934 - DNA, 14 bp, Homo sapiens
ctccttactctgag

SEQ ID NO: 1995935 - DNA, 15 bp, Homo sapiens
ctccttactctgagc

SEQ ID NO: 1995936 - DNA, 17 bp, Homo sapiens
ctccttactctgagccc

SEQ ID NO: 1995937 - DNA, 18 bp, Homo sapiens
ctccttactctgagccca

SEQ ID NO: 1995938 - DNA, 19 bp, Homo sapiens
ctccttactctgagcccag

SEQ ID NO: 1995939 - DNA, 20 bp, Homo sapiens
ctccttactctgagcccagg

SEQ ID NO: 1995940 - DNA, 16 bp, Homo sapiens
ctccttatttatcaac

SEQ ID NO: 1995941 - DNA, 15 bp, Homo sapiens
ctccttattttgtat

SEQ ID NO: 1995942 - DNA, 16 bp, Homo sapiens
ctccttcccctgtggt

SEQ ID NO: 1995943 - DNA, 21 bp, Homo sapiens
ctccttcccgccgcccgaccc

SEQ ID NO: 1995944 - DNA, 10 bp, Homo sapiens
ctccttccct

SEQ ID NO: 1995945 - DNA, 19 bp, Homo sapiens
ctccttcccttctctcctt

SEQ ID NO: 1995946 - DNA, 19 bp, Homo sapiens
ctccttcctcagtcctgga

SEQ ID NO: 1995947 - DNA, 14 bp, Homo sapiens
ctccttccttaccc

SEQ ID NO: 1995948 - DNA, 14 bp, Homo sapiens
ctccttcgtgtctc

SEQ ID NO: 1995949 - DNA, 20 bp, Homo sapiens
ctccttcgtgtctctcccac

SEQ ID NO: 1995950 - DNA, 14 bp, Homo sapiens
ctccttctgtccta

SEQ ID NO: 1995951 - DNA, 15 bp, Homo sapiens
ctccttctgtcctac

SEQ ID NO: 1995952 - DNA, 20 bp, Homo sapiens
ctccttctgtcctactctgt

SEQ ID NO: 1995953 - DNA, 14 bp, Homo sapiens
ctccttcttccctg

SEQ ID NO: 1995954 - DNA, 16 bp, Homo sapiens
ctccttcttccctgtt

SEQ ID NO: 1995955 - DNA, 13 bp, Homo sapiens
ctccttcttgctt

SEQ ID NO: 1995956 - DNA, 15 bp, Homo sapiens
ctccttgcctggtga

SEQ ID NO: 1995957 - DNA, 15 bp, Homo sapiens
ctccttggaggacag

SEQ ID NO: 1995958 - DNA, 18 bp, Homo sapiens
ctccttggaggacagtgg

SEQ ID NO: 1995959 - DNA, 14 bp, Homo sapiens
ctccttgggctcct

SEQ ID NO: 1995960 - DNA, 16 bp, Homo sapiens
ctccttgggctcctgg

SEQ ID NO: 1995961 - DNA, 15 bp, Homo sapiens
ctccttgggtcctgc

SEQ ID NO: 1995962 - DNA, 15 bp, Homo sapiens
ctccttggtgcctgg

SEQ ID NO: 1995963 - DNA, 19 bp, Homo sapiens
ctccttggtgcctggcctg

SEQ ID NO: 1995964 - DNA, 22 bp, Homo sapiens
ctccttggtgcctggcctggca

SEQ ID NO: 1995965 - DNA, 15 bp, Homo sapiens
ctcctttacctacca

SEQ ID NO: 1995966 - DNA, 20 bp, Homo sapiens
ctcctttagcaggtggtcct

SEQ ID NO: 1995967 - DNA, 18 bp, Homo sapiens
ctcctttattgctcctgt

SEQ ID NO: 1995968 - DNA, 20 bp, Homo sapiens
ctcctttcacaaccttctgt

SEQ ID NO: 1995969 - DNA, 15 bp, Homo sapiens
ctcctttgcactgag

SEQ ID NO: 1995970 - DNA, 20 bp, Homo sapiens
ctcctttgcactgagggcca

SEQ ID NO: 1995971 - DNA, 22 bp, Homo sapiens
ctcctttgcactgagggccaca

SEQ ID NO: 1995972 - DNA, 15 bp, Homo sapiens
ctcctttgcattcca

SEQ ID NO: 1995973 - DNA, 15 bp, Homo sapiens
ctccttttgctgtct

SEQ ID NO: 1995974 - DNA, 19 bp, Homo sapiens
ctccttttgtccccagggc

SEQ ID NO: 1995975 - DNA, 21 bp, Homo sapiens
ctccttttgtccccagggccc

SEQ ID NO: 1995976 - DNA, 16 bp, Homo sapiens
ctcgaaccaaggcagc

SEQ ID NO: 1995977 - DNA, 18 bp, Homo sapiens
ctcgaaccaaggcagcct

SEQ ID NO: 1995978 - DNA, 15 bp, Homo sapiens
ctcgaagaacaatgt

SEQ ID NO: 1995979 - DNA, 18 bp, Homo sapiens
ctcgaagcccttccagtg

SEQ ID NO: 1995980 - DNA, 19 bp, Homo sapiens
ctcgaagcccttccagtgg

SEQ ID NO: 1995981 - DNA, 16 bp, Homo sapiens
ctcgagaccatcctgg

SEQ ID NO: 1995982 - DNA, 18 bp, Homo sapiens
ctcgagaccatcctggcc

SEQ ID NO: 1995983 - DNA, 15 bp, Homo sapiens
ctcgagcccagatgg

SEQ ID NO: 1995984 - DNA, 23 bp, Homo sapiens
ctcgagccccctggatgtcccct

SEQ ID NO: 1995985 - DNA, 12 bp, Homo sapiens
ctcgagcgccct

SEQ ID NO: 1995986 - DNA, 15 bp, Homo sapiens
ctcgagcgccctgca

SEQ ID NO: 1995987 - DNA, 18 bp, Homo sapiens
ctcgagcgccctgcagac

SEQ ID NO: 1995988 - DNA, 23 bp, Homo sapiens
ctcgagcgccctgcagaccctgc

SEQ ID NO: 1995989 - DNA, 20 bp, Homo sapiens
ctcgaggcaccggcgctgca

SEQ ID NO: 1995990 - DNA, 23 bp, Homo sapiens
ctcgaggcaccggcgctgcaggt

SEQ ID NO: 1995991 - DNA, 17 bp, Homo sapiens
ctcgaggctcttccatc

SEQ ID NO: 1995992 - DNA, 16 bp, Homo sapiens
ctcgcaacccgtgcca

SEQ ID NO: 1995993 - DNA, 23 bp, Homo sapiens
ctcgcaacccgtgccaagtccag

SEQ ID NO: 1995994 - DNA, 20 bp, Homo sapiens
ctcgcagcctggcggggcag

SEQ ID NO: 1995995 - DNA, 21 bp, Homo sapiens
ctcgcagcctggcggggcagg

SEQ ID NO: 1995996 - DNA, 23 bp, Homo sapiens
ctcgcagcctggcggggcaggag

SEQ ID NO: 1995997 - DNA, 13 bp, Homo sapiens
ctcgccctgggtc

SEQ ID NO: 1995998 - DNA, 15 bp, Homo sapiens
ctcgccctgggtcta

SEQ ID NO: 1995999 - DNA, 12 bp, Homo sapiens
ctcgcctaggcc

SEQ ID NO: 1996000 - DNA, 16 bp, Homo sapiens
ctcgcctaggcctgtg

SEQ ID NO: 1996001 - DNA, 18 bp, Homo sapiens
ctcgcctaggcctgtgag

SEQ ID NO: 1996002 - DNA, 12 bp, Homo sapiens
ctcgcctgggcc

SEQ ID NO: 1996003 - DNA, 17 bp, Homo sapiens
ctcgcctgggcccaggc

SEQ ID NO: 1996004 - DNA, 21 bp, Homo sapiens
ctcgcctgggcccaggctctg

SEQ ID NO: 1996005 - DNA, 16 bp, Homo sapiens
ctcgctccccactctg

SEQ ID NO: 1996006 - DNA, 15 bp, Homo sapiens
ctcgctccctgtagc

SEQ ID NO: 1996007 - DNA, 22 bp, Homo sapiens
ctcgctccctgtagctctgcct

SEQ ID NO: 1996008 - DNA, 12 bp, Homo sapiens
ctcgctgctgct

SEQ ID NO: 1996009 - DNA, 21 bp, Homo sapiens
ctcgctggaatcaatttccca

SEQ ID NO: 1996010 - DNA, 17 bp, Homo sapiens
ctcgctgtcctgctgtg

SEQ ID NO: 1996011 - DNA, 14 bp, Homo sapiens
ctcgcttagctgaa

SEQ ID NO: 1996012 - DNA, 16 bp, Homo sapiens
ctcgcttctcctccag

SEQ ID NO: 1996013 - DNA, 19 bp, Homo sapiens
ctcggaagccgtctgactc

SEQ ID NO: 1996014 - DNA, 20 bp, Homo sapiens
ctcggaaggctggctgggca

SEQ ID NO: 1996015 - DNA, 20 bp, Homo sapiens
ctcggagaagagctgttcac

SEQ ID NO: 1996016 - DNA, 17 bp, Homo sapiens
ctcggagggattcccct

SEQ ID NO: 1996017 - DNA, 19 bp, Homo sapiens
ctcggggcgacccctcagt

SEQ ID NO: 1996018 - DNA, 15 bp, Homo sapiens
ctcggggtgcacagg

SEQ ID NO: 1996019 - DNA, 20 bp, Homo sapiens
ctcgggtccgattaatttat

SEQ ID NO: 1996020 - DNA, 14 bp, Homo sapiens
ctcggtggacccag

SEQ ID NO: 1996021 - DNA, 18 bp, Homo sapiens
ctcggtggacccagggat

SEQ ID NO: 1996022 - DNA, 16 bp, Homo sapiens
ctcggtggccatgctt

SEQ ID NO: 1996023 - DNA, 16 bp, Homo sapiens
ctcggtgtaaaaccat

SEQ ID NO: 1996024 - DNA, 21 bp, Homo sapiens
ctcggtgtaaaaccatgtagt

SEQ ID NO: 1996025 - DNA, 23 bp, Homo sapiens
ctcggtgtaaaaccatgtagttt

SEQ ID NO: 1996026 - DNA, 15 bp, Homo sapiens
ctcgtaccagccagg

SEQ ID NO: 1996027 - DNA, 12 bp, Homo sapiens
ctcgtatttaat

SEQ ID NO: 1996028 - DNA, 19 bp, Homo sapiens
ctcgtccacaggggcaggc

SEQ ID NO: 1996029 - DNA, 22 bp, Homo sapiens
ctcgtccacaggggcaggcctg

SEQ ID NO: 1996030 - DNA, 16 bp, Homo sapiens
ctgaaaactgtaaata

SEQ ID NO: 1996031 - DNA, 13 bp, Homo sapiens
ctgaaaactgttt

SEQ ID NO: 1996032 - DNA, 16 bp, Homo sapiens
ctgaaaatcaaagtaa

SEQ ID NO: 1996033 - DNA, 16 bp, Homo sapiens
ctgaaaattaacactg

SEQ ID NO: 1996034 - DNA, 17 bp, Homo sapiens
ctgaaaattatttaaac

SEQ ID NO: 1996035 - DNA, 18 bp, Homo sapiens
ctgaaacacacaggccat

SEQ ID NO: 1996036 - DNA, 20 bp, Homo sapiens
ctgaaacattcacacagggc

SEQ ID NO: 1996037 - DNA, 20 bp, Homo sapiens
ctgaaacattccgaagaggg

SEQ ID NO: 1996038 - DNA, 22 bp, Homo sapiens
ctgaaactcacacaactaggaa

SEQ ID NO: 1996039 - DNA, 14 bp, Homo sapiens
ctgaaagaaacagt

SEQ ID NO: 1996040 - DNA, 16 bp, Homo sapiens
ctgaaagaaacagtta

SEQ ID NO: 1996041 - DNA, 16 bp, Homo sapiens
ctgaaagacagaatgt

SEQ ID NO: 1996042 - DNA, 17 bp, Homo sapiens
ctgaaagcagcagctag

SEQ ID NO: 1996043 - DNA, 11 bp, Homo sapiens
ctgaaagccac

SEQ ID NO: 1996044 - DNA, 13 bp, Homo sapiens
ctgaaagtggctc

SEQ ID NO: 1996045 - DNA, 16 bp, Homo sapiens
ctgaaataaaagcctc

SEQ ID NO: 1996046 - DNA, 23 bp, Homo sapiens
ctgaaataaaagcctctggtgga

SEQ ID NO: 1996047 - DNA, 13 bp, Homo sapiens
ctgaaatcagtct

SEQ ID NO: 1996048 - DNA, 19 bp, Homo sapiens
ctgaaatgaaacaaataat

SEQ ID NO: 1996049 - DNA, 16 bp, Homo sapiens
ctgaacaagaattgga

SEQ ID NO: 1996050 - DNA, 19 bp, Homo sapiens
ctgaacacatactagaaag

SEQ ID NO: 1996051 - DNA, 15 bp, Homo sapiens
ctgaacatctgtgtg

SEQ ID NO: 1996052 - DNA, 19 bp, Homo sapiens
ctgaacatctgtgtgtgtc

SEQ ID NO: 1996053 - DNA, 12 bp, Homo sapiens
ctgaaccattac

SEQ ID NO: 1996054 - DNA, 14 bp, Homo sapiens
ctgaaccattactg

SEQ ID NO: 1996055 - DNA, 15 bp, Homo sapiens
ctgaaccattactgt

SEQ ID NO: 1996056 - DNA, 13 bp, Homo sapiens
ctgaacctcagtt

SEQ ID NO: 1996057 - DNA, 15 bp, Homo sapiens
ctgaacgtcctgcag

SEQ ID NO: 1996058 - DNA, 13 bp, Homo sapiens
ctgaactgagcct

SEQ ID NO: 1996059 - DNA, 16 bp, Homo sapiens
ctgaactgagcctagc

SEQ ID NO: 1996060 - DNA, 21 bp, Homo sapiens
ctgaagacaaaccactgtaca

SEQ ID NO: 1996061 - DNA, 16 bp, Homo sapiens
ctgaagacctccacat

SEQ ID NO: 1996062 - DNA, 19 bp, Homo sapiens
ctgaagactcattcttctg

SEQ ID NO: 1996063 - DNA, 22 bp, Homo sapiens
ctgaagacttacttattcttcc

SEQ ID NO: 1996064 - DNA, 22 bp, Homo sapiens
ctgaagagacagttatttatag

SEQ ID NO: 1996065 - DNA, 16 bp, Homo sapiens
ctgaagaggcaagaga

SEQ ID NO: 1996066 - DNA, 13 bp, Homo sapiens
ctgaagcatgttt

SEQ ID NO: 1996067 - DNA, 15 bp, Homo sapiens
ctgaagcatgtttca

SEQ ID NO: 1996068 - DNA, 18 bp, Homo sapiens
ctgaagcatgtttcatgt

SEQ ID NO: 1996069 - DNA, 23 bp, Homo sapiens
ctgaagcatgtttcatgttttgt

SEQ ID NO: 1996070 - DNA, 19 bp, Homo sapiens
ctgaagcccatgctttccc

SEQ ID NO: 1996071 - DNA, 13 bp, Homo sapiens
ctgaagcctctgc

SEQ ID NO: 1996072 - DNA, 16 bp, Homo sapiens
ctgaagcctctgccct

SEQ ID NO: 1996073 - DNA, 17 bp, Homo sapiens
ctgaagctgacagcact

SEQ ID NO: 1996074 - DNA, 21 bp, Homo sapiens
ctgaagcttcactcactgtca

SEQ ID NO: 1996075 - DNA, 22 bp, Homo sapiens
ctgaaggaataaattgctcctt

SEQ ID NO: 1996076 - DNA, 17 bp, Homo sapiens
ctgaaggaatagccaga

SEQ ID NO: 1996077 - DNA, 19 bp, Homo sapiens
ctgaaggaatagccagaga

SEQ ID NO: 1996078 - DNA, 20 bp, Homo sapiens
ctgaaggaatagccagagag

SEQ ID NO: 1996079 - DNA, 23 bp, Homo sapiens
ctgaaggacattgcggacagcca

SEQ ID NO: 1996080 - DNA, 21 bp, Homo sapiens
ctgaaggagattttccttcct

SEQ ID NO: 1996081 - DNA, 20 bp, Homo sapiens
ctgaagggcttcttcttata

SEQ ID NO: 1996082 - DNA, 16 bp, Homo sapiens
ctgaaggggcacacca

SEQ ID NO: 1996083 - DNA, 22 bp, Homo sapiens
ctgaaggtggccactttaagag

SEQ ID NO: 1996084 - DNA, 14 bp, Homo sapiens
ctgaagtcacacag

SEQ ID NO: 1996085 - DNA, 15 bp, Homo sapiens
ctgaagtcacacagt

SEQ ID NO: 1996086 - DNA, 19 bp, Homo sapiens
ctgaagtcacatcacagga

SEQ ID NO: 1996087 - DNA, 22 bp, Homo sapiens
ctgaagtcacatcacaggacac

SEQ ID NO: 1996088 - DNA, 13 bp, Homo sapiens
ctgaagtcactgc

SEQ ID NO: 1996089 - DNA, 14 bp, Homo sapiens
ctgaagtcactgca

SEQ ID NO: 1996090 - DNA, 17 bp, Homo sapiens
ctgaagtcactgcacag

SEQ ID NO: 1996091 - DNA, 22 bp, Homo sapiens
ctgaagtgaaggagaaaggagc

SEQ ID NO: 1996092 - DNA, 13 bp, Homo sapiens
ctgaagttctgag

SEQ ID NO: 1996093 - DNA, 20 bp, Homo sapiens
ctgaataacatttgtgtggt

SEQ ID NO: 1996094 - DNA, 19 bp, Homo sapiens
ctgaatccatcaggacttg

SEQ ID NO: 1996095 - DNA, 12 bp, Homo sapiens
ctgaatgctctg

SEQ ID NO: 1996096 - DNA, 14 bp, Homo sapiens
ctgaatggtccagg

SEQ ID NO: 1996097 - DNA, 22 bp, Homo sapiens
ctgaatggttccatgcctgagg

SEQ ID NO: 1996098 - DNA, 19 bp, Homo sapiens
ctgaatgtttattccttga

SEQ ID NO: 1996099 - DNA, 22 bp, Homo sapiens
ctgaatgtttgaactgccaaga

SEQ ID NO: 1996100 - DNA, 12 bp, Homo sapiens
ctgaattatttt

SEQ ID NO: 1996101 - DNA, 14 bp, Homo sapiens
ctgaattattttgt

SEQ ID NO: 1996102 - DNA, 15 bp, Homo sapiens
ctgaattattttgtt

SEQ ID NO: 1996103 - DNA, 15 bp, Homo sapiens
ctgaatttcaggcat

SEQ ID NO: 1996104 - DNA, 20 bp, Homo sapiens
ctgaattttaaatgttcaca

SEQ ID NO: 1996105 - DNA, 15 bp, Homo sapiens
ctgacaacctgtgca

SEQ ID NO: 1996106 - DNA, 19 bp, Homo sapiens
ctgacaagaagctcccaga

SEQ ID NO: 1996107 - DNA, 20 bp, Homo sapiens
ctgacaagatggaaaataaa

SEQ ID NO: 1996108 - DNA, 14 bp, Homo sapiens
ctgacaagggctga

SEQ ID NO: 1996109 - DNA, 19 bp, Homo sapiens
ctgacaagggctgacctgc

SEQ ID NO: 1996110 - DNA, 18 bp, Homo sapiens
ctgacaatggcagctaga

SEQ ID NO: 1996111 - DNA, 17 bp, Homo sapiens
ctgacacacagctctgt

SEQ ID NO: 1996112 - DNA, 19 bp, Homo sapiens
ctgacacacagctctgtcc

SEQ ID NO: 1996113 - DNA, 14 bp, Homo sapiens
ctgacacaggccag

SEQ ID NO: 1996114 - DNA, 16 bp, Homo sapiens
ctgacacaggccagcc

SEQ ID NO: 1996115 - DNA, 21 bp, Homo sapiens
ctgacacaggccagccccatc

SEQ ID NO: 1996116 - DNA, 19 bp, Homo sapiens
ctgacacataatttgaatg

SEQ ID NO: 1996117 - DNA, 17 bp, Homo sapiens
ctgacaccgtccctcag

SEQ ID NO: 1996118 - DNA, 15 bp, Homo sapiens
ctgacacctaccatg

SEQ ID NO: 1996119 - DNA, 18 bp, Homo sapiens
ctgacacctaccatgctg

SEQ ID NO: 1996120 - DNA, 19 bp, Homo sapiens
ctgacacctaccatgctgc

SEQ ID NO: 1996121 - DNA, 20 bp, Homo sapiens
ctgacacctaccatgctgct

SEQ ID NO: 1996122 - DNA, 18 bp, Homo sapiens
ctgacacctcactgagga

SEQ ID NO: 1996123 - DNA, 13 bp, Homo sapiens
ctgacagaaatgc

SEQ ID NO: 1996124 - DNA, 13 bp, Homo sapiens
ctgacagatacat

SEQ ID NO: 1996125 - DNA, 18 bp, Homo sapiens
ctgacagatgtcagccga

SEQ ID NO: 1996126 - DNA, 20 bp, Homo sapiens
ctgacaggatgtggcactgc

SEQ ID NO: 1996127 - DNA, 21 bp, Homo sapiens
ctgacaggatgtggcactgct

SEQ ID NO: 1996128 - DNA, 19 bp, Homo sapiens
ctgacaggcaatgctggct

SEQ ID NO: 1996129 - DNA, 16 bp, Homo sapiens
ctgacaggttcccagc

SEQ ID NO: 1996130 - DNA, 17 bp, Homo sapiens
ctgacaggttcccagca

SEQ ID NO: 1996131 - DNA, 21 bp, Homo sapiens
ctgacattgttggccaaagcc

SEQ ID NO: 1996132 - DNA, 14 bp, Homo sapiens
ctgaccaacaggct

SEQ ID NO: 1996133 - DNA, 22 bp, Homo sapiens
ctgaccacggacgtttccatca

SEQ ID NO: 1996134 - DNA, 23 bp, Homo sapiens
ctgaccacggacgtttccatcag

SEQ ID NO: 1996135 - DNA, 14 bp, Homo sapiens
ctgacccactgctt

SEQ ID NO: 1996136 - DNA, 21 bp, Homo sapiens
ctgacccagccccttgagaaa

SEQ ID NO: 1996137 - DNA, 11 bp, Homo sapiens
ctgacccagtc

SEQ ID NO: 1996138 - DNA, 13 bp, Homo sapiens
ctgacccagtccc

SEQ ID NO: 1996139 - DNA, 14 bp, Homo sapiens
ctgacccagtccct

SEQ ID NO: 1996140 - DNA, 14 bp, Homo sapiens
ctgacccagtgaga

SEQ ID NO: 1996141 - DNA, 16 bp, Homo sapiens
ctgaccccatcaccta

SEQ ID NO: 1996142 - DNA, 23 bp, Homo sapiens
ctgaccctccaccgcagaaggaa

SEQ ID NO: 1996143 - DNA, 18 bp, Homo sapiens
ctgaccctccctacctga

SEQ ID NO: 1996144 - DNA, 17 bp, Homo sapiens
ctgaccctccgctgcag

SEQ ID NO: 1996145 - DNA, 12 bp, Homo sapiens
ctgatttctcac

SEQ ID NO: 1996146 - DNA, 14 bp, Homo sapiens
ctgatttctctgaa

SEQ ID NO: 1996147 - DNA, 21 bp, Homo sapiens
ctgattttcaaagctttttcc

SEQ ID NO: 1996148 - DNA, 19 bp, Homo sapiens
ctgattttgtcactgtctt

SEQ ID NO: 1996149 - DNA, 14 bp, Homo sapiens
ctgcaaaagtggaa

SEQ ID NO: 1996150 - DNA, 22 bp, Homo sapiens
ctgcaaagggtatcaggtgctg

SEQ ID NO: 1996151 - DNA, 16 bp, Homo sapiens
ctgcaaagtgcaaata

SEQ ID NO: 1996152 - DNA, 19 bp, Homo sapiens
ctgcaacctccacctcctg

SEQ ID NO: 1996153 - DNA, 20 bp, Homo sapiens
ctgcaacctcttcctcctgg

SEQ ID NO: 1996154 - DNA, 17 bp, Homo sapiens
ctgcaacggcttagact

SEQ ID NO: 1996155 - DNA, 16 bp, Homo sapiens
ctgcaactagccaagg

SEQ ID NO: 1996156 - DNA, 15 bp, Homo sapiens
ctgcaagagccttgg

SEQ ID NO: 1996157 - DNA, 23 bp, Homo sapiens
ctgcaagagccttggtgtccacc

SEQ ID NO: 1996158 - DNA, 20 bp, Homo sapiens
ctgcaagatttcacatcagc

SEQ ID NO: 1996159 - DNA, 14 bp, Homo sapiens
ctgcaagcagggct

SEQ ID NO: 1996160 - DNA, 19 bp, Homo sapiens
ctgcaagcagggctctgcc

SEQ ID NO: 1996161 - DNA, 13 bp, Homo sapiens
ctgcaagccccag

SEQ ID NO: 1996162 - DNA, 20 bp, Homo sapiens
ctgcaagccccagggcctgg

SEQ ID NO: 1996163 - DNA, 22 bp, Homo sapiens
ctgcaagccccagggcctgggg

SEQ ID NO: 1996164 - DNA, 18 bp, Homo sapiens
ctgcaagggccagagttc

SEQ ID NO: 1996165 - DNA, 16 bp, Homo sapiens
ctgcaagtgcccgccc

SEQ ID NO: 1996166 - DNA, 23 bp, Homo sapiens
ctgcaagtgcccgccctgcccct

SEQ ID NO: 1996167 - DNA, 20 bp, Homo sapiens
ctgcaataaattatggctct

SEQ ID NO: 1996168 - DNA, 13 bp, Homo sapiens
ctgcaatctccag

SEQ ID NO: 1996169 - DNA, 22 bp, Homo sapiens
ctgcaatctccagggctgcccc

SEQ ID NO: 1996170 - DNA, 15 bp, Homo sapiens
ctgcaatgttttcct

SEQ ID NO: 1996171 - DNA, 19 bp, Homo sapiens
ctgcaattctacagtttct

SEQ ID NO: 1996172 - DNA, 20 bp, Homo sapiens
ctgcaattgcttaggatgtt

SEQ ID NO: 1996173 - DNA, 22 bp, Homo sapiens
ctgcacagatatttccatttct

SEQ ID NO: 1996174 - DNA, 21 bp, Homo sapiens
ctgcacagtttagaacagagg

SEQ ID NO: 1996175 - DNA, 18 bp, Homo sapiens
ctgcacattcctggcccc

SEQ ID NO: 1996176 - DNA, 15 bp, Homo sapiens
ctgcaccagagtgaa

SEQ ID NO: 1996177 - DNA, 11 bp, Homo sapiens
ctgcacccagg

SEQ ID NO: 1996178 - DNA, 12 bp, Homo sapiens
ctgcacccaggg

SEQ ID NO: 1996179 - DNA, 14 bp, Homo sapiens
ctgcacccgtaccc

SEQ ID NO: 1996180 - DNA, 14 bp, Homo sapiens
ctgcacccttcctc

SEQ ID NO: 1996181 - DNA, 18 bp, Homo sapiens
ctgcaccgggccacagag

SEQ ID NO: 1996182 - DNA, 23 bp, Homo sapiens
ctgcaccgggccacagagaaagt

SEQ ID NO: 1996183 - DNA, 18 bp, Homo sapiens
ctgcacctccccccactg

SEQ ID NO: 1996184 - DNA, 22 bp, Homo sapiens
ctgcacctccccccactgcagg

SEQ ID NO: 1996185 - DNA, 20 bp, Homo sapiens
ctgcacctgccagcctggct

SEQ ID NO: 1996186 - DNA, 13 bp, Homo sapiens
ctgcacctgtgca

SEQ ID NO: 1996187 - DNA, 16 bp, Homo sapiens
ctgcactaatttgatg

SEQ ID NO: 1996188 - DNA, 20 bp, Homo sapiens
ctgcactatagcctaggtga

SEQ ID NO: 1996189 - DNA, 16 bp, Homo sapiens
ctgcactccagcctgg

SEQ ID NO: 1996190 - DNA, 20 bp, Homo sapiens
ctgcactccagcctgggcga

SEQ ID NO: 1996191 - DNA, 20 bp, Homo sapiens
ctgcactccggcctgatgac

SEQ ID NO: 1996192 - DNA, 19 bp, Homo sapiens
ctgcactgacccacagcct

SEQ ID NO: 1996193 - DNA, 20 bp, Homo sapiens
ctgcactgacccacagcctc

SEQ ID NO: 1996194 - DNA, 12 bp, Homo sapiens
ctgcactgcagt

SEQ ID NO: 1996195 - DNA, 15 bp, Homo sapiens
ctgcacttcagacac

SEQ ID NO: 1996196 - DNA, 16 bp, Homo sapiens
ctgcacttcagacacc

SEQ ID NO: 1996197 - DNA, 17 bp, Homo sapiens
ctgcacttgcagactct

SEQ ID NO: 1996198 - DNA, 20 bp, Homo sapiens
ctgcagaacgtattggtcca

SEQ ID NO: 1996199 - DNA, 23 bp, Homo sapiens
ctgcagaacgtattggtccagct

SEQ ID NO: 1996200 - DNA, 13 bp, Homo sapiens
ctgcagaaggcca

SEQ ID NO: 1996201 - DNA, 15 bp, Homo sapiens
ctgcagaaggccaag

SEQ ID NO: 1996202 - DNA, 21 bp, Homo sapiens
ctgcagaccctgcccttgttt

SEQ ID NO: 1996203 - DNA, 14 bp, Homo sapiens
ctgcagagagaagc

SEQ ID NO: 1996204 - DNA, 13 bp, Homo sapiens
ctgcagagcacac

SEQ ID NO: 1996205 - DNA, 15 bp, Homo sapiens
ctgcagagctatggt

SEQ ID NO: 1996206 - DNA, 16 bp, Homo sapiens
ctgcagaggaccacag

SEQ ID NO: 1996207 - DNA, 22 bp, Homo sapiens
ctgcagaggggctttctggaga

SEQ ID NO: 1996208 - DNA, 15 bp, Homo sapiens
ctgcagatagccaga

SEQ ID NO: 1996209 - DNA, 20 bp, Homo sapiens
ctgcagatagccagacacat

SEQ ID NO: 1996210 - DNA, 24 bp, Homo sapiens
ctgcagatagccagacacatggct

SEQ ID NO: 1996211 - DNA, 12 bp, Homo sapiens
ctgcagcaactc

SEQ ID NO: 1996212 - DNA, 15 bp, Homo sapiens
ctgcagcatgaaggc

SEQ ID NO: 1996213 - DNA, 18 bp, Homo sapiens
ctgcagccaaacagagcc

SEQ ID NO: 1996214 - DNA, 14 bp, Homo sapiens
ctgcagccagccca

SEQ ID NO: 1996215 - DNA, 16 bp, Homo sapiens
ctgcagccagcccagc

SEQ ID NO: 1996216 - DNA, 22 bp, Homo sapiens
ctgcagccagcccagcccagct

SEQ ID NO: 1996217 - DNA, 23 bp, Homo sapiens
ctgcagccagcccagcccagctg

SEQ ID NO: 1996218 - DNA, 24 bp, Homo sapiens
ctgcagcccggcgccaccatcctg

SEQ ID NO: 1996219 - DNA, 22 bp, Homo sapiens
ctgcagcctcaacctcctgggc

SEQ ID NO: 1996220 - DNA, 24 bp, Homo sapiens
ctgcagcctcaacctcctgggcta

SEQ ID NO: 1996221 - DNA, 13 bp, Homo sapiens
ctgcagcctcccc

SEQ ID NO: 1996222 - DNA, 17 bp, Homo sapiens
ctgcagcctcccccaca

SEQ ID NO: 1996223 - DNA, 13 bp, Homo sapiens
ctgcagcctcctc

SEQ ID NO: 1996224 - DNA, 20 bp, Homo sapiens
ctgcagcctcctcctgacca

SEQ ID NO: 1996225 - DNA, 18 bp, Homo sapiens
ctgcagcctccttctcct

SEQ ID NO: 1996226 - DNA, 22 bp, Homo sapiens
ctgcagctatgcgcaatgtggc

SEQ ID NO: 1996227 - DNA, 19 bp, Homo sapiens
ctgcagctgcaccatcaca

SEQ ID NO: 1996228 - DNA, 12 bp, Homo sapiens
ctgcagctgctg

SEQ ID NO: 1996229 - DNA, 16 bp, Homo sapiens
ctgcagctgggcccca

SEQ ID NO: 1996230 - DNA, 19 bp, Homo sapiens
ctgcagctgggccccatgc

SEQ ID NO: 1996231 - DNA, 21 bp, Homo sapiens
ctgcagctgggccccatgctc

SEQ ID NO: 1996232 - DNA, 24 bp, Homo sapiens
ctgcagctgggccccatgctctgc

SEQ ID NO: 1996233 - DNA, 15 bp, Homo sapiens
ctgcagcttcctgtc

SEQ ID NO: 1996234 - DNA, 17 bp, Homo sapiens
ctgcagcttgtagccag

SEQ ID NO: 1996235 - DNA, 20 bp, Homo sapiens
ctgcagcttgtagccagccg

SEQ ID NO: 1996236 - DNA, 21 bp, Homo sapiens
ctgcagcttgtagccagccgg

SEQ ID NO: 1996237 - DNA, 22 bp, Homo sapiens
ctgcaggacttctgcctgaacc

SEQ ID NO: 1996238 - DNA, 17 bp, Homo sapiens
ctgcaggcaaagtgaga

SEQ ID NO: 1996239 - DNA, 12 bp, Homo sapiens
ctgcaggcacct

SEQ ID NO: 1996240 - DNA, 21 bp, Homo sapiens
ctgcaggccaagagcagaggc

SEQ ID NO: 1996241 - DNA, 14 bp, Homo sapiens
ctgcaggccccgct

SEQ ID NO: 1996242 - DNA, 23 bp, Homo sapiens
ctgcaggccccgcttgtccagcg

SEQ ID NO: 1996243 - DNA, 15 bp, Homo sapiens
ctgcagggagcaact

SEQ ID NO: 1996244 - DNA, 17 bp, Homo sapiens
ctgcagggggtgtgtct

SEQ ID NO: 1996245 - DNA, 23 bp, Homo sapiens
ctgcaggtacttcctcctgatgg

SEQ ID NO: 1996246 - DNA, 13 bp, Homo sapiens
ctgcaggtgtcta

SEQ ID NO: 1996247 - DNA, 23 bp, Homo sapiens
ctgcagtagtctctgtgctttga

SEQ ID NO: 1996248 - DNA, 17 bp, Homo sapiens
ctgcagtatggccatgg

SEQ ID NO: 1996249 - DNA, 17 bp, Homo sapiens
ctgcagtatttataaga

SEQ ID NO: 1996250 - DNA, 16 bp, Homo sapiens
ctgcagttgggccagc

SEQ ID NO: 1996251 - DNA, 18 bp, Homo sapiens
ctgcataaacttcatctt

SEQ ID NO: 1996252 - DNA, 18 bp, Homo sapiens
ctgcatatcggaggtggt

SEQ ID NO: 1996253 - DNA, 21 bp, Homo sapiens
ctgcatatcggaggtggtgga

SEQ ID NO: 1996254 - DNA, 19 bp, Homo sapiens
ctgcatccgtagttccctg

SEQ ID NO: 1996255 - DNA, 20 bp, Homo sapiens
ctgcatccgtagttccctga

SEQ ID NO: 1996256 - DNA, 20 bp, Homo sapiens
ctgcatctagaggcttcctt

SEQ ID NO: 1996257 - DNA, 21 bp, Homo sapiens
ctgcatctagaggcttccttc

SEQ ID NO: 1996258 - DNA, 20 bp, Homo sapiens
ctgcatgcctggtctttcct

SEQ ID NO: 1996259 - DNA, 17 bp, Homo sapiens
ctgcgtgctttatttat

SEQ ID NO: 1996260 - DNA, 14 bp, Homo sapiens
ctgcgttggagcca

SEQ ID NO: 1996261 - DNA, 19 bp, Homo sapiens
ctgcgtttattaatgcctc

SEQ ID NO: 1996262 - DNA, 22 bp, Homo sapiens
ctgctaagtaggggcagtgatg

SEQ ID NO: 1996263 - DNA, 23 bp, Homo sapiens
ctgctacaaatactcttaggaag

SEQ ID NO: 1996264 - DNA, 21 bp, Homo sapiens
ctgctacaccttagcagctct

SEQ ID NO: 1996265 - DNA, 15 bp, Homo sapiens
ctgctacctcactgg

SEQ ID NO: 1996266 - DNA, 17 bp, Homo sapiens
ctgctacctcactgggg

SEQ ID NO: 1996267 - DNA, 18 bp, Homo sapiens
ctgctacctcactggggt

SEQ ID NO: 1996268 - DNA, 16 bp, Homo sapiens
ctgctactacccgagc

SEQ ID NO: 1996269 - DNA, 15 bp, Homo sapiens
ctgctactcctgtgc

SEQ ID NO: 1996270 - DNA, 15 bp, Homo sapiens
ctgctagagaagggg

SEQ ID NO: 1996271 - DNA, 22 bp, Homo sapiens
ctgctagcacttggagccaagg

SEQ ID NO: 1996272 - DNA, 16 bp, Homo sapiens
ctgctagctgtagaaa

SEQ ID NO: 1996273 - DNA, 20 bp, Homo sapiens
ctgctaggcgagtgccagga

SEQ ID NO: 1996274 - DNA, 22 bp, Homo sapiens
ctgctaggcgagtgccaggact

SEQ ID NO: 1996275 - DNA, 17 bp, Homo sapiens
ctgctagtatatgtcag

SEQ ID NO: 1996276 - DNA, 16 bp, Homo sapiens
ctgctattatgtaaca

SEQ ID NO: 1996277 - DNA, 23 bp, Homo sapiens
ctgctcaacctctctccttctgg

SEQ ID NO: 1996278 - DNA, 23 bp, Homo sapiens
ctgctcaagaagacatggagact

SEQ ID NO: 1996279 - DNA, 16 bp, Homo sapiens
ctgctcacatatctgt

SEQ ID NO: 1996280 - DNA, 17 bp, Homo sapiens
ctgctcagcaggcccta

SEQ ID NO: 1996281 - DNA, 15 bp, Homo sapiens
ctgctcaggaattga

SEQ ID NO: 1996282 - DNA, 15 bp, Homo sapiens
ctgctcatcacccag

SEQ ID NO: 1996283 - DNA, 22 bp, Homo sapiens
ctgctcatcacccagtcctggc

SEQ ID NO: 1996284 - DNA, 17 bp, Homo sapiens
ctgctcatccagggtgt

SEQ ID NO: 1996285 - DNA, 19 bp, Homo sapiens
ctgctcattccttctggag

SEQ ID NO: 1996286 - DNA, 14 bp, Homo sapiens
ctgctccaagtggt

SEQ ID NO: 1996287 - DNA, 11 bp, Homo sapiens
ctgctccagag

SEQ ID NO: 1996288 - DNA, 16 bp, Homo sapiens
ctgctcccagcagccc

SEQ ID NO: 1996289 - DNA, 17 bp, Homo sapiens
ctgctcccagcagccct

SEQ ID NO: 1996290 - DNA, 21 bp, Homo sapiens
ctgctcccagcagccctaagg

SEQ ID NO: 1996291 - DNA, 12 bp, Homo sapiens
ctgctcccccac

SEQ ID NO: 1996292 - DNA, 13 bp, Homo sapiens
ctgctcccccacc

SEQ ID NO: 1996293 - DNA, 14 bp, Homo sapiens
ctgctcctctccag

SEQ ID NO: 1996294 - DNA, 17 bp, Homo sapiens
ctgctcctctccaggca

SEQ ID NO: 1996295 - DNA, 14 bp, Homo sapiens
ctgctcgaagaaca

SEQ ID NO: 1996296 - DNA, 16 bp, Homo sapiens
ctgctcgaagaacaat

SEQ ID NO: 1996297 - DNA, 19 bp, Homo sapiens
ctgctcggggtgcacagga

SEQ ID NO: 1996298 - DNA, 13 bp, Homo sapiens
ctgctctagccag

SEQ ID NO: 1996299 - DNA, 17 bp, Homo sapiens
ctgctctagccaggagt

SEQ ID NO: 1996300 - DNA, 16 bp, Homo sapiens
ctgctctagctggcag

SEQ ID NO: 1996301 - DNA, 13 bp, Homo sapiens
ctgctctcagcct

SEQ ID NO: 1996302 - DNA, 13 bp, Homo sapiens
ctgctctcatgcc

SEQ ID NO: 1996303 - DNA, 14 bp, Homo sapiens
ctgctctcatgcct

SEQ ID NO: 1996304 - DNA, 15 bp, Homo sapiens
ctgctctcatgcctg

SEQ ID NO: 1996305 - DNA, 15 bp, Homo sapiens
ctgctctctgaggga

SEQ ID NO: 1996306 - DNA, 16 bp, Homo sapiens
ctgctctctgagggag

SEQ ID NO: 1996307 - DNA, 19 bp, Homo sapiens
ctgctctcttcaggaggcc

SEQ ID NO: 1996308 - DNA, 20 bp, Homo sapiens
ctgctctgaggcttccagag

SEQ ID NO: 1996309 - DNA, 13 bp, Homo sapiens
ctgctctgcccct

SEQ ID NO: 1996310 - DNA, 13 bp, Homo sapiens
ctgctgaaacaac

SEQ ID NO: 1996311 - DNA, 22 bp, Homo sapiens
ctgctgaagaggcaagagacag

SEQ ID NO: 1996312 - DNA, 22 bp, Homo sapiens
ctgctgaatgatttccaaagag

SEQ ID NO: 1996313 - DNA, 21 bp, Homo sapiens
ctgctgacagacacaggcccg

SEQ ID NO: 1996314 - DNA, 14 bp, Homo sapiens
ctgctgacaggatg

SEQ ID NO: 1996315 - DNA, 20 bp, Homo sapiens
ctgctgacctgatcacctct

SEQ ID NO: 1996316 - DNA, 16 bp, Homo sapiens
ctgctgagaacctggc

SEQ ID NO: 1996317 - DNA, 18 bp, Homo sapiens
ctgctgagaacctggcct

SEQ ID NO: 1996318 - DNA, 20 bp, Homo sapiens
ctgctgagaacctggccttc

SEQ ID NO: 1996319 - DNA, 21 bp, Homo sapiens
ctgctgagagacccaaggagg

SEQ ID NO: 1996320 - DNA, 14 bp, Homo sapiens
ctgctgagctctga

SEQ ID NO: 1996321 - DNA, 16 bp, Homo sapiens
ctgctgagctctgaga

SEQ ID NO: 1996322 - DNA, 21 bp, Homo sapiens
ctgctgagctctgagaggccc

SEQ ID NO: 1996323 - DNA, 13 bp, Homo sapiens
ctgctgcaaagtg

SEQ ID NO: 1996324 - DNA, 15 bp, Homo sapiens
ctgctgcaaagtgca

SEQ ID NO: 1996325 - DNA, 15 bp, Homo sapiens
ctgctgcaccagagt

SEQ ID NO: 1996326 - DNA, 21 bp, Homo sapiens
ctgctgcaccagagtgaaagg

SEQ ID NO: 1996327 - DNA, 12 bp, Homo sapiens
ctgctgcccagc

SEQ ID NO: 1996328 - DNA, 16 bp, Homo sapiens
ctgctgccccgcttcc

SEQ ID NO: 1996329 - DNA, 20 bp, Homo sapiens
ctgctgccccgcttccccac

SEQ ID NO: 1996330 - DNA, 13 bp, Homo sapiens
ctgctgcccctgc

SEQ ID NO: 1996331 - DNA, 15 bp, Homo sapiens
ctgctgcccctgcag

SEQ ID NO: 1996332 - DNA, 16 bp, Homo sapiens
ctgctgcgtcagacca

SEQ ID NO: 1996333 - DNA, 20 bp, Homo sapiens
ctgctgcgtcagaccagtac

SEQ ID NO: 1996334 - DNA, 22 bp, Homo sapiens
ctgctgctactacccgagccca

SEQ ID NO: 1996335 - DNA, 17 bp, Homo sapiens
ctgctgctcatccaggg

SEQ ID NO: 1996336 - DNA, 16 bp, Homo sapiens
ctgctgctgagaacct

SEQ ID NO: 1996337 - DNA, 17 bp, Homo sapiens
ctgctgctgagaacctg

SEQ ID NO: 1996338 - DNA, 21 bp, Homo sapiens
ctgctgctgagaacctggcct

SEQ ID NO: 1996339 - DNA, 20 bp, Homo sapiens
ctgctgctgtaactgctgag

SEQ ID NO: 1996340 - DNA, 22 bp, Homo sapiens
ctgctgctgtaactgctgagcc

SEQ ID NO: 1996341 - DNA, 16 bp, Homo sapiens
ctgctggcacctcaga

SEQ ID NO: 1996342 - DNA, 23 bp, Homo sapiens
ctgctggcacctcagacaatcca

SEQ ID NO: 1996343 - DNA, 15 bp, Homo sapiens
ctgctggcctggatc

SEQ ID NO: 1996344 - DNA, 11 bp, Homo sapiens
ctgctgggaac

SEQ ID NO: 1996345 - DNA, 17 bp, Homo sapiens
ctgctgggaaccccgca

SEQ ID NO: 1996346 - DNA, 15 bp, Homo sapiens
ctgctgggctctcca

SEQ ID NO: 1996347 - DNA, 18 bp, Homo sapiens
ctgctgggctctccacct

SEQ ID NO: 1996348 - DNA, 21 bp, Homo sapiens
ctgctgggctctccacctcag

SEQ ID NO: 1996349 - DNA, 12 bp, Homo sapiens
ctgctggggcat

SEQ ID NO: 1996350 - DNA, 15 bp, Homo sapiens
ctgctggggcatgtg

SEQ ID NO: 1996351 - DNA, 19 bp, Homo sapiens
ctgctggggcatgtgtgcc

SEQ ID NO: 1996352 - DNA, 23 bp, Homo sapiens
ctgctggggcatgtgtgcctgtg

SEQ ID NO: 1996353 - DNA, 20 bp, Homo sapiens
ctgctggtaatttgtatctg

SEQ ID NO: 1996354 - DNA, 13 bp, Homo sapiens
ctgctggttcagg

SEQ ID NO: 1996355 - DNA, 16 bp, Homo sapiens
ctgctgtaactgctga

SEQ ID NO: 1996356 - DNA, 21 bp, Homo sapiens
ctgctgtaactgctgagccac

SEQ ID NO: 1996357 - DNA, 22 bp, Homo sapiens
ctgctgtaactgctgagccact

SEQ ID NO: 1996358 - DNA, 23 bp, Homo sapiens
ctgctgtgaatttgtgtaaggat

SEQ ID NO: 1996359 - DNA, 23 bp, Homo sapiens
ctgctgtgcaccttacattccta

SEQ ID NO: 1996360 - DNA, 13 bp, Homo sapiens
ctgctgtggcctc

SEQ ID NO: 1996361 - DNA, 19 bp, Homo sapiens
ctgctgtggcctcacttcc

SEQ ID NO: 1996362 - DNA, 23 bp, Homo sapiens
ctgctgtggcctcacttccctgg

SEQ ID NO: 1996363 - DNA, 19 bp, Homo sapiens
ctgctgtgggagagcgaag

SEQ ID NO: 1996364 - DNA, 10 bp, Homo sapiens
ctgctgtgta

SEQ ID NO: 1996365 - DNA, 13 bp, Homo sapiens
ctgctgtgtagct

SEQ ID NO: 1996366 - DNA, 17 bp, Homo sapiens
ctgctgtgtagctctgt

SEQ ID NO: 1996367 - DNA, 18 bp, Homo sapiens
ctgctgtgtagctctgtc

SEQ ID NO: 1996368 - DNA, 19 bp, Homo sapiens
ctgctgtgtagctctgtcc

SEQ ID NO: 1996369 - DNA, 19 bp, Homo sapiens
ctgctgtgtgaattcccag

SEQ ID NO: 1996370 - DNA, 16 bp, Homo sapiens
ctgctgttgccatagc

SEQ ID NO: 1996371 - DNA, 18 bp, Homo sapiens
ctgctgttgctggactga

SEQ ID NO: 1996372 - DNA, 20 bp, Homo sapiens
ctgctgttgctggactgagg

SEQ ID NO: 1996373 - DNA, 22 bp, Homo sapiens
ctgctgttgctggactgaggac

SEQ ID NO: 1996374 - DNA, 21 bp, Homo sapiens
ctgtcatcactccctggatgt

SEQ ID NO: 1996375 - DNA, 13 bp, Homo sapiens
ctgtcatcccgct

SEQ ID NO: 1996376 - DNA, 21 bp, Homo sapiens
ctgtcatccgtttcagctgac

SEQ ID NO: 1996377 - DNA, 14 bp, Homo sapiens
ctgtcatctagccc

SEQ ID NO: 1996378 - DNA, 17 bp, Homo sapiens
ctgtcatctagcccctt

SEQ ID NO: 1996379 - DNA, 14 bp, Homo sapiens
ctgtcatctctctg

SEQ ID NO: 1996380 - DNA, 22 bp, Homo sapiens
ctgtcatggtgtccagacagag

SEQ ID NO: 1996381 - DNA, 17 bp, Homo sapiens
ctgtcattcaaatgggt

SEQ ID NO: 1996382 - DNA, 22 bp, Homo sapiens
ctgtcattcaggaccccaaccc

SEQ ID NO: 1996383 - DNA, 23 bp, Homo sapiens
ctgtcattcaggaccccaacccc

SEQ ID NO: 1996384 - DNA, 14 bp, Homo sapiens
ctgtcattgtccat

SEQ ID NO: 1996385 - DNA, 23 bp, Homo sapiens
ctgtcattgtccatgcctacaga

SEQ ID NO: 1996386 - DNA, 14 bp, Homo sapiens
ctgtcatttgagca

SEQ ID NO: 1996387 - DNA, 21 bp, Homo sapiens
ctgtcatttgagcagggctca

SEQ ID NO: 1996388 - DNA, 20 bp, Homo sapiens
ctgtccaacctaaccccttt

SEQ ID NO: 1996389 - DNA, 12 bp, Homo sapiens
ctgtccactctc

SEQ ID NO: 1996390 - DNA, 23 bp, Homo sapiens
ctgtccactctcggggcccttgg

SEQ ID NO: 1996391 - DNA, 17 bp, Homo sapiens
ctgtccaggcactgctg

SEQ ID NO: 1996392 - DNA, 19 bp, Homo sapiens
ctgtccaggcactgctgcc

SEQ ID NO: 1996393 - DNA, 14 bp, Homo sapiens
ctgtccaggccact

SEQ ID NO: 1996394 - DNA, 16 bp, Homo sapiens
ctgtccaggccactgt

SEQ ID NO: 1996395 - DNA, 18 bp, Homo sapiens
ctgtccagggccctgagc

SEQ ID NO: 1996396 - DNA, 19 bp, Homo sapiens
ctgtccagggccctgagct

SEQ ID NO: 1996397 - DNA, 20 bp, Homo sapiens
ctgtccagggccctgagctc

SEQ ID NO: 1996398 - DNA, 23 bp, Homo sapiens
ctgtccataaagtaattttgtga

SEQ ID NO: 1996399 - DNA, 14 bp, Homo sapiens
ctgtcccaccaact

SEQ ID NO: 1996400 - DNA, 21 bp, Homo sapiens
ctgtcccaccaactctgcact

SEQ ID NO: 1996401 - DNA, 15 bp, Homo sapiens
ctgtcccaccgggag

SEQ ID NO: 1996402 - DNA, 22 bp, Homo sapiens
ctgtcccaccgggagcctcccc

SEQ ID NO: 1996403 - DNA, 23 bp, Homo sapiens
ctgtcccacctcttctcttcctg

SEQ ID NO: 1996404 - DNA, 22 bp, Homo sapiens
ctgtcccagagcttattggcca

SEQ ID NO: 1996405 - DNA, 22 bp, Homo sapiens
ctgtcccagaggttatctgcct

SEQ ID NO: 1996406 - DNA, 23 bp, Homo sapiens
ctgtcccagaggttatctgcctg

SEQ ID NO: 1996407 - DNA, 22 bp, Homo sapiens
ctgtccccctgagatcagagtc

SEQ ID NO: 1996408 - DNA, 15 bp, Homo sapiens
ctgtcccctctgtca

SEQ ID NO: 1996409 - DNA, 18 bp, Homo sapiens
ctgtcccctctgtcatca

SEQ ID NO: 1996410 - DNA, 20 bp, Homo sapiens
ctgtcccctgaaaaactgat

SEQ ID NO: 1996411 - DNA, 21 bp, Homo sapiens
ctgtcccgccttcctcctcca

SEQ ID NO: 1996412 - DNA, 14 bp, Homo sapiens
ctgtccctacccac

SEQ ID NO: 1996413 - DNA, 17 bp, Homo sapiens
ctgtccctacccactct

SEQ ID NO: 1996414 - DNA, 22 bp, Homo sapiens
ctgtccctacccactctttgct

SEQ ID NO: 1996415 - DNA, 23 bp, Homo sapiens
ctgtccctcaaatgacccaaaga

SEQ ID NO: 1996416 - DNA, 22 bp, Homo sapiens
ctgtccctctttgcctgtgtga

SEQ ID NO: 1996417 - DNA, 17 bp, Homo sapiens
ctgtccctgtcaccaag

SEQ ID NO: 1996418 - DNA, 18 bp, Homo sapiens
ctgtccgcctctgcccgc

SEQ ID NO: 1996419 - DNA, 21 bp, Homo sapiens
ctgtccgcctctgcccgcaga

SEQ ID NO: 1996420 - DNA, 20 bp, Homo sapiens
ctgtcctactctgtgtcagg

SEQ ID NO: 1996421 - DNA, 13 bp, Homo sapiens
ctgtcctccagct

SEQ ID NO: 1996422 - DNA, 14 bp, Homo sapiens
ctgtcctccagctt

SEQ ID NO: 1996423 - DNA, 19 bp, Homo sapiens
ctgtcctccagcttcccct

SEQ ID NO: 1996424 - DNA, 16 bp, Homo sapiens
ctgtcctcccatcccc

SEQ ID NO: 1996425 - DNA, 13 bp, Homo sapiens
ctgtcctctcgag

SEQ ID NO: 1996426 - DNA, 12 bp, Homo sapiens
ctgtcctgcctc

SEQ ID NO: 1996427 - DNA, 13 bp, Homo sapiens
ctgtcctgcctct

SEQ ID NO: 1996428 - DNA, 16 bp, Homo sapiens
ctgtcctggctgctct

SEQ ID NO: 1996429 - DNA, 21 bp, Homo sapiens
ctgtcctggctgctctcatgc

SEQ ID NO: 1996430 - DNA, 15 bp, Homo sapiens
ctgtccttttaggaa

SEQ ID NO: 1996431 - DNA, 13 bp, Homo sapiens
ctgtcgagacact

SEQ ID NO: 1996432 - DNA, 18 bp, Homo sapiens
ctgtcgagacacttgcct

SEQ ID NO: 1996433 - DNA, 19 bp, Homo sapiens
ctgtcgattagactggaca

SEQ ID NO: 1996434 - DNA, 16 bp, Homo sapiens
ctgtcgcatctcagcg

SEQ ID NO: 1996435 - DNA, 16 bp, Homo sapiens
ctgtcgcccagtctgg

SEQ ID NO: 1996436 - DNA, 13 bp, Homo sapiens
ctgtcgctgcttc

SEQ ID NO: 1996437 - DNA, 14 bp, Homo sapiens
ctgtcgctgcttcg

SEQ ID NO: 1996438 - DNA, 17 bp, Homo sapiens
ctgtcgctgcttcgtgg

SEQ ID NO: 1996439 - DNA, 21 bp, Homo sapiens
ctgtcgtgtttacaaaaggca

SEQ ID NO: 1996440 - DNA, 18 bp, Homo sapiens
ctgtctcaagagggcact

SEQ ID NO: 1996441 - DNA, 21 bp, Homo sapiens
ctgtctcaagagggcactggt

SEQ ID NO: 1996442 - DNA, 22 bp, Homo sapiens
ctgtctcaagagggcactggtg

SEQ ID NO: 1996443 - DNA, 18 bp, Homo sapiens
ctgtctcaagctcttcct

SEQ ID NO: 1996444 - DNA, 14 bp, Homo sapiens
ctgtctccctgggg

SEQ ID NO: 1996445 - DNA, 15 bp, Homo sapiens
ctgtctccctggggt

SEQ ID NO: 1996446 - DNA, 18 bp, Homo sapiens
ctgtctcctggtctgtgc

SEQ ID NO: 1996447 - DNA, 16 bp, Homo sapiens
ctgtctcgagcgccct

SEQ ID NO: 1996448 - DNA, 18 bp, Homo sapiens
ctgtctcgagcgccctgc

SEQ ID NO: 1996449 - DNA, 23 bp, Homo sapiens
ctgtctcgagcgccctgcagacc

SEQ ID NO: 1996450 - DNA, 13 bp, Homo sapiens
ctgtctctcatga

SEQ ID NO: 1996451 - DNA, 17 bp, Homo sapiens
ctgtctctcatgaacct

SEQ ID NO: 1996452 - DNA, 12 bp, Homo sapiens
ctgtctctcttg

SEQ ID NO: 1996453 - DNA, 19 bp, Homo sapiens
ctgtctctcttgctttgtt

SEQ ID NO: 1996454 - DNA, 14 bp, Homo sapiens
ctgtctctgcctgc

SEQ ID NO: 1996455 - DNA, 13 bp, Homo sapiens
ctgtctctgctct

SEQ ID NO: 1996456 - DNA, 16 bp, Homo sapiens
ctgtctctgctcttgc

SEQ ID NO: 1996457 - DNA, 18 bp, Homo sapiens
ctgtctctgctcttgcct

SEQ ID NO: 1996458 - DNA, 20 bp, Homo sapiens
ctgtctctgctcttgcctgc

SEQ ID NO: 1996459 - DNA, 17 bp, Homo sapiens
ctgtctctgtccctcac

SEQ ID NO: 1996460 - DNA, 21 bp, Homo sapiens
ctgtctgccagccagcagcca

SEQ ID NO: 1996461 - DNA, 17 bp, Homo sapiens
ctgtctggttttaacaa

SEQ ID NO: 1996462 - DNA, 13 bp, Homo sapiens
ctgtctgtcacca

SEQ ID NO: 1996463 - DNA, 16 bp, Homo sapiens
ctgtctgtcaccagct

SEQ ID NO: 1996464 - DNA, 22 bp, Homo sapiens
ctgtctgtcaccagctatctgt

SEQ ID NO: 1996465 - DNA, 17 bp, Homo sapiens
ctgtctgtctgtcccaa

SEQ ID NO: 1996466 - DNA, 14 bp, Homo sapiens
ctgtctgtctgtct

SEQ ID NO: 1996467 - DNA, 15 bp, Homo sapiens
ctgtctgtctgtctg

SEQ ID NO: 1996468 - DNA, 14 bp, Homo sapiens
ctgtcttcacaacc

SEQ ID NO: 1996469 - DNA, 19 bp, Homo sapiens
ctgtcttcatagcagattt

SEQ ID NO: 1996470 - DNA, 13 bp, Homo sapiens
ctgtcttctctca

SEQ ID NO: 1996471 - DNA, 17 bp, Homo sapiens
ctgtcttctctcaaagg

SEQ ID NO: 1996472 - DNA, 15 bp, Homo sapiens
ctgtcttgccagcca

SEQ ID NO: 1996473 - DNA, 16 bp, Homo sapiens
ctgtctttaaggaaaa

SEQ ID NO: 1996474 - DNA, 18 bp, Homo sapiens
ctgtgaaagtatgtgata

SEQ ID NO: 1996475 - DNA, 14 bp, Homo sapiens
ctgtgaacccagga

SEQ ID NO: 1996476 - DNA, 16 bp, Homo sapiens
ctgtgaagacccagca

SEQ ID NO: 1996477 - DNA, 21 bp, Homo sapiens
ctgtgaataaaaaccctgtat

SEQ ID NO: 1996478 - DNA, 19 bp, Homo sapiens
ctgtgaatttgtgtaagga

SEQ ID NO: 1996479 - DNA, 18 bp, Homo sapiens
ctgtgacaccagaataat

SEQ ID NO: 1996480 - DNA, 22 bp, Homo sapiens
ctgtgacaccagaataatgagt

SEQ ID NO: 1996481 - DNA, 22 bp, Homo sapiens
ctgtgacaggaagcccaaggca

SEQ ID NO: 1996482 - DNA, 17 bp, Homo sapiens
ctgtgacctctcccctg

SEQ ID NO: 1996483 - DNA, 15 bp, Homo sapiens
ctgtgacctgctgag

SEQ ID NO: 1996484 - DNA, 23 bp, Homo sapiens
ctgtgacctgctgagctctgaga

SEQ ID NO: 1996485 - DNA, 17 bp, Homo sapiens
ctgtgactcgcttagct

SEQ ID NO: 1996486 - DNA, 20 bp, Homo sapiens
ctgtgactcgcttagctgaa

SEQ ID NO: 1996487 - DNA, 18 bp, Homo sapiens
ctgtgactgccaaggtgt

SEQ ID NO: 1996488 - DNA, 20 bp, Homo sapiens
cttcaagtgttgctcttgga

SEQ ID NO: 1996489 - DNA, 18 bp, Homo sapiens
cttcaagttaaagtgaat

SEQ ID NO: 1996490 - DNA, 15 bp, Homo sapiens
cttcaattcctgggc

SEQ ID NO: 1996491 - DNA, 12 bp, Homo sapiens
cttcacaacaga

SEQ ID NO: 1996492 - DNA, 22 bp, Homo sapiens
cttcacaacctccgtgctgggc

SEQ ID NO: 1996493 - DNA, 22 bp, Homo sapiens
cttcacacacaggcaactgagg

SEQ ID NO: 1996494 - DNA, 12 bp, Homo sapiens
cttcacactgca

SEQ ID NO: 1996495 - DNA, 13 bp, Homo sapiens
cttcacactgcaa

SEQ ID NO: 1996496 - DNA, 15 bp, Homo sapiens
cttcacactgcaaga

SEQ ID NO: 1996497 - DNA, 16 bp, Homo sapiens
cttcacagcagccact

SEQ ID NO: 1996498 - DNA, 14 bp, Homo sapiens
cttcacagtgtttc

SEQ ID NO: 1996499 - DNA, 12 bp, Homo sapiens
cttcacatttaa

SEQ ID NO: 1996500 - DNA, 16 bp, Homo sapiens
cttcaccagagcccat

SEQ ID NO: 1996501 - DNA, 23 bp, Homo sapiens
cttcaccagcaactctgactctt

SEQ ID NO: 1996502 - DNA, 22 bp, Homo sapiens
cttcacccagctaatctgtagg

SEQ ID NO: 1996503 - DNA, 24 bp, Homo sapiens
cttcacccagctaatctgtagggc

SEQ ID NO: 1996504 - DNA, 14 bp, Homo sapiens
cttcacccctgcac

SEQ ID NO: 1996505 - DNA, 19 bp, Homo sapiens
cttcacctttggtgcagag

SEQ ID NO: 1996506 - DNA, 15 bp, Homo sapiens
cttcactcactgtca

SEQ ID NO: 1996507 - DNA, 16 bp, Homo sapiens
cttcactcagccacac

SEQ ID NO: 1996508 - DNA, 14 bp, Homo sapiens
cttcactccctccc

SEQ ID NO: 1996509 - DNA, 19 bp, Homo sapiens
cttcactccggtgtgcctg

SEQ ID NO: 1996510 - DNA, 23 bp, Homo sapiens
cttcactccggtgtgcctgcagc

SEQ ID NO: 1996511 - DNA, 15 bp, Homo sapiens
cttcactgttgaaaa

SEQ ID NO: 1996512 - DNA, 15 bp, Homo sapiens
cttcactttaattct

SEQ ID NO: 1996513 - DNA, 21 bp, Homo sapiens
cttcactttaattctcatgtg

SEQ ID NO: 1996514 - DNA, 15 bp, Homo sapiens
cttcagaacagaggc

SEQ ID NO: 1996515 - DNA, 18 bp, Homo sapiens
cttcagaacatgctggat

SEQ ID NO: 1996516 - DNA, 21 bp, Homo sapiens
cttcagaatatggacaaagaa

SEQ ID NO: 1996517 - DNA, 19 bp, Homo sapiens
cttcagacttttatcaaaa

SEQ ID NO: 1996518 - DNA, 14 bp, Homo sapiens
cttcagagaagtca

SEQ ID NO: 1996519 - DNA, 11 bp, Homo sapiens
cttcagagcct

SEQ ID NO: 1996520 - DNA, 15 bp, Homo sapiens
cttcagagcctagcc

SEQ ID NO: 1996521 - DNA, 20 bp, Homo sapiens
cttcagagcctagccacctc

SEQ ID NO: 1996522 - DNA, 22 bp, Homo sapiens
cttcagagcctagccacctccc

SEQ ID NO: 1996523 - DNA, 23 bp, Homo sapiens
cttcagcataattcggaagggaa

SEQ ID NO: 1996524 - DNA, 13 bp, Homo sapiens
cttcagccctggc

SEQ ID NO: 1996525 - DNA, 22 bp, Homo sapiens
cttcagcctagccgacctcagc

SEQ ID NO: 1996526 - DNA, 14 bp, Homo sapiens
cttcagcctcccga

SEQ ID NO: 1996527 - DNA, 16 bp, Homo sapiens
cttcagcctcccgagt

SEQ ID NO: 1996528 - DNA, 20 bp, Homo sapiens
cttcagcctgaggctgagac

SEQ ID NO: 1996529 - DNA, 22 bp, Homo sapiens
cttcagcctgaggctgagactg

SEQ ID NO: 1996530 - DNA, 15 bp, Homo sapiens
cttcagcgagaccct

SEQ ID NO: 1996531 - DNA, 23 bp, Homo sapiens
cttcagcgagacccttgcattag

SEQ ID NO: 1996532 - DNA, 16 bp, Homo sapiens
cttcagctcccatagc

SEQ ID NO: 1996533 - DNA, 21 bp, Homo sapiens
cttcagctcccatagcgctgg

SEQ ID NO: 1996534 - DNA, 22 bp, Homo sapiens
cttcaggaggccctggtgtcag

SEQ ID NO: 1996535 - DNA, 17 bp, Homo sapiens
cttcaggctcttctcct

SEQ ID NO: 1996536 - DNA, 23 bp, Homo sapiens
cttcagggactcaagggtccaga

SEQ ID NO: 1996537 - DNA, 22 bp, Homo sapiens
cttcagggccagaaggagggca

SEQ ID NO: 1996538 - DNA, 11 bp, Homo sapiens
cttcagggctg

SEQ ID NO: 1996539 - DNA, 21 bp, Homo sapiens
cttcaggtgcttttgatgtga

SEQ ID NO: 1996540 - DNA, 13 bp, Homo sapiens
cttcagtgcccac

SEQ ID NO: 1996541 - DNA, 17 bp, Homo sapiens
cttcagtggcagctgct

SEQ ID NO: 1996542 - DNA, 17 bp, Homo sapiens
cttcagttgttttcccg

SEQ ID NO: 1996543 - DNA, 15 bp, Homo sapiens
cttcataacaatttt

SEQ ID NO: 1996544 - DNA, 19 bp, Homo sapiens
cttcataacaattttagga

SEQ ID NO: 1996545 - DNA, 20 bp, Homo sapiens
cttcataggcggtcatgtgt

SEQ ID NO: 1996546 - DNA, 22 bp, Homo sapiens
cttcataggcggtcatgtgtgc

SEQ ID NO: 1996547 - DNA, 23 bp, Homo sapiens
cttcataggcggtcatgtgtgca

SEQ ID NO: 1996548 - DNA, 13 bp, Homo sapiens
cttcatcaatttt

SEQ ID NO: 1996549 - DNA, 16 bp, Homo sapiens
cttcatcaatttttat

SEQ ID NO: 1996550 - DNA, 17 bp, Homo sapiens
cttcatcaatttttata

SEQ ID NO: 1996551 - DNA, 22 bp, Homo sapiens
cttcatcaatttttatacatat

SEQ ID NO: 1996552 - DNA, 19 bp, Homo sapiens
cttcatcgaacaaactgat

SEQ ID NO: 1996553 - DNA, 20 bp, Homo sapiens
cttcatcgaacaaactgatg

SEQ ID NO: 1996554 - DNA, 12 bp, Homo sapiens
cttcatcttgac

SEQ ID NO: 1996555 - DNA, 23 bp, Homo sapiens
cttcatgaggaggtcagcccatt

SEQ ID NO: 1996556 - DNA, 13 bp, Homo sapiens
cttcatgcctcag

SEQ ID NO: 1996557 - DNA, 22 bp, Homo sapiens
cttcatgcctcagtttccccat

SEQ ID NO: 1996558 - DNA, 15 bp, Homo sapiens
cttcatggaccaaga

SEQ ID NO: 1996559 - DNA, 19 bp, Homo sapiens
cttcatggccatagctttt

SEQ ID NO: 1996560 - DNA, 16 bp, Homo sapiens
cttcattgaccaagat

SEQ ID NO: 1996561 - DNA, 22 bp, Homo sapiens
cttcatttccgtgaagggcacc

SEQ ID NO: 1996562 - DNA, 11 bp, Homo sapiens
cttcatttgtg

SEQ ID NO: 1996563 - DNA, 14 bp, Homo sapiens
cttcatttgtgtca

SEQ ID NO: 1996564 - DNA, 13 bp, Homo sapiens
cttcattttacat

SEQ ID NO: 1996565 - DNA, 19 bp, Homo sapiens
cttcattttgagtctcagg

SEQ ID NO: 1996566 - DNA, 14 bp, Homo sapiens
cttccaaccccagc

SEQ ID NO: 1996567 - DNA, 23 bp, Homo sapiens
cttccaccgggcctgaaccacag

SEQ ID NO: 1996568 - DNA, 19 bp, Homo sapiens
cttccagaccacctgccag

SEQ ID NO: 1996569 - DNA, 16 bp, Homo sapiens
cttccagctagtgacc

SEQ ID NO: 1996570 - DNA, 17 bp, Homo sapiens
cttccaggagcccagag

SEQ ID NO: 1996571 - DNA, 18 bp, Homo sapiens
cttccaggagcccagagg

SEQ ID NO: 1996572 - DNA, 16 bp, Homo sapiens
cttccaggcccccacc

SEQ ID NO: 1996573 - DNA, 19 bp, Homo sapiens
cttccaggcccccaccact

SEQ ID NO: 1996574 - DNA, 12 bp, Homo sapiens
cttccaggctct

SEQ ID NO: 1996575 - DNA, 13 bp, Homo sapiens
cttccaggctctt

SEQ ID NO: 1996576 - DNA, 17 bp, Homo sapiens
cttccaggctcttcctg

SEQ ID NO: 1996577 - DNA, 22 bp, Homo sapiens
cttccaggctcttcctggacct

SEQ ID NO: 1996578 - DNA, 21 bp, Homo sapiens
cttccaggtagggccagctca

SEQ ID NO: 1996579 - DNA, 22 bp, Homo sapiens
cttccagtggctcgctccctgt

SEQ ID NO: 1996580 - DNA, 16 bp, Homo sapiens
cttccagtggtaccag

SEQ ID NO: 1996581 - DNA, 21 bp, Homo sapiens
cttccagtggtaccagctcac

SEQ ID NO: 1996582 - DNA, 23 bp, Homo sapiens
cttccagtggtaccagctcactc

SEQ ID NO: 1996583 - DNA, 21 bp, Homo sapiens
cttccagtgttggctgtgtga

SEQ ID NO: 1996584 - DNA, 21 bp, Homo sapiens
cttccagtttgctttgccctt

SEQ ID NO: 1996585 - DNA, 11 bp, Homo sapiens
cttccataatg

SEQ ID NO: 1996586 - DNA, 18 bp, Homo sapiens
cttcccaatcagcactga

SEQ ID NO: 1996587 - DNA, 19 bp, Homo sapiens
cttcccaatcagcactgaa

SEQ ID NO: 1996588 - DNA, 21 bp, Homo sapiens
cttcccaatcagcactgaaaa

SEQ ID NO: 1996589 - DNA, 10 bp, Homo sapiens
cttcccagag

SEQ ID NO: 1996590 - DNA, 19 bp, Homo sapiens
cttcccagagaagctcatt

SEQ ID NO: 1996591 - DNA, 17 bp, Homo sapiens
cttcccagaggcagagc

SEQ ID NO: 1996592 - DNA, 20 bp, Homo sapiens
cttcccagctctccctctgg

SEQ ID NO: 1996593 - DNA, 16 bp, Homo sapiens
cttcccatcactggag

SEQ ID NO: 1996594 - DNA, 17 bp, Homo sapiens
cttcccatccccagcga

SEQ ID NO: 1996595 - DNA, 16 bp, Homo sapiens
cttccccaaataatat

SEQ ID NO: 1996596 - DNA, 14 bp, Homo sapiens
cttccccacagaac

SEQ ID NO: 1996597 - DNA, 22 bp, Homo sapiens
cttccccaccccagtttttgtt

SEQ ID NO: 1996598 - DNA, 12 bp, Homo sapiens
cttccccagact

SEQ ID NO: 1996599 - DNA, 13 bp, Homo sapiens
cttccccagactc

SEQ ID NO: 1996600 - DNA, 17 bp, Homo sapiens
cttccccagactcagct

SEQ ID NO: 1996601 - DNA, 20 bp, Homo sapiens
cttccccagactcagctcca

SEQ ID NO: 1996602 - DNA, 15 bp, Homo sapiens
cttggggcctggctt

SEQ ID NO: 1996603 - DNA, 19 bp, Homo sapiens
cttggggctcgccccaccc

SEQ ID NO: 1996604 - DNA, 13 bp, Homo sapiens
cttggggggtgat

SEQ ID NO: 1996605 - DNA, 22 bp, Homo sapiens
cttggggggtgatgagggcagc

SEQ ID NO: 1996606 - DNA, 23 bp, Homo sapiens
cttggggggtttttactccagtg

SEQ ID NO: 1996607 - DNA, 15 bp, Homo sapiens
cttggggtcccaggg

SEQ ID NO: 1996608 - DNA, 20 bp, Homo sapiens
cttggggttttcagtatgaa

SEQ ID NO: 1996609 - DNA, 17 bp, Homo sapiens
cttgggtcccagggaag

SEQ ID NO: 1996610 - DNA, 22 bp, Homo sapiens
cttgggtcgccctaccctcact

SEQ ID NO: 1996611 - DNA, 23 bp, Homo sapiens
cttgggtcgccctaccctcactc

SEQ ID NO: 1996612 - DNA, 22 bp, Homo sapiens
cttgggtgtaacaggtctcctc

SEQ ID NO: 1996613 - DNA, 23 bp, Homo sapiens
cttggtaaattgtaaacagctaa

SEQ ID NO: 1996614 - DNA, 17 bp, Homo sapiens
cttggtccctggtccct

SEQ ID NO: 1996615 - DNA, 18 bp, Homo sapiens
cttggtcctgtcaccctg

SEQ ID NO: 1996616 - DNA, 15 bp, Homo sapiens
cttggtctcagcttc

SEQ ID NO: 1996617 - DNA, 16 bp, Homo sapiens
cttggtgactgtccca

SEQ ID NO: 1996618 - DNA, 13 bp, Homo sapiens
cttggttggctgg

SEQ ID NO: 1996619 - DNA, 21 bp, Homo sapiens
cttggtttggacacagtgttc

SEQ ID NO: 1996620 - DNA, 17 bp, Homo sapiens
cttggtttggggagaaa

SEQ ID NO: 1996621 - DNA, 21 bp, Homo sapiens
cttggttttgctacataatta

SEQ ID NO: 1996622 - DNA, 18 bp, Homo sapiens
cttgtaaaaattaaaagt

SEQ ID NO: 1996623 - DNA, 23 bp, Homo sapiens
cttgtaaataaatagatttgatt

SEQ ID NO: 1996624 - DNA, 13 bp, Homo sapiens
cttgtaaatacac

SEQ ID NO: 1996625 - DNA, 17 bp, Homo sapiens
cttgtaaatagctcagg

SEQ ID NO: 1996626 - DNA, 21 bp, Homo sapiens
cttgtaaatagctcaggtgtc

SEQ ID NO: 1996627 - DNA, 21 bp, Homo sapiens
cttgtaactccaccaacccat

SEQ ID NO: 1996628 - DNA, 23 bp, Homo sapiens
cttgtaattctaaatgaatgttt

SEQ ID NO: 1996629 - DNA, 13 bp, Homo sapiens
cttgtaatttcta

SEQ ID NO: 1996630 - DNA, 14 bp, Homo sapiens
cttgtaccccatcc

SEQ ID NO: 1996631 - DNA, 17 bp, Homo sapiens
cttgtaccccatccctt

SEQ ID NO: 1996632 - DNA, 17 bp, Homo sapiens
cttgtactatgttaata

SEQ ID NO: 1996633 - DNA, 17 bp, Homo sapiens
cttgtagaaatctgtaa

SEQ ID NO: 1996634 - DNA, 21 bp, Homo sapiens
cttgtagaccactgtcctggc

SEQ ID NO: 1996635 - DNA, 13 bp, Homo sapiens
cttgtagccagcc

SEQ ID NO: 1996636 - DNA, 15 bp, Homo sapiens
cttgtagccagccgg

SEQ ID NO: 1996637 - DNA, 21 bp, Homo sapiens
cttgtagccagccggggcgag

SEQ ID NO: 1996638 - DNA, 23 bp, Homo sapiens
cttgtataaatgtatatacacat

SEQ ID NO: 1996639 - DNA, 15 bp, Homo sapiens
cttgtatagtgtaaa

SEQ ID NO: 1996640 - DNA, 14 bp, Homo sapiens
cttgtatatacata

SEQ ID NO: 1996641 - DNA, 17 bp, Homo sapiens
cttgtatatacatatta

SEQ ID NO: 1996642 - DNA, 23 bp, Homo sapiens
cttgtatatacatattataaata

SEQ ID NO: 1996643 - DNA, 23 bp, Homo sapiens
cttgtatattccaccattcacat

SEQ ID NO: 1996644 - DNA, 12 bp, Homo sapiens
cttgtatttaaa

SEQ ID NO: 1996645 - DNA, 20 bp, Homo sapiens
cttgtcaggacccaggccgc

SEQ ID NO: 1996646 - DNA, 23 bp, Homo sapiens
cttgtcatccataaagcaagctc

SEQ ID NO: 1996647 - DNA, 19 bp, Homo sapiens
cttgtccacagtctcccat

SEQ ID NO: 1996648 - DNA, 16 bp, Homo sapiens
cttgtcctatgtcaat

SEQ ID NO: 1996649 - DNA, 14 bp, Homo sapiens
cttgtcctctcccg

SEQ ID NO: 1996650 - DNA, 17 bp, Homo sapiens
cttgtcctgccagctgc

SEQ ID NO: 1996651 - DNA, 18 bp, Homo sapiens
cttgtcctgccagctgcc

SEQ ID NO: 1996652 - DNA, 19 bp, Homo sapiens
cttgtcctgccagctgcct

SEQ ID NO: 1996653 - DNA, 20 bp, Homo sapiens
cttgtcctgccagctgcctt

SEQ ID NO: 1996654 - DNA, 14 bp, Homo sapiens
cttgtcctgctctc

SEQ ID NO: 1996655 - DNA, 23 bp, Homo sapiens
cttgtccttttgtaccatggtgt

SEQ ID NO: 1996656 - DNA, 21 bp, Homo sapiens
cttgtctctcattctctttct

SEQ ID NO: 1996657 - DNA, 22 bp, Homo sapiens
cttgtctgaggcctcatccctc

SEQ ID NO: 1996658 - DNA, 23 bp, Homo sapiens
cttgtctgattggctcacccaag

SEQ ID NO: 1996659 - DNA, 17 bp, Homo sapiens
cttgtgaaaccacaggc

SEQ ID NO: 1996660 - DNA, 16 bp, Homo sapiens
cttgtgattctgggat

SEQ ID NO: 1996661 - DNA, 21 bp, Homo sapiens
cttgtgattctgggatggacc

SEQ ID NO: 1996662 - DNA, 16 bp, Homo sapiens
cttgtgcatgtttact

SEQ ID NO: 1996663 - DNA, 13 bp, Homo sapiens
cttgtgccctgcc

SEQ ID NO: 1996664 - DNA, 23 bp, Homo sapiens
cttgtgccctgcccccatctccc

SEQ ID NO: 1996665 - DNA, 12 bp, Homo sapiens
cttgtgcctcag

SEQ ID NO: 1996666 - DNA, 18 bp, Homo sapiens
cttgtgcttggtggggct

SEQ ID NO: 1996667 - DNA, 22 bp, Homo sapiens
cttgtgcttggtggggctcgtg

SEQ ID NO: 1996668 - DNA, 16 bp, Homo sapiens
cttgtggataagggag

SEQ ID NO: 1996669 - DNA, 10 bp, Homo sapiens
cttgtgtatg

SEQ ID NO: 1996670 - DNA, 14 bp, Homo sapiens
cttgtgtcagagct

SEQ ID NO: 1996671 - DNA, 12 bp, Homo sapiens
cttgtgtcctga

SEQ ID NO: 1996672 - DNA, 21 bp, Homo sapiens
cttgtgtctctgtgcttttaa

SEQ ID NO: 1996673 - DNA, 13 bp, Homo sapiens
cttgtgtctgcgt

SEQ ID NO: 1996674 - DNA, 18 bp, Homo sapiens
cttgtgtctgtacacgtg

SEQ ID NO: 1996675 - DNA, 19 bp, Homo sapiens
cttgtgtgttttgagagta

SEQ ID NO: 1996676 - DNA, 17 bp, Homo sapiens
cttgttaatgctttctg

SEQ ID NO: 1996677 - DNA, 15 bp, Homo sapiens
cttgttatttataac

SEQ ID NO: 1996678 - DNA, 17 bp, Homo sapiens
cttgttcatccaaggaa

SEQ ID NO: 1996679 - DNA, 22 bp, Homo sapiens
cttgttgcagagatttcctcca

SEQ ID NO: 1996680 - DNA, 22 bp, Homo sapiens
cttgttggttgtcactctacaa

SEQ ID NO: 1996681 - DNA, 13 bp, Homo sapiens
cttgttgtggagg

SEQ ID NO: 1996682 - DNA, 18 bp, Homo sapiens
cttgttgtttttaagtcc

SEQ ID NO: 1996683 - DNA, 22 bp, Homo sapiens
cttgtttgattttagctgcaga

SEQ ID NO: 1996684 - DNA, 19 bp, Homo sapiens
cttgtttggggcaggagta

SEQ ID NO: 1996685 - DNA, 14 bp, Homo sapiens
cttgttttcagttt

SEQ ID NO: 1996686 - DNA, 17 bp, Homo sapiens
cttgttttcttgccaat

SEQ ID NO: 1996687 - DNA, 15 bp, Homo sapiens
ctttaaaataaaaaa

SEQ ID NO: 1996688 - DNA, 14 bp, Homo sapiens
ctttaaagacttaa

SEQ ID NO: 1996689 - DNA, 17 bp, Homo sapiens
ctttaaagacttaagat

SEQ ID NO: 1996690 - DNA, 21 bp, Homo sapiens
ctttaaagacttaagattaaa

SEQ ID NO: 1996691 - DNA, 16 bp, Homo sapiens
ctttaaagtacctgta

SEQ ID NO: 1996692 - DNA, 17 bp, Homo sapiens
ctttaaagtacctgtag

SEQ ID NO: 1996693 - DNA, 17 bp, Homo sapiens
ctttaaagtgtaataat

SEQ ID NO: 1996694 - DNA, 21 bp, Homo sapiens
ctttaaagtgtaataatatga

SEQ ID NO: 1996695 - DNA, 12 bp, Homo sapiens
ctttaaatcaaa

SEQ ID NO: 1996696 - DNA, 19 bp, Homo sapiens
ctttaacaaaacaagaaag

SEQ ID NO: 1996697 - DNA, 20 bp, Homo sapiens
ctttaacaaaacaagaaaga

SEQ ID NO: 1996698 - DNA, 22 bp, Homo sapiens
ctttaacaaaacaagaaagaaa

SEQ ID NO: 1996699 - DNA, 23 bp, Homo sapiens
ctttaacaaaacaagaaagaaac

SEQ ID NO: 1996700 - DNA, 19 bp, Homo sapiens
ctttaaccgtttttcaaga

SEQ ID NO: 1996701 - DNA, 21 bp, Homo sapiens
ctttaaccgtttttcaagaaa

SEQ ID NO: 1996702 - DNA, 15 bp, Homo sapiens
ctttaacttaaatag

SEQ ID NO: 1996703 - DNA, 15 bp, Homo sapiens
ctttaagagagaaat

SEQ ID NO: 1996704 - DNA, 19 bp, Homo sapiens
ctttaataagtcattgaaa

SEQ ID NO: 1996705 - DNA, 18 bp, Homo sapiens
ctttaatactcacctcct

SEQ ID NO: 1996706 - DNA, 17 bp, Homo sapiens
ctttaatcttcagtttt

SEQ ID NO: 1996707 - DNA, 17 bp, Homo sapiens
ctttaatgtcacaggca

SEQ ID NO: 1996708 - DNA, 19 bp, Homo sapiens
ctttaatgtcacaggcagg

SEQ ID NO: 1996709 - DNA, 20 bp, Homo sapiens
ctttaatgtcacaggcaggt

SEQ ID NO: 1996710 - DNA, 22 bp, Homo sapiens
ctttacagatgagattccctct

SEQ ID NO: 1996711 - DNA, 19 bp, Homo sapiens
ctttacatgcaatttatta

SEQ ID NO: 1996712 - DNA, 20 bp, Homo sapiens
ctttacatgctgtgctcttt

SEQ ID NO: 1996713 - DNA, 21 bp, Homo sapiens
ctttacatttgataaactaaa

SEQ ID NO: 1996714 - DNA, 14 bp, Homo sapiens
ctttacattttatt

SEQ ID NO: 1996715 - DNA, 18 bp, Homo sapiens
ctttacctaccaccttcc

SEQ ID NO: 1996716 - DNA, 21 bp, Homo sapiens
gaccttagaaatcattgtaga

SEQ ID NO: 1996717 - DNA, 23 bp, Homo sapiens
gaccttagaaatcattgtagaaa

SEQ ID NO: 1996718 - DNA, 12 bp, Homo sapiens
gaccttcctgcc

SEQ ID NO: 1996719 - DNA, 14 bp, Homo sapiens
gaccttcctgccac

SEQ ID NO: 1996720 - DNA, 18 bp, Homo sapiens
gaccttctccaaatgaga

SEQ ID NO: 1996721 - DNA, 16 bp, Homo sapiens
gaccttggagagacac

SEQ ID NO: 1996722 - DNA, 16 bp, Homo sapiens
gaccttggtggtggga

SEQ ID NO: 1996723 - DNA, 14 bp, Homo sapiens
gacctttctgagtg

SEQ ID NO: 1996724 - DNA, 16 bp, Homo sapiens
gaccttttctctccca

SEQ ID NO: 1996725 - DNA, 22 bp, Homo sapiens
gaccttttgtctcacacagcag

SEQ ID NO: 1996726 - DNA, 23 bp, Homo sapiens
gacgatgccgtgtgtctcgtctc

SEQ ID NO: 1996727 - DNA, 16 bp, Homo sapiens
gacgattatttatttc

SEQ ID NO: 1996728 - DNA, 14 bp, Homo sapiens
gacgcagcagctgg

SEQ ID NO: 1996729 - DNA, 14 bp, Homo sapiens
gacgcatcctgcag

SEQ ID NO: 1996730 - DNA, 17 bp, Homo sapiens
gacgccactcatttcat

SEQ ID NO: 1996731 - DNA, 14 bp, Homo sapiens
gacgcgcacacaca

SEQ ID NO: 1996732 - DNA, 17 bp, Homo sapiens
gacgctcaagaatcctc

SEQ ID NO: 1996733 - DNA, 18 bp, Homo sapiens
gacgctgccgctgccgct

SEQ ID NO: 1996734 - DNA, 23 bp, Homo sapiens
gacgcttccagaccacctgccag

SEQ ID NO: 1996735 - DNA, 21 bp, Homo sapiens
gacggaggttgcagtgagccg

SEQ ID NO: 1996736 - DNA, 21 bp, Homo sapiens
gacggagtcccaccttggctg

SEQ ID NO: 1996737 - DNA, 12 bp, Homo sapiens
gacggctggacc

SEQ ID NO: 1996738 - DNA, 16 bp, Homo sapiens
gacgggaggcctcagt

SEQ ID NO: 1996739 - DNA, 17 bp, Homo sapiens
gacgggaggcctcagtt

SEQ ID NO: 1996740 - DNA, 16 bp, Homo sapiens
gacggtgttgcagaga

SEQ ID NO: 1996741 - DNA, 14 bp, Homo sapiens
gacggttgtaagca

SEQ ID NO: 1996742 - DNA, 23 bp, Homo sapiens
gacgtcatcggaggctgggcccc

SEQ ID NO: 1996743 - DNA, 21 bp, Homo sapiens
gacgtcctgctggcacctcag

SEQ ID NO: 1996744 - DNA, 23 bp, Homo sapiens
gacgtcctggaatgaagcatgta

SEQ ID NO: 1996745 - DNA, 16 bp, Homo sapiens
gacgtctcaagactga

SEQ ID NO: 1996746 - DNA, 17 bp, Homo sapiens
gacgttggttctgcact

SEQ ID NO: 1996747 - DNA, 17 bp, Homo sapiens
gacgtttttgtgctgtg

SEQ ID NO: 1996748 - DNA, 12 bp, Homo sapiens
gactaaatgaaa

SEQ ID NO: 1996749 - DNA, 16 bp, Homo sapiens
gactaacactcagaag

SEQ ID NO: 1996750 - DNA, 21 bp, Homo sapiens
gactaacataaaatctgtgaa

SEQ ID NO: 1996751 - DNA, 23 bp, Homo sapiens
gactaagccctgtcgagacactt

SEQ ID NO: 1996752 - DNA, 13 bp, Homo sapiens
gactaattaaaat

SEQ ID NO: 1996753 - DNA, 21 bp, Homo sapiens
gactaattcctgccctgccca

SEQ ID NO: 1996754 - DNA, 18 bp, Homo sapiens
gactacacatcagggctt

SEQ ID NO: 1996755 - DNA, 22 bp, Homo sapiens
gactatatacatgtgtgtatat

SEQ ID NO: 1996756 - DNA, 23 bp, Homo sapiens
gactatatacatgtgtgtatata

SEQ ID NO: 1996757 - DNA, 20 bp, Homo sapiens
gactatatagagatgttttt

SEQ ID NO: 1996758 - DNA, 22 bp, Homo sapiens
gactatcaaactgaagccagaa

SEQ ID NO: 1996759 - DNA, 18 bp, Homo sapiens
gactatcacatacaattt

SEQ ID NO: 1996760 - DNA, 16 bp, Homo sapiens
gactatggagcctggc

SEQ ID NO: 1996761 - DNA, 16 bp, Homo sapiens
gactattcaaacagtc

SEQ ID NO: 1996762 - DNA, 13 bp, Homo sapiens
gactatttatgaa

SEQ ID NO: 1996763 - DNA, 17 bp, Homo sapiens
gactattttttaataaa

SEQ ID NO: 1996764 - DNA, 19 bp, Homo sapiens
gactattttttaataaaag

SEQ ID NO: 1996765 - DNA, 12 bp, Homo sapiens
gactcaaagaga

SEQ ID NO: 1996766 - DNA, 17 bp, Homo sapiens
gactcaagggtccagaa

SEQ ID NO: 1996767 - DNA, 20 bp, Homo sapiens
gactcaagtttttacaaaat

SEQ ID NO: 1996768 - DNA, 12 bp, Homo sapiens
gactcacccaag

SEQ ID NO: 1996769 - DNA, 17 bp, Homo sapiens
gactcacctctgcctca

SEQ ID NO: 1996770 - DNA, 22 bp, Homo sapiens
gactcagctctgacattctgat

SEQ ID NO: 1996771 - DNA, 23 bp, Homo sapiens
gactcagctctgacattctgatt

SEQ ID NO: 1996772 - DNA, 12 bp, Homo sapiens
gactcagggacc

SEQ ID NO: 1996773 - DNA, 14 bp, Homo sapiens
gactcagggcccca

SEQ ID NO: 1996774 - DNA, 20 bp, Homo sapiens
gactcagggccccagcacta

SEQ ID NO: 1996775 - DNA, 11 bp, Homo sapiens
gactccaaaga

SEQ ID NO: 1996776 - DNA, 15 bp, Homo sapiens
gactccaaagaaatg

SEQ ID NO: 1996777 - DNA, 18 bp, Homo sapiens
gactccaaagaaatgtaa

SEQ ID NO: 1996778 - DNA, 19 bp, Homo sapiens
gactccagaatctgctgtt

SEQ ID NO: 1996779 - DNA, 14 bp, Homo sapiens
gactccagagtctg

SEQ ID NO: 1996780 - DNA, 15 bp, Homo sapiens
gactccagagtctga

SEQ ID NO: 1996781 - DNA, 14 bp, Homo sapiens
gactccagccagcg

SEQ ID NO: 1996782 - DNA, 20 bp, Homo sapiens
gactccagccagcgcctccc

SEQ ID NO: 1996783 - DNA, 21 bp, Homo sapiens
gactccagcgcctgccctccc

SEQ ID NO: 1996784 - DNA, 16 bp, Homo sapiens
gactcccagtgaactt

SEQ ID NO: 1996785 - DNA, 23 bp, Homo sapiens
gactccctgtgggggtggccatc

SEQ ID NO: 1996786 - DNA, 22 bp, Homo sapiens
gactcccttaaaatagaaataa

SEQ ID NO: 1996787 - DNA, 17 bp, Homo sapiens
gactccgagaacaacag

SEQ ID NO: 1996788 - DNA, 13 bp, Homo sapiens
gactcctcccaca

SEQ ID NO: 1996789 - DNA, 14 bp, Homo sapiens
gactcctctgtcca

SEQ ID NO: 1996790 - DNA, 14 bp, Homo sapiens
gactcctgcttctt

SEQ ID NO: 1996791 - DNA, 12 bp, Homo sapiens
gactcctgggct

SEQ ID NO: 1996792 - DNA, 21 bp, Homo sapiens
gactcctgtctgtcctggagg

SEQ ID NO: 1996793 - DNA, 13 bp, Homo sapiens
gactcctttctct

SEQ ID NO: 1996794 - DNA, 15 bp, Homo sapiens
gactctacagaggcc

SEQ ID NO: 1996795 - DNA, 21 bp, Homo sapiens
gactctacagaggccatgggc

SEQ ID NO: 1996796 - DNA, 15 bp, Homo sapiens
gactctgaaaaacat

SEQ ID NO: 1996797 - DNA, 22 bp, Homo sapiens
gactctgaggctctttctgggc

SEQ ID NO: 1996798 - DNA, 14 bp, Homo sapiens
gactctgcacatga

SEQ ID NO: 1996799 - DNA, 19 bp, Homo sapiens
gactctgcacatgtcttgt

SEQ ID NO: 1996800 - DNA, 16 bp, Homo sapiens
gactctgccccttctg

SEQ ID NO: 1996801 - DNA, 17 bp, Homo sapiens
gactctgccccttctgt

SEQ ID NO: 1996802 - DNA, 16 bp, Homo sapiens
gactctgcctcctctt

SEQ ID NO: 1996803 - DNA, 19 bp, Homo sapiens
gactctggaagccccccac

SEQ ID NO: 1996804 - DNA, 20 bp, Homo sapiens
gactctgggtccctcggagc

SEQ ID NO: 1996805 - DNA, 12 bp, Homo sapiens
gactctgtctca

SEQ ID NO: 1996806 - DNA, 21 bp, Homo sapiens
gactcttgcctttccacctgc

SEQ ID NO: 1996807 - DNA, 17 bp, Homo sapiens
gactgaagaaggacatt

SEQ ID NO: 1996808 - DNA, 13 bp, Homo sapiens
gactgaaggggca

SEQ ID NO: 1996809 - DNA, 23 bp, Homo sapiens
gactgaaggggcacaccactgcc

SEQ ID NO: 1996810 - DNA, 24 bp, Homo sapiens
gactgaaggggcacaccactgccc

SEQ ID NO: 1996811 - DNA, 17 bp, Homo sapiens
gactgaatttgggcctc

SEQ ID NO: 1996812 - DNA, 21 bp, Homo sapiens
gactgacaagaagctcccaga

SEQ ID NO: 1996813 - DNA, 19 bp, Homo sapiens
gactgacacaggccagccc

SEQ ID NO: 1996814 - DNA, 23 bp, Homo sapiens
gactgacacaggccagccccatc

SEQ ID NO: 1996815 - DNA, 22 bp, Homo sapiens
gactgagtcctcgtagccatct

SEQ ID NO: 1996816 - DNA, 21 bp, Homo sapiens
gactgatgttgagggaacaga

SEQ ID NO: 1996817 - DNA, 15 bp, Homo sapiens
gactgcacagcggcc

SEQ ID NO: 1996818 - DNA, 18 bp, Homo sapiens
gactgcacagcggcccct

SEQ ID NO: 1996819 - DNA, 20 bp, Homo sapiens
gactgcgatcttcagagcag

SEQ ID NO: 1996820 - DNA, 14 bp, Homo sapiens
gactgcgctggacg

SEQ ID NO: 1996821 - DNA, 15 bp, Homo sapiens
gactgctagggagtg

SEQ ID NO: 1996822 - DNA, 15 bp, Homo sapiens
gactgctccccagcc

SEQ ID NO: 1996823 - DNA, 21 bp, Homo sapiens
gactgctccccagccctggct

SEQ ID NO: 1996824 - DNA, 24 bp, Homo sapiens
gactgctccccagccctggctctg

SEQ ID NO: 1996825 - DNA, 17 bp, Homo sapiens
gactggaaccagggaga

SEQ ID NO: 1996826 - DNA, 14 bp, Homo sapiens
gactggaagcacag

SEQ ID NO: 1996827 - DNA, 15 bp, Homo sapiens
gactggacagcttgt

SEQ ID NO: 1996828 - DNA, 21 bp, Homo sapiens
gactggagaccgcttcacccc

SEQ ID NO: 1996829 - DNA, 16 bp, Homo sapiens
gactggagcccgaggg

SEQ ID NO: 1996830 - DNA, 17 bp, Homo sapiens
gagccctgctgtgggag

SEQ ID NO: 1996831 - DNA, 19 bp, Homo sapiens
gagccgagatcacgccact

SEQ ID NO: 1996832 - DNA, 20 bp, Homo sapiens
gagccgagattgcgccactg

SEQ ID NO: 1996833 - DNA, 23 bp, Homo sapiens
gagccggaccaagatgggcacat

SEQ ID NO: 1996834 - DNA, 23 bp, Homo sapiens
gagccggcacctacatccccagg

SEQ ID NO: 1996835 - DNA, 14 bp, Homo sapiens
gagccgggcctggg

SEQ ID NO: 1996836 - DNA, 19 bp, Homo sapiens
gagccggggcactttcaga

SEQ ID NO: 1996837 - DNA, 16 bp, Homo sapiens
gagcctaatgaaaggg

SEQ ID NO: 1996838 - DNA, 16 bp, Homo sapiens
gagcctaccccctgaa

SEQ ID NO: 1996839 - DNA, 18 bp, Homo sapiens
gagcctagccacctccca

SEQ ID NO: 1996840 - DNA, 15 bp, Homo sapiens
gagcctcagcatcct

SEQ ID NO: 1996841 - DNA, 17 bp, Homo sapiens
gagcctcagcatcctgg

SEQ ID NO: 1996842 - DNA, 14 bp, Homo sapiens
gagcctccccctca

SEQ ID NO: 1996843 - DNA, 15 bp, Homo sapiens
gagcctccccctcag

SEQ ID NO: 1996844 - DNA, 17 bp, Homo sapiens
gagcctccccctcagat

SEQ ID NO: 1996845 - DNA, 22 bp, Homo sapiens
gagcctcctctctcaaactggg

SEQ ID NO: 1996846 - DNA, 23 bp, Homo sapiens
gagcctcgcaacccgtgccaagt

SEQ ID NO: 1996847 - DNA, 18 bp, Homo sapiens
gagcctcggtggccatgc

SEQ ID NO: 1996848 - DNA, 12 bp, Homo sapiens
gagcctcttagt

SEQ ID NO: 1996849 - DNA, 21 bp, Homo sapiens
gagcctcttttcaattatttc

SEQ ID NO: 1996850 - DNA, 19 bp, Homo sapiens
gagcctgaattttgttgct

SEQ ID NO: 1996851 - DNA, 16 bp, Homo sapiens
gagcctgaggcatgag

SEQ ID NO: 1996852 - DNA, 15 bp, Homo sapiens
gagcctgcagttatt

SEQ ID NO: 1996853 - DNA, 18 bp, Homo sapiens
gagcctgccgagcaaccg

SEQ ID NO: 1996854 - DNA, 23 bp, Homo sapiens
gagcctgccgagcaaccgtggcc

SEQ ID NO: 1996855 - DNA, 17 bp, Homo sapiens
gagcctgcctcagctgc

SEQ ID NO: 1996856 - DNA, 18 bp, Homo sapiens
gagcctgctcccccaccc

SEQ ID NO: 1996857 - DNA, 12 bp, Homo sapiens
gagcctggagaa

SEQ ID NO: 1996858 - DNA, 14 bp, Homo sapiens
gagcctggagaagc

SEQ ID NO: 1996859 - DNA, 15 bp, Homo sapiens
gagcctggagaagct

SEQ ID NO: 1996860 - DNA, 18 bp, Homo sapiens
gagcctggcacaggactg

SEQ ID NO: 1996861 - DNA, 17 bp, Homo sapiens
gagcctggcccatagaa

SEQ ID NO: 1996862 - DNA, 15 bp, Homo sapiens
gagcctggggctcta

SEQ ID NO: 1996863 - DNA, 23 bp, Homo sapiens
gagcctggggctctaacgcctga

SEQ ID NO: 1996864 - DNA, 21 bp, Homo sapiens
gagcctgtgaacccaggacaa

SEQ ID NO: 1996865 - DNA, 19 bp, Homo sapiens
gagcctgtgcctcctcacc

SEQ ID NO: 1996866 - DNA, 20 bp, Homo sapiens
gagccttcacaaccagccac

SEQ ID NO: 1996867 - DNA, 21 bp, Homo sapiens
gagccttcacaaccagccaca

SEQ ID NO: 1996868 - DNA, 19 bp, Homo sapiens
gagccttggtgtccacctg

SEQ ID NO: 1996869 - DNA, 20 bp, Homo sapiens
gagccttggtgtccacctgg

SEQ ID NO: 1996870 - DNA, 22 bp, Homo sapiens
gagccttggtgtccacctggcc

SEQ ID NO: 1996871 - DNA, 13 bp, Homo sapiens
gagcgaaactccg

SEQ ID NO: 1996872 - DNA, 16 bp, Homo sapiens
gagcgagcgctaccca

SEQ ID NO: 1996873 - DNA, 12 bp, Homo sapiens
gagcgccctgca

SEQ ID NO: 1996874 - DNA, 16 bp, Homo sapiens
gagcgccctgcagacc

SEQ ID NO: 1996875 - DNA, 19 bp, Homo sapiens
gagcgccctgcagaccctg

SEQ ID NO: 1996876 - DNA, 22 bp, Homo sapiens
gagcgccctgcagaccctgccc

SEQ ID NO: 1996877 - DNA, 23 bp, Homo sapiens
gagcgccctgcagaccctgccct

SEQ ID NO: 1996878 - DNA, 18 bp, Homo sapiens
gagcgggcctcttccctc

SEQ ID NO: 1996879 - DNA, 19 bp, Homo sapiens
gagctacctgtgtggacag

SEQ ID NO: 1996880 - DNA, 20 bp, Homo sapiens
gagctacctgtgtggacagg

SEQ ID NO: 1996881 - DNA, 17 bp, Homo sapiens
gagctagaacctggaga

SEQ ID NO: 1996882 - DNA, 19 bp, Homo sapiens
gagctagcgctgccgcacc

SEQ ID NO: 1996883 - DNA, 18 bp, Homo sapiens
gagctaggagcaaagcct

SEQ ID NO: 1996884 - DNA, 19 bp, Homo sapiens
gagctaggagcaaagcctg

SEQ ID NO: 1996885 - DNA, 20 bp, Homo sapiens
gagctaggcatggtggcaca

SEQ ID NO: 1996886 - DNA, 20 bp, Homo sapiens
gagctatgattatgccactg

SEQ ID NO: 1996887 - DNA, 16 bp, Homo sapiens
gagctatgttccctcc

SEQ ID NO: 1996888 - DNA, 17 bp, Homo sapiens
gagctcacaaggcagca

SEQ ID NO: 1996889 - DNA, 20 bp, Homo sapiens
gagctcacaaggcagcaagg

SEQ ID NO: 1996890 - DNA, 14 bp, Homo sapiens
gagctcactcccac

SEQ ID NO: 1996891 - DNA, 15 bp, Homo sapiens
gagctcagaccccca

SEQ ID NO: 1996892 - DNA, 14 bp, Homo sapiens
gagctcaggacact

SEQ ID NO: 1996893 - DNA, 17 bp, Homo sapiens
gagctcaggctgagccc

SEQ ID NO: 1996894 - DNA, 19 bp, Homo sapiens
gagctcaggctgagcccag

SEQ ID NO: 1996895 - DNA, 23 bp, Homo sapiens
gagctcaggctgagcccagccac

SEQ ID NO: 1996896 - DNA, 13 bp, Homo sapiens
gagctcccccttc

SEQ ID NO: 1996897 - DNA, 15 bp, Homo sapiens
gagctcctgtcccta

SEQ ID NO: 1996898 - DNA, 19 bp, Homo sapiens
gagctctgagaggccctgg

SEQ ID NO: 1996899 - DNA, 20 bp, Homo sapiens
gagctctgagaggccctgga

SEQ ID NO: 1996900 - DNA, 23 bp, Homo sapiens
gagctctgagaggccctggatca

SEQ ID NO: 1996901 - DNA, 22 bp, Homo sapiens
gagctcttcaagctgtcccctc

SEQ ID NO: 1996902 - DNA, 19 bp, Homo sapiens
gagctgaacccattttgag

SEQ ID NO: 1996903 - DNA, 22 bp, Homo sapiens
gagctgaacccattttgagtga

SEQ ID NO: 1996904 - DNA, 13 bp, Homo sapiens
gagctgagatcgt

SEQ ID NO: 1996905 - DNA, 23 bp, Homo sapiens
gagctgaggggggccgtgcccag

SEQ ID NO: 1996906 - DNA, 15 bp, Homo sapiens
gagctgagtcacctc

SEQ ID NO: 1996907 - DNA, 20 bp, Homo sapiens
gagctgagtcacctcctcca

SEQ ID NO: 1996908 - DNA, 16 bp, Homo sapiens
gagctgatggagaagg

SEQ ID NO: 1996909 - DNA, 19 bp, Homo sapiens
gagctgatggagaaggaag

SEQ ID NO: 1996910 - DNA, 15 bp, Homo sapiens
gagctgatttccagg

SEQ ID NO: 1996911 - DNA, 16 bp, Homo sapiens
gagctgatttccaggc

SEQ ID NO: 1996912 - DNA, 20 bp, Homo sapiens
gagctgatttccaggcccct

SEQ ID NO: 1996913 - DNA, 12 bp, Homo sapiens
gagctgccagcc

SEQ ID NO: 1996914 - DNA, 14 bp, Homo sapiens
gagctgccagccgg

SEQ ID NO: 1996915 - DNA, 13 bp, Homo sapiens
gagctgccgcaag

SEQ ID NO: 1996916 - DNA, 19 bp, Homo sapiens
gagctgccgcaaggccctg

SEQ ID NO: 1996917 - DNA, 21 bp, Homo sapiens
gagctgccgcaaggccctgtc

SEQ ID NO: 1996918 - DNA, 13 bp, Homo sapiens
gagctgctctgct

SEQ ID NO: 1996919 - DNA, 14 bp, Homo sapiens
gagctggaaggcag

SEQ ID NO: 1996920 - DNA, 19 bp, Homo sapiens
gagctggaaggcagggcag

SEQ ID NO: 1996921 - DNA, 21 bp, Homo sapiens
gagctggaaggcagggcagag

SEQ ID NO: 1996922 - DNA, 23 bp, Homo sapiens
gagctggaattctaaatgctggt

SEQ ID NO: 1996923 - DNA, 19 bp, Homo sapiens
gagctggctttgccaagct

SEQ ID NO: 1996924 - DNA, 18 bp, Homo sapiens
gagctgggaaacagggag

SEQ ID NO: 1996925 - DNA, 19 bp, Homo sapiens
gagctgggaaacagggagc

SEQ ID NO: 1996926 - DNA, 21 bp, Homo sapiens
gagctgggaaacagggagccc

SEQ ID NO: 1996927 - DNA, 12 bp, Homo sapiens
gagctgggaggc

SEQ ID NO: 1996928 - DNA, 14 bp, Homo sapiens
gagctggggccaca

SEQ ID NO: 1996929 - DNA, 17 bp, Homo sapiens
gagctggggcctggaga

SEQ ID NO: 1996930 - DNA, 21 bp, Homo sapiens
gagctgtatatatatatgtgt

SEQ ID NO: 1996931 - DNA, 22 bp, Homo sapiens
gagctgtatatatatatgtgtg

SEQ ID NO: 1996932 - DNA, 23 bp, Homo sapiens
gagctgtatatatatatgtgtgt

SEQ ID NO: 1996933 - DNA, 20 bp, Homo sapiens
gagctgtggactttgttcac

SEQ ID NO: 1996934 - DNA, 20 bp, Homo sapiens
gagctgttcacagccagact

SEQ ID NO: 1996935 - DNA, 22 bp, Homo sapiens
gagctgttcacagccagactgg

SEQ ID NO: 1996936 - DNA, 18 bp, Homo sapiens
gagctgttggcctcgcct

SEQ ID NO: 1996937 - DNA, 15 bp, Homo sapiens
gagctgttggcctgg

SEQ ID NO: 1996938 - DNA, 16 bp, Homo sapiens
gagcttattggccact

SEQ ID NO: 1996939 - DNA, 17 bp, Homo sapiens
gagcttattggccactg

SEQ ID NO: 1996940 - DNA, 10 bp, Homo sapiens
gagcttctct

SEQ ID NO: 1996941 - DNA, 14 bp, Homo sapiens
gagcttctctgtga

SEQ ID NO: 1996942 - DNA, 16 bp, Homo sapiens
gagcttctctgtgaac

SEQ ID NO: 1996943 - DNA, 22 bp, Homo sapiens
gagcttctgggaagacaactag

SEQ ID NO: 1996944 - DNA, 13 bp, Homo sapiens
gagtttttagttt

SEQ ID NO: 1996945 - DNA, 23 bp, Homo sapiens
gataaacacagaggttttaaaca

SEQ ID NO: 1996946 - DNA, 15 bp, Homo sapiens
gataaacattaaaca

SEQ ID NO: 1996947 - DNA, 13 bp, Homo sapiens
gataaagacagct

SEQ ID NO: 1996948 - DNA, 19 bp, Homo sapiens
gataaagacagctgacaga

SEQ ID NO: 1996949 - DNA, 23 bp, Homo sapiens
gataaagagggatgtaactattg

SEQ ID NO: 1996950 - DNA, 11 bp, Homo sapiens
gataaagatga

SEQ ID NO: 1996951 - DNA, 20 bp, Homo sapiens
gataaaggaagtcaccaaaa

SEQ ID NO: 1996952 - DNA, 14 bp, Homo sapiens
gataaagtgaccag

SEQ ID NO: 1996953 - DNA, 15 bp, Homo sapiens
gataaagtgaccagg

SEQ ID NO: 1996954 - DNA, 12 bp, Homo sapiens
gataaatattta

SEQ ID NO: 1996955 - DNA, 15 bp, Homo sapiens
gataacaaaatcaca

SEQ ID NO: 1996956 - DNA, 18 bp, Homo sapiens
gataacaaaatcacaagc

SEQ ID NO: 1996957 - DNA, 16 bp, Homo sapiens
gataacaacctggaga

SEQ ID NO: 1996958 - DNA, 17 bp, Homo sapiens
gataacaacctggagac

SEQ ID NO: 1996959 - DNA, 21 bp, Homo sapiens
gataacactgtctacctcaca

SEQ ID NO: 1996960 - DNA, 23 bp, Homo sapiens
gataacctatatgatttatagtt

SEQ ID NO: 1996961 - DNA, 20 bp, Homo sapiens
gataactgaaaattatttaa

SEQ ID NO: 1996962 - DNA, 18 bp, Homo sapiens
gataactgcaattttaat

SEQ ID NO: 1996963 - DNA, 12 bp, Homo sapiens
gataagtggaaa

SEQ ID NO: 1996964 - DNA, 15 bp, Homo sapiens
gataataactagatc

SEQ ID NO: 1996965 - DNA, 17 bp, Homo sapiens
gataataactagatctc

SEQ ID NO: 1996966 - DNA, 14 bp, Homo sapiens
gataatatctgtga

SEQ ID NO: 1996967 - DNA, 20 bp, Homo sapiens
gataatatgtttgaggttaa

SEQ ID NO: 1996968 - DNA, 22 bp, Homo sapiens
gataatcaattattacatttat

SEQ ID NO: 1996969 - DNA, 22 bp, Homo sapiens
gataatgttctttaatgttgtc

SEQ ID NO: 1996970 - DNA, 12 bp, Homo sapiens
gataattttaaa

SEQ ID NO: 1996971 - DNA, 18 bp, Homo sapiens
gataattttaaattctct

SEQ ID NO: 1996972 - DNA, 20 bp, Homo sapiens
gatacagccccaaaccaggg

SEQ ID NO: 1996973 - DNA, 23 bp, Homo sapiens
gatacagccccaaaccagggtgc

SEQ ID NO: 1996974 - DNA, 19 bp, Homo sapiens
gatacaggaaaagctgctg

SEQ ID NO: 1996975 - DNA, 15 bp, Homo sapiens
gatacatagatggac

SEQ ID NO: 1996976 - DNA, 17 bp, Homo sapiens
gatacggttgtctagag

SEQ ID NO: 1996977 - DNA, 22 bp, Homo sapiens
gatactaaaagttcttctccaa

SEQ ID NO: 1996978 - DNA, 22 bp, Homo sapiens
gatactctccctgacatttcta

SEQ ID NO: 1996979 - DNA, 13 bp, Homo sapiens
gatactctgtcag

SEQ ID NO: 1996980 - DNA, 16 bp, Homo sapiens
gatactggaagttttg

SEQ ID NO: 1996981 - DNA, 20 bp, Homo sapiens
gatactgggtacaagagcca

SEQ ID NO: 1996982 - DNA, 20 bp, Homo sapiens
gatacttaagtgctgcaatt

SEQ ID NO: 1996983 - DNA, 13 bp, Homo sapiens
gatacttcaggtg

SEQ ID NO: 1996984 - DNA, 20 bp, Homo sapiens
gatacttcaggtgcttttga

SEQ ID NO: 1996985 - DNA, 22 bp, Homo sapiens
gatagaatatttacaataaaga

SEQ ID NO: 1996986 - DNA, 12 bp, Homo sapiens
gatagaatgaca

SEQ ID NO: 1996987 - DNA, 14 bp, Homo sapiens
gatagaatgacagt

SEQ ID NO: 1996988 - DNA, 23 bp, Homo sapiens
gatagatccatttggacaaaatg

SEQ ID NO: 1996989 - DNA, 22 bp, Homo sapiens
gatagctaacattttaaataaa

SEQ ID NO: 1996990 - DNA, 21 bp, Homo sapiens
gatagctattttcttacagtg

SEQ ID NO: 1996991 - DNA, 13 bp, Homo sapiens
gataggaaaagaa

SEQ ID NO: 1996992 - DNA, 14 bp, Homo sapiens
gataggaaaagaag

SEQ ID NO: 1996993 - DNA, 15 bp, Homo sapiens
gatagtatcttttaa

SEQ ID NO: 1996994 - DNA, 21 bp, Homo sapiens
gatagttaaaagactgcagct

SEQ ID NO: 1996995 - DNA, 16 bp, Homo sapiens
gatataaatggctggt

SEQ ID NO: 1996996 - DNA, 18 bp, Homo sapiens
gatatatctgaaaactgg

SEQ ID NO: 1996997 - DNA, 11 bp, Homo sapiens
gatatatgtat

SEQ ID NO: 1996998 - DNA, 12 bp, Homo sapiens
gatatattttga

SEQ ID NO: 1996999 - DNA, 17 bp, Homo sapiens
gatatatttttcacagt

SEQ ID NO: 1997000 - DNA, 18 bp, Homo sapiens
gatatcacctctcttcag

SEQ ID NO: 1997001 - DNA, 18 bp, Homo sapiens
gatatcagagctcttaat

SEQ ID NO: 1997002 - DNA, 12 bp, Homo sapiens
gatatgacaagc

SEQ ID NO: 1997003 - DNA, 21 bp, Homo sapiens
gatatgagttgttttcagact

SEQ ID NO: 1997004 - DNA, 13 bp, Homo sapiens
gatatgggactga

SEQ ID NO: 1997005 - DNA, 16 bp, Homo sapiens
gatatgtaaaacattt

SEQ ID NO: 1997006 - DNA, 16 bp, Homo sapiens
gatattaaaggagtta

SEQ ID NO: 1997007 - DNA, 17 bp, Homo sapiens
gatattatttaaatgtt

SEQ ID NO: 1997008 - DNA, 20 bp, Homo sapiens
gatattatttaaatgttgaa

SEQ ID NO: 1997009 - DNA, 22 bp, Homo sapiens
gatattcctattgtgcaatgta

SEQ ID NO: 1997010 - DNA, 20 bp, Homo sapiens
gatatttccatttcttcctc

SEQ ID NO: 1997011 - DNA, 22 bp, Homo sapiens
gatattttcaacgcagccctgc

SEQ ID NO: 1997012 - DNA, 22 bp, Homo sapiens
gatatttttgtacgttatatat

SEQ ID NO: 1997013 - DNA, 23 bp, Homo sapiens
gatcaaaaataaactagtttcca

SEQ ID NO: 1997014 - DNA, 14 bp, Homo sapiens
gatcaaagttcctg

SEQ ID NO: 1997015 - DNA, 21 bp, Homo sapiens
gatcaaccccttcgctcctgt

SEQ ID NO: 1997016 - DNA, 13 bp, Homo sapiens
gatcaactgttca

SEQ ID NO: 1997017 - DNA, 15 bp, Homo sapiens
gatcaagtccagagc

SEQ ID NO: 1997018 - DNA, 16 bp, Homo sapiens
gatcacatattctagt

SEQ ID NO: 1997019 - DNA, 13 bp, Homo sapiens
gatcacgccactg

SEQ ID NO: 1997020 - DNA, 23 bp, Homo sapiens
gatcacgccactgcactccagcc

SEQ ID NO: 1997021 - DNA, 24 bp, Homo sapiens
gatcacgccactgcactccagcct

SEQ ID NO: 1997022 - DNA, 16 bp, Homo sapiens
gatcacggctcactgc

SEQ ID NO: 1997023 - DNA, 23 bp, Homo sapiens
gatcacggctcactgcagcctca

SEQ ID NO: 1997024 - DNA, 17 bp, Homo sapiens
gatcactggagcccagg

SEQ ID NO: 1997025 - DNA, 19 bp, Homo sapiens
gatcacttgagttcaggag

SEQ ID NO: 1997026 - DNA, 12 bp, Homo sapiens
gatcagaaggct

SEQ ID NO: 1997027 - DNA, 21 bp, Homo sapiens
gatcagcctccgccattccaa

SEQ ID NO: 1997028 - DNA, 15 bp, Homo sapiens
gatcagcgtggcctt

SEQ ID NO: 1997029 - DNA, 16 bp, Homo sapiens
gatcagcgtggccttg

SEQ ID NO: 1997030 - DNA, 12 bp, Homo sapiens
gatcaggaagag

SEQ ID NO: 1997031 - DNA, 22 bp, Homo sapiens
gatcagtttcacaaagtttgtt

SEQ ID NO: 1997032 - DNA, 17 bp, Homo sapiens
gatcatccactgtgcca

SEQ ID NO: 1997033 - DNA, 13 bp, Homo sapiens
gatcatgaaaagt

SEQ ID NO: 1997034 - DNA, 22 bp, Homo sapiens
gatcatggtcagctcacaccct

SEQ ID NO: 1997035 - DNA, 22 bp, Homo sapiens
gatcattacatggctgtggttc

SEQ ID NO: 1997036 - DNA, 13 bp, Homo sapiens
gatcattttctta

SEQ ID NO: 1997037 - DNA, 23 bp, Homo sapiens
gatcattttcttatcttctgcaa

SEQ ID NO: 1997038 - DNA, 16 bp, Homo sapiens
gatccaagctggtccc

SEQ ID NO: 1997039 - DNA, 18 bp, Homo sapiens
gatccacacacagaggaa

SEQ ID NO: 1997040 - DNA, 20 bp, Homo sapiens
gatccacccacctcagcctc

SEQ ID NO: 1997041 - DNA, 18 bp, Homo sapiens
gatccaccctcaaatgtc

SEQ ID NO: 1997042 - DNA, 14 bp, Homo sapiens
gatccactgtgcag

SEQ ID NO: 1997043 - DNA, 16 bp, Homo sapiens
gatccactgtgcagga

SEQ ID NO: 1997044 - DNA, 19 bp, Homo sapiens
gatccatgtagcaggactg

SEQ ID NO: 1997045 - DNA, 18 bp, Homo sapiens
gatcccatgtcacctcag

SEQ ID NO: 1997046 - DNA, 21 bp, Homo sapiens
gatcccgcctcttcttcttca

SEQ ID NO: 1997047 - DNA, 21 bp, Homo sapiens
gatcccgtgaaattgatgcca

SEQ ID NO: 1997048 - DNA, 18 bp, Homo sapiens
gatccctccatccggctc

SEQ ID NO: 1997049 - DNA, 20 bp, Homo sapiens
gatcctaactgaagagacag

SEQ ID NO: 1997050 - DNA, 14 bp, Homo sapiens
gatcctaggtgctg

SEQ ID NO: 1997051 - DNA, 19 bp, Homo sapiens
gatcctattctcaccagga

SEQ ID NO: 1997052 - DNA, 20 bp, Homo sapiens
gatcctcccacctcagcctc

SEQ ID NO: 1997053 - DNA, 12 bp, Homo sapiens
gatcctgcagga

SEQ ID NO: 1997054 - DNA, 20 bp, Homo sapiens
gatcctgcaggaacgagcac

SEQ ID NO: 1997055 - DNA, 14 bp, Homo sapiens
gatcctgctgtggc

SEQ ID NO: 1997056 - DNA, 15 bp, Homo sapiens
gatcctgctgtggcc

SEQ ID NO: 1997057 - DNA, 17 bp, Homo sapiens
gatcctgctgtggcctc

SEQ ID NO: 1997058 - DNA, 17 bp, Homo sapiens
gcaagatcttgtctcca

SEQ ID NO: 1997059 - DNA, 17 bp, Homo sapiens
gcaagatgaattttatc

SEQ ID NO: 1997060 - DNA, 15 bp, Homo sapiens
gcaagcacctcctgc

SEQ ID NO: 1997061 - DNA, 16 bp, Homo sapiens
gcaagcagcctcctgg

SEQ ID NO: 1997062 - DNA, 22 bp, Homo sapiens
gcaagcagggaaagctccacgg

SEQ ID NO: 1997063 - DNA, 17 bp, Homo sapiens
gcaagcattcagaagaa

SEQ ID NO: 1997064 - DNA, 18 bp, Homo sapiens
gcaagcattcagaagaaa

SEQ ID NO: 1997065 - DNA, 14 bp, Homo sapiens
gcaagccccagggc

SEQ ID NO: 1997066 - DNA, 15 bp, Homo sapiens
gcaagccccagggcc

SEQ ID NO: 1997067 - DNA, 20 bp, Homo sapiens
gcaagccccagggcctgggg

SEQ ID NO: 1997068 - DNA, 23 bp, Homo sapiens
gcaagcccctcagcccttgcccc

SEQ ID NO: 1997069 - DNA, 15 bp, Homo sapiens
gcaagcgcagggagg

SEQ ID NO: 1997070 - DNA, 23 bp, Homo sapiens
gcaagcttaatggctgataattt

SEQ ID NO: 1997071 - DNA, 14 bp, Homo sapiens
gcaaggaaaataat

SEQ ID NO: 1997072 - DNA, 21 bp, Homo sapiens
gcaaggacaacctgcccctcc

SEQ ID NO: 1997073 - DNA, 22 bp, Homo sapiens
gcaaggactacgttaagggaag

SEQ ID NO: 1997074 - DNA, 22 bp, Homo sapiens
gcaaggagttcgtggctgcaaa

SEQ ID NO: 1997075 - DNA, 19 bp, Homo sapiens
gcaaggatatcagagctgg

SEQ ID NO: 1997076 - DNA, 18 bp, Homo sapiens
gcaaggcccgagcagctg

SEQ ID NO: 1997077 - DNA, 19 bp, Homo sapiens
gcaaggcccgagcagctga

SEQ ID NO: 1997078 - DNA, 15 bp, Homo sapiens
gcaaggccctgtccc

SEQ ID NO: 1997079 - DNA, 19 bp, Homo sapiens
gcaaggccctgtcccagca

SEQ ID NO: 1997080 - DNA, 19 bp, Homo sapiens
gcaagggagaagaaatcca

SEQ ID NO: 1997081 - DNA, 13 bp, Homo sapiens
gcaagggctccag

SEQ ID NO: 1997082 - DNA, 16 bp, Homo sapiens
gcaagggctccagcat

SEQ ID NO: 1997083 - DNA, 17 bp, Homo sapiens
gcaagggctccagcatc

SEQ ID NO: 1997084 - DNA, 14 bp, Homo sapiens
gcaagggtgatggg

SEQ ID NO: 1997085 - DNA, 23 bp, Homo sapiens
gcaaggtctccttactctgagcc

SEQ ID NO: 1997086 - DNA, 22 bp, Homo sapiens
gcaagtccctgactctctgtga

SEQ ID NO: 1997087 - DNA, 17 bp, Homo sapiens
gcaagtcgagagggctg

SEQ ID NO: 1997088 - DNA, 13 bp, Homo sapiens
gcaagtgaatttg

SEQ ID NO: 1997089 - DNA, 13 bp, Homo sapiens
gcaagtgagagct

SEQ ID NO: 1997090 - DNA, 15 bp, Homo sapiens
gcaagtgagagctgg

SEQ ID NO: 1997091 - DNA, 18 bp, Homo sapiens
gcaagtgcccgccctgcc

SEQ ID NO: 1997092 - DNA, 16 bp, Homo sapiens
gcaagttcagggaagc

SEQ ID NO: 1997093 - DNA, 19 bp, Homo sapiens
gcaagttcagggaagcagg

SEQ ID NO: 1997094 - DNA, 17 bp, Homo sapiens
gcaagttctagagaaga

SEQ ID NO: 1997095 - DNA, 21 bp, Homo sapiens
gcaagttctagagaagaggct

SEQ ID NO: 1997096 - DNA, 22 bp, Homo sapiens
gcaagtttctagctagaaatat

SEQ ID NO: 1997097 - DNA, 23 bp, Homo sapiens
gcaataatgtgcaaattttgcat

SEQ ID NO: 1997098 - DNA, 23 bp, Homo sapiens
gcaataattaggatctatgcaat

SEQ ID NO: 1997099 - DNA, 23 bp, Homo sapiens
gcaatactaattgagaaacatga

SEQ ID NO: 1997100 - DNA, 13 bp, Homo sapiens
gcaatgaaacaga

SEQ ID NO: 1997101 - DNA, 16 bp, Homo sapiens
gcaatgacatcttcaa

SEQ ID NO: 1997102 - DNA, 13 bp, Homo sapiens
gcaatgctggctg

SEQ ID NO: 1997103 - DNA, 14 bp, Homo sapiens
gcaatgctggctgt

SEQ ID NO: 1997104 - DNA, 13 bp, Homo sapiens
gcaatggcagcct

SEQ ID NO: 1997105 - DNA, 14 bp, Homo sapiens
gcaatggcagcctt

SEQ ID NO: 1997106 - DNA, 17 bp, Homo sapiens
gcaatgggagggggctc

SEQ ID NO: 1997107 - DNA, 21 bp, Homo sapiens
gcaatgggagggggctccatg

SEQ ID NO: 1997108 - DNA, 22 bp, Homo sapiens
gcaatgggagggggctccatgg

SEQ ID NO: 1997109 - DNA, 14 bp, Homo sapiens
gcaatgggcactgg

SEQ ID NO: 1997110 - DNA, 20 bp, Homo sapiens
gcaatggggagaggcaaatg

SEQ ID NO: 1997111 - DNA, 15 bp, Homo sapiens
gcaatgtaaatattt

SEQ ID NO: 1997112 - DNA, 14 bp, Homo sapiens
gcaattatattgtc

SEQ ID NO: 1997113 - DNA, 14 bp, Homo sapiens
gcaattgccctgta

SEQ ID NO: 1997114 - DNA, 23 bp, Homo sapiens
gcaatttcaaattactctttctc

SEQ ID NO: 1997115 - DNA, 14 bp, Homo sapiens
gcaattttgtaacg

SEQ ID NO: 1997116 - DNA, 20 bp, Homo sapiens
gcaatttttaaactagtaat

SEQ ID NO: 1997117 - DNA, 15 bp, Homo sapiens
gcacaaaatgataat

SEQ ID NO: 1997118 - DNA, 16 bp, Homo sapiens
gcacaaatatttattt

SEQ ID NO: 1997119 - DNA, 21 bp, Homo sapiens
gcacaagaggaagagagagac

SEQ ID NO: 1997120 - DNA, 13 bp, Homo sapiens
gcacaagctcaga

SEQ ID NO: 1997121 - DNA, 14 bp, Homo sapiens
gcacaagctcagaa

SEQ ID NO: 1997122 - DNA, 22 bp, Homo sapiens
gcacaagctcagaatagatctg

SEQ ID NO: 1997123 - DNA, 20 bp, Homo sapiens
gcacaagcttgtatatacat

SEQ ID NO: 1997124 - DNA, 16 bp, Homo sapiens
gcacaatttagaaaac

SEQ ID NO: 1997125 - DNA, 17 bp, Homo sapiens
gcacacaaacacctcct

SEQ ID NO: 1997126 - DNA, 15 bp, Homo sapiens
gcacacaatgctatt

SEQ ID NO: 1997127 - DNA, 22 bp, Homo sapiens
gcacacacaccggtcaccgaga

SEQ ID NO: 1997128 - DNA, 15 bp, Homo sapiens
gcacacacagatgca

SEQ ID NO: 1997129 - DNA, 18 bp, Homo sapiens
gcacacacagatgcacac

SEQ ID NO: 1997130 - DNA, 13 bp, Homo sapiens
gcacacacagctc

SEQ ID NO: 1997131 - DNA, 18 bp, Homo sapiens
gcacacaccagagcccac

SEQ ID NO: 1997132 - DNA, 19 bp, Homo sapiens
gcacacaccagagcccacc

SEQ ID NO: 1997133 - DNA, 20 bp, Homo sapiens
gcacacaccagagcccacct

SEQ ID NO: 1997134 - DNA, 18 bp, Homo sapiens
gcacacagaaatatatat

SEQ ID NO: 1997135 - DNA, 13 bp, Homo sapiens
gcacaccaaaaaa

SEQ ID NO: 1997136 - DNA, 17 bp, Homo sapiens
gcacaccactgccctgc

SEQ ID NO: 1997137 - DNA, 20 bp, Homo sapiens
gcacaccactgccctgcctg

SEQ ID NO: 1997138 - DNA, 22 bp, Homo sapiens
gcacaccactgccctgcctgcc

SEQ ID NO: 1997139 - DNA, 20 bp, Homo sapiens
gcacaccgggcactcagaag

SEQ ID NO: 1997140 - DNA, 13 bp, Homo sapiens
gcacacggatgca

SEQ ID NO: 1997141 - DNA, 15 bp, Homo sapiens
gcacacggccctgcc

SEQ ID NO: 1997142 - DNA, 20 bp, Homo sapiens
gcacacggccctgccccatc

SEQ ID NO: 1997143 - DNA, 18 bp, Homo sapiens
gcacacttgtatattgaa

SEQ ID NO: 1997144 - DNA, 20 bp, Homo sapiens
gcacagaaggaatctgtgca

SEQ ID NO: 1997145 - DNA, 14 bp, Homo sapiens
gcacagacttctgg

SEQ ID NO: 1997146 - DNA, 18 bp, Homo sapiens
gcacagagatatgcacac

SEQ ID NO: 1997147 - DNA, 17 bp, Homo sapiens
gcacagagggctaggga

SEQ ID NO: 1997148 - DNA, 19 bp, Homo sapiens
gcacagagggctagggagg

SEQ ID NO: 1997149 - DNA, 20 bp, Homo sapiens
gcacagattacttcagggct

SEQ ID NO: 1997150 - DNA, 11 bp, Homo sapiens
gcacagccctg

SEQ ID NO: 1997151 - DNA, 19 bp, Homo sapiens
gcacagcgcgggcggaggc

SEQ ID NO: 1997152 - DNA, 12 bp, Homo sapiens
gcacagctgctt

SEQ ID NO: 1997153 - DNA, 23 bp, Homo sapiens
gcacagctgcttgtcctgctctc

SEQ ID NO: 1997154 - DNA, 15 bp, Homo sapiens
gcacaggacacctgg

SEQ ID NO: 1997155 - DNA, 21 bp, Homo sapiens
gcacaggactgattctgggat

SEQ ID NO: 1997156 - DNA, 12 bp, Homo sapiens
gcacaggagcta

SEQ ID NO: 1997157 - DNA, 16 bp, Homo sapiens
gcacaggagctacctg

SEQ ID NO: 1997158 - DNA, 23 bp, Homo sapiens
gcacaggagggggtcgtggagag

SEQ ID NO: 1997159 - DNA, 15 bp, Homo sapiens
gcacaggctaatttt

SEQ ID NO: 1997160 - DNA, 12 bp, Homo sapiens
gcacaggggccc

SEQ ID NO: 1997161 - DNA, 15 bp, Homo sapiens
gcacaggggccccag

SEQ ID NO: 1997162 - DNA, 16 bp, Homo sapiens
gcacaggttttcagca

SEQ ID NO: 1997163 - DNA, 13 bp, Homo sapiens
gcacagtgcatct

SEQ ID NO: 1997164 - DNA, 15 bp, Homo sapiens
gcacagtgcatctca

SEQ ID NO: 1997165 - DNA, 18 bp, Homo sapiens
gcacagtgcatctcagcc

SEQ ID NO: 1997166 - DNA, 19 bp, Homo sapiens
gcacagtgcatctcagccc

SEQ ID NO: 1997167 - DNA, 19 bp, Homo sapiens
gcacagttgtctattctga

SEQ ID NO: 1997168 - DNA, 21 bp, Homo sapiens
gcacagttgtctattctgagc

SEQ ID NO: 1997169 - DNA, 23 bp, Homo sapiens
gcacagttgtctattctgagcct

SEQ ID NO: 1997170 - DNA, 15 bp, Homo sapiens
gcacagttttaagag

SEQ ID NO: 1997171 - DNA, 17 bp, Homo sapiens
gcacagttttctgagaa

SEQ ID NO: 1997172 - DNA, 20 bp, Homo sapiens
gcacagttttctgagaaaga

SEQ ID NO: 1997173 - DNA, 22 bp, Homo sapiens
gcaggctctgggctcagggctg

SEQ ID NO: 1997174 - DNA, 15 bp, Homo sapiens
gcaggctggctggcc

SEQ ID NO: 1997175 - DNA, 16 bp, Homo sapiens
gcagggaaagctccac

SEQ ID NO: 1997176 - DNA, 14 bp, Homo sapiens
gcagggaagagggc

SEQ ID NO: 1997177 - DNA, 16 bp, Homo sapiens
gcagggaagagggcag

SEQ ID NO: 1997178 - DNA, 17 bp, Homo sapiens
gcagggaagagggcagt

SEQ ID NO: 1997179 - DNA, 18 bp, Homo sapiens
gcagggagcaactctcca

SEQ ID NO: 1997180 - DNA, 15 bp, Homo sapiens
gcagggaggatgcca

SEQ ID NO: 1997181 - DNA, 15 bp, Homo sapiens
gcagggcagagggaa

SEQ ID NO: 1997182 - DNA, 14 bp, Homo sapiens
gcagggccggggaa

SEQ ID NO: 1997183 - DNA, 23 bp, Homo sapiens
gcagggccggggaactggccaag

SEQ ID NO: 1997184 - DNA, 21 bp, Homo sapiens
gcagggctcagcggggacagc

SEQ ID NO: 1997185 - DNA, 12 bp, Homo sapiens
gcagggctctcc

SEQ ID NO: 1997186 - DNA, 16 bp, Homo sapiens
gcagggctctcctggc

SEQ ID NO: 1997187 - DNA, 21 bp, Homo sapiens
gcagggctctgccccagaggc

SEQ ID NO: 1997188 - DNA, 11 bp, Homo sapiens
gcagggctggg

SEQ ID NO: 1997189 - DNA, 16 bp, Homo sapiens
gcaggggtctgagcca

SEQ ID NO: 1997190 - DNA, 17 bp, Homo sapiens
gcaggggtctgagccac

SEQ ID NO: 1997191 - DNA, 15 bp, Homo sapiens
gcaggggtgggagag

SEQ ID NO: 1997192 - DNA, 17 bp, Homo sapiens
gcaggggtgggagagcc

SEQ ID NO: 1997193 - DNA, 20 bp, Homo sapiens
gcaggggtgggagagccagc

SEQ ID NO: 1997194 - DNA, 17 bp, Homo sapiens
gcagggtctcactctgt

SEQ ID NO: 1997195 - DNA, 20 bp, Homo sapiens
gcaggtaagagctgatgtga

SEQ ID NO: 1997196 - DNA, 23 bp, Homo sapiens
gcaggtacttcctcctgatggcc

SEQ ID NO: 1997197 - DNA, 24 bp, Homo sapiens
gcaggtacttcctcctgatggcca

SEQ ID NO: 1997198 - DNA, 23 bp, Homo sapiens
gcaggtagatcgcttgagcccag

SEQ ID NO: 1997199 - DNA, 14 bp, Homo sapiens
gcaggtcctgccca

SEQ ID NO: 1997200 - DNA, 16 bp, Homo sapiens
gcaggtcctgcccatg

SEQ ID NO: 1997201 - DNA, 15 bp, Homo sapiens
gcaggtctcagcccg

SEQ ID NO: 1997202 - DNA, 21 bp, Homo sapiens
gcaggtctctggcagagaagg

SEQ ID NO: 1997203 - DNA, 19 bp, Homo sapiens
gcaggtcttgaactcctgg

SEQ ID NO: 1997204 - DNA, 15 bp, Homo sapiens
gcaggtgcaagagac

SEQ ID NO: 1997205 - DNA, 18 bp, Homo sapiens
gcaggtgcaagagacaga

SEQ ID NO: 1997206 - DNA, 18 bp, Homo sapiens
gcaggtgcagatgggctg

SEQ ID NO: 1997207 - DNA, 15 bp, Homo sapiens
gcaggtggtcctgag

SEQ ID NO: 1997208 - DNA, 21 bp, Homo sapiens
gcaggtggtcctgagacctga

SEQ ID NO: 1997209 - DNA, 21 bp, Homo sapiens
gcaggtgtggtggctcatggc

SEQ ID NO: 1997210 - DNA, 20 bp, Homo sapiens
gcaggttgaggggctcctgg

SEQ ID NO: 1997211 - DNA, 17 bp, Homo sapiens
gcagtagtctctgtgct

SEQ ID NO: 1997212 - DNA, 23 bp, Homo sapiens
gcagtattgccacaatgcctctc

SEQ ID NO: 1997213 - DNA, 18 bp, Homo sapiens
gcagtattttattaaagc

SEQ ID NO: 1997214 - DNA, 17 bp, Homo sapiens
gcagtcagggtgggaag

SEQ ID NO: 1997215 - DNA, 19 bp, Homo sapiens
gcagtccagaataagtgct

SEQ ID NO: 1997216 - DNA, 14 bp, Homo sapiens
gcagtccagccagc

SEQ ID NO: 1997217 - DNA, 23 bp, Homo sapiens
gcagtccccagcccttctgcctt

SEQ ID NO: 1997218 - DNA, 12 bp, Homo sapiens
gcagtcgcagga

SEQ ID NO: 1997219 - DNA, 13 bp, Homo sapiens
gcagtctgaaccc

SEQ ID NO: 1997220 - DNA, 14 bp, Homo sapiens
gcagtctgaaccct

SEQ ID NO: 1997221 - DNA, 16 bp, Homo sapiens
gcagtgactggcaggt

SEQ ID NO: 1997222 - DNA, 22 bp, Homo sapiens
gcagtgagaaaaagctcctgtc

SEQ ID NO: 1997223 - DNA, 13 bp, Homo sapiens
gcagtgagccgag

SEQ ID NO: 1997224 - DNA, 14 bp, Homo sapiens
gcagtgagctgaga

SEQ ID NO: 1997225 - DNA, 16 bp, Homo sapiens
gcagtgagcttctatt

SEQ ID NO: 1997226 - DNA, 16 bp, Homo sapiens
gcagtgatagttgact

SEQ ID NO: 1997227 - DNA, 21 bp, Homo sapiens
gcagtgatggcgcgggaggca

SEQ ID NO: 1997228 - DNA, 22 bp, Homo sapiens
gcagtgcaagagactctggcct

SEQ ID NO: 1997229 - DNA, 17 bp, Homo sapiens
gcagtgcctcctgggac

SEQ ID NO: 1997230 - DNA, 18 bp, Homo sapiens
gcagtgcctcgaggcacc

SEQ ID NO: 1997231 - DNA, 20 bp, Homo sapiens
gcagtgcctcgaggcaccgg

SEQ ID NO: 1997232 - DNA, 15 bp, Homo sapiens
gcagtgccttccata

SEQ ID NO: 1997233 - DNA, 16 bp, Homo sapiens
gcagtggctcacgcct

SEQ ID NO: 1997234 - DNA, 21 bp, Homo sapiens
gcagtgggacagggcatggcc

SEQ ID NO: 1997235 - DNA, 18 bp, Homo sapiens
gcagtgggagctgcctgt

SEQ ID NO: 1997236 - DNA, 20 bp, Homo sapiens
gcagtgtcttccataatgta

SEQ ID NO: 1997237 - DNA, 22 bp, Homo sapiens
gcagtgtgtccttggggcacag

SEQ ID NO: 1997238 - DNA, 20 bp, Homo sapiens
gcagtgttccccatctgggt

SEQ ID NO: 1997239 - DNA, 19 bp, Homo sapiens
gcagtgttcctcaccaata

SEQ ID NO: 1997240 - DNA, 22 bp, Homo sapiens
gcagtgttcctcaccaataact

SEQ ID NO: 1997241 - DNA, 17 bp, Homo sapiens
gcagttattaacactaa

SEQ ID NO: 1997242 - DNA, 18 bp, Homo sapiens
gcagttcaaatcctcacc

SEQ ID NO: 1997243 - DNA, 19 bp, Homo sapiens
gcagttcaaatcctcacca

SEQ ID NO: 1997244 - DNA, 15 bp, Homo sapiens
gcagttccatgaaga

SEQ ID NO: 1997245 - DNA, 19 bp, Homo sapiens
gcagttccatgaagacacg

SEQ ID NO: 1997246 - DNA, 16 bp, Homo sapiens
gcagttcgcagccacc

SEQ ID NO: 1997247 - DNA, 17 bp, Homo sapiens
gcagttcgcagccaccc

SEQ ID NO: 1997248 - DNA, 18 bp, Homo sapiens
gcagttcgcagccaccct

SEQ ID NO: 1997249 - DNA, 22 bp, Homo sapiens
gcagttcgcagccaccctgagg

SEQ ID NO: 1997250 - DNA, 15 bp, Homo sapiens
gcagttgaaaagact

SEQ ID NO: 1997251 - DNA, 19 bp, Homo sapiens
gcagttgaaaagactccaa

SEQ ID NO: 1997252 - DNA, 15 bp, Homo sapiens
gcagttgacagcagg

SEQ ID NO: 1997253 - DNA, 13 bp, Homo sapiens
gcagttgtgtcag

SEQ ID NO: 1997254 - DNA, 15 bp, Homo sapiens
gcagttttccaggaa

SEQ ID NO: 1997255 - DNA, 16 bp, Homo sapiens
gcataaacttcatctt

SEQ ID NO: 1997256 - DNA, 13 bp, Homo sapiens
gcataagattaaa

SEQ ID NO: 1997257 - DNA, 13 bp, Homo sapiens
gcatacatgttca

SEQ ID NO: 1997258 - DNA, 19 bp, Homo sapiens
gcatagaaactgaggagta

SEQ ID NO: 1997259 - DNA, 23 bp, Homo sapiens
gcatagaaactgaggagtagctg

SEQ ID NO: 1997260 - DNA, 23 bp, Homo sapiens
gcatagggaatatgtaagtcagg

SEQ ID NO: 1997261 - DNA, 20 bp, Homo sapiens
gcatagtaccaatcatttta

SEQ ID NO: 1997262 - DNA, 16 bp, Homo sapiens
gcatatcggaggtggt

SEQ ID NO: 1997263 - DNA, 14 bp, Homo sapiens
gcatcacctcaggc

SEQ ID NO: 1997264 - DNA, 15 bp, Homo sapiens
gcatcacctcaggcc

SEQ ID NO: 1997265 - DNA, 15 bp, Homo sapiens
gcatcacctctgtaa

SEQ ID NO: 1997266 - DNA, 12 bp, Homo sapiens
gcatcagctgct

SEQ ID NO: 1997267 - DNA, 22 bp, Homo sapiens
gcatcagctgctgaaacaacaa

SEQ ID NO: 1997268 - DNA, 23 bp, Homo sapiens
gcatcagctgctgaaacaacaaa

SEQ ID NO: 1997269 - DNA, 18 bp, Homo sapiens
gcatcaggcactggtggc

SEQ ID NO: 1997270 - DNA, 18 bp, Homo sapiens
gcatcatgcctctgaggc

SEQ ID NO: 1997271 - DNA, 17 bp, Homo sapiens
gcatccacccagtgctg

SEQ ID NO: 1997272 - DNA, 19 bp, Homo sapiens
gcatccacccagtgctgcc

SEQ ID NO: 1997273 - DNA, 20 bp, Homo sapiens
gcatccacccagtgctgcca

SEQ ID NO: 1997274 - DNA, 18 bp, Homo sapiens
gcatccacgcacacatgg

SEQ ID NO: 1997275 - DNA, 16 bp, Homo sapiens
gcatccagcctgtgtg

SEQ ID NO: 1997276 - DNA, 17 bp, Homo sapiens
gcatccagcctgtgtgt

SEQ ID NO: 1997277 - DNA, 17 bp, Homo sapiens
gcatccatctgggctac

SEQ ID NO: 1997278 - DNA, 15 bp, Homo sapiens
gcatccattcctcag

SEQ ID NO: 1997279 - DNA, 16 bp, Homo sapiens
gcatccgcagcccagg

SEQ ID NO: 1997280 - DNA, 18 bp, Homo sapiens
gcatccgtagttccctga

SEQ ID NO: 1997281 - DNA, 16 bp, Homo sapiens
gcatcctgcttcctag

SEQ ID NO: 1997282 - DNA, 21 bp, Homo sapiens
gcatcctggcacccggcccct

SEQ ID NO: 1997283 - DNA, 19 bp, Homo sapiens
gcatcgtagaagagatgtg

SEQ ID NO: 1997284 - DNA, 16 bp, Homo sapiens
gcatctacacagcctg

SEQ ID NO: 1997285 - DNA, 23 bp, Homo sapiens
gcatctagaggcttccttcattt

SEQ ID NO: 1997286 - DNA, 21 bp, Homo sapiens
gcatctcattgtagagcttgg

SEQ ID NO: 1997287 - DNA, 15 bp, Homo sapiens
gccagtgagggctgg

SEQ ID NO: 1997288 - DNA, 19 bp, Homo sapiens
gccagtgatgctaaaggtt

SEQ ID NO: 1997289 - DNA, 20 bp, Homo sapiens
gccagtgatgctaaaggttg

SEQ ID NO: 1997290 - DNA, 12 bp, Homo sapiens
gccagtgccagg

SEQ ID NO: 1997291 - DNA, 20 bp, Homo sapiens
gccagtgccaggacagctgg

SEQ ID NO: 1997292 - DNA, 23 bp, Homo sapiens
gccagtgccaggacagctggctg

SEQ ID NO: 1997293 - DNA, 10 bp, Homo sapiens
gccagtgcct

SEQ ID NO: 1997294 - DNA, 17 bp, Homo sapiens
gccagtgccttacctcc

SEQ ID NO: 1997295 - DNA, 17 bp, Homo sapiens
gccagtgtaaggcatag

SEQ ID NO: 1997296 - DNA, 13 bp, Homo sapiens
gccagtgtgacaa

SEQ ID NO: 1997297 - DNA, 17 bp, Homo sapiens
gccagtgtgatcccaag

SEQ ID NO: 1997298 - DNA, 18 bp, Homo sapiens
gccagtgtttagaagagc

SEQ ID NO: 1997299 - DNA, 20 bp, Homo sapiens
gccagtgtttagaagagcct

SEQ ID NO: 1997300 - DNA, 13 bp, Homo sapiens
gccatagccccat

SEQ ID NO: 1997301 - DNA, 16 bp, Homo sapiens
gccatagtcacatggc

SEQ ID NO: 1997302 - DNA, 16 bp, Homo sapiens
gccatcaagagactga

SEQ ID NO: 1997303 - DNA, 15 bp, Homo sapiens
gccatcacaagggga

SEQ ID NO: 1997304 - DNA, 16 bp, Homo sapiens
gccatcacaaggggaa

SEQ ID NO: 1997305 - DNA, 20 bp, Homo sapiens
gccatccaggttcagcttgt

SEQ ID NO: 1997306 - DNA, 13 bp, Homo sapiens
gccatccctgggc

SEQ ID NO: 1997307 - DNA, 20 bp, Homo sapiens
gccatccctgggcccctcca

SEQ ID NO: 1997308 - DNA, 23 bp, Homo sapiens
gccatccgggacgcttccagacc

SEQ ID NO: 1997309 - DNA, 23 bp, Homo sapiens
gccatcctaggcttaaatgcaat

SEQ ID NO: 1997310 - DNA, 15 bp, Homo sapiens
gccatctccaccctg

SEQ ID NO: 1997311 - DNA, 20 bp, Homo sapiens
gccatctccaccctgagcct

SEQ ID NO: 1997312 - DNA, 23 bp, Homo sapiens
gccatctccaccctgagcctgac

SEQ ID NO: 1997313 - DNA, 20 bp, Homo sapiens
gccatgaccagttctggcca

SEQ ID NO: 1997314 - DNA, 20 bp, Homo sapiens
gccatgaggagttgctgttt

SEQ ID NO: 1997315 - DNA, 12 bp, Homo sapiens
gccatgaggcct

SEQ ID NO: 1997316 - DNA, 20 bp, Homo sapiens
gccatgatcgagccactgca

SEQ ID NO: 1997317 - DNA, 22 bp, Homo sapiens
gccatgatggtgctgacctctg

SEQ ID NO: 1997318 - DNA, 17 bp, Homo sapiens
gccatgccactgccagg

SEQ ID NO: 1997319 - DNA, 22 bp, Homo sapiens
gccatgccactgccaggcacct

SEQ ID NO: 1997320 - DNA, 14 bp, Homo sapiens
gccatgcccagaga

SEQ ID NO: 1997321 - DNA, 13 bp, Homo sapiens
gccatgcctcatg

SEQ ID NO: 1997322 - DNA, 14 bp, Homo sapiens
gccatgcttcttgc

SEQ ID NO: 1997323 - DNA, 17 bp, Homo sapiens
gccatgcttcttgcccc

SEQ ID NO: 1997324 - DNA, 17 bp, Homo sapiens
gccatggcgtgtccctc

SEQ ID NO: 1997325 - DNA, 14 bp, Homo sapiens
gccatggctcaggc

SEQ ID NO: 1997326 - DNA, 17 bp, Homo sapiens
gccatggctcaggcaag

SEQ ID NO: 1997327 - DNA, 12 bp, Homo sapiens
gccatgggcctg

SEQ ID NO: 1997328 - DNA, 16 bp, Homo sapiens
gccatgggcctgctgc

SEQ ID NO: 1997329 - DNA, 19 bp, Homo sapiens
gccatgggcctgggcctgc

SEQ ID NO: 1997330 - DNA, 23 bp, Homo sapiens
gccatggtctctcgggcccccca

SEQ ID NO: 1997331 - DNA, 18 bp, Homo sapiens
gccatggtgacacacagc

SEQ ID NO: 1997332 - DNA, 16 bp, Homo sapiens
gccatgtaaaggcctt

SEQ ID NO: 1997333 - DNA, 17 bp, Homo sapiens
gccatgtcaaacaaata

SEQ ID NO: 1997334 - DNA, 16 bp, Homo sapiens
gccatgtggagtggac

SEQ ID NO: 1997335 - DNA, 14 bp, Homo sapiens
gccatgttggccag

SEQ ID NO: 1997336 - DNA, 15 bp, Homo sapiens
gccatgttggccagg

SEQ ID NO: 1997337 - DNA, 17 bp, Homo sapiens
gccatgttggccaggct

SEQ ID NO: 1997338 - DNA, 22 bp, Homo sapiens
gccatgttggccaggctggtct

SEQ ID NO: 1997339 - DNA, 21 bp, Homo sapiens
gccatgtttagattccaggat

SEQ ID NO: 1997340 - DNA, 13 bp, Homo sapiens
gccatttctctgc

SEQ ID NO: 1997341 - DNA, 23 bp, Homo sapiens
gccatttgcaccctccgccttca

SEQ ID NO: 1997342 - DNA, 14 bp, Homo sapiens
gcccaaatggctct

SEQ ID NO: 1997343 - DNA, 14 bp, Homo sapiens
gcccaaatttttct

SEQ ID NO: 1997344 - DNA, 23 bp, Homo sapiens
gcccaacagacaccatcttttgt

SEQ ID NO: 1997345 - DNA, 14 bp, Homo sapiens
gcccaacctcctga

SEQ ID NO: 1997346 - DNA, 21 bp, Homo sapiens
gcccaagaatagatgctgact

SEQ ID NO: 1997347 - DNA, 20 bp, Homo sapiens
gcccaagaggactgagactg

SEQ ID NO: 1997348 - DNA, 22 bp, Homo sapiens
gcccaagaggactgagactggc

SEQ ID NO: 1997349 - DNA, 14 bp, Homo sapiens
gcccaagaggtctg

SEQ ID NO: 1997350 - DNA, 18 bp, Homo sapiens
gcccaagaggtctgagcc

SEQ ID NO: 1997351 - DNA, 13 bp, Homo sapiens
gcccaaggctgca

SEQ ID NO: 1997352 - DNA, 21 bp, Homo sapiens
gcccaaggggacttgtgccag

SEQ ID NO: 1997353 - DNA, 20 bp, Homo sapiens
gcccaaggttaaaaagttca

SEQ ID NO: 1997354 - DNA, 12 bp, Homo sapiens
gcccaagtgcca

SEQ ID NO: 1997355 - DNA, 16 bp, Homo sapiens
gcccaagtgccatccc

SEQ ID NO: 1997356 - DNA, 12 bp, Homo sapiens
gcccaatattat

SEQ ID NO: 1997357 - DNA, 20 bp, Homo sapiens
gcccaatgctttgggaggcc

SEQ ID NO: 1997358 - DNA, 21 bp, Homo sapiens
gcccaatgctttgggaggcca

SEQ ID NO: 1997359 - DNA, 17 bp, Homo sapiens
gcccacaaaggggagaa

SEQ ID NO: 1997360 - DNA, 13 bp, Homo sapiens
gcccacagctccc

SEQ ID NO: 1997361 - DNA, 14 bp, Homo sapiens
gcccacagctccca

SEQ ID NO: 1997362 - DNA, 19 bp, Homo sapiens
gcccacagctcccacccca

SEQ ID NO: 1997363 - DNA, 19 bp, Homo sapiens
gcccacaggatcagtctga

SEQ ID NO: 1997364 - DNA, 17 bp, Homo sapiens
gcccacagggaccaaga

SEQ ID NO: 1997365 - DNA, 21 bp, Homo sapiens
gcccaccaacatcccattgcc

SEQ ID NO: 1997366 - DNA, 23 bp, Homo sapiens
gcccacgctggagtgcagtgagc

SEQ ID NO: 1997367 - DNA, 19 bp, Homo sapiens
gcccacgtgtgcagactgt

SEQ ID NO: 1997368 - DNA, 21 bp, Homo sapiens
gcccacttagccgtccatggc

SEQ ID NO: 1997369 - DNA, 18 bp, Homo sapiens
gcccagaattcccagctg

SEQ ID NO: 1997370 - DNA, 21 bp, Homo sapiens
gcccagaattcccagctgtct

SEQ ID NO: 1997371 - DNA, 23 bp, Homo sapiens
gcccagaattcccagctgtctgt

SEQ ID NO: 1997372 - DNA, 16 bp, Homo sapiens
gcccagagaccccttc

SEQ ID NO: 1997373 - DNA, 21 bp, Homo sapiens
gcccagagagggtggtgacct

SEQ ID NO: 1997374 - DNA, 18 bp, Homo sapiens
gcccagagatgcctccac

SEQ ID NO: 1997375 - DNA, 12 bp, Homo sapiens
gcccagagggcc

SEQ ID NO: 1997376 - DNA, 11 bp, Homo sapiens
gcccagccacc

SEQ ID NO: 1997377 - DNA, 13 bp, Homo sapiens
gcccagccacctc

SEQ ID NO: 1997378 - DNA, 21 bp, Homo sapiens
gcccagccacctcccaaggac

SEQ ID NO: 1997379 - DNA, 13 bp, Homo sapiens
gcccagcctaccc

SEQ ID NO: 1997380 - DNA, 14 bp, Homo sapiens
gcccagcctaccct

SEQ ID NO: 1997381 - DNA, 12 bp, Homo sapiens
gcccagcctctg

SEQ ID NO: 1997382 - DNA, 12 bp, Homo sapiens
gcccagcctgtc

SEQ ID NO: 1997383 - DNA, 16 bp, Homo sapiens
gcccagcctgtcctgg

SEQ ID NO: 1997384 - DNA, 20 bp, Homo sapiens
gcccagcctgtcctggtaca

SEQ ID NO: 1997385 - DNA, 15 bp, Homo sapiens
gcccagctacattcc

SEQ ID NO: 1997386 - DNA, 17 bp, Homo sapiens
gcccagctacattcctc

SEQ ID NO: 1997387 - DNA, 18 bp, Homo sapiens
gcccagctacattcctca

SEQ ID NO: 1997388 - DNA, 23 bp, Homo sapiens
gcccagctatggccccagggttg

SEQ ID NO: 1997389 - DNA, 14 bp, Homo sapiens
gcccagctgcacct

SEQ ID NO: 1997390 - DNA, 18 bp, Homo sapiens
gcccagctgcacctgcca

SEQ ID NO: 1997391 - DNA, 23 bp, Homo sapiens
gcccagctgcacctgccagcctg

SEQ ID NO: 1997392 - DNA, 24 bp, Homo sapiens
gcccagctgcacctgccagcctgg

SEQ ID NO: 1997393 - DNA, 17 bp, Homo sapiens
gcccagctggtgggaag

SEQ ID NO: 1997394 - DNA, 15 bp, Homo sapiens
gcccagctgtagcca

SEQ ID NO: 1997395 - DNA, 21 bp, Homo sapiens
gcccagctgtagccatggctc

SEQ ID NO: 1997396 - DNA, 11 bp, Homo sapiens
gcccaggagac

SEQ ID NO: 1997397 - DNA, 15 bp, Homo sapiens
gcccaggagagccag

SEQ ID NO: 1997398 - DNA, 14 bp, Homo sapiens
gcccaggatgctgc

SEQ ID NO: 1997399 - DNA, 17 bp, Homo sapiens
gcccaggcccctgccac

SEQ ID NO: 1997400 - DNA, 18 bp, Homo sapiens
gcccaggcccctgccacc

SEQ ID NO: 1997401 - DNA, 22 bp, Homo sapiens
gcccaggccgttccccttggct

SEQ ID NO: 1997402 - DNA, 18 bp, Homo sapiens
gccctgcctggaggacct

SEQ ID NO: 1997403 - DNA, 23 bp, Homo sapiens
gccctgcctggaggacctgagcc

SEQ ID NO: 1997404 - DNA, 22 bp, Homo sapiens
gccctgcgaagtggctctcagg

SEQ ID NO: 1997405 - DNA, 13 bp, Homo sapiens
gccctgctctggg

SEQ ID NO: 1997406 - DNA, 22 bp, Homo sapiens
gccctgctgccgcctcccagcc

SEQ ID NO: 1997407 - DNA, 16 bp, Homo sapiens
gccctgctttgggctg

SEQ ID NO: 1997408 - DNA, 23 bp, Homo sapiens
gccctgctttgggctgccctggt

SEQ ID NO: 1997409 - DNA, 19 bp, Homo sapiens
gccctggatcagcgtggcc

SEQ ID NO: 1997410 - DNA, 20 bp, Homo sapiens
gccctggatgtgcccacagg

SEQ ID NO: 1997411 - DNA, 10 bp, Homo sapiens
gccctggcaa

SEQ ID NO: 1997412 - DNA, 13 bp, Homo sapiens
gccctggcctgct

SEQ ID NO: 1997413 - DNA, 15 bp, Homo sapiens
gccctggcctgctgg

SEQ ID NO: 1997414 - DNA, 15 bp, Homo sapiens
gccctggctcccaca

SEQ ID NO: 1997415 - DNA, 14 bp, Homo sapiens
gccctggctctgca

SEQ ID NO: 1997416 - DNA, 15 bp, Homo sapiens
gccctgggccccacc

SEQ ID NO: 1997417 - DNA, 19 bp, Homo sapiens
gccctgggccccaccacct

SEQ ID NO: 1997418 - DNA, 15 bp, Homo sapiens
gccctgggcctcagt

SEQ ID NO: 1997419 - DNA, 22 bp, Homo sapiens
gccctgggctgtctgtcaccag

SEQ ID NO: 1997420 - DNA, 14 bp, Homo sapiens
gccctggggcctgt

SEQ ID NO: 1997421 - DNA, 16 bp, Homo sapiens
gccctgggggccagct

SEQ ID NO: 1997422 - DNA, 17 bp, Homo sapiens
gccctggtgctgccaca

SEQ ID NO: 1997423 - DNA, 19 bp, Homo sapiens
gccctggtggcagtgggag

SEQ ID NO: 1997424 - DNA, 22 bp, Homo sapiens
gccctggtggcagtgggagctg

SEQ ID NO: 1997425 - DNA, 18 bp, Homo sapiens
gccctggtgtcaggcagg

SEQ ID NO: 1997426 - DNA, 16 bp, Homo sapiens
gccctggtgtgtttcc

SEQ ID NO: 1997427 - DNA, 11 bp, Homo sapiens
gccctgtctgt

SEQ ID NO: 1997428 - DNA, 18 bp, Homo sapiens
gccctgtggattccagca

SEQ ID NO: 1997429 - DNA, 13 bp, Homo sapiens
gccctgttaaaag

SEQ ID NO: 1997430 - DNA, 20 bp, Homo sapiens
gcccttagcagggaaacagc

SEQ ID NO: 1997431 - DNA, 22 bp, Homo sapiens
gcccttagcagggaaacagcta

SEQ ID NO: 1997432 - DNA, 20 bp, Homo sapiens
gcccttattttcaagaaact

SEQ ID NO: 1997433 - DNA, 12 bp, Homo sapiens
gcccttccagtg

SEQ ID NO: 1997434 - DNA, 13 bp, Homo sapiens
gcccttccagtgg

SEQ ID NO: 1997435 - DNA, 16 bp, Homo sapiens
gcccttccagtggtac

SEQ ID NO: 1997436 - DNA, 21 bp, Homo sapiens
gcccttcctctccactgcctt

SEQ ID NO: 1997437 - DNA, 12 bp, Homo sapiens
gcccttcctgga

SEQ ID NO: 1997438 - DNA, 16 bp, Homo sapiens
gcccttcctggacagc

SEQ ID NO: 1997439 - DNA, 15 bp, Homo sapiens
gcccttcgctgccag

SEQ ID NO: 1997440 - DNA, 20 bp, Homo sapiens
gcccttcgctgccaggacac

SEQ ID NO: 1997441 - DNA, 13 bp, Homo sapiens
gcccttctttcta

SEQ ID NO: 1997442 - DNA, 13 bp, Homo sapiens
gcccttgccctga

SEQ ID NO: 1997443 - DNA, 14 bp, Homo sapiens
gcccttggggcctg

SEQ ID NO: 1997444 - DNA, 17 bp, Homo sapiens
gcccttggggcctggct

SEQ ID NO: 1997445 - DNA, 19 bp, Homo sapiens
gcccttggggcctggcttg

SEQ ID NO: 1997446 - DNA, 20 bp, Homo sapiens
gcccttgtcctgccagctgc

SEQ ID NO: 1997447 - DNA, 23 bp, Homo sapiens
gcccttgtttggggcaggagtag

SEQ ID NO: 1997448 - DNA, 13 bp, Homo sapiens
gccctttctgtgt

SEQ ID NO: 1997449 - DNA, 23 bp, Homo sapiens
gccctttgcaggcccagcagact

SEQ ID NO: 1997450 - DNA, 17 bp, Homo sapiens
gcccttttacagctctt

SEQ ID NO: 1997451 - DNA, 20 bp, Homo sapiens
gcccttttacagctcttggc

SEQ ID NO: 1997452 - DNA, 19 bp, Homo sapiens
gccgaagctaacagggaag

SEQ ID NO: 1997453 - DNA, 17 bp, Homo sapiens
gccgaccagagccccac

SEQ ID NO: 1997454 - DNA, 12 bp, Homo sapiens
gccgacctcagc

SEQ ID NO: 1997455 - DNA, 19 bp, Homo sapiens
gccgacctcgtcctccccc

SEQ ID NO: 1997456 - DNA, 20 bp, Homo sapiens
gccgacctcgtcctccccct

SEQ ID NO: 1997457 - DNA, 16 bp, Homo sapiens
gccgagatcacgccac

SEQ ID NO: 1997458 - DNA, 20 bp, Homo sapiens
gccgagcaaccgtggccctt

SEQ ID NO: 1997459 - DNA, 16 bp, Homo sapiens
gccgagccgggcctgg

SEQ ID NO: 1997460 - DNA, 17 bp, Homo sapiens
gccgagccgggcctggg

SEQ ID NO: 1997461 - DNA, 13 bp, Homo sapiens
gccgagcctaatg

SEQ ID NO: 1997462 - DNA, 13 bp, Homo sapiens
gccgcaaatcaac

SEQ ID NO: 1997463 - DNA, 15 bp, Homo sapiens
gccgcaaggccctgt

SEQ ID NO: 1997464 - DNA, 20 bp, Homo sapiens
gccgcaaggccctgtcccag

SEQ ID NO: 1997465 - DNA, 17 bp, Homo sapiens
gccgcaagtctgcagcc

SEQ ID NO: 1997466 - DNA, 18 bp, Homo sapiens
gccgcagcctccctctga

SEQ ID NO: 1997467 - DNA, 15 bp, Homo sapiens
gccgcaggaaggcag

SEQ ID NO: 1997468 - DNA, 15 bp, Homo sapiens
gccgcatcttctcca

SEQ ID NO: 1997469 - DNA, 17 bp, Homo sapiens
gccgcatcttctccatc

SEQ ID NO: 1997470 - DNA, 12 bp, Homo sapiens
gccgccctgggc

SEQ ID NO: 1997471 - DNA, 15 bp, Homo sapiens
gccgccctgggctgt

SEQ ID NO: 1997472 - DNA, 17 bp, Homo sapiens
gccgccgggcaggcctg

SEQ ID NO: 1997473 - DNA, 18 bp, Homo sapiens
gccgccgtctctgtcccg

SEQ ID NO: 1997474 - DNA, 13 bp, Homo sapiens
gccgcctcaatgt

SEQ ID NO: 1997475 - DNA, 16 bp, Homo sapiens
gccgcctccaggagcc

SEQ ID NO: 1997476 - DNA, 17 bp, Homo sapiens
gccgcctcccagcctgg

SEQ ID NO: 1997477 - DNA, 19 bp, Homo sapiens
gccgcctcccagcctgggg

SEQ ID NO: 1997478 - DNA, 19 bp, Homo sapiens
gccgcgtggaatgtgagtg

SEQ ID NO: 1997479 - DNA, 13 bp, Homo sapiens
gccgctaggagag

SEQ ID NO: 1997480 - DNA, 20 bp, Homo sapiens
gccgctcctgtctgccagcc

SEQ ID NO: 1997481 - DNA, 18 bp, Homo sapiens
gccgctcttctgtcatcc

SEQ ID NO: 1997482 - DNA, 19 bp, Homo sapiens
gccgctgctttgcgctggt

SEQ ID NO: 1997483 - DNA, 11 bp, Homo sapiens
gccgctggccc

SEQ ID NO: 1997484 - DNA, 19 bp, Homo sapiens
gccgctggcccagggtagg

SEQ ID NO: 1997485 - DNA, 12 bp, Homo sapiens
gccgctgtgagc

SEQ ID NO: 1997486 - DNA, 16 bp, Homo sapiens
gccgctgttcacccac

SEQ ID NO: 1997487 - DNA, 17 bp, Homo sapiens
gccgctgttcacccaca

SEQ ID NO: 1997488 - DNA, 19 bp, Homo sapiens
gccggaccaagatgggcac

SEQ ID NO: 1997489 - DNA, 20 bp, Homo sapiens
gccggaccaagatgggcaca

SEQ ID NO: 1997490 - DNA, 18 bp, Homo sapiens
gccggatgtcccatctgc

SEQ ID NO: 1997491 - DNA, 18 bp, Homo sapiens
gccggcaaccccagttct

SEQ ID NO: 1997492 - DNA, 21 bp, Homo sapiens
gccggcaaccccagttctgct

SEQ ID NO: 1997493 - DNA, 20 bp, Homo sapiens
gccggcacctacatccccag

SEQ ID NO: 1997494 - DNA, 23 bp, Homo sapiens
gccggcacctacatccccaggtc

SEQ ID NO: 1997495 - DNA, 22 bp, Homo sapiens
gccgggaacagacaacagaagt

SEQ ID NO: 1997496 - DNA, 19 bp, Homo sapiens
gccgggacatgcagctctg

SEQ ID NO: 1997497 - DNA, 15 bp, Homo sapiens
gccgggcaggcctgc

SEQ ID NO: 1997498 - DNA, 18 bp, Homo sapiens
gccgggcaggtcctgccc

SEQ ID NO: 1997499 - DNA, 17 bp, Homo sapiens
gccgggcggaaggggac

SEQ ID NO: 1997500 - DNA, 21 bp, Homo sapiens
gccgggctgcccttcgctgcc

SEQ ID NO: 1997501 - DNA, 24 bp, Homo sapiens
gccgggctgcccttcgctgccagg

SEQ ID NO: 1997502 - DNA, 18 bp, Homo sapiens
gccgggcttgggccctgc

SEQ ID NO: 1997503 - DNA, 19 bp, Homo sapiens
gccgggcttgggccctgca

SEQ ID NO: 1997504 - DNA, 22 bp, Homo sapiens
gccgggcttgggccctgcacag

SEQ ID NO: 1997505 - DNA, 22 bp, Homo sapiens
gccggggaactggccaagctga

SEQ ID NO: 1997506 - DNA, 20 bp, Homo sapiens
gccggggaagctggcagcac

SEQ ID NO: 1997507 - DNA, 18 bp, Homo sapiens
gccgggtacctcagtttc

SEQ ID NO: 1997508 - DNA, 20 bp, Homo sapiens
gccgggtacctcagtttctc

SEQ ID NO: 1997509 - DNA, 16 bp, Homo sapiens
gccgggtgcggtggct

SEQ ID NO: 1997510 - DNA, 19 bp, Homo sapiens
gccgggtgcggtggctcac

SEQ ID NO: 1997511 - DNA, 14 bp, Homo sapiens
gccggtacctggga

SEQ ID NO: 1997512 - DNA, 13 bp, Homo sapiens
gccggtgcctggc

SEQ ID NO: 1997513 - DNA, 20 bp, Homo sapiens
gccggttgcagagaatctgt

SEQ ID NO: 1997514 - DNA, 15 bp, Homo sapiens
gccgtactgtctatg

SEQ ID NO: 1997515 - DNA, 17 bp, Homo sapiens
gccgtagagggtggccg

SEQ ID NO: 1997516 - DNA, 14 bp, Homo sapiens
gccgtccatggcac

SEQ ID NO: 1997517 - DNA, 17 bp, Homo sapiens
gccttcctcatcccctc

SEQ ID NO: 1997518 - DNA, 22 bp, Homo sapiens
gccttcctgtctttctggccct

SEQ ID NO: 1997519 - DNA, 18 bp, Homo sapiens
gccttcgatacaccgggc

SEQ ID NO: 1997520 - DNA, 23 bp, Homo sapiens
gccttcgatacaccgggcctgga

SEQ ID NO: 1997521 - DNA, 14 bp, Homo sapiens
gccttctcctgcct

SEQ ID NO: 1997522 - DNA, 14 bp, Homo sapiens
gccttctcgcattt

SEQ ID NO: 1997523 - DNA, 15 bp, Homo sapiens
gccttctctctctgg

SEQ ID NO: 1997524 - DNA, 14 bp, Homo sapiens
gccttgaagccact

SEQ ID NO: 1997525 - DNA, 17 bp, Homo sapiens
gccttgatgaagcccgt

SEQ ID NO: 1997526 - DNA, 19 bp, Homo sapiens
gccttgatgaagcctgtgc

SEQ ID NO: 1997527 - DNA, 14 bp, Homo sapiens
gccttgcccagaga

SEQ ID NO: 1997528 - DNA, 16 bp, Homo sapiens
gccttgcccagagatg

SEQ ID NO: 1997529 - DNA, 22 bp, Homo sapiens
gccttgctttgggctttgcagg

SEQ ID NO: 1997530 - DNA, 19 bp, Homo sapiens
gccttggataatgctgttg

SEQ ID NO: 1997531 - DNA, 22 bp, Homo sapiens
gccttggtgtccacctggcccc

SEQ ID NO: 1997532 - DNA, 20 bp, Homo sapiens
gccttgtaattctaaatgaa

SEQ ID NO: 1997533 - DNA, 19 bp, Homo sapiens
gccttgtcaggacccaggc

SEQ ID NO: 1997534 - DNA, 21 bp, Homo sapiens
gccttgtcaggacccaggccg

SEQ ID NO: 1997535 - DNA, 14 bp, Homo sapiens
gccttgtgccctgc

SEQ ID NO: 1997536 - DNA, 18 bp, Homo sapiens
gccttgtggataagggag

SEQ ID NO: 1997537 - DNA, 16 bp, Homo sapiens
gccttgttctgtcacc

SEQ ID NO: 1997538 - DNA, 22 bp, Homo sapiens
gcctttagggcttatggccagg

SEQ ID NO: 1997539 - DNA, 21 bp, Homo sapiens
gcctttattaaaaactgagtg

SEQ ID NO: 1997540 - DNA, 14 bp, Homo sapiens
gcctttcctgtgcc

SEQ ID NO: 1997541 - DNA, 14 bp, Homo sapiens
gcctttctcccccg

SEQ ID NO: 1997542 - DNA, 22 bp, Homo sapiens
gcctttctcgtggtagaagcca

SEQ ID NO: 1997543 - DNA, 23 bp, Homo sapiens
gcctttctcgtggtagaagccag

SEQ ID NO: 1997544 - DNA, 21 bp, Homo sapiens
gcctttgaaattcccccactt

SEQ ID NO: 1997545 - DNA, 12 bp, Homo sapiens
gcctttgccctg

SEQ ID NO: 1997546 - DNA, 16 bp, Homo sapiens
gcctttggaagaaaca

SEQ ID NO: 1997547 - DNA, 20 bp, Homo sapiens
gcctttggatgaccagaaca

SEQ ID NO: 1997548 - DNA, 16 bp, Homo sapiens
gccttttatttcttaa

SEQ ID NO: 1997549 - DNA, 19 bp, Homo sapiens
gccttttcttatataagac

SEQ ID NO: 1997550 - DNA, 16 bp, Homo sapiens
gccttttgctgctgct

SEQ ID NO: 1997551 - DNA, 21 bp, Homo sapiens
gccttttgtgtaataagaaag

SEQ ID NO: 1997552 - DNA, 14 bp, Homo sapiens
gccttttgtttaaa

SEQ ID NO: 1997553 - DNA, 18 bp, Homo sapiens
gcctttttcataaactga

SEQ ID NO: 1997554 - DNA, 16 bp, Homo sapiens
gccttttttcacagcc

SEQ ID NO: 1997555 - DNA, 22 bp, Homo sapiens
gcgaaacaacttgtgttctatt

SEQ ID NO: 1997556 - DNA, 13 bp, Homo sapiens
gcgaaagtttctt

SEQ ID NO: 1997557 - DNA, 15 bp, Homo sapiens
gcgaagtggctctca

SEQ ID NO: 1997558 - DNA, 23 bp, Homo sapiens
gcgacagagcgagagtctgtctc

SEQ ID NO: 1997559 - DNA, 17 bp, Homo sapiens
gcgacttcacaaaatgc

SEQ ID NO: 1997560 - DNA, 17 bp, Homo sapiens
gcgacttcctctccagc

SEQ ID NO: 1997561 - DNA, 21 bp, Homo sapiens
gcgagacccttgcattagaaa

SEQ ID NO: 1997562 - DNA, 19 bp, Homo sapiens
gcgagagaggtgggcagca

SEQ ID NO: 1997563 - DNA, 18 bp, Homo sapiens
gcgagatcgctggcagag

SEQ ID NO: 1997564 - DNA, 21 bp, Homo sapiens
gcgagatcgctggcagagaag

SEQ ID NO: 1997565 - DNA, 16 bp, Homo sapiens
gcgagcatcctggcca

SEQ ID NO: 1997566 - DNA, 14 bp, Homo sapiens
gcgagcatttccct

SEQ ID NO: 1997567 - DNA, 21 bp, Homo sapiens
gcgagtgccaggactccccag

SEQ ID NO: 1997568 - DNA, 20 bp, Homo sapiens
gcgataaaactaaatatatg

SEQ ID NO: 1997569 - DNA, 14 bp, Homo sapiens
gcgattccctctca

SEQ ID NO: 1997570 - DNA, 14 bp, Homo sapiens
gcgattccctctcc

SEQ ID NO: 1997571 - DNA, 18 bp, Homo sapiens
gcgattccctctcccagg

SEQ ID NO: 1997572 - DNA, 13 bp, Homo sapiens
gcgattcttctgc

SEQ ID NO: 1997573 - DNA, 17 bp, Homo sapiens
gcgattcttctgcttca

SEQ ID NO: 1997574 - DNA, 23 bp, Homo sapiens
gcgcaagcctgtaatcccagcta

SEQ ID NO: 1997575 - DNA, 23 bp, Homo sapiens
gcgcacctatcacccaggctgga

SEQ ID NO: 1997576 - DNA, 15 bp, Homo sapiens
gcgcagcccgaagcc

SEQ ID NO: 1997577 - DNA, 18 bp, Homo sapiens
gcgcagcccgaagcccag

SEQ ID NO: 1997578 - DNA, 17 bp, Homo sapiens
gcgcagggaggatgcca

SEQ ID NO: 1997579 - DNA, 21 bp, Homo sapiens
gcgcagggaggatgccacagc

SEQ ID NO: 1997580 - DNA, 19 bp, Homo sapiens
gcgcatgtaatcccagcta

SEQ ID NO: 1997581 - DNA, 16 bp, Homo sapiens
gcgcatgtgccagttg

SEQ ID NO: 1997582 - DNA, 23 bp, Homo sapiens
gcgcccagttgggtggatgcctg

SEQ ID NO: 1997583 - DNA, 15 bp, Homo sapiens
gcgcctacaggagtg

SEQ ID NO: 1997584 - DNA, 18 bp, Homo sapiens
gcgcctacaggagtgagc

SEQ ID NO: 1997585 - DNA, 17 bp, Homo sapiens
gcgcctccctccacccc

SEQ ID NO: 1997586 - DNA, 18 bp, Homo sapiens
gcgcctccctccacccca

SEQ ID NO: 1997587 - DNA, 16 bp, Homo sapiens
gcgcgggaggcaccag

SEQ ID NO: 1997588 - DNA, 17 bp, Homo sapiens
gcgcgggaggcaccagc

SEQ ID NO: 1997589 - DNA, 16 bp, Homo sapiens
gcgcgtccttccctaa

SEQ ID NO: 1997590 - DNA, 19 bp, Homo sapiens
gcgctaacccccagcccac

SEQ ID NO: 1997591 - DNA, 20 bp, Homo sapiens
gcgctattgcactccagtct

SEQ ID NO: 1997592 - DNA, 22 bp, Homo sapiens
gcgctattgcactccagtctgg

SEQ ID NO: 1997593 - DNA, 11 bp, Homo sapiens
gcgctcaggac

SEQ ID NO: 1997594 - DNA, 12 bp, Homo sapiens
gcgctcaggacc

SEQ ID NO: 1997595 - DNA, 20 bp, Homo sapiens
gcgctcaggacccaggccct

SEQ ID NO: 1997596 - DNA, 16 bp, Homo sapiens
gcgctctagcctgggc

SEQ ID NO: 1997597 - DNA, 15 bp, Homo sapiens
gcgctctgccctccc

SEQ ID NO: 1997598 - DNA, 20 bp, Homo sapiens
gcgctctgccctccctggcc

SEQ ID NO: 1997599 - DNA, 16 bp, Homo sapiens
gcgctcttggtccctg

SEQ ID NO: 1997600 - DNA, 11 bp, Homo sapiens
gcgctgcaggt

SEQ ID NO: 1997601 - DNA, 19 bp, Homo sapiens
gcgctgccgcaccccagag

SEQ ID NO: 1997602 - DNA, 21 bp, Homo sapiens
gcgctgccgcaccccagagtg

SEQ ID NO: 1997603 - DNA, 22 bp, Homo sapiens
gcgctggacgatagcttggagg

SEQ ID NO: 1997604 - DNA, 15 bp, Homo sapiens
gcgctggctcaggaa

SEQ ID NO: 1997605 - DNA, 17 bp, Homo sapiens
gcgctggctcaggaaga

SEQ ID NO: 1997606 - DNA, 17 bp, Homo sapiens
gcgctggtggaccacag

SEQ ID NO: 1997607 - DNA, 14 bp, Homo sapiens
gcgctgtggctcct

SEQ ID NO: 1997608 - DNA, 19 bp, Homo sapiens
gcgctgtggctcctgcctt

SEQ ID NO: 1997609 - DNA, 12 bp, Homo sapiens
gcggaaaccttg

SEQ ID NO: 1997610 - DNA, 15 bp, Homo sapiens
gcggaaaccttgcag

SEQ ID NO: 1997611 - DNA, 19 bp, Homo sapiens
gcggaaaccttgcagcatt

SEQ ID NO: 1997612 - DNA, 13 bp, Homo sapiens
gcggaaggggacg

SEQ ID NO: 1997613 - DNA, 15 bp, Homo sapiens
gcggacagccacggc

SEQ ID NO: 1997614 - DNA, 19 bp, Homo sapiens
gcggacagccacggccagg

SEQ ID NO: 1997615 - DNA, 18 bp, Homo sapiens
gcggaggagaccagctca

SEQ ID NO: 1997616 - DNA, 12 bp, Homo sapiens
gcggaggcggct

SEQ ID NO: 1997617 - DNA, 13 bp, Homo sapiens
gcggatctcactc

SEQ ID NO: 1997618 - DNA, 18 bp, Homo sapiens
gcggcacgccaacagccc

SEQ ID NO: 1997619 - DNA, 14 bp, Homo sapiens
gcggcaggagcagg

SEQ ID NO: 1997620 - DNA, 19 bp, Homo sapiens
gcggccctcaaaagcactt

SEQ ID NO: 1997621 - DNA, 15 bp, Homo sapiens
gcggccgcattccct

SEQ ID NO: 1997622 - DNA, 15 bp, Homo sapiens
gcggccgggctgccc

SEQ ID NO: 1997623 - DNA, 18 bp, Homo sapiens
gcggcctatgacttgggc

SEQ ID NO: 1997624 - DNA, 19 bp, Homo sapiens
gcggcctatgacttgggca

SEQ ID NO: 1997625 - DNA, 16 bp, Homo sapiens
gcggccttccaccggg

SEQ ID NO: 1997626 - DNA, 20 bp, Homo sapiens
gcggccttccaccgggcctg

SEQ ID NO: 1997627 - DNA, 22 bp, Homo sapiens
gcggcgaccgccgcagggacgg

SEQ ID NO: 1997628 - DNA, 13 bp, Homo sapiens
gcggcgcagaggg

SEQ ID NO: 1997629 - DNA, 21 bp, Homo sapiens
gcggctactcagcagccctcc

SEQ ID NO: 1997630 - DNA, 17 bp, Homo sapiens
gcggctgctgtgtgcct

SEQ ID NO: 1997631 - DNA, 14 bp, Homo sapiens
gctcgcagcctggc

SEQ ID NO: 1997632 - DNA, 22 bp, Homo sapiens
gctcgctccctgtagctctgcc

SEQ ID NO: 1997633 - DNA, 15 bp, Homo sapiens
gctcgcttctcctcc

SEQ ID NO: 1997634 - DNA, 16 bp, Homo sapiens
gctcgcttctcctcca

SEQ ID NO: 1997635 - DNA, 20 bp, Homo sapiens
gctcgggcgctgtggctcct

SEQ ID NO: 1997636 - DNA, 23 bp, Homo sapiens
gctcgggcgctgtggctcctgcc

SEQ ID NO: 1997637 - DNA, 19 bp, Homo sapiens
gctcggggtgcacaggagg

SEQ ID NO: 1997638 - DNA, 22 bp, Homo sapiens
gctcgtaaatattccctgacga

SEQ ID NO: 1997639 - DNA, 13 bp, Homo sapiens
gctcgtggccttc

SEQ ID NO: 1997640 - DNA, 14 bp, Homo sapiens
gctctaacgcctga

SEQ ID NO: 1997641 - DNA, 17 bp, Homo sapiens
gctctaacgcctgagcc

SEQ ID NO: 1997642 - DNA, 20 bp, Homo sapiens
gctctacagctaatcagcat

SEQ ID NO: 1997643 - DNA, 13 bp, Homo sapiens
gctctagccagga

SEQ ID NO: 1997644 - DNA, 16 bp, Homo sapiens
gctctagccaggagtc

SEQ ID NO: 1997645 - DNA, 20 bp, Homo sapiens
gctctagccaggagtctgtg

SEQ ID NO: 1997646 - DNA, 24 bp, Homo sapiens
gctctagccaggagtctgtgctct

SEQ ID NO: 1997647 - DNA, 19 bp, Homo sapiens
gctctagctggcaggacac

SEQ ID NO: 1997648 - DNA, 20 bp, Homo sapiens
gctctagctggcaggacaca

SEQ ID NO: 1997649 - DNA, 22 bp, Homo sapiens
gctctatttcctcccccagtta

SEQ ID NO: 1997650 - DNA, 12 bp, Homo sapiens
gctctcagaagg

SEQ ID NO: 1997651 - DNA, 17 bp, Homo sapiens
gctctcagccaacgagt

SEQ ID NO: 1997652 - DNA, 16 bp, Homo sapiens
gctctcatgcctgcct

SEQ ID NO: 1997653 - DNA, 16 bp, Homo sapiens
gctctccaaaggggct

SEQ ID NO: 1997654 - DNA, 17 bp, Homo sapiens
gctctccaaaggggctg

SEQ ID NO: 1997655 - DNA, 21 bp, Homo sapiens
gctctccaaaggggctgctgg

SEQ ID NO: 1997656 - DNA, 23 bp, Homo sapiens
gctctccaaaggggctgctgggg

SEQ ID NO: 1997657 - DNA, 13 bp, Homo sapiens
gctctccacctca

SEQ ID NO: 1997658 - DNA, 20 bp, Homo sapiens
gctctccacctcagccttgg

SEQ ID NO: 1997659 - DNA, 21 bp, Homo sapiens
gctctccacctcagccttgga

SEQ ID NO: 1997660 - DNA, 14 bp, Homo sapiens
gctctccctctggc

SEQ ID NO: 1997661 - DNA, 18 bp, Homo sapiens
gctctccctctggccctg

SEQ ID NO: 1997662 - DNA, 20 bp, Homo sapiens
gctctccctctggccctgcc

SEQ ID NO: 1997663 - DNA, 17 bp, Homo sapiens
gctctcctaccccacct

SEQ ID NO: 1997664 - DNA, 19 bp, Homo sapiens
gctctcctcttgccactgc

SEQ ID NO: 1997665 - DNA, 21 bp, Homo sapiens
gctctcctgagaggtgctgca

SEQ ID NO: 1997666 - DNA, 12 bp, Homo sapiens
gctctcctggct

SEQ ID NO: 1997667 - DNA, 16 bp, Homo sapiens
gctctcctttctttct

SEQ ID NO: 1997668 - DNA, 19 bp, Homo sapiens
gctctcgggttgtgtgtct

SEQ ID NO: 1997669 - DNA, 17 bp, Homo sapiens
gctctctgcagccagcc

SEQ ID NO: 1997670 - DNA, 19 bp, Homo sapiens
gctctctgcagccagccca

SEQ ID NO: 1997671 - DNA, 20 bp, Homo sapiens
gctctctgcagccagcccag

SEQ ID NO: 1997672 - DNA, 22 bp, Homo sapiens
gctctctgcagccagcccagcc

SEQ ID NO: 1997673 - DNA, 18 bp, Homo sapiens
gctctctgtataaacatt

SEQ ID NO: 1997674 - DNA, 13 bp, Homo sapiens
gctctctgtctgg

SEQ ID NO: 1997675 - DNA, 22 bp, Homo sapiens
gctctcttcaggaggccctggt

SEQ ID NO: 1997676 - DNA, 23 bp, Homo sapiens
gctctcttccagaagatgccctc

SEQ ID NO: 1997677 - DNA, 19 bp, Homo sapiens
gctctgaatattttgtaat

SEQ ID NO: 1997678 - DNA, 15 bp, Homo sapiens
gctctgacccagtga

SEQ ID NO: 1997679 - DNA, 17 bp, Homo sapiens
gctctgacccagtgaga

SEQ ID NO: 1997680 - DNA, 15 bp, Homo sapiens
gctctgagaggccct

SEQ ID NO: 1997681 - DNA, 16 bp, Homo sapiens
gctctgagaggccctg

SEQ ID NO: 1997682 - DNA, 18 bp, Homo sapiens
gctctgagaggccctgga

SEQ ID NO: 1997683 - DNA, 20 bp, Homo sapiens
gctctgaggcgccccaaccc

SEQ ID NO: 1997684 - DNA, 18 bp, Homo sapiens
gctctgaggcttccagag

SEQ ID NO: 1997685 - DNA, 21 bp, Homo sapiens
gctctgaggcttccagagagt

SEQ ID NO: 1997686 - DNA, 14 bp, Homo sapiens
gctctgatcagcat

SEQ ID NO: 1997687 - DNA, 16 bp, Homo sapiens
gctctgcaggcacctt

SEQ ID NO: 1997688 - DNA, 19 bp, Homo sapiens
gctctgccccaagccccca

SEQ ID NO: 1997689 - DNA, 16 bp, Homo sapiens
gctctgccccagaggc

SEQ ID NO: 1997690 - DNA, 19 bp, Homo sapiens
gctctgccccagctctggc

SEQ ID NO: 1997691 - DNA, 20 bp, Homo sapiens
gctctgccccagctctggct

SEQ ID NO: 1997692 - DNA, 14 bp, Homo sapiens
gctctgccccttgg

SEQ ID NO: 1997693 - DNA, 14 bp, Homo sapiens
gctctgccctccct

SEQ ID NO: 1997694 - DNA, 19 bp, Homo sapiens
gctctgccctccctggcct

SEQ ID NO: 1997695 - DNA, 20 bp, Homo sapiens
gctctgccctccctggcctc

SEQ ID NO: 1997696 - DNA, 21 bp, Homo sapiens
gctctgctcctctccccagca

SEQ ID NO: 1997697 - DNA, 14 bp, Homo sapiens
gctctgctgacaga

SEQ ID NO: 1997698 - DNA, 15 bp, Homo sapiens
gctctgctggcctgg

SEQ ID NO: 1997699 - DNA, 21 bp, Homo sapiens
gctctgctggcctggccggca

SEQ ID NO: 1997700 - DNA, 22 bp, Homo sapiens
gctctggaaaatgtgacccaga

SEQ ID NO: 1997701 - DNA, 15 bp, Homo sapiens
gctctggaagcctgg

SEQ ID NO: 1997702 - DNA, 22 bp, Homo sapiens
gctctggacaggcatgttctct

SEQ ID NO: 1997703 - DNA, 17 bp, Homo sapiens
gctctggaccagcctgt

SEQ ID NO: 1997704 - DNA, 15 bp, Homo sapiens
gctctggagccagag

SEQ ID NO: 1997705 - DNA, 16 bp, Homo sapiens
gctctggagccagaga

SEQ ID NO: 1997706 - DNA, 20 bp, Homo sapiens
gctctggcggcttcctgtcc

SEQ ID NO: 1997707 - DNA, 14 bp, Homo sapiens
gctctgggctcagg

SEQ ID NO: 1997708 - DNA, 18 bp, Homo sapiens
gctctgggctcagggctg

SEQ ID NO: 1997709 - DNA, 20 bp, Homo sapiens
gctctgggctcagggctgga

SEQ ID NO: 1997710 - DNA, 14 bp, Homo sapiens
gctctggggatgca

SEQ ID NO: 1997711 - DNA, 21 bp, Homo sapiens
gctctgtagaaagaatgtgtt

SEQ ID NO: 1997712 - DNA, 16 bp, Homo sapiens
gctctgtcctgggagt

SEQ ID NO: 1997713 - DNA, 23 bp, Homo sapiens
gctctgtgaaatcagaagtgcaa

SEQ ID NO: 1997714 - DNA, 14 bp, Homo sapiens
gctctgtgcaggga

SEQ ID NO: 1997715 - DNA, 22 bp, Homo sapiens
gctcttagtgcccgcctaggag

SEQ ID NO: 1997716 - DNA, 21 bp, Homo sapiens
gctcttatgtggattaaacga

SEQ ID NO: 1997717 - DNA, 19 bp, Homo sapiens
gctcttcactcagccacac

SEQ ID NO: 1997718 - DNA, 16 bp, Homo sapiens
gctcttcctggacctg

SEQ ID NO: 1997719 - DNA, 15 bp, Homo sapiens
gctcttccttactcc

SEQ ID NO: 1997720 - DNA, 22 bp, Homo sapiens
gctcttctatttaaaaaataaa

SEQ ID NO: 1997721 - DNA, 12 bp, Homo sapiens
gctcttctccag

SEQ ID NO: 1997722 - DNA, 19 bp, Homo sapiens
gctcttctccttggaggac

SEQ ID NO: 1997723 - DNA, 23 bp, Homo sapiens
gctcttctcctttcacaaccttc

SEQ ID NO: 1997724 - DNA, 20 bp, Homo sapiens
gctcttctgttctcaaatgc

SEQ ID NO: 1997725 - DNA, 23 bp, Homo sapiens
gctcttctgttctcaaatgctaa

SEQ ID NO: 1997726 - DNA, 14 bp, Homo sapiens
gctcttgaattcct

SEQ ID NO: 1997727 - DNA, 16 bp, Homo sapiens
gctcttgcctgtaatc

SEQ ID NO: 1997728 - DNA, 22 bp, Homo sapiens
gctcttggaaagctgatgatgt

SEQ ID NO: 1997729 - DNA, 17 bp, Homo sapiens
gctcttggaagagctct

SEQ ID NO: 1997730 - DNA, 21 bp, Homo sapiens
gctcttggcattttcctcgcc

SEQ ID NO: 1997731 - DNA, 17 bp, Homo sapiens
gctcttggtccctggtc

SEQ ID NO: 1997732 - DNA, 19 bp, Homo sapiens
gctcttggtccctggtccc

SEQ ID NO: 1997733 - DNA, 12 bp, Homo sapiens
gctctttcaggg

SEQ ID NO: 1997734 - DNA, 13 bp, Homo sapiens
gctctttctgggc

SEQ ID NO: 1997735 - DNA, 21 bp, Homo sapiens
gctctttggggtcagccaggg

SEQ ID NO: 1997736 - DNA, 23 bp, Homo sapiens
gctctttggggtcagccagggcc

SEQ ID NO: 1997737 - DNA, 17 bp, Homo sapiens
gctgaaacacctcccag

SEQ ID NO: 1997738 - DNA, 19 bp, Homo sapiens
gctgaaacacctcccaggg

SEQ ID NO: 1997739 - DNA, 16 bp, Homo sapiens
gctgaacaatgaatgc

SEQ ID NO: 1997740 - DNA, 22 bp, Homo sapiens
gctgaacccattttgagtgact

SEQ ID NO: 1997741 - DNA, 22 bp, Homo sapiens
gctgaactgagcctagctacct

SEQ ID NO: 1997742 - DNA, 20 bp, Homo sapiens
gctgaagggaccttgaaggg

SEQ ID NO: 1997743 - DNA, 16 bp, Homo sapiens
gctgaagtgaaggaga

SEQ ID NO: 1997744 - DNA, 17 bp, Homo sapiens
gctgaagtgaaggagaa

SEQ ID NO: 1997745 - DNA, 13 bp, Homo sapiens
gctttatttttta

SEQ ID NO: 1997746 - DNA, 21 bp, Homo sapiens
gctttattttttaagtattta

SEQ ID NO: 1997747 - DNA, 16 bp, Homo sapiens
gctttcaacttaaatc

SEQ ID NO: 1997748 - DNA, 19 bp, Homo sapiens
gctttcaacttaaatcact

SEQ ID NO: 1997749 - DNA, 15 bp, Homo sapiens
gctttcaattgtatt

SEQ ID NO: 1997750 - DNA, 13 bp, Homo sapiens
gctttcagagcca

SEQ ID NO: 1997751 - DNA, 15 bp, Homo sapiens
gctttcagagccagt

SEQ ID NO: 1997752 - DNA, 12 bp, Homo sapiens
gctttccacagg

SEQ ID NO: 1997753 - DNA, 22 bp, Homo sapiens
gctttcccaccagcatgtcact

SEQ ID NO: 1997754 - DNA, 21 bp, Homo sapiens
gctttccccgggggaggaagg

SEQ ID NO: 1997755 - DNA, 14 bp, Homo sapiens
gctttcctccctgg

SEQ ID NO: 1997756 - DNA, 20 bp, Homo sapiens
gctttccttttcttccttct

SEQ ID NO: 1997757 - DNA, 12 bp, Homo sapiens
gctttctcaggg

SEQ ID NO: 1997758 - DNA, 13 bp, Homo sapiens
gctttctggagag

SEQ ID NO: 1997759 - DNA, 20 bp, Homo sapiens
gctttcttctacaaccagag

SEQ ID NO: 1997760 - DNA, 22 bp, Homo sapiens
gctttcttctacaaccagagcc

SEQ ID NO: 1997761 - DNA, 21 bp, Homo sapiens
gctttctttcacaaaaaagaa

SEQ ID NO: 1997762 - DNA, 19 bp, Homo sapiens
gctttgaatacccccagag

SEQ ID NO: 1997763 - DNA, 20 bp, Homo sapiens
gctttgaatacccccagaga

SEQ ID NO: 1997764 - DNA, 19 bp, Homo sapiens
gctttgcgctggtggacca

SEQ ID NO: 1997765 - DNA, 16 bp, Homo sapiens
gctttgctaccaaagc

SEQ ID NO: 1997766 - DNA, 12 bp, Homo sapiens
gctttggcccaa

SEQ ID NO: 1997767 - DNA, 15 bp, Homo sapiens
gctttgggagaatgt

SEQ ID NO: 1997768 - DNA, 21 bp, Homo sapiens
gctttgggaggccaaggcagg

SEQ ID NO: 1997769 - DNA, 23 bp, Homo sapiens
gctttggggacagttggcagaga

SEQ ID NO: 1997770 - DNA, 23 bp, Homo sapiens
gctttgtactttgtgcaaaaggg

SEQ ID NO: 1997771 - DNA, 15 bp, Homo sapiens
gctttgtatgcactt

SEQ ID NO: 1997772 - DNA, 16 bp, Homo sapiens
gctttgtgtgattgaa

SEQ ID NO: 1997773 - DNA, 17 bp, Homo sapiens
gcttttaaaaaaaaata

SEQ ID NO: 1997774 - DNA, 19 bp, Homo sapiens
gcttttaagaaacacaggg

SEQ ID NO: 1997775 - DNA, 12 bp, Homo sapiens
gcttttcactgc

SEQ ID NO: 1997776 - DNA, 13 bp, Homo sapiens
gcttttcactgct

SEQ ID NO: 1997777 - DNA, 23 bp, Homo sapiens
gcttttcactgctggctgcctta

SEQ ID NO: 1997778 - DNA, 14 bp, Homo sapiens
gcttttcccaggag

SEQ ID NO: 1997779 - DNA, 18 bp, Homo sapiens
gcttttccccggtccctt

SEQ ID NO: 1997780 - DNA, 22 bp, Homo sapiens
gcttttcctatttgttttcatg

SEQ ID NO: 1997781 - DNA, 22 bp, Homo sapiens
gcttttcctttgtttttatgaa

SEQ ID NO: 1997782 - DNA, 18 bp, Homo sapiens
gcttttctaatcttgtta

SEQ ID NO: 1997783 - DNA, 14 bp, Homo sapiens
gcttttgcttggca

SEQ ID NO: 1997784 - DNA, 15 bp, Homo sapiens
gcttttggtctgtgt

SEQ ID NO: 1997785 - DNA, 15 bp, Homo sapiens
gcttttgttgtgact

SEQ ID NO: 1997786 - DNA, 14 bp, Homo sapiens
ggaaaaaaatgact

SEQ ID NO: 1997787 - DNA, 12 bp, Homo sapiens
ggaaaaaaatta

SEQ ID NO: 1997788 - DNA, 15 bp, Homo sapiens
ggaaaacagaggaat

SEQ ID NO: 1997789 - DNA, 21 bp, Homo sapiens
ggaaaaccaagccgtggcttc

SEQ ID NO: 1997790 - DNA, 17 bp, Homo sapiens
ggaaaagaccagggctt

SEQ ID NO: 1997791 - DNA, 12 bp, Homo sapiens
ggaaaaggcctg

SEQ ID NO: 1997792 - DNA, 13 bp, Homo sapiens
ggaaaaggcctgg

SEQ ID NO: 1997793 - DNA, 14 bp, Homo sapiens
ggaaaaggcctggg

SEQ ID NO: 1997794 - DNA, 19 bp, Homo sapiens
ggaaaagggtcttcttggc

SEQ ID NO: 1997795 - DNA, 14 bp, Homo sapiens
ggaaaagtgcaatg

SEQ ID NO: 1997796 - DNA, 15 bp, Homo sapiens
ggaaaagtgttatta

SEQ ID NO: 1997797 - DNA, 15 bp, Homo sapiens
ggaaaatgcttctgt

SEQ ID NO: 1997798 - DNA, 12 bp, Homo sapiens
ggaaacagggca

SEQ ID NO: 1997799 - DNA, 16 bp, Homo sapiens
ggaaacccaaggaaca

SEQ ID NO: 1997800 - DNA, 14 bp, Homo sapiens
ggaaaccttgcagc

SEQ ID NO: 1997801 - DNA, 15 bp, Homo sapiens
ggaaaccttgcagca

SEQ ID NO: 1997802 - DNA, 13 bp, Homo sapiens
ggaaactgccagc

SEQ ID NO: 1997803 - DNA, 11 bp, Homo sapiens
ggaaactggct

SEQ ID NO: 1997804 - DNA, 22 bp, Homo sapiens
ggaaagaaagcacctgttttta

SEQ ID NO: 1997805 - DNA, 21 bp, Homo sapiens
ggaaagcaccgcagcatgtgg

SEQ ID NO: 1997806 - DNA, 21 bp, Homo sapiens
ggaaagcaggtggcatctcta

SEQ ID NO: 1997807 - DNA, 15 bp, Homo sapiens
ggaaagcagtgtgtc

SEQ ID NO: 1997808 - DNA, 16 bp, Homo sapiens
ggaaagccctccccct

SEQ ID NO: 1997809 - DNA, 13 bp, Homo sapiens
ggaaaggacccac

SEQ ID NO: 1997810 - DNA, 19 bp, Homo sapiens
ggaaaggacccacccatct

SEQ ID NO: 1997811 - DNA, 12 bp, Homo sapiens
ggaaaggctcag

SEQ ID NO: 1997812 - DNA, 23 bp, Homo sapiens
ggaaaggctcagtctcaggagca

SEQ ID NO: 1997813 - DNA, 23 bp, Homo sapiens
ggaaaggtcattgtggctatctg

SEQ ID NO: 1997814 - DNA, 23 bp, Homo sapiens
ggaaaggtttcaagacttgatac

SEQ ID NO: 1997815 - DNA, 22 bp, Homo sapiens
ggaaagtccccgtcccccagaa

SEQ ID NO: 1997816 - DNA, 16 bp, Homo sapiens
ggaaagttcagccaga

SEQ ID NO: 1997817 - DNA, 23 bp, Homo sapiens
ggaaagttggaaccgtgtccagc

SEQ ID NO: 1997818 - DNA, 20 bp, Homo sapiens
ggaaataaaacctttcaaat

SEQ ID NO: 1997819 - DNA, 18 bp, Homo sapiens
ggaaataaacctggagat

SEQ ID NO: 1997820 - DNA, 17 bp, Homo sapiens
ggaaatcaaatatgcaa

SEQ ID NO: 1997821 - DNA, 13 bp, Homo sapiens
ggaaatcctgtta

SEQ ID NO: 1997822 - DNA, 19 bp, Homo sapiens
ggaaatctggattttcagc

SEQ ID NO: 1997823 - DNA, 22 bp, Homo sapiens
ggaaatgctattgttgtgggct

SEQ ID NO: 1997824 - DNA, 15 bp, Homo sapiens
ggaaatggagggtgg

SEQ ID NO: 1997825 - DNA, 16 bp, Homo sapiens
ggaaatggagggtggg

SEQ ID NO: 1997826 - DNA, 23 bp, Homo sapiens
ggaaattcaggtgaaaatgttca

SEQ ID NO: 1997827 - DNA, 16 bp, Homo sapiens
ggaaattctgctcaga

SEQ ID NO: 1997828 - DNA, 11 bp, Homo sapiens
ggaacagaagg

SEQ ID NO: 1997829 - DNA, 19 bp, Homo sapiens
ggaacagaaggatgaatga

SEQ ID NO: 1997830 - DNA, 20 bp, Homo sapiens
ggaacagacaacagaagtca

SEQ ID NO: 1997831 - DNA, 19 bp, Homo sapiens
ggaacagactggaagcaca

SEQ ID NO: 1997832 - DNA, 17 bp, Homo sapiens
ggaacagagactctgga

SEQ ID NO: 1997833 - DNA, 17 bp, Homo sapiens
ggaacagagcgggcctc

SEQ ID NO: 1997834 - DNA, 23 bp, Homo sapiens
ggaacagagcgggcctcttccct

SEQ ID NO: 1997835 - DNA, 22 bp, Homo sapiens
ggaacagctcttcactcagcca

SEQ ID NO: 1997836 - DNA, 23 bp, Homo sapiens
ggaacatgtcggagtagaaattg

SEQ ID NO: 1997837 - DNA, 17 bp, Homo sapiens
ggaaccagggagaccga

SEQ ID NO: 1997838 - DNA, 16 bp, Homo sapiens
ggaaccagggaggaga

SEQ ID NO: 1997839 - DNA, 19 bp, Homo sapiens
ggaaccagggaggagagga

SEQ ID NO: 1997840 - DNA, 17 bp, Homo sapiens
ggaacccagccctgggg

SEQ ID NO: 1997841 - DNA, 13 bp, Homo sapiens
ggaaccctcccca

SEQ ID NO: 1997842 - DNA, 18 bp, Homo sapiens
ggaaccgtgtccagcaca

SEQ ID NO: 1997843 - DNA, 20 bp, Homo sapiens
ggaacctaattgaaatttaa

SEQ ID NO: 1997844 - DNA, 13 bp, Homo sapiens
ggaacctcaaact

SEQ ID NO: 1997845 - DNA, 23 bp, Homo sapiens
ggaaccttaacctctctaagcca

SEQ ID NO: 1997846 - DNA, 16 bp, Homo sapiens
ggaaccttccctccaa

SEQ ID NO: 1997847 - DNA, 21 bp, Homo sapiens
ggaacgagcactggccagaga

SEQ ID NO: 1997848 - DNA, 22 bp, Homo sapiens
ggaacgagcactggccagagag

SEQ ID NO: 1997849 - DNA, 16 bp, Homo sapiens
ggaacgcagaggcgga

SEQ ID NO: 1997850 - DNA, 16 bp, Homo sapiens
ggaacgtgactgcccc

SEQ ID NO: 1997851 - DNA, 17 bp, Homo sapiens
ggaacgtgactgcccca

SEQ ID NO: 1997852 - DNA, 18 bp, Homo sapiens
ggaactctaccctggtag

SEQ ID NO: 1997853 - DNA, 13 bp, Homo sapiens
ggaactctgacaa

SEQ ID NO: 1997854 - DNA, 14 bp, Homo sapiens
ggaactctgacaag

SEQ ID NO: 1997855 - DNA, 16 bp, Homo sapiens
ggaactctgacaaggg

SEQ ID NO: 1997856 - DNA, 20 bp, Homo sapiens
ggaactctggcttccaggta

SEQ ID NO: 1997857 - DNA, 22 bp, Homo sapiens
ggaactgcagtatggccatggg

SEQ ID NO: 1997858 - DNA, 23 bp, Homo sapiens
ggaactgcatatcggaggtggtg

SEQ ID NO: 1997859 - DNA, 16 bp, Homo sapiens
ggaactggccaagctg

SEQ ID NO: 1997860 - DNA, 22 bp, Homo sapiens
ggaactggccaagctgaggtgc

SEQ ID NO: 1997861 - DNA, 15 bp, Homo sapiens
ggaactggttcaaga

SEQ ID NO: 1997862 - DNA, 18 bp, Homo sapiens
ggaagaaacactcttatt

SEQ ID NO: 1997863 - DNA, 16 bp, Homo sapiens
ggaagaaagagaagga

SEQ ID NO: 1997864 - DNA, 19 bp, Homo sapiens
ggaagaaattcctgtagca

SEQ ID NO: 1997865 - DNA, 23 bp, Homo sapiens
ggaagaaattcctgtagcatctt

SEQ ID NO: 1997866 - DNA, 22 bp, Homo sapiens
ggaagaagagatcaggaagaga

SEQ ID NO: 1997867 - DNA, 18 bp, Homo sapiens
ggaagacgcaagggcctg

SEQ ID NO: 1997868 - DNA, 12 bp, Homo sapiens
ggaagagaaatc

SEQ ID NO: 1997869 - DNA, 13 bp, Homo sapiens
ggaagagaaggga

SEQ ID NO: 1997870 - DNA, 12 bp, Homo sapiens
ggaagagagaga

SEQ ID NO: 1997871 - DNA, 19 bp, Homo sapiens
ggaagagcagaacggagcc

SEQ ID NO: 1997872 - DNA, 12 bp, Homo sapiens
ggaagagcagcc

SEQ ID NO: 1997873 - DNA, 19 bp, Homo sapiens
ggaagagcagcctgatggc

SEQ ID NO: 1997874 - DNA, 23 bp, Homo sapiens
ggaagagtgtgcttgtcatctgc

SEQ ID NO: 1997875 - DNA, 14 bp, Homo sapiens
ggaagatgaagaga

SEQ ID NO: 1997876 - DNA, 18 bp, Homo sapiens
ggaagatgaagagaagct

SEQ ID NO: 1997877 - DNA, 14 bp, Homo sapiens
ggaagatggtagca

SEQ ID NO: 1997878 - DNA, 19 bp, Homo sapiens
ggaagcaaaattataagaa

SEQ ID NO: 1997879 - DNA, 20 bp, Homo sapiens
ggaagcaagacgtcctggaa

SEQ ID NO: 1997880 - DNA, 11 bp, Homo sapiens
ggaagcaggga

SEQ ID NO: 1997881 - DNA, 17 bp, Homo sapiens
ggaagcagggacacccc

SEQ ID NO: 1997882 - DNA, 11 bp, Homo sapiens
ggaagcagtgc

SEQ ID NO: 1997883 - DNA, 19 bp, Homo sapiens
ggaagcagtgccttccata

SEQ ID NO: 1997884 - DNA, 18 bp, Homo sapiens
ggaagccaggctgagtga

SEQ ID NO: 1997885 - DNA, 20 bp, Homo sapiens
ggaagccatattcacacctc

SEQ ID NO: 1997886 - DNA, 11 bp, Homo sapiens
ggaagcccccc

SEQ ID NO: 1997887 - DNA, 23 bp, Homo sapiens
ggaagccccccacctttctcgct

SEQ ID NO: 1997888 - DNA, 11 bp, Homo sapiens
ggaagccctcc

SEQ ID NO: 1997889 - DNA, 11 bp, Homo sapiens
ggaagccctgg

SEQ ID NO: 1997890 - DNA, 15 bp, Homo sapiens
ggaagccctggattt

SEQ ID NO: 1997891 - DNA, 20 bp, Homo sapiens
ggaagccgtctgactccaga

SEQ ID NO: 1997892 - DNA, 20 bp, Homo sapiens
ggaagcctggactctaagct

SEQ ID NO: 1997893 - DNA, 17 bp, Homo sapiens
ggaagcgaaatattaca

SEQ ID NO: 1997894 - DNA, 14 bp, Homo sapiens
ggaagctccactgt

SEQ ID NO: 1997895 - DNA, 14 bp, Homo sapiens
ggaagctgagcagg

SEQ ID NO: 1997896 - DNA, 17 bp, Homo sapiens
ggaagctggcagcactc

SEQ ID NO: 1997897 - DNA, 21 bp, Homo sapiens
ggaagctgtactcagagcaga

SEQ ID NO: 1997898 - DNA, 23 bp, Homo sapiens
ggaagctgtgtccttgcacctgc

SEQ ID NO: 1997899 - DNA, 19 bp, Homo sapiens
ggaaggaaagaaagaagga

SEQ ID NO: 1997900 - DNA, 17 bp, Homo sapiens
ggaaggaactctggctt

SEQ ID NO: 1997901 - DNA, 18 bp, Homo sapiens
ggaaggaactctggcttc

SEQ ID NO: 1997902 - DNA, 15 bp, Homo sapiens
ggaaggagactcacc

SEQ ID NO: 1997903 - DNA, 13 bp, Homo sapiens
ggaaggagtgaga

SEQ ID NO: 1997904 - DNA, 21 bp, Homo sapiens
ggaaggcaaagcccctggaaa

SEQ ID NO: 1997905 - DNA, 23 bp, Homo sapiens
ggaaggcaaagcccctggaaatg

SEQ ID NO: 1997906 - DNA, 16 bp, Homo sapiens
ggaaggcagctgctct

SEQ ID NO: 1997907 - DNA, 16 bp, Homo sapiens
ggaaggcaggcagggc

SEQ ID NO: 1997908 - DNA, 13 bp, Homo sapiens
ggaaggcagggac

SEQ ID NO: 1997909 - DNA, 17 bp, Homo sapiens
ggaaggcagggaggagg

SEQ ID NO: 1997910 - DNA, 14 bp, Homo sapiens
ggaaggccttttca

SEQ ID NO: 1997911 - DNA, 19 bp, Homo sapiens
ggaaggctacttcggggct

SEQ ID NO: 1997912 - DNA, 20 bp, Homo sapiens
ggaaggctacttcggggctg

SEQ ID NO: 1997913 - DNA, 14 bp, Homo sapiens
ggaaggctgctgtg

SEQ ID NO: 1997914 - DNA, 15 bp, Homo sapiens
ggaaggctggctgag

SEQ ID NO: 1997915 - DNA, 18 bp, Homo sapiens
ggaagggaaagccagaag

SEQ ID NO: 1997916 - DNA, 19 bp, Homo sapiens
ggaagggccaggagagaga

SEQ ID NO: 1997917 - DNA, 22 bp, Homo sapiens
ggaagggccaggagagagatct

SEQ ID NO: 1997918 - DNA, 12 bp, Homo sapiens
ggaagggccagt

SEQ ID NO: 1997919 - DNA, 21 bp, Homo sapiens
ggaagggccagtctgggctgc

SEQ ID NO: 1997920 - DNA, 15 bp, Homo sapiens
ggaagggggtgtgcg

SEQ ID NO: 1997921 - DNA, 22 bp, Homo sapiens
ggaagggttggtgggctggccc

SEQ ID NO: 1997922 - DNA, 15 bp, Homo sapiens
ggaaggtagcccagc

SEQ ID NO: 1997923 - DNA, 22 bp, Homo sapiens
ggaaggtagcccagcactgtga

SEQ ID NO: 1997924 - DNA, 19 bp, Homo sapiens
ggaaggtcccttgtttcca

SEQ ID NO: 1997925 - DNA, 15 bp, Homo sapiens
ggaaggtgctgagct

SEQ ID NO: 1997926 - DNA, 12 bp, Homo sapiens
ggaagtatgtgt

SEQ ID NO: 1997927 - DNA, 14 bp, Homo sapiens
ggaagtatgtgtgg

SEQ ID NO: 1997928 - DNA, 21 bp, Homo sapiens
ggaagtcgtccttactcctgt

SEQ ID NO: 1997929 - DNA, 14 bp, Homo sapiens
ggaagtgaagcccc

SEQ ID NO: 1997930 - DNA, 22 bp, Homo sapiens
ggaagtggctgagtcaggactt

SEQ ID NO: 1997931 - DNA, 12 bp, Homo sapiens
ggaagtgttcaa

SEQ ID NO: 1997932 - DNA, 22 bp, Homo sapiens
ggaagtgttcaagaaataaaaa

SEQ ID NO: 1997933 - DNA, 17 bp, Homo sapiens
ggaataagaagcaaata

SEQ ID NO: 1997934 - DNA, 20 bp, Homo sapiens
ggaataaggccttaatatgt

SEQ ID NO: 1997935 - DNA, 13 bp, Homo sapiens
ggaataataccta

SEQ ID NO: 1997936 - DNA, 13 bp, Homo sapiens
ggaataattattt

SEQ ID NO: 1997937 - DNA, 21 bp, Homo sapiens
ggaatagcccgaggaccgggc

SEQ ID NO: 1997938 - DNA, 18 bp, Homo sapiens
ggaatatgactgttttta

SEQ ID NO: 1997939 - DNA, 23 bp, Homo sapiens
ggaatatgttcaatgcaaagtaa

SEQ ID NO: 1997940 - DNA, 16 bp, Homo sapiens
ggaatcaatttcccag

SEQ ID NO: 1997941 - DNA, 13 bp, Homo sapiens
ggaatcacctgga

SEQ ID NO: 1997942 - DNA, 15 bp, Homo sapiens
ggaatcacctggagg

SEQ ID NO: 1997943 - DNA, 18 bp, Homo sapiens
ggaatcatgtcaggcctg

SEQ ID NO: 1997944 - DNA, 16 bp, Homo sapiens
ggaatctacctgtggt

SEQ ID NO: 1997945 - DNA, 21 bp, Homo sapiens
ggaatggaaaaagcagaaggc

SEQ ID NO: 1997946 - DNA, 19 bp, Homo sapiens
ggaatggaaggctttgcca

SEQ ID NO: 1997947 - DNA, 17 bp, Homo sapiens
ggaatggatggggagaa

SEQ ID NO: 1997948 - DNA, 15 bp, Homo sapiens
ggaatggcacagccc

SEQ ID NO: 1997949 - DNA, 16 bp, Homo sapiens
ggaatgttaaagtcag

SEQ ID NO: 1997950 - DNA, 18 bp, Homo sapiens
ggaatgttccctgcaccc

SEQ ID NO: 1997951 - DNA, 19 bp, Homo sapiens
ggaatgtttgcctctgcct

SEQ ID NO: 1997952 - DNA, 19 bp, Homo sapiens
ggaatgtttgggcagaagg

SEQ ID NO: 1997953 - DNA, 21 bp, Homo sapiens
ggaatgtttgggcagaaggga

SEQ ID NO: 1997954 - DNA, 15 bp, Homo sapiens
ggaattcagcaccct

SEQ ID NO: 1997955 - DNA, 20 bp, Homo sapiens
ggaattctttacaataaaca

SEQ ID NO: 1997956 - DNA, 13 bp, Homo sapiens
ggaatttaattca

SEQ ID NO: 1997957 - DNA, 17 bp, Homo sapiens
ggaatttaggataaaga

SEQ ID NO: 1997958 - DNA, 12 bp, Homo sapiens
ggaatttgtaag

SEQ ID NO: 1997959 - DNA, 14 bp, Homo sapiens
ggacaacctgcccc

SEQ ID NO: 1997960 - DNA, 15 bp, Homo sapiens
ggacaagaagctgct

SEQ ID NO: 1997961 - DNA, 17 bp, Homo sapiens
ggacaaggaagtggggg

SEQ ID NO: 1997962 - DNA, 23 bp, Homo sapiens
ggacaagggggaggaaaggggcg

SEQ ID NO: 1997963 - DNA, 12 bp, Homo sapiens
ggacacactgta

SEQ ID NO: 1997964 - DNA, 21 bp, Homo sapiens
ggacacactgtaaacccctgg

SEQ ID NO: 1997965 - DNA, 12 bp, Homo sapiens
ggacacagctct

SEQ ID NO: 1997966 - DNA, 14 bp, Homo sapiens
ggacacagctcttc

SEQ ID NO: 1997967 - DNA, 15 bp, Homo sapiens
ggacacagctcttct

SEQ ID NO: 1997968 - DNA, 21 bp, Homo sapiens
ggacacagctcttctccaggc

SEQ ID NO: 1997969 - DNA, 12 bp, Homo sapiens
ggacacagtgtt

SEQ ID NO: 1997970 - DNA, 15 bp, Homo sapiens
ggacacatcccggcc

SEQ ID NO: 1997971 - DNA, 20 bp, Homo sapiens
ggacacatcccggcctcttc

SEQ ID NO: 1997972 - DNA, 12 bp, Homo sapiens
ggacacatgtcc

SEQ ID NO: 1997973 - DNA, 19 bp, Homo sapiens
ggacacatgtccagtggga

SEQ ID NO: 1997974 - DNA, 22 bp, Homo sapiens
ggacaccccccgccccccacct

SEQ ID NO: 1997975 - DNA, 22 bp, Homo sapiens
ggagtggacattcaaaaacctg

SEQ ID NO: 1997976 - DNA, 17 bp, Homo sapiens
ggagtgtgggtgatcag

SEQ ID NO: 1997977 - DNA, 22 bp, Homo sapiens
ggagttacattaatgttaattc

SEQ ID NO: 1997978 - DNA, 22 bp, Homo sapiens
ggagttccctgaacatctgtgt

SEQ ID NO: 1997979 - DNA, 20 bp, Homo sapiens
ggagttcgaggctgcagtca

SEQ ID NO: 1997980 - DNA, 19 bp, Homo sapiens
ggagttgagtacagtgagg

SEQ ID NO: 1997981 - DNA, 13 bp, Homo sapiens
ggagttgagtcac

SEQ ID NO: 1997982 - DNA, 19 bp, Homo sapiens
ggagttgagtcacaagagg

SEQ ID NO: 1997983 - DNA, 21 bp, Homo sapiens
ggagtttgagacaagccctgg

SEQ ID NO: 1997984 - DNA, 13 bp, Homo sapiens
ggagtttgaggct

SEQ ID NO: 1997985 - DNA, 15 bp, Homo sapiens
ggataaaatgaggtt

SEQ ID NO: 1997986 - DNA, 22 bp, Homo sapiens
ggataacaaaatcacaagcaat

SEQ ID NO: 1997987 - DNA, 23 bp, Homo sapiens
ggataacaaaatcacaagcaata

SEQ ID NO: 1997988 - DNA, 17 bp, Homo sapiens
ggataacagaggcagga

SEQ ID NO: 1997989 - DNA, 18 bp, Homo sapiens
ggatacttatatggaaat

SEQ ID NO: 1997990 - DNA, 23 bp, Homo sapiens
ggatcaagaaggggacagcgcca

SEQ ID NO: 1997991 - DNA, 19 bp, Homo sapiens
ggatcactggagcccagga

SEQ ID NO: 1997992 - DNA, 16 bp, Homo sapiens
ggatcagaacaggagc

SEQ ID NO: 1997993 - DNA, 11 bp, Homo sapiens
ggatcagcctc

SEQ ID NO: 1997994 - DNA, 12 bp, Homo sapiens
ggatcagcctcc

SEQ ID NO: 1997995 - DNA, 15 bp, Homo sapiens
ggatcagcgtggcct

SEQ ID NO: 1997996 - DNA, 16 bp, Homo sapiens
ggatcagcgtggcctt

SEQ ID NO: 1997997 - DNA, 17 bp, Homo sapiens
ggatcagcgtggccttg

SEQ ID NO: 1997998 - DNA, 20 bp, Homo sapiens
ggatcagtatgggaacccca

SEQ ID NO: 1997999 - DNA, 21 bp, Homo sapiens
ggatcagtctgattcccaagc

SEQ ID NO: 1998000 - DNA, 15 bp, Homo sapiens
ggatccacacctggt

SEQ ID NO: 1998001 - DNA, 14 bp, Homo sapiens
ggatccgctgccac

SEQ ID NO: 1998002 - DNA, 15 bp, Homo sapiens
ggatccgctgccacc

SEQ ID NO: 1998003 - DNA, 14 bp, Homo sapiens
ggatcctgctgtgg

SEQ ID NO: 1998004 - DNA, 22 bp, Homo sapiens
ggatctagcttcatgcctcagt

SEQ ID NO: 1998005 - DNA, 18 bp, Homo sapiens
ggatctatgcaattttta

SEQ ID NO: 1998006 - DNA, 14 bp, Homo sapiens
ggatctccaaggac

SEQ ID NO: 1998007 - DNA, 15 bp, Homo sapiens
ggatgacatgtccct

SEQ ID NO: 1998008 - DNA, 20 bp, Homo sapiens
ggatgacatgtccctacacc

SEQ ID NO: 1998009 - DNA, 12 bp, Homo sapiens
ggatgagaaagg

SEQ ID NO: 1998010 - DNA, 22 bp, Homo sapiens
ggatgagaaaggttgaagcacc

SEQ ID NO: 1998011 - DNA, 15 bp, Homo sapiens
ggatgccacagcccc

SEQ ID NO: 1998012 - DNA, 20 bp, Homo sapiens
ggatgccacagccccacagc

SEQ ID NO: 1998013 - DNA, 17 bp, Homo sapiens
ggatgcctggtggcagc

SEQ ID NO: 1998014 - DNA, 13 bp, Homo sapiens
ggatgctccaggg

SEQ ID NO: 1998015 - DNA, 18 bp, Homo sapiens
ggatgctccagggcagcc

SEQ ID NO: 1998016 - DNA, 14 bp, Homo sapiens
ggatgctggggaga

SEQ ID NO: 1998017 - DNA, 14 bp, Homo sapiens
ggatggaagtgtct

SEQ ID NO: 1998018 - DNA, 21 bp, Homo sapiens
ggatggaccctcgcagcaggt

SEQ ID NO: 1998019 - DNA, 18 bp, Homo sapiens
ggatggagaggcggcctc

SEQ ID NO: 1998020 - DNA, 17 bp, Homo sapiens
ggatggaggagaaataa

SEQ ID NO: 1998021 - DNA, 14 bp, Homo sapiens
ggatggaggagaag

SEQ ID NO: 1998022 - DNA, 17 bp, Homo sapiens
ggatggatggacagaat

SEQ ID NO: 1998023 - DNA, 15 bp, Homo sapiens
ggatggcaccagagg

SEQ ID NO: 1998024 - DNA, 20 bp, Homo sapiens
ggatggcatctccatgtaga

SEQ ID NO: 1998025 - DNA, 12 bp, Homo sapiens
ggatgggaagat

SEQ ID NO: 1998026 - DNA, 19 bp, Homo sapiens
ggatgggatcccaggccag

SEQ ID NO: 1998027 - DNA, 17 bp, Homo sapiens
ggatgggcattgggctg

SEQ ID NO: 1998028 - DNA, 17 bp, Homo sapiens
ggatgggccagggttta

SEQ ID NO: 1998029 - DNA, 17 bp, Homo sapiens
ggatgggggatgggcca

SEQ ID NO: 1998030 - DNA, 14 bp, Homo sapiens
ggatggtcctgggg

SEQ ID NO: 1998031 - DNA, 17 bp, Homo sapiens
ggatggtttgagctcag

SEQ ID NO: 1998032 - DNA, 23 bp, Homo sapiens
ggatgtcccatctgctcctccca

SEQ ID NO: 1998033 - DNA, 16 bp, Homo sapiens
ggatgtcccctgtccc

SEQ ID NO: 1998034 - DNA, 17 bp, Homo sapiens
ggatgtcccctgtccca

SEQ ID NO: 1998035 - DNA, 19 bp, Homo sapiens
ggatgtccgttccaggagc

SEQ ID NO: 1998036 - DNA, 22 bp, Homo sapiens
ggatgtccgttccaggagcaca

SEQ ID NO: 1998037 - DNA, 13 bp, Homo sapiens
ggatgtggcactg

SEQ ID NO: 1998038 - DNA, 22 bp, Homo sapiens
ggatgtggggtccccatcatcc

SEQ ID NO: 1998039 - DNA, 15 bp, Homo sapiens
ggatgtgtaaatgga

SEQ ID NO: 1998040 - DNA, 12 bp, Homo sapiens
ggatgtgtttga

SEQ ID NO: 1998041 - DNA, 23 bp, Homo sapiens
ggatgttctagccctccctggca

SEQ ID NO: 1998042 - DNA, 23 bp, Homo sapiens
ggatgtttctgtcacatcagctc

SEQ ID NO: 1998043 - DNA, 18 bp, Homo sapiens
ggattaagatacactcct

SEQ ID NO: 1998044 - DNA, 19 bp, Homo sapiens
ggattaagatacactcctg

SEQ ID NO: 1998045 - DNA, 19 bp, Homo sapiens
ggattacaagcgtgagcca

SEQ ID NO: 1998046 - DNA, 21 bp, Homo sapiens
ggattattcatttaaaatgat

SEQ ID NO: 1998047 - DNA, 22 bp, Homo sapiens
ggattattcatttaaaatgatt

SEQ ID NO: 1998048 - DNA, 17 bp, Homo sapiens
ggattgcagtccccagt

SEQ ID NO: 1998049 - DNA, 16 bp, Homo sapiens
ggattgctatgaatga

SEQ ID NO: 1998050 - DNA, 16 bp, Homo sapiens
ggattgggagggacag

SEQ ID NO: 1998051 - DNA, 20 bp, Homo sapiens
ggattgggagggacagggct

SEQ ID NO: 1998052 - DNA, 21 bp, Homo sapiens
ggattgggagggacagggctt

SEQ ID NO: 1998053 - DNA, 15 bp, Homo sapiens
ggattgttgacatga

SEQ ID NO: 1998054 - DNA, 19 bp, Homo sapiens
ggatttatatctatagtag

SEQ ID NO: 1998055 - DNA, 18 bp, Homo sapiens
ggatttcctattttaaaa

SEQ ID NO: 1998056 - DNA, 19 bp, Homo sapiens
ggatttcctattttaaaac

SEQ ID NO: 1998057 - DNA, 13 bp, Homo sapiens
ggatttgttcaca

SEQ ID NO: 1998058 - DNA, 20 bp, Homo sapiens
ggattttaaaaacatgagaa

SEQ ID NO: 1998059 - DNA, 22 bp, Homo sapiens
ggattttaaaaacatgagaaat

SEQ ID NO: 1998060 - DNA, 23 bp, Homo sapiens
ggattttaaaaacatgagaaatg

SEQ ID NO: 1998061 - DNA, 17 bp, Homo sapiens
ggattttgtgttttttc

SEQ ID NO: 1998062 - DNA, 15 bp, Homo sapiens
ggcaaaaaaattaaa

SEQ ID NO: 1998063 - DNA, 19 bp, Homo sapiens
ggcaaaccatttcaaatgg

SEQ ID NO: 1998064 - DNA, 23 bp, Homo sapiens
ggcaaagaactgccccatctcct

SEQ ID NO: 1998065 - DNA, 16 bp, Homo sapiens
ggcaaagcccctggaa

SEQ ID NO: 1998066 - DNA, 20 bp, Homo sapiens
ggcaaaggtggctctccagt

SEQ ID NO: 1998067 - DNA, 16 bp, Homo sapiens
ggcaaatatcttgaaa

SEQ ID NO: 1998068 - DNA, 21 bp, Homo sapiens
ggcaaatgacatgcactgacc

SEQ ID NO: 1998069 - DNA, 20 bp, Homo sapiens
ggcaacacctccttgctttg

SEQ ID NO: 1998070 - DNA, 12 bp, Homo sapiens
ggcaacagagca

SEQ ID NO: 1998071 - DNA, 20 bp, Homo sapiens
ggcaacagagcaagactccg

SEQ ID NO: 1998072 - DNA, 21 bp, Homo sapiens
ggcaaccccagttctgctcct

SEQ ID NO: 1998073 - DNA, 23 bp, Homo sapiens
ggcaaccccagttctgctcctct

SEQ ID NO: 1998074 - DNA, 16 bp, Homo sapiens
ggcaacccccagcctg

SEQ ID NO: 1998075 - DNA, 17 bp, Homo sapiens
ggcaacccccagcctgc

SEQ ID NO: 1998076 - DNA, 14 bp, Homo sapiens
ggcaactgaggcag

SEQ ID NO: 1998077 - DNA, 18 bp, Homo sapiens
ggcaagagtgagactccg

SEQ ID NO: 1998078 - DNA, 17 bp, Homo sapiens
ggcaagcacctcctgcc

SEQ ID NO: 1998079 - DNA, 13 bp, Homo sapiens
ggcaagcagggaa

SEQ ID NO: 1998080 - DNA, 22 bp, Homo sapiens
ggcaagtcgagagggctgttgg

SEQ ID NO: 1998081 - DNA, 18 bp, Homo sapiens
ggcaagttttgaagcctg

SEQ ID NO: 1998082 - DNA, 17 bp, Homo sapiens
ggcaataaatgccctct

SEQ ID NO: 1998083 - DNA, 12 bp, Homo sapiens
ggcaatatttgt

SEQ ID NO: 1998084 - DNA, 15 bp, Homo sapiens
ggcaatgatggcaat

SEQ ID NO: 1998085 - DNA, 23 bp, Homo sapiens
ggcaatgctggctgttggctggg

SEQ ID NO: 1998086 - DNA, 24 bp, Homo sapiens
ggcacaactgtctaatgacacggt

SEQ ID NO: 1998087 - DNA, 16 bp, Homo sapiens
ggcacacagcagcccc

SEQ ID NO: 1998088 - DNA, 18 bp, Homo sapiens
ggcacacagcagcccccc

SEQ ID NO: 1998089 - DNA, 18 bp, Homo sapiens
ggcgacccctcagtgctc

SEQ ID NO: 1998090 - DNA, 18 bp, Homo sapiens
ggcgacttcctctccagc

SEQ ID NO: 1998091 - DNA, 19 bp, Homo sapiens
ggcgataaaactaaatata

SEQ ID NO: 1998092 - DNA, 18 bp, Homo sapiens
ggcgatcaagtccagagc

SEQ ID NO: 1998093 - DNA, 19 bp, Homo sapiens
ggcgatcaagtccagagcc

SEQ ID NO: 1998094 - DNA, 22 bp, Homo sapiens
ggcgcaagcctgtaatcccagc

SEQ ID NO: 1998095 - DNA, 16 bp, Homo sapiens
ggcgcagcccgaagcc

SEQ ID NO: 1998096 - DNA, 19 bp, Homo sapiens
ggcgcagcccgaagcccag

SEQ ID NO: 1998097 - DNA, 21 bp, Homo sapiens
ggcgcagtggctcacgcctgt

SEQ ID NO: 1998098 - DNA, 18 bp, Homo sapiens
ggcgccccaacccgtgga

SEQ ID NO: 1998099 - DNA, 20 bp, Homo sapiens
ggcgcctgtagtcccagcca

SEQ ID NO: 1998100 - DNA, 15 bp, Homo sapiens
ggcgcgggaggcacc

SEQ ID NO: 1998101 - DNA, 19 bp, Homo sapiens
ggcgcggtggctcacgcct

SEQ ID NO: 1998102 - DNA, 14 bp, Homo sapiens
ggcgcgtctgcccc

SEQ ID NO: 1998103 - DNA, 20 bp, Homo sapiens
ggcgcgtctgccccaccctc

SEQ ID NO: 1998104 - DNA, 13 bp, Homo sapiens
ggcgctctgccct

SEQ ID NO: 1998105 - DNA, 18 bp, Homo sapiens
ggcgctctgccctccctg

SEQ ID NO: 1998106 - DNA, 19 bp, Homo sapiens
ggcgctgtggctcctgcct

SEQ ID NO: 1998107 - DNA, 20 bp, Homo sapiens
ggcgctgtggctcctgcctt

SEQ ID NO: 1998108 - DNA, 17 bp, Homo sapiens
ggcggaaaccttgcagc

SEQ ID NO: 1998109 - DNA, 19 bp, Homo sapiens
ggcggagagtacagtgagc

SEQ ID NO: 1998110 - DNA, 19 bp, Homo sapiens
ggcggaggttgcagtgagc

SEQ ID NO: 1998111 - DNA, 21 bp, Homo sapiens
ggcggaggttgcagtgagccg

SEQ ID NO: 1998112 - DNA, 21 bp, Homo sapiens
ggcggcacgccaacagccccc

SEQ ID NO: 1998113 - DNA, 22 bp, Homo sapiens
ggcggcctatgacttgggcacc

SEQ ID NO: 1998114 - DNA, 13 bp, Homo sapiens
ggcggcggccctc

SEQ ID NO: 1998115 - DNA, 21 bp, Homo sapiens
ggcggctactcagcagccctc

SEQ ID NO: 1998116 - DNA, 23 bp, Homo sapiens
ggcggctactcagcagccctcct

SEQ ID NO: 1998117 - DNA, 15 bp, Homo sapiens
ggcggctccaggtcc

SEQ ID NO: 1998118 - DNA, 16 bp, Homo sapiens
ggcgggagcatctctt

SEQ ID NO: 1998119 - DNA, 14 bp, Homo sapiens
ggcggggcaggagg

SEQ ID NO: 1998120 - DNA, 16 bp, Homo sapiens
ggcggggcaggaggcc

SEQ ID NO: 1998121 - DNA, 14 bp, Homo sapiens
ggcggggctatgcc

SEQ ID NO: 1998122 - DNA, 20 bp, Homo sapiens
ggcgggggcccgaaagctga

SEQ ID NO: 1998123 - DNA, 16 bp, Homo sapiens
ggcgtaatgggcctgc

SEQ ID NO: 1998124 - DNA, 17 bp, Homo sapiens
ggcgtaatgggcctgcc

SEQ ID NO: 1998125 - DNA, 19 bp, Homo sapiens
ggcgtaatgggcctgccca

SEQ ID NO: 1998126 - DNA, 17 bp, Homo sapiens
ggcgtgcaaggggctca

SEQ ID NO: 1998127 - DNA, 19 bp, Homo sapiens
ggcgtgcagtggtgcgatc

SEQ ID NO: 1998128 - DNA, 15 bp, Homo sapiens
ggcgtgctacctgca

SEQ ID NO: 1998129 - DNA, 18 bp, Homo sapiens
ggcgttctgctgcccctg

SEQ ID NO: 1998130 - DNA, 17 bp, Homo sapiens
ggcgttggtgccacttc

SEQ ID NO: 1998131 - DNA, 11 bp, Homo sapiens
ggctaaatgaa

SEQ ID NO: 1998132 - DNA, 14 bp, Homo sapiens
ggctaactctggca

SEQ ID NO: 1998133 - DNA, 22 bp, Homo sapiens
ggctaagatgagatttgccagc

SEQ ID NO: 1998134 - DNA, 19 bp, Homo sapiens
ggctactctcctcggcccc

SEQ ID NO: 1998135 - DNA, 18 bp, Homo sapiens
ggctactctgtgccagag

SEQ ID NO: 1998136 - DNA, 19 bp, Homo sapiens
ggctactctgtgccagagc

SEQ ID NO: 1998137 - DNA, 24 bp, Homo sapiens
ggctactctgtgccagagcctggg

SEQ ID NO: 1998138 - DNA, 18 bp, Homo sapiens
ggctactgcagctttaca

SEQ ID NO: 1998139 - DNA, 14 bp, Homo sapiens
ggctactggcagct

SEQ ID NO: 1998140 - DNA, 21 bp, Homo sapiens
ggctagaacctagaagggcta

SEQ ID NO: 1998141 - DNA, 15 bp, Homo sapiens
ggctagaactggaga

SEQ ID NO: 1998142 - DNA, 20 bp, Homo sapiens
ggctagagtgcggtggcgcg

SEQ ID NO: 1998143 - DNA, 15 bp, Homo sapiens
ggctagtcagagaga

SEQ ID NO: 1998144 - DNA, 15 bp, Homo sapiens
ggctagtgtgagtgg

SEQ ID NO: 1998145 - DNA, 18 bp, Homo sapiens
ggctagtgtgagtggcag

SEQ ID NO: 1998146 - DNA, 18 bp, Homo sapiens
ggctatcctagagaggct

SEQ ID NO: 1998147 - DNA, 13 bp, Homo sapiens
ggctatttaaaag

SEQ ID NO: 1998148 - DNA, 22 bp, Homo sapiens
ggctatttaaaagtataaaact

SEQ ID NO: 1998149 - DNA, 18 bp, Homo sapiens
ggctatttgttcagagag

SEQ ID NO: 1998150 - DNA, 13 bp, Homo sapiens
ggctcaagaggcc

SEQ ID NO: 1998151 - DNA, 16 bp, Homo sapiens
ggctcaagaggcccag

SEQ ID NO: 1998152 - DNA, 17 bp, Homo sapiens
ggctcaagaggcccagg

SEQ ID NO: 1998153 - DNA, 19 bp, Homo sapiens
ggctcaagaggcccaggga

SEQ ID NO: 1998154 - DNA, 18 bp, Homo sapiens
ggctcaagcagtcctccc

SEQ ID NO: 1998155 - DNA, 15 bp, Homo sapiens
ggctcaagtcctctt

SEQ ID NO: 1998156 - DNA, 21 bp, Homo sapiens
ggctcaagtcctcttttctga

SEQ ID NO: 1998157 - DNA, 19 bp, Homo sapiens
ggctcacccaagcaaggcc

SEQ ID NO: 1998158 - DNA, 18 bp, Homo sapiens
ggctcaccttgtgctggg

SEQ ID NO: 1998159 - DNA, 20 bp, Homo sapiens
ggctcacgcctatgatccca

SEQ ID NO: 1998160 - DNA, 23 bp, Homo sapiens
ggctcacgcctgtaatcccagca

SEQ ID NO: 1998161 - DNA, 24 bp, Homo sapiens
ggctcacgcctgtaatcccagcag

SEQ ID NO: 1998162 - DNA, 15 bp, Homo sapiens
ggctcactgcagcct

SEQ ID NO: 1998163 - DNA, 10 bp, Homo sapiens
ggctcagcct

SEQ ID NO: 1998164 - DNA, 21 bp, Homo sapiens
ggctcaggaagaaaccccaag

SEQ ID NO: 1998165 - DNA, 17 bp, Homo sapiens
ggctcaggcagacaaga

SEQ ID NO: 1998166 - DNA, 17 bp, Homo sapiens
ggctcatatgcgtccca

SEQ ID NO: 1998167 - DNA, 22 bp, Homo sapiens
ggctccacctgttcaggagctg

SEQ ID NO: 1998168 - DNA, 19 bp, Homo sapiens
ggctccagcatccagcctg

SEQ ID NO: 1998169 - DNA, 16 bp, Homo sapiens
ggctccaggctccttt

SEQ ID NO: 1998170 - DNA, 17 bp, Homo sapiens
ggctccatggaggaggt

SEQ ID NO: 1998171 - DNA, 21 bp, Homo sapiens
ggctccccacgagtcacctgc

SEQ ID NO: 1998172 - DNA, 14 bp, Homo sapiens
ggctcctcacatag

SEQ ID NO: 1998173 - DNA, 20 bp, Homo sapiens
ggctcctccatctagagatt

SEQ ID NO: 1998174 - DNA, 13 bp, Homo sapiens
ggctcctgccact

SEQ ID NO: 1998175 - DNA, 17 bp, Homo sapiens
ggctcctgccactgacc

SEQ ID NO: 1998176 - DNA, 14 bp, Homo sapiens
ggctcctgccttga

SEQ ID NO: 1998177 - DNA, 16 bp, Homo sapiens
ggctcctggctgccag

SEQ ID NO: 1998178 - DNA, 17 bp, Homo sapiens
ggctcctggctgccagg

SEQ ID NO: 1998179 - DNA, 20 bp, Homo sapiens
ggctcctggctgccaggcgt

SEQ ID NO: 1998180 - DNA, 19 bp, Homo sapiens
ggctcctttctccagccag

SEQ ID NO: 1998181 - DNA, 21 bp, Homo sapiens
ggctcctttctccagccagca

SEQ ID NO: 1998182 - DNA, 16 bp, Homo sapiens
ggctcgggcgctgtgg

SEQ ID NO: 1998183 - DNA, 23 bp, Homo sapiens
ggctcgggcgctgtggctcctgc

SEQ ID NO: 1998184 - DNA, 14 bp, Homo sapiens
ggctctaacgcctg

SEQ ID NO: 1998185 - DNA, 18 bp, Homo sapiens
ggctctaacgcctgagcc

SEQ ID NO: 1998186 - DNA, 20 bp, Homo sapiens
ggctctccaaaggggctgct

SEQ ID NO: 1998187 - DNA, 17 bp, Homo sapiens
ggctctccacctcagcc

SEQ ID NO: 1998188 - DNA, 16 bp, Homo sapiens
ggctctcctggcttcc

SEQ ID NO: 1998189 - DNA, 17 bp, Homo sapiens
ggctctcctggcttccc

SEQ ID NO: 1998190 - DNA, 20 bp, Homo sapiens
ggctctgcaatgggcactgg

SEQ ID NO: 1998191 - DNA, 17 bp, Homo sapiens
ggctctggagccagaga

SEQ ID NO: 1998192 - DNA, 21 bp, Homo sapiens
ggctctggccaccctggcccg

SEQ ID NO: 1998193 - DNA, 17 bp, Homo sapiens
ggctctgggaaggggtg

SEQ ID NO: 1998194 - DNA, 16 bp, Homo sapiens
ggctctgtgaaatcag

SEQ ID NO: 1998195 - DNA, 14 bp, Homo sapiens
ggctcttcaaagac

SEQ ID NO: 1998196 - DNA, 14 bp, Homo sapiens
ggctcttcctggac

SEQ ID NO: 1998197 - DNA, 13 bp, Homo sapiens
ggctcttctcctt

SEQ ID NO: 1998198 - DNA, 20 bp, Homo sapiens
ggctcttctccttggaggac

SEQ ID NO: 1998199 - DNA, 14 bp, Homo sapiens
ggctcttctccttt

SEQ ID NO: 1998200 - DNA, 15 bp, Homo sapiens
ggctgaacggggaga

SEQ ID NO: 1998201 - DNA, 16 bp, Homo sapiens
ggctgacacctaccat

SEQ ID NO: 1998202 - DNA, 17 bp, Homo sapiens
ggctgacacctaccatg

SEQ ID NO: 1998203 - DNA, 15 bp, Homo sapiens
gggccccggggctgg

SEQ ID NO: 1998204 - DNA, 16 bp, Homo sapiens
gggccccggggctggc

SEQ ID NO: 1998205 - DNA, 19 bp, Homo sapiens
gggccccggggctggcaag

SEQ ID NO: 1998206 - DNA, 12 bp, Homo sapiens
gggcccctccac

SEQ ID NO: 1998207 - DNA, 17 bp, Homo sapiens
gggcccctccacgcctc

SEQ ID NO: 1998208 - DNA, 13 bp, Homo sapiens
gggcccctccctc

SEQ ID NO: 1998209 - DNA, 16 bp, Homo sapiens
gggcccctccctctgc

SEQ ID NO: 1998210 - DNA, 18 bp, Homo sapiens
gggcccctccctctgccc

SEQ ID NO: 1998211 - DNA, 14 bp, Homo sapiens
gggcccctgggatg

SEQ ID NO: 1998212 - DNA, 18 bp, Homo sapiens
gggccctgcacctgtgca

SEQ ID NO: 1998213 - DNA, 19 bp, Homo sapiens
gggccctgcacctgtgcag

SEQ ID NO: 1998214 - DNA, 11 bp, Homo sapiens
gggccctgggc

SEQ ID NO: 1998215 - DNA, 14 bp, Homo sapiens
gggccctgggcctc

SEQ ID NO: 1998216 - DNA, 15 bp, Homo sapiens
gggccctgggcctca

SEQ ID NO: 1998217 - DNA, 18 bp, Homo sapiens
gggccctgggcctcagtt

SEQ ID NO: 1998218 - DNA, 12 bp, Homo sapiens
gggccctggggc

SEQ ID NO: 1998219 - DNA, 14 bp, Homo sapiens
gggccctggggcct

SEQ ID NO: 1998220 - DNA, 15 bp, Homo sapiens
gggccctggggcctg

SEQ ID NO: 1998221 - DNA, 19 bp, Homo sapiens
gggccctggtccttccagg

SEQ ID NO: 1998222 - DNA, 21 bp, Homo sapiens
gggccgggcaggtcctgccca

SEQ ID NO: 1998223 - DNA, 23 bp, Homo sapiens
gggccgggcaggtcctgcccatg

SEQ ID NO: 1998224 - DNA, 20 bp, Homo sapiens
gggccggggaactggccaag

SEQ ID NO: 1998225 - DNA, 14 bp, Homo sapiens
gggccgtgcccagg

SEQ ID NO: 1998226 - DNA, 23 bp, Homo sapiens
gggcctagatccacacacagagg

SEQ ID NO: 1998227 - DNA, 18 bp, Homo sapiens
gggcctatggagagccct

SEQ ID NO: 1998228 - DNA, 18 bp, Homo sapiens
gggcctcagtttccccat

SEQ ID NO: 1998229 - DNA, 16 bp, Homo sapiens
gggcctccccccagcc

SEQ ID NO: 1998230 - DNA, 15 bp, Homo sapiens
gggcctcctgtgtgt

SEQ ID NO: 1998231 - DNA, 21 bp, Homo sapiens
gggcctctgaaatttcccaca

SEQ ID NO: 1998232 - DNA, 20 bp, Homo sapiens
gggcctgacaggttcccagc

SEQ ID NO: 1998233 - DNA, 23 bp, Homo sapiens
gggcctgacaggttcccagcagc

SEQ ID NO: 1998234 - DNA, 12 bp, Homo sapiens
gggcctgcccaa

SEQ ID NO: 1998235 - DNA, 13 bp, Homo sapiens
gggcctgctgctg

SEQ ID NO: 1998236 - DNA, 17 bp, Homo sapiens
gggcctgctgctgagaa

SEQ ID NO: 1998237 - DNA, 23 bp, Homo sapiens
gggcctgctgctgagaacctggc

SEQ ID NO: 1998238 - DNA, 13 bp, Homo sapiens
gggcctggagagg

SEQ ID NO: 1998239 - DNA, 22 bp, Homo sapiens
gggcctggcagccgtgccttca

SEQ ID NO: 1998240 - DNA, 13 bp, Homo sapiens
gggcctggcctga

SEQ ID NO: 1998241 - DNA, 22 bp, Homo sapiens
gggcctggcctgagctggggcc

SEQ ID NO: 1998242 - DNA, 17 bp, Homo sapiens
gggcctggctggctgag

SEQ ID NO: 1998243 - DNA, 21 bp, Homo sapiens
gggcctggctggctgagggca

SEQ ID NO: 1998244 - DNA, 22 bp, Homo sapiens
gggcctggctggctgagggcag

SEQ ID NO: 1998245 - DNA, 12 bp, Homo sapiens
gggcctgggcct

SEQ ID NO: 1998246 - DNA, 20 bp, Homo sapiens
gggcctgggggcagtgactg

SEQ ID NO: 1998247 - DNA, 17 bp, Homo sapiens
gggcctgtactgcctgc

SEQ ID NO: 1998248 - DNA, 20 bp, Homo sapiens
gggcctgtactgcctgcttg

SEQ ID NO: 1998249 - DNA, 16 bp, Homo sapiens
gggcctgtcccccaag

SEQ ID NO: 1998250 - DNA, 17 bp, Homo sapiens
gggcctgtgcagcagcc

SEQ ID NO: 1998251 - DNA, 21 bp, Homo sapiens
gggcctgtgcagcagcccagc

SEQ ID NO: 1998252 - DNA, 22 bp, Homo sapiens
gggccttgcccagagatgcctc

SEQ ID NO: 1998253 - DNA, 16 bp, Homo sapiens
gggccttttgtggatt

SEQ ID NO: 1998254 - DNA, 23 bp, Homo sapiens
gggcgcccattcgtctgtcccag

SEQ ID NO: 1998255 - DNA, 19 bp, Homo sapiens
gggcgctcaggacccaggc

SEQ ID NO: 1998256 - DNA, 21 bp, Homo sapiens
gggcgctcaggacccaggccc

SEQ ID NO: 1998257 - DNA, 22 bp, Homo sapiens
gggcgctctgccctccctggcc

SEQ ID NO: 1998258 - DNA, 23 bp, Homo sapiens
gggcgctctgccctccctggcct

SEQ ID NO: 1998259 - DNA, 14 bp, Homo sapiens
gggcgctgtggctc

SEQ ID NO: 1998260 - DNA, 18 bp, Homo sapiens
gggcgctgtggctcctgc

SEQ ID NO: 1998261 - DNA, 14 bp, Homo sapiens
gggcggaaggggac

SEQ ID NO: 1998262 - DNA, 13 bp, Homo sapiens
gggcggaggcggc

SEQ ID NO: 1998263 - DNA, 15 bp, Homo sapiens
gggcgggaggatgtt

SEQ ID NO: 1998264 - DNA, 12 bp, Homo sapiens
gggcggggcagg

SEQ ID NO: 1998265 - DNA, 14 bp, Homo sapiens
gggcgggggagcca

SEQ ID NO: 1998266 - DNA, 23 bp, Homo sapiens
gggcgtcgctggacaacccagaa

SEQ ID NO: 1998267 - DNA, 13 bp, Homo sapiens
gggctaaatgaag

SEQ ID NO: 1998268 - DNA, 20 bp, Homo sapiens
gggctactgcagctttacat

SEQ ID NO: 1998269 - DNA, 13 bp, Homo sapiens
gggctactggcag

SEQ ID NO: 1998270 - DNA, 14 bp, Homo sapiens
gggctactggcagc

SEQ ID NO: 1998271 - DNA, 17 bp, Homo sapiens
gggctagaacctggagg

SEQ ID NO: 1998272 - DNA, 22 bp, Homo sapiens
gggctaggggctggtccttctc

SEQ ID NO: 1998273 - DNA, 17 bp, Homo sapiens
gggctagtgtgagtggc

SEQ ID NO: 1998274 - DNA, 21 bp, Homo sapiens
gggctagtgtgagtggcagcc

SEQ ID NO: 1998275 - DNA, 22 bp, Homo sapiens
gggctagtgtgagtggcagcca

SEQ ID NO: 1998276 - DNA, 15 bp, Homo sapiens
gggctagttgggctt

SEQ ID NO: 1998277 - DNA, 15 bp, Homo sapiens
gggctatgccttgtc

SEQ ID NO: 1998278 - DNA, 14 bp, Homo sapiens
gggctatggcaagg

SEQ ID NO: 1998279 - DNA, 15 bp, Homo sapiens
gggctatggcaaggg

SEQ ID NO: 1998280 - DNA, 21 bp, Homo sapiens
gggctatgtgtcacagctctg

SEQ ID NO: 1998281 - DNA, 13 bp, Homo sapiens
gggctatttctct

SEQ ID NO: 1998282 - DNA, 17 bp, Homo sapiens
gggctatttctctcccc

SEQ ID NO: 1998283 - DNA, 18 bp, Homo sapiens
gggctcaagcagtcctcc

SEQ ID NO: 1998284 - DNA, 12 bp, Homo sapiens
gggctcagcctg

SEQ ID NO: 1998285 - DNA, 16 bp, Homo sapiens
gggctcagcctggtgg

SEQ ID NO: 1998286 - DNA, 22 bp, Homo sapiens
gggctccagcatccagcctgtg

SEQ ID NO: 1998287 - DNA, 18 bp, Homo sapiens
gggctccatggaggaggt

SEQ ID NO: 1998288 - DNA, 14 bp, Homo sapiens
gggctcctggaacc

SEQ ID NO: 1998289 - DNA, 15 bp, Homo sapiens
gggctcctggctgcc

SEQ ID NO: 1998290 - DNA, 20 bp, Homo sapiens
gggctcctttctccagccag

SEQ ID NO: 1998291 - DNA, 15 bp, Homo sapiens
gggctctaacgcctg

SEQ ID NO: 1998292 - DNA, 23 bp, Homo sapiens
gggctctaacgcctgagcccagg

SEQ ID NO: 1998293 - DNA, 13 bp, Homo sapiens
gggctctccacct

SEQ ID NO: 1998294 - DNA, 18 bp, Homo sapiens
gggctctccacctcagcc

SEQ ID NO: 1998295 - DNA, 12 bp, Homo sapiens
gggctctcctgg

SEQ ID NO: 1998296 - DNA, 13 bp, Homo sapiens
gggctctcctggc

SEQ ID NO: 1998297 - DNA, 23 bp, Homo sapiens
gggctctgccccagaggcctctc

SEQ ID NO: 1998298 - DNA, 17 bp, Homo sapiens
gggctctggccaccctg

SEQ ID NO: 1998299 - DNA, 15 bp, Homo sapiens
gggctgagccctggc

SEQ ID NO: 1998300 - DNA, 17 bp, Homo sapiens
gggctgagccctggcag

SEQ ID NO: 1998301 - DNA, 21 bp, Homo sapiens
gggctgcccctgtaggttgct

SEQ ID NO: 1998302 - DNA, 20 bp, Homo sapiens
gggctgcccttcgctgccag

SEQ ID NO: 1998303 - DNA, 22 bp, Homo sapiens
gggctgcccttcgctgccagga

SEQ ID NO: 1998304 - DNA, 14 bp, Homo sapiens
gggctgctcatcac

SEQ ID NO: 1998305 - DNA, 23 bp, Homo sapiens
gggctgctcatcacccagtcctg

SEQ ID NO: 1998306 - DNA, 14 bp, Homo sapiens
gggctgctggggca

SEQ ID NO: 1998307 - DNA, 16 bp, Homo sapiens
gggctgctggggcatg

SEQ ID NO: 1998308 - DNA, 23 bp, Homo sapiens
gggctggagtgcgctcttggtcc

SEQ ID NO: 1998309 - DNA, 16 bp, Homo sapiens
gggctggcaagcaggg

SEQ ID NO: 1998310 - DNA, 17 bp, Homo sapiens
gggctggcaagcaggga

SEQ ID NO: 1998311 - DNA, 11 bp, Homo sapiens
gggctggggtt

SEQ ID NO: 1998312 - DNA, 17 bp, Homo sapiens
gggctgttggacagctg

SEQ ID NO: 1998313 - DNA, 19 bp, Homo sapiens
gggctgttggacagctgct

SEQ ID NO: 1998314 - DNA, 16 bp, Homo sapiens
gggcttcagtggcagc

SEQ ID NO: 1998315 - DNA, 18 bp, Homo sapiens
gggcttcagtggcagctg

SEQ ID NO: 1998316 - DNA, 18 bp, Homo sapiens
gggcttcgcttccttagc

SEQ ID NO: 1998317 - DNA, 13 bp, Homo sapiens
gggcttggccttg

SEQ ID NO: 1998318 - DNA, 17 bp, Homo sapiens
ggtgagaggaagggtgg

SEQ ID NO: 1998319 - DNA, 16 bp, Homo sapiens
ggtgagaggggaacag

SEQ ID NO: 1998320 - DNA, 13 bp, Homo sapiens
ggtgaggcccagc

SEQ ID NO: 1998321 - DNA, 12 bp, Homo sapiens
ggtgataagtgg

SEQ ID NO: 1998322 - DNA, 16 bp, Homo sapiens
ggtgataagtggaaaa

SEQ ID NO: 1998323 - DNA, 15 bp, Homo sapiens
ggtgatcagaaggct

SEQ ID NO: 1998324 - DNA, 17 bp, Homo sapiens
ggtgatcagaaggctgg

SEQ ID NO: 1998325 - DNA, 18 bp, Homo sapiens
ggtgatccacccacctca

SEQ ID NO: 1998326 - DNA, 23 bp, Homo sapiens
ggtgatccacccacctcagcctc

SEQ ID NO: 1998327 - DNA, 24 bp, Homo sapiens
ggtgatccacccacctcagcctcc

SEQ ID NO: 1998328 - DNA, 15 bp, Homo sapiens
ggtgatttcagagag

SEQ ID NO: 1998329 - DNA, 15 bp, Homo sapiens
ggtgcaagagacaga

SEQ ID NO: 1998330 - DNA, 17 bp, Homo sapiens
ggtgcaagagacagagc

SEQ ID NO: 1998331 - DNA, 18 bp, Homo sapiens
ggtgcaagagacagagcc

SEQ ID NO: 1998332 - DNA, 15 bp, Homo sapiens
ggtgcacaggagggg

SEQ ID NO: 1998333 - DNA, 20 bp, Homo sapiens
ggtgcacttttctgtgtcat

SEQ ID NO: 1998334 - DNA, 16 bp, Homo sapiens
ggtgcagagctgaaga

SEQ ID NO: 1998335 - DNA, 22 bp, Homo sapiens
ggtgcagaggtgagcagaggag

SEQ ID NO: 1998336 - DNA, 16 bp, Homo sapiens
ggtgcagatgggctgt

SEQ ID NO: 1998337 - DNA, 18 bp, Homo sapiens
ggtgcagttgacagcagg

SEQ ID NO: 1998338 - DNA, 21 bp, Homo sapiens
ggtgcatttgagagaagccac

SEQ ID NO: 1998339 - DNA, 14 bp, Homo sapiens
ggtgccaccaataa

SEQ ID NO: 1998340 - DNA, 18 bp, Homo sapiens
ggtgccaccaataaaaat

SEQ ID NO: 1998341 - DNA, 19 bp, Homo sapiens
ggtgccactccctgagctt

SEQ ID NO: 1998342 - DNA, 15 bp, Homo sapiens
ggtgccattcccagc

SEQ ID NO: 1998343 - DNA, 13 bp, Homo sapiens
ggtgcccaggaga

SEQ ID NO: 1998344 - DNA, 22 bp, Homo sapiens
ggtgcctgagctggggcctgga

SEQ ID NO: 1998345 - DNA, 23 bp, Homo sapiens
ggtgcctgcctctgccatgccca

SEQ ID NO: 1998346 - DNA, 19 bp, Homo sapiens
ggtgcctgggtggggctgc

SEQ ID NO: 1998347 - DNA, 22 bp, Homo sapiens
ggtgcctgggtggggctgctcc

SEQ ID NO: 1998348 - DNA, 21 bp, Homo sapiens
ggtgcctgtgaggcaggggcg

SEQ ID NO: 1998349 - DNA, 21 bp, Homo sapiens
ggtgcgagagaggtgggcagc

SEQ ID NO: 1998350 - DNA, 23 bp, Homo sapiens
ggtgcgagagaggtgggcagcag

SEQ ID NO: 1998351 - DNA, 19 bp, Homo sapiens
ggtgcggcaggagcaggaa

SEQ ID NO: 1998352 - DNA, 12 bp, Homo sapiens
ggtgcgtggctg

SEQ ID NO: 1998353 - DNA, 17 bp, Homo sapiens
ggtgcgtggctgtggca

SEQ ID NO: 1998354 - DNA, 22 bp, Homo sapiens
ggtgctaaatggtcgcccagga

SEQ ID NO: 1998355 - DNA, 14 bp, Homo sapiens
ggtgctcgcttctc

SEQ ID NO: 1998356 - DNA, 10 bp, Homo sapiens
ggtgctctgg

SEQ ID NO: 1998357 - DNA, 14 bp, Homo sapiens
ggtgctctggcggc

SEQ ID NO: 1998358 - DNA, 20 bp, Homo sapiens
ggtgctctggcggcttcctg

SEQ ID NO: 1998359 - DNA, 20 bp, Homo sapiens
ggtgctgacaatactgctgc

SEQ ID NO: 1998360 - DNA, 12 bp, Homo sapiens
ggtgctgagctt

SEQ ID NO: 1998361 - DNA, 12 bp, Homo sapiens
ggtgctggagga

SEQ ID NO: 1998362 - DNA, 14 bp, Homo sapiens
ggtgctggatgctt

SEQ ID NO: 1998363 - DNA, 18 bp, Homo sapiens
ggtggaagccctccttcc

SEQ ID NO: 1998364 - DNA, 19 bp, Homo sapiens
ggtggaagccctccttcca

SEQ ID NO: 1998365 - DNA, 21 bp, Homo sapiens
ggtggaagggggtgtgcgtgc

SEQ ID NO: 1998366 - DNA, 14 bp, Homo sapiens
ggtggacagtcctg

SEQ ID NO: 1998367 - DNA, 12 bp, Homo sapiens
ggtggacccagg

SEQ ID NO: 1998368 - DNA, 22 bp, Homo sapiens
ggtggaggaaggtgctgagctt

SEQ ID NO: 1998369 - DNA, 22 bp, Homo sapiens
ggtggaggagctgggcttctgt

SEQ ID NO: 1998370 - DNA, 21 bp, Homo sapiens
ggtggaggttgcagtgagcca

SEQ ID NO: 1998371 - DNA, 21 bp, Homo sapiens
ggtggatgcctggtggcagct

SEQ ID NO: 1998372 - DNA, 13 bp, Homo sapiens
ggtggcacctcct

SEQ ID NO: 1998373 - DNA, 18 bp, Homo sapiens
ggtggcagccctgtaggg

SEQ ID NO: 1998374 - DNA, 12 bp, Homo sapiens
ggtggcagctgc

SEQ ID NO: 1998375 - DNA, 17 bp, Homo sapiens
ggtggcaggaccaggac

SEQ ID NO: 1998376 - DNA, 18 bp, Homo sapiens
ggtggcaggaccaggact

SEQ ID NO: 1998377 - DNA, 20 bp, Homo sapiens
ggtggcaggcacacagcagc

SEQ ID NO: 1998378 - DNA, 21 bp, Homo sapiens
ggtggcaggcacacagcagcc

SEQ ID NO: 1998379 - DNA, 21 bp, Homo sapiens
ggtggccactccagacccctg

SEQ ID NO: 1998380 - DNA, 23 bp, Homo sapiens
ggtggccactccagacccctggc

SEQ ID NO: 1998381 - DNA, 16 bp, Homo sapiens
ggtggccatccctggg

SEQ ID NO: 1998382 - DNA, 21 bp, Homo sapiens
ggtggccatccctgggcccct

SEQ ID NO: 1998383 - DNA, 22 bp, Homo sapiens
ggtggccatccctgggcccctc

SEQ ID NO: 1998384 - DNA, 23 bp, Homo sapiens
ggtggccatccctgggcccctcc

SEQ ID NO: 1998385 - DNA, 15 bp, Homo sapiens
ggtggccatgcttct

SEQ ID NO: 1998386 - DNA, 23 bp, Homo sapiens
ggtggccccctgtgccagctcag

SEQ ID NO: 1998387 - DNA, 16 bp, Homo sapiens
ggtggcccgacagcct

SEQ ID NO: 1998388 - DNA, 18 bp, Homo sapiens
ggtggcccgacagcctgg

SEQ ID NO: 1998389 - DNA, 19 bp, Homo sapiens
ggtggcccgacagcctggc

SEQ ID NO: 1998390 - DNA, 12 bp, Homo sapiens
ggtggcctcggg

SEQ ID NO: 1998391 - DNA, 14 bp, Homo sapiens
ggtggctactctgt

SEQ ID NO: 1998392 - DNA, 18 bp, Homo sapiens
ggtggctactctgtgcca

SEQ ID NO: 1998393 - DNA, 19 bp, Homo sapiens
ggtggctactctgtgccag

SEQ ID NO: 1998394 - DNA, 15 bp, Homo sapiens
ggtggctagtcagag

SEQ ID NO: 1998395 - DNA, 15 bp, Homo sapiens
ggtggctcctgccac

SEQ ID NO: 1998396 - DNA, 23 bp, Homo sapiens
ggtggctcctgccactgacctca

SEQ ID NO: 1998397 - DNA, 21 bp, Homo sapiens
ggtggctgacccagtccctgg

SEQ ID NO: 1998398 - DNA, 23 bp, Homo sapiens
ggtggctgacccagtccctgggg

SEQ ID NO: 1998399 - DNA, 16 bp, Homo sapiens
ggtgggacagccccag

SEQ ID NO: 1998400 - DNA, 19 bp, Homo sapiens
ggtgggacagccccagggc

SEQ ID NO: 1998401 - DNA, 16 bp, Homo sapiens
ggtgggatggaggaga

SEQ ID NO: 1998402 - DNA, 20 bp, Homo sapiens
ggtgggatggatgctgggga

SEQ ID NO: 1998403 - DNA, 16 bp, Homo sapiens
ggtgggcagcagctca

SEQ ID NO: 1998404 - DNA, 14 bp, Homo sapiens
ggtgggcagggctg

SEQ ID NO: 1998405 - DNA, 12 bp, Homo sapiens
ggtgggccactc

SEQ ID NO: 1998406 - DNA, 17 bp, Homo sapiens
ggtgggctgagccctgg

SEQ ID NO: 1998407 - DNA, 15 bp, Homo sapiens
ggtgggctggcccag

SEQ ID NO: 1998408 - DNA, 17 bp, Homo sapiens
ggtgggctggcccagcc

SEQ ID NO: 1998409 - DNA, 20 bp, Homo sapiens
ggtggggcaatggggagagg

SEQ ID NO: 1998410 - DNA, 10 bp, Homo sapiens
ggtggggcag

SEQ ID NO: 1998411 - DNA, 15 bp, Homo sapiens
ggtggggcagctcct

SEQ ID NO: 1998412 - DNA, 17 bp, Homo sapiens
ggtggggcagcttgagg

SEQ ID NO: 1998413 - DNA, 17 bp, Homo sapiens
ggtggggctgctcctcc

SEQ ID NO: 1998414 - DNA, 16 bp, Homo sapiens
ggtggtgacctctgcc

SEQ ID NO: 1998415 - DNA, 14 bp, Homo sapiens
ggtggtggatctgt

SEQ ID NO: 1998416 - DNA, 21 bp, Homo sapiens
ggtggtggatctgtccaagga

SEQ ID NO: 1998417 - DNA, 14 bp, Homo sapiens
ggtgtaaaaccatg

SEQ ID NO: 1998418 - DNA, 15 bp, Homo sapiens
ggtgtaaaaccatgt

SEQ ID NO: 1998419 - DNA, 18 bp, Homo sapiens
ggtgtagctcctctgctg

SEQ ID NO: 1998420 - DNA, 15 bp, Homo sapiens
ggtgtaggtaaatct

SEQ ID NO: 1998421 - DNA, 17 bp, Homo sapiens
ggtgtcaccctgcagag

SEQ ID NO: 1998422 - DNA, 19 bp, Homo sapiens
ggtgtcacctgaagactca

SEQ ID NO: 1998423 - DNA, 13 bp, Homo sapiens
ggtgtcaggcagg

SEQ ID NO: 1998424 - DNA, 12 bp, Homo sapiens
ggtgtccctgcg

SEQ ID NO: 1998425 - DNA, 18 bp, Homo sapiens
ggtgtgagtcaccaagcc

SEQ ID NO: 1998426 - DNA, 13 bp, Homo sapiens
ggtgtgccaggct

SEQ ID NO: 1998427 - DNA, 15 bp, Homo sapiens
ggtgtgcctgcagcc

SEQ ID NO: 1998428 - DNA, 17 bp, Homo sapiens
ggtgtggataaggctta

SEQ ID NO: 1998429 - DNA, 13 bp, Homo sapiens
ggtgtggcctcag

SEQ ID NO: 1998430 - DNA, 15 bp, Homo sapiens
ggtgtggtggctcat

SEQ ID NO: 1998431 - DNA, 22 bp, Homo sapiens
ggtgttgaccactccagagaag

SEQ ID NO: 1998432 - DNA, 13 bp, Homo sapiens
ggtgtttaaagtc

SEQ ID NO: 1998433 - DNA, 13 bp, Homo sapiens
gtcacaggcaggt

SEQ ID NO: 1998434 - DNA, 16 bp, Homo sapiens
gtcacaggcaggtcca

SEQ ID NO: 1998435 - DNA, 18 bp, Homo sapiens
gtcacagggcctggggag

SEQ ID NO: 1998436 - DNA, 12 bp, Homo sapiens
gtcaccaagccc

SEQ ID NO: 1998437 - DNA, 16 bp, Homo sapiens
gtcaccaccttcccag

SEQ ID NO: 1998438 - DNA, 22 bp, Homo sapiens
gtcaccaccttcccagctctcc

SEQ ID NO: 1998439 - DNA, 14 bp, Homo sapiens
gtcaccagcaacat

SEQ ID NO: 1998440 - DNA, 23 bp, Homo sapiens
gtcaccaggaatgttaaagtcag

SEQ ID NO: 1998441 - DNA, 13 bp, Homo sapiens
gtcaccctgcaga

SEQ ID NO: 1998442 - DNA, 15 bp, Homo sapiens
gtcaccctgcagagc

SEQ ID NO: 1998443 - DNA, 14 bp, Homo sapiens
gtcacccttctggg

SEQ ID NO: 1998444 - DNA, 18 bp, Homo sapiens
gtcaccgtggaccttcct

SEQ ID NO: 1998445 - DNA, 19 bp, Homo sapiens
gtcaccgtggaccttcctg

SEQ ID NO: 1998446 - DNA, 21 bp, Homo sapiens
gtcaccgtggaccttcctgcc

SEQ ID NO: 1998447 - DNA, 14 bp, Homo sapiens
gtcacctcagctga

SEQ ID NO: 1998448 - DNA, 17 bp, Homo sapiens
gtcacctcctccactca

SEQ ID NO: 1998449 - DNA, 13 bp, Homo sapiens
gtcacctgcaagc

SEQ ID NO: 1998450 - DNA, 19 bp, Homo sapiens
gtcacctgcaagccccagg

SEQ ID NO: 1998451 - DNA, 22 bp, Homo sapiens
gtcacctgcaagccccagggcc

SEQ ID NO: 1998452 - DNA, 23 bp, Homo sapiens
gtcacctgcaagccccagggcct

SEQ ID NO: 1998453 - DNA, 16 bp, Homo sapiens
gtcacgcagccaccag

SEQ ID NO: 1998454 - DNA, 13 bp, Homo sapiens
gtcactagcagct

SEQ ID NO: 1998455 - DNA, 14 bp, Homo sapiens
gtcactagcagctg

SEQ ID NO: 1998456 - DNA, 24 bp, Homo sapiens
gtcactatgctatttctggcctca

SEQ ID NO: 1998457 - DNA, 20 bp, Homo sapiens
gtcactcttcctgcaaggac

SEQ ID NO: 1998458 - DNA, 23 bp, Homo sapiens
gtcactgcacagtgcatctcagc

SEQ ID NO: 1998459 - DNA, 22 bp, Homo sapiens
gtcactgtctcaactactcagc

SEQ ID NO: 1998460 - DNA, 19 bp, Homo sapiens
gtcactgtttattttttta

SEQ ID NO: 1998461 - DNA, 20 bp, Homo sapiens
gtcacttacctagatttaca

SEQ ID NO: 1998462 - DNA, 15 bp, Homo sapiens
gtcacttatttcata

SEQ ID NO: 1998463 - DNA, 16 bp, Homo sapiens
gtcacttccagtgttg

SEQ ID NO: 1998464 - DNA, 19 bp, Homo sapiens
gtcagaacagcagactcag

SEQ ID NO: 1998465 - DNA, 18 bp, Homo sapiens
gtcagaccagtactggga

SEQ ID NO: 1998466 - DNA, 15 bp, Homo sapiens
gtcagactgctggga

SEQ ID NO: 1998467 - DNA, 16 bp, Homo sapiens
gtcagactgctgggac

SEQ ID NO: 1998468 - DNA, 18 bp, Homo sapiens
gtcagactggctggctgc

SEQ ID NO: 1998469 - DNA, 12 bp, Homo sapiens
gtcagagacaga

SEQ ID NO: 1998470 - DNA, 17 bp, Homo sapiens
gtcagagccaggctctg

SEQ ID NO: 1998471 - DNA, 10 bp, Homo sapiens
gtcagagcta

SEQ ID NO: 1998472 - DNA, 15 bp, Homo sapiens
gtcagagctgggagt

SEQ ID NO: 1998473 - DNA, 19 bp, Homo sapiens
gtcagagctgttggcctcg

SEQ ID NO: 1998474 - DNA, 21 bp, Homo sapiens
gtcagccagccgccctgggct

SEQ ID NO: 1998475 - DNA, 15 bp, Homo sapiens
gtcagccagggccag

SEQ ID NO: 1998476 - DNA, 18 bp, Homo sapiens
gtcagcccgaatgcctgt

SEQ ID NO: 1998477 - DNA, 22 bp, Homo sapiens
gtcagccttccccctcccaggg

SEQ ID NO: 1998478 - DNA, 19 bp, Homo sapiens
gtcagctttcagagccagt

SEQ ID NO: 1998479 - DNA, 19 bp, Homo sapiens
gtcagctttgcttttcctg

SEQ ID NO: 1998480 - DNA, 13 bp, Homo sapiens
gtcaggacccagg

SEQ ID NO: 1998481 - DNA, 20 bp, Homo sapiens
gtcaggacctccggggagag

SEQ ID NO: 1998482 - DNA, 22 bp, Homo sapiens
gtcaggagttcaagaccagcct

SEQ ID NO: 1998483 - DNA, 13 bp, Homo sapiens
gtcaggagttcct

SEQ ID NO: 1998484 - DNA, 13 bp, Homo sapiens
gtcaggcaggttt

SEQ ID NO: 1998485 - DNA, 21 bp, Homo sapiens
gtcaggcaggtttgccagtga

SEQ ID NO: 1998486 - DNA, 15 bp, Homo sapiens
gtcaggcctgtgtgt

SEQ ID NO: 1998487 - DNA, 21 bp, Homo sapiens
gtcaggcggggtgctgtggtg

SEQ ID NO: 1998488 - DNA, 12 bp, Homo sapiens
gtcaggctccat

SEQ ID NO: 1998489 - DNA, 15 bp, Homo sapiens
gtcagggtgggaaga

SEQ ID NO: 1998490 - DNA, 20 bp, Homo sapiens
gtcagtaggtccaagggcca

SEQ ID NO: 1998491 - DNA, 16 bp, Homo sapiens
gtcagtgtggagaggg

SEQ ID NO: 1998492 - DNA, 19 bp, Homo sapiens
gtcagtgtggagaggggtg

SEQ ID NO: 1998493 - DNA, 17 bp, Homo sapiens
gtcagttcccggagcac

SEQ ID NO: 1998494 - DNA, 21 bp, Homo sapiens
gtcagttcccggagcacagcc

SEQ ID NO: 1998495 - DNA, 18 bp, Homo sapiens
gtcagttggagaaaatga

SEQ ID NO: 1998496 - DNA, 18 bp, Homo sapiens
gtcataaacagcatttat

SEQ ID NO: 1998497 - DNA, 14 bp, Homo sapiens
gtcatataaacctg

SEQ ID NO: 1998498 - DNA, 22 bp, Homo sapiens
gtcatatattcatgtaataaat

SEQ ID NO: 1998499 - DNA, 23 bp, Homo sapiens
gtcatatattcatgtaataaatc

SEQ ID NO: 1998500 - DNA, 20 bp, Homo sapiens
gtcatattaaacttctgatt

SEQ ID NO: 1998501 - DNA, 18 bp, Homo sapiens
gtcatcactccctggatg

SEQ ID NO: 1998502 - DNA, 17 bp, Homo sapiens
gtcatcacttttcagtg

SEQ ID NO: 1998503 - DNA, 13 bp, Homo sapiens
gtcatcatacatg

SEQ ID NO: 1998504 - DNA, 14 bp, Homo sapiens
gtcatcccctacac

SEQ ID NO: 1998505 - DNA, 21 bp, Homo sapiens
gtcatcccctacactttggcc

SEQ ID NO: 1998506 - DNA, 19 bp, Homo sapiens
gtcatcccgctcctgctga

SEQ ID NO: 1998507 - DNA, 18 bp, Homo sapiens
gtcatcggaggctgggcc

SEQ ID NO: 1998508 - DNA, 20 bp, Homo sapiens
gtcatctcagggtccagacc

SEQ ID NO: 1998509 - DNA, 14 bp, Homo sapiens
gtcatctctctggg

SEQ ID NO: 1998510 - DNA, 17 bp, Homo sapiens
gtcatctctctggggcc

SEQ ID NO: 1998511 - DNA, 22 bp, Homo sapiens
gtcatctctctggggccctggg

SEQ ID NO: 1998512 - DNA, 23 bp, Homo sapiens
gtcatctctctggggccctgggc

SEQ ID NO: 1998513 - DNA, 18 bp, Homo sapiens
gtcatctgcggggcttct

SEQ ID NO: 1998514 - DNA, 18 bp, Homo sapiens
gtcatctttttctctaaa

SEQ ID NO: 1998515 - DNA, 15 bp, Homo sapiens
gtcatgaatgccttc

SEQ ID NO: 1998516 - DNA, 14 bp, Homo sapiens
gtcatgatctccct

SEQ ID NO: 1998517 - DNA, 18 bp, Homo sapiens
gtcatgatctccctgccg

SEQ ID NO: 1998518 - DNA, 15 bp, Homo sapiens
gtcatgatggagact

SEQ ID NO: 1998519 - DNA, 17 bp, Homo sapiens
gtcatggaaaagcccag

SEQ ID NO: 1998520 - DNA, 18 bp, Homo sapiens
gtcatggaaaagcccagt

SEQ ID NO: 1998521 - DNA, 19 bp, Homo sapiens
gtcatggaaaagcccagtg

SEQ ID NO: 1998522 - DNA, 20 bp, Homo sapiens
gtcatggaaaatgtcctgtg

SEQ ID NO: 1998523 - DNA, 15 bp, Homo sapiens
gtcatgtgacaggta

SEQ ID NO: 1998524 - DNA, 12 bp, Homo sapiens
gtcatgtggcta

SEQ ID NO: 1998525 - DNA, 22 bp, Homo sapiens
gtcattaaaataaataaatgca

SEQ ID NO: 1998526 - DNA, 14 bp, Homo sapiens
gtcattactgcctt

SEQ ID NO: 1998527 - DNA, 21 bp, Homo sapiens
gtcatttattttaaaaaatga

SEQ ID NO: 1998528 - DNA, 21 bp, Homo sapiens
gtcatttgctgagcatgtact

SEQ ID NO: 1998529 - DNA, 15 bp, Homo sapiens
gtcattttaaaatct

SEQ ID NO: 1998530 - DNA, 21 bp, Homo sapiens
gtccaacctaacccctttcct

SEQ ID NO: 1998531 - DNA, 22 bp, Homo sapiens
gtccaaggaaacttgaatcaaa

SEQ ID NO: 1998532 - DNA, 18 bp, Homo sapiens
gtccaatggctgtaaact

SEQ ID NO: 1998533 - DNA, 19 bp, Homo sapiens
gtccaatggctgtaaacta

SEQ ID NO: 1998534 - DNA, 15 bp, Homo sapiens
gtccacaggggcagg

SEQ ID NO: 1998535 - DNA, 16 bp, Homo sapiens
gtccacaggggcaggc

SEQ ID NO: 1998536 - DNA, 21 bp, Homo sapiens
gtccacaggggcaggcctggg

SEQ ID NO: 1998537 - DNA, 22 bp, Homo sapiens
gtccacagtctcccattctcat

SEQ ID NO: 1998538 - DNA, 16 bp, Homo sapiens
gtccacccaggagccc

SEQ ID NO: 1998539 - DNA, 12 bp, Homo sapiens
gtccacccaggc

SEQ ID NO: 1998540 - DNA, 16 bp, Homo sapiens
gtccacccaggctgca

SEQ ID NO: 1998541 - DNA, 21 bp, Homo sapiens
gtccacccaggctgcactgca

SEQ ID NO: 1998542 - DNA, 21 bp, Homo sapiens
gtccactctcggggcccttgg

SEQ ID NO: 1998543 - DNA, 15 bp, Homo sapiens
gtccagaagaatatt

SEQ ID NO: 1998544 - DNA, 16 bp, Homo sapiens
gtccagaataagtgct

SEQ ID NO: 1998545 - DNA, 18 bp, Homo sapiens
gtccagaccattgtcttc

SEQ ID NO: 1998546 - DNA, 19 bp, Homo sapiens
gtccagaccattgtcttcc

SEQ ID NO: 1998547 - DNA, 11 bp, Homo sapiens
gtgaaattatg

SEQ ID NO: 1998548 - DNA, 21 bp, Homo sapiens
gtgaacaactatttataaact

SEQ ID NO: 1998549 - DNA, 19 bp, Homo sapiens
gtgaacaccaacttttatt

SEQ ID NO: 1998550 - DNA, 12 bp, Homo sapiens
gtgaaccaaaga

SEQ ID NO: 1998551 - DNA, 19 bp, Homo sapiens
gtgaaccaccacacccagc

SEQ ID NO: 1998552 - DNA, 21 bp, Homo sapiens
gtgaaccaccacacccagccc

SEQ ID NO: 1998553 - DNA, 23 bp, Homo sapiens
gtgaaccaccacacccagcccac

SEQ ID NO: 1998554 - DNA, 12 bp, Homo sapiens
gtgaacctggag

SEQ ID NO: 1998555 - DNA, 20 bp, Homo sapiens
gtgaactaagttttttactt

SEQ ID NO: 1998556 - DNA, 19 bp, Homo sapiens
gtgaactatttctacacag

SEQ ID NO: 1998557 - DNA, 20 bp, Homo sapiens
gtgaactatttctacacagt

SEQ ID NO: 1998558 - DNA, 22 bp, Homo sapiens
gtgaactcagagcccctccctg

SEQ ID NO: 1998559 - DNA, 23 bp, Homo sapiens
gtgaagaaaagtgaatgctcaag

SEQ ID NO: 1998560 - DNA, 15 bp, Homo sapiens
gtgaagaaatggaat

SEQ ID NO: 1998561 - DNA, 16 bp, Homo sapiens
gtgaagcagtgcctcg

SEQ ID NO: 1998562 - DNA, 23 bp, Homo sapiens
gtgaagcagtgcctcgaggcacc

SEQ ID NO: 1998563 - DNA, 18 bp, Homo sapiens
gtgaaggagaaaggagcc

SEQ ID NO: 1998564 - DNA, 12 bp, Homo sapiens
gtgaataataat

SEQ ID NO: 1998565 - DNA, 19 bp, Homo sapiens
gtgaatggccctagaactg

SEQ ID NO: 1998566 - DNA, 13 bp, Homo sapiens
gtgaatgtctcag

SEQ ID NO: 1998567 - DNA, 19 bp, Homo sapiens
gtgaatgtgtgaaggtctt

SEQ ID NO: 1998568 - DNA, 12 bp, Homo sapiens
gtgaattaaaaa

SEQ ID NO: 1998569 - DNA, 11 bp, Homo sapiens
gtgaattctgc

SEQ ID NO: 1998570 - DNA, 18 bp, Homo sapiens
gtgaattctgtgaagaat

SEQ ID NO: 1998571 - DNA, 20 bp, Homo sapiens
gtgaattgcctgcagagaga

SEQ ID NO: 1998572 - DNA, 17 bp, Homo sapiens
gtgaatttttttttcct

SEQ ID NO: 1998573 - DNA, 19 bp, Homo sapiens
gtgacaacctttgtgtaat

SEQ ID NO: 1998574 - DNA, 21 bp, Homo sapiens
gtgacaacctttgtgtaataa

SEQ ID NO: 1998575 - DNA, 14 bp, Homo sapiens
gtgacaagtggagg

SEQ ID NO: 1998576 - DNA, 17 bp, Homo sapiens
gtgacaagtggaggggg

SEQ ID NO: 1998577 - DNA, 11 bp, Homo sapiens
gtgacacacag

SEQ ID NO: 1998578 - DNA, 20 bp, Homo sapiens
gtgacacccaagagggctgc

SEQ ID NO: 1998579 - DNA, 15 bp, Homo sapiens
gtgacagaggcagcc

SEQ ID NO: 1998580 - DNA, 20 bp, Homo sapiens
gtgacagagtgagactctgt

SEQ ID NO: 1998581 - DNA, 22 bp, Homo sapiens
gtgacagagtgagactctgtct

SEQ ID NO: 1998582 - DNA, 16 bp, Homo sapiens
gtgacaggaaagccct

SEQ ID NO: 1998583 - DNA, 15 bp, Homo sapiens
gtgacaggcccagtg

SEQ ID NO: 1998584 - DNA, 14 bp, Homo sapiens
gtgacatccaggag

SEQ ID NO: 1998585 - DNA, 17 bp, Homo sapiens
gtgacatcccaggaggg

SEQ ID NO: 1998586 - DNA, 15 bp, Homo sapiens
gtgacatgggtgtgc

SEQ ID NO: 1998587 - DNA, 19 bp, Homo sapiens
gtgaccaatactactgtaa

SEQ ID NO: 1998588 - DNA, 20 bp, Homo sapiens
gtgaccaggctcacaactgt

SEQ ID NO: 1998589 - DNA, 22 bp, Homo sapiens
gtgaccatctgtttgagaatat

SEQ ID NO: 1998590 - DNA, 14 bp, Homo sapiens
gtgacccacatgcc

SEQ ID NO: 1998591 - DNA, 13 bp, Homo sapiens
gtgaccccagggc

SEQ ID NO: 1998592 - DNA, 14 bp, Homo sapiens
gtgaccccagggca

SEQ ID NO: 1998593 - DNA, 19 bp, Homo sapiens
gtgaccccagggcacagga

SEQ ID NO: 1998594 - DNA, 18 bp, Homo sapiens
gtgacccggcaccccctg

SEQ ID NO: 1998595 - DNA, 21 bp, Homo sapiens
gtgacccggcaccccctgcag

SEQ ID NO: 1998596 - DNA, 12 bp, Homo sapiens
gtgacctctgcc

SEQ ID NO: 1998597 - DNA, 13 bp, Homo sapiens
gtgacctctgcct

SEQ ID NO: 1998598 - DNA, 23 bp, Homo sapiens
gtgacctgccccgcccagctgca

SEQ ID NO: 1998599 - DNA, 15 bp, Homo sapiens
gtgacctgctgagct

SEQ ID NO: 1998600 - DNA, 16 bp, Homo sapiens
gtgacctgctgagctc

SEQ ID NO: 1998601 - DNA, 20 bp, Homo sapiens
gtgacgattatttatttctg

SEQ ID NO: 1998602 - DNA, 13 bp, Homo sapiens
gtgacggtcccac

SEQ ID NO: 1998603 - DNA, 15 bp, Homo sapiens
gtgactcacccaagc

SEQ ID NO: 1998604 - DNA, 14 bp, Homo sapiens
gtgactccagcctg

SEQ ID NO: 1998605 - DNA, 22 bp, Homo sapiens
gtgactctttttagggccaggc

SEQ ID NO: 1998606 - DNA, 19 bp, Homo sapiens
gtgactgaatttgggcctc

SEQ ID NO: 1998607 - DNA, 16 bp, Homo sapiens
gtgactgccccaactc

SEQ ID NO: 1998608 - DNA, 17 bp, Homo sapiens
gtgactgcgatcttcag

SEQ ID NO: 1998609 - DNA, 20 bp, Homo sapiens
gtgactgtcgtgtttacaaa

SEQ ID NO: 1998610 - DNA, 15 bp, Homo sapiens
gtgacttcctggtga

SEQ ID NO: 1998611 - DNA, 18 bp, Homo sapiens
gtgagaataattgtgtac

SEQ ID NO: 1998612 - DNA, 18 bp, Homo sapiens
gtgagaatcctgcctctc

SEQ ID NO: 1998613 - DNA, 19 bp, Homo sapiens
gtgagaatcctgcctctcc

SEQ ID NO: 1998614 - DNA, 14 bp, Homo sapiens
gtgagactctgtct

SEQ ID NO: 1998615 - DNA, 12 bp, Homo sapiens
gtgagagctggg

SEQ ID NO: 1998616 - DNA, 12 bp, Homo sapiens
gtgagagctggt

SEQ ID NO: 1998617 - DNA, 16 bp, Homo sapiens
gtgagaggaagggtgg

SEQ ID NO: 1998618 - DNA, 16 bp, Homo sapiens
gtgagaggggaacaga

SEQ ID NO: 1998619 - DNA, 20 bp, Homo sapiens
gtgagataaccacaaccagg

SEQ ID NO: 1998620 - DNA, 23 bp, Homo sapiens
gtgagataaccacaaccaggaag

SEQ ID NO: 1998621 - DNA, 23 bp, Homo sapiens
gtgagatttgtatttatattaga

SEQ ID NO: 1998622 - DNA, 18 bp, Homo sapiens
gtgagcacatctgggagg

SEQ ID NO: 1998623 - DNA, 22 bp, Homo sapiens
gtgagcacatctgggaggctgg

SEQ ID NO: 1998624 - DNA, 21 bp, Homo sapiens
gtgagcactaaggtgtgctct

SEQ ID NO: 1998625 - DNA, 17 bp, Homo sapiens
gtgagcagaggagtcca

SEQ ID NO: 1998626 - DNA, 19 bp, Homo sapiens
gtgagcatgggtgtgccct

SEQ ID NO: 1998627 - DNA, 20 bp, Homo sapiens
gtgagccacagaccacctgc

SEQ ID NO: 1998628 - DNA, 14 bp, Homo sapiens
gtgagccactgcac

SEQ ID NO: 1998629 - DNA, 20 bp, Homo sapiens
gtgagccactgcaccgggcc

SEQ ID NO: 1998630 - DNA, 24 bp, Homo sapiens
gtgagccatgatcgagccactgca

SEQ ID NO: 1998631 - DNA, 17 bp, Homo sapiens
gtgagcccctggtcctg

SEQ ID NO: 1998632 - DNA, 21 bp, Homo sapiens
gtgagccgcatcttctccatc

SEQ ID NO: 1998633 - DNA, 18 bp, Homo sapiens
gtgaggaaagcacacagt

SEQ ID NO: 1998634 - DNA, 22 bp, Homo sapiens
gtgaggaaatggcaacacgtgg

SEQ ID NO: 1998635 - DNA, 21 bp, Homo sapiens
gtgaggattatgggtcctgca

SEQ ID NO: 1998636 - DNA, 16 bp, Homo sapiens
gtgaggcccagcctgt

SEQ ID NO: 1998637 - DNA, 13 bp, Homo sapiens
gtgaggcccctgg

SEQ ID NO: 1998638 - DNA, 17 bp, Homo sapiens
gtgagtgaatggcaaag

SEQ ID NO: 1998639 - DNA, 22 bp, Homo sapiens
gtgagtgcttgtcatggaaaat

SEQ ID NO: 1998640 - DNA, 14 bp, Homo sapiens
gtgagtggcagcca

SEQ ID NO: 1998641 - DNA, 20 bp, Homo sapiens
gtgagtggcagccatgcctc

SEQ ID NO: 1998642 - DNA, 13 bp, Homo sapiens
gtgataagtggaa

SEQ ID NO: 1998643 - DNA, 20 bp, Homo sapiens
gtgatacccatagcttccat

SEQ ID NO: 1998644 - DNA, 16 bp, Homo sapiens
gtgatacgtacagcca

SEQ ID NO: 1998645 - DNA, 17 bp, Homo sapiens
gtgatatatgtatttat

SEQ ID NO: 1998646 - DNA, 19 bp, Homo sapiens
gtgatatcacctctcttca

SEQ ID NO: 1998647 - DNA, 15 bp, Homo sapiens
gtgatcaactgttca

SEQ ID NO: 1998648 - DNA, 21 bp, Homo sapiens
gtgatcagaaggctggggcca

SEQ ID NO: 1998649 - DNA, 22 bp, Homo sapiens
gtgatcagaaggctggggccag

SEQ ID NO: 1998650 - DNA, 15 bp, Homo sapiens
gtgatccacccacct

SEQ ID NO: 1998651 - DNA, 18 bp, Homo sapiens
gtgatccacccacctcag

SEQ ID NO: 1998652 - DNA, 20 bp, Homo sapiens
gtgatccacccacctcagcc

SEQ ID NO: 1998653 - DNA, 22 bp, Homo sapiens
gtgatccacccacctcagcctc

SEQ ID NO: 1998654 - DNA, 23 bp, Homo sapiens
gtgatccacccacctcagcctcc

SEQ ID NO: 1998655 - DNA, 22 bp, Homo sapiens
gtgatccttcatcgaacaaact

SEQ ID NO: 1998656 - DNA, 23 bp, Homo sapiens
gtgatgagggcagcagccagccc

SEQ ID NO: 1998657 - DNA, 22 bp, Homo sapiens
gtgatggagtgtgcgtgtgtgc

SEQ ID NO: 1998658 - DNA, 16 bp, Homo sapiens
gtgatgggatctgtaa

SEQ ID NO: 1998659 - DNA, 14 bp, Homo sapiens
gtgatggggtgggc

SEQ ID NO: 1998660 - DNA, 22 bp, Homo sapiens
gtgatggggtgggcagggctgg

SEQ ID NO: 1998661 - DNA, 15 bp, Homo sapiens
gtgtttcttgcctca

SEQ ID NO: 1998662 - DNA, 16 bp, Homo sapiens
gtgtttgtgagcatgg

SEQ ID NO: 1998663 - DNA, 22 bp, Homo sapiens
gtgttttaattccaatatgatg

SEQ ID NO: 1998664 - DNA, 13 bp, Homo sapiens
gtgttttctgaat

SEQ ID NO: 1998665 - DNA, 18 bp, Homo sapiens
gttaaaatataaattaag

SEQ ID NO: 1998666 - DNA, 16 bp, Homo sapiens
gttaaactgagacaat

SEQ ID NO: 1998667 - DNA, 20 bp, Homo sapiens
gttaaagggcagaaggggaa

SEQ ID NO: 1998668 - DNA, 22 bp, Homo sapiens
gttaaatatttacatatgaaat

SEQ ID NO: 1998669 - DNA, 17 bp, Homo sapiens
gttaaatgaaattgtaa

SEQ ID NO: 1998670 - DNA, 18 bp, Homo sapiens
gttaaatgcaggtatttt

SEQ ID NO: 1998671 - DNA, 16 bp, Homo sapiens
gttaacactacttaaa

SEQ ID NO: 1998672 - DNA, 13 bp, Homo sapiens
gttaacattgttg

SEQ ID NO: 1998673 - DNA, 22 bp, Homo sapiens
gttaacattgttgctccctgtg

SEQ ID NO: 1998674 - DNA, 22 bp, Homo sapiens
gttaagttacttcactttaatt

SEQ ID NO: 1998675 - DNA, 22 bp, Homo sapiens
gttaataataagataatgatga

SEQ ID NO: 1998676 - DNA, 21 bp, Homo sapiens
gttaatatatcccagaaatta

SEQ ID NO: 1998677 - DNA, 12 bp, Homo sapiens
gttaatcttagg

SEQ ID NO: 1998678 - DNA, 16 bp, Homo sapiens
gttaatgaaaatgtca

SEQ ID NO: 1998679 - DNA, 12 bp, Homo sapiens
gttaatttaaag

SEQ ID NO: 1998680 - DNA, 17 bp, Homo sapiens
gttaatttgttatgtat

SEQ ID NO: 1998681 - DNA, 12 bp, Homo sapiens
gttaatttttga

SEQ ID NO: 1998682 - DNA, 16 bp, Homo sapiens
gttacacaattaattg

SEQ ID NO: 1998683 - DNA, 19 bp, Homo sapiens
gttacagcgagaggcagag

SEQ ID NO: 1998684 - DNA, 16 bp, Homo sapiens
gttacatgtttgcacc

SEQ ID NO: 1998685 - DNA, 13 bp, Homo sapiens
gttacccagagaa

SEQ ID NO: 1998686 - DNA, 20 bp, Homo sapiens
gttacccagtaactcatctg

SEQ ID NO: 1998687 - DNA, 15 bp, Homo sapiens
gttacctcctataaa

SEQ ID NO: 1998688 - DNA, 13 bp, Homo sapiens
gttacctttccca

SEQ ID NO: 1998689 - DNA, 19 bp, Homo sapiens
gttacctttcccatgctga

SEQ ID NO: 1998690 - DNA, 20 bp, Homo sapiens
gttactcagcagcagagagc

SEQ ID NO: 1998691 - DNA, 12 bp, Homo sapiens
gttactcagccc

SEQ ID NO: 1998692 - DNA, 18 bp, Homo sapiens
gttactctccaacctgga

SEQ ID NO: 1998693 - DNA, 23 bp, Homo sapiens
gttactgaaatgaggagagaagg

SEQ ID NO: 1998694 - DNA, 20 bp, Homo sapiens
gttagagaggtagcgagctg

SEQ ID NO: 1998695 - DNA, 21 bp, Homo sapiens
gttagagaggtagcgagctgc

SEQ ID NO: 1998696 - DNA, 14 bp, Homo sapiens
gttagcaggaaata

SEQ ID NO: 1998697 - DNA, 20 bp, Homo sapiens
gttagccctcagtcagttcc

SEQ ID NO: 1998698 - DNA, 20 bp, Homo sapiens
gttagctcaggaggcttgga

SEQ ID NO: 1998699 - DNA, 20 bp, Homo sapiens
gttagctggacatgctttgg

SEQ ID NO: 1998700 - DNA, 19 bp, Homo sapiens
gttaggaaataaaaccttt

SEQ ID NO: 1998701 - DNA, 19 bp, Homo sapiens
gttaggaggctgcatgctc

SEQ ID NO: 1998702 - DNA, 15 bp, Homo sapiens
gttaggagttcgaga

SEQ ID NO: 1998703 - DNA, 13 bp, Homo sapiens
gttagggaatggc

SEQ ID NO: 1998704 - DNA, 23 bp, Homo sapiens
gttagggtgctctggaagagagg

SEQ ID NO: 1998705 - DNA, 21 bp, Homo sapiens
gttagtgtgtgtgcatgtgtg

SEQ ID NO: 1998706 - DNA, 13 bp, Homo sapiens
gttataaaaatac

SEQ ID NO: 1998707 - DNA, 21 bp, Homo sapiens
gttatagcaatgtaacattaa

SEQ ID NO: 1998708 - DNA, 13 bp, Homo sapiens
gttatatattgta

SEQ ID NO: 1998709 - DNA, 21 bp, Homo sapiens
gttatatattgtattaagggc

SEQ ID NO: 1998710 - DNA, 20 bp, Homo sapiens
gttatattttactactgtgg

SEQ ID NO: 1998711 - DNA, 18 bp, Homo sapiens
gttatctaagttaattta

SEQ ID NO: 1998712 - DNA, 15 bp, Homo sapiens
gttatctgcctggcc

SEQ ID NO: 1998713 - DNA, 17 bp, Homo sapiens
gttatctgcctggcctg

SEQ ID NO: 1998714 - DNA, 18 bp, Homo sapiens
gttatctgcctggcctgg

SEQ ID NO: 1998715 - DNA, 17 bp, Homo sapiens
gttatgtatatagatgt

SEQ ID NO: 1998716 - DNA, 14 bp, Homo sapiens
gttatgtgtgtata

SEQ ID NO: 1998717 - DNA, 19 bp, Homo sapiens
gttatgtgtgtatatgtat

SEQ ID NO: 1998718 - DNA, 22 bp, Homo sapiens
gttatgtttgcactttgtatat

SEQ ID NO: 1998719 - DNA, 14 bp, Homo sapiens
gttattaatattgt

SEQ ID NO: 1998720 - DNA, 14 bp, Homo sapiens
gttattcaaatgaa

SEQ ID NO: 1998721 - DNA, 23 bp, Homo sapiens
gttattctatcactggcaatatt

SEQ ID NO: 1998722 - DNA, 16 bp, Homo sapiens
gttattgatttttgta

SEQ ID NO: 1998723 - DNA, 20 bp, Homo sapiens
gttattgggcaagtgattga

SEQ ID NO: 1998724 - DNA, 17 bp, Homo sapiens
gttattgtacagctgtt

SEQ ID NO: 1998725 - DNA, 10 bp, Homo sapiens
gttatttaaa

SEQ ID NO: 1998726 - DNA, 13 bp, Homo sapiens
gttatttaaatga

SEQ ID NO: 1998727 - DNA, 15 bp, Homo sapiens
gttatttacttgaaa

SEQ ID NO: 1998728 - DNA, 16 bp, Homo sapiens
gttatttgtaatagat

SEQ ID NO: 1998729 - DNA, 18 bp, Homo sapiens
gttatttgttattttcag

SEQ ID NO: 1998730 - DNA, 15 bp, Homo sapiens
gttattttcagtatt

SEQ ID NO: 1998731 - DNA, 16 bp, Homo sapiens
gttattttttaattat

SEQ ID NO: 1998732 - DNA, 14 bp, Homo sapiens
gttcaaaaagtcta

SEQ ID NO: 1998733 - DNA, 14 bp, Homo sapiens
gttcaaatcctcac

SEQ ID NO: 1998734 - DNA, 13 bp, Homo sapiens
gttcaagaaataa

SEQ ID NO: 1998735 - DNA, 16 bp, Homo sapiens
gttcaagaaataagtt

SEQ ID NO: 1998736 - DNA, 16 bp, Homo sapiens
gttcaagaccagcctg

SEQ ID NO: 1998737 - DNA, 13 bp, Homo sapiens
gttcaagccatgg

SEQ ID NO: 1998738 - DNA, 23 bp, Homo sapiens
gttcaagcgattcttgtgcctca

SEQ ID NO: 1998739 - DNA, 16 bp, Homo sapiens
gttcaattctcatttg

SEQ ID NO: 1998740 - DNA, 16 bp, Homo sapiens
gttcacccacagggct

SEQ ID NO: 1998741 - DNA, 15 bp, Homo sapiens
gttcacgcaacttga

SEQ ID NO: 1998742 - DNA, 16 bp, Homo sapiens
gttcactagagctggg

SEQ ID NO: 1998743 - DNA, 24 bp, Homo sapiens
gttcactctacttagcatgtccct

SEQ ID NO: 1998744 - DNA, 17 bp, Homo sapiens
gttcagagactcagggc

SEQ ID NO: 1998745 - DNA, 22 bp, Homo sapiens
gttcagagactcagggccccag

SEQ ID NO: 1998746 - DNA, 15 bp, Homo sapiens
gttcagcccctcctc

SEQ ID NO: 1998747 - DNA, 16 bp, Homo sapiens
gttcagcccctcctct

SEQ ID NO: 1998748 - DNA, 23 bp, Homo sapiens
gttcagcccctcctctgccacct

SEQ ID NO: 1998749 - DNA, 22 bp, Homo sapiens
gttcagctaagctaggaatgaa

SEQ ID NO: 1998750 - DNA, 17 bp, Homo sapiens
gttcagctccagctcac

SEQ ID NO: 1998751 - DNA, 23 bp, Homo sapiens
gttcagcttgtaaatagctcagg

SEQ ID NO: 1998752 - DNA, 21 bp, Homo sapiens
gttcaggagtcccaaggaaag

SEQ ID NO: 1998753 - DNA, 18 bp, Homo sapiens
gttcagggaagcaggcag

SEQ ID NO: 1998754 - DNA, 20 bp, Homo sapiens
gttcagggaagcaggcagag

SEQ ID NO: 1998755 - DNA, 17 bp, Homo sapiens
gttcagggttggcccct

SEQ ID NO: 1998756 - DNA, 18 bp, Homo sapiens
gttcagggttggcccctg

SEQ ID NO: 1998757 - DNA, 18 bp, Homo sapiens
gttcaggtaacaggcaga

SEQ ID NO: 1998758 - DNA, 17 bp, Homo sapiens
gttcagtgccttggagc

SEQ ID NO: 1998759 - DNA, 19 bp, Homo sapiens
gttcatatgtaccatgtac

SEQ ID NO: 1998760 - DNA, 16 bp, Homo sapiens
gttcatcccagcccca

SEQ ID NO: 1998761 - DNA, 20 bp, Homo sapiens
gttcatctgagcaagagctg

SEQ ID NO: 1998762 - DNA, 19 bp, Homo sapiens
gttcatgagaatctatatt

SEQ ID NO: 1998763 - DNA, 16 bp, Homo sapiens
gttcatggtgatcagt

SEQ ID NO: 1998764 - DNA, 18 bp, Homo sapiens
gttcatgtttgtaaatta

SEQ ID NO: 1998765 - DNA, 20 bp, Homo sapiens
gttcattaaagcatgaatgg

SEQ ID NO: 1998766 - DNA, 13 bp, Homo sapiens
gttcattttagtg

SEQ ID NO: 1998767 - DNA, 23 bp, Homo sapiens
gttccaaataaggatttgttcac

SEQ ID NO: 1998768 - DNA, 15 bp, Homo sapiens
gttccagctgcctgg

SEQ ID NO: 1998769 - DNA, 16 bp, Homo sapiens
gttccagctgcctggg

SEQ ID NO: 1998770 - DNA, 21 bp, Homo sapiens
gttccaggagcacacggccct

SEQ ID NO: 1998771 - DNA, 12 bp, Homo sapiens
gttccatgaaga

SEQ ID NO: 1998772 - DNA, 14 bp, Homo sapiens
gttccatgcctgag

SEQ ID NO: 1998773 - DNA, 20 bp, Homo sapiens
gttccatgcctgagggtgga

SEQ ID NO: 1998774 - DNA, 18 bp, Homo sapiens
gttcccaataaaagtgac

SEQ ID NO: 1998775 - DNA, 18 bp, Homo sapiens
gttccccatctgggtcct

SEQ ID NO: 1998776 - DNA, 16 bp, Homo sapiens
taacataaaatctgtg

SEQ ID NO: 1998777 - DNA, 20 bp, Homo sapiens
taacataaaatctgtgaatt

SEQ ID NO: 1998778 - DNA, 16 bp, Homo sapiens
taacataatttgtaca

SEQ ID NO: 1998779 - DNA, 15 bp, Homo sapiens
taacataggttttga

SEQ ID NO: 1998780 - DNA, 22 bp, Homo sapiens
taacataggttttgatttatat

SEQ ID NO: 1998781 - DNA, 14 bp, Homo sapiens
taacatataatgtt

SEQ ID NO: 1998782 - DNA, 14 bp, Homo sapiens
taacatcatgcatt

SEQ ID NO: 1998783 - DNA, 16 bp, Homo sapiens
taacatcatgcattca

SEQ ID NO: 1998784 - DNA, 19 bp, Homo sapiens
taacatctttgaaaagaaa

SEQ ID NO: 1998785 - DNA, 20 bp, Homo sapiens
taacatgaaaaacacggcag

SEQ ID NO: 1998786 - DNA, 13 bp, Homo sapiens
taacatgccagct

SEQ ID NO: 1998787 - DNA, 17 bp, Homo sapiens
taacatgccagcttcct

SEQ ID NO: 1998788 - DNA, 20 bp, Homo sapiens
taacattgggaaatcttata

SEQ ID NO: 1998789 - DNA, 17 bp, Homo sapiens
taacatttatctaaaag

SEQ ID NO: 1998790 - DNA, 21 bp, Homo sapiens
taacattttaaataaaagaaa

SEQ ID NO: 1998791 - DNA, 17 bp, Homo sapiens
taaccacaaccaggaag

SEQ ID NO: 1998792 - DNA, 13 bp, Homo sapiens
taaccacggaaaa

SEQ ID NO: 1998793 - DNA, 19 bp, Homo sapiens
taaccacttaaaaaatgtc

SEQ ID NO: 1998794 - DNA, 22 bp, Homo sapiens
taaccagacacatactcatttt

SEQ ID NO: 1998795 - DNA, 15 bp, Homo sapiens
taaccagctgtaaca

SEQ ID NO: 1998796 - DNA, 18 bp, Homo sapiens
taaccattacatgtttaa

SEQ ID NO: 1998797 - DNA, 13 bp, Homo sapiens
taaccccagctcc

SEQ ID NO: 1998798 - DNA, 19 bp, Homo sapiens
taaccccagctccctagga

SEQ ID NO: 1998799 - DNA, 23 bp, Homo sapiens
taacccccagtgccacagagaag

SEQ ID NO: 1998800 - DNA, 19 bp, Homo sapiens
taaccctctcttccctatt

SEQ ID NO: 1998801 - DNA, 14 bp, Homo sapiens
taaccgtttttcaa

SEQ ID NO: 1998802 - DNA, 16 bp, Homo sapiens
taaccgtttttcaaga

SEQ ID NO: 1998803 - DNA, 15 bp, Homo sapiens
taacctactagacaa

SEQ ID NO: 1998804 - DNA, 20 bp, Homo sapiens
taacctatatgatttatagt

SEQ ID NO: 1998805 - DNA, 19 bp, Homo sapiens
taacctcagtgtcatttat

SEQ ID NO: 1998806 - DNA, 19 bp, Homo sapiens
taacctgtacttcaagtta

SEQ ID NO: 1998807 - DNA, 15 bp, Homo sapiens
taacctgtttatata

SEQ ID NO: 1998808 - DNA, 21 bp, Homo sapiens
taaccttaccagatttttaca

SEQ ID NO: 1998809 - DNA, 12 bp, Homo sapiens
taacgcctgagc

SEQ ID NO: 1998810 - DNA, 13 bp, Homo sapiens
taacgcctgagcc

SEQ ID NO: 1998811 - DNA, 18 bp, Homo sapiens
taacgcctgagcccaggg

SEQ ID NO: 1998812 - DNA, 19 bp, Homo sapiens
taacgcctgagcccaggga

SEQ ID NO: 1998813 - DNA, 12 bp, Homo sapiens
taacggctccag

SEQ ID NO: 1998814 - DNA, 13 bp, Homo sapiens
taacggctccagg

SEQ ID NO: 1998815 - DNA, 18 bp, Homo sapiens
taacggctccaggatttt

SEQ ID NO: 1998816 - DNA, 19 bp, Homo sapiens
taacggtcccccctcactc

SEQ ID NO: 1998817 - DNA, 15 bp, Homo sapiens
taacgtaaatacaca

SEQ ID NO: 1998818 - DNA, 16 bp, Homo sapiens
taacgtcatctcaggg

SEQ ID NO: 1998819 - DNA, 13 bp, Homo sapiens
taactaatttaaa

SEQ ID NO: 1998820 - DNA, 14 bp, Homo sapiens
taactaatttaaac

SEQ ID NO: 1998821 - DNA, 17 bp, Homo sapiens
taactacaaattatcat

SEQ ID NO: 1998822 - DNA, 16 bp, Homo sapiens
taactacactaataaa

SEQ ID NO: 1998823 - DNA, 18 bp, Homo sapiens
taactactttttatactc

SEQ ID NO: 1998824 - DNA, 17 bp, Homo sapiens
taactagaatttattca

SEQ ID NO: 1998825 - DNA, 16 bp, Homo sapiens
taactagatctcctgt

SEQ ID NO: 1998826 - DNA, 22 bp, Homo sapiens
taactagtcctgcagaggattt

SEQ ID NO: 1998827 - DNA, 18 bp, Homo sapiens
taactatcaatatttaag

SEQ ID NO: 1998828 - DNA, 22 bp, Homo sapiens
taactcaatattttccatgaaa

SEQ ID NO: 1998829 - DNA, 14 bp, Homo sapiens
taactcatcataaa

SEQ ID NO: 1998830 - DNA, 16 bp, Homo sapiens
taactcatcataaaat

SEQ ID NO: 1998831 - DNA, 12 bp, Homo sapiens
taactcattaga

SEQ ID NO: 1998832 - DNA, 16 bp, Homo sapiens
taactccaccaaccca

SEQ ID NO: 1998833 - DNA, 19 bp, Homo sapiens
taactccagtctcctgaca

SEQ ID NO: 1998834 - DNA, 20 bp, Homo sapiens
taactccagtctcctgacat

SEQ ID NO: 1998835 - DNA, 21 bp, Homo sapiens
taactccagtctcctgacatt

SEQ ID NO: 1998836 - DNA, 14 bp, Homo sapiens
taactccagtgaag

SEQ ID NO: 1998837 - DNA, 15 bp, Homo sapiens
taactccccacccca

SEQ ID NO: 1998838 - DNA, 22 bp, Homo sapiens
taactctaattcccattttgca

SEQ ID NO: 1998839 - DNA, 22 bp, Homo sapiens
taactctatagttattgtttta

SEQ ID NO: 1998840 - DNA, 15 bp, Homo sapiens
taactctcgggacct

SEQ ID NO: 1998841 - DNA, 14 bp, Homo sapiens
taactctctttatg

SEQ ID NO: 1998842 - DNA, 12 bp, Homo sapiens
taactgcaattt

SEQ ID NO: 1998843 - DNA, 22 bp, Homo sapiens
taactggaagcatgtaggagaa

SEQ ID NO: 1998844 - DNA, 21 bp, Homo sapiens
taactggggtattaacttttt

SEQ ID NO: 1998845 - DNA, 20 bp, Homo sapiens
taactgggtaatgaaacaaa

SEQ ID NO: 1998846 - DNA, 15 bp, Homo sapiens
taactgtaaatcact

SEQ ID NO: 1998847 - DNA, 21 bp, Homo sapiens
taactgtaaatcacttgtaaa

SEQ ID NO: 1998848 - DNA, 20 bp, Homo sapiens
taactgtcatctagcccctt

SEQ ID NO: 1998849 - DNA, 16 bp, Homo sapiens
taactgtgtgaagaaa

SEQ ID NO: 1998850 - DNA, 18 bp, Homo sapiens
taactgtgtgaagaaatg

SEQ ID NO: 1998851 - DNA, 19 bp, Homo sapiens
taactgtgtgaagaaatgg

SEQ ID NO: 1998852 - DNA, 18 bp, Homo sapiens
taacttaaaaaaatgaca

SEQ ID NO: 1998853 - DNA, 15 bp, Homo sapiens
taacttagcatgtgt

SEQ ID NO: 1998854 - DNA, 22 bp, Homo sapiens
taacttatctagaaagaaaaga

SEQ ID NO: 1998855 - DNA, 13 bp, Homo sapiens
taacttcagagaa

SEQ ID NO: 1998856 - DNA, 14 bp, Homo sapiens
taacttcagagaag

SEQ ID NO: 1998857 - DNA, 18 bp, Homo sapiens
taacttcttaaaagttgt

SEQ ID NO: 1998858 - DNA, 13 bp, Homo sapiens
taacttgtatatt

SEQ ID NO: 1998859 - DNA, 16 bp, Homo sapiens
taacttgtatattcca

SEQ ID NO: 1998860 - DNA, 21 bp, Homo sapiens
taacttgtatattccaccatt

SEQ ID NO: 1998861 - DNA, 21 bp, Homo sapiens
taactttatcacattatttgc

SEQ ID NO: 1998862 - DNA, 23 bp, Homo sapiens
taactttcagaagagatgggctt

SEQ ID NO: 1998863 - DNA, 13 bp, Homo sapiens
taacttttgtaag

SEQ ID NO: 1998864 - DNA, 20 bp, Homo sapiens
taagaaaacaatcacactca

SEQ ID NO: 1998865 - DNA, 21 bp, Homo sapiens
taagaaacacagggttttgta

SEQ ID NO: 1998866 - DNA, 19 bp, Homo sapiens
taagaaacatgatgtgaga

SEQ ID NO: 1998867 - DNA, 18 bp, Homo sapiens
taagaaagtataaagtca

SEQ ID NO: 1998868 - DNA, 22 bp, Homo sapiens
taagaagacatgacaatgcaat

SEQ ID NO: 1998869 - DNA, 12 bp, Homo sapiens
taagaagaggaa

SEQ ID NO: 1998870 - DNA, 14 bp, Homo sapiens
taagaagcaaataa

SEQ ID NO: 1998871 - DNA, 23 bp, Homo sapiens
taagaatgcagattcctgggcct

SEQ ID NO: 1998872 - DNA, 21 bp, Homo sapiens
taagaatgctggttttcctaa

SEQ ID NO: 1998873 - DNA, 22 bp, Homo sapiens
taagaatgctggttttcctaaa

SEQ ID NO: 1998874 - DNA, 22 bp, Homo sapiens
taagaccgtgtcccaaggagct

SEQ ID NO: 1998875 - DNA, 18 bp, Homo sapiens
taagactcattccctaga

SEQ ID NO: 1998876 - DNA, 17 bp, Homo sapiens
taagacttgacagtgga

SEQ ID NO: 1998877 - DNA, 15 bp, Homo sapiens
taagagaaatggcaa

SEQ ID NO: 1998878 - DNA, 20 bp, Homo sapiens
taagagaagtagaaatcata

SEQ ID NO: 1998879 - DNA, 14 bp, Homo sapiens
taagagagaaatct

SEQ ID NO: 1998880 - DNA, 21 bp, Homo sapiens
taagagctgatgtgagtgtgt

SEQ ID NO: 1998881 - DNA, 16 bp, Homo sapiens
taagataaatagagtt

SEQ ID NO: 1998882 - DNA, 12 bp, Homo sapiens
taagataattat

SEQ ID NO: 1998883 - DNA, 17 bp, Homo sapiens
taagatatattttgagt

SEQ ID NO: 1998884 - DNA, 15 bp, Homo sapiens
taagattagaatgaa

SEQ ID NO: 1998885 - DNA, 17 bp, Homo sapiens
taagattgtaattcaga

SEQ ID NO: 1998886 - DNA, 12 bp, Homo sapiens
taagattgtaca

SEQ ID NO: 1998887 - DNA, 19 bp, Homo sapiens
taagatttagagatgaatt

SEQ ID NO: 1998888 - DNA, 15 bp, Homo sapiens
taagatttctcctga

SEQ ID NO: 1998889 - DNA, 16 bp, Homo sapiens
taagatttctcctgac

SEQ ID NO: 1998890 - DNA, 20 bp, Homo sapiens
taagatttctcctgactcca

SEQ ID NO: 1998891 - DNA, 18 bp, Homo sapiens
tacataacaagaaaatca

SEQ ID NO: 1998892 - DNA, 15 bp, Homo sapiens
tacataattgcaata

SEQ ID NO: 1998893 - DNA, 22 bp, Homo sapiens
tacataattttttattcaagtt

SEQ ID NO: 1998894 - DNA, 21 bp, Homo sapiens
tacatacagaggtaactatca

SEQ ID NO: 1998895 - DNA, 18 bp, Homo sapiens
tacatacatacatatata

SEQ ID NO: 1998896 - DNA, 14 bp, Homo sapiens
tacatacatatata

SEQ ID NO: 1998897 - DNA, 22 bp, Homo sapiens
tacatacatatatatctgataa

SEQ ID NO: 1998898 - DNA, 19 bp, Homo sapiens
tacatacctctctctatat

SEQ ID NO: 1998899 - DNA, 23 bp, Homo sapiens
tacatagatgtatcattaatgta

SEQ ID NO: 1998900 - DNA, 14 bp, Homo sapiens
tacatagtcacaaa

SEQ ID NO: 1998901 - DNA, 18 bp, Homo sapiens
tacatagtcacaaaaatg

SEQ ID NO: 1998902 - DNA, 20 bp, Homo sapiens
tacatagtcacaaaaatggt

SEQ ID NO: 1998903 - DNA, 14 bp, Homo sapiens
tacatatcagaaaa

SEQ ID NO: 1998904 - DNA, 15 bp, Homo sapiens
tacatatcagaaaag

SEQ ID NO: 1998905 - DNA, 18 bp, Homo sapiens
tacatatcagaaaagtag

SEQ ID NO: 1998906 - DNA, 21 bp, Homo sapiens
tacatatcagaaaagtagaat

SEQ ID NO: 1998907 - DNA, 22 bp, Homo sapiens
tacatatggaaatcctgttact

SEQ ID NO: 1998908 - DNA, 23 bp, Homo sapiens
tacatatggaaatcctgttactt

SEQ ID NO: 1998909 - DNA, 15 bp, Homo sapiens
tacatatgtaaaata

SEQ ID NO: 1998910 - DNA, 22 bp, Homo sapiens
tacatatgtagactatatacat

SEQ ID NO: 1998911 - DNA, 19 bp, Homo sapiens
tacatattataaataaatg

SEQ ID NO: 1998912 - DNA, 15 bp, Homo sapiens
tacatattctttaaa

SEQ ID NO: 1998913 - DNA, 23 bp, Homo sapiens
tacatcaaatcagtcctttgatt

SEQ ID NO: 1998914 - DNA, 13 bp, Homo sapiens
tacatcttcagct

SEQ ID NO: 1998915 - DNA, 12 bp, Homo sapiens
tacatgaaacag

SEQ ID NO: 1998916 - DNA, 15 bp, Homo sapiens
tacatgaaacagaaa

SEQ ID NO: 1998917 - DNA, 13 bp, Homo sapiens
tacatgaacacag

SEQ ID NO: 1998918 - DNA, 17 bp, Homo sapiens
tacatgaccagaaaaca

SEQ ID NO: 1998919 - DNA, 14 bp, Homo sapiens
tacatgattcattt

SEQ ID NO: 1998920 - DNA, 14 bp, Homo sapiens
tacatgctgctaat

SEQ ID NO: 1998921 - DNA, 17 bp, Homo sapiens
tacatgctgtgctcttt

SEQ ID NO: 1998922 - DNA, 16 bp, Homo sapiens
tacatggccagtgtga

SEQ ID NO: 1998923 - DNA, 16 bp, Homo sapiens
tacatgtatagtgagt

SEQ ID NO: 1998924 - DNA, 16 bp, Homo sapiens
tacatgtgtagcctgt

SEQ ID NO: 1998925 - DNA, 12 bp, Homo sapiens
tacatgtgtgga

SEQ ID NO: 1998926 - DNA, 18 bp, Homo sapiens
tacatgtgtggatgtgta

SEQ ID NO: 1998927 - DNA, 13 bp, Homo sapiens
tacatgtgtgtat

SEQ ID NO: 1998928 - DNA, 18 bp, Homo sapiens
tacatgttcatcgtattt

SEQ ID NO: 1998929 - DNA, 15 bp, Homo sapiens
tacatgtttaaattg

SEQ ID NO: 1998930 - DNA, 17 bp, Homo sapiens
tacatgtttaaattgta

SEQ ID NO: 1998931 - DNA, 12 bp, Homo sapiens
tacatgtttgca

SEQ ID NO: 1998932 - DNA, 15 bp, Homo sapiens
tacattaaggagcag

SEQ ID NO: 1998933 - DNA, 22 bp, Homo sapiens
tacattaattattattgctgtt

SEQ ID NO: 1998934 - DNA, 19 bp, Homo sapiens
tacattccctatcaaaaca

SEQ ID NO: 1998935 - DNA, 16 bp, Homo sapiens
tacattccctggcctg

SEQ ID NO: 1998936 - DNA, 20 bp, Homo sapiens
tacattcctcagctgccaag

SEQ ID NO: 1998937 - DNA, 13 bp, Homo sapiens
tacatttaataca

SEQ ID NO: 1998938 - DNA, 13 bp, Homo sapiens
tacatttatacat

SEQ ID NO: 1998939 - DNA, 16 bp, Homo sapiens
tacatttatacatcac

SEQ ID NO: 1998940 - DNA, 14 bp, Homo sapiens
tacattttatatta

SEQ ID NO: 1998941 - DNA, 16 bp, Homo sapiens
tacattttatttatta

SEQ ID NO: 1998942 - DNA, 14 bp, Homo sapiens
tacatttttacaat

SEQ ID NO: 1998943 - DNA, 17 bp, Homo sapiens
tacatttttacaataaa

SEQ ID NO: 1998944 - DNA, 19 bp, Homo sapiens
tacatttttacaataaata

SEQ ID NO: 1998945 - DNA, 21 bp, Homo sapiens
tacatttttacaataaataat

SEQ ID NO: 1998946 - DNA, 18 bp, Homo sapiens
taccaaatagcttctgtt

SEQ ID NO: 1998947 - DNA, 14 bp, Homo sapiens
taccaaatatttta

SEQ ID NO: 1998948 - DNA, 15 bp, Homo sapiens
taccaactttctgta

SEQ ID NO: 1998949 - DNA, 17 bp, Homo sapiens
taccaagttacttgaaa

SEQ ID NO: 1998950 - DNA, 15 bp, Homo sapiens
taccaatcattttaa

SEQ ID NO: 1998951 - DNA, 20 bp, Homo sapiens
taccaatcattttaattatt

SEQ ID NO: 1998952 - DNA, 11 bp, Homo sapiens
taccaatgcat

SEQ ID NO: 1998953 - DNA, 14 bp, Homo sapiens
taccacagtgtctg

SEQ ID NO: 1998954 - DNA, 16 bp, Homo sapiens
taccaccttccctctt

SEQ ID NO: 1998955 - DNA, 17 bp, Homo sapiens
taccacgccttgacctt

SEQ ID NO: 1998956 - DNA, 12 bp, Homo sapiens
taccactggtta

SEQ ID NO: 1998957 - DNA, 14 bp, Homo sapiens
taccagagacctga

SEQ ID NO: 1998958 - DNA, 16 bp, Homo sapiens
taccagatatttgaat

SEQ ID NO: 1998959 - DNA, 15 bp, Homo sapiens
taccagatcactcaa

SEQ ID NO: 1998960 - DNA, 17 bp, Homo sapiens
taccagctcactccctg

SEQ ID NO: 1998961 - DNA, 21 bp, Homo sapiens
taccaggcaccaaaagaagta

SEQ ID NO: 1998962 - DNA, 14 bp, Homo sapiens
taccaggttgaaag

SEQ ID NO: 1998963 - DNA, 16 bp, Homo sapiens
taccaggttgaaagac

SEQ ID NO: 1998964 - DNA, 15 bp, Homo sapiens
taccagtgaaccaaa

SEQ ID NO: 1998965 - DNA, 16 bp, Homo sapiens
taccagtgaaccaaag

SEQ ID NO: 1998966 - DNA, 13 bp, Homo sapiens
taccagtgtactg

SEQ ID NO: 1998967 - DNA, 15 bp, Homo sapiens
taccagtgtactgct

SEQ ID NO: 1998968 - DNA, 19 bp, Homo sapiens
taccagtgtactgctttca

SEQ ID NO: 1998969 - DNA, 20 bp, Homo sapiens
taccataagggactgtgcca

SEQ ID NO: 1998970 - DNA, 12 bp, Homo sapiens
taccatagaaca

SEQ ID NO: 1998971 - DNA, 16 bp, Homo sapiens
taccatatacagctca

SEQ ID NO: 1998972 - DNA, 22 bp, Homo sapiens
taccatgagaagagggcctgtg

SEQ ID NO: 1998973 - DNA, 22 bp, Homo sapiens
taccatgctgctttttggcaca

SEQ ID NO: 1998974 - DNA, 14 bp, Homo sapiens
taccatgttaaaga

SEQ ID NO: 1998975 - DNA, 12 bp, Homo sapiens
taccatttcaga

SEQ ID NO: 1998976 - DNA, 21 bp, Homo sapiens
tacccaaccactcaaattaat

SEQ ID NO: 1998977 - DNA, 14 bp, Homo sapiens
tacccactctttgc

SEQ ID NO: 1998978 - DNA, 21 bp, Homo sapiens
tacccactctttgctacaata

SEQ ID NO: 1998979 - DNA, 14 bp, Homo sapiens
tacccactgctctg

SEQ ID NO: 1998980 - DNA, 15 bp, Homo sapiens
tacccagagaatata

SEQ ID NO: 1998981 - DNA, 20 bp, Homo sapiens
tacccagagaatatatacat

SEQ ID NO: 1998982 - DNA, 15 bp, Homo sapiens
tacccagagccttct

SEQ ID NO: 1998983 - DNA, 17 bp, Homo sapiens
tacccagagccttctcc

SEQ ID NO: 1998984 - DNA, 22 bp, Homo sapiens
tacccagagccttctcctgcct

SEQ ID NO: 1998985 - DNA, 16 bp, Homo sapiens
tacccagcgagccctg

SEQ ID NO: 1998986 - DNA, 13 bp, Homo sapiens
tacccagctcctt

SEQ ID NO: 1998987 - DNA, 21 bp, Homo sapiens
tacccattcgtggtgatcaat

SEQ ID NO: 1998988 - DNA, 17 bp, Homo sapiens
taccccacctcatgcct

SEQ ID NO: 1998989 - DNA, 21 bp, Homo sapiens
taccccacctcatgcctggcc

SEQ ID NO: 1998990 - DNA, 20 bp, Homo sapiens
taccccagggcctactgcca

SEQ ID NO: 1998991 - DNA, 14 bp, Homo sapiens
taccccatcccttc

SEQ ID NO: 1998992 - DNA, 15 bp, Homo sapiens
tacccccagagacct

SEQ ID NO: 1998993 - DNA, 15 bp, Homo sapiens
tacccccgtggtctt

SEQ ID NO: 1998994 - DNA, 18 bp, Homo sapiens
tacccccgtggtctttga

SEQ ID NO: 1998995 - DNA, 21 bp, Homo sapiens
tacccccgtggtctttgaata

SEQ ID NO: 1998996 - DNA, 14 bp, Homo sapiens
tacccctgcctggg

SEQ ID NO: 1998997 - DNA, 13 bp, Homo sapiens
tacccgagcccag

SEQ ID NO: 1998998 - DNA, 14 bp, Homo sapiens
tacccgagcccagc

SEQ ID NO: 1998999 - DNA, 18 bp, Homo sapiens
taccctggtaggaaagca

SEQ ID NO: 1999000 - DNA, 19 bp, Homo sapiens
tacccttccacctcctaga

SEQ ID NO: 1999001 - DNA, 20 bp, Homo sapiens
tacccttggctcaatcctct

SEQ ID NO: 1999002 - DNA, 16 bp, Homo sapiens
taccctttatctctgt

SEQ ID NO: 1999003 - DNA, 22 bp, Homo sapiens
taccgacctgtctccctggggt

SEQ ID NO: 1999004 - DNA, 21 bp, Homo sapiens
taccgagtctcttctccactg

SEQ ID NO: 1999005 - DNA, 13 bp, Homo sapiens
taccgctggggaa

SEQ ID NO: 1999006 - DNA, 16 bp, Homo sapiens
taccgctggggaacag

SEQ ID NO: 1999007 - DNA, 22 bp, Homo sapiens
tagccaagttatattgaatata

SEQ ID NO: 1999008 - DNA, 16 bp, Homo sapiens
tagccacctcccaccc

SEQ ID NO: 1999009 - DNA, 21 bp, Homo sapiens
tagccactttggtcccgtgca

SEQ ID NO: 1999010 - DNA, 17 bp, Homo sapiens
tagccagagaggagcac

SEQ ID NO: 1999011 - DNA, 18 bp, Homo sapiens
tagccagagaggagcacc

SEQ ID NO: 1999012 - DNA, 23 bp, Homo sapiens
tagccagccggggcgagtggcac

SEQ ID NO: 1999013 - DNA, 21 bp, Homo sapiens
tagccatccttggcctggcgc

SEQ ID NO: 1999014 - DNA, 18 bp, Homo sapiens
tagccatggctcaggcaa

SEQ ID NO: 1999015 - DNA, 23 bp, Homo sapiens
tagccatggctcaggcaagcccc

SEQ ID NO: 1999016 - DNA, 15 bp, Homo sapiens
tagcccaagaggtct

SEQ ID NO: 1999017 - DNA, 20 bp, Homo sapiens
tagcccaagaggtctgagcc

SEQ ID NO: 1999018 - DNA, 13 bp, Homo sapiens
tagccccagtgac

SEQ ID NO: 1999019 - DNA, 13 bp, Homo sapiens
tagccccataatt

SEQ ID NO: 1999020 - DNA, 23 bp, Homo sapiens
tagcccgacagttctgaactgga

SEQ ID NO: 1999021 - DNA, 15 bp, Homo sapiens
tagccgagagcctgc

SEQ ID NO: 1999022 - DNA, 18 bp, Homo sapiens
tagccgagagcctgctcc

SEQ ID NO: 1999023 - DNA, 19 bp, Homo sapiens
tagccgagagcctgctccc

SEQ ID NO: 1999024 - DNA, 19 bp, Homo sapiens
tagccgtccatggcaccag

SEQ ID NO: 1999025 - DNA, 16 bp, Homo sapiens
tagcctaggtgacaga

SEQ ID NO: 1999026 - DNA, 19 bp, Homo sapiens
tagcctcaatttctgaaca

SEQ ID NO: 1999027 - DNA, 22 bp, Homo sapiens
tagcctccgtttatgggccttg

SEQ ID NO: 1999028 - DNA, 20 bp, Homo sapiens
tagcctcgccgtctgtgaat

SEQ ID NO: 1999029 - DNA, 14 bp, Homo sapiens
tagcctgggccaga

SEQ ID NO: 1999030 - DNA, 15 bp, Homo sapiens
tagccttaaattttt

SEQ ID NO: 1999031 - DNA, 20 bp, Homo sapiens
tagccttagaagtcacacag

SEQ ID NO: 1999032 - DNA, 21 bp, Homo sapiens
tagccttagaagtcacacagt

SEQ ID NO: 1999033 - DNA, 13 bp, Homo sapiens
tagccttctctgt

SEQ ID NO: 1999034 - DNA, 15 bp, Homo sapiens
tagccttgtgccctg

SEQ ID NO: 1999035 - DNA, 14 bp, Homo sapiens
tagcctttgccctg

SEQ ID NO: 1999036 - DNA, 17 bp, Homo sapiens
tagcctttgccctgtca

SEQ ID NO: 1999037 - DNA, 14 bp, Homo sapiens
tagcgcccagttgg

SEQ ID NO: 1999038 - DNA, 17 bp, Homo sapiens
tagcgcccagttgggtg

SEQ ID NO: 1999039 - DNA, 22 bp, Homo sapiens
tagcgctgccgcaccccagagt

SEQ ID NO: 1999040 - DNA, 17 bp, Homo sapiens
tagcgctggctcaggaa

SEQ ID NO: 1999041 - DNA, 16 bp, Homo sapiens
tagcggatctcactca

SEQ ID NO: 1999042 - DNA, 16 bp, Homo sapiens
tagcgtgctcactgac

SEQ ID NO: 1999043 - DNA, 18 bp, Homo sapiens
tagcgtgggttatcagtt

SEQ ID NO: 1999044 - DNA, 15 bp, Homo sapiens
tagctaatgaaattg

SEQ ID NO: 1999045 - DNA, 20 bp, Homo sapiens
tagctacccaaaagagaaaa

SEQ ID NO: 1999046 - DNA, 21 bp, Homo sapiens
tagctacccaaaagagaaaaa

SEQ ID NO: 1999047 - DNA, 15 bp, Homo sapiens
tagctacttttcaga

SEQ ID NO: 1999048 - DNA, 20 bp, Homo sapiens
tagctagaagtgggccagga

SEQ ID NO: 1999049 - DNA, 15 bp, Homo sapiens
tagctatcagaagac

SEQ ID NO: 1999050 - DNA, 16 bp, Homo sapiens
tagctatcagaagacc

SEQ ID NO: 1999051 - DNA, 20 bp, Homo sapiens
tagctatcatttcttttcca

SEQ ID NO: 1999052 - DNA, 12 bp, Homo sapiens
tagctatgtgga

SEQ ID NO: 1999053 - DNA, 18 bp, Homo sapiens
tagctattgcatgtaaaa

SEQ ID NO: 1999054 - DNA, 18 bp, Homo sapiens
tagctattttcttacagt

SEQ ID NO: 1999055 - DNA, 11 bp, Homo sapiens
tagctattttt

SEQ ID NO: 1999056 - DNA, 17 bp, Homo sapiens
tagctatttttatggaa

SEQ ID NO: 1999057 - DNA, 16 bp, Homo sapiens
tagctcaggtgtccct

SEQ ID NO: 1999058 - DNA, 23 bp, Homo sapiens
tagctccaccctcaccaggatga

SEQ ID NO: 1999059 - DNA, 15 bp, Homo sapiens
tagctcctctgctgc

SEQ ID NO: 1999060 - DNA, 12 bp, Homo sapiens
tagctctgcctc

SEQ ID NO: 1999061 - DNA, 17 bp, Homo sapiens
tagctctgtccactctg

SEQ ID NO: 1999062 - DNA, 21 bp, Homo sapiens
tagctcttctatttaaaaaat

SEQ ID NO: 1999063 - DNA, 21 bp, Homo sapiens
tagctgacccagccccttgag

SEQ ID NO: 1999064 - DNA, 18 bp, Homo sapiens
tagctgagaggaagatga

SEQ ID NO: 1999065 - DNA, 23 bp, Homo sapiens
tagctgagaggaagatgaagaga

SEQ ID NO: 1999066 - DNA, 11 bp, Homo sapiens
tagctgagctc

SEQ ID NO: 1999067 - DNA, 21 bp, Homo sapiens
tagctgagctcacaaggcagc

SEQ ID NO: 1999068 - DNA, 16 bp, Homo sapiens
tagctgatcagaattt

SEQ ID NO: 1999069 - DNA, 14 bp, Homo sapiens
tagctgatcagttt

SEQ ID NO: 1999070 - DNA, 13 bp, Homo sapiens
tagctgccttttt

SEQ ID NO: 1999071 - DNA, 13 bp, Homo sapiens
tagctgctttaaa

SEQ ID NO: 1999072 - DNA, 16 bp, Homo sapiens
tagctggcaggacaca

SEQ ID NO: 1999073 - DNA, 22 bp, Homo sapiens
tagctggccacagtgagctgat

SEQ ID NO: 1999074 - DNA, 11 bp, Homo sapiens
tagctgggact

SEQ ID NO: 1999075 - DNA, 15 bp, Homo sapiens
tagctgggactacag

SEQ ID NO: 1999076 - DNA, 17 bp, Homo sapiens
tagctgggactacaggc

SEQ ID NO: 1999077 - DNA, 20 bp, Homo sapiens
tagctgggactacaggcacc

SEQ ID NO: 1999078 - DNA, 21 bp, Homo sapiens
tagctgggcaaacccttctct

SEQ ID NO: 1999079 - DNA, 18 bp, Homo sapiens
tagctgtaaatacatgtg

SEQ ID NO: 1999080 - DNA, 19 bp, Homo sapiens
tagctgtaaatacatgtgt

SEQ ID NO: 1999081 - DNA, 21 bp, Homo sapiens
tagctgtaaatacatgtgtgg

SEQ ID NO: 1999082 - DNA, 13 bp, Homo sapiens
tagctgtgacctg

SEQ ID NO: 1999083 - DNA, 24 bp, Homo sapiens
tagctgtgacctgctgagctctga

SEQ ID NO: 1999084 - DNA, 14 bp, Homo sapiens
tagctgtggtgagg

SEQ ID NO: 1999085 - DNA, 14 bp, Homo sapiens
tagcttaaataaat

SEQ ID NO: 1999086 - DNA, 18 bp, Homo sapiens
tagcttaaataaattcaa

SEQ ID NO: 1999087 - DNA, 19 bp, Homo sapiens
tagcttaaataaattcaaa

SEQ ID NO: 1999088 - DNA, 15 bp, Homo sapiens
tagcttacctgacac

SEQ ID NO: 1999089 - DNA, 16 bp, Homo sapiens
tagcttacctgacaca

SEQ ID NO: 1999090 - DNA, 15 bp, Homo sapiens
tagcttagacctcag

SEQ ID NO: 1999091 - DNA, 16 bp, Homo sapiens
tagcttagacctcagc

SEQ ID NO: 1999092 - DNA, 22 bp, Homo sapiens
tagcttcatgcctcagtttccc

SEQ ID NO: 1999093 - DNA, 12 bp, Homo sapiens
tagcttccatga

SEQ ID NO: 1999094 - DNA, 19 bp, Homo sapiens
tagcttgaaggatctgttt

SEQ ID NO: 1999095 - DNA, 15 bp, Homo sapiens
tagcttggaaactgg

SEQ ID NO: 1999096 - DNA, 20 bp, Homo sapiens
tagctttattttttaagtat

SEQ ID NO: 1999097 - DNA, 15 bp, Homo sapiens
tagctttccacagga

SEQ ID NO: 1999098 - DNA, 19 bp, Homo sapiens
tagctttcccaaataaact

SEQ ID NO: 1999099 - DNA, 11 bp, Homo sapiens
tagctttgctc

SEQ ID NO: 1999100 - DNA, 14 bp, Homo sapiens
tagcttttattgta

SEQ ID NO: 1999101 - DNA, 13 bp, Homo sapiens
tagcttttcaaac

SEQ ID NO: 1999102 - DNA, 24 bp, Homo sapiens
taggaaacccaaggaacaagagaa

SEQ ID NO: 1999103 - DNA, 22 bp, Homo sapiens
taggaaagcaccgcagcatgtg

SEQ ID NO: 1999104 - DNA, 23 bp, Homo sapiens
taggaaagcaccgcagcatgtgg

SEQ ID NO: 1999105 - DNA, 19 bp, Homo sapiens
taggaaagcctcactgata

SEQ ID NO: 1999106 - DNA, 21 bp, Homo sapiens
taggaaagcctcactgatata

SEQ ID NO: 1999107 - DNA, 22 bp, Homo sapiens
taggaaagcgtggttccaagaa

SEQ ID NO: 1999108 - DNA, 19 bp, Homo sapiens
taggaaataaaacctttca

SEQ ID NO: 1999109 - DNA, 22 bp, Homo sapiens
taggaacagctcttcactcagc

SEQ ID NO: 1999110 - DNA, 22 bp, Homo sapiens
taggaatcctttgagaatgtga

SEQ ID NO: 1999111 - DNA, 21 bp, Homo sapiens
taggaatgaccacgggcctca

SEQ ID NO: 1999112 - DNA, 23 bp, Homo sapiens
taggaatgaccacgggcctcagt

SEQ ID NO: 1999113 - DNA, 23 bp, Homo sapiens
taggaatgcttttattcaagaca

SEQ ID NO: 1999114 - DNA, 18 bp, Homo sapiens
taggaatgtccagactgt

SEQ ID NO: 1999115 - DNA, 21 bp, Homo sapiens
taggacatataccttctcaaa

SEQ ID NO: 1999116 - DNA, 15 bp, Homo sapiens
taggaccaatgttgt

SEQ ID NO: 1999117 - DNA, 14 bp, Homo sapiens
taggactctgaggc

SEQ ID NO: 1999118 - DNA, 17 bp, Homo sapiens
taggacttgagcctcca

SEQ ID NO: 1999119 - DNA, 18 bp, Homo sapiens
taggagaagcagcctcct

SEQ ID NO: 1999120 - DNA, 22 bp, Homo sapiens
taggagagactgaaagcagcag

SEQ ID NO: 1999121 - DNA, 18 bp, Homo sapiens
tatatttttatatttagt

SEQ ID NO: 1999122 - DNA, 20 bp, Homo sapiens
tatatttttatatttagtta

SEQ ID NO: 1999123 - DNA, 21 bp, Homo sapiens
tatcaaaacatatcaattcaa

SEQ ID NO: 1999124 - DNA, 23 bp, Homo sapiens
tatcaaacaccaacataaaaatg

SEQ ID NO: 1999125 - DNA, 14 bp, Homo sapiens
tatcaaacttgtgc

SEQ ID NO: 1999126 - DNA, 16 bp, Homo sapiens
tatcaaacttgtgctg

SEQ ID NO: 1999127 - DNA, 18 bp, Homo sapiens
tatcaaccccagacactg

SEQ ID NO: 1999128 - DNA, 19 bp, Homo sapiens
tatcaaccccagacactgg

SEQ ID NO: 1999129 - DNA, 18 bp, Homo sapiens
tatcaacctaagcaacag

SEQ ID NO: 1999130 - DNA, 16 bp, Homo sapiens
tatcaatgaagatttt

SEQ ID NO: 1999131 - DNA, 13 bp, Homo sapiens
tatcaattacagt

SEQ ID NO: 1999132 - DNA, 17 bp, Homo sapiens
tatcaattcaacacatt

SEQ ID NO: 1999133 - DNA, 14 bp, Homo sapiens
tatcacatacaatt

SEQ ID NO: 1999134 - DNA, 18 bp, Homo sapiens
tatcacatacaatttgca

SEQ ID NO: 1999135 - DNA, 22 bp, Homo sapiens
tatcacatacaatttgcactgt

SEQ ID NO: 1999136 - DNA, 21 bp, Homo sapiens
tatcacatcaagcatgcaata

SEQ ID NO: 1999137 - DNA, 14 bp, Homo sapiens
tatcacctcatggc

SEQ ID NO: 1999138 - DNA, 23 bp, Homo sapiens
tatcacgtacaccatatgcaagt

SEQ ID NO: 1999139 - DNA, 22 bp, Homo sapiens
tatcagaaaagtagaattatat

SEQ ID NO: 1999140 - DNA, 23 bp, Homo sapiens
tatcagaaaagtagaattatatc

SEQ ID NO: 1999141 - DNA, 16 bp, Homo sapiens
tatcagaatctgtgtg

SEQ ID NO: 1999142 - DNA, 13 bp, Homo sapiens
tatcagacctctg

SEQ ID NO: 1999143 - DNA, 16 bp, Homo sapiens
tatcagacctctgatc

SEQ ID NO: 1999144 - DNA, 22 bp, Homo sapiens
tatcagagctcttaatgttgct

SEQ ID NO: 1999145 - DNA, 16 bp, Homo sapiens
tatcaggcacaggcag

SEQ ID NO: 1999146 - DNA, 19 bp, Homo sapiens
tatcaggcacaggcaggaa

SEQ ID NO: 1999147 - DNA, 23 bp, Homo sapiens
tatcaggtctcccacgtgggaga

SEQ ID NO: 1999148 - DNA, 16 bp, Homo sapiens
tatcagttactcagcc

SEQ ID NO: 1999149 - DNA, 20 bp, Homo sapiens
tatcagttactcagccctgg

SEQ ID NO: 1999150 - DNA, 20 bp, Homo sapiens
tatcagtttgtcctgtagag

SEQ ID NO: 1999151 - DNA, 13 bp, Homo sapiens
tatcataaagtat

SEQ ID NO: 1999152 - DNA, 14 bp, Homo sapiens
tatcatagaaatgt

SEQ ID NO: 1999153 - DNA, 21 bp, Homo sapiens
tatcatcagcatacctttatt

SEQ ID NO: 1999154 - DNA, 17 bp, Homo sapiens
tatcatgaaacacttct

SEQ ID NO: 1999155 - DNA, 13 bp, Homo sapiens
tatcatgacatgt

SEQ ID NO: 1999156 - DNA, 12 bp, Homo sapiens
tatcatgcattc

SEQ ID NO: 1999157 - DNA, 18 bp, Homo sapiens
tatcatgcccctgtactc

SEQ ID NO: 1999158 - DNA, 21 bp, Homo sapiens
tatcatgctttaaagtgtaat

SEQ ID NO: 1999159 - DNA, 20 bp, Homo sapiens
tatcatgggaaaagaccagg

SEQ ID NO: 1999160 - DNA, 17 bp, Homo sapiens
tatccaattatgtgaca

SEQ ID NO: 1999161 - DNA, 22 bp, Homo sapiens
tatccacatccctaacatcatg

SEQ ID NO: 1999162 - DNA, 15 bp, Homo sapiens
tatccaccactttaa

SEQ ID NO: 1999163 - DNA, 19 bp, Homo sapiens
tatccagtgatgtgctgga

SEQ ID NO: 1999164 - DNA, 21 bp, Homo sapiens
tatcccccccctgtatagtta

SEQ ID NO: 1999165 - DNA, 16 bp, Homo sapiens
tatcctaaacatcatt

SEQ ID NO: 1999166 - DNA, 19 bp, Homo sapiens
tatcctacaacaagagttt

SEQ ID NO: 1999167 - DNA, 17 bp, Homo sapiens
tatcctgaaatttcaga

SEQ ID NO: 1999168 - DNA, 19 bp, Homo sapiens
tatcctgctagctgtagaa

SEQ ID NO: 1999169 - DNA, 20 bp, Homo sapiens
tatcctgctagctgtagaaa

SEQ ID NO: 1999170 - DNA, 18 bp, Homo sapiens
tatcctgttaggggaaaa

SEQ ID NO: 1999171 - DNA, 22 bp, Homo sapiens
tatcctttgtggcaccttttct

SEQ ID NO: 1999172 - DNA, 20 bp, Homo sapiens
tatcgcaccactgtgtattt

SEQ ID NO: 1999173 - DNA, 14 bp, Homo sapiens
tatcggaagcagtg

SEQ ID NO: 1999174 - DNA, 15 bp, Homo sapiens
tatcgggagcagtgt

SEQ ID NO: 1999175 - DNA, 18 bp, Homo sapiens
tatcgggagcagtgtctt

SEQ ID NO: 1999176 - DNA, 22 bp, Homo sapiens
tatctaaaagaatttaaattct

SEQ ID NO: 1999177 - DNA, 20 bp, Homo sapiens
tatctaagttaatttaaagt

SEQ ID NO: 1999178 - DNA, 15 bp, Homo sapiens
tatctaatttataca

SEQ ID NO: 1999179 - DNA, 17 bp, Homo sapiens
tatctaatttatacaaa

SEQ ID NO: 1999180 - DNA, 16 bp, Homo sapiens
tatctacccagaatta

SEQ ID NO: 1999181 - DNA, 20 bp, Homo sapiens
tatctacctgccctctctca

SEQ ID NO: 1999182 - DNA, 21 bp, Homo sapiens
tatctacctgccctctctcag

SEQ ID NO: 1999183 - DNA, 12 bp, Homo sapiens
tatctagaaaga

SEQ ID NO: 1999184 - DNA, 11 bp, Homo sapiens
tatctagctct

SEQ ID NO: 1999185 - DNA, 14 bp, Homo sapiens
tatctatatctcta

SEQ ID NO: 1999186 - DNA, 16 bp, Homo sapiens
tatctatctatttgag

SEQ ID NO: 1999187 - DNA, 11 bp, Homo sapiens
tatctcatctc

SEQ ID NO: 1999188 - DNA, 16 bp, Homo sapiens
tatctccttcccctac

SEQ ID NO: 1999189 - DNA, 20 bp, Homo sapiens
tatctctatttaatatttat

SEQ ID NO: 1999190 - DNA, 13 bp, Homo sapiens
tatctctctgcct

SEQ ID NO: 1999191 - DNA, 15 bp, Homo sapiens
tatctctgaagcatg

SEQ ID NO: 1999192 - DNA, 17 bp, Homo sapiens
tatctctgaagcatgtt

SEQ ID NO: 1999193 - DNA, 23 bp, Homo sapiens
tatctctgaagcatgtttcatgt

SEQ ID NO: 1999194 - DNA, 13 bp, Homo sapiens
tatctgaacacat

SEQ ID NO: 1999195 - DNA, 21 bp, Homo sapiens
tatctgaacacatactagaaa

SEQ ID NO: 1999196 - DNA, 19 bp, Homo sapiens
tatctgaagacctaccagg

SEQ ID NO: 1999197 - DNA, 18 bp, Homo sapiens
tatctgcatttataaatg

SEQ ID NO: 1999198 - DNA, 23 bp, Homo sapiens
tatctgcatttataaatgtgtgg

SEQ ID NO: 1999199 - DNA, 12 bp, Homo sapiens
tatctgcctggc

SEQ ID NO: 1999200 - DNA, 13 bp, Homo sapiens
tatctgcctggcc

SEQ ID NO: 1999201 - DNA, 16 bp, Homo sapiens
tatctgtcacacaagg

SEQ ID NO: 1999202 - DNA, 14 bp, Homo sapiens
tatcttacttttgg

SEQ ID NO: 1999203 - DNA, 12 bp, Homo sapiens
tatcttatttat

SEQ ID NO: 1999204 - DNA, 15 bp, Homo sapiens
tatcttcctcatcag

SEQ ID NO: 1999205 - DNA, 17 bp, Homo sapiens
tatcttggactgacatt

SEQ ID NO: 1999206 - DNA, 20 bp, Homo sapiens
tatcttggactgacatttag

SEQ ID NO: 1999207 - DNA, 23 bp, Homo sapiens
tatcttggtgaatttttttttcc

SEQ ID NO: 1999208 - DNA, 17 bp, Homo sapiens
tatcttgtctctgggct

SEQ ID NO: 1999209 - DNA, 20 bp, Homo sapiens
tatctttaaaaagcagtcct

SEQ ID NO: 1999210 - DNA, 23 bp, Homo sapiens
tatctttgaatggtcttctgcca

SEQ ID NO: 1999211 - DNA, 21 bp, Homo sapiens
tatgaaaaactcttctacttt

SEQ ID NO: 1999212 - DNA, 18 bp, Homo sapiens
tatgaaaaatatgatatt

SEQ ID NO: 1999213 - DNA, 16 bp, Homo sapiens
tatgaaaacagatgcc

SEQ ID NO: 1999214 - DNA, 16 bp, Homo sapiens
tatgaaaagaataaaa

SEQ ID NO: 1999215 - DNA, 22 bp, Homo sapiens
tatgaaagatggctgtgcctct

SEQ ID NO: 1999216 - DNA, 23 bp, Homo sapiens
tatgaaagatggctgtgcctctg

SEQ ID NO: 1999217 - DNA, 21 bp, Homo sapiens
tatgaacaaagaaaaaaatat

SEQ ID NO: 1999218 - DNA, 21 bp, Homo sapiens
tatgaacatggagaggacttt

SEQ ID NO: 1999219 - DNA, 18 bp, Homo sapiens
tatgaacttgaggacaca

SEQ ID NO: 1999220 - DNA, 22 bp, Homo sapiens
tatgaacttgaggacacatgtc

SEQ ID NO: 1999221 - DNA, 23 bp, Homo sapiens
tatgaacttgaggacacatgtcc

SEQ ID NO: 1999222 - DNA, 13 bp, Homo sapiens
tatgaagaaaaaa

SEQ ID NO: 1999223 - DNA, 16 bp, Homo sapiens
tatgaagaaaaaatac

SEQ ID NO: 1999224 - DNA, 15 bp, Homo sapiens
tatgaagaagagagt

SEQ ID NO: 1999225 - DNA, 13 bp, Homo sapiens
tatgaagtaagtt

SEQ ID NO: 1999226 - DNA, 14 bp, Homo sapiens
tatgaatgttcttg

SEQ ID NO: 1999227 - DNA, 18 bp, Homo sapiens
tatgacaatcctgaagaa

SEQ ID NO: 1999228 - DNA, 15 bp, Homo sapiens
tatgacagttatact

SEQ ID NO: 1999229 - DNA, 20 bp, Homo sapiens
tatgacatcacttgtacaaa

SEQ ID NO: 1999230 - DNA, 24 bp, Homo sapiens
tatgacatcacttgtacaaaataa

SEQ ID NO: 1999231 - DNA, 13 bp, Homo sapiens
tatgacatgccac

SEQ ID NO: 1999232 - DNA, 18 bp, Homo sapiens
tatgactgctccccagcc

SEQ ID NO: 1999233 - DNA, 23 bp, Homo sapiens
tatgacttgggcacccccagcct

SEQ ID NO: 1999234 - DNA, 15 bp, Homo sapiens
tatgagagctaattt

SEQ ID NO: 1999235 - DNA, 12 bp, Homo sapiens
tcaaaaagtgtt

SEQ ID NO: 1999236 - DNA, 14 bp, Homo sapiens
tcaaaaagtgttta

SEQ ID NO: 1999237 - DNA, 13 bp, Homo sapiens
tcaaaaataaact

SEQ ID NO: 1999238 - DNA, 14 bp, Homo sapiens
tcaaaaataaacta

SEQ ID NO: 1999239 - DNA, 15 bp, Homo sapiens
tcaaaaataaactag

SEQ ID NO: 1999240 - DNA, 16 bp, Homo sapiens
tcaaaaataaactagt

SEQ ID NO: 1999241 - DNA, 18 bp, Homo sapiens
tcaaaaattacactacaa

SEQ ID NO: 1999242 - DNA, 20 bp, Homo sapiens
tcaaaaattacactacaagt

SEQ ID NO: 1999243 - DNA, 16 bp, Homo sapiens
tcaaaaattgaagaga

SEQ ID NO: 1999244 - DNA, 22 bp, Homo sapiens
tcaaaaattgtgtttagatttt

SEQ ID NO: 1999245 - DNA, 19 bp, Homo sapiens
tcaaaacagattgtttgca

SEQ ID NO: 1999246 - DNA, 12 bp, Homo sapiens
tcaaaacattgt

SEQ ID NO: 1999247 - DNA, 22 bp, Homo sapiens
tcaaaacattgtgccatgtcaa

SEQ ID NO: 1999248 - DNA, 13 bp, Homo sapiens
tcaaaagacatgt

SEQ ID NO: 1999249 - DNA, 23 bp, Homo sapiens
tcaaaaggtgcctgtgaggcagg

SEQ ID NO: 1999250 - DNA, 17 bp, Homo sapiens
tcaaaagtgatctgtcc

SEQ ID NO: 1999251 - DNA, 20 bp, Homo sapiens
tcaaaagtggattttcctga

SEQ ID NO: 1999252 - DNA, 23 bp, Homo sapiens
tcaaaataccatgccatttaaag

SEQ ID NO: 1999253 - DNA, 19 bp, Homo sapiens
tcaaaatatttgtacatag

SEQ ID NO: 1999254 - DNA, 19 bp, Homo sapiens
tcaaaatttcaaaagtgat

SEQ ID NO: 1999255 - DNA, 15 bp, Homo sapiens
tcaaaccataaactt

SEQ ID NO: 1999256 - DNA, 22 bp, Homo sapiens
tcaaaccatttaattcataatt

SEQ ID NO: 1999257 - DNA, 22 bp, Homo sapiens
tcaaactcttgacctcaggtga

SEQ ID NO: 1999258 - DNA, 16 bp, Homo sapiens
tcaaactgaagccaga

SEQ ID NO: 1999259 - DNA, 19 bp, Homo sapiens
tcaaactgacaacctgtgc

SEQ ID NO: 1999260 - DNA, 19 bp, Homo sapiens
tcaaactggggcctccctg

SEQ ID NO: 1999261 - DNA, 17 bp, Homo sapiens
tcaaacttgtgctgaga

SEQ ID NO: 1999262 - DNA, 16 bp, Homo sapiens
tcaaagaaatgctgat

SEQ ID NO: 1999263 - DNA, 21 bp, Homo sapiens
tcaaagaagtcatggcccaaa

SEQ ID NO: 1999264 - DNA, 17 bp, Homo sapiens
tcaaagacaatggaaac

SEQ ID NO: 1999265 - DNA, 17 bp, Homo sapiens
tcaaagattttacctgg

SEQ ID NO: 1999266 - DNA, 13 bp, Homo sapiens
tcaaagcaagcat

SEQ ID NO: 1999267 - DNA, 19 bp, Homo sapiens
tcaaagcaagcattcagaa

SEQ ID NO: 1999268 - DNA, 22 bp, Homo sapiens
tcaaagcaagcattcagaagaa

SEQ ID NO: 1999269 - DNA, 22 bp, Homo sapiens
tcaaagcccccacttctctcca

SEQ ID NO: 1999270 - DNA, 23 bp, Homo sapiens
tcaaagcccccacttctctccag

SEQ ID NO: 1999271 - DNA, 18 bp, Homo sapiens
tcaaagctgctttattca

SEQ ID NO: 1999272 - DNA, 20 bp, Homo sapiens
tcaaagcttgaagatcgtta

SEQ ID NO: 1999273 - DNA, 16 bp, Homo sapiens
tcaaagctttttccag

SEQ ID NO: 1999274 - DNA, 18 bp, Homo sapiens
tcaaagggcccacagtga

SEQ ID NO: 1999275 - DNA, 22 bp, Homo sapiens
tcaaagtaaaaaattaaagccc

SEQ ID NO: 1999276 - DNA, 14 bp, Homo sapiens
tcaaagttcctgtt

SEQ ID NO: 1999277 - DNA, 16 bp, Homo sapiens
tcaaagttgtagttct

SEQ ID NO: 1999278 - DNA, 23 bp, Homo sapiens
tcaaagttgtagttcttgtgcat

SEQ ID NO: 1999279 - DNA, 15 bp, Homo sapiens
tcaaatatctcagag

SEQ ID NO: 1999280 - DNA, 16 bp, Homo sapiens
tcaaatatgcaaagca

SEQ ID NO: 1999281 - DNA, 18 bp, Homo sapiens
tcaaatatgcaaagcact

SEQ ID NO: 1999282 - DNA, 19 bp, Homo sapiens
tcaaatatgcaaagcactg

SEQ ID NO: 1999283 - DNA, 20 bp, Homo sapiens
tcaaatcaagaaacttaagg

SEQ ID NO: 1999284 - DNA, 15 bp, Homo sapiens
tcaaatccatccaga

SEQ ID NO: 1999285 - DNA, 17 bp, Homo sapiens
tcaaatccttgagcact

SEQ ID NO: 1999286 - DNA, 13 bp, Homo sapiens
tcaaatctattca

SEQ ID NO: 1999287 - DNA, 14 bp, Homo sapiens
tcaaatctattcag

SEQ ID NO: 1999288 - DNA, 16 bp, Homo sapiens
tcaaatgaaggtggtt

SEQ ID NO: 1999289 - DNA, 16 bp, Homo sapiens
tcaaatgacccaaaga

SEQ ID NO: 1999290 - DNA, 17 bp, Homo sapiens
tcaaatgacccaaagac

SEQ ID NO: 1999291 - DNA, 21 bp, Homo sapiens
tcaaatgacccaaagaccaat

SEQ ID NO: 1999292 - DNA, 15 bp, Homo sapiens
tcaaatgggtgatat

SEQ ID NO: 1999293 - DNA, 16 bp, Homo sapiens
tcaaatgtcagagcta

SEQ ID NO: 1999294 - DNA, 21 bp, Homo sapiens
tcaaatgtcattatgtagaaa

SEQ ID NO: 1999295 - DNA, 14 bp, Homo sapiens
tcaacaaagaaata

SEQ ID NO: 1999296 - DNA, 16 bp, Homo sapiens
tcaacaaagaaatatt

SEQ ID NO: 1999297 - DNA, 14 bp, Homo sapiens
tcaacaaagcacag

SEQ ID NO: 1999298 - DNA, 23 bp, Homo sapiens
tcaacaaagcacagtgttaaatg

SEQ ID NO: 1999299 - DNA, 14 bp, Homo sapiens
tcaacaattctaaa

SEQ ID NO: 1999300 - DNA, 17 bp, Homo sapiens
tcaacaattctaaaatg

SEQ ID NO: 1999301 - DNA, 16 bp, Homo sapiens
tcaacactcttcttga

SEQ ID NO: 1999302 - DNA, 23 bp, Homo sapiens
tcaacacttaagggttttagaaa

SEQ ID NO: 1999303 - DNA, 12 bp, Homo sapiens
tcaacagagaag

SEQ ID NO: 1999304 - DNA, 17 bp, Homo sapiens
tcaacagagaaggcagg

SEQ ID NO: 1999305 - DNA, 19 bp, Homo sapiens
tcaacagagaaggcaggaa

SEQ ID NO: 1999306 - DNA, 15 bp, Homo sapiens
tcaacatcttctctc

SEQ ID NO: 1999307 - DNA, 20 bp, Homo sapiens
tcaacatctttttcctccct

SEQ ID NO: 1999308 - DNA, 19 bp, Homo sapiens
tcaacattcaaagcagcag

SEQ ID NO: 1999309 - DNA, 15 bp, Homo sapiens
tcaaccaatgtagaa

SEQ ID NO: 1999310 - DNA, 13 bp, Homo sapiens
tcaaccactgtgg

SEQ ID NO: 1999311 - DNA, 14 bp, Homo sapiens
tcaaccactgtggc

SEQ ID NO: 1999312 - DNA, 16 bp, Homo sapiens
tcaaccccagacactg

SEQ ID NO: 1999313 - DNA, 17 bp, Homo sapiens
tcaaccccagacactgg

SEQ ID NO: 1999314 - DNA, 18 bp, Homo sapiens
tcaacccccatttctatt

SEQ ID NO: 1999315 - DNA, 18 bp, Homo sapiens
tcaaccccttcgctcctg

SEQ ID NO: 1999316 - DNA, 20 bp, Homo sapiens
tcaacctctctccttctggc

SEQ ID NO: 1999317 - DNA, 14 bp, Homo sapiens
tcaacgcagccctg

SEQ ID NO: 1999318 - DNA, 17 bp, Homo sapiens
tcaacggccctgtttat

SEQ ID NO: 1999319 - DNA, 11 bp, Homo sapiens
tcaactccaga

SEQ ID NO: 1999320 - DNA, 12 bp, Homo sapiens
tcaactccagaa

SEQ ID NO: 1999321 - DNA, 14 bp, Homo sapiens
tcaactccagctcc

SEQ ID NO: 1999322 - DNA, 23 bp, Homo sapiens
tcaactgaaaagactcagtgttc

SEQ ID NO: 1999323 - DNA, 12 bp, Homo sapiens
tcaactggctgg

SEQ ID NO: 1999324 - DNA, 16 bp, Homo sapiens
tcaactggctgggaca

SEQ ID NO: 1999325 - DNA, 20 bp, Homo sapiens
tcaacttggaaaaagaaaga

SEQ ID NO: 1999326 - DNA, 21 bp, Homo sapiens
tcaacttggaaaaagaaagaa

SEQ ID NO: 1999327 - DNA, 18 bp, Homo sapiens
tcaagaaaaaataaatgg

SEQ ID NO: 1999328 - DNA, 18 bp, Homo sapiens
tcaagaaaaattattgta

SEQ ID NO: 1999329 - DNA, 12 bp, Homo sapiens
tcaagaaactga

SEQ ID NO: 1999330 - DNA, 13 bp, Homo sapiens
tcaagaaactgag

SEQ ID NO: 1999331 - DNA, 17 bp, Homo sapiens
tcaagaaactgaggaat

SEQ ID NO: 1999332 - DNA, 15 bp, Homo sapiens
tcaagaatcctctgg

SEQ ID NO: 1999333 - DNA, 13 bp, Homo sapiens
tcaagacttgata

SEQ ID NO: 1999334 - DNA, 15 bp, Homo sapiens
tcaagagaagaaaaa

SEQ ID NO: 1999335 - DNA, 23 bp, Homo sapiens
tcaagagaagaaaaaattaagag

SEQ ID NO: 1999336 - DNA, 15 bp, Homo sapiens
tcaagagactgagtc

SEQ ID NO: 1999337 - DNA, 17 bp, Homo sapiens
tcaagaggcccagggag

SEQ ID NO: 1999338 - DNA, 12 bp, Homo sapiens
tcaagaggctga

SEQ ID NO: 1999339 - DNA, 16 bp, Homo sapiens
tcaagatgacagctct

SEQ ID NO: 1999340 - DNA, 19 bp, Homo sapiens
tcaagattttttttgtaac

SEQ ID NO: 1999341 - DNA, 20 bp, Homo sapiens
tcaagattttttttgtaact

SEQ ID NO: 1999342 - DNA, 16 bp, Homo sapiens
tcaagcacctgcagat

SEQ ID NO: 1999343 - DNA, 18 bp, Homo sapiens
tcaagcactaaaaagtgg

SEQ ID NO: 1999344 - DNA, 14 bp, Homo sapiens
tcaagcctgtggga

SEQ ID NO: 1999345 - DNA, 19 bp, Homo sapiens
tcaagcgattcttctgctt

SEQ ID NO: 1999346 - DNA, 12 bp, Homo sapiens
tcaagctgtccc

SEQ ID NO: 1999347 - DNA, 16 bp, Homo sapiens
tcaaggaccacatgtg

SEQ ID NO: 1999348 - DNA, 15 bp, Homo sapiens
tcaaggtctgctttt

SEQ ID NO: 1999349 - DNA, 20 bp, Homo sapiens
tcaaggtggccaaattattt

SEQ ID NO: 1999350 - DNA, 15 bp, Homo sapiens
tcatcactccctgga

SEQ ID NO: 1999351 - DNA, 19 bp, Homo sapiens
tcatcactccctggatgtg

SEQ ID NO: 1999352 - DNA, 17 bp, Homo sapiens
tcatcacttttcagtga

SEQ ID NO: 1999353 - DNA, 14 bp, Homo sapiens
tcatcagcatacct

SEQ ID NO: 1999354 - DNA, 14 bp, Homo sapiens
tcatcataaaataa

SEQ ID NO: 1999355 - DNA, 19 bp, Homo sapiens
tcatcataaaataaagtat

SEQ ID NO: 1999356 - DNA, 17 bp, Homo sapiens
tcatcatattgtatgta

SEQ ID NO: 1999357 - DNA, 20 bp, Homo sapiens
tcatcatattgtatgtaagt

SEQ ID NO: 1999358 - DNA, 21 bp, Homo sapiens
tcatccaccaatctctaagcc

SEQ ID NO: 1999359 - DNA, 14 bp, Homo sapiens
tcatccactgtgcc

SEQ ID NO: 1999360 - DNA, 16 bp, Homo sapiens
tcatccagttgcaata

SEQ ID NO: 1999361 - DNA, 17 bp, Homo sapiens
tcatccagttgcaataa

SEQ ID NO: 1999362 - DNA, 13 bp, Homo sapiens
tcatcccagcccc

SEQ ID NO: 1999363 - DNA, 14 bp, Homo sapiens
tcatcccagcccca

SEQ ID NO: 1999364 - DNA, 15 bp, Homo sapiens
tcatccccagtccca

SEQ ID NO: 1999365 - DNA, 18 bp, Homo sapiens
tcatcccctcgtcctgtc

SEQ ID NO: 1999366 - DNA, 18 bp, Homo sapiens
tcatccccttgtgtcaga

SEQ ID NO: 1999367 - DNA, 14 bp, Homo sapiens
tcatcccgctcctg

SEQ ID NO: 1999368 - DNA, 12 bp, Homo sapiens
tcatccctttcc

SEQ ID NO: 1999369 - DNA, 13 bp, Homo sapiens
tcatccctttcca

SEQ ID NO: 1999370 - DNA, 15 bp, Homo sapiens
tcatcctgccttcat

SEQ ID NO: 1999371 - DNA, 17 bp, Homo sapiens
tcatcctgccttcatgg

SEQ ID NO: 1999372 - DNA, 12 bp, Homo sapiens
tcatcctggcct

SEQ ID NO: 1999373 - DNA, 18 bp, Homo sapiens
tcatcgaaaattcatttc

SEQ ID NO: 1999374 - DNA, 23 bp, Homo sapiens
tcatcgattcaaactgctccaag

SEQ ID NO: 1999375 - DNA, 16 bp, Homo sapiens
tcatcggaggctgggc

SEQ ID NO: 1999376 - DNA, 17 bp, Homo sapiens
tcatctatggcagtcca

SEQ ID NO: 1999377 - DNA, 20 bp, Homo sapiens
tcatctatggcagtccagcc

SEQ ID NO: 1999378 - DNA, 23 bp, Homo sapiens
tcatctattctttccctagaggc

SEQ ID NO: 1999379 - DNA, 14 bp, Homo sapiens
tcatctatttctga

SEQ ID NO: 1999380 - DNA, 22 bp, Homo sapiens
tcatctcagtgaagaatacttc

SEQ ID NO: 1999381 - DNA, 21 bp, Homo sapiens
tcatctcatttaagggaaaaa

SEQ ID NO: 1999382 - DNA, 16 bp, Homo sapiens
tcatctctctttaata

SEQ ID NO: 1999383 - DNA, 16 bp, Homo sapiens
tcatctggggacctgg

SEQ ID NO: 1999384 - DNA, 17 bp, Homo sapiens
tcatctgtgtgaaaatg

SEQ ID NO: 1999385 - DNA, 18 bp, Homo sapiens
tcatctgttatcctgcta

SEQ ID NO: 1999386 - DNA, 15 bp, Homo sapiens
tcatcttgaatattt

SEQ ID NO: 1999387 - DNA, 18 bp, Homo sapiens
tcatcttgaatatttgct

SEQ ID NO: 1999388 - DNA, 13 bp, Homo sapiens
tcatcttgacatg

SEQ ID NO: 1999389 - DNA, 11 bp, Homo sapiens
tcatgaacctc

SEQ ID NO: 1999390 - DNA, 13 bp, Homo sapiens
tcatgaagcccaa

SEQ ID NO: 1999391 - DNA, 21 bp, Homo sapiens
tcatgaatatttcaaaataaa

SEQ ID NO: 1999392 - DNA, 14 bp, Homo sapiens
tcatgacagccaga

SEQ ID NO: 1999393 - DNA, 21 bp, Homo sapiens
tcatgacatgttatatatttt

SEQ ID NO: 1999394 - DNA, 18 bp, Homo sapiens
tcatgacttttccatgta

SEQ ID NO: 1999395 - DNA, 14 bp, Homo sapiens
tcatgagagaatgg

SEQ ID NO: 1999396 - DNA, 21 bp, Homo sapiens
tcatgaggaggtcagcccatt

SEQ ID NO: 1999397 - DNA, 17 bp, Homo sapiens
tcatgataatgaacaga

SEQ ID NO: 1999398 - DNA, 14 bp, Homo sapiens
tcatgatctccctg

SEQ ID NO: 1999399 - DNA, 15 bp, Homo sapiens
tcatgatctccctgc

SEQ ID NO: 1999400 - DNA, 16 bp, Homo sapiens
tcatgatggagacttc

SEQ ID NO: 1999401 - DNA, 17 bp, Homo sapiens
tcatgatttcatttcaa

SEQ ID NO: 1999402 - DNA, 23 bp, Homo sapiens
tcatgatttcatttcaactgttt

SEQ ID NO: 1999403 - DNA, 12 bp, Homo sapiens
tcatgcattcac

SEQ ID NO: 1999404 - DNA, 17 bp, Homo sapiens
tcatgccaaagcaaaag

SEQ ID NO: 1999405 - DNA, 20 bp, Homo sapiens
tcatgccaaagcaaaagaag

SEQ ID NO: 1999406 - DNA, 15 bp, Homo sapiens
tcatgccatctgttt

SEQ ID NO: 1999407 - DNA, 14 bp, Homo sapiens
tcatgcctcagttt

SEQ ID NO: 1999408 - DNA, 13 bp, Homo sapiens
tcatgcctctgag

SEQ ID NO: 1999409 - DNA, 22 bp, Homo sapiens
tcatgcctgcctgataccctgc

SEQ ID NO: 1999410 - DNA, 23 bp, Homo sapiens
tcatgcctgcctgataccctgct

SEQ ID NO: 1999411 - DNA, 15 bp, Homo sapiens
tcatgctatctctgt

SEQ ID NO: 1999412 - DNA, 23 bp, Homo sapiens
tcatgctttaaagtgtaataata

SEQ ID NO: 1999413 - DNA, 21 bp, Homo sapiens
tcatggaccaagaatgagctg

SEQ ID NO: 1999414 - DNA, 23 bp, Homo sapiens
tcatggagtgacggtcccacact

SEQ ID NO: 1999415 - DNA, 22 bp, Homo sapiens
tcatggcagatgtaggagggac

SEQ ID NO: 1999416 - DNA, 19 bp, Homo sapiens
tcatggcgtaatgggcctg

SEQ ID NO: 1999417 - DNA, 22 bp, Homo sapiens
tcatggcgtaatgggcctgccc

SEQ ID NO: 1999418 - DNA, 17 bp, Homo sapiens
tcatgggaaaagaccag

SEQ ID NO: 1999419 - DNA, 21 bp, Homo sapiens
tcatgggaaaagaccagggct

SEQ ID NO: 1999420 - DNA, 12 bp, Homo sapiens
tcatggtcagct

SEQ ID NO: 1999421 - DNA, 19 bp, Homo sapiens
tcatgtaaacctaagcacg

SEQ ID NO: 1999422 - DNA, 15 bp, Homo sapiens
tcatgtaataaatct

SEQ ID NO: 1999423 - DNA, 14 bp, Homo sapiens
tcatgtacagcatg

SEQ ID NO: 1999424 - DNA, 14 bp, Homo sapiens
tcatgtacattggt

SEQ ID NO: 1999425 - DNA, 17 bp, Homo sapiens
tcatgtacttcctgtgt

SEQ ID NO: 1999426 - DNA, 14 bp, Homo sapiens
tcatgtcaggcctg

SEQ ID NO: 1999427 - DNA, 14 bp, Homo sapiens
tcatgtgcctggaa

SEQ ID NO: 1999428 - DNA, 19 bp, Homo sapiens
tcatgtggaatataaagat

SEQ ID NO: 1999429 - DNA, 21 bp, Homo sapiens
tcatgtggaatggattataga

SEQ ID NO: 1999430 - DNA, 15 bp, Homo sapiens
tcatgtgtgcatgtg

SEQ ID NO: 1999431 - DNA, 16 bp, Homo sapiens
tcatgtgtgcatgtga

SEQ ID NO: 1999432 - DNA, 17 bp, Homo sapiens
tcatgtgtgcatgtgag

SEQ ID NO: 1999433 - DNA, 16 bp, Homo sapiens
tcatgtgtgctgtgct

SEQ ID NO: 1999434 - DNA, 22 bp, Homo sapiens
tcatgttaccaaagcaatattt

SEQ ID NO: 1999435 - DNA, 23 bp, Homo sapiens
tcatgttaccaaagcaatatttc

SEQ ID NO: 1999436 - DNA, 18 bp, Homo sapiens
tcatgttgttcccacaca

SEQ ID NO: 1999437 - DNA, 14 bp, Homo sapiens
tcatgttttgtgac

SEQ ID NO: 1999438 - DNA, 15 bp, Homo sapiens
tcattaaagcattta

SEQ ID NO: 1999439 - DNA, 18 bp, Homo sapiens
tcattaaattggaatttt

SEQ ID NO: 1999440 - DNA, 18 bp, Homo sapiens
tcattaccaagttacttg

SEQ ID NO: 1999441 - DNA, 21 bp, Homo sapiens
tcattaccaagttacttgaaa

SEQ ID NO: 1999442 - DNA, 18 bp, Homo sapiens
tcattagctgtgattttt

SEQ ID NO: 1999443 - DNA, 20 bp, Homo sapiens
tcattaggtttccttttatt

SEQ ID NO: 1999444 - DNA, 15 bp, Homo sapiens
tcattataaacgtga

SEQ ID NO: 1999445 - DNA, 12 bp, Homo sapiens
tcattatgtaga

SEQ ID NO: 1999446 - DNA, 13 bp, Homo sapiens
tcattatgtagaa

SEQ ID NO: 1999447 - DNA, 14 bp, Homo sapiens
tcattatgtagaaa

SEQ ID NO: 1999448 - DNA, 18 bp, Homo sapiens
tcattatgtagaaatatt

SEQ ID NO: 1999449 - DNA, 16 bp, Homo sapiens
tcattcaatacaagtg

SEQ ID NO: 1999450 - DNA, 12 bp, Homo sapiens
tcattcaggaaa

SEQ ID NO: 1999451 - DNA, 21 bp, Homo sapiens
tcattcagtgagacacagagt

SEQ ID NO: 1999452 - DNA, 14 bp, Homo sapiens
tcattccccaggtg

SEQ ID NO: 1999453 - DNA, 16 bp, Homo sapiens
tcattcctgaaagaaa

SEQ ID NO: 1999454 - DNA, 15 bp, Homo sapiens
tcattccttcactca

SEQ ID NO: 1999455 - DNA, 11 bp, Homo sapiens
tcattctcttt

SEQ ID NO: 1999456 - DNA, 15 bp, Homo sapiens
tcattctgttgccca

SEQ ID NO: 1999457 - DNA, 18 bp, Homo sapiens
tcattcttgaaagctgtg

SEQ ID NO: 1999458 - DNA, 21 bp, Homo sapiens
tcattgaaatttactgtgaga

SEQ ID NO: 1999459 - DNA, 20 bp, Homo sapiens
tcattgactatcaaactgaa

SEQ ID NO: 1999460 - DNA, 21 bp, Homo sapiens
tcattgactatcaaactgaag

SEQ ID NO: 1999461 - DNA, 17 bp, Homo sapiens
tcattgactgaactgca

SEQ ID NO: 1999462 - DNA, 21 bp, Homo sapiens
tcattgactgaactgcacgtt

SEQ ID NO: 1999463 - DNA, 18 bp, Homo sapiens
tcattgagggaaaacata

SEQ ID NO: 1999464 - DNA, 18 bp, Homo sapiens
tcattgggttttatcagt

SEQ ID NO: 1999465 - DNA, 16 bp, Homo sapiens
tcccacttcactgtga

SEQ ID NO: 1999466 - DNA, 12 bp, Homo sapiens
tcccagaaatta

SEQ ID NO: 1999467 - DNA, 18 bp, Homo sapiens
tcccagaaccacactgtt

SEQ ID NO: 1999468 - DNA, 15 bp, Homo sapiens
tcccagaccacctcc

SEQ ID NO: 1999469 - DNA, 20 bp, Homo sapiens
tcccagagacaggaaaatcc

SEQ ID NO: 1999470 - DNA, 12 bp, Homo sapiens
tcccagagcagg

SEQ ID NO: 1999471 - DNA, 19 bp, Homo sapiens
tcccagagcttcccaggat

SEQ ID NO: 1999472 - DNA, 13 bp, Homo sapiens
tcccagaggcaga

SEQ ID NO: 1999473 - DNA, 19 bp, Homo sapiens
tcccagaggttatctgcct

SEQ ID NO: 1999474 - DNA, 22 bp, Homo sapiens
tcccagaggttatctgcctggc

SEQ ID NO: 1999475 - DNA, 17 bp, Homo sapiens
tcccagagtcagaggag

SEQ ID NO: 1999476 - DNA, 13 bp, Homo sapiens
tcccagcactttg

SEQ ID NO: 1999477 - DNA, 15 bp, Homo sapiens
tcccagcccaaagct

SEQ ID NO: 1999478 - DNA, 14 bp, Homo sapiens
tcccagccccaggg

SEQ ID NO: 1999479 - DNA, 15 bp, Homo sapiens
tcccagccccagggg

SEQ ID NO: 1999480 - DNA, 14 bp, Homo sapiens
tcccagccctgcca

SEQ ID NO: 1999481 - DNA, 18 bp, Homo sapiens
tcccagccctgccaggag

SEQ ID NO: 1999482 - DNA, 24 bp, Homo sapiens
tcccagcgtttagtttctagaggc

SEQ ID NO: 1999483 - DNA, 19 bp, Homo sapiens
tcccagctactcagaagcc

SEQ ID NO: 1999484 - DNA, 16 bp, Homo sapiens
tcccagctactcagga

SEQ ID NO: 1999485 - DNA, 17 bp, Homo sapiens
tcccagctacttgggag

SEQ ID NO: 1999486 - DNA, 16 bp, Homo sapiens
tcccagctctccctct

SEQ ID NO: 1999487 - DNA, 22 bp, Homo sapiens
tcccagctctccctctggccct

SEQ ID NO: 1999488 - DNA, 23 bp, Homo sapiens
tcccagctctccctctggccctg

SEQ ID NO: 1999489 - DNA, 22 bp, Homo sapiens
tcccagctgtctgtgtcagcct

SEQ ID NO: 1999490 - DNA, 11 bp, Homo sapiens
tcccaggaact

SEQ ID NO: 1999491 - DNA, 18 bp, Homo sapiens
tcccaggaatatcccaaa

SEQ ID NO: 1999492 - DNA, 12 bp, Homo sapiens
tcccaggagggg

SEQ ID NO: 1999493 - DNA, 21 bp, Homo sapiens
tcccaggaggggcctctgaaa

SEQ ID NO: 1999494 - DNA, 21 bp, Homo sapiens
tcccaggatccctcccagatc

SEQ ID NO: 1999495 - DNA, 22 bp, Homo sapiens
tcccaggccccatgacctccag

SEQ ID NO: 1999496 - DNA, 21 bp, Homo sapiens
tcccaggcgccccttccccct

SEQ ID NO: 1999497 - DNA, 15 bp, Homo sapiens
tcccaggcttcaccc

SEQ ID NO: 1999498 - DNA, 16 bp, Homo sapiens
tcccagggccagggcc

SEQ ID NO: 1999499 - DNA, 17 bp, Homo sapiens
tcccagggccagggccc

SEQ ID NO: 1999500 - DNA, 21 bp, Homo sapiens
tcccagggccagggccctgca

SEQ ID NO: 1999501 - DNA, 22 bp, Homo sapiens
tcccagggccagggccctgcag

SEQ ID NO: 1999502 - DNA, 18 bp, Homo sapiens
tcccaggggaccacacct

SEQ ID NO: 1999503 - DNA, 19 bp, Homo sapiens
tcccaggggctccacctgt

SEQ ID NO: 1999504 - DNA, 15 bp, Homo sapiens
tcccagttcaggagt

SEQ ID NO: 1999505 - DNA, 14 bp, Homo sapiens
tcccataagctaag

SEQ ID NO: 1999506 - DNA, 22 bp, Homo sapiens
tcccataagctaagccttatgt

SEQ ID NO: 1999507 - DNA, 17 bp, Homo sapiens
tcccatagcgctggctc

SEQ ID NO: 1999508 - DNA, 14 bp, Homo sapiens
tcccatcactggag

SEQ ID NO: 1999509 - DNA, 15 bp, Homo sapiens
tcccatccccagcga

SEQ ID NO: 1999510 - DNA, 13 bp, Homo sapiens
tcccatctgctcc

SEQ ID NO: 1999511 - DNA, 20 bp, Homo sapiens
tcccatgagcctcagcatcc

SEQ ID NO: 1999512 - DNA, 21 bp, Homo sapiens
tcccatgcacacaaacacctc

SEQ ID NO: 1999513 - DNA, 23 bp, Homo sapiens
tcccatgcacacaaacacctcct

SEQ ID NO: 1999514 - DNA, 16 bp, Homo sapiens
tcccatgctgaattat

SEQ ID NO: 1999515 - DNA, 15 bp, Homo sapiens
tcccatggccttccc

SEQ ID NO: 1999516 - DNA, 16 bp, Homo sapiens
tcccatggccttccct

SEQ ID NO: 1999517 - DNA, 21 bp, Homo sapiens
tcccatgggggtgctgcagcc

SEQ ID NO: 1999518 - DNA, 23 bp, Homo sapiens
tcccatgggggtgctgcagccag

SEQ ID NO: 1999519 - DNA, 21 bp, Homo sapiens
tcccatgtgtgactccagcct

SEQ ID NO: 1999520 - DNA, 13 bp, Homo sapiens
tcccattgccctg

SEQ ID NO: 1999521 - DNA, 12 bp, Homo sapiens
tcccatttcctt

SEQ ID NO: 1999522 - DNA, 15 bp, Homo sapiens
tcccatttccttgga

SEQ ID NO: 1999523 - DNA, 19 bp, Homo sapiens
tcccatttgtaatgtatct

SEQ ID NO: 1999524 - DNA, 21 bp, Homo sapiens
tcccattttgcaaaatttcca

SEQ ID NO: 1999525 - DNA, 21 bp, Homo sapiens
tccccaaacccatcagacagg

SEQ ID NO: 1999526 - DNA, 21 bp, Homo sapiens
tccccaatcccggtcatgctt

SEQ ID NO: 1999527 - DNA, 10 bp, Homo sapiens
tccccacaga

SEQ ID NO: 1999528 - DNA, 12 bp, Homo sapiens
tccccacagaac

SEQ ID NO: 1999529 - DNA, 13 bp, Homo sapiens
tccccacagcagg

SEQ ID NO: 1999530 - DNA, 21 bp, Homo sapiens
tccccacagtcctcacagcct

SEQ ID NO: 1999531 - DNA, 23 bp, Homo sapiens
tccccacagtcctcacagcctct

SEQ ID NO: 1999532 - DNA, 23 bp, Homo sapiens
tccccacccccgctgggggtggg

SEQ ID NO: 1999533 - DNA, 11 bp, Homo sapiens
tccccacctct

SEQ ID NO: 1999534 - DNA, 20 bp, Homo sapiens
tccccaccttcaattcctgg

SEQ ID NO: 1999535 - DNA, 22 bp, Homo sapiens
tccccaccttcaattcctgggc

SEQ ID NO: 1999536 - DNA, 13 bp, Homo sapiens
tccccaccttccc

SEQ ID NO: 1999537 - DNA, 20 bp, Homo sapiens
tccccacgagtcacctgcaa

SEQ ID NO: 1999538 - DNA, 22 bp, Homo sapiens
tccccacgagtcacctgcaagc

SEQ ID NO: 1999539 - DNA, 22 bp, Homo sapiens
tccccactccctggctctcaga

SEQ ID NO: 1999540 - DNA, 16 bp, Homo sapiens
tccccactctgctctg

SEQ ID NO: 1999541 - DNA, 17 bp, Homo sapiens
tccccagactcagctcc

SEQ ID NO: 1999542 - DNA, 21 bp, Homo sapiens
tccccagactcagctccagaa

SEQ ID NO: 1999543 - DNA, 20 bp, Homo sapiens
tccccagattgcaacaggct

SEQ ID NO: 1999544 - DNA, 20 bp, Homo sapiens
tccccagcaagtgagagctg

SEQ ID NO: 1999545 - DNA, 15 bp, Homo sapiens
tccccagccctggct

SEQ ID NO: 1999546 - DNA, 22 bp, Homo sapiens
tccccagcccttctgcctttct

SEQ ID NO: 1999547 - DNA, 18 bp, Homo sapiens
tccccagctccccaggac

SEQ ID NO: 1999548 - DNA, 14 bp, Homo sapiens
tccccaggactcac

SEQ ID NO: 1999549 - DNA, 12 bp, Homo sapiens
tccccaggccag

SEQ ID NO: 1999550 - DNA, 14 bp, Homo sapiens
tccccaggccaggc

SEQ ID NO: 1999551 - DNA, 19 bp, Homo sapiens
tccccaggccaggccacca

SEQ ID NO: 1999552 - DNA, 12 bp, Homo sapiens
tccccagggccc

SEQ ID NO: 1999553 - DNA, 14 bp, Homo sapiens
tccccagggcccct

SEQ ID NO: 1999554 - DNA, 16 bp, Homo sapiens
tccccagggcccctcc

SEQ ID NO: 1999555 - DNA, 10 bp, Homo sapiens
tccccagggg

SEQ ID NO: 1999556 - DNA, 14 bp, Homo sapiens
tccccatcatccca

SEQ ID NO: 1999557 - DNA, 19 bp, Homo sapiens
tccccattagagtcagcct

SEQ ID NO: 1999558 - DNA, 21 bp, Homo sapiens
tccccattagagtcagccttc

SEQ ID NO: 1999559 - DNA, 15 bp, Homo sapiens
tccccattagtatcc

SEQ ID NO: 1999560 - DNA, 23 bp, Homo sapiens
tcccccaaacatctggcatggct

SEQ ID NO: 1999561 - DNA, 18 bp, Homo sapiens
tcccccaccccagagttg

SEQ ID NO: 1999562 - DNA, 18 bp, Homo sapiens
tcccccaccccctcccca

SEQ ID NO: 1999563 - DNA, 22 bp, Homo sapiens
tcccccacctgacaatggcagc

SEQ ID NO: 1999564 - DNA, 15 bp, Homo sapiens
tcccccactgccaca

SEQ ID NO: 1999565 - DNA, 14 bp, Homo sapiens
tcccccagacagag

SEQ ID NO: 1999566 - DNA, 21 bp, Homo sapiens
tcccccagccctcaggccagt

SEQ ID NO: 1999567 - DNA, 18 bp, Homo sapiens
tcccccatcccccactgc

SEQ ID NO: 1999568 - DNA, 19 bp, Homo sapiens
tcccccatcccccactgcc

SEQ ID NO: 1999569 - DNA, 12 bp, Homo sapiens
tccccccactgc

SEQ ID NO: 1999570 - DNA, 19 bp, Homo sapiens
tccccccactgcaggcccc

SEQ ID NO: 1999571 - DNA, 12 bp, Homo sapiens
tccccccagccc

SEQ ID NO: 1999572 - DNA, 15 bp, Homo sapiens
tccccccagcccctc

SEQ ID NO: 1999573 - DNA, 14 bp, Homo sapiens
tcccccccagtgca

SEQ ID NO: 1999574 - DNA, 19 bp, Homo sapiens
tccccccccaacctttccc

SEQ ID NO: 1999575 - DNA, 20 bp, Homo sapiens
tcccccgacactgctgcacc

SEQ ID NO: 1999576 - DNA, 17 bp, Homo sapiens
tccccctcccagggcca

SEQ ID NO: 1999577 - DNA, 17 bp, Homo sapiens
tccccctgcctttgaaa

SEQ ID NO: 1999578 - DNA, 20 bp, Homo sapiens
tccccctgcttctcagcccc

SEQ ID NO: 1999579 - DNA, 15 bp, Homo sapiens
tccccctgggctctg

SEQ ID NO: 1999580 - DNA, 14 bp, Homo sapiens
tcctcagtcctgga

SEQ ID NO: 1999581 - DNA, 22 bp, Homo sapiens
tcctcatagtatggtggctggg

SEQ ID NO: 1999582 - DNA, 20 bp, Homo sapiens
tcctcatcagtagatggtac

SEQ ID NO: 1999583 - DNA, 13 bp, Homo sapiens
tcctcatctgcag

SEQ ID NO: 1999584 - DNA, 14 bp, Homo sapiens
tcctcatctgcaga

SEQ ID NO: 1999585 - DNA, 23 bp, Homo sapiens
tcctccaaaggaagtctaggagc

SEQ ID NO: 1999586 - DNA, 22 bp, Homo sapiens
tcctccaacgttaaaagacagt

SEQ ID NO: 1999587 - DNA, 15 bp, Homo sapiens
tcctccaagtcttca

SEQ ID NO: 1999588 - DNA, 23 bp, Homo sapiens
tcctccaattccacagtctctgg

SEQ ID NO: 1999589 - DNA, 15 bp, Homo sapiens
tcctccacagtgctg

SEQ ID NO: 1999590 - DNA, 19 bp, Homo sapiens
tcctccacagtgctgcttc

SEQ ID NO: 1999591 - DNA, 18 bp, Homo sapiens
tcctccactcactccagc

SEQ ID NO: 1999592 - DNA, 13 bp, Homo sapiens
tcctccactccac

SEQ ID NO: 1999593 - DNA, 17 bp, Homo sapiens
tcctccactccacctcc

SEQ ID NO: 1999594 - DNA, 13 bp, Homo sapiens
tcctccagacaga

SEQ ID NO: 1999595 - DNA, 18 bp, Homo sapiens
tcctccagacccctgtgg

SEQ ID NO: 1999596 - DNA, 20 bp, Homo sapiens
tcctccaggcacgtcccgga

SEQ ID NO: 1999597 - DNA, 19 bp, Homo sapiens
tcctccagggccacgtgcc

SEQ ID NO: 1999598 - DNA, 15 bp, Homo sapiens
tcctccattgctgtt

SEQ ID NO: 1999599 - DNA, 19 bp, Homo sapiens
tcctccatttcaactccag

SEQ ID NO: 1999600 - DNA, 12 bp, Homo sapiens
tcctcccacctc

SEQ ID NO: 1999601 - DNA, 13 bp, Homo sapiens
tcctcccatcccc

SEQ ID NO: 1999602 - DNA, 18 bp, Homo sapiens
tcctcccatcccctggac

SEQ ID NO: 1999603 - DNA, 23 bp, Homo sapiens
tcctcccatcccctggactggga

SEQ ID NO: 1999604 - DNA, 13 bp, Homo sapiens
tcctcccatggcc

SEQ ID NO: 1999605 - DNA, 22 bp, Homo sapiens
tcctccccaccttccccagact

SEQ ID NO: 1999606 - DNA, 22 bp, Homo sapiens
tcctccccagtctacgttctcc

SEQ ID NO: 1999607 - DNA, 20 bp, Homo sapiens
tcctcccccaccttcaagca

SEQ ID NO: 1999608 - DNA, 14 bp, Homo sapiens
tcctcccccagagc

SEQ ID NO: 1999609 - DNA, 14 bp, Homo sapiens
tcctccccctgcca

SEQ ID NO: 1999610 - DNA, 15 bp, Homo sapiens
tcctccccctgccag

SEQ ID NO: 1999611 - DNA, 17 bp, Homo sapiens
tcctccccctgccagtg

SEQ ID NO: 1999612 - DNA, 24 bp, Homo sapiens
tcctccccctgccagtgccttacc

SEQ ID NO: 1999613 - DNA, 10 bp, Homo sapiens
tcctcccctt

SEQ ID NO: 1999614 - DNA, 18 bp, Homo sapiens
tcctccccttcctgcacc

SEQ ID NO: 1999615 - DNA, 19 bp, Homo sapiens
tcctccgtccacccaggct

SEQ ID NO: 1999616 - DNA, 21 bp, Homo sapiens
tcctccgtccacccaggctgc

SEQ ID NO: 1999617 - DNA, 15 bp, Homo sapiens
tcctcctccacagtg

SEQ ID NO: 1999618 - DNA, 14 bp, Homo sapiens
tcctcctcccaact

SEQ ID NO: 1999619 - DNA, 16 bp, Homo sapiens
tcctcctctctctact

SEQ ID NO: 1999620 - DNA, 21 bp, Homo sapiens
tcctcctgaagcctctgccct

SEQ ID NO: 1999621 - DNA, 24 bp, Homo sapiens
tcctcctgaagcctctgccctgcc

SEQ ID NO: 1999622 - DNA, 13 bp, Homo sapiens
tcctcctgatggc

SEQ ID NO: 1999623 - DNA, 15 bp, Homo sapiens
tcctccttcccctgt

SEQ ID NO: 1999624 - DNA, 14 bp, Homo sapiens
tcctcgccctgggt

SEQ ID NO: 1999625 - DNA, 21 bp, Homo sapiens
tcctctaagccactcttccaa

SEQ ID NO: 1999626 - DNA, 18 bp, Homo sapiens
tcctctacttaatgagat

SEQ ID NO: 1999627 - DNA, 17 bp, Homo sapiens
tcctctccaattgtaaa

SEQ ID NO: 1999628 - DNA, 14 bp, Homo sapiens
tcctctccactgcc

SEQ ID NO: 1999629 - DNA, 17 bp, Homo sapiens
tcctctccactgccttc

SEQ ID NO: 1999630 - DNA, 18 bp, Homo sapiens
tcctctcccctctgccct

SEQ ID NO: 1999631 - DNA, 22 bp, Homo sapiens
tcctctccttgggctcctggct

SEQ ID NO: 1999632 - DNA, 23 bp, Homo sapiens
tcctctccttgggctcctggctg

SEQ ID NO: 1999633 - DNA, 16 bp, Homo sapiens
tcctctcgagcccaga

SEQ ID NO: 1999634 - DNA, 17 bp, Homo sapiens
tcctctgaggaagaagg

SEQ ID NO: 1999635 - DNA, 15 bp, Homo sapiens
tcctctgatacccag

SEQ ID NO: 1999636 - DNA, 16 bp, Homo sapiens
tcctctgattatcagg

SEQ ID NO: 1999637 - DNA, 22 bp, Homo sapiens
tcctctgccacctcccctatcc

SEQ ID NO: 1999638 - DNA, 10 bp, Homo sapiens
tcctctgcct

SEQ ID NO: 1999639 - DNA, 12 bp, Homo sapiens
tcctctgctgct

SEQ ID NO: 1999640 - DNA, 14 bp, Homo sapiens
tcctctgctgctcc

SEQ ID NO: 1999641 - DNA, 12 bp, Homo sapiens
tcctctggccca

SEQ ID NO: 1999642 - DNA, 23 bp, Homo sapiens
tcctctggggttcatctagggac

SEQ ID NO: 1999643 - DNA, 16 bp, Homo sapiens
tcctcttccccttgcc

SEQ ID NO: 1999644 - DNA, 19 bp, Homo sapiens
tcctcttccccttgccctt

SEQ ID NO: 1999645 - DNA, 19 bp, Homo sapiens
tcctcttctattttgtaaa

SEQ ID NO: 1999646 - DNA, 18 bp, Homo sapiens
tcctctttctctccttct

SEQ ID NO: 1999647 - DNA, 21 bp, Homo sapiens
tcctctttctctccttcttcc

SEQ ID NO: 1999648 - DNA, 14 bp, Homo sapiens
tcctctttgcatgg

SEQ ID NO: 1999649 - DNA, 21 bp, Homo sapiens
tcctgaaaaggtttatgaaaa

SEQ ID NO: 1999650 - DNA, 21 bp, Homo sapiens
tcctgaaagaaacagttaact

SEQ ID NO: 1999651 - DNA, 15 bp, Homo sapiens
tcctgaaatttcaga

SEQ ID NO: 1999652 - DNA, 12 bp, Homo sapiens
tcctgaagccag

SEQ ID NO: 1999653 - DNA, 13 bp, Homo sapiens
tcctgaagccaga

SEQ ID NO: 1999654 - DNA, 17 bp, Homo sapiens
tcctgaagcctctgccc

SEQ ID NO: 1999655 - DNA, 14 bp, Homo sapiens
tcctgacattaaga

SEQ ID NO: 1999656 - DNA, 14 bp, Homo sapiens
tcctgacccagtcc

SEQ ID NO: 1999657 - DNA, 15 bp, Homo sapiens
tcctgaccctcccta

SEQ ID NO: 1999658 - DNA, 18 bp, Homo sapiens
tcctgaccctccgctgca

SEQ ID NO: 1999659 - DNA, 16 bp, Homo sapiens
tcctgacctgaggctc

SEQ ID NO: 1999660 - DNA, 15 bp, Homo sapiens
tcctgacgccctgcg

SEQ ID NO: 1999661 - DNA, 14 bp, Homo sapiens
tcctgactccagtg

SEQ ID NO: 1999662 - DNA, 23 bp, Homo sapiens
tcctgactcggtcaaaatatttt

SEQ ID NO: 1999663 - DNA, 20 bp, Homo sapiens
tcctgactgacacaggccag

SEQ ID NO: 1999664 - DNA, 23 bp, Homo sapiens
tcctgagaataagaaagtttcac

SEQ ID NO: 1999665 - DNA, 15 bp, Homo sapiens
tcctgagaggtgctg

SEQ ID NO: 1999666 - DNA, 14 bp, Homo sapiens
tcctgagcactgcc

SEQ ID NO: 1999667 - DNA, 15 bp, Homo sapiens
tcctgagcactgcca

SEQ ID NO: 1999668 - DNA, 20 bp, Homo sapiens
tcctgagcactgccaggagg

SEQ ID NO: 1999669 - DNA, 21 bp, Homo sapiens
tcctgagcactgccaggaggg

SEQ ID NO: 1999670 - DNA, 22 bp, Homo sapiens
tcctgagcactgccaggaggga

SEQ ID NO: 1999671 - DNA, 23 bp, Homo sapiens
tcctgagcactgccaggagggac

SEQ ID NO: 1999672 - DNA, 13 bp, Homo sapiens
tcctgaggctgag

SEQ ID NO: 1999673 - DNA, 19 bp, Homo sapiens
tcctgagggtccccacctg

SEQ ID NO: 1999674 - DNA, 22 bp, Homo sapiens
tcctgagggtccccacctggga

SEQ ID NO: 1999675 - DNA, 18 bp, Homo sapiens
tcctgagtcttggcctgc

SEQ ID NO: 1999676 - DNA, 19 bp, Homo sapiens
tcctgataaacattaaaca

SEQ ID NO: 1999677 - DNA, 17 bp, Homo sapiens
tcctgataataattgat

SEQ ID NO: 1999678 - DNA, 18 bp, Homo sapiens
tcctgataataattgatc

SEQ ID NO: 1999679 - DNA, 19 bp, Homo sapiens
tcctgataataattgatca

SEQ ID NO: 1999680 - DNA, 23 bp, Homo sapiens
tcctgatgaaaaatatgtgcttg

SEQ ID NO: 1999681 - DNA, 13 bp, Homo sapiens
tcctgatggccaa

SEQ ID NO: 1999682 - DNA, 16 bp, Homo sapiens
tcctgatggccaagag

SEQ ID NO: 1999683 - DNA, 16 bp, Homo sapiens
tcctgatttcagggaa

SEQ ID NO: 1999684 - DNA, 15 bp, Homo sapiens
tcctgatttctctga

SEQ ID NO: 1999685 - DNA, 16 bp, Homo sapiens
tcctgatttctctgaa

SEQ ID NO: 1999686 - DNA, 17 bp, Homo sapiens
tcctgatttctctgaac

SEQ ID NO: 1999687 - DNA, 17 bp, Homo sapiens
tcctgcaaaattttata

SEQ ID NO: 1999688 - DNA, 17 bp, Homo sapiens
tcctgcaaagggaactg

SEQ ID NO: 1999689 - DNA, 21 bp, Homo sapiens
tcctgcaatctccagggctgc

SEQ ID NO: 1999690 - DNA, 13 bp, Homo sapiens
tcctgcactccag

SEQ ID NO: 1999691 - DNA, 22 bp, Homo sapiens
tcctgcagcctcctcctgacca

SEQ ID NO: 1999692 - DNA, 17 bp, Homo sapiens
tcctgcaggaacgagca

SEQ ID NO: 1999693 - DNA, 23 bp, Homo sapiens
tcctgcaggaacgagcactggcc

SEQ ID NO: 1999694 - DNA, 22 bp, Homo sapiens
tcctgccaccagtcactgtccc

SEQ ID NO: 1999695 - DNA, 16 bp, Homo sapiens
tctacctcacagaaat

SEQ ID NO: 1999696 - DNA, 13 bp, Homo sapiens
tctacctgagcat

SEQ ID NO: 1999697 - DNA, 19 bp, Homo sapiens
tctacctttttttctctcc

SEQ ID NO: 1999698 - DNA, 21 bp, Homo sapiens
tctacctttttttctctccta

SEQ ID NO: 1999699 - DNA, 15 bp, Homo sapiens
tctacgctctccttt

SEQ ID NO: 1999700 - DNA, 16 bp, Homo sapiens
tctacgtataaatatg

SEQ ID NO: 1999701 - DNA, 16 bp, Homo sapiens
tctacgttctccagcc

SEQ ID NO: 1999702 - DNA, 20 bp, Homo sapiens
tctactaaaaatacaaaaat

SEQ ID NO: 1999703 - DNA, 17 bp, Homo sapiens
tctactaaatattttat

SEQ ID NO: 1999704 - DNA, 21 bp, Homo sapiens
tctactcagaaatttttattt

SEQ ID NO: 1999705 - DNA, 23 bp, Homo sapiens
tctactggtcttgtggaattggg

SEQ ID NO: 1999706 - DNA, 21 bp, Homo sapiens
tctacttctttttctttgaga

SEQ ID NO: 1999707 - DNA, 21 bp, Homo sapiens
tctagaaaccagtatggaagg

SEQ ID NO: 1999708 - DNA, 14 bp, Homo sapiens
tctagaacacccac

SEQ ID NO: 1999709 - DNA, 21 bp, Homo sapiens
tctagaacacccactggccag

SEQ ID NO: 1999710 - DNA, 22 bp, Homo sapiens
tctagaacacccactggccagt

SEQ ID NO: 1999711 - DNA, 14 bp, Homo sapiens
tctagacactgcca

SEQ ID NO: 1999712 - DNA, 17 bp, Homo sapiens
tctagactttctcagtg

SEQ ID NO: 1999713 - DNA, 13 bp, Homo sapiens
tctagaggcctca

SEQ ID NO: 1999714 - DNA, 21 bp, Homo sapiens
tctagaggcttccttcatttc

SEQ ID NO: 1999715 - DNA, 22 bp, Homo sapiens
tctagaggtgagaccaaaggat

SEQ ID NO: 1999716 - DNA, 17 bp, Homo sapiens
tctagataggtgctttt

SEQ ID NO: 1999717 - DNA, 15 bp, Homo sapiens
tctagattgagagaa

SEQ ID NO: 1999718 - DNA, 23 bp, Homo sapiens
tctagcaactgttggataataac

SEQ ID NO: 1999719 - DNA, 20 bp, Homo sapiens
tctagccaggagtctgtgct

SEQ ID NO: 1999720 - DNA, 19 bp, Homo sapiens
tctagccgggccatgcttt

SEQ ID NO: 1999721 - DNA, 14 bp, Homo sapiens
tctagcctgggcca

SEQ ID NO: 1999722 - DNA, 16 bp, Homo sapiens
tctagctagaaatatg

SEQ ID NO: 1999723 - DNA, 16 bp, Homo sapiens
tctagctattattttc

SEQ ID NO: 1999724 - DNA, 14 bp, Homo sapiens
tctagctggcagga

SEQ ID NO: 1999725 - DNA, 15 bp, Homo sapiens
tctagctggcaggac

SEQ ID NO: 1999726 - DNA, 17 bp, Homo sapiens
tctagcttcatgcctca

SEQ ID NO: 1999727 - DNA, 19 bp, Homo sapiens
tctaggagctgtctccagg

SEQ ID NO: 1999728 - DNA, 20 bp, Homo sapiens
tctaggagtcaactggctgg

SEQ ID NO: 1999729 - DNA, 21 bp, Homo sapiens
tctaggcagttcaaagcagga

SEQ ID NO: 1999730 - DNA, 19 bp, Homo sapiens
tctaggggtcaggctccat

SEQ ID NO: 1999731 - DNA, 22 bp, Homo sapiens
tctagtacttgggagacctgta

SEQ ID NO: 1999732 - DNA, 24 bp, Homo sapiens
tctagtattccagacctgaagaat

SEQ ID NO: 1999733 - DNA, 20 bp, Homo sapiens
tctagtctcctttgcactga

SEQ ID NO: 1999734 - DNA, 14 bp, Homo sapiens
tctagtgaagatgt

SEQ ID NO: 1999735 - DNA, 19 bp, Homo sapiens
tctagtgatttcctgtata

SEQ ID NO: 1999736 - DNA, 14 bp, Homo sapiens
tctagtgccctcca

SEQ ID NO: 1999737 - DNA, 12 bp, Homo sapiens
tctagtgggaag

SEQ ID NO: 1999738 - DNA, 22 bp, Homo sapiens
tctagttctcaatcactgctcc

SEQ ID NO: 1999739 - DNA, 19 bp, Homo sapiens
tctagttgaaaataaagtg

SEQ ID NO: 1999740 - DNA, 14 bp, Homo sapiens
tctagtttcttgtg

SEQ ID NO: 1999741 - DNA, 16 bp, Homo sapiens
tctagtttctttctgt

SEQ ID NO: 1999742 - DNA, 18 bp, Homo sapiens
tctagttttttttgtaaa

SEQ ID NO: 1999743 - DNA, 16 bp, Homo sapiens
tctatagagaaaaact

SEQ ID NO: 1999744 - DNA, 19 bp, Homo sapiens
tctatagccaaaaatagct

SEQ ID NO: 1999745 - DNA, 18 bp, Homo sapiens
tctatagctcttctattt

SEQ ID NO: 1999746 - DNA, 14 bp, Homo sapiens
tctatagtagtcaa

SEQ ID NO: 1999747 - DNA, 19 bp, Homo sapiens
tctatagttattgttttat

SEQ ID NO: 1999748 - DNA, 18 bp, Homo sapiens
tctatataaggaggaaaa

SEQ ID NO: 1999749 - DNA, 15 bp, Homo sapiens
tctatatatacatgt

SEQ ID NO: 1999750 - DNA, 13 bp, Homo sapiens
tctatatgcattt

SEQ ID NO: 1999751 - DNA, 14 bp, Homo sapiens
tctatatgcattta

SEQ ID NO: 1999752 - DNA, 18 bp, Homo sapiens
tctatatgttgctgaaac

SEQ ID NO: 1999753 - DNA, 16 bp, Homo sapiens
tctatattggaatctg

SEQ ID NO: 1999754 - DNA, 21 bp, Homo sapiens
tctatcaaccccagacactgg

SEQ ID NO: 1999755 - DNA, 20 bp, Homo sapiens
tctatcaggaaaacaaatca

SEQ ID NO: 1999756 - DNA, 15 bp, Homo sapiens
tctatcccaagccaa

SEQ ID NO: 1999757 - DNA, 16 bp, Homo sapiens
tctatcctacaacaag

SEQ ID NO: 1999758 - DNA, 15 bp, Homo sapiens
tctatgcaattttta

SEQ ID NO: 1999759 - DNA, 16 bp, Homo sapiens
tctatgcaatttttaa

SEQ ID NO: 1999760 - DNA, 21 bp, Homo sapiens
tctatgcaatttttaaactag

SEQ ID NO: 1999761 - DNA, 14 bp, Homo sapiens
tctatgcattttct

SEQ ID NO: 1999762 - DNA, 14 bp, Homo sapiens
tctatggagggcag

SEQ ID NO: 1999763 - DNA, 19 bp, Homo sapiens
tctatggcagtccagccag

SEQ ID NO: 1999764 - DNA, 12 bp, Homo sapiens
tctatgggactc

SEQ ID NO: 1999765 - DNA, 17 bp, Homo sapiens
tctattaagatttccaa

SEQ ID NO: 1999766 - DNA, 20 bp, Homo sapiens
tctattagttttctttgtaa

SEQ ID NO: 1999767 - DNA, 20 bp, Homo sapiens
tctattattataaaaataat

SEQ ID NO: 1999768 - DNA, 16 bp, Homo sapiens
tctattcaaaaggaaa

SEQ ID NO: 1999769 - DNA, 16 bp, Homo sapiens
tctattcagacaagca

SEQ ID NO: 1999770 - DNA, 15 bp, Homo sapiens
tctattcctgaccct

SEQ ID NO: 1999771 - DNA, 19 bp, Homo sapiens
tctattctctcctcagact

SEQ ID NO: 1999772 - DNA, 16 bp, Homo sapiens
tctattctgagccttg

SEQ ID NO: 1999773 - DNA, 13 bp, Homo sapiens
tctattgaaaaat

SEQ ID NO: 1999774 - DNA, 17 bp, Homo sapiens
tctattgtagcatttct

SEQ ID NO: 1999775 - DNA, 18 bp, Homo sapiens
tctattgtagcatttctt

SEQ ID NO: 1999776 - DNA, 20 bp, Homo sapiens
tctattgtagcatttcttga

SEQ ID NO: 1999777 - DNA, 14 bp, Homo sapiens
tctattgtgcctat

SEQ ID NO: 1999778 - DNA, 13 bp, Homo sapiens
tctattgtttgtt

SEQ ID NO: 1999779 - DNA, 12 bp, Homo sapiens
tctatttaatat

SEQ ID NO: 1999780 - DNA, 13 bp, Homo sapiens
tctatttaatatt

SEQ ID NO: 1999781 - DNA, 15 bp, Homo sapiens
tctatttatttactg

SEQ ID NO: 1999782 - DNA, 12 bp, Homo sapiens
tctatttctgag

SEQ ID NO: 1999783 - DNA, 15 bp, Homo sapiens
tctatttctgagaag

SEQ ID NO: 1999784 - DNA, 14 bp, Homo sapiens
tctatttttcttct

SEQ ID NO: 1999785 - DNA, 17 bp, Homo sapiens
tctcaaaactgcactgt

SEQ ID NO: 1999786 - DNA, 13 bp, Homo sapiens
tctcaaactcttg

SEQ ID NO: 1999787 - DNA, 16 bp, Homo sapiens
tctcaaatgctaaatg

SEQ ID NO: 1999788 - DNA, 17 bp, Homo sapiens
tctcaaattctcaacct

SEQ ID NO: 1999789 - DNA, 21 bp, Homo sapiens
tctcaacctaccaccccttcc

SEQ ID NO: 1999790 - DNA, 22 bp, Homo sapiens
tctcaacctaccaccccttcct

SEQ ID NO: 1999791 - DNA, 23 bp, Homo sapiens
tctcaacctaccaccccttcctg

SEQ ID NO: 1999792 - DNA, 12 bp, Homo sapiens
tctcaagactga

SEQ ID NO: 1999793 - DNA, 15 bp, Homo sapiens
tctcaagagccctgt

SEQ ID NO: 1999794 - DNA, 17 bp, Homo sapiens
tctcaagagggcactgg

SEQ ID NO: 1999795 - DNA, 18 bp, Homo sapiens
tctcaagagggcactggt

SEQ ID NO: 1999796 - DNA, 19 bp, Homo sapiens
tctcaagagggcactggtg

SEQ ID NO: 1999797 - DNA, 21 bp, Homo sapiens
tctcaagcactaaaaagtggc

SEQ ID NO: 1999798 - DNA, 23 bp, Homo sapiens
tctcaagggtaccaatcctggca

SEQ ID NO: 1999799 - DNA, 17 bp, Homo sapiens
tctcaatattcaataaa

SEQ ID NO: 1999800 - DNA, 20 bp, Homo sapiens
tctcaatattcaataaagct

SEQ ID NO: 1999801 - DNA, 13 bp, Homo sapiens
tctcaatcagtgc

SEQ ID NO: 1999802 - DNA, 12 bp, Homo sapiens
tctcacacacat

SEQ ID NO: 1999803 - DNA, 17 bp, Homo sapiens
tctcaccagctgctgct

SEQ ID NO: 1999804 - DNA, 13 bp, Homo sapiens
tctcactaaactt

SEQ ID NO: 1999805 - DNA, 17 bp, Homo sapiens
tctcactaaactttacc

SEQ ID NO: 1999806 - DNA, 14 bp, Homo sapiens
tctcactaaatctt

SEQ ID NO: 1999807 - DNA, 17 bp, Homo sapiens
tctcactatgttgccca

SEQ ID NO: 1999808 - DNA, 19 bp, Homo sapiens
tctcactatgttgcccagg

SEQ ID NO: 1999809 - DNA, 13 bp, Homo sapiens
tctcactccacca

SEQ ID NO: 1999810 - DNA, 14 bp, Homo sapiens
tctgcatcagctgc

SEQ ID NO: 1999811 - DNA, 17 bp, Homo sapiens
tctgcattcaggatcaa

SEQ ID NO: 1999812 - DNA, 20 bp, Homo sapiens
tctgcattgttattgtggaa

SEQ ID NO: 1999813 - DNA, 23 bp, Homo sapiens
tctgcattgttattgtggaagat

SEQ ID NO: 1999814 - DNA, 17 bp, Homo sapiens
tctgcatttataaatgt

SEQ ID NO: 1999815 - DNA, 13 bp, Homo sapiens
tctgccacagaga

SEQ ID NO: 1999816 - DNA, 17 bp, Homo sapiens
tctgccaccatcctgct

SEQ ID NO: 1999817 - DNA, 15 bp, Homo sapiens
tctgccacctcccct

SEQ ID NO: 1999818 - DNA, 16 bp, Homo sapiens
tctgccagccagcagc

SEQ ID NO: 1999819 - DNA, 16 bp, Homo sapiens
tctgccaggcccatct

SEQ ID NO: 1999820 - DNA, 23 bp, Homo sapiens
tctgccatattctgttggccagt

SEQ ID NO: 1999821 - DNA, 16 bp, Homo sapiens
tctgccatgcccagag

SEQ ID NO: 1999822 - DNA, 17 bp, Homo sapiens
tctgccatgcccagaga

SEQ ID NO: 1999823 - DNA, 15 bp, Homo sapiens
tctgccccaagcccc

SEQ ID NO: 1999824 - DNA, 22 bp, Homo sapiens
tctgccccaagcccccaacccc

SEQ ID NO: 1999825 - DNA, 13 bp, Homo sapiens
tctgccccaaggg

SEQ ID NO: 1999826 - DNA, 16 bp, Homo sapiens
tctgccccaaggggcc

SEQ ID NO: 1999827 - DNA, 20 bp, Homo sapiens
tctgccccaaggggcccaca

SEQ ID NO: 1999828 - DNA, 16 bp, Homo sapiens
tctgccccacccacct

SEQ ID NO: 1999829 - DNA, 16 bp, Homo sapiens
tctgccccagctttat

SEQ ID NO: 1999830 - DNA, 17 bp, Homo sapiens
tctgccccagctttatc

SEQ ID NO: 1999831 - DNA, 13 bp, Homo sapiens
tctgccccagtag

SEQ ID NO: 1999832 - DNA, 23 bp, Homo sapiens
tctgccccagtagtcagaagcag

SEQ ID NO: 1999833 - DNA, 22 bp, Homo sapiens
tctgcccccgtcttctctccat

SEQ ID NO: 1999834 - DNA, 19 bp, Homo sapiens
tctgccccttctgtttcca

SEQ ID NO: 1999835 - DNA, 19 bp, Homo sapiens
tctgccctccctggcctca

SEQ ID NO: 1999836 - DNA, 14 bp, Homo sapiens
tctgccctgcctcc

SEQ ID NO: 1999837 - DNA, 13 bp, Homo sapiens
tctgccctgtata

SEQ ID NO: 1999838 - DNA, 22 bp, Homo sapiens
tctgcctctgacacacagctct

SEQ ID NO: 1999839 - DNA, 13 bp, Homo sapiens
tctgcctgcccag

SEQ ID NO: 1999840 - DNA, 14 bp, Homo sapiens
tctgcctgcccagg

SEQ ID NO: 1999841 - DNA, 15 bp, Homo sapiens
tctgcctgcccaggc

SEQ ID NO: 1999842 - DNA, 17 bp, Homo sapiens
tctgcctgcccaggccc

SEQ ID NO: 1999843 - DNA, 18 bp, Homo sapiens
tctgcctgcccaggcccc

SEQ ID NO: 1999844 - DNA, 20 bp, Homo sapiens
tctgcctgcccaggcccctg

SEQ ID NO: 1999845 - DNA, 15 bp, Homo sapiens
tctgcctgcggccca

SEQ ID NO: 1999846 - DNA, 17 bp, Homo sapiens
tctgcctggaaattctg

SEQ ID NO: 1999847 - DNA, 23 bp, Homo sapiens
tctgcctggaaattctggaactg

SEQ ID NO: 1999848 - DNA, 13 bp, Homo sapiens
tctgcctggcctg

SEQ ID NO: 1999849 - DNA, 19 bp, Homo sapiens
tctgcctgggcctgtgcag

SEQ ID NO: 1999850 - DNA, 18 bp, Homo sapiens
tctgcctgtggccttgcc

SEQ ID NO: 1999851 - DNA, 19 bp, Homo sapiens
tctgccttttttcacagcc

SEQ ID NO: 1999852 - DNA, 15 bp, Homo sapiens
tctgcggccttccac

SEQ ID NO: 1999853 - DNA, 19 bp, Homo sapiens
tctgcggtggtgccagagg

SEQ ID NO: 1999854 - DNA, 16 bp, Homo sapiens
tctgcgtcccccagcc

SEQ ID NO: 1999855 - DNA, 15 bp, Homo sapiens
tctgcgtctgtgttg

SEQ ID NO: 1999856 - DNA, 16 bp, Homo sapiens
tctgcgtgactatttt

SEQ ID NO: 1999857 - DNA, 14 bp, Homo sapiens
tctgctacctcact

SEQ ID NO: 1999858 - DNA, 17 bp, Homo sapiens
tctgctatattttcatg

SEQ ID NO: 1999859 - DNA, 18 bp, Homo sapiens
tctgctcagatagaatga

SEQ ID NO: 1999860 - DNA, 12 bp, Homo sapiens
tctgctccagag

SEQ ID NO: 1999861 - DNA, 22 bp, Homo sapiens
tctgctcctcccattcccctta

SEQ ID NO: 1999862 - DNA, 15 bp, Homo sapiens
tctgctcctctccag

SEQ ID NO: 1999863 - DNA, 16 bp, Homo sapiens
tctgctcctctccagg

SEQ ID NO: 1999864 - DNA, 17 bp, Homo sapiens
tctgctcctctccaggc

SEQ ID NO: 1999865 - DNA, 18 bp, Homo sapiens
tctgctcctctccaggca

SEQ ID NO: 1999866 - DNA, 11 bp, Homo sapiens
tctgctctgat

SEQ ID NO: 1999867 - DNA, 18 bp, Homo sapiens
tctgctcttccaaagctc

SEQ ID NO: 1999868 - DNA, 14 bp, Homo sapiens
tctgctcttgcctg

SEQ ID NO: 1999869 - DNA, 20 bp, Homo sapiens
tctgctgccccgcttcccca

SEQ ID NO: 1999870 - DNA, 23 bp, Homo sapiens
tctgctgccccgcttccccacag

SEQ ID NO: 1999871 - DNA, 14 bp, Homo sapiens
tctgctgcccctgc

SEQ ID NO: 1999872 - DNA, 15 bp, Homo sapiens
tctgctgcccctgca

SEQ ID NO: 1999873 - DNA, 16 bp, Homo sapiens
tctgctgcccctgcag

SEQ ID NO: 1999874 - DNA, 18 bp, Homo sapiens
tctgctgcccctgcagtt

SEQ ID NO: 1999875 - DNA, 15 bp, Homo sapiens
tctgcttcagcctcc

SEQ ID NO: 1999876 - DNA, 14 bp, Homo sapiens
tctgcttcagtgga

SEQ ID NO: 1999877 - DNA, 19 bp, Homo sapiens
tctgcttgtattttccata

SEQ ID NO: 1999878 - DNA, 18 bp, Homo sapiens
tctggaaaaaaaatatat

SEQ ID NO: 1999879 - DNA, 19 bp, Homo sapiens
tctggaaaaaaaatatata

SEQ ID NO: 1999880 - DNA, 14 bp, Homo sapiens
tctggaaagggcac

SEQ ID NO: 1999881 - DNA, 10 bp, Homo sapiens
tctggaaatt

SEQ ID NO: 1999882 - DNA, 13 bp, Homo sapiens
tctggaaattttg

SEQ ID NO: 1999883 - DNA, 14 bp, Homo sapiens
tctggaaattttgt

SEQ ID NO: 1999884 - DNA, 12 bp, Homo sapiens
tctggaagctga

SEQ ID NO: 1999885 - DNA, 21 bp, Homo sapiens
tctggaagctgagcaggcccg

SEQ ID NO: 1999886 - DNA, 14 bp, Homo sapiens
tctggaaggctggc

SEQ ID NO: 1999887 - DNA, 15 bp, Homo sapiens
tctggaaggctggct

SEQ ID NO: 1999888 - DNA, 20 bp, Homo sapiens
tctggaagtccccgggagcc

SEQ ID NO: 1999889 - DNA, 15 bp, Homo sapiens
tctggaatgcagtgg

SEQ ID NO: 1999890 - DNA, 16 bp, Homo sapiens
tctggaatgcagtggt

SEQ ID NO: 1999891 - DNA, 14 bp, Homo sapiens
tctggacaggcatg

SEQ ID NO: 1999892 - DNA, 15 bp, Homo sapiens
tctggagaagcagtg

SEQ ID NO: 1999893 - DNA, 20 bp, Homo sapiens
tctggagagctagaacctgg

SEQ ID NO: 1999894 - DNA, 24 bp, Homo sapiens
tctggaggctgcagagctgaccca

SEQ ID NO: 1999895 - DNA, 19 bp, Homo sapiens
tctggagtctccagtggtt

SEQ ID NO: 1999896 - DNA, 22 bp, Homo sapiens
tctggatcctgctgtggcctca

SEQ ID NO: 1999897 - DNA, 23 bp, Homo sapiens
tctggatctatctgtattttcat

SEQ ID NO: 1999898 - DNA, 14 bp, Homo sapiens
tctggatctgggac

SEQ ID NO: 1999899 - DNA, 22 bp, Homo sapiens
tctggattccagagcactgctc

SEQ ID NO: 1999900 - DNA, 21 bp, Homo sapiens
tctggatttttacaaataaag

SEQ ID NO: 1999901 - DNA, 22 bp, Homo sapiens
tctggcacacagtaggtgctca

SEQ ID NO: 1999902 - DNA, 20 bp, Homo sapiens
tctggcaccactagggtcct

SEQ ID NO: 1999903 - DNA, 12 bp, Homo sapiens
tctggcacccag

SEQ ID NO: 1999904 - DNA, 11 bp, Homo sapiens
tctggcagcca

SEQ ID NO: 1999905 - DNA, 15 bp, Homo sapiens
tctggcagccacact

SEQ ID NO: 1999906 - DNA, 21 bp, Homo sapiens
tctggcagccacacttctcag

SEQ ID NO: 1999907 - DNA, 20 bp, Homo sapiens
tctggcagggtgggatggag

SEQ ID NO: 1999908 - DNA, 10 bp, Homo sapiens
tctggccacc

SEQ ID NO: 1999909 - DNA, 11 bp, Homo sapiens
tctggccaccc

SEQ ID NO: 1999910 - DNA, 13 bp, Homo sapiens
tctggcccagcct

SEQ ID NO: 1999911 - DNA, 16 bp, Homo sapiens
tctggcctcagaccaa

SEQ ID NO: 1999912 - DNA, 13 bp, Homo sapiens
tctggctccagaa

SEQ ID NO: 1999913 - DNA, 15 bp, Homo sapiens
tctggctcctccttc

SEQ ID NO: 1999914 - DNA, 14 bp, Homo sapiens
tctggctcctgttt

SEQ ID NO: 1999915 - DNA, 21 bp, Homo sapiens
tctggctgagctgaacccatt

SEQ ID NO: 1999916 - DNA, 20 bp, Homo sapiens
tctggctgcaagggccagag

SEQ ID NO: 1999917 - DNA, 20 bp, Homo sapiens
tctggctgtacgtctggtgt

SEQ ID NO: 1999918 - DNA, 23 bp, Homo sapiens
tctggcttccagaaaaccccagc

SEQ ID NO: 1999919 - DNA, 19 bp, Homo sapiens
tctggctttgtctctagcc

SEQ ID NO: 1999920 - DNA, 23 bp, Homo sapiens
tctggctttgtctctagccgggc

SEQ ID NO: 1999921 - DNA, 12 bp, Homo sapiens
tctgggacacag

SEQ ID NO: 1999922 - DNA, 13 bp, Homo sapiens
tctgggacacagt

SEQ ID NO: 1999923 - DNA, 16 bp, Homo sapiens
tctgggaccctttcct

SEQ ID NO: 1999924 - DNA, 13 bp, Homo sapiens
tctgggaggctgg

SEQ ID NO: 1999925 - DNA, 19 bp, Homo sapiens
tctgggaggctggtctccc

SEQ ID NO: 1999926 - DNA, 14 bp, Homo sapiens
tcttggtccctggt

SEQ ID NO: 1999927 - DNA, 14 bp, Homo sapiens
tcttggtttgggga

SEQ ID NO: 1999928 - DNA, 16 bp, Homo sapiens
tcttggtttggggaga

SEQ ID NO: 1999929 - DNA, 14 bp, Homo sapiens
tcttgtacatgtgt

SEQ ID NO: 1999930 - DNA, 21 bp, Homo sapiens
tcttgtagaagatggactctg

SEQ ID NO: 1999931 - DNA, 21 bp, Homo sapiens
tcttgtatttgggccaaggtg

SEQ ID NO: 1999932 - DNA, 23 bp, Homo sapiens
tcttgtatttgggccaaggtgtt

SEQ ID NO: 1999933 - DNA, 14 bp, Homo sapiens
tcttgtattttctt

SEQ ID NO: 1999934 - DNA, 22 bp, Homo sapiens
tcttgtccacagtctcccattc

SEQ ID NO: 1999935 - DNA, 14 bp, Homo sapiens
tcttgtctccacta

SEQ ID NO: 1999936 - DNA, 13 bp, Homo sapiens
tcttgtctctggg

SEQ ID NO: 1999937 - DNA, 14 bp, Homo sapiens
tcttgtctctgggc

SEQ ID NO: 1999938 - DNA, 18 bp, Homo sapiens
tcttgtgaaaccacaggc

SEQ ID NO: 1999939 - DNA, 17 bp, Homo sapiens
tcttgtgcatgtttact

SEQ ID NO: 1999940 - DNA, 13 bp, Homo sapiens
tcttgtgcctcag

SEQ ID NO: 1999941 - DNA, 19 bp, Homo sapiens
tcttgtgctcacgctcccc

SEQ ID NO: 1999942 - DNA, 13 bp, Homo sapiens
tcttgtgtcctga

SEQ ID NO: 1999943 - DNA, 18 bp, Homo sapiens
tcttgttttttttttcca

SEQ ID NO: 1999944 - DNA, 19 bp, Homo sapiens
tctttaaaagaaagttagg

SEQ ID NO: 1999945 - DNA, 20 bp, Homo sapiens
tctttaaatcaaaagctgct

SEQ ID NO: 1999946 - DNA, 18 bp, Homo sapiens
tctttaatgtcacaggca

SEQ ID NO: 1999947 - DNA, 22 bp, Homo sapiens
tctttaatgtcacaggcaggtc

SEQ ID NO: 1999948 - DNA, 20 bp, Homo sapiens
tctttaatgttgtccaggaa

SEQ ID NO: 1999949 - DNA, 18 bp, Homo sapiens
tctttagcattgaagtgt

SEQ ID NO: 1999950 - DNA, 15 bp, Homo sapiens
tctttatttctagca

SEQ ID NO: 1999951 - DNA, 16 bp, Homo sapiens
tctttcaagtgaatct

SEQ ID NO: 1999952 - DNA, 15 bp, Homo sapiens
tctttcacaaaaaag

SEQ ID NO: 1999953 - DNA, 20 bp, Homo sapiens
tctttcaggggggttgtgag

SEQ ID NO: 1999954 - DNA, 13 bp, Homo sapiens
tctttccccacct

SEQ ID NO: 1999955 - DNA, 14 bp, Homo sapiens
tctttccccacctc

SEQ ID NO: 1999956 - DNA, 22 bp, Homo sapiens
tctttccccacctcttccttcc

SEQ ID NO: 1999957 - DNA, 16 bp, Homo sapiens
tctttcccctcagagc

SEQ ID NO: 1999958 - DNA, 18 bp, Homo sapiens
tctttcccctcagagctc

SEQ ID NO: 1999959 - DNA, 20 bp, Homo sapiens
tctttcccctcagagctctt

SEQ ID NO: 1999960 - DNA, 17 bp, Homo sapiens
tctttccctagaggcaa

SEQ ID NO: 1999961 - DNA, 17 bp, Homo sapiens
tctttccgtctccctaa

SEQ ID NO: 1999962 - DNA, 22 bp, Homo sapiens
tctttccgtctccctaaaataa

SEQ ID NO: 1999963 - DNA, 21 bp, Homo sapiens
tctttcctctccaattgtaaa

SEQ ID NO: 1999964 - DNA, 16 bp, Homo sapiens
tctttccttgtctctc

SEQ ID NO: 1999965 - DNA, 19 bp, Homo sapiens
tctttctaatgtgtgaatc

SEQ ID NO: 1999966 - DNA, 18 bp, Homo sapiens
tctttctacatagttatt

SEQ ID NO: 1999967 - DNA, 18 bp, Homo sapiens
tctttctacattctcatc

SEQ ID NO: 1999968 - DNA, 17 bp, Homo sapiens
tctttctattcataata

SEQ ID NO: 1999969 - DNA, 17 bp, Homo sapiens
tctttctccaaagttat

SEQ ID NO: 1999970 - DNA, 21 bp, Homo sapiens
tctttctccaaagttatccag

SEQ ID NO: 1999971 - DNA, 14 bp, Homo sapiens
tctttctctaaata

SEQ ID NO: 1999972 - DNA, 16 bp, Homo sapiens
tctttctgatgtcaaa

SEQ ID NO: 1999973 - DNA, 13 bp, Homo sapiens
tctttctggagtc

SEQ ID NO: 1999974 - DNA, 22 bp, Homo sapiens
tctttctttttctgtctctctt

SEQ ID NO: 1999975 - DNA, 15 bp, Homo sapiens
tctttgaaaagaaaa

SEQ ID NO: 1999976 - DNA, 16 bp, Homo sapiens
tctttgaataaagtct

SEQ ID NO: 1999977 - DNA, 19 bp, Homo sapiens
tctttgaataaagtctgag

SEQ ID NO: 1999978 - DNA, 22 bp, Homo sapiens
tctttgacgggaggcctcagtt

SEQ ID NO: 1999979 - DNA, 22 bp, Homo sapiens
tctttgagaaaggattaagata

SEQ ID NO: 1999980 - DNA, 21 bp, Homo sapiens
tctttgagagagtttatcatt

SEQ ID NO: 1999981 - DNA, 13 bp, Homo sapiens
tctttgattcaga

SEQ ID NO: 1999982 - DNA, 17 bp, Homo sapiens
tctttgcacatgtgacc

SEQ ID NO: 1999983 - DNA, 17 bp, Homo sapiens
tctttgcagacaggcaa

SEQ ID NO: 1999984 - DNA, 12 bp, Homo sapiens
tctttgcctcaa

SEQ ID NO: 1999985 - DNA, 12 bp, Homo sapiens
tctttgcctggt

SEQ ID NO: 1999986 - DNA, 14 bp, Homo sapiens
tctttgctacaata

SEQ ID NO: 1999987 - DNA, 18 bp, Homo sapiens
tctttggaaggagtgaga

SEQ ID NO: 1999988 - DNA, 24 bp, Homo sapiens
tctttggaaggagtgagatcattt

SEQ ID NO: 1999989 - DNA, 16 bp, Homo sapiens
tctttggaggaacagc

SEQ ID NO: 1999990 - DNA, 21 bp, Homo sapiens
tctttggggtcagccagggcc

SEQ ID NO: 1999991 - DNA, 17 bp, Homo sapiens
tctttgtaaaggtcaga

SEQ ID NO: 1999992 - DNA, 23 bp, Homo sapiens
tctttgtaatcgttatgtgtgta

SEQ ID NO: 1999993 - DNA, 23 bp, Homo sapiens
tctttgtgacaggaaagccctcc

SEQ ID NO: 1999994 - DNA, 19 bp, Homo sapiens
tctttgtgataacaaagag

SEQ ID NO: 1999995 - DNA, 19 bp, Homo sapiens
tctttgtgggagggtaaga

SEQ ID NO: 1999996 - DNA, 21 bp, Homo sapiens
tctttgtgggagggtaagaca

SEQ ID NO: 1999997 - DNA, 18 bp, Homo sapiens
tctttgtgtagctttgct

SEQ ID NO: 1999998 - DNA, 21 bp, Homo sapiens
tcttttaaaatgaaatgtttt

SEQ ID NO: 1999999 - DNA, 19 bp, Homo sapiens
tcttttaaagaagtaaatt

SEQ ID NO: 2000000 - DNA, 22 bp, Homo sapiens
tcttttaaagttttatatgcat

SEQ ID NO: 2000001 - DNA, 13 bp, Homo sapiens
tcttttataaaaa

SEQ ID NO: 2000002 - DNA, 19 bp, Homo sapiens
tcttttataactagtcctt

SEQ ID NO: 2000003 - DNA, 18 bp, Homo sapiens
tcttttcaattatttcaa

SEQ ID NO: 2000004 - DNA, 16 bp, Homo sapiens
tcttttcccacattca

SEQ ID NO: 2000005 - DNA, 13 bp, Homo sapiens
tcttttggccttg

SEQ ID NO: 2000006 - DNA, 14 bp, Homo sapiens
tcttttggccttgt

SEQ ID NO: 2000007 - DNA, 21 bp, Homo sapiens
tctttttaagcttatttaatt

SEQ ID NO: 2000008 - DNA, 12 bp, Homo sapiens
tctttttcagtt

SEQ ID NO: 2000009 - DNA, 15 bp, Homo sapiens
tctttttctgtctct

SEQ ID NO: 2000010 - DNA, 13 bp, Homo sapiens
tctttttgtaatt

SEQ ID NO: 2000011 - DNA, 14 bp, Homo sapiens
tgaaaaaaaagttt

SEQ ID NO: 2000012 - DNA, 19 bp, Homo sapiens
tgaaaaaaagttgctttgt

SEQ ID NO: 2000013 - DNA, 18 bp, Homo sapiens
tgaaaaaatgttctatat

SEQ ID NO: 2000014 - DNA, 17 bp, Homo sapiens
tgaaaaacacggcagct

SEQ ID NO: 2000015 - DNA, 18 bp, Homo sapiens
tgaaaaacacggcagctg

SEQ ID NO: 2000016 - DNA, 19 bp, Homo sapiens
tgaaaaacacggcagctgt

SEQ ID NO: 2000017 - DNA, 22 bp, Homo sapiens
tgaaaaacacggcagctgtagc

SEQ ID NO: 2000018 - DNA, 12 bp, Homo sapiens
tgaaaaacttcc

SEQ ID NO: 2000019 - DNA, 9 bp, Homo sapiens
tgaaaaaga

SEQ ID NO: 2000020 - DNA, 13 bp, Homo sapiens
tgaaaaagcgaaa

SEQ ID NO: 2000021 - DNA, 16 bp, Homo sapiens
tgaaaaatatgttgag

SEQ ID NO: 2000022 - DNA, 11 bp, Homo sapiens
tgaaaaatctt

SEQ ID NO: 2000023 - DNA, 15 bp, Homo sapiens
tgaaaacccagagag

SEQ ID NO: 2000024 - DNA, 16 bp, Homo sapiens
tgaaaacccagagagg

SEQ ID NO: 2000025 - DNA, 15 bp, Homo sapiens
tgaaaactgtaaata

SEQ ID NO: 2000026 - DNA, 20 bp, Homo sapiens
tgaaaactgtaaatacaaaa

SEQ ID NO: 2000027 - DNA, 18 bp, Homo sapiens
tgaaaagaataaaaattg

SEQ ID NO: 2000028 - DNA, 18 bp, Homo sapiens
tgaaaagcaattgccctg

SEQ ID NO: 2000029 - DNA, 13 bp, Homo sapiens
tgaaaataattgt

SEQ ID NO: 2000030 - DNA, 19 bp, Homo sapiens
tgaaaataatttgttgtac

SEQ ID NO: 2000031 - DNA, 18 bp, Homo sapiens
tgaaaataccatcaggcc

SEQ ID NO: 2000032 - DNA, 18 bp, Homo sapiens
tgaaaataggtatacagt

SEQ ID NO: 2000033 - DNA, 22 bp, Homo sapiens
tgaaaatatttgtatcacaaat

SEQ ID NO: 2000034 - DNA, 19 bp, Homo sapiens
tgaaaatcgtgacaacact

SEQ ID NO: 2000035 - DNA, 21 bp, Homo sapiens
tgaaaatctaatattaaaaat

SEQ ID NO: 2000036 - DNA, 20 bp, Homo sapiens
tgaaaatgaatagagagtat

SEQ ID NO: 2000037 - DNA, 16 bp, Homo sapiens
tgaaaatgagcctgta

SEQ ID NO: 2000038 - DNA, 17 bp, Homo sapiens
tgaaaatgagcctgtaa

SEQ ID NO: 2000039 - DNA, 15 bp, Homo sapiens
tgaaaatgaggagga

SEQ ID NO: 2000040 - DNA, 13 bp, Homo sapiens
tgaaaatgtactg

SEQ ID NO: 2000041 - DNA, 18 bp, Homo sapiens
tgacttggggagatggag

SEQ ID NO: 2000042 - DNA, 14 bp, Homo sapiens
tgactttaattgtg

SEQ ID NO: 2000043 - DNA, 15 bp, Homo sapiens
tgactttaattgtgt

SEQ ID NO: 2000044 - DNA, 18 bp, Homo sapiens
tgacttttccatgtatct

SEQ ID NO: 2000045 - DNA, 22 bp, Homo sapiens
tgacttttccatgtatctacct

SEQ ID NO: 2000046 - DNA, 22 bp, Homo sapiens
tgactttttctgagcttttcat

SEQ ID NO: 2000047 - DNA, 16 bp, Homo sapiens
tgagaaaaagctcctg

SEQ ID NO: 2000048 - DNA, 17 bp, Homo sapiens
tgagaaaaagctcctgt

SEQ ID NO: 2000049 - DNA, 18 bp, Homo sapiens
tgagaaaaagctcctgtc

SEQ ID NO: 2000050 - DNA, 17 bp, Homo sapiens
tgagaaacccaccagcc

SEQ ID NO: 2000051 - DNA, 23 bp, Homo sapiens
tgagaaaccttattgtacctctc

SEQ ID NO: 2000052 - DNA, 20 bp, Homo sapiens
tgagaaagactattcaaaca

SEQ ID NO: 2000053 - DNA, 11 bp, Homo sapiens
tgagaaatgtg

SEQ ID NO: 2000054 - DNA, 14 bp, Homo sapiens
tgagaaatttaaac

SEQ ID NO: 2000055 - DNA, 17 bp, Homo sapiens
tgagaaatttaaactat

SEQ ID NO: 2000056 - DNA, 20 bp, Homo sapiens
tgagaacaagtcacagctgc

SEQ ID NO: 2000057 - DNA, 23 bp, Homo sapiens
tgagaacaagtcacagctgcagc

SEQ ID NO: 2000058 - DNA, 16 bp, Homo sapiens
tgagaacctggccttc

SEQ ID NO: 2000059 - DNA, 13 bp, Homo sapiens
tgagaacttcaat

SEQ ID NO: 2000060 - DNA, 15 bp, Homo sapiens
tgagaagagggcctg

SEQ ID NO: 2000061 - DNA, 17 bp, Homo sapiens
tgagaagagggcctgtg

SEQ ID NO: 2000062 - DNA, 22 bp, Homo sapiens
tgagaaggagtcagaaactgtt

SEQ ID NO: 2000063 - DNA, 18 bp, Homo sapiens
tgagaagtgtatatagtt

SEQ ID NO: 2000064 - DNA, 18 bp, Homo sapiens
tgagaagttaagcagcct

SEQ ID NO: 2000065 - DNA, 12 bp, Homo sapiens
tgagaataattg

SEQ ID NO: 2000066 - DNA, 17 bp, Homo sapiens
tgagaataattgtgtac

SEQ ID NO: 2000067 - DNA, 17 bp, Homo sapiens
tgagaatcctgcctctc

SEQ ID NO: 2000068 - DNA, 23 bp, Homo sapiens
tgagaatctatatttaacaagat

SEQ ID NO: 2000069 - DNA, 21 bp, Homo sapiens
tgagaatgcccaactcttcat

SEQ ID NO: 2000070 - DNA, 19 bp, Homo sapiens
tgagaatttaaaaataaga

SEQ ID NO: 2000071 - DNA, 20 bp, Homo sapiens
tgagaatttggatacactct

SEQ ID NO: 2000072 - DNA, 13 bp, Homo sapiens
tgagaattttaaa

SEQ ID NO: 2000073 - DNA, 15 bp, Homo sapiens
tgagacaagccctgg

SEQ ID NO: 2000074 - DNA, 16 bp, Homo sapiens
tgagacaagccctggc

SEQ ID NO: 2000075 - DNA, 20 bp, Homo sapiens
tgagacaagccctggcaaca

SEQ ID NO: 2000076 - DNA, 21 bp, Homo sapiens
tgagaccacagagagagggga

SEQ ID NO: 2000077 - DNA, 19 bp, Homo sapiens
tgagaccacctctcaatat

SEQ ID NO: 2000078 - DNA, 13 bp, Homo sapiens
tgagaccagcctg

SEQ ID NO: 2000079 - DNA, 17 bp, Homo sapiens
tgagaccagcctgggca

SEQ ID NO: 2000080 - DNA, 15 bp, Homo sapiens
tgagaccctgtctct

SEQ ID NO: 2000081 - DNA, 12 bp, Homo sapiens
tgagacctcagc

SEQ ID NO: 2000082 - DNA, 19 bp, Homo sapiens
tgagacctcagccatgagg

SEQ ID NO: 2000083 - DNA, 12 bp, Homo sapiens
tgagactctgtc

SEQ ID NO: 2000084 - DNA, 20 bp, Homo sapiens
tgagactctgtctcaaaaaa

SEQ ID NO: 2000085 - DNA, 21 bp, Homo sapiens
tgagagaagccacgctgtcct

SEQ ID NO: 2000086 - DNA, 22 bp, Homo sapiens
tgagagaagccacgctgtcctc

SEQ ID NO: 2000087 - DNA, 17 bp, Homo sapiens
tgagagccctgctgtgg

SEQ ID NO: 2000088 - DNA, 19 bp, Homo sapiens
tgagagccctgctgtggga

SEQ ID NO: 2000089 - DNA, 20 bp, Homo sapiens
tgagagccctgctgtgggag

SEQ ID NO: 2000090 - DNA, 13 bp, Homo sapiens
tgagaggaagatg

SEQ ID NO: 2000091 - DNA, 22 bp, Homo sapiens
tgagaggaagatgaagagaagc

SEQ ID NO: 2000092 - DNA, 14 bp, Homo sapiens
tgagaggcagaagt

SEQ ID NO: 2000093 - DNA, 17 bp, Homo sapiens
tgagagggcatgcgcac

SEQ ID NO: 2000094 - DNA, 13 bp, Homo sapiens
tgagagtgtgacc

SEQ ID NO: 2000095 - DNA, 18 bp, Homo sapiens
tgagagttggctcaggca

SEQ ID NO: 2000096 - DNA, 23 bp, Homo sapiens
tgagataaccacaaccaggaaga

SEQ ID NO: 2000097 - DNA, 15 bp, Homo sapiens
tgagatatttattgt

SEQ ID NO: 2000098 - DNA, 22 bp, Homo sapiens
tgagatccaagttgaaatcaga

SEQ ID NO: 2000099 - DNA, 22 bp, Homo sapiens
tgagatctaagcctttccataa

SEQ ID NO: 2000100 - DNA, 15 bp, Homo sapiens
tgagattacagagga

SEQ ID NO: 2000101 - DNA, 23 bp, Homo sapiens
tgagatttaccagggatgtagat

SEQ ID NO: 2000102 - DNA, 21 bp, Homo sapiens
tgagatttcttttaaagaagt

SEQ ID NO: 2000103 - DNA, 19 bp, Homo sapiens
tgagatttgtatttatatt

SEQ ID NO: 2000104 - DNA, 15 bp, Homo sapiens
tgagcaaatgtggct

SEQ ID NO: 2000105 - DNA, 14 bp, Homo sapiens
tgagcaattctcct

SEQ ID NO: 2000106 - DNA, 13 bp, Homo sapiens
tgagcaccccctc

SEQ ID NO: 2000107 - DNA, 21 bp, Homo sapiens
tgagcacctgcttcatgctca

SEQ ID NO: 2000108 - DNA, 22 bp, Homo sapiens
tgagcactgccaggagggacaa

SEQ ID NO: 2000109 - DNA, 20 bp, Homo sapiens
tgagcagatctgaaaggcac

SEQ ID NO: 2000110 - DNA, 15 bp, Homo sapiens
tgagcaggattttaa

SEQ ID NO: 2000111 - DNA, 13 bp, Homo sapiens
tgagcaggcccga

SEQ ID NO: 2000112 - DNA, 18 bp, Homo sapiens
tgagcaggcccgacagag

SEQ ID NO: 2000113 - DNA, 21 bp, Homo sapiens
tgagcaggcccgacagagaga

SEQ ID NO: 2000114 - DNA, 16 bp, Homo sapiens
tgagcagggctcagcg

SEQ ID NO: 2000115 - DNA, 17 bp, Homo sapiens
tgagcagggctcagcgg

SEQ ID NO: 2000116 - DNA, 15 bp, Homo sapiens
tgagcagtcacactg

SEQ ID NO: 2000117 - DNA, 16 bp, Homo sapiens
tgagcagtcacactgt

SEQ ID NO: 2000118 - DNA, 23 bp, Homo sapiens
tgagcagtgagttacagcgagag

SEQ ID NO: 2000119 - DNA, 12 bp, Homo sapiens
tgagcatctctg

SEQ ID NO: 2000120 - DNA, 14 bp, Homo sapiens
tgagcatctctgtg

SEQ ID NO: 2000121 - DNA, 15 bp, Homo sapiens
tgagcatctctgtgt

SEQ ID NO: 2000122 - DNA, 16 bp, Homo sapiens
tgagcatctctgtgta

SEQ ID NO: 2000123 - DNA, 19 bp, Homo sapiens
tgagcatgcacagctgctt

SEQ ID NO: 2000124 - DNA, 19 bp, Homo sapiens
tgagcattagctacttttc

SEQ ID NO: 2000125 - DNA, 15 bp, Homo sapiens
tgagcattcaggcag

SEQ ID NO: 2000126 - DNA, 21 bp, Homo sapiens
tgagcattttatatccacatc

SEQ ID NO: 2000127 - DNA, 19 bp, Homo sapiens
tgagccaaacacactgtaa

SEQ ID NO: 2000128 - DNA, 21 bp, Homo sapiens
tgagccaaacacactgtaaat

SEQ ID NO: 2000129 - DNA, 22 bp, Homo sapiens
tgagccaaacacactgtaaata

SEQ ID NO: 2000130 - DNA, 23 bp, Homo sapiens
tgagccaaagagaaaagattaaa

SEQ ID NO: 2000131 - DNA, 18 bp, Homo sapiens
tgagccacagaccacctg

SEQ ID NO: 2000132 - DNA, 19 bp, Homo sapiens
tgagccacagaccacctgc

SEQ ID NO: 2000133 - DNA, 22 bp, Homo sapiens
tgagccactcgcagtcgcagga

SEQ ID NO: 2000134 - DNA, 20 bp, Homo sapiens
tgagccaggtaatgagggac

SEQ ID NO: 2000135 - DNA, 23 bp, Homo sapiens
tgagccatgatcgagccactgca

SEQ ID NO: 2000136 - DNA, 14 bp, Homo sapiens
tgagcccagccacc

SEQ ID NO: 2000137 - DNA, 12 bp, Homo sapiens
tgagcccaggag

SEQ ID NO: 2000138 - DNA, 13 bp, Homo sapiens
tgagcccaggagt

SEQ ID NO: 2000139 - DNA, 13 bp, Homo sapiens
tgagcccagggag

SEQ ID NO: 2000140 - DNA, 15 bp, Homo sapiens
tgagcccagggaggc

SEQ ID NO: 2000141 - DNA, 15 bp, Homo sapiens
tgagcccctggtcct

SEQ ID NO: 2000142 - DNA, 19 bp, Homo sapiens
tgagccgagatcacgccac

SEQ ID NO: 2000143 - DNA, 23 bp, Homo sapiens
tgagccgcatcttctccatctgg

SEQ ID NO: 2000144 - DNA, 18 bp, Homo sapiens
tgagcctcagcatcctgg

SEQ ID NO: 2000145 - DNA, 21 bp, Homo sapiens
tgagcctcagcatcctggcac

SEQ ID NO: 2000146 - DNA, 13 bp, Homo sapiens
tgagcctgccgag

SEQ ID NO: 2000147 - DNA, 22 bp, Homo sapiens
tgagcctgtcacgtggtcaagg

SEQ ID NO: 2000148 - DNA, 13 bp, Homo sapiens
tgagccttcagtc

SEQ ID NO: 2000149 - DNA, 13 bp, Homo sapiens
tgagccttgtaat

SEQ ID NO: 2000150 - DNA, 17 bp, Homo sapiens
tgagctcacaaggcagc

SEQ ID NO: 2000151 - DNA, 18 bp, Homo sapiens
tgagctcacaaggcagca

SEQ ID NO: 2000152 - DNA, 19 bp, Homo sapiens
tgagctcacaaggcagcaa

SEQ ID NO: 2000153 - DNA, 20 bp, Homo sapiens
tgagctcacaaggcagcaag

SEQ ID NO: 2000154 - DNA, 21 bp, Homo sapiens
tgagctccccaaaaacctcac

SEQ ID NO: 2000155 - DNA, 19 bp, Homo sapiens
tgcagagatttcctccatg

SEQ ID NO: 2000156 - DNA, 18 bp, Homo sapiens
tgcagagcacacaggtac

SEQ ID NO: 2000157 - DNA, 11 bp, Homo sapiens
tgcagagcctt

SEQ ID NO: 2000158 - DNA, 19 bp, Homo sapiens
tgcagagctatggtgaggt

SEQ ID NO: 2000159 - DNA, 18 bp, Homo sapiens
tgcagagctgacccagag

SEQ ID NO: 2000160 - DNA, 15 bp, Homo sapiens
tgcagaggaccacag

SEQ ID NO: 2000161 - DNA, 18 bp, Homo sapiens
tgcagaggatttaactgt

SEQ ID NO: 2000162 - DNA, 22 bp, Homo sapiens
tgcagaggggctttctggagag

SEQ ID NO: 2000163 - DNA, 15 bp, Homo sapiens
tgcagaggtgagcag

SEQ ID NO: 2000164 - DNA, 16 bp, Homo sapiens
tgcagatcatctgggg

SEQ ID NO: 2000165 - DNA, 21 bp, Homo sapiens
tgcagatctttttgtgaaatt

SEQ ID NO: 2000166 - DNA, 18 bp, Homo sapiens
tgcagatgagcagtcaca

SEQ ID NO: 2000167 - DNA, 20 bp, Homo sapiens
tgcagatgagcagtcacact

SEQ ID NO: 2000168 - DNA, 22 bp, Homo sapiens
tgcagatgagcagtcacactgt

SEQ ID NO: 2000169 - DNA, 22 bp, Homo sapiens
tgcagattattttagtctgtca

SEQ ID NO: 2000170 - DNA, 14 bp, Homo sapiens
tgcagattcctggg

SEQ ID NO: 2000171 - DNA, 17 bp, Homo sapiens
tgcagattcctgggcct

SEQ ID NO: 2000172 - DNA, 18 bp, Homo sapiens
tgcagattcctgggcctg

SEQ ID NO: 2000173 - DNA, 21 bp, Homo sapiens
tgcagattcctgggcctgtcc

SEQ ID NO: 2000174 - DNA, 13 bp, Homo sapiens
tgcagcaactccc

SEQ ID NO: 2000175 - DNA, 14 bp, Homo sapiens
tgcagcaactccca

SEQ ID NO: 2000176 - DNA, 15 bp, Homo sapiens
tgcagcaactcccac

SEQ ID NO: 2000177 - DNA, 16 bp, Homo sapiens
tgcagcaactcccacg

SEQ ID NO: 2000178 - DNA, 19 bp, Homo sapiens
tgcagcactttaaccctct

SEQ ID NO: 2000179 - DNA, 20 bp, Homo sapiens
tgcagcactttaaccctctc

SEQ ID NO: 2000180 - DNA, 13 bp, Homo sapiens
tgcagcagaagcc

SEQ ID NO: 2000181 - DNA, 17 bp, Homo sapiens
tgcagccaaacagagcc

SEQ ID NO: 2000182 - DNA, 12 bp, Homo sapiens
tgcagccagccc

SEQ ID NO: 2000183 - DNA, 13 bp, Homo sapiens
tgcagccagccca

SEQ ID NO: 2000184 - DNA, 14 bp, Homo sapiens
tgcagccagcccag

SEQ ID NO: 2000185 - DNA, 15 bp, Homo sapiens
tgcagccagcccagc

SEQ ID NO: 2000186 - DNA, 21 bp, Homo sapiens
tgcagccagcccagcccagct

SEQ ID NO: 2000187 - DNA, 23 bp, Homo sapiens
tgcagccagcccagcccagctgg

SEQ ID NO: 2000188 - DNA, 18 bp, Homo sapiens
tgcagcctcaacctcctg

SEQ ID NO: 2000189 - DNA, 19 bp, Homo sapiens
tgcagcctcaacctcctgg

SEQ ID NO: 2000190 - DNA, 21 bp, Homo sapiens
tgcagcctcaacctcctgggc

SEQ ID NO: 2000191 - DNA, 22 bp, Homo sapiens
tgcagcctcaacctcctgggct

SEQ ID NO: 2000192 - DNA, 23 bp, Homo sapiens
tgcagcctcaacctcctgggcta

SEQ ID NO: 2000193 - DNA, 15 bp, Homo sapiens
tgcagcctcccccac

SEQ ID NO: 2000194 - DNA, 16 bp, Homo sapiens
tgcagcctcctcctga

SEQ ID NO: 2000195 - DNA, 17 bp, Homo sapiens
tgcagcctcctcctgac

SEQ ID NO: 2000196 - DNA, 20 bp, Homo sapiens
tgcagctctttcttctttga

SEQ ID NO: 2000197 - DNA, 21 bp, Homo sapiens
tgcagctctttcttctttgaa

SEQ ID NO: 2000198 - DNA, 19 bp, Homo sapiens
tgcagctgcaccatcacac

SEQ ID NO: 2000199 - DNA, 20 bp, Homo sapiens
tgcagctgctgaagttctga

SEQ ID NO: 2000200 - DNA, 19 bp, Homo sapiens
tgcagctgcttgttgtcaa

SEQ ID NO: 2000201 - DNA, 20 bp, Homo sapiens
tgcagctgggccccatgctc

SEQ ID NO: 2000202 - DNA, 23 bp, Homo sapiens
tgcagctgggccccatgctctgc

SEQ ID NO: 2000203 - DNA, 18 bp, Homo sapiens
tgcagcttcctgtcaaca

SEQ ID NO: 2000204 - DNA, 14 bp, Homo sapiens
tgcagcttgtagcc

SEQ ID NO: 2000205 - DNA, 18 bp, Homo sapiens
tgcagcttgtagccagcc

SEQ ID NO: 2000206 - DNA, 20 bp, Homo sapiens
tgcagcttgtagccagccgg

SEQ ID NO: 2000207 - DNA, 21 bp, Homo sapiens
tgcagcttgtagccagccggg

SEQ ID NO: 2000208 - DNA, 15 bp, Homo sapiens
tgcaggaatcaaaaa

SEQ ID NO: 2000209 - DNA, 19 bp, Homo sapiens
tgcaggaatcaaaaattga

SEQ ID NO: 2000210 - DNA, 20 bp, Homo sapiens
tgcaggccaagagcagaggc

SEQ ID NO: 2000211 - DNA, 13 bp, Homo sapiens
tgcaggctctggg

SEQ ID NO: 2000212 - DNA, 23 bp, Homo sapiens
tgcaggctctgggctcagggctg

SEQ ID NO: 2000213 - DNA, 18 bp, Homo sapiens
tgcagggaagagggcagt

SEQ ID NO: 2000214 - DNA, 15 bp, Homo sapiens
tgcagggacaaagag

SEQ ID NO: 2000215 - DNA, 23 bp, Homo sapiens
tgcagggagcatggctgtgagga

SEQ ID NO: 2000216 - DNA, 19 bp, Homo sapiens
tgcaggtacttcctcctga

SEQ ID NO: 2000217 - DNA, 20 bp, Homo sapiens
tgcaggtacttcctcctgat

SEQ ID NO: 2000218 - DNA, 22 bp, Homo sapiens
tgcaggtacttcctcctgatgg

SEQ ID NO: 2000219 - DNA, 23 bp, Homo sapiens
tgcaggtacttcctcctgatggc

SEQ ID NO: 2000220 - DNA, 11 bp, Homo sapiens
tgcaggtgctg

SEQ ID NO: 2000221 - DNA, 14 bp, Homo sapiens
tgcagtacaggcaa

SEQ ID NO: 2000222 - DNA, 17 bp, Homo sapiens
tgcagtattgagcactg

SEQ ID NO: 2000223 - DNA, 16 bp, Homo sapiens
tgcagtattgccacaa

SEQ ID NO: 2000224 - DNA, 20 bp, Homo sapiens
tgcagtcaacagttcaaaga

SEQ ID NO: 2000225 - DNA, 22 bp, Homo sapiens
tgcagtcaacagttcaaagaag

SEQ ID NO: 2000226 - DNA, 16 bp, Homo sapiens
tgcagtcatcagaagt

SEQ ID NO: 2000227 - DNA, 15 bp, Homo sapiens
tgcagtccagaataa

SEQ ID NO: 2000228 - DNA, 17 bp, Homo sapiens
tgcagtccagaataagt

SEQ ID NO: 2000229 - DNA, 13 bp, Homo sapiens
tgcagtctcagaa

SEQ ID NO: 2000230 - DNA, 17 bp, Homo sapiens
tgcagtctcagaaagcc

SEQ ID NO: 2000231 - DNA, 22 bp, Homo sapiens
tgcagtgatacatgtactccag

SEQ ID NO: 2000232 - DNA, 23 bp, Homo sapiens
tgcagtgatggcgcgggaggcac

SEQ ID NO: 2000233 - DNA, 17 bp, Homo sapiens
tgcagtggctcacgcct

SEQ ID NO: 2000234 - DNA, 14 bp, Homo sapiens
tgcagttcctgagt

SEQ ID NO: 2000235 - DNA, 17 bp, Homo sapiens
tgcagttgacagcaggt

SEQ ID NO: 2000236 - DNA, 14 bp, Homo sapiens
tgcagttgagaggg

SEQ ID NO: 2000237 - DNA, 23 bp, Homo sapiens
tgcagttttgtaaataagtgaaa

SEQ ID NO: 2000238 - DNA, 14 bp, Homo sapiens
tgcataaacttcat

SEQ ID NO: 2000239 - DNA, 17 bp, Homo sapiens
tgcataaacttcatctt

SEQ ID NO: 2000240 - DNA, 18 bp, Homo sapiens
tgcataagattaaaggaa

SEQ ID NO: 2000241 - DNA, 23 bp, Homo sapiens
tgcataatcagcgccctggagtc

SEQ ID NO: 2000242 - DNA, 20 bp, Homo sapiens
tgcatagattccctgagcag

SEQ ID NO: 2000243 - DNA, 19 bp, Homo sapiens
tgcatagtgctaagaaagc

SEQ ID NO: 2000244 - DNA, 20 bp, Homo sapiens
tgcatatcggaggtggtgga

SEQ ID NO: 2000245 - DNA, 19 bp, Homo sapiens
tgcatcaagggctttatca

SEQ ID NO: 2000246 - DNA, 18 bp, Homo sapiens
tgcatcagaaagggaggg

SEQ ID NO: 2000247 - DNA, 22 bp, Homo sapiens
tgcatcagaaagggagggctct

SEQ ID NO: 2000248 - DNA, 14 bp, Homo sapiens
tgcatccattcctc

SEQ ID NO: 2000249 - DNA, 20 bp, Homo sapiens
tgcatccattcctcagggac

SEQ ID NO: 2000250 - DNA, 21 bp, Homo sapiens
tgcatccggagaattgcctct

SEQ ID NO: 2000251 - DNA, 22 bp, Homo sapiens
tgcatccggagaattgcctcta

SEQ ID NO: 2000252 - DNA, 19 bp, Homo sapiens
tgcatctgggattcccacc

SEQ ID NO: 2000253 - DNA, 19 bp, Homo sapiens
tgcatgaaggtttctgaaa

SEQ ID NO: 2000254 - DNA, 21 bp, Homo sapiens
tgcatgaaggtttctgaaaat

SEQ ID NO: 2000255 - DNA, 14 bp, Homo sapiens
tgcatgatgtattt

SEQ ID NO: 2000256 - DNA, 16 bp, Homo sapiens
tgcatgattttataca

SEQ ID NO: 2000257 - DNA, 22 bp, Homo sapiens
tgcatgattttatacatagtca

SEQ ID NO: 2000258 - DNA, 18 bp, Homo sapiens
tgcatgcagccactgtgc

SEQ ID NO: 2000259 - DNA, 22 bp, Homo sapiens
tgcatgcagccactgtgctgaa

SEQ ID NO: 2000260 - DNA, 21 bp, Homo sapiens
tgcatgccatctccaccctga

SEQ ID NO: 2000261 - DNA, 19 bp, Homo sapiens
tgcatgctctctgcagcca

SEQ ID NO: 2000262 - DNA, 22 bp, Homo sapiens
tgcatgctctggaagcctggac

SEQ ID NO: 2000263 - DNA, 18 bp, Homo sapiens
tgcatggaaatgtcctcc

SEQ ID NO: 2000264 - DNA, 19 bp, Homo sapiens
tgcatggcttggggagcag

SEQ ID NO: 2000265 - DNA, 17 bp, Homo sapiens
tgcatgtaaaatgcagt

SEQ ID NO: 2000266 - DNA, 20 bp, Homo sapiens
tgcatgtaaaatgcagtcca

SEQ ID NO: 2000267 - DNA, 21 bp, Homo sapiens
tgcatgtatgtgcacatgtgt

SEQ ID NO: 2000268 - DNA, 21 bp, Homo sapiens
tgcctgtagccccagtgacag

SEQ ID NO: 2000269 - DNA, 20 bp, Homo sapiens
tgcctgtagttaggaaataa

SEQ ID NO: 2000270 - DNA, 22 bp, Homo sapiens
tgcctgtagttaggaaataaaa

SEQ ID NO: 2000271 - DNA, 14 bp, Homo sapiens
tgcctgtgaggcag

SEQ ID NO: 2000272 - DNA, 20 bp, Homo sapiens
tgcctgtgcacggccagctg

SEQ ID NO: 2000273 - DNA, 23 bp, Homo sapiens
tgcctgtgcatgacctgatcatt

SEQ ID NO: 2000274 - DNA, 23 bp, Homo sapiens
tgcctgtgggggtccatttgggt

SEQ ID NO: 2000275 - DNA, 13 bp, Homo sapiens
tgcctgtgtgagc

SEQ ID NO: 2000276 - DNA, 15 bp, Homo sapiens
tgcctgtgtgagcat

SEQ ID NO: 2000277 - DNA, 16 bp, Homo sapiens
tgcctgttcagctcca

SEQ ID NO: 2000278 - DNA, 20 bp, Homo sapiens
tgcctgttcagctccagctc

SEQ ID NO: 2000279 - DNA, 21 bp, Homo sapiens
tgcctgttcagctccagctca

SEQ ID NO: 2000280 - DNA, 15 bp, Homo sapiens
tgccttaaagaaagt

SEQ ID NO: 2000281 - DNA, 15 bp, Homo sapiens
tgccttacctcctgc

SEQ ID NO: 2000282 - DNA, 16 bp, Homo sapiens
tgccttacctcctgcc

SEQ ID NO: 2000283 - DNA, 18 bp, Homo sapiens
tgccttacctcctgccca

SEQ ID NO: 2000284 - DNA, 20 bp, Homo sapiens
tgccttacctcctgcccagg

SEQ ID NO: 2000285 - DNA, 21 bp, Homo sapiens
tgccttacctcctgcccagga

SEQ ID NO: 2000286 - DNA, 16 bp, Homo sapiens
tgccttagcacttctt

SEQ ID NO: 2000287 - DNA, 17 bp, Homo sapiens
tgccttagcacttcttt

SEQ ID NO: 2000288 - DNA, 18 bp, Homo sapiens
tgccttatgtaattattt

SEQ ID NO: 2000289 - DNA, 13 bp, Homo sapiens
tgccttccataat

SEQ ID NO: 2000290 - DNA, 17 bp, Homo sapiens
tgccttccataattatg

SEQ ID NO: 2000291 - DNA, 21 bp, Homo sapiens
tgccttccataattatgacag

SEQ ID NO: 2000292 - DNA, 16 bp, Homo sapiens
tgccttctacttttaa

SEQ ID NO: 2000293 - DNA, 17 bp, Homo sapiens
tgccttctccctgggaa

SEQ ID NO: 2000294 - DNA, 17 bp, Homo sapiens
tgccttcttcacccagc

SEQ ID NO: 2000295 - DNA, 22 bp, Homo sapiens
tgccttcttcggggaactcctg

SEQ ID NO: 2000296 - DNA, 23 bp, Homo sapiens
tgccttcttcggggaactcctgg

SEQ ID NO: 2000297 - DNA, 14 bp, Homo sapiens
tgccttgaagccac

SEQ ID NO: 2000298 - DNA, 17 bp, Homo sapiens
tgccttgatgaagcctg

SEQ ID NO: 2000299 - DNA, 15 bp, Homo sapiens
tgccttgtctgggga

SEQ ID NO: 2000300 - DNA, 18 bp, Homo sapiens
tgcctttccacctgcttt

SEQ ID NO: 2000301 - DNA, 13 bp, Homo sapiens
tgcctttctagtc

SEQ ID NO: 2000302 - DNA, 18 bp, Homo sapiens
tgcctttctctggctcca

SEQ ID NO: 2000303 - DNA, 17 bp, Homo sapiens
tgccttttgctgctgct

SEQ ID NO: 2000304 - DNA, 16 bp, Homo sapiens
tgccttttttcacagc

SEQ ID NO: 2000305 - DNA, 17 bp, Homo sapiens
tgcgaaaacgttgaccc

SEQ ID NO: 2000306 - DNA, 18 bp, Homo sapiens
tgcgaaaacgttgacccc

SEQ ID NO: 2000307 - DNA, 21 bp, Homo sapiens
tgcgaaaacttgaatctgtta

SEQ ID NO: 2000308 - DNA, 22 bp, Homo sapiens
tgcgaaacaacttgtgttctat

SEQ ID NO: 2000309 - DNA, 13 bp, Homo sapiens
tgcgaaagaattt

SEQ ID NO: 2000310 - DNA, 16 bp, Homo sapiens
tgcgaaggggccctgg

SEQ ID NO: 2000311 - DNA, 21 bp, Homo sapiens
tgcgaaggggccctggtcctt

SEQ ID NO: 2000312 - DNA, 14 bp, Homo sapiens
tgcgaccatgtgta

SEQ ID NO: 2000313 - DNA, 16 bp, Homo sapiens
tgcgaccatgtgtaga

SEQ ID NO: 2000314 - DNA, 24 bp, Homo sapiens
tgcgagagaggtgggcagcagctc

SEQ ID NO: 2000315 - DNA, 15 bp, Homo sapiens
tgcgagcatttccct

SEQ ID NO: 2000316 - DNA, 14 bp, Homo sapiens
tgcgatctgggttc

SEQ ID NO: 2000317 - DNA, 15 bp, Homo sapiens
tgcgatctgggttca

SEQ ID NO: 2000318 - DNA, 18 bp, Homo sapiens
tgcgatcttcagagcagg

SEQ ID NO: 2000319 - DNA, 17 bp, Homo sapiens
tgcgcaacaacaaggac

SEQ ID NO: 2000320 - DNA, 13 bp, Homo sapiens
tgcgcaatgtggc

SEQ ID NO: 2000321 - DNA, 22 bp, Homo sapiens
tgcgcacacacaccgatgtaca

SEQ ID NO: 2000322 - DNA, 16 bp, Homo sapiens
tgcgcctacaggagtg

SEQ ID NO: 2000323 - DNA, 12 bp, Homo sapiens
tgcgctcttggt

SEQ ID NO: 2000324 - DNA, 21 bp, Homo sapiens
tgcgctcttggtccctggtcc

SEQ ID NO: 2000325 - DNA, 21 bp, Homo sapiens
tgcgctggtggaccacaggca

SEQ ID NO: 2000326 - DNA, 17 bp, Homo sapiens
tgcggacagccacggcc

SEQ ID NO: 2000327 - DNA, 18 bp, Homo sapiens
tgcggacagccacggcca

SEQ ID NO: 2000328 - DNA, 21 bp, Homo sapiens
tgcggacagccacggccaggc

SEQ ID NO: 2000329 - DNA, 11 bp, Homo sapiens
tgcggcaggag

SEQ ID NO: 2000330 - DNA, 12 bp, Homo sapiens
tgcggcaggagc

SEQ ID NO: 2000331 - DNA, 14 bp, Homo sapiens
tgcggccgggctgc

SEQ ID NO: 2000332 - DNA, 16 bp, Homo sapiens
tgcggccgggctgccc

SEQ ID NO: 2000333 - DNA, 17 bp, Homo sapiens
tgcggccgggctgccct

SEQ ID NO: 2000334 - DNA, 18 bp, Homo sapiens
tgcggccgggctgccctt

SEQ ID NO: 2000335 - DNA, 19 bp, Homo sapiens
tgcgggatggtcctggggc

SEQ ID NO: 2000336 - DNA, 19 bp, Homo sapiens
tgcgggggagctggaaata

SEQ ID NO: 2000337 - DNA, 20 bp, Homo sapiens
tgcgggggagctggaaataa

SEQ ID NO: 2000338 - DNA, 14 bp, Homo sapiens
tgcggtccacccag

SEQ ID NO: 2000339 - DNA, 15 bp, Homo sapiens
tgcggtccacccagg

SEQ ID NO: 2000340 - DNA, 18 bp, Homo sapiens
tgcggtccacccaggagc

SEQ ID NO: 2000341 - DNA, 14 bp, Homo sapiens
tgcgtcccccagcc

SEQ ID NO: 2000342 - DNA, 18 bp, Homo sapiens
tgcgtcctgacgccctgc

SEQ ID NO: 2000343 - DNA, 22 bp, Homo sapiens
tgcgtctctctttctccctcac

SEQ ID NO: 2000344 - DNA, 22 bp, Homo sapiens
tgcgtgactattttttaataaa

SEQ ID NO: 2000345 - DNA, 22 bp, Homo sapiens
tgcgtgccctgacccctgcacc

SEQ ID NO: 2000346 - DNA, 23 bp, Homo sapiens
tgcgtgccgggagaggactctgc

SEQ ID NO: 2000347 - DNA, 16 bp, Homo sapiens
tgcgtgcgtgtgcgtg

SEQ ID NO: 2000348 - DNA, 18 bp, Homo sapiens
tgcgtggactctgcacat

SEQ ID NO: 2000349 - DNA, 13 bp, Homo sapiens
tgcgtgtcgtggg

SEQ ID NO: 2000350 - DNA, 18 bp, Homo sapiens
tgcgtgtgtgtgtgtttg

SEQ ID NO: 2000351 - DNA, 13 bp, Homo sapiens
tgcgttttagagt

SEQ ID NO: 2000352 - DNA, 14 bp, Homo sapiens
tgctaaaacttcac

SEQ ID NO: 2000353 - DNA, 16 bp, Homo sapiens
tgctaaatgaagagac

SEQ ID NO: 2000354 - DNA, 21 bp, Homo sapiens
tgctaaattttcagtagggct

SEQ ID NO: 2000355 - DNA, 20 bp, Homo sapiens
tgctaactagcttggaaact

SEQ ID NO: 2000356 - DNA, 22 bp, Homo sapiens
tgctaactagcttggaaactgg

SEQ ID NO: 2000357 - DNA, 16 bp, Homo sapiens
tgctaactgtatgtgt

SEQ ID NO: 2000358 - DNA, 23 bp, Homo sapiens
tgctaatcagggaggtcattttg

SEQ ID NO: 2000359 - DNA, 18 bp, Homo sapiens
tgctaatttatcctgaaa

SEQ ID NO: 2000360 - DNA, 14 bp, Homo sapiens
tgctacaaaaacac

SEQ ID NO: 2000361 - DNA, 18 bp, Homo sapiens
tgctacaaaaacacagca

SEQ ID NO: 2000362 - DNA, 14 bp, Homo sapiens
tgctacaataaatg

SEQ ID NO: 2000363 - DNA, 15 bp, Homo sapiens
tgctacaataaatgc

SEQ ID NO: 2000364 - DNA, 19 bp, Homo sapiens
tgctacagtactatgtaaa

SEQ ID NO: 2000365 - DNA, 16 bp, Homo sapiens
tgctaccaaggcccag

SEQ ID NO: 2000366 - DNA, 21 bp, Homo sapiens
tgctactgtcctacccaccct

SEQ ID NO: 2000367 - DNA, 22 bp, Homo sapiens
tgctactgtcctacccaccctc

SEQ ID NO: 2000368 - DNA, 13 bp, Homo sapiens
tgctactttgcct

SEQ ID NO: 2000369 - DNA, 17 bp, Homo sapiens
tgctactttgccttttg

SEQ ID NO: 2000370 - DNA, 18 bp, Homo sapiens
tgctactttgccttttgc

SEQ ID NO: 2000371 - DNA, 19 bp, Homo sapiens
tgctagatgtgcaaatgca

SEQ ID NO: 2000372 - DNA, 13 bp, Homo sapiens
tgctagctgtaga

SEQ ID NO: 2000373 - DNA, 15 bp, Homo sapiens
tgctagctgtagaaa

SEQ ID NO: 2000374 - DNA, 16 bp, Homo sapiens
tgctagctgtagaaat

SEQ ID NO: 2000375 - DNA, 12 bp, Homo sapiens
tgctaggaagtg

SEQ ID NO: 2000376 - DNA, 21 bp, Homo sapiens
tgctaggcgagtgccaggact

SEQ ID NO: 2000377 - DNA, 22 bp, Homo sapiens
tgctaggcgagtgccaggactc

SEQ ID NO: 2000378 - DNA, 19 bp, Homo sapiens
tgctaggggatgaggggct

SEQ ID NO: 2000379 - DNA, 16 bp, Homo sapiens
tgctagtgatttcatt

SEQ ID NO: 2000380 - DNA, 18 bp, Homo sapiens
tgctagtttattggaagt

SEQ ID NO: 2000381 - DNA, 23 bp, Homo sapiens
tgctataggctggagaagctcac

SEQ ID NO: 2000382 - DNA, 20 bp, Homo sapiens
tggatgaccagaacaaggtt

SEQ ID NO: 2000383 - DNA, 20 bp, Homo sapiens
tggatgagacttccaaacct

SEQ ID NO: 2000384 - DNA, 14 bp, Homo sapiens
tggatgcctggtgg

SEQ ID NO: 2000385 - DNA, 18 bp, Homo sapiens
tggatgctccagggcagc

SEQ ID NO: 2000386 - DNA, 18 bp, Homo sapiens
tggatggaaatatgttct

SEQ ID NO: 2000387 - DNA, 18 bp, Homo sapiens
tggatggaggagaaataa

SEQ ID NO: 2000388 - DNA, 19 bp, Homo sapiens
tggatgggcattgggctga

SEQ ID NO: 2000389 - DNA, 23 bp, Homo sapiens
tggatgtggggtccccatcatcc

SEQ ID NO: 2000390 - DNA, 16 bp, Homo sapiens
tggattattcatttaa

SEQ ID NO: 2000391 - DNA, 18 bp, Homo sapiens
tggattattcatttaaaa

SEQ ID NO: 2000392 - DNA, 13 bp, Homo sapiens
tggattcctaagc

SEQ ID NO: 2000393 - DNA, 18 bp, Homo sapiens
tggatttcctattttaaa

SEQ ID NO: 2000394 - DNA, 21 bp, Homo sapiens
tggatttcctattttaaaacc

SEQ ID NO: 2000395 - DNA, 22 bp, Homo sapiens
tggatttcctattttaaaacca

SEQ ID NO: 2000396 - DNA, 14 bp, Homo sapiens
tggcaaagtgctgt

SEQ ID NO: 2000397 - DNA, 15 bp, Homo sapiens
tggcaacagaagcag

SEQ ID NO: 2000398 - DNA, 13 bp, Homo sapiens
tggcaacagagca

SEQ ID NO: 2000399 - DNA, 14 bp, Homo sapiens
tggcaacctgttct

SEQ ID NO: 2000400 - DNA, 16 bp, Homo sapiens
tggcaagggggcgggg

SEQ ID NO: 2000401 - DNA, 14 bp, Homo sapiens
tggcacagaaacac

SEQ ID NO: 2000402 - DNA, 21 bp, Homo sapiens
tggcacagacttctggaaggc

SEQ ID NO: 2000403 - DNA, 19 bp, Homo sapiens
tggcacagttttctgagaa

SEQ ID NO: 2000404 - DNA, 19 bp, Homo sapiens
tggcaccactgcactccag

SEQ ID NO: 2000405 - DNA, 14 bp, Homo sapiens
tggcaccagaggct

SEQ ID NO: 2000406 - DNA, 19 bp, Homo sapiens
tggcaccagaggctgcaga

SEQ ID NO: 2000407 - DNA, 20 bp, Homo sapiens
tggcaccagaggctgcagaa

SEQ ID NO: 2000408 - DNA, 20 bp, Homo sapiens
tggcaccagatgcaacctca

SEQ ID NO: 2000409 - DNA, 17 bp, Homo sapiens
tggcaccagccccctgg

SEQ ID NO: 2000410 - DNA, 15 bp, Homo sapiens
tggcacccggcccct

SEQ ID NO: 2000411 - DNA, 13 bp, Homo sapiens
tggcacctcctga

SEQ ID NO: 2000412 - DNA, 14 bp, Homo sapiens
tggcacctcctgag

SEQ ID NO: 2000413 - DNA, 17 bp, Homo sapiens
tggcacctcctgagaag

SEQ ID NO: 2000414 - DNA, 19 bp, Homo sapiens
tggcacctcctgagaaggc

SEQ ID NO: 2000415 - DNA, 15 bp, Homo sapiens
tggcacggagagaag

SEQ ID NO: 2000416 - DNA, 19 bp, Homo sapiens
tggcacggagagaaggccc

SEQ ID NO: 2000417 - DNA, 22 bp, Homo sapiens
tggcactgagatatttattgtt

SEQ ID NO: 2000418 - DNA, 10 bp, Homo sapiens
tggcactgat

SEQ ID NO: 2000419 - DNA, 22 bp, Homo sapiens
tggcactgcttgaggaggggca

SEQ ID NO: 2000420 - DNA, 20 bp, Homo sapiens
tggcacttagcccaagaggt

SEQ ID NO: 2000421 - DNA, 17 bp, Homo sapiens
tggcagaaaagaggaga

SEQ ID NO: 2000422 - DNA, 19 bp, Homo sapiens
tggcagaaaagaggagacc

SEQ ID NO: 2000423 - DNA, 22 bp, Homo sapiens
tggcagaaaagaggagaccctg

SEQ ID NO: 2000424 - DNA, 14 bp, Homo sapiens
tggcagaccatctc

SEQ ID NO: 2000425 - DNA, 15 bp, Homo sapiens
tggcagaccatctcc

SEQ ID NO: 2000426 - DNA, 16 bp, Homo sapiens
tggcagaccgggggcc

SEQ ID NO: 2000427 - DNA, 12 bp, Homo sapiens
tggcagagaagg

SEQ ID NO: 2000428 - DNA, 23 bp, Homo sapiens
tggcagagaaggcctcttgtgct

SEQ ID NO: 2000429 - DNA, 21 bp, Homo sapiens
tggcagagaaggcttcctcca

SEQ ID NO: 2000430 - DNA, 19 bp, Homo sapiens
tggcagataatcagcctct

SEQ ID NO: 2000431 - DNA, 20 bp, Homo sapiens
tggcagataatcagcctctt

SEQ ID NO: 2000432 - DNA, 18 bp, Homo sapiens
tggcagatgtaggaggga

SEQ ID NO: 2000433 - DNA, 18 bp, Homo sapiens
tggcagcagttccatgaa

SEQ ID NO: 2000434 - DNA, 19 bp, Homo sapiens
tggcagccacacttctcag

SEQ ID NO: 2000435 - DNA, 13 bp, Homo sapiens
tggcagccatgcc

SEQ ID NO: 2000436 - DNA, 14 bp, Homo sapiens
tggcagccctgtag

SEQ ID NO: 2000437 - DNA, 17 bp, Homo sapiens
tggcagccgtgccttca

SEQ ID NO: 2000438 - DNA, 20 bp, Homo sapiens
tggcagccgtgccttcagct

SEQ ID NO: 2000439 - DNA, 22 bp, Homo sapiens
tggcagctagactggagtgagg

SEQ ID NO: 2000440 - DNA, 17 bp, Homo sapiens
tggcagctcctctcctt

SEQ ID NO: 2000441 - DNA, 13 bp, Homo sapiens
tggcagctgtccc

SEQ ID NO: 2000442 - DNA, 23 bp, Homo sapiens
tggcagctgtcccctctccctgg

SEQ ID NO: 2000443 - DNA, 17 bp, Homo sapiens
tggcagcttaacattga

SEQ ID NO: 2000444 - DNA, 17 bp, Homo sapiens
tggcaggacacatcccg

SEQ ID NO: 2000445 - DNA, 14 bp, Homo sapiens
tggcaggaccagga

SEQ ID NO: 2000446 - DNA, 23 bp, Homo sapiens
tggcaggagaatcaataaaaatc

SEQ ID NO: 2000447 - DNA, 20 bp, Homo sapiens
tggcaggcacacagcagccc

SEQ ID NO: 2000448 - DNA, 23 bp, Homo sapiens
tggcaggcacacagcagcccccc

SEQ ID NO: 2000449 - DNA, 21 bp, Homo sapiens
tggcaggcctaggacctcagg

SEQ ID NO: 2000450 - DNA, 16 bp, Homo sapiens
tggcagggtgggatgg

SEQ ID NO: 2000451 - DNA, 17 bp, Homo sapiens
tggcagggtgggatgga

SEQ ID NO: 2000452 - DNA, 18 bp, Homo sapiens
tggcagtccagccagctc

SEQ ID NO: 2000453 - DNA, 15 bp, Homo sapiens
tggcagtgggagctg

SEQ ID NO: 2000454 - DNA, 20 bp, Homo sapiens
tggcagtgggagctgcctgt

SEQ ID NO: 2000455 - DNA, 23 bp, Homo sapiens
tggcagtgtgtcacactgagctg

SEQ ID NO: 2000456 - DNA, 24 bp, Homo sapiens
tggcagtgtgtcacactgagctgg

SEQ ID NO: 2000457 - DNA, 20 bp, Homo sapiens
tggcagttggaggacacagt

SEQ ID NO: 2000458 - DNA, 13 bp, Homo sapiens
tggcatgatttat

SEQ ID NO: 2000459 - DNA, 13 bp, Homo sapiens
tggcatgtggaga

SEQ ID NO: 2000460 - DNA, 12 bp, Homo sapiens
tggcatgtgttt

SEQ ID NO: 2000461 - DNA, 15 bp, Homo sapiens
tggcattaattatta

SEQ ID NO: 2000462 - DNA, 17 bp, Homo sapiens
tggcattggtctgctga

SEQ ID NO: 2000463 - DNA, 23 bp, Homo sapiens
tggccaaagccaaagctaggcct

SEQ ID NO: 2000464 - DNA, 14 bp, Homo sapiens
tggccaaagtgtta

SEQ ID NO: 2000465 - DNA, 14 bp, Homo sapiens
tggccaagctgagg

SEQ ID NO: 2000466 - DNA, 19 bp, Homo sapiens
tggccaagctgaggtgccc

SEQ ID NO: 2000467 - DNA, 23 bp, Homo sapiens
tggccaagctgaggtgcccagga

SEQ ID NO: 2000468 - DNA, 22 bp, Homo sapiens
tggccaatccaggtgggagaga

SEQ ID NO: 2000469 - DNA, 22 bp, Homo sapiens
tggccaatgcacctaaagaaaa

SEQ ID NO: 2000470 - DNA, 22 bp, Homo sapiens
tggccacaccacagcaagccgg

SEQ ID NO: 2000471 - DNA, 20 bp, Homo sapiens
tggccacccaacagcaccaa

SEQ ID NO: 2000472 - DNA, 17 bp, Homo sapiens
tggccaccccgtgccac

SEQ ID NO: 2000473 - DNA, 22 bp, Homo sapiens
tggccacccgttctgctggcct

SEQ ID NO: 2000474 - DNA, 16 bp, Homo sapiens
tggccaccctggcccg

SEQ ID NO: 2000475 - DNA, 19 bp, Homo sapiens
tggccactgggtctcactc

SEQ ID NO: 2000476 - DNA, 22 bp, Homo sapiens
tggccactgggtctcactcctg

SEQ ID NO: 2000477 - DNA, 16 bp, Homo sapiens
tggccactttaagaga

SEQ ID NO: 2000478 - DNA, 19 bp, Homo sapiens
tggccagacgctgccgctg

SEQ ID NO: 2000479 - DNA, 13 bp, Homo sapiens
tggccagagaggg

SEQ ID NO: 2000480 - DNA, 22 bp, Homo sapiens
tggccagagagggcccagctgt

SEQ ID NO: 2000481 - DNA, 15 bp, Homo sapiens
tggccagagagtggg

SEQ ID NO: 2000482 - DNA, 21 bp, Homo sapiens
tggccagagctggaaggcagg

SEQ ID NO: 2000483 - DNA, 21 bp, Homo sapiens
tggccagatgcaccagccctt

SEQ ID NO: 2000484 - DNA, 14 bp, Homo sapiens
tggccagcaccctc

SEQ ID NO: 2000485 - DNA, 15 bp, Homo sapiens
tggccagcaccctct

SEQ ID NO: 2000486 - DNA, 20 bp, Homo sapiens
tggccagcaccctctcctgg

SEQ ID NO: 2000487 - DNA, 22 bp, Homo sapiens
tggccaggaggttggtgactga

SEQ ID NO: 2000488 - DNA, 20 bp, Homo sapiens
tggccaggctggtcgtgaac

SEQ ID NO: 2000489 - DNA, 12 bp, Homo sapiens
tggccagggtga

SEQ ID NO: 2000490 - DNA, 16 bp, Homo sapiens
tggccaggtggccact

SEQ ID NO: 2000491 - DNA, 17 bp, Homo sapiens
tggccaggtggccactc

SEQ ID NO: 2000492 - DNA, 19 bp, Homo sapiens
tggccaggtggccactcca

SEQ ID NO: 2000493 - DNA, 19 bp, Homo sapiens
tggccagtcctagagctcc

SEQ ID NO: 2000494 - DNA, 17 bp, Homo sapiens
tggccagtctgggtctg

SEQ ID NO: 2000495 - DNA, 14 bp, Homo sapiens
tggccatccctggg

SEQ ID NO: 2000496 - DNA, 12 bp, Homo sapiens
tggtttctccag

SEQ ID NO: 2000497 - DNA, 23 bp, Homo sapiens
tggtttgaagaatgttaagactt

SEQ ID NO: 2000498 - DNA, 14 bp, Homo sapiens
tggtttggggagaa

SEQ ID NO: 2000499 - DNA, 21 bp, Homo sapiens
tggtttgtcatatattcatgt

SEQ ID NO: 2000500 - DNA, 20 bp, Homo sapiens
tggttttaacaactgtgctt

SEQ ID NO: 2000501 - DNA, 22 bp, Homo sapiens
tggttttcctaaatgcagtgaa

SEQ ID NO: 2000502 - DNA, 13 bp, Homo sapiens
tggtttttatatt

SEQ ID NO: 2000503 - DNA, 19 bp, Homo sapiens
tggtttttggctctttcag

SEQ ID NO: 2000504 - DNA, 13 bp, Homo sapiens
tgtaaaaaaaaaa

SEQ ID NO: 2000505 - DNA, 15 bp, Homo sapiens
tgtaaaaaaggaaca

SEQ ID NO: 2000506 - DNA, 18 bp, Homo sapiens
tgtaaaacctgtcaatga

SEQ ID NO: 2000507 - DNA, 14 bp, Homo sapiens
tgtaaaataaaatt

SEQ ID NO: 2000508 - DNA, 18 bp, Homo sapiens
tgtaaaatatctacctgc

SEQ ID NO: 2000509 - DNA, 22 bp, Homo sapiens
tgtaaaatcttggcacagaaac

SEQ ID NO: 2000510 - DNA, 23 bp, Homo sapiens
tgtaaaatgcagtccagaataag

SEQ ID NO: 2000511 - DNA, 16 bp, Homo sapiens
tgtaaacatagatagt

SEQ ID NO: 2000512 - DNA, 20 bp, Homo sapiens
tgtaaactcaaaatatttgt

SEQ ID NO: 2000513 - DNA, 23 bp, Homo sapiens
tgtaaactcaaaatatttgtaca

SEQ ID NO: 2000514 - DNA, 20 bp, Homo sapiens
tgtaaagagtggagcaaatg

SEQ ID NO: 2000515 - DNA, 18 bp, Homo sapiens
tgtaaagccaacaccctg

SEQ ID NO: 2000516 - DNA, 14 bp, Homo sapiens
tgtaaaggtcagag

SEQ ID NO: 2000517 - DNA, 18 bp, Homo sapiens
tgtaaataaatagatttg

SEQ ID NO: 2000518 - DNA, 21 bp, Homo sapiens
tgtaaatacaaaataaaatta

SEQ ID NO: 2000519 - DNA, 16 bp, Homo sapiens
tgtaaatacatgtgtg

SEQ ID NO: 2000520 - DNA, 18 bp, Homo sapiens
tgtaaatacatgtgtgga

SEQ ID NO: 2000521 - DNA, 21 bp, Homo sapiens
tgtaaatagttttaaatatga

SEQ ID NO: 2000522 - DNA, 11 bp, Homo sapiens
tgtaaatatag

SEQ ID NO: 2000523 - DNA, 15 bp, Homo sapiens
tgtaaatatgtttgt

SEQ ID NO: 2000524 - DNA, 20 bp, Homo sapiens
tgtaaatatgtttgtgcctt

SEQ ID NO: 2000525 - DNA, 17 bp, Homo sapiens
tgtaaatattttaaaga

SEQ ID NO: 2000526 - DNA, 20 bp, Homo sapiens
tgtaaatattttaaagaatt

SEQ ID NO: 2000527 - DNA, 22 bp, Homo sapiens
tgtaaatattttaaagaattgt

SEQ ID NO: 2000528 - DNA, 19 bp, Homo sapiens
tgtaaatgaccaagaaaaa

SEQ ID NO: 2000529 - DNA, 22 bp, Homo sapiens
tgtaaatgaccaagaaaaagaa

SEQ ID NO: 2000530 - DNA, 13 bp, Homo sapiens
tgtaaatgctcgt

SEQ ID NO: 2000531 - DNA, 15 bp, Homo sapiens
tgtaaattaatactt

SEQ ID NO: 2000532 - DNA, 23 bp, Homo sapiens
tgtaaattaggaggctcaacaat

SEQ ID NO: 2000533 - DNA, 16 bp, Homo sapiens
tgtaaattcctgttgt

SEQ ID NO: 2000534 - DNA, 17 bp, Homo sapiens
tgtaaattttagagcat

SEQ ID NO: 2000535 - DNA, 14 bp, Homo sapiens
tgtaacaagccacc

SEQ ID NO: 2000536 - DNA, 14 bp, Homo sapiens
tgtaacaagccaga

SEQ ID NO: 2000537 - DNA, 15 bp, Homo sapiens
tgtaacatccagaag

SEQ ID NO: 2000538 - DNA, 21 bp, Homo sapiens
tgtaacattaattctactaaa

SEQ ID NO: 2000539 - DNA, 14 bp, Homo sapiens
tgtaaccagattaa

SEQ ID NO: 2000540 - DNA, 14 bp, Homo sapiens
tgtaactacactaa

SEQ ID NO: 2000541 - DNA, 12 bp, Homo sapiens
tgtaactccacc

SEQ ID NO: 2000542 - DNA, 12 bp, Homo sapiens
tgtaactgctga

SEQ ID NO: 2000543 - DNA, 16 bp, Homo sapiens
tgtaactgctgagcca

SEQ ID NO: 2000544 - DNA, 14 bp, Homo sapiens
tgtaacttcaaata

SEQ ID NO: 2000545 - DNA, 20 bp, Homo sapiens
tgtaagacaaaggttttcct

SEQ ID NO: 2000546 - DNA, 15 bp, Homo sapiens
tgtaagcaacttgct

SEQ ID NO: 2000547 - DNA, 17 bp, Homo sapiens
tgtaaggaattgaagat

SEQ ID NO: 2000548 - DNA, 20 bp, Homo sapiens
tgtaagggtctgttgtaaat

SEQ ID NO: 2000549 - DNA, 21 bp, Homo sapiens
tgtaagtaattgcatttctgc

SEQ ID NO: 2000550 - DNA, 13 bp, Homo sapiens
tgtaagtcaggag

SEQ ID NO: 2000551 - DNA, 20 bp, Homo sapiens
tgtaagttgtgtgcaacaaa

SEQ ID NO: 2000552 - DNA, 20 bp, Homo sapiens
tgtaagtttatgtctaaaga

SEQ ID NO: 2000553 - DNA, 13 bp, Homo sapiens
tgtaagtttattt

SEQ ID NO: 2000554 - DNA, 22 bp, Homo sapiens
tgtaagtttattttttctacac

SEQ ID NO: 2000555 - DNA, 16 bp, Homo sapiens
tgtaataaactctcta

SEQ ID NO: 2000556 - DNA, 16 bp, Homo sapiens
tgtaataaaggtcttt

SEQ ID NO: 2000557 - DNA, 11 bp, Homo sapiens
tgtaataaatc

SEQ ID NO: 2000558 - DNA, 15 bp, Homo sapiens
tgtaataagaaagta

SEQ ID NO: 2000559 - DNA, 13 bp, Homo sapiens
tgtaatagtccat

SEQ ID NO: 2000560 - DNA, 15 bp, Homo sapiens
tgtaatcccagcact

SEQ ID NO: 2000561 - DNA, 16 bp, Homo sapiens
tgtaatcccagctact

SEQ ID NO: 2000562 - DNA, 21 bp, Homo sapiens
tgtaatcccagctactcagga

SEQ ID NO: 2000563 - DNA, 22 bp, Homo sapiens
tgtaatcccagctacttgggag

SEQ ID NO: 2000564 - DNA, 17 bp, Homo sapiens
tgtaatggaactgaccc

SEQ ID NO: 2000565 - DNA, 20 bp, Homo sapiens
tgtaattaagtaaaccaaaa

SEQ ID NO: 2000566 - DNA, 22 bp, Homo sapiens
tgtaattatgaggtgaaacaat

SEQ ID NO: 2000567 - DNA, 20 bp, Homo sapiens
tgtaattcagaaaacataat

SEQ ID NO: 2000568 - DNA, 13 bp, Homo sapiens
tgtaattctaaat

SEQ ID NO: 2000569 - DNA, 15 bp, Homo sapiens
tgtaattctaaatga

SEQ ID NO: 2000570 - DNA, 18 bp, Homo sapiens
tgtaattggtgacaatgt

SEQ ID NO: 2000571 - DNA, 15 bp, Homo sapiens
tgtaatttataaaat

SEQ ID NO: 2000572 - DNA, 17 bp, Homo sapiens
tgtaattttgtttgtaa

SEQ ID NO: 2000573 - DNA, 14 bp, Homo sapiens
tgtacaaaagtacc

SEQ ID NO: 2000574 - DNA, 13 bp, Homo sapiens
tgtacaaatactg

SEQ ID NO: 2000575 - DNA, 17 bp, Homo sapiens
tgtacaagttttgtata

SEQ ID NO: 2000576 - DNA, 17 bp, Homo sapiens
tgtacaatatttaaaat

SEQ ID NO: 2000577 - DNA, 22 bp, Homo sapiens
tgtacaattactaaattgtata

SEQ ID NO: 2000578 - DNA, 18 bp, Homo sapiens
tgtacacacggaccatgt

SEQ ID NO: 2000579 - DNA, 22 bp, Homo sapiens
tgtacactggatatgttgttaa

SEQ ID NO: 2000580 - DNA, 18 bp, Homo sapiens
tgtacagaatttttaatg

SEQ ID NO: 2000581 - DNA, 19 bp, Homo sapiens
tgtacagacgtatgcttat

SEQ ID NO: 2000582 - DNA, 17 bp, Homo sapiens
tgtacagagtggcccct

SEQ ID NO: 2000583 - DNA, 17 bp, Homo sapiens
tgtacagtggagaaata

SEQ ID NO: 2000584 - DNA, 17 bp, Homo sapiens
tgtacagtgtgtaaagt

SEQ ID NO: 2000585 - DNA, 23 bp, Homo sapiens
tgtacagttaactctcccaggtg

SEQ ID NO: 2000586 - DNA, 17 bp, Homo sapiens
tgtacagttatttatgc

SEQ ID NO: 2000587 - DNA, 20 bp, Homo sapiens
tgtacagttcagttcctctt

SEQ ID NO: 2000588 - DNA, 15 bp, Homo sapiens
tgtacatagatgtat

SEQ ID NO: 2000589 - DNA, 18 bp, Homo sapiens
tgtacatagatgtatcat

SEQ ID NO: 2000590 - DNA, 21 bp, Homo sapiens
tgtacatagatgtatcattaa

SEQ ID NO: 2000591 - DNA, 18 bp, Homo sapiens
tgtacatagttatttatt

SEQ ID NO: 2000592 - DNA, 13 bp, Homo sapiens
tgtacatatgtaa

SEQ ID NO: 2000593 - DNA, 11 bp, Homo sapiens
tgtacatgtgt

SEQ ID NO: 2000594 - DNA, 15 bp, Homo sapiens
tgtacatgtgtagcc

SEQ ID NO: 2000595 - DNA, 22 bp, Homo sapiens
tgtacatgtgtagggaaagtta

SEQ ID NO: 2000596 - DNA, 17 bp, Homo sapiens
tgtacattccctgcatc

SEQ ID NO: 2000597 - DNA, 17 bp, Homo sapiens
tgtaccatgtacatgaa

SEQ ID NO: 2000598 - DNA, 16 bp, Homo sapiens
tgtacccaccgggcca

SEQ ID NO: 2000599 - DNA, 21 bp, Homo sapiens
tgtacccaccgggccactcct

SEQ ID NO: 2000600 - DNA, 14 bp, Homo sapiens
tgtacccagctcct

SEQ ID NO: 2000601 - DNA, 13 bp, Homo sapiens
tgtaccccatccc

SEQ ID NO: 2000602 - DNA, 19 bp, Homo sapiens
tgtaccccatcccttcctc

SEQ ID NO: 2000603 - DNA, 16 bp, Homo sapiens
tgtacccttccacctc

SEQ ID NO: 2000604 - DNA, 22 bp, Homo sapiens
tgtacccttccacctcctagag

SEQ ID NO: 2000605 - DNA, 16 bp, Homo sapiens
tgtacccttcctacag

SEQ ID NO: 2000606 - DNA, 18 bp, Homo sapiens
tgtaccgcgtctaccctg

SEQ ID NO: 2000607 - DNA, 19 bp, Homo sapiens
tgtacctatggctgcctgc

SEQ ID NO: 2000608 - DNA, 14 bp, Homo sapiens
tgtacgtctggtgt

SEQ ID NO: 2000609 - DNA, 15 bp, Homo sapiens
tgtacgttatatatt

SEQ ID NO: 2000610 - DNA, 15 bp, Homo sapiens
tgtactaaggagcat

SEQ ID NO: 2000611 - DNA, 13 bp, Homo sapiens
tgtcttggacact

SEQ ID NO: 2000612 - DNA, 19 bp, Homo sapiens
tgtcttggacactgtacaa

SEQ ID NO: 2000613 - DNA, 17 bp, Homo sapiens
tgtcttgtacatgtgta

SEQ ID NO: 2000614 - DNA, 14 bp, Homo sapiens
tgtctttaaatctt

SEQ ID NO: 2000615 - DNA, 15 bp, Homo sapiens
tgtctttaaggaaaa

SEQ ID NO: 2000616 - DNA, 19 bp, Homo sapiens
tgtctttgttggaaaagaa

SEQ ID NO: 2000617 - DNA, 21 bp, Homo sapiens
tgtgaaaataatagccatcct

SEQ ID NO: 2000618 - DNA, 17 bp, Homo sapiens
tgtgaaaatgaggagga

SEQ ID NO: 2000619 - DNA, 14 bp, Homo sapiens
tgtgaaaccacagg

SEQ ID NO: 2000620 - DNA, 20 bp, Homo sapiens
tgtgaaaggaagctccactg

SEQ ID NO: 2000621 - DNA, 22 bp, Homo sapiens
tgtgaaagtcagatgcccagag

SEQ ID NO: 2000622 - DNA, 23 bp, Homo sapiens
tgtgaaattcaacctgtgtctta

SEQ ID NO: 2000623 - DNA, 15 bp, Homo sapiens
tgtgaaccaccacac

SEQ ID NO: 2000624 - DNA, 20 bp, Homo sapiens
tgtgaaccaccacacccagc

SEQ ID NO: 2000625 - DNA, 16 bp, Homo sapiens
tgtgaacccaggacaa

SEQ ID NO: 2000626 - DNA, 21 bp, Homo sapiens
tgtgaacgatttagaaagaag

SEQ ID NO: 2000627 - DNA, 23 bp, Homo sapiens
tgtgaagacccagcaggaagcca

SEQ ID NO: 2000628 - DNA, 15 bp, Homo sapiens
tgtgaatcagaccct

SEQ ID NO: 2000629 - DNA, 16 bp, Homo sapiens
tgtgaattctgtgaag

SEQ ID NO: 2000630 - DNA, 18 bp, Homo sapiens
tgtgaattctgtgaagaa

SEQ ID NO: 2000631 - DNA, 18 bp, Homo sapiens
tgtgaattgagctgcaga

SEQ ID NO: 2000632 - DNA, 23 bp, Homo sapiens
tgtgaatttcttcactgttgaaa

SEQ ID NO: 2000633 - DNA, 19 bp, Homo sapiens
tgtgacaacctttgtgtaa

SEQ ID NO: 2000634 - DNA, 21 bp, Homo sapiens
tgtgacaacctttgtgtaata

SEQ ID NO: 2000635 - DNA, 17 bp, Homo sapiens
tgtgacacatatgcacc

SEQ ID NO: 2000636 - DNA, 16 bp, Homo sapiens
tgtgaccctctgaatg

SEQ ID NO: 2000637 - DNA, 16 bp, Homo sapiens
tgtgacctgctgagct

SEQ ID NO: 2000638 - DNA, 18 bp, Homo sapiens
tgtgacctgctgagctct

SEQ ID NO: 2000639 - DNA, 14 bp, Homo sapiens
tgtgacgattattt

SEQ ID NO: 2000640 - DNA, 22 bp, Homo sapiens
tgtgactatatagagatgtttt

SEQ ID NO: 2000641 - DNA, 21 bp, Homo sapiens
tgtgactcgcttagctgaaac

SEQ ID NO: 2000642 - DNA, 20 bp, Homo sapiens
tgtgactgaaggggcacacc

SEQ ID NO: 2000643 - DNA, 22 bp, Homo sapiens
tgtgactgatgttacatcacag

SEQ ID NO: 2000644 - DNA, 13 bp, Homo sapiens
tgtgactggtcag

SEQ ID NO: 2000645 - DNA, 13 bp, Homo sapiens
tgtgagagctggt

SEQ ID NO: 2000646 - DNA, 21 bp, Homo sapiens
tgtgagatatacaaatatatt

SEQ ID NO: 2000647 - DNA, 14 bp, Homo sapiens
tgtgagcaagaagt

SEQ ID NO: 2000648 - DNA, 14 bp, Homo sapiens
tgtgagcacatgcg

SEQ ID NO: 2000649 - DNA, 19 bp, Homo sapiens
tgtgagccaaagagaaaag

SEQ ID NO: 2000650 - DNA, 17 bp, Homo sapiens
tgtgagcccctggtcct

SEQ ID NO: 2000651 - DNA, 23 bp, Homo sapiens
tgtgaggattatgggtcctgcaa

SEQ ID NO: 2000652 - DNA, 18 bp, Homo sapiens
tgtgaggcaggggcggag

SEQ ID NO: 2000653 - DNA, 13 bp, Homo sapiens
tgtgaggcccctg

SEQ ID NO: 2000654 - DNA, 18 bp, Homo sapiens
tgtgaggtaactgggatc

SEQ ID NO: 2000655 - DNA, 21 bp, Homo sapiens
tgtgagtgactcggtgtaaaa

SEQ ID NO: 2000656 - DNA, 18 bp, Homo sapiens
tgtgagtggcagccatgc

SEQ ID NO: 2000657 - DNA, 23 bp, Homo sapiens
tgtgataacaaagagtcttggtt

SEQ ID NO: 2000658 - DNA, 18 bp, Homo sapiens
tgtgataaggatcagaac

SEQ ID NO: 2000659 - DNA, 17 bp, Homo sapiens
tgtgatatctgaacaca

SEQ ID NO: 2000660 - DNA, 18 bp, Homo sapiens
tgtgatcccaagtgccag

SEQ ID NO: 2000661 - DNA, 15 bp, Homo sapiens
tgtgatgaactttct

SEQ ID NO: 2000662 - DNA, 23 bp, Homo sapiens
tgtgatgctggtaccactggaat

SEQ ID NO: 2000663 - DNA, 18 bp, Homo sapiens
tgtgatgggatctgtaag

SEQ ID NO: 2000664 - DNA, 16 bp, Homo sapiens
tgtgatgttaactatt

SEQ ID NO: 2000665 - DNA, 14 bp, Homo sapiens
tgtgattctaatgt

SEQ ID NO: 2000666 - DNA, 15 bp, Homo sapiens
tgtgatttcctacag

SEQ ID NO: 2000667 - DNA, 17 bp, Homo sapiens
tgtgatttcctacagaa

SEQ ID NO: 2000668 - DNA, 17 bp, Homo sapiens
tgtgattttgtacagaa

SEQ ID NO: 2000669 - DNA, 18 bp, Homo sapiens
tgtgattttgtacagaat

SEQ ID NO: 2000670 - DNA, 15 bp, Homo sapiens
tgtgcaaattttgca

SEQ ID NO: 2000671 - DNA, 17 bp, Homo sapiens
tgtgcaaattttgcatt

SEQ ID NO: 2000672 - DNA, 15 bp, Homo sapiens
tgtgcacaatgggca

SEQ ID NO: 2000673 - DNA, 17 bp, Homo sapiens
tgtgcacccctccccat

SEQ ID NO: 2000674 - DNA, 21 bp, Homo sapiens
tgtgcaccttacattcctaga

SEQ ID NO: 2000675 - DNA, 21 bp, Homo sapiens
tgtgcaccttaccaactttct

SEQ ID NO: 2000676 - DNA, 21 bp, Homo sapiens
tgtgcacggcagcttgagcct

SEQ ID NO: 2000677 - DNA, 22 bp, Homo sapiens
tgtgcactgacatgtttcacaa

SEQ ID NO: 2000678 - DNA, 22 bp, Homo sapiens
tgtgcagtcccgtggagggtag

SEQ ID NO: 2000679 - DNA, 20 bp, Homo sapiens
tgtgcatgtatgtcttggac

SEQ ID NO: 2000680 - DNA, 23 bp, Homo sapiens
tgtgcatgtatgtgcacatgtgt

SEQ ID NO: 2000681 - DNA, 15 bp, Homo sapiens
tgtgcatgtgtgtat

SEQ ID NO: 2000682 - DNA, 15 bp, Homo sapiens
tgtgcatgtgtgtgt

SEQ ID NO: 2000683 - DNA, 17 bp, Homo sapiens
tgtgcatgtgtgtgtct

SEQ ID NO: 2000684 - DNA, 19 bp, Homo sapiens
tgtgcatgtgtgtgtctgt

SEQ ID NO: 2000685 - DNA, 21 bp, Homo sapiens
tgtgcatgtgtgtgtctgtct

SEQ ID NO: 2000686 - DNA, 22 bp, Homo sapiens
tgtgcatgtttactttattaga

SEQ ID NO: 2000687 - DNA, 13 bp, Homo sapiens
tgtgccaacctga

SEQ ID NO: 2000688 - DNA, 17 bp, Homo sapiens
tgtgccaacctgatgcc

SEQ ID NO: 2000689 - DNA, 13 bp, Homo sapiens
tgtgccacctgca

SEQ ID NO: 2000690 - DNA, 14 bp, Homo sapiens
tgtgccagagcctg

SEQ ID NO: 2000691 - DNA, 17 bp, Homo sapiens
tgtgccagagcctgggg

SEQ ID NO: 2000692 - DNA, 22 bp, Homo sapiens
tgtgccagttggggccccgcgg

SEQ ID NO: 2000693 - DNA, 16 bp, Homo sapiens
tgtgccatagtcacat

SEQ ID NO: 2000694 - DNA, 18 bp, Homo sapiens
tgtgccatagtcacatgg

SEQ ID NO: 2000695 - DNA, 15 bp, Homo sapiens
tgtgcccacgtgtgc

SEQ ID NO: 2000696 - DNA, 21 bp, Homo sapiens
tgtgcccacgtgtgcagactg

SEQ ID NO: 2000697 - DNA, 18 bp, Homo sapiens
tgtgccctgccttcagct

SEQ ID NO: 2000698 - DNA, 19 bp, Homo sapiens
tgtgcctcagcctcctaag

SEQ ID NO: 2000699 - DNA, 20 bp, Homo sapiens
tgtgcctcgctccccactct

SEQ ID NO: 2000700 - DNA, 21 bp, Homo sapiens
tgtgcctcgctccccactctg

SEQ ID NO: 2000701 - DNA, 15 bp, Homo sapiens
tgtgcctctgcctgt

SEQ ID NO: 2000702 - DNA, 15 bp, Homo sapiens
tgtgcctgaccctac

SEQ ID NO: 2000703 - DNA, 13 bp, Homo sapiens
tgtgcctgcagcc

SEQ ID NO: 2000704 - DNA, 13 bp, Homo sapiens
tgtgcctgccctg

SEQ ID NO: 2000705 - DNA, 15 bp, Homo sapiens
tgtgcctgccctgga

SEQ ID NO: 2000706 - DNA, 20 bp, Homo sapiens
tgtgcctgctagagcaaccc

SEQ ID NO: 2000707 - DNA, 14 bp, Homo sapiens
tgtgcctgtggcag

SEQ ID NO: 2000708 - DNA, 15 bp, Homo sapiens
tgtgcctgtggcaga

SEQ ID NO: 2000709 - DNA, 18 bp, Homo sapiens
tgtgccttaaaaggagag

SEQ ID NO: 2000710 - DNA, 17 bp, Homo sapiens
tgtgcctttgggaggca

SEQ ID NO: 2000711 - DNA, 19 bp, Homo sapiens
tgtgcgtctctctttctcc

SEQ ID NO: 2000712 - DNA, 24 bp, Homo sapiens
tgtgcgtctctctttctccctcac

SEQ ID NO: 2000713 - DNA, 13 bp, Homo sapiens
tgtgctagatgtg

SEQ ID NO: 2000714 - DNA, 14 bp, Homo sapiens
tgtgctcacgctcc

SEQ ID NO: 2000715 - DNA, 16 bp, Homo sapiens
tgtgctcctccttggt

SEQ ID NO: 2000716 - DNA, 18 bp, Homo sapiens
tgtgctctggacaggcat

SEQ ID NO: 2000717 - DNA, 19 bp, Homo sapiens
tgtgctctggacaggcatg

SEQ ID NO: 2000718 - DNA, 16 bp, Homo sapiens
tgtgctctggaggctg

SEQ ID NO: 2000719 - DNA, 15 bp, Homo sapiens
tgtgctctttgaaga

SEQ ID NO: 2000720 - DNA, 16 bp, Homo sapiens
tgtgctctttgaagag

SEQ ID NO: 2000721 - DNA, 17 bp, Homo sapiens
tgtgctgaggactccct

SEQ ID NO: 2000722 - DNA, 16 bp, Homo sapiens
tgtgctggagctggct

SEQ ID NO: 2000723 - DNA, 18 bp, Homo sapiens
tgtgctgtgcctgctaga

SEQ ID NO: 2000724 - DNA, 12 bp, Homo sapiens
tgtgctgtgggc

SEQ ID NO: 2000725 - DNA, 18 bp, Homo sapiens
ttaaaagatgaaaatatt

SEQ ID NO: 2000726 - DNA, 17 bp, Homo sapiens
ttaaaagccacatagag

SEQ ID NO: 2000727 - DNA, 14 bp, Homo sapiens
ttaaaagtgtattt

SEQ ID NO: 2000728 - DNA, 22 bp, Homo sapiens
ttaaaagttgggaaaagtgtta

SEQ ID NO: 2000729 - DNA, 19 bp, Homo sapiens
ttaaaagtttcaatgtgat

SEQ ID NO: 2000730 - DNA, 15 bp, Homo sapiens
ttaaaataactagtg

SEQ ID NO: 2000731 - DNA, 19 bp, Homo sapiens
ttaaaatagcaaaagaaga

SEQ ID NO: 2000732 - DNA, 22 bp, Homo sapiens
ttaaaatagcaaaagaagaagt

SEQ ID NO: 2000733 - DNA, 13 bp, Homo sapiens
ttaaaatataaat

SEQ ID NO: 2000734 - DNA, 16 bp, Homo sapiens
ttaaaatataaattaa

SEQ ID NO: 2000735 - DNA, 12 bp, Homo sapiens
ttaaaatatatt

SEQ ID NO: 2000736 - DNA, 20 bp, Homo sapiens
ttaaaatatgtatgtctaat

SEQ ID NO: 2000737 - DNA, 14 bp, Homo sapiens
ttaaaatattttat

SEQ ID NO: 2000738 - DNA, 23 bp, Homo sapiens
ttaaaatcaggattttagtgctt

SEQ ID NO: 2000739 - DNA, 15 bp, Homo sapiens
ttaaaatcattcaat

SEQ ID NO: 2000740 - DNA, 22 bp, Homo sapiens
ttaaaatcatttctgcatcagc

SEQ ID NO: 2000741 - DNA, 17 bp, Homo sapiens
ttaaaatctgatttaat

SEQ ID NO: 2000742 - DNA, 13 bp, Homo sapiens
ttaaaatctggaa

SEQ ID NO: 2000743 - DNA, 21 bp, Homo sapiens
ttaaaatctggaaatctgttt

SEQ ID NO: 2000744 - DNA, 18 bp, Homo sapiens
ttaaaatgattgtaaaat

SEQ ID NO: 2000745 - DNA, 17 bp, Homo sapiens
ttaaaatgctgttttgt

SEQ ID NO: 2000746 - DNA, 13 bp, Homo sapiens
ttaaaatgtacac

SEQ ID NO: 2000747 - DNA, 15 bp, Homo sapiens
ttaaaattagtgaga

SEQ ID NO: 2000748 - DNA, 20 bp, Homo sapiens
ttaaaattggtaattgaatg

SEQ ID NO: 2000749 - DNA, 12 bp, Homo sapiens
ttaaaatttatt

SEQ ID NO: 2000750 - DNA, 15 bp, Homo sapiens
ttaaaatttattgct

SEQ ID NO: 2000751 - DNA, 19 bp, Homo sapiens
ttaaaattttacttttgtt

SEQ ID NO: 2000752 - DNA, 17 bp, Homo sapiens
ttaaacacctgacacat

SEQ ID NO: 2000753 - DNA, 14 bp, Homo sapiens
ttaaacactgtaat

SEQ ID NO: 2000754 - DNA, 23 bp, Homo sapiens
ttaaacagtgagcctgaattttg

SEQ ID NO: 2000755 - DNA, 22 bp, Homo sapiens
ttaaacatgctaaatagttcta

SEQ ID NO: 2000756 - DNA, 17 bp, Homo sapiens
ttaaaccagcagaaaag

SEQ ID NO: 2000757 - DNA, 21 bp, Homo sapiens
ttaaaccagcagaaaagtgct

SEQ ID NO: 2000758 - DNA, 22 bp, Homo sapiens
ttaaaccagcagaaaagtgctt

SEQ ID NO: 2000759 - DNA, 13 bp, Homo sapiens
ttaaactagtaat

SEQ ID NO: 2000760 - DNA, 14 bp, Homo sapiens
ttaaactgaagaag

SEQ ID NO: 2000761 - DNA, 20 bp, Homo sapiens
ttaaactgattagtattcag

SEQ ID NO: 2000762 - DNA, 13 bp, Homo sapiens
ttaaacttctgat

SEQ ID NO: 2000763 - DNA, 16 bp, Homo sapiens
ttaaagacttaagatt

SEQ ID NO: 2000764 - DNA, 22 bp, Homo sapiens
ttaaagagcatggaaaaatact

SEQ ID NO: 2000765 - DNA, 20 bp, Homo sapiens
ttaaagaggcgtcttgtatt

SEQ ID NO: 2000766 - DNA, 14 bp, Homo sapiens
ttaaagcaaaggag

SEQ ID NO: 2000767 - DNA, 22 bp, Homo sapiens
ttaaagcagagggactttgtat

SEQ ID NO: 2000768 - DNA, 15 bp, Homo sapiens
ttaaagcatttactt

SEQ ID NO: 2000769 - DNA, 20 bp, Homo sapiens
ttaaagcatttactttgaat

SEQ ID NO: 2000770 - DNA, 23 bp, Homo sapiens
ttaaaggaaaagtcaacatcttc

SEQ ID NO: 2000771 - DNA, 12 bp, Homo sapiens
ttaaaggaagga

SEQ ID NO: 2000772 - DNA, 18 bp, Homo sapiens
ttaaaggcaccatctaat

SEQ ID NO: 2000773 - DNA, 22 bp, Homo sapiens
ttaaagggtagcctacaaatgt

SEQ ID NO: 2000774 - DNA, 22 bp, Homo sapiens
ttaaagtacctgtagtgagaaa

SEQ ID NO: 2000775 - DNA, 23 bp, Homo sapiens
ttaaagtatgttattgcataatt

SEQ ID NO: 2000776 - DNA, 17 bp, Homo sapiens
ttaaagtgtaataatat

SEQ ID NO: 2000777 - DNA, 15 bp, Homo sapiens
ttaaagttgtttgtg

SEQ ID NO: 2000778 - DNA, 13 bp, Homo sapiens
ttaaataaaagaa

SEQ ID NO: 2000779 - DNA, 21 bp, Homo sapiens
ttaaataaagtatcatgcatt

SEQ ID NO: 2000780 - DNA, 21 bp, Homo sapiens
ttaaataaatgtcattaaaat

SEQ ID NO: 2000781 - DNA, 14 bp, Homo sapiens
ttaaataaattcaa

SEQ ID NO: 2000782 - DNA, 15 bp, Homo sapiens
ttaaatagcatctgc

SEQ ID NO: 2000783 - DNA, 20 bp, Homo sapiens
ttaaatagcatctgctcttc

SEQ ID NO: 2000784 - DNA, 19 bp, Homo sapiens
ttaaatataaatgtttgtc

SEQ ID NO: 2000785 - DNA, 15 bp, Homo sapiens
ttaaatatgaacaaa

SEQ ID NO: 2000786 - DNA, 20 bp, Homo sapiens
ttaaatattgaataagtatt

SEQ ID NO: 2000787 - DNA, 17 bp, Homo sapiens
ttaaatatttaacatag

SEQ ID NO: 2000788 - DNA, 18 bp, Homo sapiens
ttaaatatttacatatga

SEQ ID NO: 2000789 - DNA, 17 bp, Homo sapiens
ttaaatcaaaagctgct

SEQ ID NO: 2000790 - DNA, 18 bp, Homo sapiens
ttaaatctgtttttctaa

SEQ ID NO: 2000791 - DNA, 22 bp, Homo sapiens
ttaaatcttcaatatgaaggac

SEQ ID NO: 2000792 - DNA, 19 bp, Homo sapiens
ttaaatgaaaatgtaactt

SEQ ID NO: 2000793 - DNA, 14 bp, Homo sapiens
ttaaatgaaattgt

SEQ ID NO: 2000794 - DNA, 19 bp, Homo sapiens
ttaaatgtcttatatagca

SEQ ID NO: 2000795 - DNA, 20 bp, Homo sapiens
ttaaatgttgaaatcttaaa

SEQ ID NO: 2000796 - DNA, 21 bp, Homo sapiens
ttaacaaaacaagaaagaaac

SEQ ID NO: 2000797 - DNA, 15 bp, Homo sapiens
ttaacaaaagcaaga

SEQ ID NO: 2000798 - DNA, 14 bp, Homo sapiens
ttaacagaaccaga

SEQ ID NO: 2000799 - DNA, 17 bp, Homo sapiens
ttaacatctattataaa

SEQ ID NO: 2000800 - DNA, 14 bp, Homo sapiens
ttaacattctgtaa

SEQ ID NO: 2000801 - DNA, 19 bp, Homo sapiens
ttaacattgacttcttggt

SEQ ID NO: 2000802 - DNA, 19 bp, Homo sapiens
ttaacatttatctaaaaga

SEQ ID NO: 2000803 - DNA, 15 bp, Homo sapiens
ttaaccgtttttcaa

SEQ ID NO: 2000804 - DNA, 17 bp, Homo sapiens
ttaaccgtttttcaaga

SEQ ID NO: 2000805 - DNA, 22 bp, Homo sapiens
ttaaccgtttttcaagaaaact

SEQ ID NO: 2000806 - DNA, 18 bp, Homo sapiens
ttaacctgtttatataat

SEQ ID NO: 2000807 - DNA, 19 bp, Homo sapiens
ttaacctttccgctgtcgc

SEQ ID NO: 2000808 - DNA, 17 bp, Homo sapiens
ttaacggctccaggatt

SEQ ID NO: 2000809 - DNA, 19 bp, Homo sapiens
ttaacggctccaggatttt

SEQ ID NO: 2000810 - DNA, 17 bp, Homo sapiens
ttaacgtcatctcaggg

SEQ ID NO: 2000811 - DNA, 12 bp, Homo sapiens
ttaactaattta

SEQ ID NO: 2000812 - DNA, 14 bp, Homo sapiens
ttaactagaattta

SEQ ID NO: 2000813 - DNA, 19 bp, Homo sapiens
ttaactatgtgatgttaac

SEQ ID NO: 2000814 - DNA, 16 bp, Homo sapiens
ttaactcattagactg

SEQ ID NO: 2000815 - DNA, 17 bp, Homo sapiens
ttaactctctttatgtc

SEQ ID NO: 2000816 - DNA, 19 bp, Homo sapiens
ttaactctctttatgtctg

SEQ ID NO: 2000817 - DNA, 22 bp, Homo sapiens
ttaactgtgtgaagaaatggaa

SEQ ID NO: 2000818 - DNA, 18 bp, Homo sapiens
ttaacttaacattctgta

SEQ ID NO: 2000819 - DNA, 18 bp, Homo sapiens
ttaacttagcttgaagga

SEQ ID NO: 2000820 - DNA, 13 bp, Homo sapiens
ttaacttgtatat

SEQ ID NO: 2000821 - DNA, 16 bp, Homo sapiens
ttaactttaagactga

SEQ ID NO: 2000822 - DNA, 17 bp, Homo sapiens
ttaagaatggaagaaaa

SEQ ID NO: 2000823 - DNA, 16 bp, Homo sapiens
ttaagacgtgaatgtc

SEQ ID NO: 2000824 - DNA, 19 bp, Homo sapiens
ttaagacgtgaatgtctca

SEQ ID NO: 2000825 - DNA, 20 bp, Homo sapiens
ttaagacgtgaatgtctcag

SEQ ID NO: 2000826 - DNA, 17 bp, Homo sapiens
ttaagacttgacagtgg

SEQ ID NO: 2000827 - DNA, 10 bp, Homo sapiens
ttaagacttt

SEQ ID NO: 2000828 - DNA, 12 bp, Homo sapiens
ttaagagaaatg

SEQ ID NO: 2000829 - DNA, 15 bp, Homo sapiens
ttaagagaaatggca

SEQ ID NO: 2000830 - DNA, 14 bp, Homo sapiens
ttaagagcaataaa

SEQ ID NO: 2000831 - DNA, 19 bp, Homo sapiens
ttaagagtgaaataattaa

SEQ ID NO: 2000832 - DNA, 21 bp, Homo sapiens
ttaagatacactcctgctgtg

SEQ ID NO: 2000833 - DNA, 23 bp, Homo sapiens
ttaagattaaattatatctgagg

SEQ ID NO: 2000834 - DNA, 13 bp, Homo sapiens
ttaagcagccttt

SEQ ID NO: 2000835 - DNA, 21 bp, Homo sapiens
ttaagcagcctttctgtggag

SEQ ID NO: 2000836 - DNA, 22 bp, Homo sapiens
ttaagcaggaatcctagaagca

SEQ ID NO: 2000837 - DNA, 22 bp, Homo sapiens
ttaagcctcatatttaaagaca

SEQ ID NO: 2000838 - DNA, 19 bp, Homo sapiens
ttaaggaggtagctcccag

SEQ ID NO: 2000839 - DNA, 14 bp, Homo sapiens
ttatggtgtaatgc

SEQ ID NO: 2000840 - DNA, 16 bp, Homo sapiens
ttatggtgtaatgcac

SEQ ID NO: 2000841 - DNA, 19 bp, Homo sapiens
ttatggtgtaatgcacaat

SEQ ID NO: 2000842 - DNA, 18 bp, Homo sapiens
ttatgtaacatccagaag

SEQ ID NO: 2000843 - DNA, 14 bp, Homo sapiens
ttatgtaatgcttt

SEQ ID NO: 2000844 - DNA, 18 bp, Homo sapiens
ttatgtaattattttctt

SEQ ID NO: 2000845 - DNA, 21 bp, Homo sapiens
ttatgtatatactatacaaca

SEQ ID NO: 2000846 - DNA, 23 bp, Homo sapiens
ttatgtgacaacctttgtgtaat

SEQ ID NO: 2000847 - DNA, 16 bp, Homo sapiens
ttatgtgtgggaaagg

SEQ ID NO: 2000848 - DNA, 18 bp, Homo sapiens
ttatgtgtgtatatgtat

SEQ ID NO: 2000849 - DNA, 13 bp, Homo sapiens
ttatgttaaaatc

SEQ ID NO: 2000850 - DNA, 20 bp, Homo sapiens
ttattaaaatgattgtaaaa

SEQ ID NO: 2000851 - DNA, 13 bp, Homo sapiens
ttattaaagcaac

SEQ ID NO: 2000852 - DNA, 20 bp, Homo sapiens
ttattaaataaatattttac

SEQ ID NO: 2000853 - DNA, 23 bp, Homo sapiens
ttattaaataaatattttacagt

SEQ ID NO: 2000854 - DNA, 19 bp, Homo sapiens
ttattaacgggcatgtatt

SEQ ID NO: 2000855 - DNA, 20 bp, Homo sapiens
ttattaacgggcatgtatta

SEQ ID NO: 2000856 - DNA, 22 bp, Homo sapiens
ttattaagtctgggatgtagaa

SEQ ID NO: 2000857 - DNA, 23 bp, Homo sapiens
ttattaagtctgggatgtagaac

SEQ ID NO: 2000858 - DNA, 22 bp, Homo sapiens
ttattaagttctcaatgtgaaa

SEQ ID NO: 2000859 - DNA, 21 bp, Homo sapiens
ttattagattctccaaatgat

SEQ ID NO: 2000860 - DNA, 11 bp, Homo sapiens
ttattattaga

SEQ ID NO: 2000861 - DNA, 16 bp, Homo sapiens
ttattattttcacctg

SEQ ID NO: 2000862 - DNA, 13 bp, Homo sapiens
ttattcaaatgaa

SEQ ID NO: 2000863 - DNA, 16 bp, Homo sapiens
ttattcaagttattgt

SEQ ID NO: 2000864 - DNA, 17 bp, Homo sapiens
ttattcaattctgtata

SEQ ID NO: 2000865 - DNA, 19 bp, Homo sapiens
ttattcactgtaagtttat

SEQ ID NO: 2000866 - DNA, 20 bp, Homo sapiens
ttattcagcttcatttgtgt

SEQ ID NO: 2000867 - DNA, 21 bp, Homo sapiens
ttattcatgctttctcctttt

SEQ ID NO: 2000868 - DNA, 15 bp, Homo sapiens
ttattcattgtatga

SEQ ID NO: 2000869 - DNA, 12 bp, Homo sapiens
ttattcatttaa

SEQ ID NO: 2000870 - DNA, 13 bp, Homo sapiens
ttattcatttaaa

SEQ ID NO: 2000871 - DNA, 19 bp, Homo sapiens
ttattccctttcacaaaat

SEQ ID NO: 2000872 - DNA, 13 bp, Homo sapiens
ttattctaatttt

SEQ ID NO: 2000873 - DNA, 13 bp, Homo sapiens
ttattctagatta

SEQ ID NO: 2000874 - DNA, 22 bp, Homo sapiens
ttattctatcactggcaatatt

SEQ ID NO: 2000875 - DNA, 11 bp, Homo sapiens
ttattctgctc

SEQ ID NO: 2000876 - DNA, 13 bp, Homo sapiens
ttattctttttaa

SEQ ID NO: 2000877 - DNA, 18 bp, Homo sapiens
ttattgacaataatttca

SEQ ID NO: 2000878 - DNA, 13 bp, Homo sapiens
ttattgagaattt

SEQ ID NO: 2000879 - DNA, 14 bp, Homo sapiens
ttattgagctctat

SEQ ID NO: 2000880 - DNA, 14 bp, Homo sapiens
ttattgctcctgta

SEQ ID NO: 2000881 - DNA, 15 bp, Homo sapiens
ttattgcttaatccc

SEQ ID NO: 2000882 - DNA, 19 bp, Homo sapiens
ttattggaagtgttcaaga

SEQ ID NO: 2000883 - DNA, 19 bp, Homo sapiens
ttattgggcaagtgattga

SEQ ID NO: 2000884 - DNA, 14 bp, Homo sapiens
ttattgtacctctc

SEQ ID NO: 2000885 - DNA, 23 bp, Homo sapiens
ttattgtcattactgcctttgga

SEQ ID NO: 2000886 - DNA, 15 bp, Homo sapiens
ttatttaaaatagca

SEQ ID NO: 2000887 - DNA, 22 bp, Homo sapiens
ttatttaaaatagcaaaagaag

SEQ ID NO: 2000888 - DNA, 19 bp, Homo sapiens
ttatttaaatgttgaaatc

SEQ ID NO: 2000889 - DNA, 20 bp, Homo sapiens
ttatttaatgtttgatttag

SEQ ID NO: 2000890 - DNA, 17 bp, Homo sapiens
ttatttactgagcttct

SEQ ID NO: 2000891 - DNA, 22 bp, Homo sapiens
ttatttactgagcttctctgtg

SEQ ID NO: 2000892 - DNA, 13 bp, Homo sapiens
ttatttacttgta

SEQ ID NO: 2000893 - DNA, 18 bp, Homo sapiens
ttatttatattcagagat

SEQ ID NO: 2000894 - DNA, 14 bp, Homo sapiens
ttatttatgcctct

SEQ ID NO: 2000895 - DNA, 20 bp, Homo sapiens
ttatttatgcctctgtattt

SEQ ID NO: 2000896 - DNA, 13 bp, Homo sapiens
ttatttattcact

SEQ ID NO: 2000897 - DNA, 22 bp, Homo sapiens
ttatttattcagcttcatttgt

SEQ ID NO: 2000898 - DNA, 15 bp, Homo sapiens
ttatttattggagat

SEQ ID NO: 2000899 - DNA, 23 bp, Homo sapiens
ttatttatttctgtaaaatttgt

SEQ ID NO: 2000900 - DNA, 18 bp, Homo sapiens
ttatttccaaaataaaat

SEQ ID NO: 2000901 - DNA, 20 bp, Homo sapiens
ttatttccaaaataaaatga

SEQ ID NO: 2000902 - DNA, 17 bp, Homo sapiens
ttatttccaaataaaat

SEQ ID NO: 2000903 - DNA, 12 bp, Homo sapiens
ttatttctagca

SEQ ID NO: 2000904 - DNA, 19 bp, Homo sapiens
ttatttctcgggtgcattt

SEQ ID NO: 2000905 - DNA, 16 bp, Homo sapiens
ttatttctgtcattca

SEQ ID NO: 2000906 - DNA, 19 bp, Homo sapiens
ttatttcttaaacaaatgt

SEQ ID NO: 2000907 - DNA, 14 bp, Homo sapiens
ttatttgcaataaa

SEQ ID NO: 2000908 - DNA, 20 bp, Homo sapiens
ttatttggaataataatttt

SEQ ID NO: 2000909 - DNA, 12 bp, Homo sapiens
ttatttgtaata

SEQ ID NO: 2000910 - DNA, 18 bp, Homo sapiens
ttatttgtaatagatgtt

SEQ ID NO: 2000911 - DNA, 13 bp, Homo sapiens
ttatttgtataat

SEQ ID NO: 2000912 - DNA, 21 bp, Homo sapiens
ttatttgtgtaatagaaaact

SEQ ID NO: 2000913 - DNA, 17 bp, Homo sapiens
ttattttaaaaaatgaa

SEQ ID NO: 2000914 - DNA, 16 bp, Homo sapiens
ttattttaaacaaaat

SEQ ID NO: 2000915 - DNA, 20 bp, Homo sapiens
ttattttagtctgtcatcca

SEQ ID NO: 2000916 - DNA, 17 bp, Homo sapiens
ttattttctttgaaatt

SEQ ID NO: 2000917 - DNA, 15 bp, Homo sapiens
ttattttgaaatttg

SEQ ID NO: 2000918 - DNA, 13 bp, Homo sapiens
ttattttgtaata

SEQ ID NO: 2000919 - DNA, 21 bp, Homo sapiens
ttattttgttgtgattttgta

SEQ ID NO: 2000920 - DNA, 18 bp, Homo sapiens
ttatttttagacagagtc

SEQ ID NO: 2000921 - DNA, 19 bp, Homo sapiens
ttatttttatacaccattg

SEQ ID NO: 2000922 - DNA, 21 bp, Homo sapiens
ttatttttatacaccattgtt

SEQ ID NO: 2000923 - DNA, 14 bp, Homo sapiens
ttatttttcatatt

SEQ ID NO: 2000924 - DNA, 16 bp, Homo sapiens
ttatttttcatattgt

SEQ ID NO: 2000925 - DNA, 16 bp, Homo sapiens
ttattttttaaaataa

SEQ ID NO: 2000926 - DNA, 18 bp, Homo sapiens
ttattttttaagtattta

SEQ ID NO: 2000927 - DNA, 20 bp, Homo sapiens
ttattttttctacacagtaa

SEQ ID NO: 2000928 - DNA, 14 bp, Homo sapiens
ttcaaaaagtgttt

SEQ ID NO: 2000929 - DNA, 21 bp, Homo sapiens
ttcaaaaattacactacaagt

SEQ ID NO: 2000930 - DNA, 19 bp, Homo sapiens
ttcaaaagacatgttgtaa

SEQ ID NO: 2000931 - DNA, 16 bp, Homo sapiens
ttcaaaccatttaatt

SEQ ID NO: 2000932 - DNA, 18 bp, Homo sapiens
ttcaaagttaattttccc

SEQ ID NO: 2000933 - DNA, 19 bp, Homo sapiens
ttcaaagtttaataaattt

SEQ ID NO: 2000934 - DNA, 23 bp, Homo sapiens
ttcaaatggcagcagttccatga

SEQ ID NO: 2000935 - DNA, 20 bp, Homo sapiens
ttcaaatgtcagcttaaaat

SEQ ID NO: 2000936 - DNA, 14 bp, Homo sapiens
ttcaaccagcattt

SEQ ID NO: 2000937 - DNA, 15 bp, Homo sapiens
ttcaaccagcatttt

SEQ ID NO: 2000938 - DNA, 18 bp, Homo sapiens
ttcaaccagcattttact

SEQ ID NO: 2000939 - DNA, 23 bp, Homo sapiens
ttcaaccagcattttactacttg

SEQ ID NO: 2000940 - DNA, 15 bp, Homo sapiens
ttcaaccattcccca

SEQ ID NO: 2000941 - DNA, 17 bp, Homo sapiens
ttcaaccttaaggactt

SEQ ID NO: 2000942 - DNA, 14 bp, Homo sapiens
ttcaacgcagccct

SEQ ID NO: 2000943 - DNA, 13 bp, Homo sapiens
ttcaactccagaa

SEQ ID NO: 2000944 - DNA, 18 bp, Homo sapiens
ttcaacttggaaaaagaa

SEQ ID NO: 2000945 - DNA, 12 bp, Homo sapiens
ttcaacttttcc

SEQ ID NO: 2000946 - DNA, 21 bp, Homo sapiens
ttcaagaaaaaataaatggaa

SEQ ID NO: 2000947 - DNA, 15 bp, Homo sapiens
ttcaagaaaactgga

SEQ ID NO: 2000948 - DNA, 13 bp, Homo sapiens
ttcaagaaactga

SEQ ID NO: 2000949 - DNA, 23 bp, Homo sapiens
ttcaagaaactgaggaattttct

SEQ ID NO: 2000950 - DNA, 14 bp, Homo sapiens
ttcaagaccagcct

SEQ ID NO: 2000951 - DNA, 20 bp, Homo sapiens
ttcaagatacatttcatctg

SEQ ID NO: 2000952 - DNA, 12 bp, Homo sapiens
ttcaaggaaagt

SEQ ID NO: 2000953 - DNA, 17 bp, Homo sapiens
ttcaaggtggccaaatt

SEQ ID NO: 2000954 - DNA, 21 bp, Homo sapiens
ttcctgtatttgttcccaaga

SEQ ID NO: 2000955 - DNA, 15 bp, Homo sapiens
ttcctgtcccacctc

SEQ ID NO: 2000956 - DNA, 15 bp, Homo sapiens
ttcctgtgccaacct

SEQ ID NO: 2000957 - DNA, 18 bp, Homo sapiens
ttcctgtggccaggaggt

SEQ ID NO: 2000958 - DNA, 19 bp, Homo sapiens
ttcctgtggccaggaggtt

SEQ ID NO: 2000959 - DNA, 23 bp, Homo sapiens
ttcctgttcaccttatgtattat

SEQ ID NO: 2000960 - DNA, 19 bp, Homo sapiens
ttccttaagtcagaacagc

SEQ ID NO: 2000961 - DNA, 15 bp, Homo sapiens
ttccttacccaaact

SEQ ID NO: 2000962 - DNA, 16 bp, Homo sapiens
ttccttactgcagaat

SEQ ID NO: 2000963 - DNA, 22 bp, Homo sapiens
ttccttataagaattaatctta

SEQ ID NO: 2000964 - DNA, 17 bp, Homo sapiens
ttccttcatttcctccg

SEQ ID NO: 2000965 - DNA, 13 bp, Homo sapiens
ttccttcccactc

SEQ ID NO: 2000966 - DNA, 13 bp, Homo sapiens
ttccttccctggg

SEQ ID NO: 2000967 - DNA, 17 bp, Homo sapiens
ttccttctaaacatttt

SEQ ID NO: 2000968 - DNA, 19 bp, Homo sapiens
ttccttctgcacccagaaa

SEQ ID NO: 2000969 - DNA, 17 bp, Homo sapiens
ttccttgagaaaaacaa

SEQ ID NO: 2000970 - DNA, 12 bp, Homo sapiens
ttccttggaggc

SEQ ID NO: 2000971 - DNA, 14 bp, Homo sapiens
ttccttggaggcca

SEQ ID NO: 2000972 - DNA, 18 bp, Homo sapiens
ttccttggaggccaccgg

SEQ ID NO: 2000973 - DNA, 14 bp, Homo sapiens
ttcctttatattta

SEQ ID NO: 2000974 - DNA, 10 bp, Homo sapiens
ttcctttcct

SEQ ID NO: 2000975 - DNA, 21 bp, Homo sapiens
ttcctttcctctgcagcactt

SEQ ID NO: 2000976 - DNA, 22 bp, Homo sapiens
ttcctttgaatcctctctctgt

SEQ ID NO: 2000977 - DNA, 16 bp, Homo sapiens
ttcctttggaagaaaa

SEQ ID NO: 2000978 - DNA, 17 bp, Homo sapiens
ttcctttggaagaaaaa

SEQ ID NO: 2000979 - DNA, 20 bp, Homo sapiens
ttccttttattctgtacctt

SEQ ID NO: 2000980 - DNA, 18 bp, Homo sapiens
ttccttttctaactctcc

SEQ ID NO: 2000981 - DNA, 23 bp, Homo sapiens
ttccttttgaaagaatcagtctt

SEQ ID NO: 2000982 - DNA, 20 bp, Homo sapiens
ttccttttgatggggagaaa

SEQ ID NO: 2000983 - DNA, 20 bp, Homo sapiens
ttccttttgcaacaagacaa

SEQ ID NO: 2000984 - DNA, 15 bp, Homo sapiens
ttcgaatgacactgt

SEQ ID NO: 2000985 - DNA, 18 bp, Homo sapiens
ttcgagaccaacctgacc

SEQ ID NO: 2000986 - DNA, 15 bp, Homo sapiens
ttcgagaccagccca

SEQ ID NO: 2000987 - DNA, 14 bp, Homo sapiens
ttcgagaccagcct

SEQ ID NO: 2000988 - DNA, 13 bp, Homo sapiens
ttcgcagccaccc

SEQ ID NO: 2000989 - DNA, 12 bp, Homo sapiens
ttcgcctgtggg

SEQ ID NO: 2000990 - DNA, 16 bp, Homo sapiens
ttcgcctgtgggaaga

SEQ ID NO: 2000991 - DNA, 13 bp, Homo sapiens
ttcgctcctgtgt

SEQ ID NO: 2000992 - DNA, 19 bp, Homo sapiens
ttcgctcctgtgtcttgca

SEQ ID NO: 2000993 - DNA, 10 bp, Homo sapiens
ttcgctgcca

SEQ ID NO: 2000994 - DNA, 14 bp, Homo sapiens
ttcgctgccaggac

SEQ ID NO: 2000995 - DNA, 14 bp, Homo sapiens
ttcgctgctctagc

SEQ ID NO: 2000996 - DNA, 13 bp, Homo sapiens
ttcgctttcctct

SEQ ID NO: 2000997 - DNA, 19 bp, Homo sapiens
ttcggacagtttatttgtt

SEQ ID NO: 2000998 - DNA, 15 bp, Homo sapiens
ttcggggtgtgatga

SEQ ID NO: 2000999 - DNA, 16 bp, Homo sapiens
ttcggtgggacagccc

SEQ ID NO: 2001000 - DNA, 13 bp, Homo sapiens
ttcggtttctgag

SEQ ID NO: 2001001 - DNA, 13 bp, Homo sapiens
ttcgtctgtccca

SEQ ID NO: 2001002 - DNA, 18 bp, Homo sapiens
ttcgtctgtcccagagct

SEQ ID NO: 2001003 - DNA, 12 bp, Homo sapiens
ttcgtgcatttg

SEQ ID NO: 2001004 - DNA, 14 bp, Homo sapiens
ttcgtgcatttgtg

SEQ ID NO: 2001005 - DNA, 15 bp, Homo sapiens
ttcgtgcatttgtga

SEQ ID NO: 2001006 - DNA, 15 bp, Homo sapiens
ttctaaaatgattgt

SEQ ID NO: 2001007 - DNA, 14 bp, Homo sapiens
ttctaaaatgcctt

SEQ ID NO: 2001008 - DNA, 13 bp, Homo sapiens
ttctaaaattgaa

SEQ ID NO: 2001009 - DNA, 13 bp, Homo sapiens
ttctaaatagcaa

SEQ ID NO: 2001010 - DNA, 18 bp, Homo sapiens
ttctaaatgaatgtttac

SEQ ID NO: 2001011 - DNA, 13 bp, Homo sapiens
ttctaacctcagc

SEQ ID NO: 2001012 - DNA, 16 bp, Homo sapiens
ttctaactgtaaatca

SEQ ID NO: 2001013 - DNA, 21 bp, Homo sapiens
ttctaactgtaaatcacttgt

SEQ ID NO: 2001014 - DNA, 22 bp, Homo sapiens
ttctaactgtaaatcacttgta

SEQ ID NO: 2001015 - DNA, 16 bp, Homo sapiens
ttctaagagcatagaa

SEQ ID NO: 2001016 - DNA, 22 bp, Homo sapiens
ttctaaggaaatggagaagctc

SEQ ID NO: 2001017 - DNA, 23 bp, Homo sapiens
ttctaaggaaatggagaagctct

SEQ ID NO: 2001018 - DNA, 15 bp, Homo sapiens
ttctaagtaaaacca

SEQ ID NO: 2001019 - DNA, 21 bp, Homo sapiens
ttctaagttcatgtttgtaaa

SEQ ID NO: 2001020 - DNA, 15 bp, Homo sapiens
ttctaataaaacaaa

SEQ ID NO: 2001021 - DNA, 14 bp, Homo sapiens
ttctaatagaactc

SEQ ID NO: 2001022 - DNA, 17 bp, Homo sapiens
ttctaattggcatgaag

SEQ ID NO: 2001023 - DNA, 13 bp, Homo sapiens
ttctacaaccaga

SEQ ID NO: 2001024 - DNA, 18 bp, Homo sapiens
ttctacaaccagagcccc

SEQ ID NO: 2001025 - DNA, 17 bp, Homo sapiens
ttctacacatatatgta

SEQ ID NO: 2001026 - DNA, 19 bp, Homo sapiens
ttctacacatatatgtata

SEQ ID NO: 2001027 - DNA, 18 bp, Homo sapiens
ttctacatagtaactctt

SEQ ID NO: 2001028 - DNA, 14 bp, Homo sapiens
ttctaccatttcag

SEQ ID NO: 2001029 - DNA, 15 bp, Homo sapiens
ttctacgtataaata

SEQ ID NO: 2001030 - DNA, 19 bp, Homo sapiens
ttctacttgcactagcatg

SEQ ID NO: 2001031 - DNA, 22 bp, Homo sapiens
ttctagacttcagaacatgctg

SEQ ID NO: 2001032 - DNA, 12 bp, Homo sapiens
ttctagagaaga

SEQ ID NO: 2001033 - DNA, 22 bp, Homo sapiens
ttctagagaagaggctggtgct

SEQ ID NO: 2001034 - DNA, 16 bp, Homo sapiens
ttctagctagaaatat

SEQ ID NO: 2001035 - DNA, 18 bp, Homo sapiens
ttctaggtcctggcttct

SEQ ID NO: 2001036 - DNA, 21 bp, Homo sapiens
ttctagtctcctttgcactga

SEQ ID NO: 2001037 - DNA, 23 bp, Homo sapiens
ttctagtctcctttgcactgagg

SEQ ID NO: 2001038 - DNA, 21 bp, Homo sapiens
ttctagtgtaacactgcaaga

SEQ ID NO: 2001039 - DNA, 19 bp, Homo sapiens
ttctatataaggaggaaaa

SEQ ID NO: 2001040 - DNA, 22 bp, Homo sapiens
ttctattcaaggtggccaaatt

SEQ ID NO: 2001041 - DNA, 16 bp, Homo sapiens
ttctattcataataaa

SEQ ID NO: 2001042 - DNA, 20 bp, Homo sapiens
ttctattctctcctcagact

SEQ ID NO: 2001043 - DNA, 14 bp, Homo sapiens
ttctattgaaaaat

SEQ ID NO: 2001044 - DNA, 20 bp, Homo sapiens
ttctatttaaaaaataaaaa

SEQ ID NO: 2001045 - DNA, 13 bp, Homo sapiens
ttctattttgtaa

SEQ ID NO: 2001046 - DNA, 16 bp, Homo sapiens
ttctattttgtaaact

SEQ ID NO: 2001047 - DNA, 18 bp, Homo sapiens
ttctatttttcttctaaa

SEQ ID NO: 2001048 - DNA, 11 bp, Homo sapiens
ttctcacaatt

SEQ ID NO: 2001049 - DNA, 18 bp, Homo sapiens
ttctcacaattgtaaagt

SEQ ID NO: 2001050 - DNA, 18 bp, Homo sapiens
ttctcacatctgtccaga

SEQ ID NO: 2001051 - DNA, 15 bp, Homo sapiens
ttctcactccaccac

SEQ ID NO: 2001052 - DNA, 16 bp, Homo sapiens
ttctcactcctacctg

SEQ ID NO: 2001053 - DNA, 17 bp, Homo sapiens
ttctcagaatccaaaga

SEQ ID NO: 2001054 - DNA, 18 bp, Homo sapiens
ttctcagaatccaaagat

SEQ ID NO: 2001055 - DNA, 19 bp, Homo sapiens
ttctcagacttgttgtcta

SEQ ID NO: 2001056 - DNA, 22 bp, Homo sapiens
ttctcaggacacaggcctgtgt

SEQ ID NO: 2001057 - DNA, 19 bp, Homo sapiens
ttctcagtcggtgtgtaat

SEQ ID NO: 2001058 - DNA, 22 bp, Homo sapiens
ttctcataggaaaagtacattt

SEQ ID NO: 2001059 - DNA, 15 bp, Homo sapiens
ttctcatcatattgt

SEQ ID NO: 2001060 - DNA, 17 bp, Homo sapiens
ttctcatgatttacaga

SEQ ID NO: 2001061 - DNA, 22 bp, Homo sapiens
ttctcattttttaaaaaagctt

SEQ ID NO: 2001062 - DNA, 13 bp, Homo sapiens
ttctccaccctgc

SEQ ID NO: 2001063 - DNA, 16 bp, Homo sapiens
ttctccaccctgctct

SEQ ID NO: 2001064 - DNA, 19 bp, Homo sapiens
ttctccagacccaccacac

SEQ ID NO: 2001065 - DNA, 15 bp, Homo sapiens
ttctccagcccacac

SEQ ID NO: 2001066 - DNA, 21 bp, Homo sapiens
ttctccagcccacacccctcc

SEQ ID NO: 2001067 - DNA, 22 bp, Homo sapiens
ttctccagcccacacccctcca

SEQ ID NO: 2001068 - DNA, 17 bp, Homo sapiens
ttctccaggattccaaa

SEQ ID NO: 2001069 - DNA, 14 bp, Homo sapiens
ttgccactttggct

SEQ ID NO: 2001070 - DNA, 15 bp, Homo sapiens
ttgccactttggctt

SEQ ID NO: 2001071 - DNA, 21 bp, Homo sapiens
ttgccagccagaagcctctgc

SEQ ID NO: 2001072 - DNA, 12 bp, Homo sapiens
ttgccaggctag

SEQ ID NO: 2001073 - DNA, 18 bp, Homo sapiens
ttgccatgttggccaggc

SEQ ID NO: 2001074 - DNA, 12 bp, Homo sapiens
ttgcccagagat

SEQ ID NO: 2001075 - DNA, 16 bp, Homo sapiens
ttgcccagagatgcct

SEQ ID NO: 2001076 - DNA, 17 bp, Homo sapiens
ttgcccagagatgcctc

SEQ ID NO: 2001077 - DNA, 19 bp, Homo sapiens
ttgcccagagatgcctcca

SEQ ID NO: 2001078 - DNA, 16 bp, Homo sapiens
ttgcccaggcaggtct

SEQ ID NO: 2001079 - DNA, 12 bp, Homo sapiens
ttgcccaggctg

SEQ ID NO: 2001080 - DNA, 13 bp, Homo sapiens
ttgcccccatccc

SEQ ID NO: 2001081 - DNA, 13 bp, Homo sapiens
ttgccccttcccc

SEQ ID NO: 2001082 - DNA, 18 bp, Homo sapiens
ttgccccttccccatctc

SEQ ID NO: 2001083 - DNA, 19 bp, Homo sapiens
ttgccccttccccatctcc

SEQ ID NO: 2001084 - DNA, 12 bp, Homo sapiens
ttgccccttggg

SEQ ID NO: 2001085 - DNA, 13 bp, Homo sapiens
ttgccccttgggc

SEQ ID NO: 2001086 - DNA, 22 bp, Homo sapiens
ttgccccttgggcctcccccca

SEQ ID NO: 2001087 - DNA, 15 bp, Homo sapiens
ttgcccgccagcctc

SEQ ID NO: 2001088 - DNA, 13 bp, Homo sapiens
ttgccctgacctc

SEQ ID NO: 2001089 - DNA, 18 bp, Homo sapiens
ttgccctgacctcccagc

SEQ ID NO: 2001090 - DNA, 10 bp, Homo sapiens
ttgccctggt

SEQ ID NO: 2001091 - DNA, 17 bp, Homo sapiens
ttgcccttcacagtgtt

SEQ ID NO: 2001092 - DNA, 14 bp, Homo sapiens
ttgccgagagaggc

SEQ ID NO: 2001093 - DNA, 17 bp, Homo sapiens
ttgcctactatgccaga

SEQ ID NO: 2001094 - DNA, 23 bp, Homo sapiens
ttgcctcaaataaaaagtgcttt

SEQ ID NO: 2001095 - DNA, 13 bp, Homo sapiens
ttgcctgaggctc

SEQ ID NO: 2001096 - DNA, 17 bp, Homo sapiens
ttgcctgaggctcaaga

SEQ ID NO: 2001097 - DNA, 23 bp, Homo sapiens
ttgcctgaggctcaagaggccca

SEQ ID NO: 2001098 - DNA, 15 bp, Homo sapiens
ttgcctgcagagaga

SEQ ID NO: 2001099 - DNA, 15 bp, Homo sapiens
ttgcctgccagggcc

SEQ ID NO: 2001100 - DNA, 22 bp, Homo sapiens
ttgcctgcgttttggaagctct

SEQ ID NO: 2001101 - DNA, 21 bp, Homo sapiens
ttgcctggctgtggaggcctg

SEQ ID NO: 2001102 - DNA, 22 bp, Homo sapiens
ttgcctggctgtggaggcctga

SEQ ID NO: 2001103 - DNA, 19 bp, Homo sapiens
ttgcctgtaacaagccaga

SEQ ID NO: 2001104 - DNA, 14 bp, Homo sapiens
ttgccttagcactt

SEQ ID NO: 2001105 - DNA, 18 bp, Homo sapiens
ttgccttagcacttcttt

SEQ ID NO: 2001106 - DNA, 22 bp, Homo sapiens
ttgccttagcacttctttcctc

SEQ ID NO: 2001107 - DNA, 17 bp, Homo sapiens
ttgccttctacttttaa

SEQ ID NO: 2001108 - DNA, 16 bp, Homo sapiens
ttgccttttaaaagaa

SEQ ID NO: 2001109 - DNA, 18 bp, Homo sapiens
ttgccttttgcaaacttt

SEQ ID NO: 2001110 - DNA, 16 bp, Homo sapiens
ttgcgctggtggacca

SEQ ID NO: 2001111 - DNA, 23 bp, Homo sapiens
ttgcgctggtggaccacaggcat

SEQ ID NO: 2001112 - DNA, 19 bp, Homo sapiens
ttgcgggggagctggaaat

SEQ ID NO: 2001113 - DNA, 23 bp, Homo sapiens
ttgctaaacgactccgagaacaa

SEQ ID NO: 2001114 - DNA, 16 bp, Homo sapiens
ttgctagacagccagg

SEQ ID NO: 2001115 - DNA, 21 bp, Homo sapiens
ttgctatcaaaataaattgaa

SEQ ID NO: 2001116 - DNA, 9 bp, Homo sapiens
ttgctattt

SEQ ID NO: 2001117 - DNA, 16 bp, Homo sapiens
ttgctcaaaaatctgt

SEQ ID NO: 2001118 - DNA, 16 bp, Homo sapiens
ttgctcagtgcctcct

SEQ ID NO: 2001119 - DNA, 17 bp, Homo sapiens
ttgctcagtgcctcctg

SEQ ID NO: 2001120 - DNA, 17 bp, Homo sapiens
ttgctcttctttctgag

SEQ ID NO: 2001121 - DNA, 14 bp, Homo sapiens
ttgctgaatttcag

SEQ ID NO: 2001122 - DNA, 20 bp, Homo sapiens
ttgctgagcaccctctccgg

SEQ ID NO: 2001123 - DNA, 19 bp, Homo sapiens
ttgctgattcaagaaacag

SEQ ID NO: 2001124 - DNA, 21 bp, Homo sapiens
ttgctgcctgaagaacagtaa

SEQ ID NO: 2001125 - DNA, 14 bp, Homo sapiens
ttgctgctctctga

SEQ ID NO: 2001126 - DNA, 11 bp, Homo sapiens
ttgctgtccta

SEQ ID NO: 2001127 - DNA, 15 bp, Homo sapiens
ttgctgtcctaggcc

SEQ ID NO: 2001128 - DNA, 20 bp, Homo sapiens
ttgctgtgagcaagaagtca

SEQ ID NO: 2001129 - DNA, 13 bp, Homo sapiens
ttgctgtttcctt

SEQ ID NO: 2001130 - DNA, 14 bp, Homo sapiens
ttgcttaaaagaca

SEQ ID NO: 2001131 - DNA, 13 bp, Homo sapiens
ttgcttacatttt

SEQ ID NO: 2001132 - DNA, 22 bp, Homo sapiens
ttgcttagatgagggtgactgt

SEQ ID NO: 2001133 - DNA, 19 bp, Homo sapiens
ttgcttagtatggttctca

SEQ ID NO: 2001134 - DNA, 13 bp, Homo sapiens
ttgcttatgacat

SEQ ID NO: 2001135 - DNA, 15 bp, Homo sapiens
ttgcttattcttgag

SEQ ID NO: 2001136 - DNA, 14 bp, Homo sapiens
ttgcttatttatat

SEQ ID NO: 2001137 - DNA, 19 bp, Homo sapiens
ttgcttctaaatgcccagt

SEQ ID NO: 2001138 - DNA, 13 bp, Homo sapiens
ttgcttctgcagc

SEQ ID NO: 2001139 - DNA, 14 bp, Homo sapiens
ttgcttctgcagca

SEQ ID NO: 2001140 - DNA, 22 bp, Homo sapiens
ttgcttctgcagcaactcccac

SEQ ID NO: 2001141 - DNA, 17 bp, Homo sapiens
ttgcttgagcccaggag

SEQ ID NO: 2001142 - DNA, 15 bp, Homo sapiens
ttgcttgccgagcct

SEQ ID NO: 2001143 - DNA, 16 bp, Homo sapiens
ttgcttggcagagagg

SEQ ID NO: 2001144 - DNA, 15 bp, Homo sapiens
ttgctttcttttctc

SEQ ID NO: 2001145 - DNA, 15 bp, Homo sapiens
ttgctttgaagcagt

SEQ ID NO: 2001146 - DNA, 22 bp, Homo sapiens
ttgctttgaagcagttgtgtca

SEQ ID NO: 2001147 - DNA, 13 bp, Homo sapiens
ttggaaaaaaatt

SEQ ID NO: 2001148 - DNA, 19 bp, Homo sapiens
ttggaaaagaatacagaaa

SEQ ID NO: 2001149 - DNA, 16 bp, Homo sapiens
ttggaaacattttctt

SEQ ID NO: 2001150 - DNA, 17 bp, Homo sapiens
ttggaaaggtttcaaga

SEQ ID NO: 2001151 - DNA, 18 bp, Homo sapiens
ttggaactctaccctggt

SEQ ID NO: 2001152 - DNA, 21 bp, Homo sapiens
ttggaagagaggcacctgctg

SEQ ID NO: 2001153 - DNA, 22 bp, Homo sapiens
ttggaagagaggcacctgctgg

SEQ ID NO: 2001154 - DNA, 19 bp, Homo sapiens
ttggaagctccgctttcta

SEQ ID NO: 2001155 - DNA, 16 bp, Homo sapiens
ttggaagttttcagga

SEQ ID NO: 2001156 - DNA, 19 bp, Homo sapiens
ttggaataataattttcct

SEQ ID NO: 2001157 - DNA, 14 bp, Homo sapiens
ttggaatgaacaat

SEQ ID NO: 2001158 - DNA, 14 bp, Homo sapiens
ttggacacactgta

SEQ ID NO: 2001159 - DNA, 14 bp, Homo sapiens
ttggacacagtgtt

SEQ ID NO: 2001160 - DNA, 13 bp, Homo sapiens
ttggacagctgct

SEQ ID NO: 2001161 - DNA, 18 bp, Homo sapiens
ttggacattttcttcaga

SEQ ID NO: 2001162 - DNA, 16 bp, Homo sapiens
ttggacccgctctgga

SEQ ID NO: 2001163 - DNA, 17 bp, Homo sapiens
ttggacccgctctggac

SEQ ID NO: 2001164 - DNA, 16 bp, Homo sapiens
ttggacctctgctctg

SEQ ID NO: 2001165 - DNA, 15 bp, Homo sapiens
ttggagaaattattt

SEQ ID NO: 2001166 - DNA, 15 bp, Homo sapiens
ttggagagcagctgg

SEQ ID NO: 2001167 - DNA, 17 bp, Homo sapiens
ttggagagcagctggct

SEQ ID NO: 2001168 - DNA, 18 bp, Homo sapiens
ttggagagtaaaaactga

SEQ ID NO: 2001169 - DNA, 20 bp, Homo sapiens
ttggagataatctagaacac

SEQ ID NO: 2001170 - DNA, 14 bp, Homo sapiens
ttggagcccgtgca

SEQ ID NO: 2001171 - DNA, 11 bp, Homo sapiens
ttggaggacag

SEQ ID NO: 2001172 - DNA, 12 bp, Homo sapiens
ttggagggatgg

SEQ ID NO: 2001173 - DNA, 21 bp, Homo sapiens
ttggataataactagatctcc

SEQ ID NO: 2001174 - DNA, 21 bp, Homo sapiens
ttggatacaaggatcagaatg

SEQ ID NO: 2001175 - DNA, 17 bp, Homo sapiens
ttggatagtcagctgta

SEQ ID NO: 2001176 - DNA, 17 bp, Homo sapiens
ttggattattcatttaa

SEQ ID NO: 2001177 - DNA, 20 bp, Homo sapiens
ttggattattcatttaaaat

SEQ ID NO: 2001178 - DNA, 20 bp, Homo sapiens
ttggatttacgactgaagaa

SEQ ID NO: 2001179 - DNA, 16 bp, Homo sapiens
ttggcaaattcctagt

SEQ ID NO: 2001180 - DNA, 15 bp, Homo sapiens
ttggcaacagaagca

SEQ ID NO: 2001181 - DNA, 20 bp, Homo sapiens
ttggcaatagtttgcataga

SEQ ID NO: 2001182 - DNA, 14 bp, Homo sapiens
ttggcagagaaggc

SEQ ID NO: 2001183 - DNA, 18 bp, Homo sapiens
ttggcagagaaggcctct

SEQ ID NO: 2001184 - DNA, 23 bp, Homo sapiens
ttggcagcttaacattgacttct

SEQ ID NO: 2001185 - DNA, 16 bp, Homo sapiens
ttgtagcatttcttga

SEQ ID NO: 2001186 - DNA, 23 bp, Homo sapiens
ttgtagttaatttattaagtctg

SEQ ID NO: 2001187 - DNA, 19 bp, Homo sapiens
ttgtagttcttgtgcatgt

SEQ ID NO: 2001188 - DNA, 17 bp, Homo sapiens
ttgtataaatgtatata

SEQ ID NO: 2001189 - DNA, 14 bp, Homo sapiens
ttgtataacttctt

SEQ ID NO: 2001190 - DNA, 17 bp, Homo sapiens
ttgtatagagatatgca

SEQ ID NO: 2001191 - DNA, 15 bp, Homo sapiens
ttgtatagtaaagtg

SEQ ID NO: 2001192 - DNA, 15 bp, Homo sapiens
ttgtatatacatatt

SEQ ID NO: 2001193 - DNA, 20 bp, Homo sapiens
ttgtatatacatattataaa

SEQ ID NO: 2001194 - DNA, 21 bp, Homo sapiens
ttgtatatatgtgtgtttaaa

SEQ ID NO: 2001195 - DNA, 18 bp, Homo sapiens
ttgtatattatggaagat

SEQ ID NO: 2001196 - DNA, 19 bp, Homo sapiens
ttgtatcacaaatcttaac

SEQ ID NO: 2001197 - DNA, 20 bp, Homo sapiens
ttgtatctctgaagcatgtt

SEQ ID NO: 2001198 - DNA, 21 bp, Homo sapiens
ttgtatctctgaagcatgttt

SEQ ID NO: 2001199 - DNA, 20 bp, Homo sapiens
ttgtatgatgtgttgtgata

SEQ ID NO: 2001200 - DNA, 12 bp, Homo sapiens
ttgtatgtaagt

SEQ ID NO: 2001201 - DNA, 19 bp, Homo sapiens
ttgtatgttaagttacttc

SEQ ID NO: 2001202 - DNA, 16 bp, Homo sapiens
ttgtattacatctaat

SEQ ID NO: 2001203 - DNA, 18 bp, Homo sapiens
ttgtattttcttcccatt

SEQ ID NO: 2001204 - DNA, 22 bp, Homo sapiens
ttgtattttcttcccatttgta

SEQ ID NO: 2001205 - DNA, 23 bp, Homo sapiens
ttgtattttcttcccatttgtaa

SEQ ID NO: 2001206 - DNA, 23 bp, Homo sapiens
ttgtcacaatcctaacacattat

SEQ ID NO: 2001207 - DNA, 18 bp, Homo sapiens
ttgtcactagcagctgca

SEQ ID NO: 2001208 - DNA, 20 bp, Homo sapiens
ttgtcactagcagctgcagt

SEQ ID NO: 2001209 - DNA, 14 bp, Homo sapiens
ttgtcactctacaa

SEQ ID NO: 2001210 - DNA, 15 bp, Homo sapiens
ttgtcactgtcttca

SEQ ID NO: 2001211 - DNA, 14 bp, Homo sapiens
ttgtcagactttaa

SEQ ID NO: 2001212 - DNA, 23 bp, Homo sapiens
ttgtcatataaacctgatgttga

SEQ ID NO: 2001213 - DNA, 15 bp, Homo sapiens
ttgtcatatattcat

SEQ ID NO: 2001214 - DNA, 23 bp, Homo sapiens
ttgtcatatattcatgtaataaa

SEQ ID NO: 2001215 - DNA, 23 bp, Homo sapiens
ttgtcatcattgtatatatgtgt

SEQ ID NO: 2001216 - DNA, 19 bp, Homo sapiens
ttgtcatctttcttctatt

SEQ ID NO: 2001217 - DNA, 18 bp, Homo sapiens
ttgtcatgtaccatcaat

SEQ ID NO: 2001218 - DNA, 13 bp, Homo sapiens
ttgtcatgtggct

SEQ ID NO: 2001219 - DNA, 13 bp, Homo sapiens
ttgtcattatgta

SEQ ID NO: 2001220 - DNA, 14 bp, Homo sapiens
ttgtcattatgtac

SEQ ID NO: 2001221 - DNA, 20 bp, Homo sapiens
ttgtccacagtctcccattc

SEQ ID NO: 2001222 - DNA, 13 bp, Homo sapiens
ttgtccatgccta

SEQ ID NO: 2001223 - DNA, 20 bp, Homo sapiens
ttgtccccagggcccctccc

SEQ ID NO: 2001224 - DNA, 11 bp, Homo sapiens
ttgtccccagt

SEQ ID NO: 2001225 - DNA, 13 bp, Homo sapiens
ttgtccctgctcc

SEQ ID NO: 2001226 - DNA, 15 bp, Homo sapiens
ttgtcctatgtcaat

SEQ ID NO: 2001227 - DNA, 13 bp, Homo sapiens
ttgtcctctcccg

SEQ ID NO: 2001228 - DNA, 16 bp, Homo sapiens
ttgtccttcagagctc

SEQ ID NO: 2001229 - DNA, 17 bp, Homo sapiens
ttgtccttcagagctct

SEQ ID NO: 2001230 - DNA, 19 bp, Homo sapiens
ttgtcctttgagaaagaaa

SEQ ID NO: 2001231 - DNA, 20 bp, Homo sapiens
ttgtctagaggtgagaccaa

SEQ ID NO: 2001232 - DNA, 18 bp, Homo sapiens
ttgtctattacctgttag

SEQ ID NO: 2001233 - DNA, 16 bp, Homo sapiens
ttgtctattctgagcc

SEQ ID NO: 2001234 - DNA, 18 bp, Homo sapiens
ttgtctattctgagcctt

SEQ ID NO: 2001235 - DNA, 19 bp, Homo sapiens
ttgtctcctacctgctgct

SEQ ID NO: 2001236 - DNA, 11 bp, Homo sapiens
ttgtctctcat

SEQ ID NO: 2001237 - DNA, 14 bp, Homo sapiens
ttgtctctgcatct

SEQ ID NO: 2001238 - DNA, 20 bp, Homo sapiens
ttgtctgaagtcactgcaca

SEQ ID NO: 2001239 - DNA, 11 bp, Homo sapiens
ttgtcttccaa

SEQ ID NO: 2001240 - DNA, 19 bp, Homo sapiens
ttgtgaaattcaacctgtg

SEQ ID NO: 2001241 - DNA, 19 bp, Homo sapiens
ttgtgactatatagagatg

SEQ ID NO: 2001242 - DNA, 22 bp, Homo sapiens
ttgtgactatatagagatgttt

SEQ ID NO: 2001243 - DNA, 14 bp, Homo sapiens
ttgtgactgaaggg

SEQ ID NO: 2001244 - DNA, 15 bp, Homo sapiens
ttgtgactggcaccc

SEQ ID NO: 2001245 - DNA, 16 bp, Homo sapiens
ttgtgagccaaagaga

SEQ ID NO: 2001246 - DNA, 22 bp, Homo sapiens
ttgtgatgtcccaacttgtaaa

SEQ ID NO: 2001247 - DNA, 18 bp, Homo sapiens
ttgtgatgtgagttgcac

SEQ ID NO: 2001248 - DNA, 17 bp, Homo sapiens
ttgtgattttgtacaga

SEQ ID NO: 2001249 - DNA, 22 bp, Homo sapiens
ttgtgcaatgtaaatattttaa

SEQ ID NO: 2001250 - DNA, 23 bp, Homo sapiens
ttgtgcaatgtaaatattttaaa

SEQ ID NO: 2001251 - DNA, 14 bp, Homo sapiens
ttgtgcatgtttac

SEQ ID NO: 2001252 - DNA, 16 bp, Homo sapiens
ttgtgcatgtttactt

SEQ ID NO: 2001253 - DNA, 16 bp, Homo sapiens
ttgtgccaatatgtat

SEQ ID NO: 2001254 - DNA, 21 bp, Homo sapiens
ttgtgccatgtcaaacaaata

SEQ ID NO: 2001255 - DNA, 17 bp, Homo sapiens
ttgtgcccactgtctct

SEQ ID NO: 2001256 - DNA, 22 bp, Homo sapiens
ttgtgctgatcgtgctaaattt

SEQ ID NO: 2001257 - DNA, 15 bp, Homo sapiens
ttgtgctgtgggcag

SEQ ID NO: 2001258 - DNA, 19 bp, Homo sapiens
ttgtgctgtgggcagcacc

SEQ ID NO: 2001259 - DNA, 22 bp, Homo sapiens
ttgtgctgtgggcagcaccctc

SEQ ID NO: 2001260 - DNA, 14 bp, Homo sapiens
ttgtgcttaaatta

SEQ ID NO: 2001261 - DNA, 16 bp, Homo sapiens
ttgtgcttaaattatt

SEQ ID NO: 2001262 - DNA, 16 bp, Homo sapiens
ttgtggataagggaga

SEQ ID NO: 2001263 - DNA, 16 bp, Homo sapiens
ttgtggcccaagcctg

SEQ ID NO: 2001264 - DNA, 14 bp, Homo sapiens
ttgtggtaaaaaga

SEQ ID NO: 2001265 - DNA, 21 bp, Homo sapiens
ttgtgtaatagaaaactgaaa

SEQ ID NO: 2001266 - DNA, 21 bp, Homo sapiens
ttgtgtacaaagtagagaagt

SEQ ID NO: 2001267 - DNA, 22 bp, Homo sapiens
ttgtgtacaaagtagagaagta

SEQ ID NO: 2001268 - DNA, 19 bp, Homo sapiens
ttgtgtcagagctgggagt

SEQ ID NO: 2001269 - DNA, 19 bp, Homo sapiens
ttgtgtctggcagtttata

SEQ ID NO: 2001270 - DNA, 13 bp, Homo sapiens
ttgtgtctgtaca

SEQ ID NO: 2001271 - DNA, 14 bp, Homo sapiens
ttgtgtctgtacac

SEQ ID NO: 2001272 - DNA, 15 bp, Homo sapiens
ttgtgtctgtacacg

SEQ ID NO: 2001273 - DNA, 16 bp, Homo sapiens
ttgtgtgttatttaaa

SEQ ID NO: 2001274 - DNA, 16 bp, Homo sapiens
ttgtgttctgagtgaa

SEQ ID NO: 2001275 - DNA, 13 bp, Homo sapiens
ttgtgtttagatt

SEQ ID NO: 2001276 - DNA, 17 bp, Homo sapiens
ttgttaaaaatattttc

SEQ ID NO: 2001277 - DNA, 18 bp, Homo sapiens
ttgttaaaaatattttct

SEQ ID NO: 2001278 - DNA, 14 bp, Homo sapiens
ttgttaaatattta

SEQ ID NO: 2001279 - DNA, 17 bp, Homo sapiens
ttgttaatattcatttt

SEQ ID NO: 2001280 - DNA, 12 bp, Homo sapiens
ttgttaatgcat

SEQ ID NO: 2001281 - DNA, 21 bp, Homo sapiens
ttgttaatttagaaaacttta

SEQ ID NO: 2001282 - DNA, 17 bp, Homo sapiens
ttgttatatatatcaag

SEQ ID NO: 2001283 - DNA, 12 bp, Homo sapiens
ttgttatgctat

SEQ ID NO: 2001284 - DNA, 14 bp, Homo sapiens
ttgttatgctatta

SEQ ID NO: 2001285 - DNA, 15 bp, Homo sapiens
ttgttatttgtacag

SEQ ID NO: 2001286 - DNA, 20 bp, Homo sapiens
ttgttctagttagcaggaaa

SEQ ID NO: 2001287 - DNA, 14 bp, Homo sapiens
ttgttctgtcacca

SEQ ID NO: 2001288 - DNA, 14 bp, Homo sapiens
ttgttctttaaaat

SEQ ID NO: 2001289 - DNA, 15 bp, Homo sapiens
ttgttgattaatttg

SEQ ID NO: 2001290 - DNA, 14 bp, Homo sapiens
ttgttgcaaaggtc

SEQ ID NO: 2001291 - DNA, 19 bp, Homo sapiens
ttgttgcaagtactgctgt

SEQ ID NO: 2001292 - DNA, 23 bp, Homo sapiens
ttgttgccttatcttgaaaagaa

SEQ ID NO: 2001293 - DNA, 18 bp, Homo sapiens
ttgtttaaaatcatttct

SEQ ID NO: 2001294 - DNA, 12 bp, Homo sapiens
ttgtttaaagtt

SEQ ID NO: 2001295 - DNA, 15 bp, Homo sapiens
ttgtttaaatataaa

SEQ ID NO: 2001296 - DNA, 12 bp, Homo sapiens
ttgtttaattgt

SEQ ID NO: 2001297 - DNA, 11 bp, Homo sapiens
ttgtttcagaa

SEQ ID NO: 2001298 - DNA, 16 bp, Homo sapiens
ttgtttctccccctgg

SEQ ID NO: 2001299 - DNA, 17 bp, Homo sapiens
ttgtttctccccctggg

SEQ ID NO: 2001300 - DNA, 21 bp, Homo sapiens
tttctaacatatgtattaagc

SEQ ID NO: 2001301 - DNA, 17 bp, Homo sapiens
tttctaactgtaaatca

SEQ ID NO: 2001302 - DNA, 20 bp, Homo sapiens
tttctaactgtaaatcactt

SEQ ID NO: 2001303 - DNA, 22 bp, Homo sapiens
tttctaactgtaaatcacttgt

SEQ ID NO: 2001304 - DNA, 23 bp, Homo sapiens
tttctaagtagatagaaagcaat

SEQ ID NO: 2001305 - DNA, 19 bp, Homo sapiens
tttctacacagtaaaaact

SEQ ID NO: 2001306 - DNA, 22 bp, Homo sapiens
tttctacacagtaaaaacttgt

SEQ ID NO: 2001307 - DNA, 21 bp, Homo sapiens
tttctacctgtgttcattctt

SEQ ID NO: 2001308 - DNA, 23 bp, Homo sapiens
tttctacgttatgaaaacagatg

SEQ ID NO: 2001309 - DNA, 17 bp, Homo sapiens
tttctacttatcctcat

SEQ ID NO: 2001310 - DNA, 23 bp, Homo sapiens
tttctagacttcagaacatgctg

SEQ ID NO: 2001311 - DNA, 15 bp, Homo sapiens
tttctagactttctg

SEQ ID NO: 2001312 - DNA, 16 bp, Homo sapiens
tttctagactttctgt

SEQ ID NO: 2001313 - DNA, 19 bp, Homo sapiens
tttctagctagaaatatga

SEQ ID NO: 2001314 - DNA, 22 bp, Homo sapiens
tttctagctagaaatatgattt

SEQ ID NO: 2001315 - DNA, 14 bp, Homo sapiens
tttctagtttcagt

SEQ ID NO: 2001316 - DNA, 18 bp, Homo sapiens
tttctatagccaaaaata

SEQ ID NO: 2001317 - DNA, 22 bp, Homo sapiens
tttctatagccaaaaatagcta

SEQ ID NO: 2001318 - DNA, 13 bp, Homo sapiens
tttctatagctct

SEQ ID NO: 2001319 - DNA, 22 bp, Homo sapiens
tttctattcataataaactaga

SEQ ID NO: 2001320 - DNA, 14 bp, Homo sapiens
tttctattccaaag

SEQ ID NO: 2001321 - DNA, 18 bp, Homo sapiens
tttctcagaatccaaaga

SEQ ID NO: 2001322 - DNA, 23 bp, Homo sapiens
tttctcagccgcttctgactgct

SEQ ID NO: 2001323 - DNA, 16 bp, Homo sapiens
tttctcagtttgtata

SEQ ID NO: 2001324 - DNA, 18 bp, Homo sapiens
tttctccagccagcaatg

SEQ ID NO: 2001325 - DNA, 17 bp, Homo sapiens
tttctcccagtcattta

SEQ ID NO: 2001326 - DNA, 15 bp, Homo sapiens
tttctccctcacccc

SEQ ID NO: 2001327 - DNA, 20 bp, Homo sapiens
tttctctccagcctgacttg

SEQ ID NO: 2001328 - DNA, 19 bp, Homo sapiens
tttctctccttcttccctg

SEQ ID NO: 2001329 - DNA, 20 bp, Homo sapiens
tttctctccttcttccctgt

SEQ ID NO: 2001330 - DNA, 14 bp, Homo sapiens
tttctctctttctt

SEQ ID NO: 2001331 - DNA, 16 bp, Homo sapiens
tttctctgagagagat

SEQ ID NO: 2001332 - DNA, 18 bp, Homo sapiens
tttctctgagagagatga

SEQ ID NO: 2001333 - DNA, 20 bp, Homo sapiens
tttctcttccctccttccct

SEQ ID NO: 2001334 - DNA, 20 bp, Homo sapiens
tttctgaaaattaacactgc

SEQ ID NO: 2001335 - DNA, 20 bp, Homo sapiens
tttctgaaatcgccgtgtta

SEQ ID NO: 2001336 - DNA, 14 bp, Homo sapiens
tttctgaccaaaga

SEQ ID NO: 2001337 - DNA, 15 bp, Homo sapiens
tttctgagaaaagaa

SEQ ID NO: 2001338 - DNA, 15 bp, Homo sapiens
tttctgagaaagact

SEQ ID NO: 2001339 - DNA, 22 bp, Homo sapiens
tttctgagaaagactattcaaa

SEQ ID NO: 2001340 - DNA, 19 bp, Homo sapiens
tttctgagaaggtccttaa

SEQ ID NO: 2001341 - DNA, 21 bp, Homo sapiens
tttctgagagttggctcaggc

SEQ ID NO: 2001342 - DNA, 17 bp, Homo sapiens
tttctgatgacataata

SEQ ID NO: 2001343 - DNA, 22 bp, Homo sapiens
tttctgattcactattagagaa

SEQ ID NO: 2001344 - DNA, 15 bp, Homo sapiens
tttctgcgtgcttta

SEQ ID NO: 2001345 - DNA, 16 bp, Homo sapiens
tttctgctgtttaagg

SEQ ID NO: 2001346 - DNA, 15 bp, Homo sapiens
tttctggaaattttg

SEQ ID NO: 2001347 - DNA, 18 bp, Homo sapiens
tttctggaatacatgaaa

SEQ ID NO: 2001348 - DNA, 20 bp, Homo sapiens
tttctggaatacatgaaata

SEQ ID NO: 2001349 - DNA, 21 bp, Homo sapiens
tttctggaatacatgaaatat

SEQ ID NO: 2001350 - DNA, 18 bp, Homo sapiens
tttctggtgcctatttat

SEQ ID NO: 2001351 - DNA, 13 bp, Homo sapiens
tttctgtctctct

SEQ ID NO: 2001352 - DNA, 14 bp, Homo sapiens
tttctgtcttctct

SEQ ID NO: 2001353 - DNA, 24 bp, Homo sapiens
tttctgtggagagtgagaataatt

SEQ ID NO: 2001354 - DNA, 13 bp, Homo sapiens
tttcttaaaatgt

SEQ ID NO: 2001355 - DNA, 16 bp, Homo sapiens
tttcttaaacaaatgt

SEQ ID NO: 2001356 - DNA, 13 bp, Homo sapiens
tttcttaaataag

SEQ ID NO: 2001357 - DNA, 17 bp, Homo sapiens
tttcttatcttctgcaa

SEQ ID NO: 2001358 - DNA, 23 bp, Homo sapiens
tttcttattttgtaataaactct

SEQ ID NO: 2001359 - DNA, 21 bp, Homo sapiens
tttcttcactgttgaaaatta

SEQ ID NO: 2001360 - DNA, 12 bp, Homo sapiens
tttcttcccatt

SEQ ID NO: 2001361 - DNA, 16 bp, Homo sapiens
tttcttcccatttgta

SEQ ID NO: 2001362 - DNA, 11 bp, Homo sapiens
tttcttcctct

SEQ ID NO: 2001363 - DNA, 18 bp, Homo sapiens
tttcttctacaaccagag

SEQ ID NO: 2001364 - DNA, 12 bp, Homo sapiens
tttcttctattt

SEQ ID NO: 2001365 - DNA, 22 bp, Homo sapiens
tttcttgactcttgttttcagt

SEQ ID NO: 2001366 - DNA, 16 bp, Homo sapiens
tttcttgcagatcaaa

SEQ ID NO: 2001367 - DNA, 16 bp, Homo sapiens
tttctttaagaaagta

SEQ ID NO: 2001368 - DNA, 15 bp, Homo sapiens
tttctttcacaaaaa

SEQ ID NO: 2001369 - DNA, 16 bp, Homo sapiens
tttctttcacaaaaaa

SEQ ID NO: 2001370 - DNA, 13 bp, Homo sapiens
tttctttgtaaag

SEQ ID NO: 2001371 - DNA, 16 bp, Homo sapiens
tttcttttaaagaagt

SEQ ID NO: 2001372 - DNA, 17 bp, Homo sapiens
tttctttttctgtctct

SEQ ID NO: 2001373 - DNA, 17 bp, Homo sapiens
tttctttttttaaattg

SEQ ID NO: 2001374 - DNA, 20 bp, Homo sapiens
tttgaaaaagcgaaaaaatc

SEQ ID NO: 2001375 - DNA, 23 bp, Homo sapiens
tttgaaactgtaaatatgtttgt

SEQ ID NO: 2001376 - DNA, 17 bp, Homo sapiens
tttgaaattttatttag

SEQ ID NO: 2001377 - DNA, 18 bp, Homo sapiens
tttgaactgccaagaaaa

SEQ ID NO: 2001378 - DNA, 17 bp, Homo sapiens
tttgaagaagggaaatt

SEQ ID NO: 2001379 - DNA, 23 bp, Homo sapiens
tttgaagtagtttgtataacttc

SEQ ID NO: 2001380 - DNA, 19 bp, Homo sapiens
tttgaataaagtctgagtg

SEQ ID NO: 2001381 - DNA, 18 bp, Homo sapiens
tttgaatataaacactat

SEQ ID NO: 2001382 - DNA, 19 bp, Homo sapiens
tttgaatataaacactata

SEQ ID NO: 2001383 - DNA, 17 bp, Homo sapiens
tttgaatccatgcttgg

SEQ ID NO: 2001384 - DNA, 13 bp, Homo sapiens
tttgacagtgtgg

SEQ ID NO: 2001385 - DNA, 17 bp, Homo sapiens
tttgacattgtatgtat

SEQ ID NO: 2001386 - DNA, 14 bp, Homo sapiens
tttgacatttcctt

SEQ ID NO: 2001387 - DNA, 18 bp, Homo sapiens
tttgacctcacagtgacc

SEQ ID NO: 2001388 - DNA, 14 bp, Homo sapiens
tttgacggatgatt

SEQ ID NO: 2001389 - DNA, 14 bp, Homo sapiens
tttgagaaagaaat

SEQ ID NO: 2001390 - DNA, 15 bp, Homo sapiens
tttgagaaagaaata

SEQ ID NO: 2001391 - DNA, 16 bp, Homo sapiens
tttgagacaagccctg

SEQ ID NO: 2001392 - DNA, 14 bp, Homo sapiens
tttgagaccagcct

SEQ ID NO: 2001393 - DNA, 19 bp, Homo sapiens
tttgagaccagcctgggca

SEQ ID NO: 2001394 - DNA, 15 bp, Homo sapiens
tttgagcaattcatt

SEQ ID NO: 2001395 - DNA, 23 bp, Homo sapiens
tttgagcaattcatttcacttta

SEQ ID NO: 2001396 - DNA, 15 bp, Homo sapiens
tttgagcaattttcg

SEQ ID NO: 2001397 - DNA, 23 bp, Homo sapiens
tttgagcatgcacagctgcttgt

SEQ ID NO: 2001398 - DNA, 21 bp, Homo sapiens
tttgaggaattatcatgggaa

SEQ ID NO: 2001399 - DNA, 15 bp, Homo sapiens
tttgaggagagtgaa

SEQ ID NO: 2001400 - DNA, 20 bp, Homo sapiens
tttgaggagcagcttcagtt

SEQ ID NO: 2001401 - DNA, 12 bp, Homo sapiens
tttgagtaattc

SEQ ID NO: 2001402 - DNA, 16 bp, Homo sapiens
tttgagtgattatttg

SEQ ID NO: 2001403 - DNA, 14 bp, Homo sapiens
tttgagtgttttaa

SEQ ID NO: 2001404 - DNA, 14 bp, Homo sapiens
tttgagttatagtt

SEQ ID NO: 2001405 - DNA, 19 bp, Homo sapiens
tttgagttattttaattat

SEQ ID NO: 2001406 - DNA, 15 bp, Homo sapiens
tttgagttcaaattt

SEQ ID NO: 2001407 - DNA, 21 bp, Homo sapiens
tttgatagcagaagaaaaagt

SEQ ID NO: 2001408 - DNA, 13 bp, Homo sapiens
tttgatggggaga

SEQ ID NO: 2001409 - DNA, 14 bp, Homo sapiens
tttgatggggagaa

SEQ ID NO: 2001410 - DNA, 18 bp, Homo sapiens
tttgatgtacatgtgtag

SEQ ID NO: 2001411 - DNA, 15 bp, Homo sapiens
tttgatgtcagcctt

SEQ ID NO: 2001412 - DNA, 20 bp, Homo sapiens
tttgatttccaagtaatata

SEQ ID NO: 2001413 - DNA, 19 bp, Homo sapiens
tttgcaaactttattttca

SEQ ID NO: 2001414 - DNA, 19 bp, Homo sapiens
aagctgggggaagggtggt

SEQ ID NO: 2001415 - DNA, 16 bp, Homo sapiens
aagctggtttaatgtt

SEQ ID NO: 2001416 - DNA, 17 bp, Homo sapiens
aagctgtaaaaagagag

SEQ ID NO: 2001417 - DNA, 13 bp, Homo sapiens
aagctgtggccag

SEQ ID NO: 2001418 - DNA, 15 bp, Homo sapiens
aagcttaaaactttg

SEQ ID NO: 2001419 - DNA, 22 bp, Homo sapiens
aagcttaaattgcttttgttgt

SEQ ID NO: 2001420 - DNA, 15 bp, Homo sapiens
aagcttcaaccctca

SEQ ID NO: 2001421 - DNA, 15 bp, Homo sapiens
aagcttcaagtgata

SEQ ID NO: 2001422 - DNA, 13 bp, Homo sapiens
aagcttcagagcc

SEQ ID NO: 2001423 - DNA, 17 bp, Homo sapiens
aagcttcagagcctagc

SEQ ID NO: 2001424 - DNA, 18 bp, Homo sapiens
aagcttcagagcctagcc

SEQ ID NO: 2001425 - DNA, 19 bp, Homo sapiens
aagcttcagagcctagcca

SEQ ID NO: 2001426 - DNA, 20 bp, Homo sapiens
aagcttcagagcctagccac

SEQ ID NO: 2001427 - DNA, 17 bp, Homo sapiens
aagcttgtatatacata

SEQ ID NO: 2001428 - DNA, 22 bp, Homo sapiens
aagcttgtatatacatattata

SEQ ID NO: 2001429 - DNA, 14 bp, Homo sapiens
aagctttctccttt

SEQ ID NO: 2001430 - DNA, 20 bp, Homo sapiens
aagctttgaatacccccaga

SEQ ID NO: 2001431 - DNA, 15 bp, Homo sapiens
aaggaaaaccaggga

SEQ ID NO: 2001432 - DNA, 16 bp, Homo sapiens
aaggaaaaccagggat

SEQ ID NO: 2001433 - DNA, 14 bp, Homo sapiens
aaggaaaagaacac

SEQ ID NO: 2001434 - DNA, 18 bp, Homo sapiens
aaggaacacccggaaaga

SEQ ID NO: 2001435 - DNA, 18 bp, Homo sapiens
aaggaacctaattgaaat

SEQ ID NO: 2001436 - DNA, 18 bp, Homo sapiens
aaggaactctggcttcca

SEQ ID NO: 2001437 - DNA, 14 bp, Homo sapiens
aaggaactggaaca

SEQ ID NO: 2001438 - DNA, 16 bp, Homo sapiens
aaggaagctccactgt

SEQ ID NO: 2001439 - DNA, 16 bp, Homo sapiens
aaggaaggaaagaaag

SEQ ID NO: 2001440 - DNA, 13 bp, Homo sapiens
aaggaagggacac

SEQ ID NO: 2001441 - DNA, 15 bp, Homo sapiens
aaggaagggacacac

SEQ ID NO: 2001442 - DNA, 23 bp, Homo sapiens
aaggaagtgggggccgctggccc

SEQ ID NO: 2001443 - DNA, 17 bp, Homo sapiens
aaggaatagccagagag

SEQ ID NO: 2001444 - DNA, 23 bp, Homo sapiens
aaggaatctgaaagtatattttc

SEQ ID NO: 2001445 - DNA, 15 bp, Homo sapiens
aaggaatctgtgcag

SEQ ID NO: 2001446 - DNA, 22 bp, Homo sapiens
aaggacaatgccttgggagaga

SEQ ID NO: 2001447 - DNA, 16 bp, Homo sapiens
aaggacattatgtgtg

SEQ ID NO: 2001448 - DNA, 21 bp, Homo sapiens
aaggacattttctctttaaaa

SEQ ID NO: 2001449 - DNA, 16 bp, Homo sapiens
aaggaccgtttttact

SEQ ID NO: 2001450 - DNA, 18 bp, Homo sapiens
aaggactaacataaaatc

SEQ ID NO: 2001451 - DNA, 18 bp, Homo sapiens
aaggacttagctggccac

SEQ ID NO: 2001452 - DNA, 16 bp, Homo sapiens
aaggacttctgcagct

SEQ ID NO: 2001453 - DNA, 13 bp, Homo sapiens
aaggagaaaggag

SEQ ID NO: 2001454 - DNA, 20 bp, Homo sapiens
aaggagactcacctctgcct

SEQ ID NO: 2001455 - DNA, 22 bp, Homo sapiens
aaggagactcacctctgcctca

SEQ ID NO: 2001456 - DNA, 11 bp, Homo sapiens
aaggagagaag

SEQ ID NO: 2001457 - DNA, 17 bp, Homo sapiens
aaggagagttcaagcct

SEQ ID NO: 2001458 - DNA, 22 bp, Homo sapiens
aaggagagttcaagcctgtggg

SEQ ID NO: 2001459 - DNA, 14 bp, Homo sapiens
aaggagcccagaaa

SEQ ID NO: 2001460 - DNA, 10 bp, Homo sapiens
aaggagcctg

SEQ ID NO: 2001461 - DNA, 12 bp, Homo sapiens
aaggagcctgtg

SEQ ID NO: 2001462 - DNA, 13 bp, Homo sapiens
aaggagcctgtga

SEQ ID NO: 2001463 - DNA, 21 bp, Homo sapiens
aaggagcctgtgaacccagga

SEQ ID NO: 2001464 - DNA, 17 bp, Homo sapiens
aaggagggacaagaatc

SEQ ID NO: 2001465 - DNA, 13 bp, Homo sapiens
aaggagggcagag

SEQ ID NO: 2001466 - DNA, 17 bp, Homo sapiens
aaggagggcagagccat

SEQ ID NO: 2001467 - DNA, 19 bp, Homo sapiens
aaggaggtgagggatgtga

SEQ ID NO: 2001468 - DNA, 20 bp, Homo sapiens
aaggagttccatgaagacca

SEQ ID NO: 2001469 - DNA, 13 bp, Homo sapiens
aaggagttttttt

SEQ ID NO: 2001470 - DNA, 15 bp, Homo sapiens
aaggatcagaatgga

SEQ ID NO: 2001471 - DNA, 19 bp, Homo sapiens
aaggatgaagggcccgaga

SEQ ID NO: 2001472 - DNA, 15 bp, Homo sapiens
aaggatggcaagcac

SEQ ID NO: 2001473 - DNA, 17 bp, Homo sapiens
aaggatgtaaacagtgc

SEQ ID NO: 2001474 - DNA, 21 bp, Homo sapiens
aaggcaaaaatagtttggata

SEQ ID NO: 2001475 - DNA, 20 bp, Homo sapiens
aaggcaaagcacgaaatgtt

SEQ ID NO: 2001476 - DNA, 12 bp, Homo sapiens
aaggcaactggg

SEQ ID NO: 2001477 - DNA, 20 bp, Homo sapiens
aaggcacgtttggcatttct

SEQ ID NO: 2001478 - DNA, 12 bp, Homo sapiens
aaggcacttgtc

SEQ ID NO: 2001479 - DNA, 18 bp, Homo sapiens
aaggcacttgtcactatg

SEQ ID NO: 2001480 - DNA, 14 bp, Homo sapiens
aaggcagcaaggcc

SEQ ID NO: 2001481 - DNA, 18 bp, Homo sapiens
aaggcaggcagggctctc

SEQ ID NO: 2001482 - DNA, 20 bp, Homo sapiens
aaggcagggacagagatgga

SEQ ID NO: 2001483 - DNA, 20 bp, Homo sapiens
aaggcagggagcgagggaga

SEQ ID NO: 2001484 - DNA, 19 bp, Homo sapiens
aaggcagggaggaggcaga

SEQ ID NO: 2001485 - DNA, 16 bp, Homo sapiens
aaggcagtgttcctca

SEQ ID NO: 2001486 - DNA, 21 bp, Homo sapiens
aaggcatgatgttaaccagaa

SEQ ID NO: 2001487 - DNA, 23 bp, Homo sapiens
aaggcccagctatggccccaggg

SEQ ID NO: 2001488 - DNA, 21 bp, Homo sapiens
aaggcccgagcagctgagcag

SEQ ID NO: 2001489 - DNA, 21 bp, Homo sapiens
aaggccctgtcccagcagaag

SEQ ID NO: 2001490 - DNA, 19 bp, Homo sapiens
aaggccgctgccccagccc

SEQ ID NO: 2001491 - DNA, 20 bp, Homo sapiens
aaggccgctgccccagcccc

SEQ ID NO: 2001492 - DNA, 22 bp, Homo sapiens
aaggccgctgttcacccacagg

SEQ ID NO: 2001493 - DNA, 16 bp, Homo sapiens
aaggcctcttgtgctc

SEQ ID NO: 2001494 - DNA, 23 bp, Homo sapiens
aaggcctcttgtgctcacgctcc

SEQ ID NO: 2001495 - DNA, 16 bp, Homo sapiens
aaggcctgccctccca

SEQ ID NO: 2001496 - DNA, 22 bp, Homo sapiens
aaggcctggaaccagggaggag

SEQ ID NO: 2001497 - DNA, 21 bp, Homo sapiens
aaggcctggggtgacccggca

SEQ ID NO: 2001498 - DNA, 16 bp, Homo sapiens
aaggcgaggagagtgg

SEQ ID NO: 2001499 - DNA, 16 bp, Homo sapiens
aaggctcagtctcagg

SEQ ID NO: 2001500 - DNA, 17 bp, Homo sapiens
aaggctctgaaagccag

SEQ ID NO: 2001501 - DNA, 15 bp, Homo sapiens
aaggctgaccaagag

SEQ ID NO: 2001502 - DNA, 14 bp, Homo sapiens
aaggctgctcagag

SEQ ID NO: 2001503 - DNA, 21 bp, Homo sapiens
aaggctggctgaaaatcacta

SEQ ID NO: 2001504 - DNA, 16 bp, Homo sapiens
aaggctggctgggcat

SEQ ID NO: 2001505 - DNA, 11 bp, Homo sapiens
aagggaaaaat

SEQ ID NO: 2001506 - DNA, 17 bp, Homo sapiens
aagggaaactgccagca

SEQ ID NO: 2001507 - DNA, 16 bp, Homo sapiens
aagggaaactggctga

SEQ ID NO: 2001508 - DNA, 17 bp, Homo sapiens
aagggaaaggaaaagaa

SEQ ID NO: 2001509 - DNA, 17 bp, Homo sapiens
aagggaactgaagacct

SEQ ID NO: 2001510 - DNA, 17 bp, Homo sapiens
aagggaagttgtgcctt

SEQ ID NO: 2001511 - DNA, 22 bp, Homo sapiens
aagggacccgaagcccaggctg

SEQ ID NO: 2001512 - DNA, 14 bp, Homo sapiens
aacataaaaatgat

SEQ ID NO: 2001513 - DNA, 14 bp, Homo sapiens
aacataaaatacaa

SEQ ID NO: 2001514 - DNA, 15 bp, Homo sapiens
aacataaaatataca

SEQ ID NO: 2001515 - DNA, 14 bp, Homo sapiens
aacataaaatctgt

SEQ ID NO: 2001516 - DNA, 16 bp, Homo sapiens
aacataaggagaatgt

SEQ ID NO: 2001517 - DNA, 18 bp, Homo sapiens
aacataatataagaatca

SEQ ID NO: 2001518 - DNA, 17 bp, Homo sapiens
aacatacccttctttaa

SEQ ID NO: 2001519 - DNA, 22 bp, Homo sapiens
aacatagaaattgcctgacgaa

SEQ ID NO: 2001520 - DNA, 15 bp, Homo sapiens
aacatagacagaaga

SEQ ID NO: 2001521 - DNA, 16 bp, Homo sapiens
aacatagacagaagaa

SEQ ID NO: 2001522 - DNA, 17 bp, Homo sapiens
aacatagatagtgcttt

SEQ ID NO: 2001523 - DNA, 12 bp, Homo sapiens
aacatagattta

SEQ ID NO: 2001524 - DNA, 13 bp, Homo sapiens
aacatatgatact

SEQ ID NO: 2001525 - DNA, 17 bp, Homo sapiens
aacatcactgaaatgct

SEQ ID NO: 2001526 - DNA, 19 bp, Homo sapiens
aacatcatcaggcttggaa

SEQ ID NO: 2001527 - DNA, 23 bp, Homo sapiens
aacatcatcaggcttggaatgaa

SEQ ID NO: 2001528 - DNA, 17 bp, Homo sapiens
aacatcatgcattcaca

SEQ ID NO: 2001529 - DNA, 22 bp, Homo sapiens
aacatccaaggagaaacagaga

SEQ ID NO: 2001530 - DNA, 12 bp, Homo sapiens
aacatccagaag

SEQ ID NO: 2001531 - DNA, 19 bp, Homo sapiens
aacatccttcaagaactct

SEQ ID NO: 2001532 - DNA, 14 bp, Homo sapiens
aacatctcgagccc

SEQ ID NO: 2001533 - DNA, 22 bp, Homo sapiens
aacatctgtcctgtgaaagact

SEQ ID NO: 2001534 - DNA, 20 bp, Homo sapiens
aacatctttgaaaagaaaaa

SEQ ID NO: 2001535 - DNA, 23 bp, Homo sapiens
aacatgaaaaacacggcagctgt

SEQ ID NO: 2001536 - DNA, 21 bp, Homo sapiens
aacatgaagtcgttgtgaggg

SEQ ID NO: 2001537 - DNA, 13 bp, Homo sapiens
aacatgagaaatg

SEQ ID NO: 2001538 - DNA, 17 bp, Homo sapiens
aacatgagtttatggga

SEQ ID NO: 2001539 - DNA, 22 bp, Homo sapiens
aacatgcaattttgcatttgaa

SEQ ID NO: 2001540 - DNA, 14 bp, Homo sapiens
aacatgcacattta

SEQ ID NO: 2001541 - DNA, 19 bp, Homo sapiens
aacatgcacatttatatat

SEQ ID NO: 2001542 - DNA, 14 bp, Homo sapiens
aacatgcctgattt

SEQ ID NO: 2001543 - DNA, 19 bp, Homo sapiens
aacatggagaaaccctgtc

SEQ ID NO: 2001544 - DNA, 17 bp, Homo sapiens
aacatggagaggacttt

SEQ ID NO: 2001545 - DNA, 23 bp, Homo sapiens
aacatggcaaaaccccatctcta

SEQ ID NO: 2001546 - DNA, 21 bp, Homo sapiens
aacatgggcattgggttctaa

SEQ ID NO: 2001547 - DNA, 22 bp, Homo sapiens
aacatgggcattgggttctaaa

SEQ ID NO: 2001548 - DNA, 13 bp, Homo sapiens
aacatgtgtttta

SEQ ID NO: 2001549 - DNA, 21 bp, Homo sapiens
aacattaaaagaagactggaa

SEQ ID NO: 2001550 - DNA, 14 bp, Homo sapiens
aacattaaatgtct

SEQ ID NO: 2001551 - DNA, 18 bp, Homo sapiens
aacattaaatgtcttata

SEQ ID NO: 2001552 - DNA, 17 bp, Homo sapiens
aacattaattctactaa

SEQ ID NO: 2001553 - DNA, 20 bp, Homo sapiens
aacattcacacagggctctt

SEQ ID NO: 2001554 - DNA, 20 bp, Homo sapiens
aacattcatccagttgcaat

SEQ ID NO: 2001555 - DNA, 23 bp, Homo sapiens
aacattcatccagttgcaataaa

SEQ ID NO: 2001556 - DNA, 18 bp, Homo sapiens
aacattgggaaatcttat

SEQ ID NO: 2001557 - DNA, 20 bp, Homo sapiens
aacattgttgctccctgtga

SEQ ID NO: 2001558 - DNA, 20 bp, Homo sapiens
aacatttacaataaatattc

SEQ ID NO: 2001559 - DNA, 22 bp, Homo sapiens
aacatttacaataaatattctg

SEQ ID NO: 2001560 - DNA, 21 bp, Homo sapiens
aacatttacacattctcacaa

SEQ ID NO: 2001561 - DNA, 15 bp, Homo sapiens
aacatttattttgac

SEQ ID NO: 2001562 - DNA, 19 bp, Homo sapiens
aacatttattttgacataa

SEQ ID NO: 2001563 - DNA, 18 bp, Homo sapiens
aacatttcttatgatttt

SEQ ID NO: 2001564 - DNA, 13 bp, Homo sapiens
aacatttgagtat

SEQ ID NO: 2001565 - DNA, 19 bp, Homo sapiens
aacatttgctttgttttct

SEQ ID NO: 2001566 - DNA, 14 bp, Homo sapiens
aacatttgtacatt

SEQ ID NO: 2001567 - DNA, 19 bp, Homo sapiens
aacattttaaataaaagaa

SEQ ID NO: 2001568 - DNA, 19 bp, Homo sapiens
aaccaaagagactggagca

SEQ ID NO: 2001569 - DNA, 18 bp, Homo sapiens
aagcatcattgtaaatta

SEQ ID NO: 2001570 - DNA, 13 bp, Homo sapiens
aagcatctgtgta

SEQ ID NO: 2001571 - DNA, 12 bp, Homo sapiens
aagcatgaaatg

SEQ ID NO: 2001572 - DNA, 11 bp, Homo sapiens
aagcatggact

SEQ ID NO: 2001573 - DNA, 15 bp, Homo sapiens
aagcatggctatttt

SEQ ID NO: 2001574 - DNA, 20 bp, Homo sapiens
aagcatgtttcatgttttgt

SEQ ID NO: 2001575 - DNA, 13 bp, Homo sapiens
aagcattctgtct

SEQ ID NO: 2001576 - DNA, 22 bp, Homo sapiens
aagcattcttagactagttgaa

SEQ ID NO: 2001577 - DNA, 16 bp, Homo sapiens
aagcattgaatggcta

SEQ ID NO: 2001578 - DNA, 20 bp, Homo sapiens
aagcattttactgtctgtaa

SEQ ID NO: 2001579 - DNA, 16 bp, Homo sapiens
aagccaaactctgcca

SEQ ID NO: 2001580 - DNA, 20 bp, Homo sapiens
aagccaaactctgccagcca

SEQ ID NO: 2001581 - DNA, 17 bp, Homo sapiens
aagccaaagctaggcct

SEQ ID NO: 2001582 - DNA, 20 bp, Homo sapiens
aagccaaagctaggcctggc

SEQ ID NO: 2001583 - DNA, 16 bp, Homo sapiens
aagccaacaccctgtc

SEQ ID NO: 2001584 - DNA, 22 bp, Homo sapiens
aagccaacttggctttcccgga

SEQ ID NO: 2001585 - DNA, 16 bp, Homo sapiens
aagccaacttgtaaat

SEQ ID NO: 2001586 - DNA, 22 bp, Homo sapiens
aagccacgctgtcctctcgagc

SEQ ID NO: 2001587 - DNA, 14 bp, Homo sapiens
aagccactgaagct

SEQ ID NO: 2001588 - DNA, 17 bp, Homo sapiens
aagccactgaagctggg

SEQ ID NO: 2001589 - DNA, 14 bp, Homo sapiens
aagccagagcctgg

SEQ ID NO: 2001590 - DNA, 15 bp, Homo sapiens
aagccagctgccgac

SEQ ID NO: 2001591 - DNA, 17 bp, Homo sapiens
aagccatggtgacacac

SEQ ID NO: 2001592 - DNA, 19 bp, Homo sapiens
aagccatggtgacacacag

SEQ ID NO: 2001593 - DNA, 20 bp, Homo sapiens
aagccattttttgaggagag

SEQ ID NO: 2001594 - DNA, 17 bp, Homo sapiens
aagcccaaatggctctg

SEQ ID NO: 2001595 - DNA, 16 bp, Homo sapiens
aagcccaacctcctga

SEQ ID NO: 2001596 - DNA, 22 bp, Homo sapiens
aagcccaacctcctgacctgtc

SEQ ID NO: 2001597 - DNA, 19 bp, Homo sapiens
aagcccaaggcagtgttcc

SEQ ID NO: 2001598 - DNA, 18 bp, Homo sapiens
aagcccaatattataatt

SEQ ID NO: 2001599 - DNA, 21 bp, Homo sapiens
aagcccataaggccagaaact

SEQ ID NO: 2001600 - DNA, 16 bp, Homo sapiens
aagccccagggcctgg

SEQ ID NO: 2001601 - DNA, 12 bp, Homo sapiens
aagcccctcagc

SEQ ID NO: 2001602 - DNA, 16 bp, Homo sapiens
aagcccctcagccctt

SEQ ID NO: 2001603 - DNA, 18 bp, Homo sapiens
aagcccgcctctgtccta

SEQ ID NO: 2001604 - DNA, 11 bp, Homo sapiens
aagccctcctt

SEQ ID NO: 2001605 - DNA, 12 bp, Homo sapiens
aagccctccttc

SEQ ID NO: 2001606 - DNA, 13 bp, Homo sapiens
aagccctgctggg

SEQ ID NO: 2001607 - DNA, 11 bp, Homo sapiens
aagccctggca

SEQ ID NO: 2001608 - DNA, 18 bp, Homo sapiens
aagccctgtcgagacact

SEQ ID NO: 2001609 - DNA, 16 bp, Homo sapiens
aagccgtctgactcca

SEQ ID NO: 2001610 - DNA, 22 bp, Homo sapiens
aagcctatttatttgaaagtcc

SEQ ID NO: 2001611 - DNA, 20 bp, Homo sapiens
aagcctcatatttaaagaca

SEQ ID NO: 2001612 - DNA, 14 bp, Homo sapiens
aagcctccctcctc

SEQ ID NO: 2001613 - DNA, 20 bp, Homo sapiens
aagcctccggtttccactac

SEQ ID NO: 2001614 - DNA, 18 bp, Homo sapiens
aagcctccgtcaggagag

SEQ ID NO: 2001615 - DNA, 17 bp, Homo sapiens
aagcctctgccccaagg

SEQ ID NO: 2001616 - DNA, 19 bp, Homo sapiens
aagcctctgccccaagggg

SEQ ID NO: 2001617 - DNA, 14 bp, Homo sapiens
aagcctctgccctg

SEQ ID NO: 2001618 - DNA, 18 bp, Homo sapiens
aagcctctgccctgcctc

SEQ ID NO: 2001619 - DNA, 23 bp, Homo sapiens
aagcctgcctaggaattcccagc

SEQ ID NO: 2001620 - DNA, 13 bp, Homo sapiens
aagcctgtataga

SEQ ID NO: 2001621 - DNA, 12 bp, Homo sapiens
aagcctgtgaat

SEQ ID NO: 2001622 - DNA, 16 bp, Homo sapiens
aagcctgtgccacctg

SEQ ID NO: 2001623 - DNA, 17 bp, Homo sapiens
aagcctgtgccacctgc

SEQ ID NO: 2001624 - DNA, 20 bp, Homo sapiens
aagcctgtgccacctgcaag

SEQ ID NO: 2001625 - DNA, 18 bp, Homo sapiens
aagcctgttcatggcaga

SEQ ID NO: 2001626 - DNA, 15 bp, Homo sapiens
aagccttactcacct

SEQ ID NO: 2001627 - DNA, 18 bp, Homo sapiens
aagccttactcacctctc

SEQ ID NO: 2001628 - DNA, 19 bp, Homo sapiens
aagccttactcacctctct

SEQ ID NO: 2001629 - DNA, 17 bp, Homo sapiens
aagcctttagttcctac

SEQ ID NO: 2001630 - DNA, 14 bp, Homo sapiens
aagcctttccataa

SEQ ID NO: 2001631 - DNA, 22 bp, Homo sapiens
aagcctttttttagtaaatcct

SEQ ID NO: 2001632 - DNA, 17 bp, Homo sapiens
aagcgaaaaaaaaaaat

SEQ ID NO: 2001633 - DNA, 15 bp, Homo sapiens
aagcgaaaaaatcag

SEQ ID NO: 2001634 - DNA, 18 bp, Homo sapiens
aagcgagatcccatctct

SEQ ID NO: 2001635 - DNA, 20 bp, Homo sapiens
aagcgatgaatttggagact

SEQ ID NO: 2001636 - DNA, 14 bp, Homo sapiens
aagcgattcttctg

SEQ ID NO: 2001637 - DNA, 21 bp, Homo sapiens
aagcgattcttctgcttcagc

SEQ ID NO: 2001638 - DNA, 19 bp, Homo sapiens
aagcgattcttgtgcctca

SEQ ID NO: 2001639 - DNA, 21 bp, Homo sapiens
aagcgattcttgtgcctcagc

SEQ ID NO: 2001640 - DNA, 13 bp, Homo sapiens
aagcgctcatctg

SEQ ID NO: 2001641 - DNA, 23 bp, Homo sapiens
aagctaaaacctgagctagaagc

SEQ ID NO: 2001642 - DNA, 21 bp, Homo sapiens
aagctaacagggaaggcaggc

SEQ ID NO: 2001643 - DNA, 18 bp, Homo sapiens
aagctactgaatttattg

SEQ ID NO: 2001644 - DNA, 16 bp, Homo sapiens
aagctagaacctggag

SEQ ID NO: 2001645 - DNA, 19 bp, Homo sapiens
aagctagaaggccacatgt

SEQ ID NO: 2001646 - DNA, 14 bp, Homo sapiens
aagctaggaatgaa

SEQ ID NO: 2001647 - DNA, 16 bp, Homo sapiens
aagctaggcctggcca

SEQ ID NO: 2001648 - DNA, 17 bp, Homo sapiens
aagctaggcctggccag

SEQ ID NO: 2001649 - DNA, 18 bp, Homo sapiens
aagctaggcctggccaga

SEQ ID NO: 2001650 - DNA, 17 bp, Homo sapiens
aagctatccaaataact

SEQ ID NO: 2001651 - DNA, 23 bp, Homo sapiens
aagctcacagttcctcgccctgg

SEQ ID NO: 2001652 - DNA, 14 bp, Homo sapiens
aagctcagaataga

SEQ ID NO: 2001653 - DNA, 20 bp, Homo sapiens
aagctcatattttgtatata

SEQ ID NO: 2001654 - DNA, 23 bp, Homo sapiens
aagctccacggtgcgtggctgtg

SEQ ID NO: 2001655 - DNA, 18 bp, Homo sapiens
aagctcccagatgctggg

SEQ ID NO: 2001656 - DNA, 14 bp, Homo sapiens
aagctcctgtcctc

SEQ ID NO: 2001657 - DNA, 20 bp, Homo sapiens
aagctcctgtcctcccatcc

SEQ ID NO: 2001658 - DNA, 22 bp, Homo sapiens
aagctcctgtcctcccatcccc

SEQ ID NO: 2001659 - DNA, 20 bp, Homo sapiens
aatatataaaaatatatata

SEQ ID NO: 2001660 - DNA, 14 bp, Homo sapiens
aatatataatggtt

SEQ ID NO: 2001661 - DNA, 20 bp, Homo sapiens
aatatataatggtttactgc

SEQ ID NO: 2001662 - DNA, 15 bp, Homo sapiens
aatatatatacatat

SEQ ID NO: 2001663 - DNA, 22 bp, Homo sapiens
aatatatatagtgctatatata

SEQ ID NO: 2001664 - DNA, 19 bp, Homo sapiens
aatatatatatatatttaa

SEQ ID NO: 2001665 - DNA, 17 bp, Homo sapiens
aatatatatgtgcagta

SEQ ID NO: 2001666 - DNA, 12 bp, Homo sapiens
aatatatatttt

SEQ ID NO: 2001667 - DNA, 14 bp, Homo sapiens
aatatatatttttc

SEQ ID NO: 2001668 - DNA, 19 bp, Homo sapiens
aatatatatttttcaacca

SEQ ID NO: 2001669 - DNA, 21 bp, Homo sapiens
aatatatcagaatctgtgtga

SEQ ID NO: 2001670 - DNA, 19 bp, Homo sapiens
aatatatttaatacctttg

SEQ ID NO: 2001671 - DNA, 14 bp, Homo sapiens
aatatattttatga

SEQ ID NO: 2001672 - DNA, 15 bp, Homo sapiens
aatatatttttatat

SEQ ID NO: 2001673 - DNA, 19 bp, Homo sapiens
aatatatttttatatttag

SEQ ID NO: 2001674 - DNA, 16 bp, Homo sapiens
aatatcaatgaagatt

SEQ ID NO: 2001675 - DNA, 19 bp, Homo sapiens
aatatcagttactcagccc

SEQ ID NO: 2001676 - DNA, 22 bp, Homo sapiens
aatatcagttactcagccctgg

SEQ ID NO: 2001677 - DNA, 14 bp, Homo sapiens
aatatcctaaacat

SEQ ID NO: 2001678 - DNA, 15 bp, Homo sapiens
aatatcctaaacatc

SEQ ID NO: 2001679 - DNA, 17 bp, Homo sapiens
aatatcctaaacatcat

SEQ ID NO: 2001680 - DNA, 18 bp, Homo sapiens
aatatctacctgccctct

SEQ ID NO: 2001681 - DNA, 18 bp, Homo sapiens
aatatctgagaagtgtat

SEQ ID NO: 2001682 - DNA, 15 bp, Homo sapiens
aatatctgccccagt

SEQ ID NO: 2001683 - DNA, 18 bp, Homo sapiens
aatatcttgctggattaa

SEQ ID NO: 2001684 - DNA, 15 bp, Homo sapiens
aatatgaaatgataa

SEQ ID NO: 2001685 - DNA, 12 bp, Homo sapiens
aatatgaacaaa

SEQ ID NO: 2001686 - DNA, 22 bp, Homo sapiens
aatatgaacaaagaaaaaaata

SEQ ID NO: 2001687 - DNA, 21 bp, Homo sapiens
aatatgaaggactattaattc

SEQ ID NO: 2001688 - DNA, 11 bp, Homo sapiens
aatatgatgac

SEQ ID NO: 2001689 - DNA, 15 bp, Homo sapiens
aatatgcaaagcact

SEQ ID NO: 2001690 - DNA, 21 bp, Homo sapiens
aatatgctacagtactatgta

SEQ ID NO: 2001691 - DNA, 22 bp, Homo sapiens
aatatgctacagtactatgtaa

SEQ ID NO: 2001692 - DNA, 12 bp, Homo sapiens
aatatgctgtgg

SEQ ID NO: 2001693 - DNA, 17 bp, Homo sapiens
aatatgctgtggggcat

SEQ ID NO: 2001694 - DNA, 21 bp, Homo sapiens
aatatggaaccttccctccaa

SEQ ID NO: 2001695 - DNA, 15 bp, Homo sapiens
aatatggacaaagaa

SEQ ID NO: 2001696 - DNA, 17 bp, Homo sapiens
aatatggactcagtttt

SEQ ID NO: 2001697 - DNA, 15 bp, Homo sapiens
aatatggctataaat

SEQ ID NO: 2001698 - DNA, 20 bp, Homo sapiens
aatatgtattgtaaacatgt

SEQ ID NO: 2001699 - DNA, 21 bp, Homo sapiens
aatatgttaacctcagtgtca

SEQ ID NO: 2001700 - DNA, 16 bp, Homo sapiens
aatatgttagcaaaga

SEQ ID NO: 2001701 - DNA, 15 bp, Homo sapiens
aatatgtttgaggtt

SEQ ID NO: 2001702 - DNA, 24 bp, Homo sapiens
aatatgtttgaggttaaaatataa

SEQ ID NO: 2001703 - DNA, 14 bp, Homo sapiens
aatatgtttgtgcc

SEQ ID NO: 2001704 - DNA, 22 bp, Homo sapiens
aatattaccaaaaaagtatttt

SEQ ID NO: 2001705 - DNA, 21 bp, Homo sapiens
aatattataaatccaaagtaa

SEQ ID NO: 2001706 - DNA, 12 bp, Homo sapiens
aatattattggg

SEQ ID NO: 2001707 - DNA, 16 bp, Homo sapiens
aatattcaataaagct

SEQ ID NO: 2001708 - DNA, 20 bp, Homo sapiens
aatattcccctatctctaga

SEQ ID NO: 2001709 - DNA, 15 bp, Homo sapiens
aatattcctgcattt

SEQ ID NO: 2001710 - DNA, 17 bp, Homo sapiens
aatatttaaacagcagt

SEQ ID NO: 2001711 - DNA, 17 bp, Homo sapiens
aatatttaagatagttt

SEQ ID NO: 2001712 - DNA, 13 bp, Homo sapiens
aatatttaagtat

SEQ ID NO: 2001713 - DNA, 20 bp, Homo sapiens
aatatttaagtatatagtat

SEQ ID NO: 2001714 - DNA, 18 bp, Homo sapiens
aatatttaagtttgttgc

SEQ ID NO: 2001715 - DNA, 15 bp, Homo sapiens
aatatttactcatca

SEQ ID NO: 2001716 - DNA, 15 bp, Homo sapiens
aatatttaggcaaga

SEQ ID NO: 2001717 - DNA, 15 bp, Homo sapiens
aatatttatgtaaac

SEQ ID NO: 2001718 - DNA, 21 bp, Homo sapiens
aatatttatgtctatttaagc

SEQ ID NO: 2001719 - DNA, 13 bp, Homo sapiens
aatatttattacc

SEQ ID NO: 2001720 - DNA, 18 bp, Homo sapiens
aatatttattacctctga

SEQ ID NO: 2001721 - DNA, 12 bp, Homo sapiens
aatatttcatga

SEQ ID NO: 2001722 - DNA, 12 bp, Homo sapiens
aatatttgctga

SEQ ID NO: 2001723 - DNA, 12 bp, Homo sapiens
aatatttgtaca

SEQ ID NO: 2001724 - DNA, 14 bp, Homo sapiens
aatatttgtacata

SEQ ID NO: 2001725 - DNA, 22 bp, Homo sapiens
aatatttgttctggtttagtgt

SEQ ID NO: 2001726 - DNA, 22 bp, Homo sapiens
aatattttagccttaaattttt

SEQ ID NO: 2001727 - DNA, 21 bp, Homo sapiens
aatattttccatgaaaatgca

SEQ ID NO: 2001728 - DNA, 15 bp, Homo sapiens
aatattttctgggtt

SEQ ID NO: 2001729 - DNA, 23 bp, Homo sapiens
aatatttttgaaaggcatgttcc

SEQ ID NO: 2001730 - DNA, 10 bp, Homo sapiens
aatcaaaact

SEQ ID NO: 2001731 - DNA, 13 bp, Homo sapiens
aatcaaaagctgc

SEQ ID NO: 2001732 - DNA, 15 bp, Homo sapiens
aatcaaatatgcaaa

SEQ ID NO: 2001733 - DNA, 16 bp, Homo sapiens
aatcaaatatgcaaag

SEQ ID NO: 2001734 - DNA, 18 bp, Homo sapiens
aatcaactttccttaaaa

SEQ ID NO: 2001735 - DNA, 15 bp, Homo sapiens
aatcaagaaacttaa

SEQ ID NO: 2001736 - DNA, 17 bp, Homo sapiens
aatcaagaatattcaaa

SEQ ID NO: 2001737 - DNA, 12 bp, Homo sapiens
aatcaataaaaa

SEQ ID NO: 2001738 - DNA, 16 bp, Homo sapiens
aatcaataaaaatctt

SEQ ID NO: 2001739 - DNA, 23 bp, Homo sapiens
aatcaatgttcacgcaacttgaa

SEQ ID NO: 2001740 - DNA, 14 bp, Homo sapiens
aatcaatttcccag

SEQ ID NO: 2001741 - DNA, 14 bp, Homo sapiens
aatcacaagcaata

SEQ ID NO: 2001742 - DNA, 19 bp, Homo sapiens
aatcacaagcaataattag

SEQ ID NO: 2001743 - DNA, 16 bp, Homo sapiens
aatcacacctctgggc

SEQ ID NO: 2001744 - DNA, 22 bp, Homo sapiens
aatcacagatgggtattaaact

SEQ ID NO: 2001745 - DNA, 13 bp, Homo sapiens
aatcaccaaagta

SEQ ID NO: 2001746 - DNA, 18 bp, Homo sapiens
aatcactctgtccttgga

SEQ ID NO: 2001747 - DNA, 21 bp, Homo sapiens
aatcactgaggcatttttact

SEQ ID NO: 2001748 - DNA, 23 bp, Homo sapiens
aatcactgtattttcattttaat

SEQ ID NO: 2001749 - DNA, 12 bp, Homo sapiens
aatcacttgtaa

SEQ ID NO: 2001750 - DNA, 16 bp, Homo sapiens
aatcacttgtaaataa

SEQ ID NO: 2001751 - DNA, 21 bp, Homo sapiens
aatcagaagtgcaaaggtgtg

SEQ ID NO: 2001752 - DNA, 13 bp, Homo sapiens
aatcagacaaagt

SEQ ID NO: 2001753 - DNA, 12 bp, Homo sapiens
aatcagcctctt

SEQ ID NO: 2001754 - DNA, 16 bp, Homo sapiens
aatcagcctcttaaag

SEQ ID NO: 2001755 - DNA, 11 bp, Homo sapiens
aatcagctccc

SEQ ID NO: 2001756 - DNA, 17 bp, Homo sapiens
aatcagctgcagctgct

SEQ ID NO: 2001757 - DNA, 21 bp, Homo sapiens
aatcagcttttaataaaattg

SEQ ID NO: 2001758 - DNA, 16 bp, Homo sapiens
aatcaggattttagtg

SEQ ID NO: 2001759 - DNA, 18 bp, Homo sapiens
aatcagggaggtcatttt

SEQ ID NO: 2001760 - DNA, 19 bp, Homo sapiens
aatcagggaggtcattttg

SEQ ID NO: 2001761 - DNA, 18 bp, Homo sapiens
aatcataaactgtgtgca

SEQ ID NO: 2001762 - DNA, 15 bp, Homo sapiens
aatcataattttcaa

SEQ ID NO: 2001763 - DNA, 20 bp, Homo sapiens
aatcataattttcaagagaa

SEQ ID NO: 2001764 - DNA, 21 bp, Homo sapiens
aatcatcgaaaattcatttca

SEQ ID NO: 2001765 - DNA, 15 bp, Homo sapiens
aatcatctgtgtgaa

SEQ ID NO: 2001766 - DNA, 18 bp, Homo sapiens
aatcatctgtgtgaaaat

SEQ ID NO: 2001767 - DNA, 19 bp, Homo sapiens
aatcatgaatatttcaaaa

SEQ ID NO: 2001768 - DNA, 22 bp, Homo sapiens
aatcatgaatatttcaaaataa

SEQ ID NO: 2001769 - DNA, 23 bp, Homo sapiens
aatcatgaatatttcaaaataaa

SEQ ID NO: 2001770 - DNA, 19 bp, Homo sapiens
aatcatgagtacctcaaag

SEQ ID NO: 2001771 - DNA, 23 bp, Homo sapiens
aatcattctttcccctcagagct

SEQ ID NO: 2001772 - DNA, 14 bp, Homo sapiens
aatgatggcaattt

SEQ ID NO: 2001773 - DNA, 14 bp, Homo sapiens
aatgatgtccagaa

SEQ ID NO: 2001774 - DNA, 20 bp, Homo sapiens
aatgattgtaaaatagcttg

SEQ ID NO: 2001775 - DNA, 13 bp, Homo sapiens
aatgatttcatgc

SEQ ID NO: 2001776 - DNA, 15 bp, Homo sapiens
aatgattttcatcaa

SEQ ID NO: 2001777 - DNA, 20 bp, Homo sapiens
aatgattttcatcaatttaa

SEQ ID NO: 2001778 - DNA, 17 bp, Homo sapiens
aatgcaaaatgaaataa

SEQ ID NO: 2001779 - DNA, 16 bp, Homo sapiens
aatgcacaagctcaga

SEQ ID NO: 2001780 - DNA, 23 bp, Homo sapiens
aagtgatcctcccacctcagcct

SEQ ID NO: 2001781 - DNA, 18 bp, Homo sapiens
aagtgatctgtcccctct

SEQ ID NO: 2001782 - DNA, 22 bp, Homo sapiens
aagtgatctgtcccctctcccc

SEQ ID NO: 2001783 - DNA, 19 bp, Homo sapiens
aagtgattctcctgcctca

SEQ ID NO: 2001784 - DNA, 20 bp, Homo sapiens
aagtgattctcctgcctcag

SEQ ID NO: 2001785 - DNA, 19 bp, Homo sapiens
aagtgcaaaggtgtgcaaa

SEQ ID NO: 2001786 - DNA, 14 bp, Homo sapiens
aagtgcaaatactc

SEQ ID NO: 2001787 - DNA, 20 bp, Homo sapiens
aagtgcaatgcgtgttgtac

SEQ ID NO: 2001788 - DNA, 17 bp, Homo sapiens
aagtgcaatttcccctc

SEQ ID NO: 2001789 - DNA, 18 bp, Homo sapiens
aagtgcacacagaaatat

SEQ ID NO: 2001790 - DNA, 21 bp, Homo sapiens
aagtgcagcccttcctcctga

SEQ ID NO: 2001791 - DNA, 21 bp, Homo sapiens
aagtgccactcattcctgtag

SEQ ID NO: 2001792 - DNA, 21 bp, Homo sapiens
aagtgccagtcttgtgtctgc

SEQ ID NO: 2001793 - DNA, 10 bp, Homo sapiens
aagtgccatc

SEQ ID NO: 2001794 - DNA, 16 bp, Homo sapiens
aagtgccatcccacat

SEQ ID NO: 2001795 - DNA, 21 bp, Homo sapiens
aagtgcccgccctgcccctgc

SEQ ID NO: 2001796 - DNA, 23 bp, Homo sapiens
aagtgctatgccaagccatgtct

SEQ ID NO: 2001797 - DNA, 13 bp, Homo sapiens
aagtgctccccac

SEQ ID NO: 2001798 - DNA, 15 bp, Homo sapiens
aagtgctccccacac

SEQ ID NO: 2001799 - DNA, 18 bp, Homo sapiens
aagtgcttagaaagttat

SEQ ID NO: 2001800 - DNA, 23 bp, Homo sapiens
aagtgcttgcagatcatctgggg

SEQ ID NO: 2001801 - DNA, 17 bp, Homo sapiens
aagtggaaaaaagagaa

SEQ ID NO: 2001802 - DNA, 20 bp, Homo sapiens
aagtggaccaggacaggacc

SEQ ID NO: 2001803 - DNA, 12 bp, Homo sapiens
aagtggaggggg

SEQ ID NO: 2001804 - DNA, 14 bp, Homo sapiens
aagtggagggggtg

SEQ ID NO: 2001805 - DNA, 18 bp, Homo sapiens
aagtggctaattcaattt

SEQ ID NO: 2001806 - DNA, 21 bp, Homo sapiens
aagtgggccaggacaggcccg

SEQ ID NO: 2001807 - DNA, 17 bp, Homo sapiens
aagtggggctaaatgaa

SEQ ID NO: 2001808 - DNA, 19 bp, Homo sapiens
aagtgggggcagagggcag

SEQ ID NO: 2001809 - DNA, 19 bp, Homo sapiens
aagtgggggccgctggccc

SEQ ID NO: 2001810 - DNA, 16 bp, Homo sapiens
aagtgtaatagattat

SEQ ID NO: 2001811 - DNA, 18 bp, Homo sapiens
aagtgtcgaaagcaactc

SEQ ID NO: 2001812 - DNA, 22 bp, Homo sapiens
aagtgtgttgggaattgcatgc

SEQ ID NO: 2001813 - DNA, 17 bp, Homo sapiens
aagtgtgtttccttcag

SEQ ID NO: 2001814 - DNA, 13 bp, Homo sapiens
aagtgttcaagaa

SEQ ID NO: 2001815 - DNA, 17 bp, Homo sapiens
aagtgttcaagaaataa

SEQ ID NO: 2001816 - DNA, 18 bp, Homo sapiens
aagtgttcaagaaataaa

SEQ ID NO: 2001817 - DNA, 12 bp, Homo sapiens
aagtgttgaaga

SEQ ID NO: 2001818 - DNA, 22 bp, Homo sapiens
aagtgttgaagaagagtttgca

SEQ ID NO: 2001819 - DNA, 18 bp, Homo sapiens
aagtgttgctcttggaaa

SEQ ID NO: 2001820 - DNA, 22 bp, Homo sapiens
aagtgttgtaaatatttatgta

SEQ ID NO: 2001821 - DNA, 23 bp, Homo sapiens
aagtgtttaacttgtcaaaaaac

SEQ ID NO: 2001822 - DNA, 14 bp, Homo sapiens
aagttaaattttat

SEQ ID NO: 2001823 - DNA, 16 bp, Homo sapiens
aagttacatgtttgca

SEQ ID NO: 2001824 - DNA, 20 bp, Homo sapiens
aagttacatgtttgcacctt

SEQ ID NO: 2001825 - DNA, 22 bp, Homo sapiens
aagttacttcactttaattctc

SEQ ID NO: 2001826 - DNA, 12 bp, Homo sapiens
aagttacttgaa

SEQ ID NO: 2001827 - DNA, 13 bp, Homo sapiens
aagttagctcagg

SEQ ID NO: 2001828 - DNA, 14 bp, Homo sapiens
aagttagctcagga

SEQ ID NO: 2001829 - DNA, 22 bp, Homo sapiens
aagttaggtcattactaaccat

SEQ ID NO: 2001830 - DNA, 20 bp, Homo sapiens
aagttagtgtgttgtctgtg

SEQ ID NO: 2001831 - DNA, 18 bp, Homo sapiens
aagttataaatcaatgtc

SEQ ID NO: 2001832 - DNA, 17 bp, Homo sapiens
aagttatagtatatctg

SEQ ID NO: 2001833 - DNA, 16 bp, Homo sapiens
aagttatattgaatat

SEQ ID NO: 2001834 - DNA, 22 bp, Homo sapiens
aagttatattgaatatatcaga

SEQ ID NO: 2001835 - DNA, 18 bp, Homo sapiens
aagttatgagggtcaggg

SEQ ID NO: 2001836 - DNA, 23 bp, Homo sapiens
aagttattaacgggcatgtatta

SEQ ID NO: 2001837 - DNA, 22 bp, Homo sapiens
aagttattaatcttatgtgttt

SEQ ID NO: 2001838 - DNA, 17 bp, Homo sapiens
aagttattgtgttgcct

SEQ ID NO: 2001839 - DNA, 19 bp, Homo sapiens
aagttcaatctgtttttca

SEQ ID NO: 2001840 - DNA, 16 bp, Homo sapiens
aagttcagccaccctg

SEQ ID NO: 2001841 - DNA, 13 bp, Homo sapiens
aagttcagccaga

SEQ ID NO: 2001842 - DNA, 20 bp, Homo sapiens
aagttcagggaagcaggcag

SEQ ID NO: 2001843 - DNA, 14 bp, Homo sapiens
aagttcatagggtc

SEQ ID NO: 2001844 - DNA, 20 bp, Homo sapiens
aagttcatgtttgtaaatta

SEQ ID NO: 2001845 - DNA, 14 bp, Homo sapiens
aagttccctacttc

SEQ ID NO: 2001846 - DNA, 18 bp, Homo sapiens
aagttcctgcactccaga

SEQ ID NO: 2001847 - DNA, 16 bp, Homo sapiens
aagttctaagttcatg

SEQ ID NO: 2001848 - DNA, 17 bp, Homo sapiens
aagttctagagaagagg

SEQ ID NO: 2001849 - DNA, 18 bp, Homo sapiens
aagttctgaaaactgttt

SEQ ID NO: 2001850 - DNA, 20 bp, Homo sapiens
aagttgaaagagtcctattt

SEQ ID NO: 2001851 - DNA, 17 bp, Homo sapiens
aagttgaagctaagatt

SEQ ID NO: 2001852 - DNA, 22 bp, Homo sapiens
aagttggaaccgtgtccagcac

SEQ ID NO: 2001853 - DNA, 23 bp, Homo sapiens
aagttggaaccgtgtccagcaca

SEQ ID NO: 2001854 - DNA, 17 bp, Homo sapiens
aagttgttaactaaatt

SEQ ID NO: 2001855 - DNA, 20 bp, Homo sapiens
aagttgttccttaagtcaga

SEQ ID NO: 2001856 - DNA, 20 bp, Homo sapiens
aagtttacagtaaataaatt

SEQ ID NO: 2001857 - DNA, 21 bp, Homo sapiens
aagtttacagtaaataaattg

SEQ ID NO: 2001858 - DNA, 14 bp, Homo sapiens
aagtttatttcatg

SEQ ID NO: 2001859 - DNA, 20 bp, Homo sapiens
aagtttattttttctacaca

SEQ ID NO: 2001860 - DNA, 21 bp, Homo sapiens
aagtttattttttctacacag

SEQ ID NO: 2001861 - DNA, 22 bp, Homo sapiens
aagtttcaatgtgattctaatg

SEQ ID NO: 2001862 - DNA, 14 bp, Homo sapiens
aagtttcaccttgg

SEQ ID NO: 2001863 - DNA, 21 bp, Homo sapiens
aagtttctagctagaaatatg

SEQ ID NO: 2001864 - DNA, 16 bp, Homo sapiens
aagtttgatttcatta

SEQ ID NO: 2001865 - DNA, 14 bp, Homo sapiens
aagtttgcactgta

SEQ ID NO: 2001866 - DNA, 13 bp, Homo sapiens
aagttttcctgag

SEQ ID NO: 2001867 - DNA, 13 bp, Homo sapiens
aagttttgatgaa

SEQ ID NO: 2001868 - DNA, 22 bp, Homo sapiens
aagttttgtataaataataaag

SEQ ID NO: 2001869 - DNA, 16 bp, Homo sapiens
aataaaaaaatacagt

SEQ ID NO: 2001870 - DNA, 21 bp, Homo sapiens
aataaaaaaatacagtaaagt

SEQ ID NO: 2001871 - DNA, 17 bp, Homo sapiens
aataaaaaacatttgta

SEQ ID NO: 2001872 - DNA, 15 bp, Homo sapiens
aataaaaaccagaat

SEQ ID NO: 2001873 - DNA, 19 bp, Homo sapiens
aataaaaactgactcctta

SEQ ID NO: 2001874 - DNA, 16 bp, Homo sapiens
aataaaaataaatttg

SEQ ID NO: 2001875 - DNA, 17 bp, Homo sapiens
aataaaaatttgtttaa

SEQ ID NO: 2001876 - DNA, 14 bp, Homo sapiens
aataaaacattatg

SEQ ID NO: 2001877 - DNA, 12 bp, Homo sapiens
aataaaaccttt

SEQ ID NO: 2001878 - DNA, 13 bp, Homo sapiens
aataaaacctttc

SEQ ID NO: 2001879 - DNA, 14 bp, Homo sapiens
aataaaacctttca

SEQ ID NO: 2001880 - DNA, 15 bp, Homo sapiens
aataaaacctttcaa

SEQ ID NO: 2001881 - DNA, 18 bp, Homo sapiens
aataaaagcagcatctgc

SEQ ID NO: 2001882 - DNA, 18 bp, Homo sapiens
aataaaatcatgtacatt

SEQ ID NO: 2001883 - DNA, 14 bp, Homo sapiens
aataaaatcctgct

SEQ ID NO: 2001884 - DNA, 16 bp, Homo sapiens
aataaaatcttgaaaa

SEQ ID NO: 2001885 - DNA, 19 bp, Homo sapiens
aataaaatgaggacatgtt

SEQ ID NO: 2001886 - DNA, 15 bp, Homo sapiens
aataaaattttcaaa

SEQ ID NO: 2001887 - DNA, 13 bp, Homo sapiens
aataaacaaataa

SEQ ID NO: 2001888 - DNA, 21 bp, Homo sapiens
aataaaccaaaggacattatg

SEQ ID NO: 2001889 - DNA, 12 bp, Homo sapiens
aattcagtaaca

SEQ ID NO: 2001890 - DNA, 16 bp, Homo sapiens
aattcataattagaac

SEQ ID NO: 2001891 - DNA, 19 bp, Homo sapiens
aattcataattagaacaat

SEQ ID NO: 2001892 - DNA, 14 bp, Homo sapiens
aattcattaaattt

SEQ ID NO: 2001893 - DNA, 15 bp, Homo sapiens
aattcatttcacatt

SEQ ID NO: 2001894 - DNA, 20 bp, Homo sapiens
aattcatttcatctactaca

SEQ ID NO: 2001895 - DNA, 14 bp, Homo sapiens
aattccaaaggaat

SEQ ID NO: 2001896 - DNA, 12 bp, Homo sapiens
aattccaaggag

SEQ ID NO: 2001897 - DNA, 16 bp, Homo sapiens
aattccaatatgatga

SEQ ID NO: 2001898 - DNA, 21 bp, Homo sapiens
aattcccagctgtctgtgtca

SEQ ID NO: 2001899 - DNA, 17 bp, Homo sapiens
aattcccattttgcaaa

SEQ ID NO: 2001900 - DNA, 16 bp, Homo sapiens
aattcctgaagccaga

SEQ ID NO: 2001901 - DNA, 16 bp, Homo sapiens
aattcctggcatgaca

SEQ ID NO: 2001902 - DNA, 17 bp, Homo sapiens
aattcctgtagcatctt

SEQ ID NO: 2001903 - DNA, 15 bp, Homo sapiens
aattccttcccactc

SEQ ID NO: 2001904 - DNA, 19 bp, Homo sapiens
aattccttttctaactctc

SEQ ID NO: 2001905 - DNA, 14 bp, Homo sapiens
aattctaaaatgat

SEQ ID NO: 2001906 - DNA, 14 bp, Homo sapiens
aattctaacttttt

SEQ ID NO: 2001907 - DNA, 21 bp, Homo sapiens
aattctaagattgtacatatg

SEQ ID NO: 2001908 - DNA, 18 bp, Homo sapiens
aattctacagcatacaga

SEQ ID NO: 2001909 - DNA, 14 bp, Homo sapiens
aattctacagtttc

SEQ ID NO: 2001910 - DNA, 13 bp, Homo sapiens
aattctagaaaat

SEQ ID NO: 2001911 - DNA, 23 bp, Homo sapiens
aattctaggcatcccaggggacc

SEQ ID NO: 2001912 - DNA, 17 bp, Homo sapiens
aattctcaacctaccac

SEQ ID NO: 2001913 - DNA, 13 bp, Homo sapiens
aattctcatgtga

SEQ ID NO: 2001914 - DNA, 16 bp, Homo sapiens
aattctcatgtgatcc

SEQ ID NO: 2001915 - DNA, 21 bp, Homo sapiens
aattctcatgtgatcctttta

SEQ ID NO: 2001916 - DNA, 21 bp, Homo sapiens
aattctgcaactagccaaggc

SEQ ID NO: 2001917 - DNA, 19 bp, Homo sapiens
aattctgcaatgttttcct

SEQ ID NO: 2001918 - DNA, 16 bp, Homo sapiens
aattctgctacctcac

SEQ ID NO: 2001919 - DNA, 19 bp, Homo sapiens
aattctgctacctcactgg

SEQ ID NO: 2001920 - DNA, 16 bp, Homo sapiens
aattctgctcagatag

SEQ ID NO: 2001921 - DNA, 20 bp, Homo sapiens
aattctggaggaagaagaca

SEQ ID NO: 2001922 - DNA, 20 bp, Homo sapiens
aattctgtgaagaatgaagt

SEQ ID NO: 2001923 - DNA, 14 bp, Homo sapiens
aattcttaaaatat

SEQ ID NO: 2001924 - DNA, 17 bp, Homo sapiens
aattcttacaaacatgt

SEQ ID NO: 2001925 - DNA, 14 bp, Homo sapiens
aattcttatttctg

SEQ ID NO: 2001926 - DNA, 15 bp, Homo sapiens
aattcttatttctgt

SEQ ID NO: 2001927 - DNA, 23 bp, Homo sapiens
aattcttattttttaaaaagcta

SEQ ID NO: 2001928 - DNA, 17 bp, Homo sapiens
aattctttacaataaac

SEQ ID NO: 2001929 - DNA, 14 bp, Homo sapiens
aattctttttcaaa

SEQ ID NO: 2001930 - DNA, 13 bp, Homo sapiens
aattgaaatttaa

SEQ ID NO: 2001931 - DNA, 23 bp, Homo sapiens
aattgaaatttaaaaataaagct

SEQ ID NO: 2001932 - DNA, 21 bp, Homo sapiens
aattgaacttaaataaatgtc

SEQ ID NO: 2001933 - DNA, 22 bp, Homo sapiens
aattgaacttaaataaatgtca

SEQ ID NO: 2001934 - DNA, 22 bp, Homo sapiens
aattgacttcttgcttgtacat

SEQ ID NO: 2001935 - DNA, 12 bp, Homo sapiens
aattgagaaaca

SEQ ID NO: 2001936 - DNA, 15 bp, Homo sapiens
aattgagaagggaaa

SEQ ID NO: 2001937 - DNA, 20 bp, Homo sapiens
aattgagataatatctgtga

SEQ ID NO: 2001938 - DNA, 22 bp, Homo sapiens
aattgagtctcttttttattct

SEQ ID NO: 2001939 - DNA, 23 bp, Homo sapiens
aattgagtctcttttttattctg

SEQ ID NO: 2001940 - DNA, 18 bp, Homo sapiens
aattgagtgtttaaagtt

SEQ ID NO: 2001941 - DNA, 14 bp, Homo sapiens
aattgattattctg

SEQ ID NO: 2001942 - DNA, 22 bp, Homo sapiens
aattgatttgacccactcacac

SEQ ID NO: 2001943 - DNA, 23 bp, Homo sapiens
aattgatttgacccactcacact

SEQ ID NO: 2001944 - DNA, 12 bp, Homo sapiens
aattgcacaatt

SEQ ID NO: 2001945 - DNA, 17 bp, Homo sapiens
aattgcacaatttgagc

SEQ ID NO: 2001946 - DNA, 20 bp, Homo sapiens
aattgcattctgaatgaata

SEQ ID NO: 2001947 - DNA, 16 bp, Homo sapiens
aattgcctcttgcagg

SEQ ID NO: 2001948 - DNA, 23 bp, Homo sapiens
aattgcctgacgaactccttgat

SEQ ID NO: 2001949 - DNA, 21 bp, Homo sapiens
aattgctagtgatttcattac

SEQ ID NO: 2001950 - DNA, 16 bp, Homo sapiens
aattggagtatctaaa

SEQ ID NO: 2001951 - DNA, 22 bp, Homo sapiens
aattgggattttaaaaacatga

SEQ ID NO: 2001952 - DNA, 18 bp, Homo sapiens
aattggtaattgaatgga

SEQ ID NO: 2001953 - DNA, 18 bp, Homo sapiens
aattgtagatggaaatca

SEQ ID NO: 2001954 - DNA, 23 bp, Homo sapiens
aattgtatagagatatgcagaag

SEQ ID NO: 2001955 - DNA, 24 bp, Homo sapiens
aattgtatcatttgaacaactagg

SEQ ID NO: 2001956 - DNA, 15 bp, Homo sapiens
aattgtcaaatgtca

SEQ ID NO: 2001957 - DNA, 20 bp, Homo sapiens
aattgtcttttgtcatgtgg

SEQ ID NO: 2001958 - DNA, 15 bp, Homo sapiens
aattgtgatgttttg

SEQ ID NO: 2001959 - DNA, 16 bp, Homo sapiens
aattgtgatgttttgt

SEQ ID NO: 2001960 - DNA, 17 bp, Homo sapiens
aattgtgtgtcttctat

SEQ ID NO: 2001961 - DNA, 19 bp, Homo sapiens
aattgttcctgatgtgcca

SEQ ID NO: 2001962 - DNA, 19 bp, Homo sapiens
aattgttgattaatttgag

SEQ ID NO: 2001963 - DNA, 21 bp, Homo sapiens
aattgttgattaatttgagaa

SEQ ID NO: 2001964 - DNA, 22 bp, Homo sapiens
aattgtttggggatgagaaagg

SEQ ID NO: 2001965 - DNA, 20 bp, Homo sapiens
aattgtttgtaagtgaagtg

SEQ ID NO: 2001966 - DNA, 16 bp, Homo sapiens
aatttaaaccagcaga

SEQ ID NO: 2001967 - DNA, 17 bp, Homo sapiens
aatttaaaccagcagaa

SEQ ID NO: 2001968 - DNA, 22 bp, Homo sapiens
aatttaaaccagcagaaaagtg

SEQ ID NO: 2001969 - DNA, 15 bp, Homo sapiens
aatttaactaattta

SEQ ID NO: 2001970 - DNA, 16 bp, Homo sapiens
aatttaactaatttaa

SEQ ID NO: 2001971 - DNA, 20 bp, Homo sapiens
aatttaactaatttaaacca

SEQ ID NO: 2001972 - DNA, 21 bp, Homo sapiens
aatttaactaatttaaaccag

SEQ ID NO: 2001973 - DNA, 20 bp, Homo sapiens
aatttaaggagggacaagaa

SEQ ID NO: 2001974 - DNA, 23 bp, Homo sapiens
aatttaattaatcgaaatgaatt

SEQ ID NO: 2001975 - DNA, 13 bp, Homo sapiens
aatttaattcaaa

SEQ ID NO: 2001976 - DNA, 20 bp, Homo sapiens
aatttagaaatcattttgca

SEQ ID NO: 2001977 - DNA, 21 bp, Homo sapiens
aatttagaaatcattttgcaa

SEQ ID NO: 2001978 - DNA, 18 bp, Homo sapiens
aatttagcagtccaaaga

SEQ ID NO: 2001979 - DNA, 12 bp, Homo sapiens
aatttagtttca

SEQ ID NO: 2001980 - DNA, 14 bp, Homo sapiens
aatttagtttcata

SEQ ID NO: 2001981 - DNA, 16 bp, Homo sapiens
aatttataaaattaga

SEQ ID NO: 2001982 - DNA, 18 bp, Homo sapiens
aatttatcctgaaatttc

SEQ ID NO: 2001983 - DNA, 19 bp, Homo sapiens
aatttatcctgaaatttca

SEQ ID NO: 2001984 - DNA, 23 bp, Homo sapiens
aatttatcctgaaatttcagatt

SEQ ID NO: 2001985 - DNA, 20 bp, Homo sapiens
aatttatcttgtctctgggc

SEQ ID NO: 2001986 - DNA, 12 bp, Homo sapiens
aatttatggttt

SEQ ID NO: 2001987 - DNA, 15 bp, Homo sapiens
aatttattaaaatga

SEQ ID NO: 2001988 - DNA, 18 bp, Homo sapiens
aatttattagttaatata

SEQ ID NO: 2001989 - DNA, 19 bp, Homo sapiens
aatttattagttaatatat

SEQ ID NO: 2001990 - DNA, 21 bp, Homo sapiens
aatttattcaattcctctggg

SEQ ID NO: 2001991 - DNA, 12 bp, Homo sapiens
aatttattgccg

SEQ ID NO: 2001992 - DNA, 13 bp, Homo sapiens
aatttattttctt

SEQ ID NO: 2001993 - DNA, 17 bp, Homo sapiens
aatttcaaaagacatgt

SEQ ID NO: 2001994 - DNA, 22 bp, Homo sapiens
aatttcaggttttgtaaagatg

SEQ ID NO: 2001995 - DNA, 22 bp, Homo sapiens
aatttcatacctatcatcttaa

SEQ ID NO: 2001996 - DNA, 16 bp, Homo sapiens
acaacaagaacaacaa

SEQ ID NO: 2001997 - DNA, 12 bp, Homo sapiens
acaacaaggacc

SEQ ID NO: 2001998 - DNA, 14 bp, Homo sapiens
acaacaaggaccct

SEQ ID NO: 2001999 - DNA, 12 bp, Homo sapiens
acaacactcaca

SEQ ID NO: 2002000 - DNA, 13 bp, Homo sapiens
acaacaggcattc

SEQ ID NO: 2002001 - DNA, 18 bp, Homo sapiens
acaacaggttttcaccat

SEQ ID NO: 2002002 - DNA, 19 bp, Homo sapiens
acaacatccatgtcctatg

SEQ ID NO: 2002003 - DNA, 20 bp, Homo sapiens
acaacatttctatagccaaa

SEQ ID NO: 2002004 - DNA, 12 bp, Homo sapiens
acaacattttat

SEQ ID NO: 2002005 - DNA, 17 bp, Homo sapiens
acaaccagccacacaga

SEQ ID NO: 2002006 - DNA, 24 bp, Homo sapiens
acaaccccatcatatgacatgcca

SEQ ID NO: 2002007 - DNA, 22 bp, Homo sapiens
acaacctgagccttttcttata

SEQ ID NO: 2002008 - DNA, 12 bp, Homo sapiens
acaacctggaga

SEQ ID NO: 2002009 - DNA, 15 bp, Homo sapiens
acaactccaggaaaa

SEQ ID NO: 2002010 - DNA, 21 bp, Homo sapiens
acaactccaggaaaactgttt

SEQ ID NO: 2002011 - DNA, 18 bp, Homo sapiens
acaactcttccatttatt

SEQ ID NO: 2002012 - DNA, 15 bp, Homo sapiens
acaactgacacagga

SEQ ID NO: 2002013 - DNA, 20 bp, Homo sapiens
acaactgtctaatgacacgg

SEQ ID NO: 2002014 - DNA, 19 bp, Homo sapiens
acaactgtttttgaagaag

SEQ ID NO: 2002015 - DNA, 17 bp, Homo sapiens
acaacttcaagtgcatg

SEQ ID NO: 2002016 - DNA, 14 bp, Homo sapiens
acaacttctttgta

SEQ ID NO: 2002017 - DNA, 23 bp, Homo sapiens
acaagaaatccctgtttaatatt

SEQ ID NO: 2002018 - DNA, 17 bp, Homo sapiens
acaagaagcattttgta

SEQ ID NO: 2002019 - DNA, 18 bp, Homo sapiens
acaagaagcattttgtaa

SEQ ID NO: 2002020 - DNA, 17 bp, Homo sapiens
acaagaatcacctcaaa

SEQ ID NO: 2002021 - DNA, 19 bp, Homo sapiens
acaagagccatgtaccagt

SEQ ID NO: 2002022 - DNA, 16 bp, Homo sapiens
acaagagcgaaactcc

SEQ ID NO: 2002023 - DNA, 17 bp, Homo sapiens
acaagagctgctgtcct

SEQ ID NO: 2002024 - DNA, 18 bp, Homo sapiens
acaagaggttaaggtggg

SEQ ID NO: 2002025 - DNA, 23 bp, Homo sapiens
acaagaggttaaggtgggtccag

SEQ ID NO: 2002026 - DNA, 18 bp, Homo sapiens
acaagagtttatttccaa

SEQ ID NO: 2002027 - DNA, 20 bp, Homo sapiens
acaagatctttcaggaaaga

SEQ ID NO: 2002028 - DNA, 16 bp, Homo sapiens
acaagattcccagaga

SEQ ID NO: 2002029 - DNA, 13 bp, Homo sapiens
acaagcaataatt

SEQ ID NO: 2002030 - DNA, 15 bp, Homo sapiens
acaagcaataattag

SEQ ID NO: 2002031 - DNA, 17 bp, Homo sapiens
acaagcaataattagga

SEQ ID NO: 2002032 - DNA, 12 bp, Homo sapiens
acaagcacaaag

SEQ ID NO: 2002033 - DNA, 16 bp, Homo sapiens
acaagcacagttttaa

SEQ ID NO: 2002034 - DNA, 18 bp, Homo sapiens
acaagccacagaagccag

SEQ ID NO: 2002035 - DNA, 16 bp, Homo sapiens
acaagcccaggctgga

SEQ ID NO: 2002036 - DNA, 17 bp, Homo sapiens
acaagccttactcacct

SEQ ID NO: 2002037 - DNA, 21 bp, Homo sapiens
acaagccttactcacctctct

SEQ ID NO: 2002038 - DNA, 24 bp, Homo sapiens
acaagccttactcacctctctcta

SEQ ID NO: 2002039 - DNA, 20 bp, Homo sapiens
acaagcgtgagccactgcac

SEQ ID NO: 2002040 - DNA, 16 bp, Homo sapiens
acaagctcctggtctt

SEQ ID NO: 2002041 - DNA, 16 bp, Homo sapiens
acaagctggaagcaca

SEQ ID NO: 2002042 - DNA, 21 bp, Homo sapiens
acaagcttgtatatacatatt

SEQ ID NO: 2002043 - DNA, 16 bp, Homo sapiens
acaaggattgctactg

SEQ ID NO: 2002044 - DNA, 15 bp, Homo sapiens
acaaggcagcaaggc

SEQ ID NO: 2002045 - DNA, 16 bp, Homo sapiens
acaaggcagcaaggcc

SEQ ID NO: 2002046 - DNA, 22 bp, Homo sapiens
acaaggcagcaaggcccgagca

SEQ ID NO: 2002047 - DNA, 13 bp, Homo sapiens
acaaggctgacca

SEQ ID NO: 2002048 - DNA, 20 bp, Homo sapiens
acaaggctgaccaagagaga

SEQ ID NO: 2002049 - DNA, 22 bp, Homo sapiens
acaaggctgaccaagagagaaa

SEQ ID NO: 2002050 - DNA, 14 bp, Homo sapiens
acaaggtagttttt

SEQ ID NO: 2002051 - DNA, 20 bp, Homo sapiens
acaaggtcaggagttcgaga

SEQ ID NO: 2002052 - DNA, 20 bp, Homo sapiens
acaaggttccctctgagaat

SEQ ID NO: 2002053 - DNA, 21 bp, Homo sapiens
acaagtagaatggcagctgga

SEQ ID NO: 2002054 - DNA, 18 bp, Homo sapiens
acaagtcacagctgcagc

SEQ ID NO: 2002055 - DNA, 22 bp, Homo sapiens
acaagtgagttgttgccctggg

SEQ ID NO: 2002056 - DNA, 14 bp, Homo sapiens
acaagtggaggggg

SEQ ID NO: 2002057 - DNA, 15 bp, Homo sapiens
acaagtggagggggt

SEQ ID NO: 2002058 - DNA, 20 bp, Homo sapiens
acaagtgtatatcagaaaag

SEQ ID NO: 2002059 - DNA, 16 bp, Homo sapiens
acaagttatttaaatc

SEQ ID NO: 2002060 - DNA, 11 bp, Homo sapiens
acaagttgcct

SEQ ID NO: 2002061 - DNA, 12 bp, Homo sapiens
acaataaaacat

SEQ ID NO: 2002062 - DNA, 14 bp, Homo sapiens
acaataaaacattc

SEQ ID NO: 2002063 - DNA, 13 bp, Homo sapiens
acaataaagactg

SEQ ID NO: 2002064 - DNA, 15 bp, Homo sapiens
acaataaatattctg

SEQ ID NO: 2002065 - DNA, 11 bp, Homo sapiens
acaataaatgc

SEQ ID NO: 2002066 - DNA, 12 bp, Homo sapiens
acaataaatgct

SEQ ID NO: 2002067 - DNA, 21 bp, Homo sapiens
acaataaatgctgaatgaatc

SEQ ID NO: 2002068 - DNA, 13 bp, Homo sapiens
acaataacaacaa

SEQ ID NO: 2002069 - DNA, 14 bp, Homo sapiens
acaataattttcta

SEQ ID NO: 2002070 - DNA, 16 bp, Homo sapiens
acaatatgattttaaa

SEQ ID NO: 2002071 - DNA, 10 bp, Homo sapiens
acaatattta

SEQ ID NO: 2002072 - DNA, 18 bp, Homo sapiens
acaatccactctcaggag

SEQ ID NO: 2002073 - DNA, 14 bp, Homo sapiens
acaatcctgaagaa

SEQ ID NO: 2002074 - DNA, 17 bp, Homo sapiens
acaatcctgtccctcac

SEQ ID NO: 2002075 - DNA, 22 bp, Homo sapiens
acaatcctttgagttatagttt

SEQ ID NO: 2002076 - DNA, 12 bp, Homo sapiens
acaatggcagct

SEQ ID NO: 2002077 - DNA, 21 bp, Homo sapiens
acaatggctaattcccagagt

SEQ ID NO: 2002078 - DNA, 17 bp, Homo sapiens
acaatggggtgggccca

SEQ ID NO: 2002079 - DNA, 17 bp, Homo sapiens
acaatggtttacatgaa

SEQ ID NO: 2002080 - DNA, 19 bp, Homo sapiens
acaatggtttacatgaaca

SEQ ID NO: 2002081 - DNA, 14 bp, Homo sapiens
acaatgtcacataa

SEQ ID NO: 2002082 - DNA, 23 bp, Homo sapiens
acaatgttctgttgtaaagagtg

SEQ ID NO: 2002083 - DNA, 19 bp, Homo sapiens
acaattaaagctgttattt

SEQ ID NO: 2002084 - DNA, 14 bp, Homo sapiens
acaattccaaagga

SEQ ID NO: 2002085 - DNA, 14 bp, Homo sapiens
acaatttaaagcaa

SEQ ID NO: 2002086 - DNA, 13 bp, Homo sapiens
acaatttagaaaa

SEQ ID NO: 2002087 - DNA, 16 bp, Homo sapiens
acaatttcctttatat

SEQ ID NO: 2002088 - DNA, 20 bp, Homo sapiens
acaatttcctttatatttag

SEQ ID NO: 2002089 - DNA, 18 bp, Homo sapiens
acaatttgagcaattcat

SEQ ID NO: 2002090 - DNA, 13 bp, Homo sapiens
acacaaaagccaa

SEQ ID NO: 2002091 - DNA, 22 bp, Homo sapiens
acacaaaccacaactgacacag

SEQ ID NO: 2002092 - DNA, 14 bp, Homo sapiens
acacaagccacaga

SEQ ID NO: 2002093 - DNA, 13 bp, Homo sapiens
acacaaggctggg

SEQ ID NO: 2002094 - DNA, 16 bp, Homo sapiens
acacaagtcctgtgaa

SEQ ID NO: 2002095 - DNA, 21 bp, Homo sapiens
acacaagtttgtgctatctat

SEQ ID NO: 2002096 - DNA, 14 bp, Homo sapiens
acacaatctttcct

SEQ ID NO: 2002097 - DNA, 18 bp, Homo sapiens
acacacaaaatgtcacaa

SEQ ID NO: 2002098 - DNA, 9 bp, Homo sapiens
acacacaca

SEQ ID NO: 2002099 - DNA, 11 bp, Homo sapiens
acacacacaca

SEQ ID NO: 2002100 - DNA, 12 bp, Homo sapiens
acacacacacac

SEQ ID NO: 2002101 - DNA, 16 bp, Homo sapiens
acacacacacacacac

SEQ ID NO: 2002102 - DNA, 16 bp, Homo sapiens
acacacacacacacat

SEQ ID NO: 2002103 - DNA, 16 bp, Homo sapiens
acacacacacacatac

SEQ ID NO: 2002104 - DNA, 14 bp, Homo sapiens
acacacacacatac

SEQ ID NO: 2002105 - DNA, 11 bp, Homo sapiens
acacacacata

SEQ ID NO: 2002106 - DNA, 12 bp, Homo sapiens
acacacacatac

SEQ ID NO: 2002107 - DNA, 22 bp, Homo sapiens
acacacacgcgtgcacacacca

SEQ ID NO: 2002108 - DNA, 19 bp, Homo sapiens
acacacagatatacacatg

SEQ ID NO: 2002109 - DNA, 22 bp, Homo sapiens
acacacagatggtcacacagag

SEQ ID NO: 2002110 - DNA, 13 bp, Homo sapiens
acacacagcagca

SEQ ID NO: 2002111 - DNA, 18 bp, Homo sapiens
acacacagcagcactgca

SEQ ID NO: 2002112 - DNA, 17 bp, Homo sapiens
acacacagctctgtcct

SEQ ID NO: 2002113 - DNA, 19 bp, Homo sapiens
acacacagctctgtcctgg

SEQ ID NO: 2002114 - DNA, 18 bp, Homo sapiens
acacacaggccatttcat

SEQ ID NO: 2002115 - DNA, 12 bp, Homo sapiens
acacacatagat

SEQ ID NO: 2002116 - DNA, 19 bp, Homo sapiens
acacacatatacatatata

SEQ ID NO: 2002117 - DNA, 15 bp, Homo sapiens
acacaccagagccca

SEQ ID NO: 2002118 - DNA, 13 bp, Homo sapiens
acacacccctcaa

SEQ ID NO: 2002119 - DNA, 16 bp, Homo sapiens
acacaccgatgtacac

SEQ ID NO: 2002120 - DNA, 17 bp, Homo sapiens
acacaccggtcaccgag

SEQ ID NO: 2002121 - DNA, 13 bp, Homo sapiens
acacacctctgga

SEQ ID NO: 2002122 - DNA, 15 bp, Homo sapiens
acacactcaaatcaa

SEQ ID NO: 2002123 - DNA, 12 bp, Homo sapiens
acacagaaatat

SEQ ID NO: 2002124 - DNA, 21 bp, Homo sapiens
acacagaaatatatatacata

SEQ ID NO: 2002125 - DNA, 17 bp, Homo sapiens
acacagagatatgcaca

SEQ ID NO: 2002126 - DNA, 16 bp, Homo sapiens
acacagagcctgcctc

SEQ ID NO: 2002127 - DNA, 12 bp, Homo sapiens
acacagaggaag

SEQ ID NO: 2002128 - DNA, 13 bp, Homo sapiens
acacagaggaaga

SEQ ID NO: 2002129 - DNA, 21 bp, Homo sapiens
acacagaggaagagcaggcac

SEQ ID NO: 2002130 - DNA, 20 bp, Homo sapiens
acacagagtggagccctcag

SEQ ID NO: 2002131 - DNA, 21 bp, Homo sapiens
acacagatggtcacacagaga

SEQ ID NO: 2002132 - DNA, 13 bp, Homo sapiens
acacagcagcccc

SEQ ID NO: 2002133 - DNA, 14 bp, Homo sapiens
acacagcctggact

SEQ ID NO: 2002134 - DNA, 21 bp, Homo sapiens
acacagcgtccctagcagtga

SEQ ID NO: 2002135 - DNA, 14 bp, Homo sapiens
acacagctctgtcc

SEQ ID NO: 2002136 - DNA, 16 bp, Homo sapiens
acacagctcttctcca

SEQ ID NO: 2002137 - DNA, 22 bp, Homo sapiens
acacagctgagagacttttaat

SEQ ID NO: 2002138 - DNA, 13 bp, Homo sapiens
acacaggcctgtg

SEQ ID NO: 2002139 - DNA, 16 bp, Homo sapiens
acacaggcctgtgtag

SEQ ID NO: 2002140 - DNA, 17 bp, Homo sapiens
acacaggtacagcaaca

SEQ ID NO: 2002141 - DNA, 24 bp, Homo sapiens
acacagtaaaaacttgtactatgt

SEQ ID NO: 2002142 - DNA, 18 bp, Homo sapiens
acacagtattacttctgc

SEQ ID NO: 2002143 - DNA, 22 bp, Homo sapiens
acacagtattacttctgctaca

SEQ ID NO: 2002144 - DNA, 19 bp, Homo sapiens
acacagtctcagtccagat

SEQ ID NO: 2002145 - DNA, 11 bp, Homo sapiens
acacagtgagt

SEQ ID NO: 2002146 - DNA, 13 bp, Homo sapiens
acacagtgagtcg

SEQ ID NO: 2002147 - DNA, 22 bp, Homo sapiens
acacagtgggaactctgacaag

SEQ ID NO: 2002148 - DNA, 20 bp, Homo sapiens
acacagtgggtggtggatct

SEQ ID NO: 2002149 - DNA, 10 bp, Homo sapiens
acacagtgtt

SEQ ID NO: 2002150 - DNA, 20 bp, Homo sapiens
acatatcaattcaacacatt

SEQ ID NO: 2002151 - DNA, 13 bp, Homo sapiens
acatatcagaaaa

SEQ ID NO: 2002152 - DNA, 15 bp, Homo sapiens
acatatgcaccttgt

SEQ ID NO: 2002153 - DNA, 16 bp, Homo sapiens
acatatgcaccttgtg

SEQ ID NO: 2002154 - DNA, 18 bp, Homo sapiens
acatatgcaccttgtgtc

SEQ ID NO: 2002155 - DNA, 23 bp, Homo sapiens
acatatggactctgcacatgaat

SEQ ID NO: 2002156 - DNA, 15 bp, Homo sapiens
acatatgggtgctgg

SEQ ID NO: 2002157 - DNA, 18 bp, Homo sapiens
acatatgggtgctggcag

SEQ ID NO: 2002158 - DNA, 17 bp, Homo sapiens
acatatgtattaagcca

SEQ ID NO: 2002159 - DNA, 14 bp, Homo sapiens
acatatgtctgtat

SEQ ID NO: 2002160 - DNA, 17 bp, Homo sapiens
acatattataaataaat

SEQ ID NO: 2002161 - DNA, 22 bp, Homo sapiens
acatattataaataaatgccaa

SEQ ID NO: 2002162 - DNA, 20 bp, Homo sapiens
acatatttgttaaatattta

SEQ ID NO: 2002163 - DNA, 17 bp, Homo sapiens
acatcaaatttgccacc

SEQ ID NO: 2002164 - DNA, 15 bp, Homo sapiens
acatcaagcatgcaa

SEQ ID NO: 2002165 - DNA, 17 bp, Homo sapiens
acatcaagcatgcaata

SEQ ID NO: 2002166 - DNA, 21 bp, Homo sapiens
acatcaagcatgcaataatgt

SEQ ID NO: 2002167 - DNA, 15 bp, Homo sapiens
acatcacagcagaat

SEQ ID NO: 2002168 - DNA, 23 bp, Homo sapiens
acatcaccgacgcgtctcctgtt

SEQ ID NO: 2002169 - DNA, 19 bp, Homo sapiens
acatcactgattgggtgcc

SEQ ID NO: 2002170 - DNA, 19 bp, Homo sapiens
acatcacttgtacaaaata

SEQ ID NO: 2002171 - DNA, 13 bp, Homo sapiens
acatccaaggaga

SEQ ID NO: 2002172 - DNA, 14 bp, Homo sapiens
acatccaaggagaa

SEQ ID NO: 2002173 - DNA, 18 bp, Homo sapiens
acatccatgtttgtaaaa

SEQ ID NO: 2002174 - DNA, 20 bp, Homo sapiens
acatccatgtttgtaaaact

SEQ ID NO: 2002175 - DNA, 17 bp, Homo sapiens
acatccattcccaagaa

SEQ ID NO: 2002176 - DNA, 20 bp, Homo sapiens
acatccattcccaagaaatg

SEQ ID NO: 2002177 - DNA, 14 bp, Homo sapiens
acatcccactgcca

SEQ ID NO: 2002178 - DNA, 23 bp, Homo sapiens
acatcccaggaggggcctctgaa

SEQ ID NO: 2002179 - DNA, 12 bp, Homo sapiens
acatccctgggc

SEQ ID NO: 2002180 - DNA, 14 bp, Homo sapiens
acatccctgggcct

SEQ ID NO: 2002181 - DNA, 21 bp, Homo sapiens
acacagtgttccagctgcctg

SEQ ID NO: 2002182 - DNA, 11 bp, Homo sapiens
acacatacata

SEQ ID NO: 2002183 - DNA, 15 bp, Homo sapiens
acacatacatacaca

SEQ ID NO: 2002184 - DNA, 17 bp, Homo sapiens
acacatacatacacata

SEQ ID NO: 2002185 - DNA, 23 bp, Homo sapiens
acacatacatacacatacataca

SEQ ID NO: 2002186 - DNA, 18 bp, Homo sapiens
acacatagattaatggca

SEQ ID NO: 2002187 - DNA, 21 bp, Homo sapiens
acacatagattaatggcactg

SEQ ID NO: 2002188 - DNA, 14 bp, Homo sapiens
acacatatacatat

SEQ ID NO: 2002189 - DNA, 15 bp, Homo sapiens
acacatatacatata

SEQ ID NO: 2002190 - DNA, 20 bp, Homo sapiens
acacatgcatcatcagccta

SEQ ID NO: 2002191 - DNA, 20 bp, Homo sapiens
acacatgtcctatccaaagg

SEQ ID NO: 2002192 - DNA, 20 bp, Homo sapiens
acacattctcacaattgtaa

SEQ ID NO: 2002193 - DNA, 12 bp, Homo sapiens
acacattctcct

SEQ ID NO: 2002194 - DNA, 13 bp, Homo sapiens
acacattctcctg

SEQ ID NO: 2002195 - DNA, 22 bp, Homo sapiens
acacattttctcctaggagaag

SEQ ID NO: 2002196 - DNA, 17 bp, Homo sapiens
acaccacagcaagccgg

SEQ ID NO: 2002197 - DNA, 16 bp, Homo sapiens
acaccacgaatttggt

SEQ ID NO: 2002198 - DNA, 13 bp, Homo sapiens
acaccactctggc

SEQ ID NO: 2002199 - DNA, 16 bp, Homo sapiens
acaccactctggcagc

SEQ ID NO: 2002200 - DNA, 18 bp, Homo sapiens
acaccactctggcagcca

SEQ ID NO: 2002201 - DNA, 22 bp, Homo sapiens
acaccactctggcagccacact

SEQ ID NO: 2002202 - DNA, 22 bp, Homo sapiens
acaccactgccctgcctgccca

SEQ ID NO: 2002203 - DNA, 18 bp, Homo sapiens
acaccagaataatgagtc

SEQ ID NO: 2002204 - DNA, 19 bp, Homo sapiens
acaccaggagtccctggta

SEQ ID NO: 2002205 - DNA, 21 bp, Homo sapiens
acaccataggtagaatgtaaa

SEQ ID NO: 2002206 - DNA, 19 bp, Homo sapiens
acaccatcttaaatgacag

SEQ ID NO: 2002207 - DNA, 14 bp, Homo sapiens
acaccatcttttgt

SEQ ID NO: 2002208 - DNA, 14 bp, Homo sapiens
acaccatgaatctt

SEQ ID NO: 2002209 - DNA, 22 bp, Homo sapiens
acaccattgttccttaccttta

SEQ ID NO: 2002210 - DNA, 11 bp, Homo sapiens
acacccactgg

SEQ ID NO: 2002211 - DNA, 15 bp, Homo sapiens
acacccactggccag

SEQ ID NO: 2002212 - DNA, 12 bp, Homo sapiens
acaccccaaggg

SEQ ID NO: 2002213 - DNA, 16 bp, Homo sapiens
acaccccaagggacaa

SEQ ID NO: 2002214 - DNA, 13 bp, Homo sapiens
acaccccagcgcc

SEQ ID NO: 2002215 - DNA, 14 bp, Homo sapiens
acacccccaagaca

SEQ ID NO: 2002216 - DNA, 22 bp, Homo sapiens
acaccccccagtcgagccctgc

SEQ ID NO: 2002217 - DNA, 21 bp, Homo sapiens
acaccccccgccccccacctt

SEQ ID NO: 2002218 - DNA, 22 bp, Homo sapiens
acacccctcaaaaaaagccttt

SEQ ID NO: 2002219 - DNA, 12 bp, Homo sapiens
acacccctgtgc

SEQ ID NO: 2002220 - DNA, 17 bp, Homo sapiens
acaccccttatccagga

SEQ ID NO: 2002221 - DNA, 17 bp, Homo sapiens
acacccgactcctcaaa

SEQ ID NO: 2002222 - DNA, 13 bp, Homo sapiens
acaccctaataag

SEQ ID NO: 2002223 - DNA, 18 bp, Homo sapiens
acacccttggacttgagg

SEQ ID NO: 2002224 - DNA, 14 bp, Homo sapiens
acaccgggcctgga

SEQ ID NO: 2002225 - DNA, 14 bp, Homo sapiens
acaccgtccctcag

SEQ ID NO: 2002226 - DNA, 20 bp, Homo sapiens
acaccgtccctcagtgatac

SEQ ID NO: 2002227 - DNA, 15 bp, Homo sapiens
acacctaccatgctg

SEQ ID NO: 2002228 - DNA, 16 bp, Homo sapiens
acacctaccatgctgc

SEQ ID NO: 2002229 - DNA, 15 bp, Homo sapiens
acacctagcatctca

SEQ ID NO: 2002230 - DNA, 20 bp, Homo sapiens
acacctatgtcatttcattt

SEQ ID NO: 2002231 - DNA, 15 bp, Homo sapiens
acacctcctagcaag

SEQ ID NO: 2002232 - DNA, 17 bp, Homo sapiens
acacctctggatccctg

SEQ ID NO: 2002233 - DNA, 19 bp, Homo sapiens
acacctctggatccctgga

SEQ ID NO: 2002234 - DNA, 13 bp, Homo sapiens
acacctctgggct

SEQ ID NO: 2002235 - DNA, 11 bp, Homo sapiens
acacctgacac

SEQ ID NO: 2002236 - DNA, 19 bp, Homo sapiens
acacctgcacctcccccca

SEQ ID NO: 2002237 - DNA, 12 bp, Homo sapiens
acacctgcccca

SEQ ID NO: 2002238 - DNA, 16 bp, Homo sapiens
acacctgccccagcgc

SEQ ID NO: 2002239 - DNA, 20 bp, Homo sapiens
acacctgccccagcgcggct

SEQ ID NO: 2002240 - DNA, 14 bp, Homo sapiens
acacctgccctgcc

SEQ ID NO: 2002241 - DNA, 15 bp, Homo sapiens
acacctgccctgccc

SEQ ID NO: 2002242 - DNA, 21 bp, Homo sapiens
acacctgtaatcccagcactt

SEQ ID NO: 2002243 - DNA, 16 bp, Homo sapiens
acacctgtgcacccca

SEQ ID NO: 2002244 - DNA, 15 bp, Homo sapiens
accagagccccccac

SEQ ID NO: 2002245 - DNA, 20 bp, Homo sapiens
accagagccccccacaatga

SEQ ID NO: 2002246 - DNA, 16 bp, Homo sapiens
accagaggaagcccct

SEQ ID NO: 2002247 - DNA, 19 bp, Homo sapiens
accagaggctgcagaaggc

SEQ ID NO: 2002248 - DNA, 22 bp, Homo sapiens
accagaggctgcagaaggccaa

SEQ ID NO: 2002249 - DNA, 21 bp, Homo sapiens
accagataagaatgctggttt

SEQ ID NO: 2002250 - DNA, 14 bp, Homo sapiens
accagatcactcaa

SEQ ID NO: 2002251 - DNA, 21 bp, Homo sapiens
accagatgagaagttaagcag

SEQ ID NO: 2002252 - DNA, 19 bp, Homo sapiens
accagcaacatctcgagcc

SEQ ID NO: 2002253 - DNA, 16 bp, Homo sapiens
accagcaactctgact

SEQ ID NO: 2002254 - DNA, 12 bp, Homo sapiens
accagcagaaaa

SEQ ID NO: 2002255 - DNA, 23 bp, Homo sapiens
accagcaggtgtggtggctcatg

SEQ ID NO: 2002256 - DNA, 13 bp, Homo sapiens
accagcattcatg

SEQ ID NO: 2002257 - DNA, 14 bp, Homo sapiens
accagcattttact

SEQ ID NO: 2002258 - DNA, 20 bp, Homo sapiens
accagccacacagagcctgc

SEQ ID NO: 2002259 - DNA, 13 bp, Homo sapiens
accagccccagca

SEQ ID NO: 2002260 - DNA, 14 bp, Homo sapiens
accagccccagcaa

SEQ ID NO: 2002261 - DNA, 17 bp, Homo sapiens
accagccccagcaagag

SEQ ID NO: 2002262 - DNA, 16 bp, Homo sapiens
accagccccagtgccc

SEQ ID NO: 2002263 - DNA, 18 bp, Homo sapiens
accagccccagtgcccac

SEQ ID NO: 2002264 - DNA, 19 bp, Homo sapiens
accagccccagtgcccaca

SEQ ID NO: 2002265 - DNA, 13 bp, Homo sapiens
accagccccctgg

SEQ ID NO: 2002266 - DNA, 16 bp, Homo sapiens
accagccccctggatg

SEQ ID NO: 2002267 - DNA, 19 bp, Homo sapiens
accagccccctggatgggc

SEQ ID NO: 2002268 - DNA, 14 bp, Homo sapiens
accagcccggcctg

SEQ ID NO: 2002269 - DNA, 15 bp, Homo sapiens
accagcccggcctgc

SEQ ID NO: 2002270 - DNA, 21 bp, Homo sapiens
accagcccggcctgctcccag

SEQ ID NO: 2002271 - DNA, 15 bp, Homo sapiens
accagcccttccctg

SEQ ID NO: 2002272 - DNA, 16 bp, Homo sapiens
accagcccttccctgc

SEQ ID NO: 2002273 - DNA, 18 bp, Homo sapiens
accagcccttccctgctt

SEQ ID NO: 2002274 - DNA, 19 bp, Homo sapiens
accagcctccatgctgcct

SEQ ID NO: 2002275 - DNA, 20 bp, Homo sapiens
accagcctccatgctgcctc

SEQ ID NO: 2002276 - DNA, 21 bp, Homo sapiens
accagcctccatgctgcctcc

SEQ ID NO: 2002277 - DNA, 11 bp, Homo sapiens
accagcctggc

SEQ ID NO: 2002278 - DNA, 13 bp, Homo sapiens
accagcctgggca

SEQ ID NO: 2002279 - DNA, 23 bp, Homo sapiens
accagcctgttggacccgctctg

SEQ ID NO: 2002280 - DNA, 15 bp, Homo sapiens
accagctcactccct

SEQ ID NO: 2002281 - DNA, 14 bp, Homo sapiens
accagctctgtggc

SEQ ID NO: 2002282 - DNA, 15 bp, Homo sapiens
accagctctgtggcc

SEQ ID NO: 2002283 - DNA, 18 bp, Homo sapiens
accagctctgtggcctgt

SEQ ID NO: 2002284 - DNA, 14 bp, Homo sapiens
accagctgccaaaa

SEQ ID NO: 2002285 - DNA, 14 bp, Homo sapiens
accagctgctctgc

SEQ ID NO: 2002286 - DNA, 16 bp, Homo sapiens
accagctgctctgccc

SEQ ID NO: 2002287 - DNA, 19 bp, Homo sapiens
accagctgctctgcccctt

SEQ ID NO: 2002288 - DNA, 15 bp, Homo sapiens
accagcttctccagg

SEQ ID NO: 2002289 - DNA, 18 bp, Homo sapiens
accagcttctccaggctc

SEQ ID NO: 2002290 - DNA, 20 bp, Homo sapiens
accagcttctccaggctctt

SEQ ID NO: 2002291 - DNA, 19 bp, Homo sapiens
accaggactatagcccagg

SEQ ID NO: 2002292 - DNA, 22 bp, Homo sapiens
accaggagtccctggtaataag

SEQ ID NO: 2002293 - DNA, 19 bp, Homo sapiens
accaggcaccaaaagaagt

SEQ ID NO: 2002294 - DNA, 19 bp, Homo sapiens
accaggctcacaactgttt

SEQ ID NO: 2002295 - DNA, 16 bp, Homo sapiens
accagggaggagagga

SEQ ID NO: 2002296 - DNA, 22 bp, Homo sapiens
accagggcatattaaaggcttt

SEQ ID NO: 2002297 - DNA, 22 bp, Homo sapiens
accagggtccgcaccagctgct

SEQ ID NO: 2002298 - DNA, 16 bp, Homo sapiens
accagggtgcatggct

SEQ ID NO: 2002299 - DNA, 20 bp, Homo sapiens
accagggtgcatggcttggg

SEQ ID NO: 2002300 - DNA, 14 bp, Homo sapiens
accagtatggaagg

SEQ ID NO: 2002301 - DNA, 15 bp, Homo sapiens
accagtatggaaggg

SEQ ID NO: 2002302 - DNA, 16 bp, Homo sapiens
accagtatggaaggga

SEQ ID NO: 2002303 - DNA, 15 bp, Homo sapiens
accagtcccagagca

SEQ ID NO: 2002304 - DNA, 16 bp, Homo sapiens
accagtgaaccaaaga

SEQ ID NO: 2002305 - DNA, 18 bp, Homo sapiens
accagtgaaccaaagaga

SEQ ID NO: 2002306 - DNA, 14 bp, Homo sapiens
accagtgtactgct

SEQ ID NO: 2002307 - DNA, 18 bp, Homo sapiens
accagtgtactgctttca

SEQ ID NO: 2002308 - DNA, 19 bp, Homo sapiens
accagtgtactgctttcaa

SEQ ID NO: 2002309 - DNA, 13 bp, Homo sapiens
accagtgtcccct

SEQ ID NO: 2002310 - DNA, 21 bp, Homo sapiens
accagtgtggtttgtgtttga

SEQ ID NO: 2002311 - DNA, 14 bp, Homo sapiens
accagttaagaatg

SEQ ID NO: 2002312 - DNA, 19 bp, Homo sapiens
accagttaagaatggaaga

SEQ ID NO: 2002313 - DNA, 15 bp, Homo sapiens
accagttctggccag

SEQ ID NO: 2002314 - DNA, 21 bp, Homo sapiens
accagttctggccaggagctg

SEQ ID NO: 2002315 - DNA, 22 bp, Homo sapiens
accagttctggccaggagctgg

SEQ ID NO: 2002316 - DNA, 15 bp, Homo sapiens
accagttgggagcac

SEQ ID NO: 2002317 - DNA, 20 bp, Homo sapiens
accagttgggagcactggag

SEQ ID NO: 2002318 - DNA, 21 bp, Homo sapiens
accagttgggagcactggagt

SEQ ID NO: 2002319 - DNA, 21 bp, Homo sapiens
accagtttagatttcaagaaa

SEQ ID NO: 2002320 - DNA, 13 bp, Homo sapiens
accataaaaagag

SEQ ID NO: 2002321 - DNA, 13 bp, Homo sapiens
accataatgttac

SEQ ID NO: 2002322 - DNA, 18 bp, Homo sapiens
accataatgttacattat

SEQ ID NO: 2002323 - DNA, 14 bp, Homo sapiens
accatagaacagaa

SEQ ID NO: 2002324 - DNA, 21 bp, Homo sapiens
accatagttatttacttgaaa

SEQ ID NO: 2002325 - DNA, 13 bp, Homo sapiens
accatcacacatg

SEQ ID NO: 2002326 - DNA, 17 bp, Homo sapiens
accatcaccctctgggc

SEQ ID NO: 2002327 - DNA, 10 bp, Homo sapiens
accatcactg

SEQ ID NO: 2002328 - DNA, 16 bp, Homo sapiens
accatcagttactggt

SEQ ID NO: 2002329 - DNA, 20 bp, Homo sapiens
accatcagttactggtttca

SEQ ID NO: 2002330 - DNA, 14 bp, Homo sapiens
accatcatgtctgg

SEQ ID NO: 2002331 - DNA, 16 bp, Homo sapiens
accatcatgtctggct

SEQ ID NO: 2002332 - DNA, 16 bp, Homo sapiens
accatcctgcagcctc

SEQ ID NO: 2002333 - DNA, 13 bp, Homo sapiens
accatcctggccc

SEQ ID NO: 2002334 - DNA, 13 bp, Homo sapiens
accatctaatagc

SEQ ID NO: 2002335 - DNA, 15 bp, Homo sapiens
accatctgctgcccc

SEQ ID NO: 2002336 - DNA, 19 bp, Homo sapiens
accatctgtcttgccagcc

SEQ ID NO: 2002337 - DNA, 21 bp, Homo sapiens
accatctgtcttgccagccag

SEQ ID NO: 2002338 - DNA, 22 bp, Homo sapiens
accatctgtcttgccagccaga

SEQ ID NO: 2002339 - DNA, 18 bp, Homo sapiens
accatgagaagagggcct

SEQ ID NO: 2002340 - DNA, 20 bp, Homo sapiens
accatgagaagagggcctgt

SEQ ID NO: 2002341 - DNA, 20 bp, Homo sapiens
accatgcagcttcatcaatt

SEQ ID NO: 2002342 - DNA, 21 bp, Homo sapiens
accccagctagggctggactc

SEQ ID NO: 2002343 - DNA, 15 bp, Homo sapiens
accccagctggcctc

SEQ ID NO: 2002344 - DNA, 11 bp, Homo sapiens
accccaggacg

SEQ ID NO: 2002345 - DNA, 21 bp, Homo sapiens
accccaggacgccactcattt

SEQ ID NO: 2002346 - DNA, 17 bp, Homo sapiens
accccaggcatcccatc

SEQ ID NO: 2002347 - DNA, 12 bp, Homo sapiens
accccagggcac

SEQ ID NO: 2002348 - DNA, 18 bp, Homo sapiens
accccagggcccccacag

SEQ ID NO: 2002349 - DNA, 20 bp, Homo sapiens
accccagggcccccacaggc

SEQ ID NO: 2002350 - DNA, 17 bp, Homo sapiens
acctgccctgccctgcc

SEQ ID NO: 2002351 - DNA, 18 bp, Homo sapiens
acctgccctgccctgcca

SEQ ID NO: 2002352 - DNA, 21 bp, Homo sapiens
acctgccctgccctgccacct

SEQ ID NO: 2002353 - DNA, 20 bp, Homo sapiens
acctgccgacctcgtcctcc

SEQ ID NO: 2002354 - DNA, 17 bp, Homo sapiens
acctgcctatccatcct

SEQ ID NO: 2002355 - DNA, 11 bp, Homo sapiens
acctgcctctc

SEQ ID NO: 2002356 - DNA, 14 bp, Homo sapiens
acctgcctgccctc

SEQ ID NO: 2002357 - DNA, 22 bp, Homo sapiens
acctgcggctgctgtgtgcctt

SEQ ID NO: 2002358 - DNA, 17 bp, Homo sapiens
acctgctcactgttcta

SEQ ID NO: 2002359 - DNA, 19 bp, Homo sapiens
acctgctctcctcttgcca

SEQ ID NO: 2002360 - DNA, 16 bp, Homo sapiens
acctgctgagagaccc

SEQ ID NO: 2002361 - DNA, 22 bp, Homo sapiens
acctgctgagagacccaaggag

SEQ ID NO: 2002362 - DNA, 18 bp, Homo sapiens
acctgctgagctctgaga

SEQ ID NO: 2002363 - DNA, 20 bp, Homo sapiens
acctgctgagctctgagagg

SEQ ID NO: 2002364 - DNA, 23 bp, Homo sapiens
acctgctgtgcaccttacattcc

SEQ ID NO: 2002365 - DNA, 18 bp, Homo sapiens
acctggaagcatttgttt

SEQ ID NO: 2002366 - DNA, 23 bp, Homo sapiens
acctggaagcatttgtttctact

SEQ ID NO: 2002367 - DNA, 20 bp, Homo sapiens
acctggaatcagattattaa

SEQ ID NO: 2002368 - DNA, 23 bp, Homo sapiens
acctggagaactagaacctggag

SEQ ID NO: 2002369 - DNA, 13 bp, Homo sapiens
acctggagatgat

SEQ ID NO: 2002370 - DNA, 17 bp, Homo sapiens
acctggagatgatgatg

SEQ ID NO: 2002371 - DNA, 21 bp, Homo sapiens
acctggagggctagaacctag

SEQ ID NO: 2002372 - DNA, 15 bp, Homo sapiens
acctggagggctgga

SEQ ID NO: 2002373 - DNA, 22 bp, Homo sapiens
acctggcaagctagaacctgga

SEQ ID NO: 2002374 - DNA, 23 bp, Homo sapiens
acctggcaagctagaacctggag

SEQ ID NO: 2002375 - DNA, 17 bp, Homo sapiens
acctgggaaaacagagg

SEQ ID NO: 2002376 - DNA, 19 bp, Homo sapiens
acctgggaaaacagaggaa

SEQ ID NO: 2002377 - DNA, 19 bp, Homo sapiens
acctgggatatgacaagca

SEQ ID NO: 2002378 - DNA, 20 bp, Homo sapiens
acctgggccaaaagggcagc

SEQ ID NO: 2002379 - DNA, 22 bp, Homo sapiens
acctgggccaaaagggcagcca

SEQ ID NO: 2002380 - DNA, 13 bp, Homo sapiens
acctgggccctgg

SEQ ID NO: 2002381 - DNA, 15 bp, Homo sapiens
acctgggccctgggg

SEQ ID NO: 2002382 - DNA, 16 bp, Homo sapiens
acctgggccctggggc

SEQ ID NO: 2002383 - DNA, 20 bp, Homo sapiens
acctgggccctggggcctgt

SEQ ID NO: 2002384 - DNA, 16 bp, Homo sapiens
acctgtaatcccagca

SEQ ID NO: 2002385 - DNA, 12 bp, Homo sapiens
acctgtactcag

SEQ ID NO: 2002386 - DNA, 21 bp, Homo sapiens
acctgtagaacacccctgtgc

SEQ ID NO: 2002387 - DNA, 16 bp, Homo sapiens
acctgtagtgagaaac

SEQ ID NO: 2002388 - DNA, 17 bp, Homo sapiens
acctgtatgtctccagt

SEQ ID NO: 2002389 - DNA, 19 bp, Homo sapiens
acctgtcaccgtgagcagc

SEQ ID NO: 2002390 - DNA, 15 bp, Homo sapiens
acctgtccataaagt

SEQ ID NO: 2002391 - DNA, 16 bp, Homo sapiens
acctgtccataaagta

SEQ ID NO: 2002392 - DNA, 17 bp, Homo sapiens
acctgtctcctttctca

SEQ ID NO: 2002393 - DNA, 14 bp, Homo sapiens
acctgtgcacccca

SEQ ID NO: 2002394 - DNA, 18 bp, Homo sapiens
acctgtgcaccccatgag

SEQ ID NO: 2002395 - DNA, 14 bp, Homo sapiens
acctgtggggcccc

SEQ ID NO: 2002396 - DNA, 18 bp, Homo sapiens
acctgtgtattttttaaa

SEQ ID NO: 2002397 - DNA, 19 bp, Homo sapiens
acctgtgtttcttgcctca

SEQ ID NO: 2002398 - DNA, 21 bp, Homo sapiens
acctgtgtttcttgcctcatt

SEQ ID NO: 2002399 - DNA, 19 bp, Homo sapiens
acctgttaaaatgtacact

SEQ ID NO: 2002400 - DNA, 15 bp, Homo sapiens
acctgttcaggagct

SEQ ID NO: 2002401 - DNA, 20 bp, Homo sapiens
acctgttggttagctggaca

SEQ ID NO: 2002402 - DNA, 13 bp, Homo sapiens
acctgtttatata

SEQ ID NO: 2002403 - DNA, 16 bp, Homo sapiens
acctgtttttaagctg

SEQ ID NO: 2002404 - DNA, 18 bp, Homo sapiens
acctgtttttaagctgtt

SEQ ID NO: 2002405 - DNA, 19 bp, Homo sapiens
acctgtttttaagctgttt

SEQ ID NO: 2002406 - DNA, 18 bp, Homo sapiens
accttaatattattgggg

SEQ ID NO: 2002407 - DNA, 13 bp, Homo sapiens
accttacattcct

SEQ ID NO: 2002408 - DNA, 15 bp, Homo sapiens
accttacattcctag

SEQ ID NO: 2002409 - DNA, 23 bp, Homo sapiens
accttacattcctagagagcaga

SEQ ID NO: 2002410 - DNA, 20 bp, Homo sapiens
accttacttaaagcttgttt

SEQ ID NO: 2002411 - DNA, 22 bp, Homo sapiens
accttagaaatcattgtagaaa

SEQ ID NO: 2002412 - DNA, 17 bp, Homo sapiens
accttagattagctctg

SEQ ID NO: 2002413 - DNA, 18 bp, Homo sapiens
accttagattagctctgg

SEQ ID NO: 2002414 - DNA, 14 bp, Homo sapiens
accttagtggcttt

SEQ ID NO: 2002415 - DNA, 17 bp, Homo sapiens
accttatgtattatttt

SEQ ID NO: 2002416 - DNA, 17 bp, Homo sapiens
accttattgtacctctc

SEQ ID NO: 2002417 - DNA, 22 bp, Homo sapiens
accttattgtacctctcttata

SEQ ID NO: 2002418 - DNA, 12 bp, Homo sapiens
accttcaataaa

SEQ ID NO: 2002419 - DNA, 15 bp, Homo sapiens
accttcaataaagta

SEQ ID NO: 2002420 - DNA, 23 bp, Homo sapiens
accttcaataaagtatctacatg

SEQ ID NO: 2002421 - DNA, 18 bp, Homo sapiens
accttcaattcctgggcc

SEQ ID NO: 2002422 - DNA, 14 bp, Homo sapiens
accttcagcagtta

SEQ ID NO: 2002423 - DNA, 20 bp, Homo sapiens
accttcattttacattctgt

SEQ ID NO: 2002424 - DNA, 11 bp, Homo sapiens
accttcccagc

SEQ ID NO: 2002425 - DNA, 18 bp, Homo sapiens
accttccttctaaacatt

SEQ ID NO: 2002426 - DNA, 17 bp, Homo sapiens
accttctccccattctg

SEQ ID NO: 2002427 - DNA, 20 bp, Homo sapiens
accttctctacccatctccc

SEQ ID NO: 2002428 - DNA, 12 bp, Homo sapiens
accttctgaaga

SEQ ID NO: 2002429 - DNA, 19 bp, Homo sapiens
accttctggttgcttcaga

SEQ ID NO: 2002430 - DNA, 13 bp, Homo sapiens
accttctgtggct

SEQ ID NO: 2002431 - DNA, 16 bp, Homo sapiens
accttctgtggctcac

SEQ ID NO: 2002432 - DNA, 20 bp, Homo sapiens
accttgaactgggtacttgt

SEQ ID NO: 2002433 - DNA, 15 bp, Homo sapiens
accttgacagggcac

SEQ ID NO: 2002434 - DNA, 10 bp, Homo sapiens
accttgcagc

SEQ ID NO: 2002435 - DNA, 19 bp, Homo sapiens
accttgccaagctttcttc

SEQ ID NO: 2002436 - DNA, 20 bp, Homo sapiens
accttgccaagctttcttct

SEQ ID NO: 2002437 - DNA, 18 bp, Homo sapiens
accttgcgaccatgtgta

SEQ ID NO: 2002438 - DNA, 13 bp, Homo sapiens
accttggactcct

SEQ ID NO: 2002439 - DNA, 14 bp, Homo sapiens
accttggctcaagt

SEQ ID NO: 2002440 - DNA, 17 bp, Homo sapiens
accttggctgcagggag

SEQ ID NO: 2002441 - DNA, 18 bp, Homo sapiens
accttggctgcagggagt

SEQ ID NO: 2002442 - DNA, 17 bp, Homo sapiens
accttgggacctgttta

SEQ ID NO: 2002443 - DNA, 18 bp, Homo sapiens
accttgggtttgtatttt

SEQ ID NO: 2002444 - DNA, 16 bp, Homo sapiens
accttggtaaattgta

SEQ ID NO: 2002445 - DNA, 20 bp, Homo sapiens
accttgtcatgtaccatcaa

SEQ ID NO: 2002446 - DNA, 21 bp, Homo sapiens
accttgtcatgtaccatcaat

SEQ ID NO: 2002447 - DNA, 22 bp, Homo sapiens
accttgttgcatgatgtatttt

SEQ ID NO: 2002448 - DNA, 18 bp, Homo sapiens
acctttaagtcctctctt

SEQ ID NO: 2002449 - DNA, 21 bp, Homo sapiens
acctttattaatgaactgtga

SEQ ID NO: 2002450 - DNA, 17 bp, Homo sapiens
acctttcaaatttcaca

SEQ ID NO: 2002451 - DNA, 23 bp, Homo sapiens
acctttcccatgctgaattattt

SEQ ID NO: 2002452 - DNA, 17 bp, Homo sapiens
acctttccccagacaca

SEQ ID NO: 2002453 - DNA, 19 bp, Homo sapiens
acctttccctcaccccctc

SEQ ID NO: 2002454 - DNA, 19 bp, Homo sapiens
acctttgggatcagcctcc

SEQ ID NO: 2002455 - DNA, 21 bp, Homo sapiens
acctttgggatcagcctccgc

SEQ ID NO: 2002456 - DNA, 15 bp, Homo sapiens
acctttggtgcagag

SEQ ID NO: 2002457 - DNA, 13 bp, Homo sapiens
acctttgtgtaat

SEQ ID NO: 2002458 - DNA, 14 bp, Homo sapiens
acctttgtgtaata

SEQ ID NO: 2002459 - DNA, 16 bp, Homo sapiens
acctttgtgtaataaa

SEQ ID NO: 2002460 - DNA, 22 bp, Homo sapiens
acctttgttttgcactgacaag

SEQ ID NO: 2002461 - DNA, 14 bp, Homo sapiens
accttttctctccc

SEQ ID NO: 2002462 - DNA, 16 bp, Homo sapiens
accttttgtatttaaa

SEQ ID NO: 2002463 - DNA, 15 bp, Homo sapiens
acctttttttctctc

SEQ ID NO: 2002464 - DNA, 14 bp, Homo sapiens
acgttaaaagacag

SEQ ID NO: 2002465 - DNA, 23 bp, Homo sapiens
acgttaacccatttttgagccaa

SEQ ID NO: 2002466 - DNA, 22 bp, Homo sapiens
acgttaagtccaaggagaagaa

SEQ ID NO: 2002467 - DNA, 23 bp, Homo sapiens
acgttaagtccaaggagaagaag

SEQ ID NO: 2002468 - DNA, 19 bp, Homo sapiens
acgttatatattgtattaa

SEQ ID NO: 2002469 - DNA, 14 bp, Homo sapiens
acgttcctaagctg

SEQ ID NO: 2002470 - DNA, 16 bp, Homo sapiens
acgttccttactgcag

SEQ ID NO: 2002471 - DNA, 18 bp, Homo sapiens
acgttccttactgcagaa

SEQ ID NO: 2002472 - DNA, 20 bp, Homo sapiens
acgttccttactgcagaata

SEQ ID NO: 2002473 - DNA, 14 bp, Homo sapiens
acgttcggggcatg

SEQ ID NO: 2002474 - DNA, 16 bp, Homo sapiens
acgttctccagcccac

SEQ ID NO: 2002475 - DNA, 19 bp, Homo sapiens
acgttctccagcccacacc

SEQ ID NO: 2002476 - DNA, 19 bp, Homo sapiens
acgttgacccctttccccc

SEQ ID NO: 2002477 - DNA, 22 bp, Homo sapiens
acgttgacccctttcccccacc

SEQ ID NO: 2002478 - DNA, 13 bp, Homo sapiens
acgttgctcccca

SEQ ID NO: 2002479 - DNA, 15 bp, Homo sapiens
acgtttcctgagaag

SEQ ID NO: 2002480 - DNA, 20 bp, Homo sapiens
actaaaaagtggctaattca

SEQ ID NO: 2002481 - DNA, 12 bp, Homo sapiens
actaaaaataca

SEQ ID NO: 2002482 - DNA, 11 bp, Homo sapiens
actaaaagaat

SEQ ID NO: 2002483 - DNA, 15 bp, Homo sapiens
actatgactgctccc

SEQ ID NO: 2002484 - DNA, 15 bp, Homo sapiens
actatgatctcagga

SEQ ID NO: 2002485 - DNA, 16 bp, Homo sapiens
actatgcacaatttaa

SEQ ID NO: 2002486 - DNA, 15 bp, Homo sapiens
actatgctatttctg

SEQ ID NO: 2002487 - DNA, 22 bp, Homo sapiens
actatgctatttctggcctcag

SEQ ID NO: 2002488 - DNA, 23 bp, Homo sapiens
actatgctatttctggcctcagc

SEQ ID NO: 2002489 - DNA, 16 bp, Homo sapiens
actatggctgtatttt

SEQ ID NO: 2002490 - DNA, 17 bp, Homo sapiens
actatggctgtattttt

SEQ ID NO: 2002491 - DNA, 14 bp, Homo sapiens
actatgtgatgtta

SEQ ID NO: 2002492 - DNA, 22 bp, Homo sapiens
actatgtgggacacctcaaata

SEQ ID NO: 2002493 - DNA, 16 bp, Homo sapiens
actatgtgtcatgatt

SEQ ID NO: 2002494 - DNA, 18 bp, Homo sapiens
actatgtgtcatgatttc

SEQ ID NO: 2002495 - DNA, 16 bp, Homo sapiens
actattaaagtgccat

SEQ ID NO: 2002496 - DNA, 17 bp, Homo sapiens
actattaagagcaataa

SEQ ID NO: 2002497 - DNA, 13 bp, Homo sapiens
actattcaaacag

SEQ ID NO: 2002498 - DNA, 14 bp, Homo sapiens
actattcaaacagt

SEQ ID NO: 2002499 - DNA, 21 bp, Homo sapiens
actattcaaacagtctcagga

SEQ ID NO: 2002500 - DNA, 14 bp, Homo sapiens
actattcctaggag

SEQ ID NO: 2002501 - DNA, 14 bp, Homo sapiens
actattgtttaaaa

SEQ ID NO: 2002502 - DNA, 19 bp, Homo sapiens
actattgtttaaaaacagg

SEQ ID NO: 2002503 - DNA, 20 bp, Homo sapiens
actattgtttaaaaacagga

SEQ ID NO: 2002504 - DNA, 14 bp, Homo sapiens
actatttaacttga

SEQ ID NO: 2002505 - DNA, 18 bp, Homo sapiens
actatttaacttgagggt

SEQ ID NO: 2002506 - DNA, 22 bp, Homo sapiens
actatttcccttgaaattttaa

SEQ ID NO: 2002507 - DNA, 13 bp, Homo sapiens
actattttacttc

SEQ ID NO: 2002508 - DNA, 16 bp, Homo sapiens
actattttttaataaa

SEQ ID NO: 2002509 - DNA, 15 bp, Homo sapiens
actcaaaaaggtgtg

SEQ ID NO: 2002510 - DNA, 19 bp, Homo sapiens
actcaaaatatttgtacat

SEQ ID NO: 2002511 - DNA, 14 bp, Homo sapiens
actcaaatcaagaa

SEQ ID NO: 2002512 - DNA, 13 bp, Homo sapiens
aaagaactgcccc

SEQ ID NO: 2002513 - DNA, 12 bp, Homo sapiens
aaagaagagaca

SEQ ID NO: 2002514 - DNA, 23 bp, Homo sapiens
aaagaaggctgcctaaggaggag

SEQ ID NO: 2002515 - DNA, 15 bp, Homo sapiens
aaagaagtaaatttg

SEQ ID NO: 2002516 - DNA, 16 bp, Homo sapiens
aaagaagtaaatttgt

SEQ ID NO: 2002517 - DNA, 14 bp, Homo sapiens
aaagaatacatttt

SEQ ID NO: 2002518 - DNA, 22 bp, Homo sapiens
aaagaatattcagagaatatca

SEQ ID NO: 2002519 - DNA, 19 bp, Homo sapiens
aaagaatccctgcagcctg

SEQ ID NO: 2002520 - DNA, 21 bp, Homo sapiens
aaagaattcctgaagccagat

SEQ ID NO: 2002521 - DNA, 20 bp, Homo sapiens
aaagacagtggatcatgaaa

SEQ ID NO: 2002522 - DNA, 22 bp, Homo sapiens
aaagacagtggatcatgaaaag

SEQ ID NO: 2002523 - DNA, 13 bp, Homo sapiens
aaagaccagggct

SEQ ID NO: 2002524 - DNA, 14 bp, Homo sapiens
aaagactaatttaa

SEQ ID NO: 2002525 - DNA, 14 bp, Homo sapiens
aaagactattcaaa

SEQ ID NO: 2002526 - DNA, 15 bp, Homo sapiens
aaagactattcaaac

SEQ ID NO: 2002527 - DNA, 18 bp, Homo sapiens
aaagactattcaaacagt

SEQ ID NO: 2002528 - DNA, 15 bp, Homo sapiens
aaagactcagtgttc

SEQ ID NO: 2002529 - DNA, 15 bp, Homo sapiens
aaagactccaaagaa

SEQ ID NO: 2002530 - DNA, 13 bp, Homo sapiens
aaagactgcagct

SEQ ID NO: 2002531 - DNA, 13 bp, Homo sapiens
aaagacttaagat

SEQ ID NO: 2002532 - DNA, 20 bp, Homo sapiens
aaagacttagtatattttct

SEQ ID NO: 2002533 - DNA, 15 bp, Homo sapiens
aaagacttcatgttc

SEQ ID NO: 2002534 - DNA, 15 bp, Homo sapiens
aaagagaaaaaccaa

SEQ ID NO: 2002535 - DNA, 14 bp, Homo sapiens
aaagagaccagcac

SEQ ID NO: 2002536 - DNA, 22 bp, Homo sapiens
aaagagagaaaacttatttgag

SEQ ID NO: 2002537 - DNA, 15 bp, Homo sapiens
aaagagcaagtctgg

SEQ ID NO: 2002538 - DNA, 18 bp, Homo sapiens
aaagaggcgtcttgtatt

SEQ ID NO: 2002539 - DNA, 19 bp, Homo sapiens
aaagaggtgaccccagggc

SEQ ID NO: 2002540 - DNA, 20 bp, Homo sapiens
aaagaggtgaccccagggca

SEQ ID NO: 2002541 - DNA, 20 bp, Homo sapiens
aaagagtggagcaaatgctt

SEQ ID NO: 2002542 - DNA, 16 bp, Homo sapiens
aaagagttattcaaat

SEQ ID NO: 2002543 - DNA, 19 bp, Homo sapiens
aaagagttattcaaatgaa

SEQ ID NO: 2002544 - DNA, 20 bp, Homo sapiens
aaagagttcaagaaataagt

SEQ ID NO: 2002545 - DNA, 20 bp, Homo sapiens
aaagatatctcatctcttct

SEQ ID NO: 2002546 - DNA, 21 bp, Homo sapiens
aaagatccaccctcaaatgtc

SEQ ID NO: 2002547 - DNA, 13 bp, Homo sapiens
aaagatgaaaata

SEQ ID NO: 2002548 - DNA, 23 bp, Homo sapiens
aaagatggctgtgcctctgcctg

SEQ ID NO: 2002549 - DNA, 10 bp, Homo sapiens
aaagatgtgt

SEQ ID NO: 2002550 - DNA, 11 bp, Homo sapiens
aaagatgtgtt

SEQ ID NO: 2002551 - DNA, 21 bp, Homo sapiens
aaagatgtttgtcagatatga

SEQ ID NO: 2002552 - DNA, 15 bp, Homo sapiens
aaagattatatatca

SEQ ID NO: 2002553 - DNA, 22 bp, Homo sapiens
aaagattatatatcataaagta

SEQ ID NO: 2002554 - DNA, 14 bp, Homo sapiens
aaagattcactaaa

SEQ ID NO: 2002555 - DNA, 13 bp, Homo sapiens
aaagattttttaa

SEQ ID NO: 2002556 - DNA, 19 bp, Homo sapiens
aaagattttttaataattt

SEQ ID NO: 2002557 - DNA, 16 bp, Homo sapiens
aaagcaaaaaagaaaa

SEQ ID NO: 2002558 - DNA, 13 bp, Homo sapiens
aaagcaaatgaga

SEQ ID NO: 2002559 - DNA, 22 bp, Homo sapiens
aaagcaagcattcagaagaaaa

SEQ ID NO: 2002560 - DNA, 12 bp, Homo sapiens
aaagcaataaaa

SEQ ID NO: 2002561 - DNA, 15 bp, Homo sapiens
aaagcaattatattg

SEQ ID NO: 2002562 - DNA, 15 bp, Homo sapiens
aaagcacaggagaca

SEQ ID NO: 2002563 - DNA, 21 bp, Homo sapiens
aaagcacagtgttaaatgaaa

SEQ ID NO: 2002564 - DNA, 14 bp, Homo sapiens
aaagcaccaaattc

SEQ ID NO: 2002565 - DNA, 22 bp, Homo sapiens
aaagcaccgcagcatgtgggga

SEQ ID NO: 2002566 - DNA, 17 bp, Homo sapiens
aaagcactgacttctaa

SEQ ID NO: 2002567 - DNA, 22 bp, Homo sapiens
aaagcagcacatggtgttgtat

SEQ ID NO: 2002568 - DNA, 20 bp, Homo sapiens
aaagcagcagctaggactga

SEQ ID NO: 2002569 - DNA, 21 bp, Homo sapiens
aaagcagcagctaggactgag

SEQ ID NO: 2002570 - DNA, 17 bp, Homo sapiens
aaagcaggtggcatctc

SEQ ID NO: 2002571 - DNA, 21 bp, Homo sapiens
aaagcagtcctcttattccta

SEQ ID NO: 2002572 - DNA, 10 bp, Homo sapiens
aaagcagtgt

SEQ ID NO: 2002573 - DNA, 16 bp, Homo sapiens
aaagcagttaaactga

SEQ ID NO: 2002574 - DNA, 18 bp, Homo sapiens
aaagcatcacctcaggcc

SEQ ID NO: 2002575 - DNA, 14 bp, Homo sapiens
aaagcatgaatggt

SEQ ID NO: 2002576 - DNA, 19 bp, Homo sapiens
aaagcattgtaaatgtgct

SEQ ID NO: 2002577 - DNA, 17 bp, Homo sapiens
aaagcatttactttgaa

SEQ ID NO: 2002578 - DNA, 17 bp, Homo sapiens
aaagccaaatttatatg

SEQ ID NO: 2002579 - DNA, 23 bp, Homo sapiens
aaagccaacagtcaaaacagaga

SEQ ID NO: 2002580 - DNA, 19 bp, Homo sapiens
aaagccacaaccacataca

SEQ ID NO: 2002581 - DNA, 18 bp, Homo sapiens
aaagccacgttccttact

SEQ ID NO: 2002582 - DNA, 21 bp, Homo sapiens
aaagcccagctctttgttcag

SEQ ID NO: 2002583 - DNA, 17 bp, Homo sapiens
aaagccctcccccttcc

SEQ ID NO: 2002584 - DNA, 16 bp, Homo sapiens
aaagcctctgctgcca

SEQ ID NO: 2002585 - DNA, 17 bp, Homo sapiens
aaagcctgttcatggca

SEQ ID NO: 2002586 - DNA, 15 bp, Homo sapiens
aaagcggttgcttct

SEQ ID NO: 2002587 - DNA, 21 bp, Homo sapiens
aaagcggttgcttctggctcc

SEQ ID NO: 2002588 - DNA, 14 bp, Homo sapiens
aaagctactgaatt

SEQ ID NO: 2002589 - DNA, 13 bp, Homo sapiens
aaagctagaattg

SEQ ID NO: 2002590 - DNA, 18 bp, Homo sapiens
aaagctaggcctggccag

SEQ ID NO: 2002591 - DNA, 13 bp, Homo sapiens
aaagctcatattt

SEQ ID NO: 2002592 - DNA, 21 bp, Homo sapiens
aaagctcatattttgtatata

SEQ ID NO: 2002593 - DNA, 13 bp, Homo sapiens
aaagctcctgtcc

SEQ ID NO: 2002594 - DNA, 18 bp, Homo sapiens
aaagctctgaacaaaagc

SEQ ID NO: 2002595 - DNA, 15 bp, Homo sapiens
aaagctgaagaaaat

SEQ ID NO: 2002596 - DNA, 15 bp, Homo sapiens
aaagctgcctgtagt

SEQ ID NO: 2002597 - DNA, 17 bp, Homo sapiens
aaagctgcctgtagtta

SEQ ID NO: 2002598 - DNA, 19 bp, Homo sapiens
aaagctggacaagaagctg

SEQ ID NO: 2002599 - DNA, 15 bp, Homo sapiens
aaagctggtttaatg

SEQ ID NO: 2002600 - DNA, 16 bp, Homo sapiens
aaagctggtttaatgt

SEQ ID NO: 2002601 - DNA, 18 bp, Homo sapiens
aaagctgtgtgtttggaa

SEQ ID NO: 2002602 - DNA, 15 bp, Homo sapiens
aaagcttaaatgcct

SEQ ID NO: 2002603 - DNA, 21 bp, Homo sapiens
aaagcttctatcccaggaggt

SEQ ID NO: 2002604 - DNA, 19 bp, Homo sapiens
aaagcttgcaacaaaattc

SEQ ID NO: 2002605 - DNA, 12 bp, Homo sapiens
aaaggaaggaaa

SEQ ID NO: 2002606 - DNA, 14 bp, Homo sapiens
aaaggacattatgt

SEQ ID NO: 2002607 - DNA, 15 bp, Homo sapiens
aaaggagaaaggagc

SEQ ID NO: 2002608 - DNA, 12 bp, Homo sapiens
aaaggagagaag

SEQ ID NO: 2002609 - DNA, 19 bp, Homo sapiens
aaaggagagaagagagaaa

SEQ ID NO: 2002610 - DNA, 22 bp, Homo sapiens
aaaggagccggaccaagatggg

SEQ ID NO: 2002611 - DNA, 20 bp, Homo sapiens
aaaggatgaaagtctgagaa

SEQ ID NO: 2002612 - DNA, 18 bp, Homo sapiens
aaaggatgttttgtccca

SEQ ID NO: 2002613 - DNA, 13 bp, Homo sapiens
aaaggattaagat

SEQ ID NO: 2002614 - DNA, 14 bp, Homo sapiens
aaaggcctctgtcc

SEQ ID NO: 2002615 - DNA, 19 bp, Homo sapiens
aaaggctaggtacacagct

SEQ ID NO: 2002616 - DNA, 21 bp, Homo sapiens
aaaggctcagtctcaggagca

SEQ ID NO: 2002617 - DNA, 18 bp, Homo sapiens
aaagggaagttgtgcctt

SEQ ID NO: 2002618 - DNA, 21 bp, Homo sapiens
aaagggacccgaagcccaggc

SEQ ID NO: 2002619 - DNA, 17 bp, Homo sapiens
aaagggagggctctgag

SEQ ID NO: 2002620 - DNA, 18 bp, Homo sapiens
aaagggagggctctgagg

SEQ ID NO: 2002621 - DNA, 19 bp, Homo sapiens
aaagggagggctctgaggc

SEQ ID NO: 2002622 - DNA, 12 bp, Homo sapiens
aaagggcagcca

SEQ ID NO: 2002623 - DNA, 14 bp, Homo sapiens
aaagggcagccagg

SEQ ID NO: 2002624 - DNA, 15 bp, Homo sapiens
aaagggcagtaaagt

SEQ ID NO: 2002625 - DNA, 15 bp, Homo sapiens
aaatagcttctgttt

SEQ ID NO: 2002626 - DNA, 15 bp, Homo sapiens
aaatagcttgtatag

SEQ ID NO: 2002627 - DNA, 21 bp, Homo sapiens
aaatagtaggaccaatgttgt

SEQ ID NO: 2002628 - DNA, 21 bp, Homo sapiens
aaatagtgttctttttaaaaa

SEQ ID NO: 2002629 - DNA, 16 bp, Homo sapiens
aaatagttgtccatat

SEQ ID NO: 2002630 - DNA, 14 bp, Homo sapiens
aaatagtttggata

SEQ ID NO: 2002631 - DNA, 20 bp, Homo sapiens
aaatagtttggatatgtaaa

SEQ ID NO: 2002632 - DNA, 18 bp, Homo sapiens
aaatagttttaaatatga

SEQ ID NO: 2002633 - DNA, 21 bp, Homo sapiens
aaatagttttaaatatgaaca

SEQ ID NO: 2002634 - DNA, 22 bp, Homo sapiens
aaatagttttaaatatgaacaa

SEQ ID NO: 2002635 - DNA, 11 bp, Homo sapiens
aaatataaaac

SEQ ID NO: 2002636 - DNA, 12 bp, Homo sapiens
aaatataaatgc

SEQ ID NO: 2002637 - DNA, 16 bp, Homo sapiens
aaatataaatgtttaa

SEQ ID NO: 2002638 - DNA, 12 bp, Homo sapiens
aaatataaatta

SEQ ID NO: 2002639 - DNA, 14 bp, Homo sapiens
aaatataaattaag

SEQ ID NO: 2002640 - DNA, 18 bp, Homo sapiens
aaatataaattaagactt

SEQ ID NO: 2002641 - DNA, 17 bp, Homo sapiens
aaatataaccattacat

SEQ ID NO: 2002642 - DNA, 14 bp, Homo sapiens
aaatatacaaacat

SEQ ID NO: 2002643 - DNA, 15 bp, Homo sapiens
aaatatatatacata

SEQ ID NO: 2002644 - DNA, 18 bp, Homo sapiens
aaatatatatacatatgt

SEQ ID NO: 2002645 - DNA, 17 bp, Homo sapiens
aaatatatatatatatt

SEQ ID NO: 2002646 - DNA, 20 bp, Homo sapiens
aaatatatatatatatttaa

SEQ ID NO: 2002647 - DNA, 18 bp, Homo sapiens
aaatatatatttttcaac

SEQ ID NO: 2002648 - DNA, 20 bp, Homo sapiens
aaatatatatttttcaacca

SEQ ID NO: 2002649 - DNA, 21 bp, Homo sapiens
aaatatatttaagataattat

SEQ ID NO: 2002650 - DNA, 22 bp, Homo sapiens
aaatatatttaagataattata

SEQ ID NO: 2002651 - DNA, 20 bp, Homo sapiens
aaatatatttaatacctttg

SEQ ID NO: 2002652 - DNA, 17 bp, Homo sapiens
aaatatattttatgatt

SEQ ID NO: 2002653 - DNA, 21 bp, Homo sapiens
aaatatcaccccttgaagcct

SEQ ID NO: 2002654 - DNA, 18 bp, Homo sapiens
aaatatcagttactcagc

SEQ ID NO: 2002655 - DNA, 14 bp, Homo sapiens
aaatatcctcaggg

SEQ ID NO: 2002656 - DNA, 20 bp, Homo sapiens
aaatatctacctgccctctc

SEQ ID NO: 2002657 - DNA, 12 bp, Homo sapiens
aaatatgaacaa

SEQ ID NO: 2002658 - DNA, 19 bp, Homo sapiens
aaatatgatattgcatatg

SEQ ID NO: 2002659 - DNA, 22 bp, Homo sapiens
aaatgtatatacacatatacct

SEQ ID NO: 2002660 - DNA, 23 bp, Homo sapiens
aaatgtatatacacatataccta

SEQ ID NO: 2002661 - DNA, 20 bp, Homo sapiens
aaatgtatcatagaaatgta

SEQ ID NO: 2002662 - DNA, 20 bp, Homo sapiens
aaatgtatcctgataaacat

SEQ ID NO: 2002663 - DNA, 21 bp, Homo sapiens
aaatgtatcctgataaacatt

SEQ ID NO: 2002664 - DNA, 14 bp, Homo sapiens
aaatgtatcttatt

SEQ ID NO: 2002665 - DNA, 18 bp, Homo sapiens
aaatgtatgattacatca

SEQ ID NO: 2002666 - DNA, 17 bp, Homo sapiens
aaatgtcacacttgttt

SEQ ID NO: 2002667 - DNA, 14 bp, Homo sapiens
aaatgtcagagcta

SEQ ID NO: 2002668 - DNA, 12 bp, Homo sapiens
aaatgtcattat

SEQ ID NO: 2002669 - DNA, 18 bp, Homo sapiens
aaatgtctatagagaaaa

SEQ ID NO: 2002670 - DNA, 13 bp, Homo sapiens
aaatgtctgtttc

SEQ ID NO: 2002671 - DNA, 14 bp, Homo sapiens
aaatgtctttctat

SEQ ID NO: 2002672 - DNA, 22 bp, Homo sapiens
aaatgtctttctattcataata

SEQ ID NO: 2002673 - DNA, 17 bp, Homo sapiens
aaatgtgaagggtgggg

SEQ ID NO: 2002674 - DNA, 15 bp, Homo sapiens
aaatgtgatcaactg

SEQ ID NO: 2002675 - DNA, 18 bp, Homo sapiens
aaatgtgccttcattttt

SEQ ID NO: 2002676 - DNA, 21 bp, Homo sapiens
aaatgtgctaaagttggaaag

SEQ ID NO: 2002677 - DNA, 15 bp, Homo sapiens
aaatgtgtcagcatg

SEQ ID NO: 2002678 - DNA, 20 bp, Homo sapiens
aaatgttattttttaattat

SEQ ID NO: 2002679 - DNA, 21 bp, Homo sapiens
aaatgttattttttaattatt

SEQ ID NO: 2002680 - DNA, 21 bp, Homo sapiens
aaatgttcagaaggttgctct

SEQ ID NO: 2002681 - DNA, 20 bp, Homo sapiens
aaatgttcccttgaccattg

SEQ ID NO: 2002682 - DNA, 20 bp, Homo sapiens
aaatgttctatatgcattta

SEQ ID NO: 2002683 - DNA, 23 bp, Homo sapiens
aaatgttgaaatatgatgttaaa

SEQ ID NO: 2002684 - DNA, 14 bp, Homo sapiens
aaatgttgaaatct

SEQ ID NO: 2002685 - DNA, 22 bp, Homo sapiens
aaatgttgttctcttctttaaa

SEQ ID NO: 2002686 - DNA, 16 bp, Homo sapiens
aaatgtttcattttca

SEQ ID NO: 2002687 - DNA, 17 bp, Homo sapiens
aaatgtttcattttcat

SEQ ID NO: 2002688 - DNA, 12 bp, Homo sapiens
aaattaaagccc

SEQ ID NO: 2002689 - DNA, 17 bp, Homo sapiens
aaattaacagtcctaac

SEQ ID NO: 2002690 - DNA, 12 bp, Homo sapiens
aaattaagacat

SEQ ID NO: 2002691 - DNA, 13 bp, Homo sapiens
aaattaagacttt

SEQ ID NO: 2002692 - DNA, 14 bp, Homo sapiens
aaattaaggtctgg

SEQ ID NO: 2002693 - DNA, 19 bp, Homo sapiens
aaattaccagagttgttct

SEQ ID NO: 2002694 - DNA, 15 bp, Homo sapiens
aaattactacaaaat

SEQ ID NO: 2002695 - DNA, 20 bp, Homo sapiens
aaattagaaacaccattcat

SEQ ID NO: 2002696 - DNA, 17 bp, Homo sapiens
aaattaggttttgtaca

SEQ ID NO: 2002697 - DNA, 17 bp, Homo sapiens
aaattagtgaagttctt

SEQ ID NO: 2002698 - DNA, 13 bp, Homo sapiens
aaattagtgagat

SEQ ID NO: 2002699 - DNA, 18 bp, Homo sapiens
aaattataagaagaggaa

SEQ ID NO: 2002700 - DNA, 14 bp, Homo sapiens
aaattatggtgaaa

SEQ ID NO: 2002701 - DNA, 21 bp, Homo sapiens
aaattatttgtgtaatagaaa

SEQ ID NO: 2002702 - DNA, 21 bp, Homo sapiens
aaattattttaatattttgta

SEQ ID NO: 2002703 - DNA, 14 bp, Homo sapiens
aaattatttttatt

SEQ ID NO: 2002704 - DNA, 22 bp, Homo sapiens
aaattcaaaccatttaattcat

SEQ ID NO: 2002705 - DNA, 23 bp, Homo sapiens
aaattcaaaccatttaattcata

SEQ ID NO: 2002706 - DNA, 17 bp, Homo sapiens
aaattcatttcacatta

SEQ ID NO: 2002707 - DNA, 13 bp, Homo sapiens
aaattcatttttt

SEQ ID NO: 2002708 - DNA, 14 bp, Homo sapiens
aaattcctgttgtc

SEQ ID NO: 2002709 - DNA, 23 bp, Homo sapiens
aaattccttagcttagacctcag

SEQ ID NO: 2002710 - DNA, 17 bp, Homo sapiens
aaattctggaaatgtct

SEQ ID NO: 2002711 - DNA, 16 bp, Homo sapiens
aaattctttttcaaaa

SEQ ID NO: 2002712 - DNA, 23 bp, Homo sapiens
aaattgaagagatttcaacatat

SEQ ID NO: 2002713 - DNA, 11 bp, Homo sapiens
aaattgcacaa

SEQ ID NO: 2002714 - DNA, 16 bp, Homo sapiens
aaattgcacaatttga

SEQ ID NO: 2002715 - DNA, 18 bp, Homo sapiens
aaattgcatttcctgaca

SEQ ID NO: 2002716 - DNA, 22 bp, Homo sapiens
aaattgcctccttatttatcaa

SEQ ID NO: 2002717 - DNA, 15 bp, Homo sapiens
aaattgctattttat

SEQ ID NO: 2002718 - DNA, 20 bp, Homo sapiens
aaattgctattttatttgta

SEQ ID NO: 2002719 - DNA, 22 bp, Homo sapiens
aaattgctcctaagcttcaaat

SEQ ID NO: 2002720 - DNA, 13 bp, Homo sapiens
aaattgcttctag

SEQ ID NO: 2002721 - DNA, 18 bp, Homo sapiens
aaattgcttttgttgtga

SEQ ID NO: 2002722 - DNA, 20 bp, Homo sapiens
aaattggtaattgaatggaa

SEQ ID NO: 2002723 - DNA, 20 bp, Homo sapiens
aaattggtatcaagaaagtc

SEQ ID NO: 2002724 - DNA, 15 bp, Homo sapiens
aaattggtgataagt

SEQ ID NO: 2002725 - DNA, 18 bp, Homo sapiens
aaattgtcttttgtcatg

SEQ ID NO: 2002726 - DNA, 17 bp, Homo sapiens
aaattgtgatgttttgt

SEQ ID NO: 2002727 - DNA, 13 bp, Homo sapiens
aaattgttcctga

SEQ ID NO: 2002728 - DNA, 22 bp, Homo sapiens
aaattgtttaagtgttgtaaat

SEQ ID NO: 2002729 - DNA, 22 bp, Homo sapiens
aacaactccctgaacctcagtt

SEQ ID NO: 2002730 - DNA, 13 bp, Homo sapiens
aacaagaaagaaa

SEQ ID NO: 2002731 - DNA, 14 bp, Homo sapiens
aacaagaaagaaac

SEQ ID NO: 2002732 - DNA, 21 bp, Homo sapiens
aacaagaagccacagacctag

SEQ ID NO: 2002733 - DNA, 12 bp, Homo sapiens
aacaagaattgg

SEQ ID NO: 2002734 - DNA, 19 bp, Homo sapiens
aacaagcaaggatatcaga

SEQ ID NO: 2002735 - DNA, 22 bp, Homo sapiens
aacaaggaccctgttttccaca

SEQ ID NO: 2002736 - DNA, 20 bp, Homo sapiens
aacaaggcttaaaagagtag

SEQ ID NO: 2002737 - DNA, 16 bp, Homo sapiens
aacaaggtagttttta

SEQ ID NO: 2002738 - DNA, 12 bp, Homo sapiens
aacaaggtgtct

SEQ ID NO: 2002739 - DNA, 17 bp, Homo sapiens
aacaagtcacagctgca

SEQ ID NO: 2002740 - DNA, 21 bp, Homo sapiens
aacaagtcacagctgcagctg

SEQ ID NO: 2002741 - DNA, 17 bp, Homo sapiens
aacaataaaacattatg

SEQ ID NO: 2002742 - DNA, 15 bp, Homo sapiens
aacaataaagactga

SEQ ID NO: 2002743 - DNA, 14 bp, Homo sapiens
aacaataaagagct

SEQ ID NO: 2002744 - DNA, 15 bp, Homo sapiens
aacaataaagagctc

SEQ ID NO: 2002745 - DNA, 12 bp, Homo sapiens
aacaataacaac

SEQ ID NO: 2002746 - DNA, 14 bp, Homo sapiens
aacaataacaacaa

SEQ ID NO: 2002747 - DNA, 14 bp, Homo sapiens
aacaatagctattg

SEQ ID NO: 2002748 - DNA, 17 bp, Homo sapiens
aacaatagctattgcat

SEQ ID NO: 2002749 - DNA, 21 bp, Homo sapiens
aacaatagctattgcatgtaa

SEQ ID NO: 2002750 - DNA, 22 bp, Homo sapiens
aacaatagctattgcatgtaaa

SEQ ID NO: 2002751 - DNA, 16 bp, Homo sapiens
aacaatattgtctgaa

SEQ ID NO: 2002752 - DNA, 13 bp, Homo sapiens
aacaatcacactc

SEQ ID NO: 2002753 - DNA, 11 bp, Homo sapiens
aacaatgaatg

SEQ ID NO: 2002754 - DNA, 20 bp, Homo sapiens
aacaatgtgggcgtttgtaa

SEQ ID NO: 2002755 - DNA, 23 bp, Homo sapiens
aacaatgtgggcgtttgtaaatt

SEQ ID NO: 2002756 - DNA, 14 bp, Homo sapiens
aacaattattgtac

SEQ ID NO: 2002757 - DNA, 12 bp, Homo sapiens
aacaattctaaa

SEQ ID NO: 2002758 - DNA, 22 bp, Homo sapiens
aacaatttcctttatatttagt

SEQ ID NO: 2002759 - DNA, 15 bp, Homo sapiens
aacacaagctggaag

SEQ ID NO: 2002760 - DNA, 14 bp, Homo sapiens
aacacacaaaggta

SEQ ID NO: 2002761 - DNA, 13 bp, Homo sapiens
aacacactgtaaa

SEQ ID NO: 2002762 - DNA, 15 bp, Homo sapiens
aacacactgtaaata

SEQ ID NO: 2002763 - DNA, 16 bp, Homo sapiens
aacacagctgctgaag

SEQ ID NO: 2002764 - DNA, 22 bp, Homo sapiens
aacacagctgctgaagaggcaa

SEQ ID NO: 2002765 - DNA, 22 bp, Homo sapiens
aacacaggcaaaatccttgctt

SEQ ID NO: 2002766 - DNA, 22 bp, Homo sapiens
aacacagtgcctggcaaggcct

SEQ ID NO: 2002767 - DNA, 12 bp, Homo sapiens
aacacatcagct

SEQ ID NO: 2002768 - DNA, 16 bp, Homo sapiens
aacacatcagcttgcc

SEQ ID NO: 2002769 - DNA, 17 bp, Homo sapiens
aacacatctttcctgtc

SEQ ID NO: 2002770 - DNA, 15 bp, Homo sapiens
aacacattacttgca

SEQ ID NO: 2002771 - DNA, 21 bp, Homo sapiens
aacacattatcgggagcagtg

SEQ ID NO: 2002772 - DNA, 11 bp, Homo sapiens
aacacccactg

SEQ ID NO: 2002773 - DNA, 12 bp, Homo sapiens
aacacccactgg

SEQ ID NO: 2002774 - DNA, 13 bp, Homo sapiens
aacacccactggc

SEQ ID NO: 2002775 - DNA, 20 bp, Homo sapiens
aacacccagtctgttcccca

SEQ ID NO: 2002776 - DNA, 14 bp, Homo sapiens
aacacctcctagca

SEQ ID NO: 2002777 - DNA, 13 bp, Homo sapiens
aacacctgacaca

SEQ ID NO: 2002778 - DNA, 21 bp, Homo sapiens
aacacctttgttttgcactga

SEQ ID NO: 2002779 - DNA, 24 bp, Homo sapiens
aacacgtggaggtgaagtccctgt

SEQ ID NO: 2002780 - DNA, 15 bp, Homo sapiens
aacactaaaaataaa

SEQ ID NO: 2002781 - DNA, 14 bp, Homo sapiens
aacactatatggca

SEQ ID NO: 2002782 - DNA, 21 bp, Homo sapiens
aacactatatggcagtgtctt

SEQ ID NO: 2002783 - DNA, 12 bp, Homo sapiens
aacactcaccat

SEQ ID NO: 2002784 - DNA, 17 bp, Homo sapiens
aacactcagaagcctgg

SEQ ID NO: 2002785 - DNA, 21 bp, Homo sapiens
aacactctctgagatgcccct

SEQ ID NO: 2002786 - DNA, 17 bp, Homo sapiens
aacactgcttgtgtttt

SEQ ID NO: 2002787 - DNA, 16 bp, Homo sapiens
aacactgggggagggg

SEQ ID NO: 2002788 - DNA, 16 bp, Homo sapiens
aacactgtcttgaaga

SEQ ID NO: 2002789 - DNA, 14 bp, Homo sapiens
aacactgtgtattt

SEQ ID NO: 2002790 - DNA, 22 bp, Homo sapiens
aacacttaagggttttagaaaa

SEQ ID NO: 2002791 - DNA, 13 bp, Homo sapiens
aacagaaacaaaa

SEQ ID NO: 2002792 - DNA, 18 bp, Homo sapiens
aacagaacatagacagaa

SEQ ID NO: 2002793 - DNA, 16 bp, Homo sapiens
aacagaaccagagggt

SEQ ID NO: 2002794 - DNA, 13 bp, Homo sapiens
aacagaaggatga

SEQ ID NO: 2002795 - DNA, 16 bp, Homo sapiens
aacagacaacagaagt

SEQ ID NO: 2002796 - DNA, 19 bp, Homo sapiens
aacagacaccatcttttgt

SEQ ID NO: 2002797 - DNA, 15 bp, Homo sapiens
aacagacaggagaaa

SEQ ID NO: 2002798 - DNA, 15 bp, Homo sapiens
aacagagaaggcagg

SEQ ID NO: 2002799 - DNA, 10 bp, Homo sapiens
aacagagact

SEQ ID NO: 2002800 - DNA, 16 bp, Homo sapiens
aacagagactctggaa

SEQ ID NO: 2002801 - DNA, 15 bp, Homo sapiens
aacagagccttcaca

SEQ ID NO: 2002802 - DNA, 16 bp, Homo sapiens
aacagagccttcacaa

SEQ ID NO: 2002803 - DNA, 16 bp, Homo sapiens
aacagagcgggcctct

SEQ ID NO: 2002804 - DNA, 20 bp, Homo sapiens
aacagaggcaggagtggcag

SEQ ID NO: 2002805 - DNA, 17 bp, Homo sapiens
aacagaggccatggcag

SEQ ID NO: 2002806 - DNA, 20 bp, Homo sapiens
aacagaggcgtctcacattt

SEQ ID NO: 2002807 - DNA, 15 bp, Homo sapiens
aacagagtatatatg

SEQ ID NO: 2002808 - DNA, 16 bp, Homo sapiens
aacagatcaatttgta

SEQ ID NO: 2002809 - DNA, 19 bp, Homo sapiens
aacagattattaccttaca

SEQ ID NO: 2002810 - DNA, 13 bp, Homo sapiens
aacagcagaaaga

SEQ ID NO: 2002811 - DNA, 15 bp, Homo sapiens
aacagcagaaagact

SEQ ID NO: 2002812 - DNA, 19 bp, Homo sapiens
aacagcagactcagctctg

SEQ ID NO: 2002813 - DNA, 21 bp, Homo sapiens
aacagcagggtagtctggttt

SEQ ID NO: 2002814 - DNA, 15 bp, Homo sapiens
aacagcagtgttccc

SEQ ID NO: 2002815 - DNA, 22 bp, Homo sapiens
aacagcatctgcctctattcaa

SEQ ID NO: 2002816 - DNA, 14 bp, Homo sapiens
aacagcctcacaga

SEQ ID NO: 2002817 - DNA, 18 bp, Homo sapiens
aacagcctgacaacattt

SEQ ID NO: 2002818 - DNA, 15 bp, Homo sapiens
aacagctccctagtg

SEQ ID NO: 2002819 - DNA, 22 bp, Homo sapiens
aacagctccctagtggcttcct

SEQ ID NO: 2002820 - DNA, 19 bp, Homo sapiens
aacagcttttcccaggaga

SEQ ID NO: 2002821 - DNA, 22 bp, Homo sapiens
aacaggaaaaaaaataatgtaa

SEQ ID NO: 2002822 - DNA, 14 bp, Homo sapiens
aacaggaatctcag

SEQ ID NO: 2002823 - DNA, 21 bp, Homo sapiens
aacaggaatctcagagacagg

SEQ ID NO: 2002824 - DNA, 20 bp, Homo sapiens
aacaggaccacaaaaatgaa

SEQ ID NO: 2002825 - DNA, 17 bp, Homo sapiens
aacaggagacaggaagg

SEQ ID NO: 2002826 - DNA, 13 bp, Homo sapiens
aacaggctgggct

SEQ ID NO: 2002827 - DNA, 22 bp, Homo sapiens
aacaggctgggcttcagtggca

SEQ ID NO: 2002828 - DNA, 22 bp, Homo sapiens
aacaggctgttctgcactgaaa

SEQ ID NO: 2002829 - DNA, 20 bp, Homo sapiens
aacagggaaggcaggcaggg

SEQ ID NO: 2002830 - DNA, 17 bp, Homo sapiens
aacagggacaaagaaat

SEQ ID NO: 2002831 - DNA, 21 bp, Homo sapiens
aacagggagcccctaggaaag

SEQ ID NO: 2002832 - DNA, 16 bp, Homo sapiens
aacaggggatcaaagt

SEQ ID NO: 2002833 - DNA, 17 bp, Homo sapiens
aacaggggatcaaagtt

SEQ ID NO: 2002834 - DNA, 18 bp, Homo sapiens
aacaggggatcaaagttc

SEQ ID NO: 2002835 - DNA, 15 bp, Homo sapiens
aacaggtctcctctt

SEQ ID NO: 2002836 - DNA, 17 bp, Homo sapiens
aacaggtctcctcttaa

SEQ ID NO: 2002837 - DNA, 19 bp, Homo sapiens
aacaggtctcctcttaaaa

SEQ ID NO: 2002838 - DNA, 16 bp, Homo sapiens
aacagtatttgtacaa

SEQ ID NO: 2002839 - DNA, 14 bp, Homo sapiens
aacagtcatttaaa

SEQ ID NO: 2002840 - DNA, 14 bp, Homo sapiens
aacagtctcaggaa

SEQ ID NO: 2002841 - DNA, 15 bp, Homo sapiens
aacagtgcctgctga

SEQ ID NO: 2002842 - DNA, 13 bp, Homo sapiens
aacagtgtttccc

SEQ ID NO: 2002843 - DNA, 21 bp, Homo sapiens
aacagttaattagttaacagt

SEQ ID NO: 2002844 - DNA, 11 bp, Homo sapiens
aacagttcaaa

SEQ ID NO: 2002845 - DNA, 14 bp, Homo sapiens
aacagttcaaagaa

SEQ ID NO: 2002846 - DNA, 19 bp, Homo sapiens
aacagttgggctgtcaaca

SEQ ID NO: 2002847 - DNA, 15 bp, Homo sapiens
agatgatctctccac

SEQ ID NO: 2002848 - DNA, 11 bp, Homo sapiens
agatgatgatg

SEQ ID NO: 2002849 - DNA, 21 bp, Homo sapiens
agatgattctggctgaaaaag

SEQ ID NO: 2002850 - DNA, 13 bp, Homo sapiens
agatgcaagatat

SEQ ID NO: 2002851 - DNA, 15 bp, Homo sapiens
agatgcaccagccct

SEQ ID NO: 2002852 - DNA, 16 bp, Homo sapiens
agatgccattcataga

SEQ ID NO: 2002853 - DNA, 11 bp, Homo sapiens
agatgccctga

SEQ ID NO: 2002854 - DNA, 16 bp, Homo sapiens
agatgcctccaccgct

SEQ ID NO: 2002855 - DNA, 21 bp, Homo sapiens
agatgcctccaccgctgccta

SEQ ID NO: 2002856 - DNA, 22 bp, Homo sapiens
agatgcgagcgctatcttcaca

SEQ ID NO: 2002857 - DNA, 20 bp, Homo sapiens
agatgctgactgtactcctc

SEQ ID NO: 2002858 - DNA, 23 bp, Homo sapiens
agatggaagttgcagtgagctga

SEQ ID NO: 2002859 - DNA, 17 bp, Homo sapiens
agatggaatagaaaaga

SEQ ID NO: 2002860 - DNA, 12 bp, Homo sapiens
agatggaccagt

SEQ ID NO: 2002861 - DNA, 19 bp, Homo sapiens
agatggagttcttgtgcca

SEQ ID NO: 2002862 - DNA, 20 bp, Homo sapiens
agatggcgagcatcctggcc

SEQ ID NO: 2002863 - DNA, 17 bp, Homo sapiens
agatggctgtgcctctg

SEQ ID NO: 2002864 - DNA, 21 bp, Homo sapiens
agatggctgtgcctctgcctg

SEQ ID NO: 2002865 - DNA, 23 bp, Homo sapiens
agatggctgtgcctctgcctgtc

SEQ ID NO: 2002866 - DNA, 20 bp, Homo sapiens
agatggcttatttgtataat

SEQ ID NO: 2002867 - DNA, 22 bp, Homo sapiens
agatgggctgaactgagcctag

SEQ ID NO: 2002868 - DNA, 14 bp, Homo sapiens
agatggggtcttgc

SEQ ID NO: 2002869 - DNA, 24 bp, Homo sapiens
agatgggtctccgcacttggaaag

SEQ ID NO: 2002870 - DNA, 17 bp, Homo sapiens
agatgggtctggctgag

SEQ ID NO: 2002871 - DNA, 23 bp, Homo sapiens
agatgggtctggctgagctgaac

SEQ ID NO: 2002872 - DNA, 13 bp, Homo sapiens
agatggtagcaga

SEQ ID NO: 2002873 - DNA, 16 bp, Homo sapiens
agatggtagcagataa

SEQ ID NO: 2002874 - DNA, 14 bp, Homo sapiens
agatggtcagtgtg

SEQ ID NO: 2002875 - DNA, 14 bp, Homo sapiens
agatgtaccatgtt

SEQ ID NO: 2002876 - DNA, 17 bp, Homo sapiens
agatgtatcattaatgt

SEQ ID NO: 2002877 - DNA, 19 bp, Homo sapiens
agatgtcaaatatctcaga

SEQ ID NO: 2002878 - DNA, 22 bp, Homo sapiens
agatgtcaataggaattgcatt

SEQ ID NO: 2002879 - DNA, 18 bp, Homo sapiens
agatgtcagactggctgg

SEQ ID NO: 2002880 - DNA, 18 bp, Homo sapiens
agatgtctaatagttatt

SEQ ID NO: 2002881 - DNA, 15 bp, Homo sapiens
agatgtctttaggca

SEQ ID NO: 2002882 - DNA, 17 bp, Homo sapiens
agatgtgaacacatcag

SEQ ID NO: 2002883 - DNA, 12 bp, Homo sapiens
agatgtgatgct

SEQ ID NO: 2002884 - DNA, 20 bp, Homo sapiens
agatgtgattcctgcatttt

SEQ ID NO: 2002885 - DNA, 17 bp, Homo sapiens
agatgtgtgtgtgtgta

SEQ ID NO: 2002886 - DNA, 16 bp, Homo sapiens
agatgtgtttttaatg

SEQ ID NO: 2002887 - DNA, 17 bp, Homo sapiens
agatgtttgatagattt

SEQ ID NO: 2002888 - DNA, 19 bp, Homo sapiens
agatgtttgatagattttc

SEQ ID NO: 2002889 - DNA, 24 bp, Homo sapiens
agatgtttgtcagatatgatatgt

SEQ ID NO: 2002890 - DNA, 16 bp, Homo sapiens
agattaaaattagtga

SEQ ID NO: 2002891 - DNA, 20 bp, Homo sapiens
agattaaaattagtgagatt

SEQ ID NO: 2002892 - DNA, 14 bp, Homo sapiens
agattaaaggaagg

SEQ ID NO: 2002893 - DNA, 15 bp, Homo sapiens
agattaaaggaagga

SEQ ID NO: 2002894 - DNA, 16 bp, Homo sapiens
agattaaaggaaggaa

SEQ ID NO: 2002895 - DNA, 18 bp, Homo sapiens
agattaaggtgatgtgat

SEQ ID NO: 2002896 - DNA, 13 bp, Homo sapiens
agattaatttgtg

SEQ ID NO: 2002897 - DNA, 16 bp, Homo sapiens
agattactttgtcccg

SEQ ID NO: 2002898 - DNA, 16 bp, Homo sapiens
agattatatatcataa

SEQ ID NO: 2002899 - DNA, 19 bp, Homo sapiens
agattatatatcataaagt

SEQ ID NO: 2002900 - DNA, 22 bp, Homo sapiens
agattatattataataatgttc

SEQ ID NO: 2002901 - DNA, 21 bp, Homo sapiens
agattattgtagtgttcaaaa

SEQ ID NO: 2002902 - DNA, 20 bp, Homo sapiens
agattccacacaaaatgtca

SEQ ID NO: 2002903 - DNA, 21 bp, Homo sapiens
agattccagagagtggctcct

SEQ ID NO: 2002904 - DNA, 23 bp, Homo sapiens
agattcctcttgcctctctcagg

SEQ ID NO: 2002905 - DNA, 15 bp, Homo sapiens
agattcctgggcctg

SEQ ID NO: 2002906 - DNA, 16 bp, Homo sapiens
agattctccaaatgat

SEQ ID NO: 2002907 - DNA, 15 bp, Homo sapiens
agattctcctgtgct

SEQ ID NO: 2002908 - DNA, 23 bp, Homo sapiens
agattctgatttttttgttgttg

SEQ ID NO: 2002909 - DNA, 18 bp, Homo sapiens
agattgagagaagagaca

SEQ ID NO: 2002910 - DNA, 22 bp, Homo sapiens
agattgaggcctgccctcaggg

SEQ ID NO: 2002911 - DNA, 20 bp, Homo sapiens
agattgcaacaggctgggct

SEQ ID NO: 2002912 - DNA, 23 bp, Homo sapiens
agattgcaacaggctgggcttca

SEQ ID NO: 2002913 - DNA, 12 bp, Homo sapiens
agattgcttctc

SEQ ID NO: 2002914 - DNA, 21 bp, Homo sapiens
agattgtccagtgcaaccaca

SEQ ID NO: 2002915 - DNA, 15 bp, Homo sapiens
agattgtgtaacaat

SEQ ID NO: 2002916 - DNA, 14 bp, Homo sapiens
agattgttaaaata

SEQ ID NO: 2002917 - DNA, 23 bp, Homo sapiens
agattgttttatatgtagtacta

SEQ ID NO: 2002918 - DNA, 22 bp, Homo sapiens
agatttaccttttctgttgtac

SEQ ID NO: 2002919 - DNA, 18 bp, Homo sapiens
agatttagtgaaagctag

SEQ ID NO: 2002920 - DNA, 15 bp, Homo sapiens
agatttcaacatatc

SEQ ID NO: 2002921 - DNA, 19 bp, Homo sapiens
agatttcaagaaaaaataa

SEQ ID NO: 2002922 - DNA, 15 bp, Homo sapiens
agatttcacatcagc

SEQ ID NO: 2002923 - DNA, 13 bp, Homo sapiens
agatttcctccat

SEQ ID NO: 2002924 - DNA, 13 bp, Homo sapiens
agatttgccagca

SEQ ID NO: 2002925 - DNA, 16 bp, Homo sapiens
agatttgtggaaaaat

SEQ ID NO: 2002926 - DNA, 14 bp, Homo sapiens
agattttaattttg

SEQ ID NO: 2002927 - DNA, 14 bp, Homo sapiens
agattttcttggca

SEQ ID NO: 2002928 - DNA, 17 bp, Homo sapiens
agattttttttgtaact

SEQ ID NO: 2002929 - DNA, 12 bp, Homo sapiens
agcaaaaaagaa

SEQ ID NO: 2002930 - DNA, 14 bp, Homo sapiens
agcaaaagaagaag

SEQ ID NO: 2002931 - DNA, 15 bp, Homo sapiens
agcaaaatctaccag

SEQ ID NO: 2002932 - DNA, 21 bp, Homo sapiens
agcaaagcctgttcatggcag

SEQ ID NO: 2002933 - DNA, 18 bp, Homo sapiens
agcaaagcttaaatgcct

SEQ ID NO: 2002934 - DNA, 15 bp, Homo sapiens
agcaaaggaaaccaa

SEQ ID NO: 2002935 - DNA, 18 bp, Homo sapiens
agcaaaggaaaccaaagg

SEQ ID NO: 2002936 - DNA, 14 bp, Homo sapiens
agcaaagtctaaag

SEQ ID NO: 2002937 - DNA, 15 bp, Homo sapiens
agcaaagtctaaagt

SEQ ID NO: 2002938 - DNA, 17 bp, Homo sapiens
agcaaagtgtcagtgtt

SEQ ID NO: 2002939 - DNA, 18 bp, Homo sapiens
agcaaagtgtcagtgttg

SEQ ID NO: 2002940 - DNA, 18 bp, Homo sapiens
agcaaatgtttctgcagt

SEQ ID NO: 2002941 - DNA, 18 bp, Homo sapiens
agcaaatttcaaaagaca

SEQ ID NO: 2002942 - DNA, 17 bp, Homo sapiens
agcaacacaagctggaa

SEQ ID NO: 2002943 - DNA, 20 bp, Homo sapiens
agcaacacaagctggaagca

SEQ ID NO: 2002944 - DNA, 23 bp, Homo sapiens
agcaacagagtgagaccctgtct

SEQ ID NO: 2002945 - DNA, 18 bp, Homo sapiens
agcaacaggttttataat

SEQ ID NO: 2002946 - DNA, 19 bp, Homo sapiens
agcaacaggttttataatt

SEQ ID NO: 2002947 - DNA, 19 bp, Homo sapiens
agcaacccctgtacccagc

SEQ ID NO: 2002948 - DNA, 20 bp, Homo sapiens
agcaacccctgtacccagct

SEQ ID NO: 2002949 - DNA, 19 bp, Homo sapiens
agcaaccgtggcccttcct

SEQ ID NO: 2002950 - DNA, 21 bp, Homo sapiens
agcaaccgtggcccttcctgg

SEQ ID NO: 2002951 - DNA, 22 bp, Homo sapiens
agcaaccgtggcccttcctgga

SEQ ID NO: 2002952 - DNA, 14 bp, Homo sapiens
agcaactcccacga

SEQ ID NO: 2002953 - DNA, 15 bp, Homo sapiens
agcaacttgcttcta

SEQ ID NO: 2002954 - DNA, 17 bp, Homo sapiens
agcaagacgtcctggaa

SEQ ID NO: 2002955 - DNA, 16 bp, Homo sapiens
agcaagactgttgctc

SEQ ID NO: 2002956 - DNA, 22 bp, Homo sapiens
agcaagacttctctttgcctca

SEQ ID NO: 2002957 - DNA, 13 bp, Homo sapiens
agcaagagcacaa

SEQ ID NO: 2002958 - DNA, 21 bp, Homo sapiens
agcaagcattcagaagaaaaa

SEQ ID NO: 2002959 - DNA, 20 bp, Homo sapiens
agcaagcatttatgtttatt

SEQ ID NO: 2002960 - DNA, 12 bp, Homo sapiens
agcaaggcccga

SEQ ID NO: 2002961 - DNA, 14 bp, Homo sapiens
agcaaggcccgagc

SEQ ID NO: 2002962 - DNA, 18 bp, Homo sapiens
agcaaggcccgagcagct

SEQ ID NO: 2002963 - DNA, 20 bp, Homo sapiens
agcaaggcccgagcagctga

SEQ ID NO: 2002964 - DNA, 21 bp, Homo sapiens
agcaaggcccgagcagctgag

SEQ ID NO: 2002965 - DNA, 22 bp, Homo sapiens
agcaaggcccgagcagctgagc

SEQ ID NO: 2002966 - DNA, 16 bp, Homo sapiens
agcaagggctccagca

SEQ ID NO: 2002967 - DNA, 22 bp, Homo sapiens
agcaagggtgatgggaaagcat

SEQ ID NO: 2002968 - DNA, 16 bp, Homo sapiens
agcaaggtgtgaatga

SEQ ID NO: 2002969 - DNA, 20 bp, Homo sapiens
agcaagttctagagaagagg

SEQ ID NO: 2002970 - DNA, 21 bp, Homo sapiens
agcaagttctagagaagaggc

SEQ ID NO: 2002971 - DNA, 23 bp, Homo sapiens
agcaagttctagagaagaggctg

SEQ ID NO: 2002972 - DNA, 17 bp, Homo sapiens
agcaagtttcaccttgg

SEQ ID NO: 2002973 - DNA, 14 bp, Homo sapiens
agcaataattagga

SEQ ID NO: 2002974 - DNA, 23 bp, Homo sapiens
agcaatccatgttagtttttact

SEQ ID NO: 2002975 - DNA, 19 bp, Homo sapiens
agcaatgatgtccagaaga

SEQ ID NO: 2002976 - DNA, 13 bp, Homo sapiens
agcaatggacctt

SEQ ID NO: 2002977 - DNA, 13 bp, Homo sapiens
agcaatgggaggg

SEQ ID NO: 2002978 - DNA, 17 bp, Homo sapiens
agcaatgggagggggct

SEQ ID NO: 2002979 - DNA, 20 bp, Homo sapiens
agcaatgggagggggctcca

SEQ ID NO: 2002980 - DNA, 22 bp, Homo sapiens
agcaatgggagggggctccatg

SEQ ID NO: 2002981 - DNA, 15 bp, Homo sapiens
agcaattatattgtc

SEQ ID NO: 2002982 - DNA, 14 bp, Homo sapiens
agcaattcatttca

SEQ ID NO: 2002983 - DNA, 17 bp, Homo sapiens
agcaattcatttcactt

SEQ ID NO: 2002984 - DNA, 20 bp, Homo sapiens
agcaattcatttcactttaa

SEQ ID NO: 2002985 - DNA, 13 bp, Homo sapiens
agcaattggctcc

SEQ ID NO: 2002986 - DNA, 14 bp, Homo sapiens
agcaattttcgaac

SEQ ID NO: 2002987 - DNA, 19 bp, Homo sapiens
agcacaagaggaagagaga

SEQ ID NO: 2002988 - DNA, 21 bp, Homo sapiens
agcacaagttatttaaatctg

SEQ ID NO: 2002989 - DNA, 14 bp, Homo sapiens
agcacacaggtaca

SEQ ID NO: 2002990 - DNA, 20 bp, Homo sapiens
agcacacgaaccctgccagg

SEQ ID NO: 2002991 - DNA, 14 bp, Homo sapiens
agcacactgtagca

SEQ ID NO: 2002992 - DNA, 19 bp, Homo sapiens
agcacactgtagcattaca

SEQ ID NO: 2002993 - DNA, 23 bp, Homo sapiens
agcacagaaggaatctgtgcaga

SEQ ID NO: 2002994 - DNA, 13 bp, Homo sapiens
agcacagagggct

SEQ ID NO: 2002995 - DNA, 21 bp, Homo sapiens
agcacagcttcatttcctgtg

SEQ ID NO: 2002996 - DNA, 13 bp, Homo sapiens
agcacaggagaca

SEQ ID NO: 2002997 - DNA, 12 bp, Homo sapiens
agcacaggcagc

SEQ ID NO: 2002998 - DNA, 12 bp, Homo sapiens
agcacaggctaa

SEQ ID NO: 2002999 - DNA, 19 bp, Homo sapiens
agcacagtctgatgacaca

SEQ ID NO: 2003000 - DNA, 13 bp, Homo sapiens
agcacatctggga

SEQ ID NO: 2003001 - DNA, 22 bp, Homo sapiens
agcaccaaaagcttaccaaggg

SEQ ID NO: 2003002 - DNA, 17 bp, Homo sapiens
agcaccagcttctccag

SEQ ID NO: 2003003 - DNA, 19 bp, Homo sapiens
agcaccagcttctccaggc

SEQ ID NO: 2003004 - DNA, 14 bp, Homo sapiens
agcaccaggcacga

SEQ ID NO: 2003005 - DNA, 10 bp, Homo sapiens
agcacccagg

SEQ ID NO: 2003006 - DNA, 13 bp, Homo sapiens
agcacccaggctc

SEQ ID NO: 2003007 - DNA, 18 bp, Homo sapiens
agcaccccctcattcccc

SEQ ID NO: 2003008 - DNA, 15 bp, Homo sapiens
agcacccctgtctct

SEQ ID NO: 2003009 - DNA, 14 bp, Homo sapiens
agcaccctcccccg

SEQ ID NO: 2003010 - DNA, 15 bp, Homo sapiens
agcaccctctcctgg

SEQ ID NO: 2003011 - DNA, 20 bp, Homo sapiens
agcaccctgcagagcacaca

SEQ ID NO: 2003012 - DNA, 14 bp, Homo sapiens
agcaccctgggtgc

SEQ ID NO: 2003013 - DNA, 16 bp, Homo sapiens
agcacccttctgctgt

SEQ ID NO: 2003014 - DNA, 23 bp, Homo sapiens
agcacctgaaccccatgggcttg

SEQ ID NO: 2003015 - DNA, 19 bp, Homo sapiens
agcacctgccgacctcgtc

SEQ ID NO: 2003016 - DNA, 22 bp, Homo sapiens
agcacctgccgacctcgtcctc

SEQ ID NO: 2003017 - DNA, 20 bp, Homo sapiens
agcacctgcttcatgctcag

SEQ ID NO: 2003018 - DNA, 21 bp, Homo sapiens
agcacctgcttcatgctcagc

SEQ ID NO: 2003019 - DNA, 20 bp, Homo sapiens
agcaccttaatattattggg

SEQ ID NO: 2003020 - DNA, 18 bp, Homo sapiens
agcacgaaatgttatttt

SEQ ID NO: 2003021 - DNA, 18 bp, Homo sapiens
agcacgattttgcacaaa

SEQ ID NO: 2003022 - DNA, 15 bp, Homo sapiens
agcacgggacaggag

SEQ ID NO: 2003023 - DNA, 20 bp, Homo sapiens
agcactaaggtgtgctctga

SEQ ID NO: 2003024 - DNA, 23 bp, Homo sapiens
agcactcaaccaacctccccgca

SEQ ID NO: 2003025 - DNA, 12 bp, Homo sapiens
agcactcctctg

SEQ ID NO: 2003026 - DNA, 17 bp, Homo sapiens
agcactcctctgtctct

SEQ ID NO: 2003027 - DNA, 21 bp, Homo sapiens
agcactcgagaccatcctggc

SEQ ID NO: 2003028 - DNA, 22 bp, Homo sapiens
agcactctctaaatcttccttg

SEQ ID NO: 2003029 - DNA, 19 bp, Homo sapiens
agcactgcagatagccaga

SEQ ID NO: 2003030 - DNA, 22 bp, Homo sapiens
agcactgcagatagccagacac

SEQ ID NO: 2003031 - DNA, 14 bp, Homo sapiens
agcactgccaggag

SEQ ID NO: 2003032 - DNA, 22 bp, Homo sapiens
agcactgctaggcgagtgccag

SEQ ID NO: 2003033 - DNA, 20 bp, Homo sapiens
agcactgctgtgtccgcttt

SEQ ID NO: 2003034 - DNA, 16 bp, Homo sapiens
agcactggagtgcagg

SEQ ID NO: 2003035 - DNA, 17 bp, Homo sapiens
agcactggagtgcaggg

SEQ ID NO: 2003036 - DNA, 19 bp, Homo sapiens
agcactggagtgcagggag

SEQ ID NO: 2003037 - DNA, 22 bp, Homo sapiens
agcactggagtgcagggaggag

SEQ ID NO: 2003038 - DNA, 15 bp, Homo sapiens
agcactgtgaagacc

SEQ ID NO: 2003039 - DNA, 18 bp, Homo sapiens
agcactgtgaagacccag

SEQ ID NO: 2003040 - DNA, 22 bp, Homo sapiens
agcactgtgaagacccagcagg

SEQ ID NO: 2003041 - DNA, 21 bp, Homo sapiens
agcacttctttcctctccaat

SEQ ID NO: 2003042 - DNA, 17 bp, Homo sapiens
agcacttgcgtcctgca

SEQ ID NO: 2003043 - DNA, 19 bp, Homo sapiens
agcacttgcgtcctgcaga

SEQ ID NO: 2003044 - DNA, 20 bp, Homo sapiens
agcacttgcgtcctgcagag

SEQ ID NO: 2003045 - DNA, 14 bp, Homo sapiens
agcacttggagcca

SEQ ID NO: 2003046 - DNA, 20 bp, Homo sapiens
agcacttgttccttctgctt

SEQ ID NO: 2003047 - DNA, 18 bp, Homo sapiens
agcactttaaccctctct

SEQ ID NO: 2003048 - DNA, 20 bp, Homo sapiens
agcactttaaccctctcttc

SEQ ID NO: 2003049 - DNA, 23 bp, Homo sapiens
agcactttaaccctctcttccct

SEQ ID NO: 2003050 - DNA, 23 bp, Homo sapiens
agcagaaaagtgcttagaaagtt

SEQ ID NO: 2003051 - DNA, 18 bp, Homo sapiens
agcagaaaccaagtctac

SEQ ID NO: 2003052 - DNA, 17 bp, Homo sapiens
agcagaagagggaggct

SEQ ID NO: 2003053 - DNA, 23 bp, Homo sapiens
agcagaagagggaggcttcctga

SEQ ID NO: 2003054 - DNA, 13 bp, Homo sapiens
agcagaatgaaga

SEQ ID NO: 2003055 - DNA, 13 bp, Homo sapiens
agcagacagagaa

SEQ ID NO: 2003056 - DNA, 16 bp, Homo sapiens
agcagacagagaaatg

SEQ ID NO: 2003057 - DNA, 16 bp, Homo sapiens
agcagacgcagcagct

SEQ ID NO: 2003058 - DNA, 20 bp, Homo sapiens
agcagactcagctctgacat

SEQ ID NO: 2003059 - DNA, 14 bp, Homo sapiens
agcagagagccctg

SEQ ID NO: 2003060 - DNA, 17 bp, Homo sapiens
agcagagcaaatgaggg

SEQ ID NO: 2003061 - DNA, 19 bp, Homo sapiens
agcagagggcctaggagga

SEQ ID NO: 2003062 - DNA, 17 bp, Homo sapiens
agcagagtataggatgg

SEQ ID NO: 2003063 - DNA, 20 bp, Homo sapiens
agcagagtgaggatgtgttt

SEQ ID NO: 2003064 - DNA, 18 bp, Homo sapiens
agcagataaagacagctg

SEQ ID NO: 2003065 - DNA, 18 bp, Homo sapiens
agcagatttaacaattcc

SEQ ID NO: 2003066 - DNA, 17 bp, Homo sapiens
agcagcaaaaatataaa

SEQ ID NO: 2003067 - DNA, 19 bp, Homo sapiens
agcagcacgattttgcaca

SEQ ID NO: 2003068 - DNA, 14 bp, Homo sapiens
agcagcactgcaga

SEQ ID NO: 2003069 - DNA, 15 bp, Homo sapiens
agcagcagagagccc

SEQ ID NO: 2003070 - DNA, 13 bp, Homo sapiens
agcagcagtgagc

SEQ ID NO: 2003071 - DNA, 21 bp, Homo sapiens
agcagcattcagcacacccca

SEQ ID NO: 2003072 - DNA, 16 bp, Homo sapiens
agcagccagccagtct

SEQ ID NO: 2003073 - DNA, 21 bp, Homo sapiens
agcagccagccagtcttgcct

SEQ ID NO: 2003074 - DNA, 14 bp, Homo sapiens
agcagccagccctg

SEQ ID NO: 2003075 - DNA, 15 bp, Homo sapiens
agcagccagccctgc

SEQ ID NO: 2003076 - DNA, 16 bp, Homo sapiens
agcagccagccctgcc

SEQ ID NO: 2003077 - DNA, 17 bp, Homo sapiens
agcagccagccctgcct

SEQ ID NO: 2003078 - DNA, 19 bp, Homo sapiens
agcagccagccctgcctgg

SEQ ID NO: 2003079 - DNA, 20 bp, Homo sapiens
agcagccagccctgcctgga

SEQ ID NO: 2003080 - DNA, 17 bp, Homo sapiens
agcagccagctctcagc

SEQ ID NO: 2003081 - DNA, 17 bp, Homo sapiens
agcagcccagcttcctg

SEQ ID NO: 2003082 - DNA, 18 bp, Homo sapiens
agcagccccccagcacta

SEQ ID NO: 2003083 - DNA, 17 bp, Homo sapiens
agcagccctcctcaccc

SEQ ID NO: 2003084 - DNA, 18 bp, Homo sapiens
agcagccctcctcacccc

SEQ ID NO: 2003085 - DNA, 23 bp, Homo sapiens
agcagccctcctcaccccgtctg

SEQ ID NO: 2003086 - DNA, 17 bp, Homo sapiens
agcagcctcctgggcag

SEQ ID NO: 2003087 - DNA, 19 bp, Homo sapiens
agcagcctcctgggcagtc

SEQ ID NO: 2003088 - DNA, 13 bp, Homo sapiens
agcagcctgatgg

SEQ ID NO: 2003089 - DNA, 14 bp, Homo sapiens
agcagcctgatggc

SEQ ID NO: 2003090 - DNA, 20 bp, Homo sapiens
agcagcctgatggccaaggg

SEQ ID NO: 2003091 - DNA, 15 bp, Homo sapiens
agcagcctttctgtg

SEQ ID NO: 2003092 - DNA, 22 bp, Homo sapiens
agcagctaggactgaggagtgg

SEQ ID NO: 2003093 - DNA, 19 bp, Homo sapiens
agcagctcagcctcccccc

SEQ ID NO: 2003094 - DNA, 20 bp, Homo sapiens
agcagctcttcccctttcct

SEQ ID NO: 2003095 - DNA, 21 bp, Homo sapiens
agcagctcttcccctttcctg

SEQ ID NO: 2003096 - DNA, 12 bp, Homo sapiens
agcagctgagca

SEQ ID NO: 2003097 - DNA, 18 bp, Homo sapiens
agcagctgagcagggccg

SEQ ID NO: 2003098 - DNA, 16 bp, Homo sapiens
agcagcttcagttgtt

SEQ ID NO: 2003099 - DNA, 14 bp, Homo sapiens
agcaggaacagaga

SEQ ID NO: 2003100 - DNA, 16 bp, Homo sapiens
agcaggaacagagact

SEQ ID NO: 2003101 - DNA, 17 bp, Homo sapiens
agcaggaacagagactc

SEQ ID NO: 2003102 - DNA, 17 bp, Homo sapiens
agcaggaatgggaagga

SEQ ID NO: 2003103 - DNA, 13 bp, Homo sapiens
agcaggcacagga

SEQ ID NO: 2003104 - DNA, 20 bp, Homo sapiens
agcaggcagagcggggaggt

SEQ ID NO: 2003105 - DNA, 17 bp, Homo sapiens
agcaggcccgacagaga

SEQ ID NO: 2003106 - DNA, 19 bp, Homo sapiens
agcaggcccgacagagaga

SEQ ID NO: 2003107 - DNA, 20 bp, Homo sapiens
agcaggcccgacagagagat

SEQ ID NO: 2003108 - DNA, 21 bp, Homo sapiens
agcaggcccgacagagagatg

SEQ ID NO: 2003109 - DNA, 13 bp, Homo sapiens
agcagggaaacag

SEQ ID NO: 2003110 - DNA, 14 bp, Homo sapiens
agcagggaaacagc

SEQ ID NO: 2003111 - DNA, 17 bp, Homo sapiens
agcagggaaagctccac

SEQ ID NO: 2003112 - DNA, 14 bp, Homo sapiens
agcagggacacccc

SEQ ID NO: 2003113 - DNA, 19 bp, Homo sapiens
agcagggcatggctgggaa

SEQ ID NO: 2003114 - DNA, 13 bp, Homo sapiens
agcagggctcagc

SEQ ID NO: 2003115 - DNA, 15 bp, Homo sapiens
agcagggctcagcgg

SEQ ID NO: 2003116 - DNA, 16 bp, Homo sapiens
agcagggctctgcccc

SEQ ID NO: 2003117 - DNA, 22 bp, Homo sapiens
agcaggggtccttggtgtgacc

SEQ ID NO: 2003118 - DNA, 15 bp, Homo sapiens
agcaggggtctgagc

SEQ ID NO: 2003119 - DNA, 23 bp, Homo sapiens
agcaggtagtgggtgaatgtgtg

SEQ ID NO: 2003120 - DNA, 13 bp, Homo sapiens
agcaggtctctgg

SEQ ID NO: 2003121 - DNA, 18 bp, Homo sapiens
agcaggtctctggcagag

SEQ ID NO: 2003122 - DNA, 21 bp, Homo sapiens
agcaggtgcaagagacagagc

SEQ ID NO: 2003123 - DNA, 23 bp, Homo sapiens
agcaggtgcaagagacagagccc

SEQ ID NO: 2003124 - DNA, 22 bp, Homo sapiens
agcaggtgtggtggctcatggc

SEQ ID NO: 2003125 - DNA, 21 bp, Homo sapiens
agcaggttcttgatgtcatgt

SEQ ID NO: 2003126 - DNA, 20 bp, Homo sapiens
agcaggttgaggggctcctg

SEQ ID NO: 2003127 - DNA, 19 bp, Homo sapiens
agcagtaaactttctctgc

SEQ ID NO: 2003128 - DNA, 21 bp, Homo sapiens
agcagtaaactttctctgcaa

SEQ ID NO: 2003129 - DNA, 15 bp, Homo sapiens
agcagtacatgggaa

SEQ ID NO: 2003130 - DNA, 15 bp, Homo sapiens
agcagtatgaatgat

SEQ ID NO: 2003131 - DNA, 14 bp, Homo sapiens
agcagtcacactgt

SEQ ID NO: 2003132 - DNA, 20 bp, Homo sapiens
agcagtcacactgttactcc

SEQ ID NO: 2003133 - DNA, 15 bp, Homo sapiens
agcagtccaaagaac

SEQ ID NO: 2003134 - DNA, 22 bp, Homo sapiens
agcagtgagaaaaagctcctgt

SEQ ID NO: 2003135 - DNA, 17 bp, Homo sapiens
agcagtgagcttctatt

SEQ ID NO: 2003136 - DNA, 16 bp, Homo sapiens
agcagtgagtctcttc

SEQ ID NO: 2003137 - DNA, 16 bp, Homo sapiens
agcagtgcctcgaggc

SEQ ID NO: 2003138 - DNA, 22 bp, Homo sapiens
agcagtgcctcgaggcaccggc

SEQ ID NO: 2003139 - DNA, 20 bp, Homo sapiens
agcagtgccttccataatta

SEQ ID NO: 2003140 - DNA, 16 bp, Homo sapiens
agcagtgcttgtaaac

SEQ ID NO: 2003141 - DNA, 20 bp, Homo sapiens
agcagtgtcatcagaagata

SEQ ID NO: 2003142 - DNA, 15 bp, Homo sapiens
agcagttaactttaa

SEQ ID NO: 2003143 - DNA, 18 bp, Homo sapiens
agcagttccatgaagaca

SEQ ID NO: 2003144 - DNA, 19 bp, Homo sapiens
agcagttccatgaagacac

SEQ ID NO: 2003145 - DNA, 21 bp, Homo sapiens
agcagttgaaaagactccaaa

SEQ ID NO: 2003146 - DNA, 21 bp, Homo sapiens
agcataatgctcccatctcct

SEQ ID NO: 2003147 - DNA, 18 bp, Homo sapiens
agcataccttggactgac

SEQ ID NO: 2003148 - DNA, 16 bp, Homo sapiens
agcatacctttattgt

SEQ ID NO: 2003149 - DNA, 17 bp, Homo sapiens
agcatacctttattgtg

SEQ ID NO: 2003150 - DNA, 18 bp, Homo sapiens
agcatatgcctacttgta

SEQ ID NO: 2003151 - DNA, 16 bp, Homo sapiens
agcatcatgcctctga

SEQ ID NO: 2003152 - DNA, 19 bp, Homo sapiens
agcatcatgcctctgaggc

SEQ ID NO: 2003153 - DNA, 18 bp, Homo sapiens
agcatcattgtaaattat

SEQ ID NO: 2003154 - DNA, 22 bp, Homo sapiens
agcatcctggcacccggcccct

SEQ ID NO: 2003155 - DNA, 19 bp, Homo sapiens
agcatcgtgacccttcagg

SEQ ID NO: 2003156 - DNA, 20 bp, Homo sapiens
agcatcgtgacccttcaggg

SEQ ID NO: 2003157 - DNA, 20 bp, Homo sapiens
agcatctctgtgtacccact

SEQ ID NO: 2003158 - DNA, 17 bp, Homo sapiens
agcatctcttgaggcca

SEQ ID NO: 2003159 - DNA, 19 bp, Homo sapiens
agcatctcttgaggccagg

SEQ ID NO: 2003160 - DNA, 20 bp, Homo sapiens
agcatctgcctctattcaat

SEQ ID NO: 2003161 - DNA, 15 bp, Homo sapiens
agcatcttgtcaaga

SEQ ID NO: 2003162 - DNA, 19 bp, Homo sapiens
agcatcttgtcaagaaata

SEQ ID NO: 2003163 - DNA, 18 bp, Homo sapiens
agcatgattttaagaggc

SEQ ID NO: 2003164 - DNA, 17 bp, Homo sapiens
agcatgcacagctgctt

SEQ ID NO: 2003165 - DNA, 22 bp, Homo sapiens
agcatgcatagtgctaagaaag

SEQ ID NO: 2003166 - DNA, 16 bp, Homo sapiens
agcatggactctgggt

SEQ ID NO: 2003167 - DNA, 20 bp, Homo sapiens
agcatggagagcctcttagt

SEQ ID NO: 2003168 - DNA, 16 bp, Homo sapiens
agcatggctgtgagga

SEQ ID NO: 2003169 - DNA, 17 bp, Homo sapiens
agcatggctgtgaggat

SEQ ID NO: 2003170 - DNA, 22 bp, Homo sapiens
agcatgggactgtgcctttggg

SEQ ID NO: 2003171 - DNA, 17 bp, Homo sapiens
agcatggtcacaagcac

SEQ ID NO: 2003172 - DNA, 12 bp, Homo sapiens
agcatgtacaaa

SEQ ID NO: 2003173 - DNA, 12 bp, Homo sapiens
agcatgtagctc

SEQ ID NO: 2003174 - DNA, 19 bp, Homo sapiens
agcatgtggggaagcaaga

SEQ ID NO: 2003175 - DNA, 14 bp, Homo sapiens
agcatgtttcatgt

SEQ ID NO: 2003176 - DNA, 19 bp, Homo sapiens
agcattacgtgagccaggt

SEQ ID NO: 2003177 - DNA, 22 bp, Homo sapiens
agcattagctacttttcagaat

SEQ ID NO: 2003178 - DNA, 15 bp, Homo sapiens
agcattattcttcag

SEQ ID NO: 2003179 - DNA, 15 bp, Homo sapiens
agcattcagaagaaa

SEQ ID NO: 2003180 - DNA, 21 bp, Homo sapiens
agcattcagaagaaaaagaag

SEQ ID NO: 2003181 - DNA, 20 bp, Homo sapiens
agcattcagcacaccccaag

SEQ ID NO: 2003182 - DNA, 12 bp, Homo sapiens
agcattctgtct

SEQ ID NO: 2003183 - DNA, 22 bp, Homo sapiens
agcattgaacatttcttatgat

SEQ ID NO: 2003184 - DNA, 18 bp, Homo sapiens
agcattgagacggtgctc

SEQ ID NO: 2003185 - DNA, 14 bp, Homo sapiens
agccaaaaatagct

SEQ ID NO: 2003186 - DNA, 22 bp, Homo sapiens
agccaaaaatagctaaatacct

SEQ ID NO: 2003187 - DNA, 13 bp, Homo sapiens
agccaaacagagc

SEQ ID NO: 2003188 - DNA, 20 bp, Homo sapiens
agccaaacagagccttcaca

SEQ ID NO: 2003189 - DNA, 18 bp, Homo sapiens
agccaaacccatgaggca

SEQ ID NO: 2003190 - DNA, 13 bp, Homo sapiens
agccaaagagaaa

SEQ ID NO: 2003191 - DNA, 20 bp, Homo sapiens
agccaaagagaaaagattaa

SEQ ID NO: 2003192 - DNA, 20 bp, Homo sapiens
agccaaagctaggcctggcc

SEQ ID NO: 2003193 - DNA, 23 bp, Homo sapiens
agccaaagctaggcctggccaga

SEQ ID NO: 2003194 - DNA, 20 bp, Homo sapiens
agccaaatgtaattgaataa

SEQ ID NO: 2003195 - DNA, 18 bp, Homo sapiens
aagggccagtctgggctg

SEQ ID NO: 2003196 - DNA, 15 bp, Homo sapiens
aagggcccagagagg

SEQ ID NO: 2003197 - DNA, 23 bp, Homo sapiens
aagggctccagcatccagcctgt

SEQ ID NO: 2003198 - DNA, 17 bp, Homo sapiens
aagggctgccgggccag

SEQ ID NO: 2003199 - DNA, 17 bp, Homo sapiens
aaggggacttgtgccag

SEQ ID NO: 2003200 - DNA, 13 bp, Homo sapiens
aaggggagttgag

SEQ ID NO: 2003201 - DNA, 17 bp, Homo sapiens
aaggggcacaccactgc

SEQ ID NO: 2003202 - DNA, 15 bp, Homo sapiens
aaggggcacctggga

SEQ ID NO: 2003203 - DNA, 20 bp, Homo sapiens
aaggggccccggggctggca

SEQ ID NO: 2003204 - DNA, 13 bp, Homo sapiens
aaggggccctggt

SEQ ID NO: 2003205 - DNA, 18 bp, Homo sapiens
aagggggtcaaaggaaga

SEQ ID NO: 2003206 - DNA, 16 bp, Homo sapiens
aagggggtccacccag

SEQ ID NO: 2003207 - DNA, 18 bp, Homo sapiens
aagggtatgggaagccat

SEQ ID NO: 2003208 - DNA, 18 bp, Homo sapiens
aagggtctagggagagac

SEQ ID NO: 2003209 - DNA, 20 bp, Homo sapiens
aagggtctgttgtaaatgac

SEQ ID NO: 2003210 - DNA, 14 bp, Homo sapiens
aagggtgacatccc

SEQ ID NO: 2003211 - DNA, 21 bp, Homo sapiens
aagggtgatgggaaagcattg

SEQ ID NO: 2003212 - DNA, 18 bp, Homo sapiens
aagggtggtctgagcacc

SEQ ID NO: 2003213 - DNA, 19 bp, Homo sapiens
aagggttggtgggctggcc

SEQ ID NO: 2003214 - DNA, 19 bp, Homo sapiens
aagggttttccaccctgga

SEQ ID NO: 2003215 - DNA, 20 bp, Homo sapiens
aaggtagcttacctgacaca

SEQ ID NO: 2003216 - DNA, 22 bp, Homo sapiens
aaggtcattgtggctatctgca

SEQ ID NO: 2003217 - DNA, 20 bp, Homo sapiens
aaggtctccttactctgagc

SEQ ID NO: 2003218 - DNA, 18 bp, Homo sapiens
aaggtgcctgtgaggcag

SEQ ID NO: 2003219 - DNA, 17 bp, Homo sapiens
aaggtgtaaaatatcta

SEQ ID NO: 2003220 - DNA, 23 bp, Homo sapiens
aaggtgtaaaatatctacctgcc

SEQ ID NO: 2003221 - DNA, 17 bp, Homo sapiens
aaggtgtaactctaatt

SEQ ID NO: 2003222 - DNA, 17 bp, Homo sapiens
aaggttaggatttaaca

SEQ ID NO: 2003223 - DNA, 17 bp, Homo sapiens
aaggttcttcatccctt

SEQ ID NO: 2003224 - DNA, 22 bp, Homo sapiens
aaggttgacaataaatgtgctt

SEQ ID NO: 2003225 - DNA, 17 bp, Homo sapiens
aaggttgactcaagttt

SEQ ID NO: 2003226 - DNA, 18 bp, Homo sapiens
aaggttgttttgaaactg

SEQ ID NO: 2003227 - DNA, 17 bp, Homo sapiens
aaggtttatgaaaaaga

SEQ ID NO: 2003228 - DNA, 13 bp, Homo sapiens
aaggtttggtgtg

SEQ ID NO: 2003229 - DNA, 14 bp, Homo sapiens
aaggttttctccac

SEQ ID NO: 2003230 - DNA, 15 bp, Homo sapiens
aagtaaaaaaatatg

SEQ ID NO: 2003231 - DNA, 17 bp, Homo sapiens
aagtaaagtttatttca

SEQ ID NO: 2003232 - DNA, 23 bp, Homo sapiens
aagtaatataatggaagagaaat

SEQ ID NO: 2003233 - DNA, 16 bp, Homo sapiens
aagtaatcactaaccc

SEQ ID NO: 2003234 - DNA, 15 bp, Homo sapiens
aagtaattatcggga

SEQ ID NO: 2003235 - DNA, 17 bp, Homo sapiens
aagtaccactcaggcca

SEQ ID NO: 2003236 - DNA, 17 bp, Homo sapiens
aagtaccatagaacaga

SEQ ID NO: 2003237 - DNA, 21 bp, Homo sapiens
aagtaccatagaacagaactg

SEQ ID NO: 2003238 - DNA, 12 bp, Homo sapiens
aagtacctgtag

SEQ ID NO: 2003239 - DNA, 18 bp, Homo sapiens
aagtacttctccaccctg

SEQ ID NO: 2003240 - DNA, 11 bp, Homo sapiens
aagtacttctt

SEQ ID NO: 2003241 - DNA, 13 bp, Homo sapiens
aagtagaaatcat

SEQ ID NO: 2003242 - DNA, 15 bp, Homo sapiens
aagtagaaatcatag

SEQ ID NO: 2003243 - DNA, 15 bp, Homo sapiens
aagtagagaagtatc

SEQ ID NO: 2003244 - DNA, 21 bp, Homo sapiens
aagtagggacttctgtcttca

SEQ ID NO: 2003245 - DNA, 16 bp, Homo sapiens
aagtagtagtgtcttc

SEQ ID NO: 2003246 - DNA, 13 bp, Homo sapiens
aagtataaagtca

SEQ ID NO: 2003247 - DNA, 23 bp, Homo sapiens
aagtataaagtcacttccagtgt

SEQ ID NO: 2003248 - DNA, 22 bp, Homo sapiens
aagtatagaaaagatttaagta

SEQ ID NO: 2003249 - DNA, 16 bp, Homo sapiens
aagtatatatagaatc

SEQ ID NO: 2003250 - DNA, 23 bp, Homo sapiens
aagtatatattctacacatatat

SEQ ID NO: 2003251 - DNA, 19 bp, Homo sapiens
aagtatcatcagtgtagaa

SEQ ID NO: 2003252 - DNA, 17 bp, Homo sapiens
aagtatctacatgcggt

SEQ ID NO: 2003253 - DNA, 21 bp, Homo sapiens
aagtatgtaaacaggagacag

SEQ ID NO: 2003254 - DNA, 18 bp, Homo sapiens
aagtatgtgatatctgaa

SEQ ID NO: 2003255 - DNA, 18 bp, Homo sapiens
aagtattgcgaatgtgca

SEQ ID NO: 2003256 - DNA, 19 bp, Homo sapiens
aagtattgcgaatgtgcag

SEQ ID NO: 2003257 - DNA, 20 bp, Homo sapiens
aagtatttgttaatttagaa

SEQ ID NO: 2003258 - DNA, 18 bp, Homo sapiens
aagtattttatctgtgtt

SEQ ID NO: 2003259 - DNA, 14 bp, Homo sapiens
aagtcaacatcttc

SEQ ID NO: 2003260 - DNA, 13 bp, Homo sapiens
aagtcaaggagaa

SEQ ID NO: 2003261 - DNA, 14 bp, Homo sapiens
aagtcacacagaca

SEQ ID NO: 2003262 - DNA, 17 bp, Homo sapiens
aagtcacagctgcagct

SEQ ID NO: 2003263 - DNA, 19 bp, Homo sapiens
aagtcacagctgcagctgg

SEQ ID NO: 2003264 - DNA, 17 bp, Homo sapiens
aagtcacatcacaggac

SEQ ID NO: 2003265 - DNA, 22 bp, Homo sapiens
aagtcactgcacagtgcatctc

SEQ ID NO: 2003266 - DNA, 14 bp, Homo sapiens
aagtcacttccagt

SEQ ID NO: 2003267 - DNA, 17 bp, Homo sapiens
aagtcagactgctggga

SEQ ID NO: 2003268 - DNA, 18 bp, Homo sapiens
aagtcagtgggaacgtga

SEQ ID NO: 2003269 - DNA, 18 bp, Homo sapiens
aagtcagttggagaaaat

SEQ ID NO: 2003270 - DNA, 19 bp, Homo sapiens
aagtcatgatggagacttc

SEQ ID NO: 2003271 - DNA, 18 bp, Homo sapiens
aagtcattttaactttat

SEQ ID NO: 2003272 - DNA, 22 bp, Homo sapiens
aagtcattttaactttatcaca

SEQ ID NO: 2003273 - DNA, 16 bp, Homo sapiens
aagtccaacctgcctg

SEQ ID NO: 2003274 - DNA, 17 bp, Homo sapiens
aagtccaagcataccaa

SEQ ID NO: 2003275 - DNA, 18 bp, Homo sapiens
aagtccaggtcctggtgg

SEQ ID NO: 2003276 - DNA, 19 bp, Homo sapiens
aagtccctgactctctgtg

SEQ ID NO: 2003277 - DNA, 17 bp, Homo sapiens
aagtcctacaagctaaa

SEQ ID NO: 2003278 - DNA, 23 bp, Homo sapiens
aagtcctatcgactttatacaga

SEQ ID NO: 2003279 - DNA, 22 bp, Homo sapiens
aagtcctcttttctgagaggac

SEQ ID NO: 2003280 - DNA, 15 bp, Homo sapiens
aagtcgaattaatag

SEQ ID NO: 2003281 - DNA, 21 bp, Homo sapiens
aagtcgtccttactcctgtgg

SEQ ID NO: 2003282 - DNA, 22 bp, Homo sapiens
aagtcgtccttactcctgtggg

SEQ ID NO: 2003283 - DNA, 17 bp, Homo sapiens
aagtctaaagtttacag

SEQ ID NO: 2003284 - DNA, 14 bp, Homo sapiens
aagtctccttcccc

SEQ ID NO: 2003285 - DNA, 15 bp, Homo sapiens
aagtctctgctgcta

SEQ ID NO: 2003286 - DNA, 21 bp, Homo sapiens
aagtctctttttttactctta

SEQ ID NO: 2003287 - DNA, 22 bp, Homo sapiens
aagtctgagaatgcccaactct

SEQ ID NO: 2003288 - DNA, 18 bp, Homo sapiens
aagtctgggatgtagaac

SEQ ID NO: 2003289 - DNA, 22 bp, Homo sapiens
aagtctgtgtgatgaactttct

SEQ ID NO: 2003290 - DNA, 18 bp, Homo sapiens
aagtcttccctgatcaag

SEQ ID NO: 2003291 - DNA, 16 bp, Homo sapiens
aagtcttgagaaaaag

SEQ ID NO: 2003292 - DNA, 16 bp, Homo sapiens
aagtcttttttgatca

SEQ ID NO: 2003293 - DNA, 16 bp, Homo sapiens
aagtgaaatcaaaggt

SEQ ID NO: 2003294 - DNA, 15 bp, Homo sapiens
aagtgaataaacttc

SEQ ID NO: 2003295 - DNA, 20 bp, Homo sapiens
aagtgaataaacttcagcac

SEQ ID NO: 2003296 - DNA, 18 bp, Homo sapiens
aagtgaatacttggaagt

SEQ ID NO: 2003297 - DNA, 23 bp, Homo sapiens
actccatggccaccccgtgccac

SEQ ID NO: 2003298 - DNA, 21 bp, Homo sapiens
actccattactaaagacagaa

SEQ ID NO: 2003299 - DNA, 22 bp, Homo sapiens
actccattcccaactagacatt

SEQ ID NO: 2003300 - DNA, 16 bp, Homo sapiens
actcccacacccaaga

SEQ ID NO: 2003301 - DNA, 15 bp, Homo sapiens
actccccaggccagg

SEQ ID NO: 2003302 - DNA, 14 bp, Homo sapiens
actcccccacctga

SEQ ID NO: 2003303 - DNA, 15 bp, Homo sapiens
actccccgcctgtcc

SEQ ID NO: 2003304 - DNA, 14 bp, Homo sapiens
actcccctgatccc

SEQ ID NO: 2003305 - DNA, 20 bp, Homo sapiens
actccctaagaaaccccagg

SEQ ID NO: 2003306 - DNA, 23 bp, Homo sapiens
actccctccatgtggccccaggt

SEQ ID NO: 2003307 - DNA, 14 bp, Homo sapiens
actccctcccctgc

SEQ ID NO: 2003308 - DNA, 15 bp, Homo sapiens
actccctgggaaagg

SEQ ID NO: 2003309 - DNA, 22 bp, Homo sapiens
actccctgtgggggtggccatc

SEQ ID NO: 2003310 - DNA, 19 bp, Homo sapiens
actccggcctgatgacaga

SEQ ID NO: 2003311 - DNA, 20 bp, Homo sapiens
actccggtgtgcctgcagcc

SEQ ID NO: 2003312 - DNA, 21 bp, Homo sapiens
actccggtgtgcctgcagccc

SEQ ID NO: 2003313 - DNA, 16 bp, Homo sapiens
actcctacctcagcct

SEQ ID NO: 2003314 - DNA, 17 bp, Homo sapiens
actcctataaggagagt

SEQ ID NO: 2003315 - DNA, 20 bp, Homo sapiens
actcctcaaaagcaaatgag

SEQ ID NO: 2003316 - DNA, 22 bp, Homo sapiens
actcctcactgccccaccagcc

SEQ ID NO: 2003317 - DNA, 12 bp, Homo sapiens
actcctcccaca

SEQ ID NO: 2003318 - DNA, 13 bp, Homo sapiens
actcctcccacaa

SEQ ID NO: 2003319 - DNA, 20 bp, Homo sapiens
actcctccttgcctgctttt

SEQ ID NO: 2003320 - DNA, 23 bp, Homo sapiens
actcctctaagccactcttccaa

SEQ ID NO: 2003321 - DNA, 17 bp, Homo sapiens
actcctctgtctctgct

SEQ ID NO: 2003322 - DNA, 16 bp, Homo sapiens
actcctcttatttgct

SEQ ID NO: 2003323 - DNA, 15 bp, Homo sapiens
actcctgacagtctt

SEQ ID NO: 2003324 - DNA, 21 bp, Homo sapiens
actcctgacagtcttgtgctt

SEQ ID NO: 2003325 - DNA, 18 bp, Homo sapiens
actcctgcaaaattttat

SEQ ID NO: 2003326 - DNA, 10 bp, Homo sapiens
actcctgcct

SEQ ID NO: 2003327 - DNA, 18 bp, Homo sapiens
actcctgcctgtgtttgt

SEQ ID NO: 2003328 - DNA, 12 bp, Homo sapiens
actcctggaaat

SEQ ID NO: 2003329 - DNA, 14 bp, Homo sapiens
actcctggcctcaa

SEQ ID NO: 2003330 - DNA, 20 bp, Homo sapiens
actcctgtcccgccttcctc

SEQ ID NO: 2003331 - DNA, 22 bp, Homo sapiens
actcctgtgctctggaggctgc

SEQ ID NO: 2003332 - DNA, 17 bp, Homo sapiens
actcctgtgggagcctc

SEQ ID NO: 2003333 - DNA, 18 bp, Homo sapiens
actcctgtgggagcctcg

SEQ ID NO: 2003334 - DNA, 15 bp, Homo sapiens
agccaacaggtggca

SEQ ID NO: 2003335 - DNA, 21 bp, Homo sapiens
agccaacaggtggcaggacca

SEQ ID NO: 2003336 - DNA, 14 bp, Homo sapiens
agccaacttggctt

SEQ ID NO: 2003337 - DNA, 19 bp, Homo sapiens
agccaacttgtaaatacac

SEQ ID NO: 2003338 - DNA, 19 bp, Homo sapiens
agccaagcttcaaccctca

SEQ ID NO: 2003339 - DNA, 23 bp, Homo sapiens
agccaaggccctgagttggcagt

SEQ ID NO: 2003340 - DNA, 19 bp, Homo sapiens
agccaatatttactcatca

SEQ ID NO: 2003341 - DNA, 17 bp, Homo sapiens
agccacaaccacataca

SEQ ID NO: 2003342 - DNA, 19 bp, Homo sapiens
agccacaagaaatttgatt

SEQ ID NO: 2003343 - DNA, 18 bp, Homo sapiens
agccacacttctcaggac

SEQ ID NO: 2003344 - DNA, 10 bp, Homo sapiens
agccacagaa

SEQ ID NO: 2003345 - DNA, 22 bp, Homo sapiens
agccacagaagccaggagcaaa

SEQ ID NO: 2003346 - DNA, 16 bp, Homo sapiens
agccacagaccacctg

SEQ ID NO: 2003347 - DNA, 17 bp, Homo sapiens
agccacagaccacctgc

SEQ ID NO: 2003348 - DNA, 11 bp, Homo sapiens
agccacatccc

SEQ ID NO: 2003349 - DNA, 19 bp, Homo sapiens
agccaccctgaggagtctg

SEQ ID NO: 2003350 - DNA, 20 bp, Homo sapiens
agccaccctgaggagtctga

SEQ ID NO: 2003351 - DNA, 21 bp, Homo sapiens
agccaccctgaggagtctgag

SEQ ID NO: 2003352 - DNA, 21 bp, Homo sapiens
agccaccgtctacagatggct

SEQ ID NO: 2003353 - DNA, 12 bp, Homo sapiens
agccacctccca

SEQ ID NO: 2003354 - DNA, 17 bp, Homo sapiens
agccacctcccaaggac

SEQ ID NO: 2003355 - DNA, 14 bp, Homo sapiens
agccacctcccacc

SEQ ID NO: 2003356 - DNA, 17 bp, Homo sapiens
agccacctcccacccca

SEQ ID NO: 2003357 - DNA, 18 bp, Homo sapiens
agccacctcccaccccac

SEQ ID NO: 2003358 - DNA, 16 bp, Homo sapiens
agccaccttccagtga

SEQ ID NO: 2003359 - DNA, 18 bp, Homo sapiens
agccacgctgtcctctcg

SEQ ID NO: 2003360 - DNA, 23 bp, Homo sapiens
agccacgctgtcctctcgagccc

SEQ ID NO: 2003361 - DNA, 14 bp, Homo sapiens
agccacggccaggc

SEQ ID NO: 2003362 - DNA, 16 bp, Homo sapiens
agccacggccaggcca

SEQ ID NO: 2003363 - DNA, 17 bp, Homo sapiens
agccacggccaggccag

SEQ ID NO: 2003364 - DNA, 14 bp, Homo sapiens
agccacgtgaatgg

SEQ ID NO: 2003365 - DNA, 21 bp, Homo sapiens
agccacgttccttactgcaga

SEQ ID NO: 2003366 - DNA, 22 bp, Homo sapiens
agccacgttccttactgcagaa

SEQ ID NO: 2003367 - DNA, 15 bp, Homo sapiens
agccactcaggaggc

SEQ ID NO: 2003368 - DNA, 22 bp, Homo sapiens
agccactcaggaggctgaggca

SEQ ID NO: 2003369 - DNA, 14 bp, Homo sapiens
agccactcctgtcc

SEQ ID NO: 2003370 - DNA, 19 bp, Homo sapiens
agccactcctgtcccgcct

SEQ ID NO: 2003371 - DNA, 23 bp, Homo sapiens
agccactcctgtcccgccttcct

SEQ ID NO: 2003372 - DNA, 20 bp, Homo sapiens
agccactcgcagtcgcagga

SEQ ID NO: 2003373 - DNA, 13 bp, Homo sapiens
agccactgcaccg

SEQ ID NO: 2003374 - DNA, 16 bp, Homo sapiens
agccactgcaccgggc

SEQ ID NO: 2003375 - DNA, 18 bp, Homo sapiens
agccactgcaccgggcca

SEQ ID NO: 2003376 - DNA, 18 bp, Homo sapiens
agccactgtgctgaattc

SEQ ID NO: 2003377 - DNA, 17 bp, Homo sapiens
agccacttaccttcaat

SEQ ID NO: 2003378 - DNA, 18 bp, Homo sapiens
agccacttaccttcaata

SEQ ID NO: 2003379 - DNA, 21 bp, Homo sapiens
agccacttaccttcaataaag

SEQ ID NO: 2003380 - DNA, 14 bp, Homo sapiens
agccagaacctgga

SEQ ID NO: 2003381 - DNA, 13 bp, Homo sapiens
agccagacacatg

SEQ ID NO: 2003382 - DNA, 14 bp, Homo sapiens
agccagactggcac

SEQ ID NO: 2003383 - DNA, 19 bp, Homo sapiens
agccagactggcacagttt

SEQ ID NO: 2003384 - DNA, 12 bp, Homo sapiens
agccagagagga

SEQ ID NO: 2003385 - DNA, 20 bp, Homo sapiens
agccagagaggagcacctga

SEQ ID NO: 2003386 - DNA, 13 bp, Homo sapiens
agccagagcctgg

SEQ ID NO: 2003387 - DNA, 18 bp, Homo sapiens
agccagattttttaaaat

SEQ ID NO: 2003388 - DNA, 22 bp, Homo sapiens
agccagattttttaaaatttat

SEQ ID NO: 2003389 - DNA, 14 bp, Homo sapiens
agccagcagccagc

SEQ ID NO: 2003390 - DNA, 13 bp, Homo sapiens
agccagccctccc

SEQ ID NO: 2003391 - DNA, 15 bp, Homo sapiens
agccagccctccctg

SEQ ID NO: 2003392 - DNA, 16 bp, Homo sapiens
agccagccctccctgt

SEQ ID NO: 2003393 - DNA, 20 bp, Homo sapiens
agccagccctccctgtcctc

SEQ ID NO: 2003394 - DNA, 23 bp, Homo sapiens
agccagccctccctgtcctcctc

SEQ ID NO: 2003395 - DNA, 18 bp, Homo sapiens
agccagccctgcctggag

SEQ ID NO: 2003396 - DNA, 21 bp, Homo sapiens
agccagccctgcctggaggac

SEQ ID NO: 2003397 - DNA, 22 bp, Homo sapiens
agccagccgccctgggctgtct

SEQ ID NO: 2003398 - DNA, 19 bp, Homo sapiens
agccagccggggcgagtgg

SEQ ID NO: 2003399 - DNA, 15 bp, Homo sapiens
agccagccggtgcct

SEQ ID NO: 2003400 - DNA, 15 bp, Homo sapiens
agccagcctgggact

SEQ ID NO: 2003401 - DNA, 11 bp, Homo sapiens
agccagctctc

SEQ ID NO: 2003402 - DNA, 15 bp, Homo sapiens
agccagctctcagcc

SEQ ID NO: 2003403 - DNA, 16 bp, Homo sapiens
agccagctctcagcca

SEQ ID NO: 2003404 - DNA, 20 bp, Homo sapiens
agccagctgccgaccagagc

SEQ ID NO: 2003405 - DNA, 14 bp, Homo sapiens
agccaggagtctgt

SEQ ID NO: 2003406 - DNA, 12 bp, Homo sapiens
agccaggctctg

SEQ ID NO: 2003407 - DNA, 13 bp, Homo sapiens
agccaggctctgc

SEQ ID NO: 2003408 - DNA, 14 bp, Homo sapiens
agccagggccaggg

SEQ ID NO: 2003409 - DNA, 14 bp, Homo sapiens
agccaggggctgct

SEQ ID NO: 2003410 - DNA, 17 bp, Homo sapiens
agccaggggctgctcat

SEQ ID NO: 2003411 - DNA, 17 bp, Homo sapiens
agccatattcacacctc

SEQ ID NO: 2003412 - DNA, 17 bp, Homo sapiens
agccatcaagagactga

SEQ ID NO: 2003413 - DNA, 22 bp, Homo sapiens
agccatctccatcttgaaggaa

SEQ ID NO: 2003414 - DNA, 19 bp, Homo sapiens
agccatgaggagttgctgt

SEQ ID NO: 2003415 - DNA, 18 bp, Homo sapiens
agccatgataactgcaat

SEQ ID NO: 2003416 - DNA, 21 bp, Homo sapiens
agccatgatcgagccactgca

SEQ ID NO: 2003417 - DNA, 15 bp, Homo sapiens
agccatgcctcatgc

SEQ ID NO: 2003418 - DNA, 12 bp, Homo sapiens
agccatggctca

SEQ ID NO: 2003419 - DNA, 16 bp, Homo sapiens
agccatggctcaggca

SEQ ID NO: 2003420 - DNA, 20 bp, Homo sapiens
agccatggctcaggcaagcc

SEQ ID NO: 2003421 - DNA, 18 bp, Homo sapiens
agccatgggcctgggcct

SEQ ID NO: 2003422 - DNA, 19 bp, Homo sapiens
agccatgggcctgggcctg

SEQ ID NO: 2003423 - DNA, 19 bp, Homo sapiens
agccatgtaccagtgtact

SEQ ID NO: 2003424 - DNA, 18 bp, Homo sapiens
agccattaccatggagac

SEQ ID NO: 2003425 - DNA, 13 bp, Homo sapiens
agcccaaagaagg

SEQ ID NO: 2003426 - DNA, 16 bp, Homo sapiens
agcccaaagctgttgg

SEQ ID NO: 2003427 - DNA, 22 bp, Homo sapiens
agcccaaatggctctgtgaaat

SEQ ID NO: 2003428 - DNA, 23 bp, Homo sapiens
agcccaacagacaccatcttttg

SEQ ID NO: 2003429 - DNA, 19 bp, Homo sapiens
agcccaagaggtctgagcc

SEQ ID NO: 2003430 - DNA, 20 bp, Homo sapiens
agcccaagaggtctgagccc

SEQ ID NO: 2003431 - DNA, 14 bp, Homo sapiens
agcccaagtgccat

SEQ ID NO: 2003432 - DNA, 15 bp, Homo sapiens
agcccaagtgccatc

SEQ ID NO: 2003433 - DNA, 16 bp, Homo sapiens
agcccaagtgccatcc

SEQ ID NO: 2003434 - DNA, 19 bp, Homo sapiens
agcccaagtgccatcccac

SEQ ID NO: 2003435 - DNA, 15 bp, Homo sapiens
agcccacacccctcc

SEQ ID NO: 2003436 - DNA, 16 bp, Homo sapiens
agcccacagagcctga

SEQ ID NO: 2003437 - DNA, 21 bp, Homo sapiens
agcccacagcagcaatatgct

SEQ ID NO: 2003438 - DNA, 23 bp, Homo sapiens
agcccacgcccgactagcaggca

SEQ ID NO: 2003439 - DNA, 22 bp, Homo sapiens
agcccacttctgccatattctg

SEQ ID NO: 2003440 - DNA, 15 bp, Homo sapiens
agcccacttgtcatc

SEQ ID NO: 2003441 - DNA, 19 bp, Homo sapiens
agcccagaaaacctccagt

SEQ ID NO: 2003442 - DNA, 13 bp, Homo sapiens
agcccagagggcc

SEQ ID NO: 2003443 - DNA, 20 bp, Homo sapiens
agcccagcactgtgaagacc

SEQ ID NO: 2003444 - DNA, 13 bp, Homo sapiens
agcccagccacct

SEQ ID NO: 2003445 - DNA, 15 bp, Homo sapiens
agcccagcccagctg

SEQ ID NO: 2003446 - DNA, 15 bp, Homo sapiens
agcccagcctctgtc

SEQ ID NO: 2003447 - DNA, 17 bp, Homo sapiens
agcccagcctctgtccc

SEQ ID NO: 2003448 - DNA, 23 bp, Homo sapiens
agcccagcctctgtccctctttg

SEQ ID NO: 2003449 - DNA, 17 bp, Homo sapiens
agcccagctctgctttt

SEQ ID NO: 2003450 - DNA, 14 bp, Homo sapiens
agcccagcttcctg

SEQ ID NO: 2003451 - DNA, 18 bp, Homo sapiens
agccgccgggcaggcctg

SEQ ID NO: 2003452 - DNA, 19 bp, Homo sapiens
agccgccgggcaggcctgc

SEQ ID NO: 2003453 - DNA, 14 bp, Homo sapiens
agccgctcctgtct

SEQ ID NO: 2003454 - DNA, 16 bp, Homo sapiens
agccgctcctgtctgc

SEQ ID NO: 2003455 - DNA, 16 bp, Homo sapiens
agccgctgtgagcccc

SEQ ID NO: 2003456 - DNA, 20 bp, Homo sapiens
agccggaccaagatgggcac

SEQ ID NO: 2003457 - DNA, 16 bp, Homo sapiens
agccggctcttcaaag

SEQ ID NO: 2003458 - DNA, 23 bp, Homo sapiens
agccgggaacagacaacagaagt

SEQ ID NO: 2003459 - DNA, 13 bp, Homo sapiens
agccgggcaagtc

SEQ ID NO: 2003460 - DNA, 13 bp, Homo sapiens
agccgggcctggg

SEQ ID NO: 2003461 - DNA, 15 bp, Homo sapiens
agccgtactgtctat

SEQ ID NO: 2003462 - DNA, 16 bp, Homo sapiens
agccgtccatggcacc

SEQ ID NO: 2003463 - DNA, 21 bp, Homo sapiens
agccgtccatggcaccagccc

SEQ ID NO: 2003464 - DNA, 24 bp, Homo sapiens
agccgtctgactccagagtctgag

SEQ ID NO: 2003465 - DNA, 17 bp, Homo sapiens
agccgtgatgctcaggc

SEQ ID NO: 2003466 - DNA, 18 bp, Homo sapiens
agccgtgatgctcaggct

SEQ ID NO: 2003467 - DNA, 20 bp, Homo sapiens
agccgtgatgctcaggcttg

SEQ ID NO: 2003468 - DNA, 17 bp, Homo sapiens
agccgtgccttcagctc

SEQ ID NO: 2003469 - DNA, 21 bp, Homo sapiens
agccgtgcctttctctggctc

SEQ ID NO: 2003470 - DNA, 23 bp, Homo sapiens
agccgtgctcgcccacaaactga

SEQ ID NO: 2003471 - DNA, 19 bp, Homo sapiens
agcctaaataaaaagtata

SEQ ID NO: 2003472 - DNA, 19 bp, Homo sapiens
agcctaaatctaatcaggt

SEQ ID NO: 2003473 - DNA, 13 bp, Homo sapiens
agcctaagaagct

SEQ ID NO: 2003474 - DNA, 12 bp, Homo sapiens
agcctaatgaaa

SEQ ID NO: 2003475 - DNA, 14 bp, Homo sapiens
agcctaatgaaagg

SEQ ID NO: 2003476 - DNA, 23 bp, Homo sapiens
agcctacccttgtaccccatccc

SEQ ID NO: 2003477 - DNA, 17 bp, Homo sapiens
agcctagccacctccca

SEQ ID NO: 2003478 - DNA, 20 bp, Homo sapiens
agcctattagatgttttaca

SEQ ID NO: 2003479 - DNA, 15 bp, Homo sapiens
agcctatttttcaaa

SEQ ID NO: 2003480 - DNA, 18 bp, Homo sapiens
agcctcaacctcctgggc

SEQ ID NO: 2003481 - DNA, 17 bp, Homo sapiens
agcctcacttgaatgtg

SEQ ID NO: 2003482 - DNA, 23 bp, Homo sapiens
agcctcacttttaatgaacaaat

SEQ ID NO: 2003483 - DNA, 13 bp, Homo sapiens
agcctcagcatcc

SEQ ID NO: 2003484 - DNA, 21 bp, Homo sapiens
agcctcagcatcctggcaccc

SEQ ID NO: 2003485 - DNA, 22 bp, Homo sapiens
agcctcagcatcctggcacccg

SEQ ID NO: 2003486 - DNA, 13 bp, Homo sapiens
agcctcagtgcca

SEQ ID NO: 2003487 - DNA, 14 bp, Homo sapiens
agcctcagtgccac

SEQ ID NO: 2003488 - DNA, 15 bp, Homo sapiens
agcctcatatttaaa

SEQ ID NO: 2003489 - DNA, 16 bp, Homo sapiens
agcctcatatttaaag

SEQ ID NO: 2003490 - DNA, 17 bp, Homo sapiens
agcctcatatttaaaga

SEQ ID NO: 2003491 - DNA, 17 bp, Homo sapiens
agcctcatccgaggcag

SEQ ID NO: 2003492 - DNA, 12 bp, Homo sapiens
agcctccagagc

SEQ ID NO: 2003493 - DNA, 14 bp, Homo sapiens
agcctccagagcca

SEQ ID NO: 2003494 - DNA, 16 bp, Homo sapiens
agcctccagagccagc

SEQ ID NO: 2003495 - DNA, 17 bp, Homo sapiens
agcctccatgctgcctc

SEQ ID NO: 2003496 - DNA, 19 bp, Homo sapiens
agcctccatttctggcttc

SEQ ID NO: 2003497 - DNA, 21 bp, Homo sapiens
agcctcccaaagtgctgggat

SEQ ID NO: 2003498 - DNA, 15 bp, Homo sapiens
agcctccccctcaga

SEQ ID NO: 2003499 - DNA, 23 bp, Homo sapiens
agcctccccctcagatgatctct

SEQ ID NO: 2003500 - DNA, 15 bp, Homo sapiens
agcctccccctgctg

SEQ ID NO: 2003501 - DNA, 18 bp, Homo sapiens
agcctccccctgctgctc

SEQ ID NO: 2003502 - DNA, 19 bp, Homo sapiens
agcctccccctgctgctca

SEQ ID NO: 2003503 - DNA, 22 bp, Homo sapiens
agcctcccgaatagctgggact

SEQ ID NO: 2003504 - DNA, 17 bp, Homo sapiens
agcctcccgagtagctg

SEQ ID NO: 2003505 - DNA, 18 bp, Homo sapiens
agcctccctcctcgtccc

SEQ ID NO: 2003506 - DNA, 15 bp, Homo sapiens
agcctccctctgacc

SEQ ID NO: 2003507 - DNA, 22 bp, Homo sapiens
agcctccctctgacctgcaggc

SEQ ID NO: 2003508 - DNA, 17 bp, Homo sapiens
agcctccgccattccaa

SEQ ID NO: 2003509 - DNA, 16 bp, Homo sapiens
agcctccgtcaggaga

SEQ ID NO: 2003510 - DNA, 18 bp, Homo sapiens
agcctccgtttatgggcc

SEQ ID NO: 2003511 - DNA, 18 bp, Homo sapiens
agcctcctaagcagctgg

SEQ ID NO: 2003512 - DNA, 19 bp, Homo sapiens
agcctcctcctgaccacgg

SEQ ID NO: 2003513 - DNA, 21 bp, Homo sapiens
agcctctcccggctgcctgcc

SEQ ID NO: 2003514 - DNA, 15 bp, Homo sapiens
agcctctctgctata

SEQ ID NO: 2003515 - DNA, 15 bp, Homo sapiens
agcctctgccccaag

SEQ ID NO: 2003516 - DNA, 20 bp, Homo sapiens
agcctctgccccaaggggcc

SEQ ID NO: 2003517 - DNA, 14 bp, Homo sapiens
agcctctgccctgc

SEQ ID NO: 2003518 - DNA, 18 bp, Homo sapiens
agcctctgccctgcctcc

SEQ ID NO: 2003519 - DNA, 19 bp, Homo sapiens
agcctctgccctgcctccc

SEQ ID NO: 2003520 - DNA, 13 bp, Homo sapiens
agcctctgctgcc

SEQ ID NO: 2003521 - DNA, 18 bp, Homo sapiens
agcctctgctgccatggc

SEQ ID NO: 2003522 - DNA, 22 bp, Homo sapiens
agcctctgtcccccttggagga

SEQ ID NO: 2003523 - DNA, 15 bp, Homo sapiens
agcctctgtccctct

SEQ ID NO: 2003524 - DNA, 14 bp, Homo sapiens
agcctcttctgcca

SEQ ID NO: 2003525 - DNA, 20 bp, Homo sapiens
agcctcttctgccaagagag

SEQ ID NO: 2003526 - DNA, 20 bp, Homo sapiens
agcctcttttcaattatttc

SEQ ID NO: 2003527 - DNA, 17 bp, Homo sapiens
agcctgacaacatttct

SEQ ID NO: 2003528 - DNA, 16 bp, Homo sapiens
agcctgagtctcctgt

SEQ ID NO: 2003529 - DNA, 17 bp, Homo sapiens
agcctgagtctcctgtg

SEQ ID NO: 2003530 - DNA, 16 bp, Homo sapiens
agcctgatggccaagg

SEQ ID NO: 2003531 - DNA, 23 bp, Homo sapiens
agcctgatggccaagggggtgga

SEQ ID NO: 2003532 - DNA, 18 bp, Homo sapiens
agcctgcaaactcactgc

SEQ ID NO: 2003533 - DNA, 19 bp, Homo sapiens
agcctgcaaactcactgct

SEQ ID NO: 2003534 - DNA, 23 bp, Homo sapiens
agcctgcagttattaacactaac

SEQ ID NO: 2003535 - DNA, 15 bp, Homo sapiens
agcctgcctcagctg

SEQ ID NO: 2003536 - DNA, 15 bp, Homo sapiens
agcctgctcccccac

SEQ ID NO: 2003537 - DNA, 22 bp, Homo sapiens
agcctgctccttcccaggagtg

SEQ ID NO: 2003538 - DNA, 20 bp, Homo sapiens
agcctggaagggaagtgaga

SEQ ID NO: 2003539 - DNA, 20 bp, Homo sapiens
agcctggactctaagctgga

SEQ ID NO: 2003540 - DNA, 23 bp, Homo sapiens
agcctggactctaagctggagct

SEQ ID NO: 2003541 - DNA, 14 bp, Homo sapiens
agcctggactttgg

SEQ ID NO: 2003542 - DNA, 21 bp, Homo sapiens
agcctggactttggttctctc

SEQ ID NO: 2003543 - DNA, 14 bp, Homo sapiens
agcctggagaagct

SEQ ID NO: 2003544 - DNA, 17 bp, Homo sapiens
agcctggagggatgcca

SEQ ID NO: 2003545 - DNA, 16 bp, Homo sapiens
agcctggcacaggact

SEQ ID NO: 2003546 - DNA, 14 bp, Homo sapiens
agcctggccaacat

SEQ ID NO: 2003547 - DNA, 15 bp, Homo sapiens
agcctggccatcccc

SEQ ID NO: 2003548 - DNA, 13 bp, Homo sapiens
agcctggcctcct

SEQ ID NO: 2003549 - DNA, 16 bp, Homo sapiens
agcctggcctcctgcc

SEQ ID NO: 2003550 - DNA, 19 bp, Homo sapiens
agcctggcctcctgcctct

SEQ ID NO: 2003551 - DNA, 15 bp, Homo sapiens
agcctggcggggcag

SEQ ID NO: 2003552 - DNA, 18 bp, Homo sapiens
agcctggcggggcaggag

SEQ ID NO: 2003553 - DNA, 19 bp, Homo sapiens
agcctggcggggcaggagg

SEQ ID NO: 2003554 - DNA, 20 bp, Homo sapiens
agcctggcggggcaggaggc

SEQ ID NO: 2003555 - DNA, 21 bp, Homo sapiens
agcctggcggggcaggaggcc

SEQ ID NO: 2003556 - DNA, 22 bp, Homo sapiens
agcctggcggggcaggaggcct

SEQ ID NO: 2003557 - DNA, 15 bp, Homo sapiens
agcctggcttctgga

SEQ ID NO: 2003558 - DNA, 19 bp, Homo sapiens
agcctggcttctggagccc

SEQ ID NO: 2003559 - DNA, 14 bp, Homo sapiens
agcctgggaccagg

SEQ ID NO: 2003560 - DNA, 17 bp, Homo sapiens
agcctgggactcccagt

SEQ ID NO: 2003561 - DNA, 18 bp, Homo sapiens
agcctgggactcccagtg

SEQ ID NO: 2003562 - DNA, 18 bp, Homo sapiens
agcctgggcaacagagca

SEQ ID NO: 2003563 - DNA, 22 bp, Homo sapiens
agcctgggcctatggagagccc

SEQ ID NO: 2003564 - DNA, 23 bp, Homo sapiens
agcctgggcctatggagagccct

SEQ ID NO: 2003565 - DNA, 16 bp, Homo sapiens
agcctggggcatccca

SEQ ID NO: 2003566 - DNA, 13 bp, Homo sapiens
agcctggggctct

SEQ ID NO: 2003567 - DNA, 14 bp, Homo sapiens
agcctggggctcta

SEQ ID NO: 2003568 - DNA, 16 bp, Homo sapiens
agcctggggctctaac

SEQ ID NO: 2003569 - DNA, 21 bp, Homo sapiens
agcctggggctctaacgcctg

SEQ ID NO: 2003570 - DNA, 13 bp, Homo sapiens
agcctgggtgaga

SEQ ID NO: 2003571 - DNA, 21 bp, Homo sapiens
agcctgggtgagaatcctgcc

SEQ ID NO: 2003572 - DNA, 22 bp, Homo sapiens
agcctgggtgagaatcctgcct

SEQ ID NO: 2003573 - DNA, 16 bp, Homo sapiens
agcctggtgggcctcc

SEQ ID NO: 2003574 - DNA, 21 bp, Homo sapiens
agcctggtgggcctcctctgt

SEQ ID NO: 2003575 - DNA, 22 bp, Homo sapiens
agcctggtgggcctcctctgtc

SEQ ID NO: 2003576 - DNA, 17 bp, Homo sapiens
agcctggttttcacata

SEQ ID NO: 2003577 - DNA, 17 bp, Homo sapiens
agcctgtaatcccagct

SEQ ID NO: 2003578 - DNA, 14 bp, Homo sapiens
agcctgtcacgtgg

SEQ ID NO: 2003579 - DNA, 17 bp, Homo sapiens
agcctgtcacgtggtca

SEQ ID NO: 2003580 - DNA, 13 bp, Homo sapiens
agcctgtcctggt

SEQ ID NO: 2003581 - DNA, 14 bp, Homo sapiens
agcctgtcctggta

SEQ ID NO: 2003582 - DNA, 22 bp, Homo sapiens
agcctgtcctggtacagcaggg

SEQ ID NO: 2003583 - DNA, 15 bp, Homo sapiens
agcctgtgaacccag

SEQ ID NO: 2003584 - DNA, 22 bp, Homo sapiens
agcctgtgaataaaaaccctgt

SEQ ID NO: 2003585 - DNA, 13 bp, Homo sapiens
agcctgtgccacc

SEQ ID NO: 2003586 - DNA, 15 bp, Homo sapiens
agcctgtgccacctg

SEQ ID NO: 2003587 - DNA, 16 bp, Homo sapiens
agcctgtgccacctgc

SEQ ID NO: 2003588 - DNA, 17 bp, Homo sapiens
agcctgtgccacctgca

SEQ ID NO: 2003589 - DNA, 11 bp, Homo sapiens
agcctgtggga

SEQ ID NO: 2003590 - DNA, 20 bp, Homo sapiens
agcctgtgggagtagaaaaa

SEQ ID NO: 2003591 - DNA, 14 bp, Homo sapiens
agcctgtgtgttct

SEQ ID NO: 2003592 - DNA, 19 bp, Homo sapiens
agcctgttcatggcagatg

SEQ ID NO: 2003593 - DNA, 20 bp, Homo sapiens
agcctgttgttcccatctgc

SEQ ID NO: 2003594 - DNA, 18 bp, Homo sapiens
agcctgttttgttggaag

SEQ ID NO: 2003595 - DNA, 19 bp, Homo sapiens
agccttcacaaccagccac

SEQ ID NO: 2003596 - DNA, 22 bp, Homo sapiens
agccttcataggcggtcatgtg

SEQ ID NO: 2003597 - DNA, 12 bp, Homo sapiens
agccttctctct

SEQ ID NO: 2003598 - DNA, 14 bp, Homo sapiens
agccttctctctct

SEQ ID NO: 2003599 - DNA, 16 bp, Homo sapiens
agccttctctctctgg

SEQ ID NO: 2003600 - DNA, 17 bp, Homo sapiens
agccttctctctctggt

SEQ ID NO: 2003601 - DNA, 14 bp, Homo sapiens
agccttctctgttc

SEQ ID NO: 2003602 - DNA, 20 bp, Homo sapiens
agccttctctgttcatttcc

SEQ ID NO: 2003603 - DNA, 21 bp, Homo sapiens
agccttctctgttcatttcct

SEQ ID NO: 2003604 - DNA, 23 bp, Homo sapiens
agccttctctgttcatttcctca

SEQ ID NO: 2003605 - DNA, 18 bp, Homo sapiens
agccttgcactgtggggg

SEQ ID NO: 2003606 - DNA, 20 bp, Homo sapiens
agccttgctagacagccagg

SEQ ID NO: 2003607 - DNA, 19 bp, Homo sapiens
agccttggataatgctgtt

SEQ ID NO: 2003608 - DNA, 20 bp, Homo sapiens
agccttggataatgctgttg

SEQ ID NO: 2003609 - DNA, 19 bp, Homo sapiens
agccttgtgccctgccccc

SEQ ID NO: 2003610 - DNA, 13 bp, Homo sapiens
agcctttctgtgg

SEQ ID NO: 2003611 - DNA, 20 bp, Homo sapiens
agcctttggatgaccagaac

SEQ ID NO: 2003612 - DNA, 14 bp, Homo sapiens
agccttttcttata

SEQ ID NO: 2003613 - DNA, 18 bp, Homo sapiens
agcgaaccaatatttgta

SEQ ID NO: 2003614 - DNA, 16 bp, Homo sapiens
agcgaactagaagaaa

SEQ ID NO: 2003615 - DNA, 20 bp, Homo sapiens
agcgaagggggtcaaaggaa

SEQ ID NO: 2003616 - DNA, 16 bp, Homo sapiens
agcgaatcatctcaaa

SEQ ID NO: 2003617 - DNA, 17 bp, Homo sapiens
agcgagctgctctgcta

SEQ ID NO: 2003618 - DNA, 15 bp, Homo sapiens
agcgagggcgtgtct

SEQ ID NO: 2003619 - DNA, 19 bp, Homo sapiens
agcgaggtcaacagagaag

SEQ ID NO: 2003620 - DNA, 22 bp, Homo sapiens
agcgaggtcaacagagaaggca

SEQ ID NO: 2003621 - DNA, 21 bp, Homo sapiens
agcgagttgtggaaagcctct

SEQ ID NO: 2003622 - DNA, 19 bp, Homo sapiens
agcgattccctctcccagg

SEQ ID NO: 2003623 - DNA, 20 bp, Homo sapiens
agcgattccctctcccaggc

SEQ ID NO: 2003624 - DNA, 21 bp, Homo sapiens
agcgattccctctcccaggcc

SEQ ID NO: 2003625 - DNA, 15 bp, Homo sapiens
agcgattcttctgct

SEQ ID NO: 2003626 - DNA, 19 bp, Homo sapiens
agcgattcttctgcttcag

SEQ ID NO: 2003627 - DNA, 19 bp, Homo sapiens
agcgattcttgtgcctcag

SEQ ID NO: 2003628 - DNA, 20 bp, Homo sapiens
agcgattcttgtgcctcagc

SEQ ID NO: 2003629 - DNA, 12 bp, Homo sapiens
agcgcacctgcc

SEQ ID NO: 2003630 - DNA, 21 bp, Homo sapiens
agcgcacctgccccctggtgg

SEQ ID NO: 2003631 - DNA, 14 bp, Homo sapiens
agcgcagggaggat

SEQ ID NO: 2003632 - DNA, 18 bp, Homo sapiens
agcgcagggaggatgcca

SEQ ID NO: 2003633 - DNA, 22 bp, Homo sapiens
agcgcccagttgggtggatgcc

SEQ ID NO: 2003634 - DNA, 13 bp, Homo sapiens
agcgccctgcaga

SEQ ID NO: 2003635 - DNA, 16 bp, Homo sapiens
agcgccctgcagaccc

SEQ ID NO: 2003636 - DNA, 13 bp, Homo sapiens
agcgcctccctcc

SEQ ID NO: 2003637 - DNA, 14 bp, Homo sapiens
agcgcctccctcca

SEQ ID NO: 2003638 - DNA, 18 bp, Homo sapiens
agcgcctccctccacccc

SEQ ID NO: 2003639 - DNA, 19 bp, Homo sapiens
agcgcctccctccacccca

SEQ ID NO: 2003640 - DNA, 20 bp, Homo sapiens
agcgcctccctccaccccag

SEQ ID NO: 2003641 - DNA, 15 bp, Homo sapiens
agcgcctgccctccc

SEQ ID NO: 2003642 - DNA, 20 bp, Homo sapiens
agcgcctgccctccctgggg

SEQ ID NO: 2003643 - DNA, 21 bp, Homo sapiens
agcgcctgccctccctggggt

SEQ ID NO: 2003644 - DNA, 20 bp, Homo sapiens
agcgcctgtgctgaggactc

SEQ ID NO: 2003645 - DNA, 17 bp, Homo sapiens
agcgcggcttggccgcc

SEQ ID NO: 2003646 - DNA, 19 bp, Homo sapiens
agcgcggcttggccgccat

SEQ ID NO: 2003647 - DNA, 12 bp, Homo sapiens
agcgcgggcgga

SEQ ID NO: 2003648 - DNA, 18 bp, Homo sapiens
agcgcgggcggaggcggc

SEQ ID NO: 2003649 - DNA, 14 bp, Homo sapiens
agcgcgtgcacagc

SEQ ID NO: 2003650 - DNA, 18 bp, Homo sapiens
agcgctatcttcacatag

SEQ ID NO: 2003651 - DNA, 18 bp, Homo sapiens
agcggaggagaccagctc

SEQ ID NO: 2003652 - DNA, 16 bp, Homo sapiens
agcggctgagtcatga

SEQ ID NO: 2003653 - DNA, 20 bp, Homo sapiens
agcggctgggtggtgaagga

SEQ ID NO: 2003654 - DNA, 19 bp, Homo sapiens
agcggggacagctccttct

SEQ ID NO: 2003655 - DNA, 20 bp, Homo sapiens
agcggggacagctccttctg

SEQ ID NO: 2003656 - DNA, 22 bp, Homo sapiens
agcggggacagctccttctgtc

SEQ ID NO: 2003657 - DNA, 15 bp, Homo sapiens
agcgtagacatatat

SEQ ID NO: 2003658 - DNA, 17 bp, Homo sapiens
agcgtccctagcagtga

SEQ ID NO: 2003659 - DNA, 22 bp, Homo sapiens
agcgtggccttgttctgtcacc

SEQ ID NO: 2003660 - DNA, 15 bp, Homo sapiens
agctaaaacctgagc

SEQ ID NO: 2003661 - DNA, 16 bp, Homo sapiens
agctaaagcccaacct

SEQ ID NO: 2003662 - DNA, 13 bp, Homo sapiens
agctaacagggaa

SEQ ID NO: 2003663 - DNA, 23 bp, Homo sapiens
agctaacagggaaggcaggcagg

SEQ ID NO: 2003664 - DNA, 17 bp, Homo sapiens
agctaacattttaaata

SEQ ID NO: 2003665 - DNA, 20 bp, Homo sapiens
agctaacattttaaataaaa

SEQ ID NO: 2003666 - DNA, 23 bp, Homo sapiens
agctaacccccttctactgagcc

SEQ ID NO: 2003667 - DNA, 19 bp, Homo sapiens
agctaagccttatgtgagc

SEQ ID NO: 2003668 - DNA, 18 bp, Homo sapiens
agctaaggaagggaaagg

SEQ ID NO: 2003669 - DNA, 22 bp, Homo sapiens
agctaaggaagggaaagggaag

SEQ ID NO: 2003670 - DNA, 16 bp, Homo sapiens
agctaatcagcattct

SEQ ID NO: 2003671 - DNA, 19 bp, Homo sapiens
agctaatctgtagggctgg

SEQ ID NO: 2003672 - DNA, 20 bp, Homo sapiens
agctaatctgtagggctgga

SEQ ID NO: 2003673 - DNA, 15 bp, Homo sapiens
agctaatgggacact

SEQ ID NO: 2003674 - DNA, 21 bp, Homo sapiens
agctacactattgcattgttc

SEQ ID NO: 2003675 - DNA, 13 bp, Homo sapiens
agctacattcctc

SEQ ID NO: 2003676 - DNA, 17 bp, Homo sapiens
agctacattcctcagct

SEQ ID NO: 2003677 - DNA, 19 bp, Homo sapiens
agctacccaaaagagaaaa

SEQ ID NO: 2003678 - DNA, 20 bp, Homo sapiens
agctacctgtgtggacagga

SEQ ID NO: 2003679 - DNA, 22 bp, Homo sapiens
agctacctgtgtggacaggact

SEQ ID NO: 2003680 - DNA, 21 bp, Homo sapiens
agctactcaagaggctgaggc

SEQ ID NO: 2003681 - DNA, 14 bp, Homo sapiens
agctactcagaagc

SEQ ID NO: 2003682 - DNA, 18 bp, Homo sapiens
agctactcaggaggctga

SEQ ID NO: 2003683 - DNA, 17 bp, Homo sapiens
agcccagcttcctggtg

SEQ ID NO: 2003684 - DNA, 11 bp, Homo sapiens
agcccaggccg

SEQ ID NO: 2003685 - DNA, 13 bp, Homo sapiens
agcccaggccgtt

SEQ ID NO: 2003686 - DNA, 12 bp, Homo sapiens
agcccaggctga

SEQ ID NO: 2003687 - DNA, 23 bp, Homo sapiens
agcccaggctggagatcctaact

SEQ ID NO: 2003688 - DNA, 23 bp, Homo sapiens
agcccaggtcctctgatacccag

SEQ ID NO: 2003689 - DNA, 14 bp, Homo sapiens
agcccagtgacctg

SEQ ID NO: 2003690 - DNA, 16 bp, Homo sapiens
agcccagtgacctgac

SEQ ID NO: 2003691 - DNA, 14 bp, Homo sapiens
agcccagtgcttct

SEQ ID NO: 2003692 - DNA, 16 bp, Homo sapiens
agcccagtttcccttc

SEQ ID NO: 2003693 - DNA, 19 bp, Homo sapiens
agcccatgctcaaccactg

SEQ ID NO: 2003694 - DNA, 16 bp, Homo sapiens
agcccatggcctctgg

SEQ ID NO: 2003695 - DNA, 19 bp, Homo sapiens
agcccattctctctcctgt

SEQ ID NO: 2003696 - DNA, 18 bp, Homo sapiens
agccccaagccatggtga

SEQ ID NO: 2003697 - DNA, 12 bp, Homo sapiens
agccccacagca

SEQ ID NO: 2003698 - DNA, 21 bp, Homo sapiens
agccccacagcacccaggctc

SEQ ID NO: 2003699 - DNA, 19 bp, Homo sapiens
agccccactcccggccagg

SEQ ID NO: 2003700 - DNA, 12 bp, Homo sapiens
agccccagcaag

SEQ ID NO: 2003701 - DNA, 15 bp, Homo sapiens
agccccaggcctctg

SEQ ID NO: 2003702 - DNA, 12 bp, Homo sapiens
agccccagggcc

SEQ ID NO: 2003703 - DNA, 13 bp, Homo sapiens
agccccaggggtg

SEQ ID NO: 2003704 - DNA, 13 bp, Homo sapiens
agccccagtgccc

SEQ ID NO: 2003705 - DNA, 14 bp, Homo sapiens
agccccagtgccca

SEQ ID NO: 2003706 - DNA, 22 bp, Homo sapiens
agccccatcttggtcctgtcac

SEQ ID NO: 2003707 - DNA, 17 bp, Homo sapiens
agccccattctgcctgc

SEQ ID NO: 2003708 - DNA, 20 bp, Homo sapiens
agcccccaaccccgcggtgc

SEQ ID NO: 2003709 - DNA, 12 bp, Homo sapiens
agcccccaagcc

SEQ ID NO: 2003710 - DNA, 16 bp, Homo sapiens
agcccccaagcctctg

SEQ ID NO: 2003711 - DNA, 21 bp, Homo sapiens
agcccccacctccgccccaga

SEQ ID NO: 2003712 - DNA, 20 bp, Homo sapiens
agccccccacctttctcgct

SEQ ID NO: 2003713 - DNA, 19 bp, Homo sapiens
agccccctggatgtcccct

SEQ ID NO: 2003714 - DNA, 16 bp, Homo sapiens
agccccgactccagcc

SEQ ID NO: 2003715 - DNA, 17 bp, Homo sapiens
agccccgactccagcca

SEQ ID NO: 2003716 - DNA, 19 bp, Homo sapiens
agccccgactccagccagc

SEQ ID NO: 2003717 - DNA, 16 bp, Homo sapiens
agccccgaggccttct

SEQ ID NO: 2003718 - DNA, 17 bp, Homo sapiens
agccccgaggccttctc

SEQ ID NO: 2003719 - DNA, 15 bp, Homo sapiens
agccccgcgcctcct

SEQ ID NO: 2003720 - DNA, 18 bp, Homo sapiens
agccccgcgcctccttcc

SEQ ID NO: 2003721 - DNA, 19 bp, Homo sapiens
agccccgggcctgcctctg

SEQ ID NO: 2003722 - DNA, 21 bp, Homo sapiens
agcccctcagcccttgccccc

SEQ ID NO: 2003723 - DNA, 13 bp, Homo sapiens
agcccctcctccc

SEQ ID NO: 2003724 - DNA, 15 bp, Homo sapiens
agcccctcctctgcc

SEQ ID NO: 2003725 - DNA, 16 bp, Homo sapiens
agcccctcctctgcca

SEQ ID NO: 2003726 - DNA, 17 bp, Homo sapiens
agcccctcctctgccac

SEQ ID NO: 2003727 - DNA, 21 bp, Homo sapiens
agcccctcttttcccacattc

SEQ ID NO: 2003728 - DNA, 21 bp, Homo sapiens
agccccttcgaggttgcccct

SEQ ID NO: 2003729 - DNA, 17 bp, Homo sapiens
agccccttgagaaacct

SEQ ID NO: 2003730 - DNA, 20 bp, Homo sapiens
agccccttgctctcccctgc

SEQ ID NO: 2003731 - DNA, 23 bp, Homo sapiens
agccccttgctctcccctgccct

SEQ ID NO: 2003732 - DNA, 13 bp, Homo sapiens
agcccgaagccca

SEQ ID NO: 2003733 - DNA, 17 bp, Homo sapiens
agcccgaggaccgggct

SEQ ID NO: 2003734 - DNA, 17 bp, Homo sapiens
agcccgagggcctgaca

SEQ ID NO: 2003735 - DNA, 22 bp, Homo sapiens
agcccggccagggcctggtgtg

SEQ ID NO: 2003736 - DNA, 19 bp, Homo sapiens
agcccggcctgctcccagc

SEQ ID NO: 2003737 - DNA, 20 bp, Homo sapiens
agcccggcgccaccatcctg

SEQ ID NO: 2003738 - DNA, 23 bp, Homo sapiens
agcccgggtgtgcctgccctgga

SEQ ID NO: 2003739 - DNA, 17 bp, Homo sapiens
agcccgtgaagcagtgc

SEQ ID NO: 2003740 - DNA, 16 bp, Homo sapiens
agccctaaggatctct

SEQ ID NO: 2003741 - DNA, 21 bp, Homo sapiens
agccctaaggatctctcagga

SEQ ID NO: 2003742 - DNA, 15 bp, Homo sapiens
agccctacatcttca

SEQ ID NO: 2003743 - DNA, 18 bp, Homo sapiens
agccctacatcttcagct

SEQ ID NO: 2003744 - DNA, 23 bp, Homo sapiens
agccctacatcttcagctcccat

SEQ ID NO: 2003745 - DNA, 12 bp, Homo sapiens
agccctcaggcc

SEQ ID NO: 2003746 - DNA, 12 bp, Homo sapiens
agccctccccct

SEQ ID NO: 2003747 - DNA, 22 bp, Homo sapiens
agccctcccccttccccttctg

SEQ ID NO: 2003748 - DNA, 15 bp, Homo sapiens
agccctccctgcccc

SEQ ID NO: 2003749 - DNA, 14 bp, Homo sapiens
agccctcctcaccc

SEQ ID NO: 2003750 - DNA, 17 bp, Homo sapiens
agccctccttccacgga

SEQ ID NO: 2003751 - DNA, 21 bp, Homo sapiens
agccctcgaaccaaggcagcc

SEQ ID NO: 2003752 - DNA, 22 bp, Homo sapiens
agccctcgaaccaaggcagcct

SEQ ID NO: 2003753 - DNA, 15 bp, Homo sapiens
agccctgagctcagg

SEQ ID NO: 2003754 - DNA, 16 bp, Homo sapiens
agccctgagctcaggc

SEQ ID NO: 2003755 - DNA, 19 bp, Homo sapiens
agccctgagctcaggctga

SEQ ID NO: 2003756 - DNA, 20 bp, Homo sapiens
agccctgagctcaggctgag

SEQ ID NO: 2003757 - DNA, 23 bp, Homo sapiens
agccctgagctcaggctgagccc

SEQ ID NO: 2003758 - DNA, 21 bp, Homo sapiens
agccctgcagccaaacagagc

SEQ ID NO: 2003759 - DNA, 12 bp, Homo sapiens
agccctgccagg

SEQ ID NO: 2003760 - DNA, 15 bp, Homo sapiens
agccctgccaggagg

SEQ ID NO: 2003761 - DNA, 13 bp, Homo sapiens
agccctgcctgga

SEQ ID NO: 2003762 - DNA, 14 bp, Homo sapiens
agccctgcctggag

SEQ ID NO: 2003763 - DNA, 15 bp, Homo sapiens
agccctgcctggagg

SEQ ID NO: 2003764 - DNA, 19 bp, Homo sapiens
agccctgcctggaggacct

SEQ ID NO: 2003765 - DNA, 22 bp, Homo sapiens
agccctgcctggaggacctgag

SEQ ID NO: 2003766 - DNA, 16 bp, Homo sapiens
agccctgcggagccgg

SEQ ID NO: 2003767 - DNA, 17 bp, Homo sapiens
agccctgcggagccggc

SEQ ID NO: 2003768 - DNA, 20 bp, Homo sapiens
agccctgcggagccggcacc

SEQ ID NO: 2003769 - DNA, 20 bp, Homo sapiens
agccctgctgggcccatgtg

SEQ ID NO: 2003770 - DNA, 20 bp, Homo sapiens
agccctgctttgggctgccc

SEQ ID NO: 2003771 - DNA, 22 bp, Homo sapiens
agccctgctttgggctgccctg

SEQ ID NO: 2003772 - DNA, 23 bp, Homo sapiens
agccctggatttcagaaagagca

SEQ ID NO: 2003773 - DNA, 15 bp, Homo sapiens
agccctgggaccgct

SEQ ID NO: 2003774 - DNA, 20 bp, Homo sapiens
agccctgggaccgctacacc

SEQ ID NO: 2003775 - DNA, 16 bp, Homo sapiens
agccctgggccccacc

SEQ ID NO: 2003776 - DNA, 19 bp, Homo sapiens
agccctgggccccaccacc

SEQ ID NO: 2003777 - DNA, 23 bp, Homo sapiens
agccctgggccccaccacctagg

SEQ ID NO: 2003778 - DNA, 16 bp, Homo sapiens
agccctgggggccagc

SEQ ID NO: 2003779 - DNA, 22 bp, Homo sapiens
agccctggggtatgagctgcca

SEQ ID NO: 2003780 - DNA, 14 bp, Homo sapiens
agccctggtggcag

SEQ ID NO: 2003781 - DNA, 15 bp, Homo sapiens
agccctggtggcagt

SEQ ID NO: 2003782 - DNA, 23 bp, Homo sapiens
agccctggtggcagtgggagctg

SEQ ID NO: 2003783 - DNA, 21 bp, Homo sapiens
agccctgtcgagacacttgcc

SEQ ID NO: 2003784 - DNA, 15 bp, Homo sapiens
agcccttccctgctt

SEQ ID NO: 2003785 - DNA, 16 bp, Homo sapiens
agcccttccctgcttt

SEQ ID NO: 2003786 - DNA, 14 bp, Homo sapiens
agcccttcctcctg

SEQ ID NO: 2003787 - DNA, 18 bp, Homo sapiens
agcccttctgcctttctc

SEQ ID NO: 2003788 - DNA, 15 bp, Homo sapiens
agcccttgcccccat

SEQ ID NO: 2003789 - DNA, 22 bp, Homo sapiens
agcccttgcccccatccctcgg

SEQ ID NO: 2003790 - DNA, 12 bp, Homo sapiens
agccctttctgt

SEQ ID NO: 2003791 - DNA, 22 bp, Homo sapiens
agccctttgggaggctgaggcg

SEQ ID NO: 2003792 - DNA, 16 bp, Homo sapiens
agccgacctcagcctt

SEQ ID NO: 2003793 - DNA, 15 bp, Homo sapiens
agccgagagcctgct

SEQ ID NO: 2003794 - DNA, 17 bp, Homo sapiens
agccgagagcctgctcc

SEQ ID NO: 2003795 - DNA, 20 bp, Homo sapiens
agccgagatcacgccactgc

SEQ ID NO: 2003796 - DNA, 18 bp, Homo sapiens
agccgagccgggcctggg

SEQ ID NO: 2003797 - DNA, 18 bp, Homo sapiens
agccgcagcctccctctg

SEQ ID NO: 2003798 - DNA, 21 bp, Homo sapiens
agccgcatcttctccatctgg

SEQ ID NO: 2003799 - DNA, 13 bp, Homo sapiens
agctactctcttg

SEQ ID NO: 2003800 - DNA, 12 bp, Homo sapiens
agctactctgtc

SEQ ID NO: 2003801 - DNA, 14 bp, Homo sapiens
agctactctgtcca

SEQ ID NO: 2003802 - DNA, 22 bp, Homo sapiens
agctactctgtccaggccactg

SEQ ID NO: 2003803 - DNA, 16 bp, Homo sapiens
agctactgatttttgt

SEQ ID NO: 2003804 - DNA, 15 bp, Homo sapiens
agctacttaagagaa

SEQ ID NO: 2003805 - DNA, 21 bp, Homo sapiens
agctacttaagagaaatggca

SEQ ID NO: 2003806 - DNA, 14 bp, Homo sapiens
agctacttgggagg

SEQ ID NO: 2003807 - DNA, 16 bp, Homo sapiens
agctagaacccggcag

SEQ ID NO: 2003808 - DNA, 15 bp, Homo sapiens
agctagaaggccaca

SEQ ID NO: 2003809 - DNA, 19 bp, Homo sapiens
agctagaagtgggccagga

SEQ ID NO: 2003810 - DNA, 14 bp, Homo sapiens
agctagcgctgccg

SEQ ID NO: 2003811 - DNA, 20 bp, Homo sapiens
agctagcgctgccgcacccc

SEQ ID NO: 2003812 - DNA, 12 bp, Homo sapiens
agctaggaatga

SEQ ID NO: 2003813 - DNA, 13 bp, Homo sapiens
agctaggaatgaa

SEQ ID NO: 2003814 - DNA, 17 bp, Homo sapiens
agctaggactgaggagt

SEQ ID NO: 2003815 - DNA, 18 bp, Homo sapiens
agctaggagcaaagcctg

SEQ ID NO: 2003816 - DNA, 20 bp, Homo sapiens
agctaggagcaaagcctgtt

SEQ ID NO: 2003817 - DNA, 21 bp, Homo sapiens
agctaggagcaaagcctgttc

SEQ ID NO: 2003818 - DNA, 21 bp, Homo sapiens
agctaggcctggccagatgca

SEQ ID NO: 2003819 - DNA, 20 bp, Homo sapiens
agctagtgacccacatgcca

SEQ ID NO: 2003820 - DNA, 21 bp, Homo sapiens
agctagtgacccacatgccat

SEQ ID NO: 2003821 - DNA, 19 bp, Homo sapiens
agctatgattatgccactg

SEQ ID NO: 2003822 - DNA, 13 bp, Homo sapiens
agctatggtgagg

SEQ ID NO: 2003823 - DNA, 15 bp, Homo sapiens
agctattagcaactg

SEQ ID NO: 2003824 - DNA, 20 bp, Homo sapiens
agctattagcaactgtgcta

SEQ ID NO: 2003825 - DNA, 13 bp, Homo sapiens
agctattgatgtt

SEQ ID NO: 2003826 - DNA, 14 bp, Homo sapiens
agctattgcatgta

SEQ ID NO: 2003827 - DNA, 16 bp, Homo sapiens
agctattgcatgtaaa

SEQ ID NO: 2003828 - DNA, 22 bp, Homo sapiens
agctattttcttacagtggagt

SEQ ID NO: 2003829 - DNA, 20 bp, Homo sapiens
agctcaagatgacagctctt

SEQ ID NO: 2003830 - DNA, 15 bp, Homo sapiens
agctcacaagcccag

SEQ ID NO: 2003831 - DNA, 18 bp, Homo sapiens
agctcacaagcccaggct

SEQ ID NO: 2003832 - DNA, 21 bp, Homo sapiens
agctcacagttcctcgccctg

SEQ ID NO: 2003833 - DNA, 23 bp, Homo sapiens
agctcacagttcctcgccctggg

SEQ ID NO: 2003834 - DNA, 15 bp, Homo sapiens
agctcaccagcccca

SEQ ID NO: 2003835 - DNA, 16 bp, Homo sapiens
agctcaccagccccag

SEQ ID NO: 2003836 - DNA, 21 bp, Homo sapiens
agctcacccaataaacattaa

SEQ ID NO: 2003837 - DNA, 15 bp, Homo sapiens
agctcacctctgaag

SEQ ID NO: 2003838 - DNA, 14 bp, Homo sapiens
agctcactccctgg

SEQ ID NO: 2003839 - DNA, 20 bp, Homo sapiens
agctcagacccccactctca

SEQ ID NO: 2003840 - DNA, 18 bp, Homo sapiens
agctcagaggcccaggaa

SEQ ID NO: 2003841 - DNA, 13 bp, Homo sapiens
agctcagcctccc

SEQ ID NO: 2003842 - DNA, 21 bp, Homo sapiens
agctcagcctccccctgctgc

SEQ ID NO: 2003843 - DNA, 22 bp, Homo sapiens
agctcagcctccccctgctgct

SEQ ID NO: 2003844 - DNA, 20 bp, Homo sapiens
agctcagctttttgtctttt

SEQ ID NO: 2003845 - DNA, 17 bp, Homo sapiens
agctcaggaggcttgga

SEQ ID NO: 2003846 - DNA, 13 bp, Homo sapiens
agctcaggctgag

SEQ ID NO: 2003847 - DNA, 19 bp, Homo sapiens
agctcaggctgagcccagc

SEQ ID NO: 2003848 - DNA, 17 bp, Homo sapiens
agctcaggtgtccctgc

SEQ ID NO: 2003849 - DNA, 19 bp, Homo sapiens
agctcagtttatccaaggt

SEQ ID NO: 2003850 - DNA, 15 bp, Homo sapiens
agctcatattttgta

SEQ ID NO: 2003851 - DNA, 14 bp, Homo sapiens
agctccaacagctt

SEQ ID NO: 2003852 - DNA, 18 bp, Homo sapiens
agctccagctcaccagcc

SEQ ID NO: 2003853 - DNA, 21 bp, Homo sapiens
agctccatctccactccagat

SEQ ID NO: 2003854 - DNA, 17 bp, Homo sapiens
agctcccagatgctggg

SEQ ID NO: 2003855 - DNA, 16 bp, Homo sapiens
agctcccatagcgctg

SEQ ID NO: 2003856 - DNA, 17 bp, Homo sapiens
agctcccatagcgctgg

SEQ ID NO: 2003857 - DNA, 23 bp, Homo sapiens
agctccccaggactcaccctcat

SEQ ID NO: 2003858 - DNA, 19 bp, Homo sapiens
agctcccctcggagaagag

SEQ ID NO: 2003859 - DNA, 17 bp, Homo sapiens
agctccctaggagacca

SEQ ID NO: 2003860 - DNA, 19 bp, Homo sapiens
agctcccttcccctgcctg

SEQ ID NO: 2003861 - DNA, 19 bp, Homo sapiens
agctcccttttctttttcc

SEQ ID NO: 2003862 - DNA, 22 bp, Homo sapiens
agctccgctaagacctccccac

SEQ ID NO: 2003863 - DNA, 14 bp, Homo sapiens
agctccgtcatctg

SEQ ID NO: 2003864 - DNA, 14 bp, Homo sapiens
agctccgtggagca

SEQ ID NO: 2003865 - DNA, 15 bp, Homo sapiens
agctcctctgctgct

SEQ ID NO: 2003866 - DNA, 18 bp, Homo sapiens
agctcctctgctgctccc

SEQ ID NO: 2003867 - DNA, 20 bp, Homo sapiens
agctcctggtcttgagatgt

SEQ ID NO: 2003868 - DNA, 13 bp, Homo sapiens
agctcctgtccct

SEQ ID NO: 2003869 - DNA, 15 bp, Homo sapiens
agctcctgtccctac

SEQ ID NO: 2003870 - DNA, 17 bp, Homo sapiens
agctcctgtcctcccat

SEQ ID NO: 2003871 - DNA, 13 bp, Homo sapiens
agctccttttgtc

SEQ ID NO: 2003872 - DNA, 21 bp, Homo sapiens
agctccttttgtccccagggc

SEQ ID NO: 2003873 - DNA, 14 bp, Homo sapiens
agctcggtggaccc

SEQ ID NO: 2003874 - DNA, 16 bp, Homo sapiens
agctcggtggacccag

SEQ ID NO: 2003875 - DNA, 14 bp, Homo sapiens
agctctccctctgg

SEQ ID NO: 2003876 - DNA, 16 bp, Homo sapiens
agctctccctctggcc

SEQ ID NO: 2003877 - DNA, 18 bp, Homo sapiens
agctctccctctggccct

SEQ ID NO: 2003878 - DNA, 20 bp, Homo sapiens
agctctccctctggccctgc

SEQ ID NO: 2003879 - DNA, 15 bp, Homo sapiens
agctctcctgctgca

SEQ ID NO: 2003880 - DNA, 18 bp, Homo sapiens
agctctgaacaaacactg

SEQ ID NO: 2003881 - DNA, 23 bp, Homo sapiens
agctctgaacaaacactgaatca

SEQ ID NO: 2003882 - DNA, 23 bp, Homo sapiens
agctctgaagtcacatcacagga

SEQ ID NO: 2003883 - DNA, 23 bp, Homo sapiens
agctctgaatctgataggaaaag

SEQ ID NO: 2003884 - DNA, 12 bp, Homo sapiens
agctctgcatta

SEQ ID NO: 2003885 - DNA, 11 bp, Homo sapiens
agctctgcctc

SEQ ID NO: 2003886 - DNA, 16 bp, Homo sapiens
agctctgtcctgggag

SEQ ID NO: 2003887 - DNA, 13 bp, Homo sapiens
agctctgtggcct

SEQ ID NO: 2003888 - DNA, 15 bp, Homo sapiens
agctcttcactcagc

SEQ ID NO: 2003889 - DNA, 17 bp, Homo sapiens
agctcttcactcagcca

SEQ ID NO: 2003890 - DNA, 19 bp, Homo sapiens
agctcttcactcagccaca

SEQ ID NO: 2003891 - DNA, 13 bp, Homo sapiens
agctcttcatgtt

SEQ ID NO: 2003892 - DNA, 16 bp, Homo sapiens
agctcttcatgtttca

SEQ ID NO: 2003893 - DNA, 21 bp, Homo sapiens
agctcttccttactcccaggc

SEQ ID NO: 2003894 - DNA, 22 bp, Homo sapiens
agctcttccttactcccaggca

SEQ ID NO: 2003895 - DNA, 17 bp, Homo sapiens
agctcttcggtttctga

SEQ ID NO: 2003896 - DNA, 18 bp, Homo sapiens
agctcttcggtttctgag

SEQ ID NO: 2003897 - DNA, 19 bp, Homo sapiens
agctcttcggtttctgagc

SEQ ID NO: 2003898 - DNA, 14 bp, Homo sapiens
agctcttctaagga

SEQ ID NO: 2003899 - DNA, 17 bp, Homo sapiens
agctcttctatttaaaa

SEQ ID NO: 2003900 - DNA, 18 bp, Homo sapiens
agctcttctatttaaaaa

SEQ ID NO: 2003901 - DNA, 21 bp, Homo sapiens
agctcttctatttaaaaaata

SEQ ID NO: 2003902 - DNA, 16 bp, Homo sapiens
agctcttctccaggct

SEQ ID NO: 2003903 - DNA, 17 bp, Homo sapiens
agctcttctccaggctg

SEQ ID NO: 2003904 - DNA, 12 bp, Homo sapiens
agctcttggaag

SEQ ID NO: 2003905 - DNA, 16 bp, Homo sapiens
agctcttggaagagct

SEQ ID NO: 2003906 - DNA, 14 bp, Homo sapiens
agctgaaagttggg

SEQ ID NO: 2003907 - DNA, 17 bp, Homo sapiens
agctgaaagttgggact

SEQ ID NO: 2003908 - DNA, 16 bp, Homo sapiens
agctgaacaatgaatg

SEQ ID NO: 2003909 - DNA, 14 bp, Homo sapiens
agctgaagacaaac

SEQ ID NO: 2003910 - DNA, 23 bp, Homo sapiens
agctgaagcccatgctttcccac

SEQ ID NO: 2003911 - DNA, 17 bp, Homo sapiens
agctgaagtgaaggaga

SEQ ID NO: 2003912 - DNA, 14 bp, Homo sapiens
agctgacagataca

SEQ ID NO: 2003913 - DNA, 17 bp, Homo sapiens
agctgagaagaagctga

SEQ ID NO: 2003914 - DNA, 14 bp, Homo sapiens
agctgagagccctg

SEQ ID NO: 2003915 - DNA, 16 bp, Homo sapiens
agctgagagccctgct

SEQ ID NO: 2003916 - DNA, 18 bp, Homo sapiens
agctgagcaggcccgaca

SEQ ID NO: 2003917 - DNA, 18 bp, Homo sapiens
agctgagctcacaaggca

SEQ ID NO: 2003918 - DNA, 24 bp, Homo sapiens
agctgaggatcctcacaggagcag

SEQ ID NO: 2003919 - DNA, 13 bp, Homo sapiens
agctgaggggggc

SEQ ID NO: 2003920 - DNA, 15 bp, Homo sapiens
agctgaggtgcccag

SEQ ID NO: 2003921 - DNA, 13 bp, Homo sapiens
agctgagtcacct

SEQ ID NO: 2003922 - DNA, 14 bp, Homo sapiens
agctgagtcacctc

SEQ ID NO: 2003923 - DNA, 17 bp, Homo sapiens
agctgagtcacctcctc

SEQ ID NO: 2003924 - DNA, 18 bp, Homo sapiens
agctgagtgagagggttt

SEQ ID NO: 2003925 - DNA, 22 bp, Homo sapiens
agctgagttccttataagaatt

SEQ ID NO: 2003926 - DNA, 20 bp, Homo sapiens
agctgatgatgtctcttgta

SEQ ID NO: 2003927 - DNA, 21 bp, Homo sapiens
agctgatgatgtctcttgtag

SEQ ID NO: 2003928 - DNA, 19 bp, Homo sapiens
agctgatggagaaggaagg

SEQ ID NO: 2003929 - DNA, 21 bp, Homo sapiens
agctgatgtgagtgtgtgtga

SEQ ID NO: 2003930 - DNA, 17 bp, Homo sapiens
agctgatttccaggccc

SEQ ID NO: 2003931 - DNA, 18 bp, Homo sapiens
agctgatttccaggcccc

SEQ ID NO: 2003932 - DNA, 21 bp, Homo sapiens
agctgatttccaggcccctga

SEQ ID NO: 2003933 - DNA, 18 bp, Homo sapiens
agctgcaagtgacatctc

SEQ ID NO: 2003934 - DNA, 14 bp, Homo sapiens
agctgcacattcct

SEQ ID NO: 2003935 - DNA, 18 bp, Homo sapiens
agctgcacattcctggcc

SEQ ID NO: 2003936 - DNA, 19 bp, Homo sapiens
agctgcacattcctggccc

SEQ ID NO: 2003937 - DNA, 19 bp, Homo sapiens
agctgcaccatcacacatg

SEQ ID NO: 2003938 - DNA, 13 bp, Homo sapiens
agctgcagcttcc

SEQ ID NO: 2003939 - DNA, 16 bp, Homo sapiens
agctgcagcttcctgt

SEQ ID NO: 2003940 - DNA, 17 bp, Homo sapiens
agctgcaggaatcaaaa

SEQ ID NO: 2003941 - DNA, 17 bp, Homo sapiens
agctgccaagtctattt

SEQ ID NO: 2003942 - DNA, 23 bp, Homo sapiens
agctgccgcaaggccctgtccca

SEQ ID NO: 2003943 - DNA, 22 bp, Homo sapiens
agctgcctgtagttaggaaata

SEQ ID NO: 2003944 - DNA, 23 bp, Homo sapiens
agctgcctgtagttaggaaataa

SEQ ID NO: 2003945 - DNA, 16 bp, Homo sapiens
agctgcctgttcagct

SEQ ID NO: 2003946 - DNA, 18 bp, Homo sapiens
agctgcctgttcagctcc

SEQ ID NO: 2003947 - DNA, 19 bp, Homo sapiens
agctgccttcctcatcccc

SEQ ID NO: 2003948 - DNA, 13 bp, Homo sapiens
agctgcggtccac

SEQ ID NO: 2003949 - DNA, 17 bp, Homo sapiens
agctgcggtccacccag

SEQ ID NO: 2003950 - DNA, 20 bp, Homo sapiens
agctgcggtccacccaggag

SEQ ID NO: 2003951 - DNA, 23 bp, Homo sapiens
agctgcgtttattaatgcctctc

SEQ ID NO: 2003952 - DNA, 12 bp, Homo sapiens
agctgctctgcc

SEQ ID NO: 2003953 - DNA, 13 bp, Homo sapiens
agctgctctgccc

SEQ ID NO: 2003954 - DNA, 14 bp, Homo sapiens
agctgctctgcccc

SEQ ID NO: 2003955 - DNA, 21 bp, Homo sapiens
agctgctctgccccttgggca

SEQ ID NO: 2003956 - DNA, 19 bp, Homo sapiens
agctgctcttagtgcccgc

SEQ ID NO: 2003957 - DNA, 21 bp, Homo sapiens
agctgctcttagtgcccgcct

SEQ ID NO: 2003958 - DNA, 15 bp, Homo sapiens
agctgctgaaacaac

SEQ ID NO: 2003959 - DNA, 16 bp, Homo sapiens
agctgctgaaacaaca

SEQ ID NO: 2003960 - DNA, 16 bp, Homo sapiens
agctgctgaagaggca

SEQ ID NO: 2003961 - DNA, 18 bp, Homo sapiens
agctgctgaagttctgag

SEQ ID NO: 2003962 - DNA, 20 bp, Homo sapiens
agctgctgttccaacagaca

SEQ ID NO: 2003963 - DNA, 14 bp, Homo sapiens
agctgcttgactat

SEQ ID NO: 2003964 - DNA, 19 bp, Homo sapiens
agctgcttgactatcacat

SEQ ID NO: 2003965 - DNA, 15 bp, Homo sapiens
agctgcttgtgggcc

SEQ ID NO: 2003966 - DNA, 21 bp, Homo sapiens
agctgcttgttgtcaagtata

SEQ ID NO: 2003967 - DNA, 23 bp, Homo sapiens
agctgcttgttgtcaagtataaa

SEQ ID NO: 2003968 - DNA, 22 bp, Homo sapiens
agctgcttttgtctatgggact

SEQ ID NO: 2003969 - DNA, 10 bp, Homo sapiens
agctggaaat

SEQ ID NO: 2003970 - DNA, 17 bp, Homo sapiens
agctggaaataaacctg

SEQ ID NO: 2003971 - DNA, 19 bp, Homo sapiens
agctggaaataaacctgga

SEQ ID NO: 2003972 - DNA, 24 bp, Homo sapiens
agctggaaataaacctggagatga

SEQ ID NO: 2003973 - DNA, 13 bp, Homo sapiens
agctggaagcact

SEQ ID NO: 2003974 - DNA, 16 bp, Homo sapiens
agctggaagcactgct

SEQ ID NO: 2003975 - DNA, 18 bp, Homo sapiens
agctggaagcactgctgt

SEQ ID NO: 2003976 - DNA, 15 bp, Homo sapiens
agctggaaggcaggg

SEQ ID NO: 2003977 - DNA, 17 bp, Homo sapiens
agctggaaggcagggca

SEQ ID NO: 2003978 - DNA, 19 bp, Homo sapiens
agctggaaggcagggcaga

SEQ ID NO: 2003979 - DNA, 20 bp, Homo sapiens
agctggaaggcagggcagag

SEQ ID NO: 2003980 - DNA, 21 bp, Homo sapiens
agctggaaggcagggcagagg

SEQ ID NO: 2003981 - DNA, 16 bp, Homo sapiens
agctggaattctaaat

SEQ ID NO: 2003982 - DNA, 21 bp, Homo sapiens
agctggaattctaaatgctgg

SEQ ID NO: 2003983 - DNA, 18 bp, Homo sapiens
agctggaattgctgctct

SEQ ID NO: 2003984 - DNA, 21 bp, Homo sapiens
agctggaattgctgctctctg

SEQ ID NO: 2003985 - DNA, 22 bp, Homo sapiens
agctggaattgctgctctctga

SEQ ID NO: 2003986 - DNA, 17 bp, Homo sapiens
agctggacaagaagctg

SEQ ID NO: 2003987 - DNA, 19 bp, Homo sapiens
agctggacaagaagctgct

SEQ ID NO: 2003988 - DNA, 15 bp, Homo sapiens
agctggagctcttgg

SEQ ID NO: 2003989 - DNA, 16 bp, Homo sapiens
agctggagctcttgga

SEQ ID NO: 2003990 - DNA, 19 bp, Homo sapiens
agctggcaaaggtggctct

SEQ ID NO: 2003991 - DNA, 21 bp, Homo sapiens
agctggcagcactcagtgagg

SEQ ID NO: 2003992 - DNA, 13 bp, Homo sapiens
agctggcaggaca

SEQ ID NO: 2003993 - DNA, 15 bp, Homo sapiens
agctggctgctgaca

SEQ ID NO: 2003994 - DNA, 17 bp, Homo sapiens
agctggctgctgacagg

SEQ ID NO: 2003995 - DNA, 20 bp, Homo sapiens
agctggctgctgacaggatg

SEQ ID NO: 2003996 - DNA, 22 bp, Homo sapiens
agctggctgctgacaggatgtg

SEQ ID NO: 2003997 - DNA, 11 bp, Homo sapiens
agctggctgtc

SEQ ID NO: 2003998 - DNA, 13 bp, Homo sapiens
agctgggaaacag

SEQ ID NO: 2003999 - DNA, 14 bp, Homo sapiens
agctgggaaattca

SEQ ID NO: 2004000 - DNA, 21 bp, Homo sapiens
agctgggaacccgactgtgaa

SEQ ID NO: 2004001 - DNA, 15 bp, Homo sapiens
agctgggactacagg

SEQ ID NO: 2004002 - DNA, 16 bp, Homo sapiens
agctgggactacaggc

SEQ ID NO: 2004003 - DNA, 18 bp, Homo sapiens
agctgggactacaggcac

SEQ ID NO: 2004004 - DNA, 23 bp, Homo sapiens
agctgggactacaggcacccacc

SEQ ID NO: 2004005 - DNA, 16 bp, Homo sapiens
agctgggactacaggt

SEQ ID NO: 2004006 - DNA, 19 bp, Homo sapiens
agctgggactacaggtgtg

SEQ ID NO: 2004007 - DNA, 16 bp, Homo sapiens
agctgggaggcatggc

SEQ ID NO: 2004008 - DNA, 19 bp, Homo sapiens
agctgggaggcatggccct

SEQ ID NO: 2004009 - DNA, 20 bp, Homo sapiens
agctgggaggcatggccctg

SEQ ID NO: 2004010 - DNA, 15 bp, Homo sapiens
agctgggagtagcat

SEQ ID NO: 2004011 - DNA, 20 bp, Homo sapiens
agctgggcaaacccttctct

SEQ ID NO: 2004012 - DNA, 22 bp, Homo sapiens
agctgggccccatgctctgccc

SEQ ID NO: 2004013 - DNA, 18 bp, Homo sapiens
agctgggccggccagcct

SEQ ID NO: 2004014 - DNA, 18 bp, Homo sapiens
agctgggggaagggtggt

SEQ ID NO: 2004015 - DNA, 22 bp, Homo sapiens
agctgggtgtcaagagggtctg

SEQ ID NO: 2004016 - DNA, 16 bp, Homo sapiens
agctggtccagggcct

SEQ ID NO: 2004017 - DNA, 15 bp, Homo sapiens
agctggtcccactca

SEQ ID NO: 2004018 - DNA, 17 bp, Homo sapiens
agctggtcccactcagt

SEQ ID NO: 2004019 - DNA, 13 bp, Homo sapiens
agctggtgggaag

SEQ ID NO: 2004020 - DNA, 20 bp, Homo sapiens
agctgtaaatacatgtgtgg

SEQ ID NO: 2004021 - DNA, 20 bp, Homo sapiens
agctgtactcagagcagagc

SEQ ID NO: 2004022 - DNA, 19 bp, Homo sapiens
agctgtagaaatgtatcct

SEQ ID NO: 2004023 - DNA, 15 bp, Homo sapiens
agctgtagccatggc

SEQ ID NO: 2004024 - DNA, 20 bp, Homo sapiens
agctgtagtagccctttctg

SEQ ID NO: 2004025 - DNA, 21 bp, Homo sapiens
agctgtagtagccctttctgt

SEQ ID NO: 2004026 - DNA, 22 bp, Homo sapiens
agctgtagtagccctttctgtg

SEQ ID NO: 2004027 - DNA, 21 bp, Homo sapiens
agctgtatatatatatgtgtg

SEQ ID NO: 2004028 - DNA, 19 bp, Homo sapiens
agctgtcatcaattaaagg

SEQ ID NO: 2004029 - DNA, 20 bp, Homo sapiens
agctgtcatggaaaagccca

SEQ ID NO: 2004030 - DNA, 23 bp, Homo sapiens
agctgtcatggaaaagcccagtg

SEQ ID NO: 2004031 - DNA, 15 bp, Homo sapiens
agctgtcattcagga

SEQ ID NO: 2004032 - DNA, 17 bp, Homo sapiens
agctgtcccctctccct

SEQ ID NO: 2004033 - DNA, 19 bp, Homo sapiens
agctgtcccctctccctgg

SEQ ID NO: 2004034 - DNA, 16 bp, Homo sapiens
agctgtcccctctgtc

SEQ ID NO: 2004035 - DNA, 14 bp, Homo sapiens
agctgtcgcatctc

SEQ ID NO: 2004036 - DNA, 15 bp, Homo sapiens
agctgtcgcatctca

SEQ ID NO: 2004037 - DNA, 11 bp, Homo sapiens
agctgtctgct

SEQ ID NO: 2004038 - DNA, 17 bp, Homo sapiens
agctgtgacctctcccc

SEQ ID NO: 2004039 - DNA, 19 bp, Homo sapiens
agctgtgctctggacaggc

SEQ ID NO: 2004040 - DNA, 21 bp, Homo sapiens
agctgtgctctggacaggcat

SEQ ID NO: 2004041 - DNA, 21 bp, Homo sapiens
agctgtgtccttgcacctgca

SEQ ID NO: 2004042 - DNA, 24 bp, Homo sapiens
agctgtgtccttgcacctgcatcc

SEQ ID NO: 2004043 - DNA, 22 bp, Homo sapiens
agctgtgtgtttggaagactat

SEQ ID NO: 2004044 - DNA, 16 bp, Homo sapiens
agctgttcacagccag

SEQ ID NO: 2004045 - DNA, 13 bp, Homo sapiens
agctgttgagctg

SEQ ID NO: 2004046 - DNA, 14 bp, Homo sapiens
agctgttgagctgt

SEQ ID NO: 2004047 - DNA, 20 bp, Homo sapiens
agctgttggcctcgcctggg

SEQ ID NO: 2004048 - DNA, 13 bp, Homo sapiens
agctgtttgtcat

SEQ ID NO: 2004049 - DNA, 15 bp, Homo sapiens
agctgttttccctga

SEQ ID NO: 2004050 - DNA, 19 bp, Homo sapiens
agcttaaataaattcaaac

SEQ ID NO: 2004051 - DNA, 23 bp, Homo sapiens
agcttaaattgcttttgttgtga

SEQ ID NO: 2004052 - DNA, 14 bp, Homo sapiens
agcttagacctcag

SEQ ID NO: 2004053 - DNA, 16 bp, Homo sapiens
agcttagacctcagcc

SEQ ID NO: 2004054 - DNA, 15 bp, Homo sapiens
agcttagccttgtgc

SEQ ID NO: 2004055 - DNA, 22 bp, Homo sapiens
agcttattcatctgtttttctt

SEQ ID NO: 2004056 - DNA, 13 bp, Homo sapiens
agcttattggcca

SEQ ID NO: 2004057 - DNA, 15 bp, Homo sapiens
agcttattggccact

SEQ ID NO: 2004058 - DNA, 12 bp, Homo sapiens
agcttatttaat

SEQ ID NO: 2004059 - DNA, 19 bp, Homo sapiens
agcttcaaccctcagcctt

SEQ ID NO: 2004060 - DNA, 18 bp, Homo sapiens
agcttcaagtgatatatg

SEQ ID NO: 2004061 - DNA, 19 bp, Homo sapiens
agcttcaagtgatatatgt

SEQ ID NO: 2004062 - DNA, 22 bp, Homo sapiens
agcttcaagtgatatatgtatt

SEQ ID NO: 2004063 - DNA, 16 bp, Homo sapiens
agcttcagaagtttgg

SEQ ID NO: 2004064 - DNA, 17 bp, Homo sapiens
agcttcagagcctagcc

SEQ ID NO: 2004065 - DNA, 23 bp, Homo sapiens
agcttcagagcctagccacctcc

SEQ ID NO: 2004066 - DNA, 20 bp, Homo sapiens
agcttcatcaatttttatac

SEQ ID NO: 2004067 - DNA, 19 bp, Homo sapiens
agcttcatgcctcagtttc

SEQ ID NO: 2004068 - DNA, 20 bp, Homo sapiens
agcttcatttccgtgaaggg

SEQ ID NO: 2004069 - DNA, 19 bp, Homo sapiens
agcttccagtgcatgttgc

SEQ ID NO: 2004070 - DNA, 15 bp, Homo sapiens
agcttcccctcgctg

SEQ ID NO: 2004071 - DNA, 23 bp, Homo sapiens
agcttcctccagacccctgtggc

SEQ ID NO: 2004072 - DNA, 21 bp, Homo sapiens
agcttctacagattttagaca

SEQ ID NO: 2004073 - DNA, 17 bp, Homo sapiens
agcttctattaaatgta

SEQ ID NO: 2004074 - DNA, 23 bp, Homo sapiens
agcttctattatagccacatccc

SEQ ID NO: 2004075 - DNA, 12 bp, Homo sapiens
agcttctctgcc

SEQ ID NO: 2004076 - DNA, 22 bp, Homo sapiens
agcttgaagatcgttagtatct

SEQ ID NO: 2004077 - DNA, 14 bp, Homo sapiens
agcttgaccagacc

SEQ ID NO: 2004078 - DNA, 17 bp, Homo sapiens
agcttgaccagacctag

SEQ ID NO: 2004079 - DNA, 13 bp, Homo sapiens
agcttgagcctga

SEQ ID NO: 2004080 - DNA, 13 bp, Homo sapiens
agcttgagcctgt

SEQ ID NO: 2004081 - DNA, 14 bp, Homo sapiens
agcttgagcctgtc

SEQ ID NO: 2004082 - DNA, 22 bp, Homo sapiens
agcttgagggttgggctggtgt

SEQ ID NO: 2004083 - DNA, 19 bp, Homo sapiens
agcttgctcttcagtggga

SEQ ID NO: 2004084 - DNA, 23 bp, Homo sapiens
agcttggaaactggatgaggtca

SEQ ID NO: 2004085 - DNA, 16 bp, Homo sapiens
agcttggagggatgga

SEQ ID NO: 2004086 - DNA, 21 bp, Homo sapiens
agcttgggggatgactagagg

SEQ ID NO: 2004087 - DNA, 16 bp, Homo sapiens
agcttggtggctgagc

SEQ ID NO: 2004088 - DNA, 21 bp, Homo sapiens
agcttgtaaatagctcaggtg

SEQ ID NO: 2004089 - DNA, 14 bp, Homo sapiens
agcttgtatataca

SEQ ID NO: 2004090 - DNA, 17 bp, Homo sapiens
agcttgtatatacatat

SEQ ID NO: 2004091 - DNA, 17 bp, Homo sapiens
agcttgttccctgtctt

SEQ ID NO: 2004092 - DNA, 18 bp, Homo sapiens
agctttaacttaaatagt

SEQ ID NO: 2004093 - DNA, 17 bp, Homo sapiens
agctttacaacttccat

SEQ ID NO: 2004094 - DNA, 20 bp, Homo sapiens
agctttacacacacagatgt

SEQ ID NO: 2004095 - DNA, 16 bp, Homo sapiens
agctttagcttctctg

SEQ ID NO: 2004096 - DNA, 16 bp, Homo sapiens
agctttaggggaccat

SEQ ID NO: 2004097 - DNA, 15 bp, Homo sapiens
agctttcatttgaca

SEQ ID NO: 2004098 - DNA, 16 bp, Homo sapiens
agctttcatttgacac

SEQ ID NO: 2004099 - DNA, 13 bp, Homo sapiens
agctttccacagg

SEQ ID NO: 2004100 - DNA, 20 bp, Homo sapiens
agctttcttctacaaccaga

SEQ ID NO: 2004101 - DNA, 19 bp, Homo sapiens
agctttgaatacccccaga

SEQ ID NO: 2004102 - DNA, 16 bp, Homo sapiens
agctttgctaccaaag

SEQ ID NO: 2004103 - DNA, 23 bp, Homo sapiens
agctttgctctttggtagaaaag

SEQ ID NO: 2004104 - DNA, 16 bp, Homo sapiens
agctttggaaacagga

SEQ ID NO: 2004105 - DNA, 18 bp, Homo sapiens
agcttttaataaaattga

SEQ ID NO: 2004106 - DNA, 17 bp, Homo sapiens
agcttttattgtataaa

SEQ ID NO: 2004107 - DNA, 19 bp, Homo sapiens
agcttttattgtataaact

SEQ ID NO: 2004108 - DNA, 16 bp, Homo sapiens
agcttttcaaacaaga

SEQ ID NO: 2004109 - DNA, 13 bp, Homo sapiens
agctttttgtctt

SEQ ID NO: 2004110 - DNA, 13 bp, Homo sapiens
aggaaaaaaaata

SEQ ID NO: 2004111 - DNA, 15 bp, Homo sapiens
aggaaaaaaatgact

SEQ ID NO: 2004112 - DNA, 20 bp, Homo sapiens
aggaaaaccaagccgtggct

SEQ ID NO: 2004113 - DNA, 21 bp, Homo sapiens
aggaaaaccaagccgtggctt

SEQ ID NO: 2004114 - DNA, 22 bp, Homo sapiens
aggaaaaccaagccgtggcttc

SEQ ID NO: 2004115 - DNA, 17 bp, Homo sapiens
aggaaaacgggaaagaa

SEQ ID NO: 2004116 - DNA, 15 bp, Homo sapiens
aggaaaaggcctggg

SEQ ID NO: 2004117 - DNA, 18 bp, Homo sapiens
aggaaaaggcctggggtg

SEQ ID NO: 2004118 - DNA, 14 bp, Homo sapiens
aggaaaatcctctg

SEQ ID NO: 2004119 - DNA, 14 bp, Homo sapiens
aggaaaattgaatg

SEQ ID NO: 2004120 - DNA, 13 bp, Homo sapiens
aggaaaatttcac

SEQ ID NO: 2004121 - DNA, 18 bp, Homo sapiens
aggaaaccaaaggaatcg

SEQ ID NO: 2004122 - DNA, 13 bp, Homo sapiens
aggaaaccaacac

SEQ ID NO: 2004123 - DNA, 17 bp, Homo sapiens
aggaaagaaagaaggaa

SEQ ID NO: 2004124 - DNA, 22 bp, Homo sapiens
aggaaagcaccgcagcatgtgg

SEQ ID NO: 2004125 - DNA, 16 bp, Homo sapiens
aggaaagcctcactga

SEQ ID NO: 2004126 - DNA, 20 bp, Homo sapiens
aggaaagcctcactgatata

SEQ ID NO: 2004127 - DNA, 17 bp, Homo sapiens
aggaaataaaacctttc

SEQ ID NO: 2004128 - DNA, 20 bp, Homo sapiens
aggaaataaaacctttcaaa

SEQ ID NO: 2004129 - DNA, 22 bp, Homo sapiens
aggaaataaaacctttcaaatt

SEQ ID NO: 2004130 - DNA, 18 bp, Homo sapiens
aggaaatagtgttctttt

SEQ ID NO: 2004131 - DNA, 20 bp, Homo sapiens
aggaaatcaaatatgcaaag

SEQ ID NO: 2004132 - DNA, 23 bp, Homo sapiens
aggaaatgtttgagttttcaaag

SEQ ID NO: 2004133 - DNA, 23 bp, Homo sapiens
aggaacaagagaaaaaactagag

SEQ ID NO: 2004134 - DNA, 14 bp, Homo sapiens
aggaacactggaaa

SEQ ID NO: 2004135 - DNA, 21 bp, Homo sapiens
aggaacagaaggatgaatgag

SEQ ID NO: 2004136 - DNA, 12 bp, Homo sapiens
aggaacagctcc

SEQ ID NO: 2004137 - DNA, 23 bp, Homo sapiens
aggaacagctcttcactcagcca

SEQ ID NO: 2004138 - DNA, 15 bp, Homo sapiens
aggaacctaattgaa

SEQ ID NO: 2004139 - DNA, 19 bp, Homo sapiens
aggaacctaattgaaattt

SEQ ID NO: 2004140 - DNA, 14 bp, Homo sapiens
aggaacgagcactg

SEQ ID NO: 2004141 - DNA, 16 bp, Homo sapiens
aggaacgagcactggc

SEQ ID NO: 2004142 - DNA, 14 bp, Homo sapiens
aggaactcccagca

SEQ ID NO: 2004143 - DNA, 18 bp, Homo sapiens
aggaactctggcttccag

SEQ ID NO: 2004144 - DNA, 19 bp, Homo sapiens
aggaactctggcttccagg

SEQ ID NO: 2004145 - DNA, 15 bp, Homo sapiens
aggaactggaacaca

SEQ ID NO: 2004146 - DNA, 17 bp, Homo sapiens
aggaagaaaccccaagc

SEQ ID NO: 2004147 - DNA, 18 bp, Homo sapiens
aggagaatccaagcgagg

SEQ ID NO: 2004148 - DNA, 19 bp, Homo sapiens
aggagaattgcttgaaccg

SEQ ID NO: 2004149 - DNA, 13 bp, Homo sapiens
aggagaccagctc

SEQ ID NO: 2004150 - DNA, 15 bp, Homo sapiens
aggagaccagctcag

SEQ ID NO: 2004151 - DNA, 14 bp, Homo sapiens
aggagaccctggaa

SEQ ID NO: 2004152 - DNA, 14 bp, Homo sapiens
aggagagccagccc

SEQ ID NO: 2004153 - DNA, 15 bp, Homo sapiens
aggagagccagccct

SEQ ID NO: 2004154 - DNA, 16 bp, Homo sapiens
aggagagccagccctc

SEQ ID NO: 2004155 - DNA, 19 bp, Homo sapiens
aggagaggggaagggccag

SEQ ID NO: 2004156 - DNA, 22 bp, Homo sapiens
aggagaggggaagggccagtct

SEQ ID NO: 2004157 - DNA, 13 bp, Homo sapiens
aggagatataaaa

SEQ ID NO: 2004158 - DNA, 20 bp, Homo sapiens
aggagcaaaacgcctctttt

SEQ ID NO: 2004159 - DNA, 18 bp, Homo sapiens
aggagcaaatgtttctgc

SEQ ID NO: 2004160 - DNA, 18 bp, Homo sapiens
aggagcaagagagggcaa

SEQ ID NO: 2004161 - DNA, 18 bp, Homo sapiens
aggagcacacggccctgc

SEQ ID NO: 2004162 - DNA, 23 bp, Homo sapiens
aggagcacacggccctgccccat

SEQ ID NO: 2004163 - DNA, 15 bp, Homo sapiens
aggagcacaggcagc

SEQ ID NO: 2004164 - DNA, 22 bp, Homo sapiens
aggagcacaggcagctggatga

SEQ ID NO: 2004165 - DNA, 17 bp, Homo sapiens
aggagcagacagagaaa

SEQ ID NO: 2004166 - DNA, 16 bp, Homo sapiens
aggagcagagggccta

SEQ ID NO: 2004167 - DNA, 19 bp, Homo sapiens
aggagcagagggcctagga

SEQ ID NO: 2004168 - DNA, 11 bp, Homo sapiens
aggagcagggt

SEQ ID NO: 2004169 - DNA, 17 bp, Homo sapiens
aggagcccagaaaacct

SEQ ID NO: 2004170 - DNA, 13 bp, Homo sapiens
aggagcccagagg

SEQ ID NO: 2004171 - DNA, 21 bp, Homo sapiens
aggagccggaccaagatgggc

SEQ ID NO: 2004172 - DNA, 12 bp, Homo sapiens
aggagcctgtga

SEQ ID NO: 2004173 - DNA, 17 bp, Homo sapiens
aggagcctgtgaaccca

SEQ ID NO: 2004174 - DNA, 18 bp, Homo sapiens
aggagcctgtgaacccag

SEQ ID NO: 2004175 - DNA, 19 bp, Homo sapiens
aggagctcagccgtgcact

SEQ ID NO: 2004176 - DNA, 23 bp, Homo sapiens
aggagctccgctaagacctcccc

SEQ ID NO: 2004177 - DNA, 20 bp, Homo sapiens
aggagctgatttccaggccc

SEQ ID NO: 2004178 - DNA, 20 bp, Homo sapiens
aggagctgccgcaaggccct

SEQ ID NO: 2004179 - DNA, 19 bp, Homo sapiens
aggaggaaaacgggaaaga

SEQ ID NO: 2004180 - DNA, 16 bp, Homo sapiens
aggaggagctgccgca

SEQ ID NO: 2004181 - DNA, 13 bp, Homo sapiens
aggaggaggaagg

SEQ ID NO: 2004182 - DNA, 16 bp, Homo sapiens
aggaggaggaaggcaa

SEQ ID NO: 2004183 - DNA, 16 bp, Homo sapiens
aggaggaggaggaagg

SEQ ID NO: 2004184 - DNA, 20 bp, Homo sapiens
aggaggattgcttgagccca

SEQ ID NO: 2004185 - DNA, 14 bp, Homo sapiens
aggaggcagagaag

SEQ ID NO: 2004186 - DNA, 23 bp, Homo sapiens
aggaggccctggtgtcaggcagg

SEQ ID NO: 2004187 - DNA, 15 bp, Homo sapiens
aggaggcctggcctt

SEQ ID NO: 2004188 - DNA, 16 bp, Homo sapiens
aggaggctgaggcaga

SEQ ID NO: 2004189 - DNA, 13 bp, Homo sapiens
aggaggctgcatg

SEQ ID NO: 2004190 - DNA, 19 bp, Homo sapiens
aggaggctgcatgctctgg

SEQ ID NO: 2004191 - DNA, 20 bp, Homo sapiens
aggaggctgcatgctctgga

SEQ ID NO: 2004192 - DNA, 20 bp, Homo sapiens
aggaggcttggaaagcatca

SEQ ID NO: 2004193 - DNA, 14 bp, Homo sapiens
aggagggacaaagg

SEQ ID NO: 2004194 - DNA, 14 bp, Homo sapiens
aggagggacaagaa

SEQ ID NO: 2004195 - DNA, 15 bp, Homo sapiens
aggagggacaagaat

SEQ ID NO: 2004196 - DNA, 19 bp, Homo sapiens
aggagggactgtcgctgct

SEQ ID NO: 2004197 - DNA, 18 bp, Homo sapiens
aggagggcagagccatgg

SEQ ID NO: 2004198 - DNA, 19 bp, Homo sapiens
aggaggggcacctgccacc

SEQ ID NO: 2004199 - DNA, 18 bp, Homo sapiens
aggagggtggaggaaggt

SEQ ID NO: 2004200 - DNA, 22 bp, Homo sapiens
aggagggtggaggaaggtgctg

SEQ ID NO: 2004201 - DNA, 22 bp, Homo sapiens
aggagggttgggcgtgctacct

SEQ ID NO: 2004202 - DNA, 14 bp, Homo sapiens
aggaggtcctcctc

SEQ ID NO: 2004203 - DNA, 17 bp, Homo sapiens
aggaggtggcagccctg

SEQ ID NO: 2004204 - DNA, 15 bp, Homo sapiens
aggaggtgtcccaag

SEQ ID NO: 2004205 - DNA, 17 bp, Homo sapiens
aggaggtgtcccaagct

SEQ ID NO: 2004206 - DNA, 19 bp, Homo sapiens
aggaggttggtgactgaaa

SEQ ID NO: 2004207 - DNA, 17 bp, Homo sapiens
aggagtagctgagagga

SEQ ID NO: 2004208 - DNA, 17 bp, Homo sapiens
aggagtcaactggctgg

SEQ ID NO: 2004209 - DNA, 13 bp, Homo sapiens
aggagtctgaggt

SEQ ID NO: 2004210 - DNA, 17 bp, Homo sapiens
aggagtctgaggtcctg

SEQ ID NO: 2004211 - DNA, 13 bp, Homo sapiens
aggagtctgtgct

SEQ ID NO: 2004212 - DNA, 17 bp, Homo sapiens
aggagtctgtgctcttt

SEQ ID NO: 2004213 - DNA, 21 bp, Homo sapiens
aggagttcgagaccagcctgg

SEQ ID NO: 2004214 - DNA, 16 bp, Homo sapiens
aggagttcgaggctgc

SEQ ID NO: 2004215 - DNA, 13 bp, Homo sapiens
aggagttctgaag

SEQ ID NO: 2004216 - DNA, 22 bp, Homo sapiens
aggagttctgaagctgacagca

SEQ ID NO: 2004217 - DNA, 17 bp, Homo sapiens
aggagttctgacattca

SEQ ID NO: 2004218 - DNA, 20 bp, Homo sapiens
aggagttgagtacagtgagg

SEQ ID NO: 2004219 - DNA, 16 bp, Homo sapiens
aggagttgccagggaa

SEQ ID NO: 2004220 - DNA, 22 bp, Homo sapiens
aggagttggagaccaggcctga

SEQ ID NO: 2004221 - DNA, 17 bp, Homo sapiens
aggagtttgagacaagc

SEQ ID NO: 2004222 - DNA, 15 bp, Homo sapiens
aggagtttgtgtgtc

SEQ ID NO: 2004223 - DNA, 14 bp, Homo sapiens
aggatagcattttt

SEQ ID NO: 2004224 - DNA, 15 bp, Homo sapiens
aggatcaagaaagtg

SEQ ID NO: 2004225 - DNA, 14 bp, Homo sapiens
aggatcactggagc

SEQ ID NO: 2004226 - DNA, 15 bp, Homo sapiens
aggatcactggagcc

SEQ ID NO: 2004227 - DNA, 19 bp, Homo sapiens
aggatcactggagcccagg

SEQ ID NO: 2004228 - DNA, 20 bp, Homo sapiens
aggatcactggagcccagga

SEQ ID NO: 2004229 - DNA, 14 bp, Homo sapiens
aggatccgctgcca

SEQ ID NO: 2004230 - DNA, 19 bp, Homo sapiens
aggatcctcacaggagcag

SEQ ID NO: 2004231 - DNA, 16 bp, Homo sapiens
aggatctagaatgtgt

SEQ ID NO: 2004232 - DNA, 22 bp, Homo sapiens
aggatctagaatgtgttttctg

SEQ ID NO: 2004233 - DNA, 14 bp, Homo sapiens
aggatctagcttca

SEQ ID NO: 2004234 - DNA, 13 bp, Homo sapiens
aggatctctcagg

SEQ ID NO: 2004235 - DNA, 21 bp, Homo sapiens
aggatctctcaggagcacagg

SEQ ID NO: 2004236 - DNA, 19 bp, Homo sapiens
aggatgaatgaggtcccag

SEQ ID NO: 2004237 - DNA, 18 bp, Homo sapiens
aggatgactttttttctg

SEQ ID NO: 2004238 - DNA, 21 bp, Homo sapiens
aggatgatttcagaaggagaa

SEQ ID NO: 2004239 - DNA, 16 bp, Homo sapiens
aggatgcaacaaatat

SEQ ID NO: 2004240 - DNA, 17 bp, Homo sapiens
aggatggagagagggga

SEQ ID NO: 2004241 - DNA, 19 bp, Homo sapiens
aggatggagagaggggaat

SEQ ID NO: 2004242 - DNA, 17 bp, Homo sapiens
aggatggagccagctct

SEQ ID NO: 2004243 - DNA, 17 bp, Homo sapiens
aggatggattgcagtcc

SEQ ID NO: 2004244 - DNA, 18 bp, Homo sapiens
aggatgtaaacagtgcct

SEQ ID NO: 2004245 - DNA, 20 bp, Homo sapiens
aggatgtaaacagtgcctgc

SEQ ID NO: 2004246 - DNA, 21 bp, Homo sapiens
aggatgtaaacagtgcctgct

SEQ ID NO: 2004247 - DNA, 18 bp, Homo sapiens
aggatgtaactttataaa

SEQ ID NO: 2004248 - DNA, 12 bp, Homo sapiens
aggatgttctgg

SEQ ID NO: 2004249 - DNA, 20 bp, Homo sapiens
aggatgttctgggacacagt

SEQ ID NO: 2004250 - DNA, 21 bp, Homo sapiens
aggattaagatacactcctgc

SEQ ID NO: 2004251 - DNA, 15 bp, Homo sapiens
aggattacaggcctt

SEQ ID NO: 2004252 - DNA, 14 bp, Homo sapiens
aggattcctctctc

SEQ ID NO: 2004253 - DNA, 21 bp, Homo sapiens
aggattgatggtgctcccctt

SEQ ID NO: 2004254 - DNA, 20 bp, Homo sapiens
aggattgcttgagcccagga

SEQ ID NO: 2004255 - DNA, 18 bp, Homo sapiens
aggatttaacagtcattt

SEQ ID NO: 2004256 - DNA, 15 bp, Homo sapiens
aggatttcaagcctg

SEQ ID NO: 2004257 - DNA, 18 bp, Homo sapiens
aggcaaagcccctggaaa

SEQ ID NO: 2004258 - DNA, 14 bp, Homo sapiens
aggcaactgaggca

SEQ ID NO: 2004259 - DNA, 19 bp, Homo sapiens
aggcaactgaggcagacag

SEQ ID NO: 2004260 - DNA, 14 bp, Homo sapiens
aggcaagcacctcc

SEQ ID NO: 2004261 - DNA, 18 bp, Homo sapiens
aggcaagcacctcctgcc

SEQ ID NO: 2004262 - DNA, 19 bp, Homo sapiens
aggcaagcacctcctgcct

SEQ ID NO: 2004263 - DNA, 14 bp, Homo sapiens
aggcaagcccctca

SEQ ID NO: 2004264 - DNA, 20 bp, Homo sapiens
aggaagaaaccccaagcagc

SEQ ID NO: 2004265 - DNA, 11 bp, Homo sapiens
aggaagaagac

SEQ ID NO: 2004266 - DNA, 12 bp, Homo sapiens
aggaagagaagg

SEQ ID NO: 2004267 - DNA, 17 bp, Homo sapiens
aggaagagaaggagcag

SEQ ID NO: 2004268 - DNA, 12 bp, Homo sapiens
aggaagagcagg

SEQ ID NO: 2004269 - DNA, 20 bp, Homo sapiens
aggaagagcaggcacatgga

SEQ ID NO: 2004270 - DNA, 23 bp, Homo sapiens
aggaagagcaggcacatggagga

SEQ ID NO: 2004271 - DNA, 15 bp, Homo sapiens
aggaagatgaaagag

SEQ ID NO: 2004272 - DNA, 16 bp, Homo sapiens
aggaagatgaagagaa

SEQ ID NO: 2004273 - DNA, 20 bp, Homo sapiens
aggaagatgaagagaagctg

SEQ ID NO: 2004274 - DNA, 16 bp, Homo sapiens
aggaagccacagctgg

SEQ ID NO: 2004275 - DNA, 15 bp, Homo sapiens
aggaagccaggctga

SEQ ID NO: 2004276 - DNA, 18 bp, Homo sapiens
aggaagccaggctgagtg

SEQ ID NO: 2004277 - DNA, 19 bp, Homo sapiens
aggaagccaggctgagtga

SEQ ID NO: 2004278 - DNA, 16 bp, Homo sapiens
aggaagcctaaataaa

SEQ ID NO: 2004279 - DNA, 12 bp, Homo sapiens
aggaaggaaaga

SEQ ID NO: 2004280 - DNA, 16 bp, Homo sapiens
aggaaggactatgaaa

SEQ ID NO: 2004281 - DNA, 13 bp, Homo sapiens
aggaaggatggca

SEQ ID NO: 2004282 - DNA, 13 bp, Homo sapiens
aggaaggcagctg

SEQ ID NO: 2004283 - DNA, 14 bp, Homo sapiens
aggaaggcagctgc

SEQ ID NO: 2004284 - DNA, 19 bp, Homo sapiens
aggaaggcagctgctctta

SEQ ID NO: 2004285 - DNA, 16 bp, Homo sapiens
aggaagggccaggaga

SEQ ID NO: 2004286 - DNA, 19 bp, Homo sapiens
aggaagggccaggagagag

SEQ ID NO: 2004287 - DNA, 21 bp, Homo sapiens
aggaagggtgggaagcttgct

SEQ ID NO: 2004288 - DNA, 17 bp, Homo sapiens
aggaaggtgctgagctt

SEQ ID NO: 2004289 - DNA, 14 bp, Homo sapiens
aggaaggttttctc

SEQ ID NO: 2004290 - DNA, 17 bp, Homo sapiens
aggaagtgaaaataggt

SEQ ID NO: 2004291 - DNA, 14 bp, Homo sapiens
aggaagtgggggcc

SEQ ID NO: 2004292 - DNA, 17 bp, Homo sapiens
aggaagtgggggccgct

SEQ ID NO: 2004293 - DNA, 18 bp, Homo sapiens
aggaagtgggggccgctg

SEQ ID NO: 2004294 - DNA, 20 bp, Homo sapiens
aggaagtgggggccgctggc

SEQ ID NO: 2004295 - DNA, 23 bp, Homo sapiens
aggaagttattaacgggcatgta

SEQ ID NO: 2004296 - DNA, 19 bp, Homo sapiens
aggaataaattgctccttg

SEQ ID NO: 2004297 - DNA, 14 bp, Homo sapiens
aggaatagccagag

SEQ ID NO: 2004298 - DNA, 15 bp, Homo sapiens
aggaatagccagaga

SEQ ID NO: 2004299 - DNA, 17 bp, Homo sapiens
aggaatagccagagagg

SEQ ID NO: 2004300 - DNA, 16 bp, Homo sapiens
aggaatagcccgagga

SEQ ID NO: 2004301 - DNA, 15 bp, Homo sapiens
aggaatcagacttca

SEQ ID NO: 2004302 - DNA, 14 bp, Homo sapiens
aggaatcagctgca

SEQ ID NO: 2004303 - DNA, 23 bp, Homo sapiens
aggaatcatgtcaggcctgtgtg

SEQ ID NO: 2004304 - DNA, 23 bp, Homo sapiens
aggaatccagacccggctgcgtg

SEQ ID NO: 2004305 - DNA, 17 bp, Homo sapiens
aggaatctacctgtggt

SEQ ID NO: 2004306 - DNA, 14 bp, Homo sapiens
aggaatctcagaga

SEQ ID NO: 2004307 - DNA, 18 bp, Homo sapiens
aggaatctcagagacagg

SEQ ID NO: 2004308 - DNA, 19 bp, Homo sapiens
aggaatctgaaagtatatt

SEQ ID NO: 2004309 - DNA, 22 bp, Homo sapiens
aggaatgaccacgggcctcagt

SEQ ID NO: 2004310 - DNA, 22 bp, Homo sapiens
aggaatgttaaagtcagtggga

SEQ ID NO: 2004311 - DNA, 22 bp, Homo sapiens
aggaattctaggcatcccaggg

SEQ ID NO: 2004312 - DNA, 13 bp, Homo sapiens
aggaattgaagat

SEQ ID NO: 2004313 - DNA, 14 bp, Homo sapiens
aggaattgaagatg

SEQ ID NO: 2004314 - DNA, 16 bp, Homo sapiens
aggacaaggaagtggg

SEQ ID NO: 2004315 - DNA, 23 bp, Homo sapiens
aggacaaggaagtgggggccgct

SEQ ID NO: 2004316 - DNA, 15 bp, Homo sapiens
aggacaatgccttgg

SEQ ID NO: 2004317 - DNA, 23 bp, Homo sapiens
aggacacaagcacagttttaaga

SEQ ID NO: 2004318 - DNA, 14 bp, Homo sapiens
aggacacacagtct

SEQ ID NO: 2004319 - DNA, 23 bp, Homo sapiens
aggacacacagtctcagtccaga

SEQ ID NO: 2004320 - DNA, 15 bp, Homo sapiens
aggacacaggcctgt

SEQ ID NO: 2004321 - DNA, 13 bp, Homo sapiens
aggacacatgtcc

SEQ ID NO: 2004322 - DNA, 16 bp, Homo sapiens
aggacacctgccccag

SEQ ID NO: 2004323 - DNA, 16 bp, Homo sapiens
aggacacgtggcctgc

SEQ ID NO: 2004324 - DNA, 19 bp, Homo sapiens
aggacactaaccacgctgg

SEQ ID NO: 2004325 - DNA, 23 bp, Homo sapiens
aggacactaaccacgctggacct

SEQ ID NO: 2004326 - DNA, 23 bp, Homo sapiens
aggacagcctgtggcggtgcctg

SEQ ID NO: 2004327 - DNA, 17 bp, Homo sapiens
aggacagctggctgctg

SEQ ID NO: 2004328 - DNA, 18 bp, Homo sapiens
aggacaggaccagatttt

SEQ ID NO: 2004329 - DNA, 19 bp, Homo sapiens
aggacagtgcttcagcctg

SEQ ID NO: 2004330 - DNA, 22 bp, Homo sapiens
aggacagtgcttcagcctgagg

SEQ ID NO: 2004331 - DNA, 20 bp, Homo sapiens
aggacataaattagaggtct

SEQ ID NO: 2004332 - DNA, 22 bp, Homo sapiens
aggacatgatactgatgccatg

SEQ ID NO: 2004333 - DNA, 17 bp, Homo sapiens
aggacatggagagagac

SEQ ID NO: 2004334 - DNA, 16 bp, Homo sapiens
aggacatgtttttgtt

SEQ ID NO: 2004335 - DNA, 21 bp, Homo sapiens
aggacatgtttttgttttctt

SEQ ID NO: 2004336 - DNA, 19 bp, Homo sapiens
aggacattgcggacagcca

SEQ ID NO: 2004337 - DNA, 21 bp, Homo sapiens
aggacattttctctttaaaag

SEQ ID NO: 2004338 - DNA, 23 bp, Homo sapiens
aggaccaactggcttctgtgcac

SEQ ID NO: 2004339 - DNA, 20 bp, Homo sapiens
aggacccacccatcttcctg

SEQ ID NO: 2004340 - DNA, 22 bp, Homo sapiens
aggacccacccatcttcctgct

SEQ ID NO: 2004341 - DNA, 12 bp, Homo sapiens
aggacccaggcc

SEQ ID NO: 2004342 - DNA, 17 bp, Homo sapiens
aggacccaggccctcca

SEQ ID NO: 2004343 - DNA, 20 bp, Homo sapiens
aggacccaggccgcctgcca

SEQ ID NO: 2004344 - DNA, 20 bp, Homo sapiens
aggacccggaggggcctggc

SEQ ID NO: 2004345 - DNA, 19 bp, Homo sapiens
aggaccctgttttccacac

SEQ ID NO: 2004346 - DNA, 18 bp, Homo sapiens
aggacctcaggcggggag

SEQ ID NO: 2004347 - DNA, 21 bp, Homo sapiens
aggacctcaggcggggaggag

SEQ ID NO: 2004348 - DNA, 21 bp, Homo sapiens
aggacctcatatcttcctcat

SEQ ID NO: 2004349 - DNA, 12 bp, Homo sapiens
aggacctgagcc

SEQ ID NO: 2004350 - DNA, 17 bp, Homo sapiens
aggacctgagcctgccg

SEQ ID NO: 2004351 - DNA, 18 bp, Homo sapiens
aggacctgagcctgccga

SEQ ID NO: 2004352 - DNA, 20 bp, Homo sapiens
aggacggttgtaagcagttg

SEQ ID NO: 2004353 - DNA, 17 bp, Homo sapiens
aggactaacactcagaa

SEQ ID NO: 2004354 - DNA, 23 bp, Homo sapiens
aggactaacactcagaagcctgg

SEQ ID NO: 2004355 - DNA, 16 bp, Homo sapiens
aggactactatttgaa

SEQ ID NO: 2004356 - DNA, 16 bp, Homo sapiens
aggactatagcccagg

SEQ ID NO: 2004357 - DNA, 16 bp, Homo sapiens
aggactattaattcca

SEQ ID NO: 2004358 - DNA, 19 bp, Homo sapiens
aggactccccaggccaggc

SEQ ID NO: 2004359 - DNA, 21 bp, Homo sapiens
aggactctgccccttctgttt

SEQ ID NO: 2004360 - DNA, 13 bp, Homo sapiens
aggactctgcctc

SEQ ID NO: 2004361 - DNA, 14 bp, Homo sapiens
aggactctgcctcc

SEQ ID NO: 2004362 - DNA, 18 bp, Homo sapiens
aggactctgcctcctctt

SEQ ID NO: 2004363 - DNA, 13 bp, Homo sapiens
aggactctgcctt

SEQ ID NO: 2004364 - DNA, 14 bp, Homo sapiens
aggactctggcctc

SEQ ID NO: 2004365 - DNA, 19 bp, Homo sapiens
aggactgaattgtccccag

SEQ ID NO: 2004366 - DNA, 10 bp, Homo sapiens
aggactggct

SEQ ID NO: 2004367 - DNA, 14 bp, Homo sapiens
aggactggctcacc

SEQ ID NO: 2004368 - DNA, 15 bp, Homo sapiens
aggactggctcaccc

SEQ ID NO: 2004369 - DNA, 22 bp, Homo sapiens
aggacttgagcctccatttctg

SEQ ID NO: 2004370 - DNA, 16 bp, Homo sapiens
aggactttccagtgag

SEQ ID NO: 2004371 - DNA, 21 bp, Homo sapiens
aggactttcctaaatgtttaa

SEQ ID NO: 2004372 - DNA, 17 bp, Homo sapiens
aggacttttctttgtgg

SEQ ID NO: 2004373 - DNA, 22 bp, Homo sapiens
aggacttttctttgtggcttcc

SEQ ID NO: 2004374 - DNA, 13 bp, Homo sapiens
aggagaaaggagc

SEQ ID NO: 2004375 - DNA, 16 bp, Homo sapiens
aggagaaaggagctct

SEQ ID NO: 2004376 - DNA, 11 bp, Homo sapiens
aggagaaataa

SEQ ID NO: 2004377 - DNA, 16 bp, Homo sapiens
aggagaaatgcatcca

SEQ ID NO: 2004378 - DNA, 16 bp, Homo sapiens
aggagaaggaaggaga

SEQ ID NO: 2004379 - DNA, 16 bp, Homo sapiens
aggagaatccaagcga

SEQ ID NO: 2004380 - DNA, 15 bp, Homo sapiens
aggcaagcccctcag

SEQ ID NO: 2004381 - DNA, 19 bp, Homo sapiens
aggcaagcccctcagccct

SEQ ID NO: 2004382 - DNA, 23 bp, Homo sapiens
aggcaagcccctcagcccttgcc

SEQ ID NO: 2004383 - DNA, 13 bp, Homo sapiens
aggcaagtgaaga

SEQ ID NO: 2004384 - DNA, 17 bp, Homo sapiens
aggcaatgtcaggaaca

SEQ ID NO: 2004385 - DNA, 20 bp, Homo sapiens
aggcacacagcagcccccca

SEQ ID NO: 2004386 - DNA, 23 bp, Homo sapiens
aggcacacagcagccccccagca

SEQ ID NO: 2004387 - DNA, 12 bp, Homo sapiens
aggcacacttct

SEQ ID NO: 2004388 - DNA, 16 bp, Homo sapiens
aggcacacttcttctt

SEQ ID NO: 2004389 - DNA, 14 bp, Homo sapiens
aggcacaggcagga

SEQ ID NO: 2004390 - DNA, 20 bp, Homo sapiens
aggcacaggcaggaagagag

SEQ ID NO: 2004391 - DNA, 22 bp, Homo sapiens
aggcacaggcaggaagagagag

SEQ ID NO: 2004392 - DNA, 13 bp, Homo sapiens
aggcacatggagg

SEQ ID NO: 2004393 - DNA, 14 bp, Homo sapiens
aggcacatggagga

SEQ ID NO: 2004394 - DNA, 13 bp, Homo sapiens
aggcaccagctct

SEQ ID NO: 2004395 - DNA, 15 bp, Homo sapiens
aggcaccagctctgt

SEQ ID NO: 2004396 - DNA, 20 bp, Homo sapiens
aggcaccagctctgtggcct

SEQ ID NO: 2004397 - DNA, 22 bp, Homo sapiens
aggcaccagctctgtggcctgt

SEQ ID NO: 2004398 - DNA, 15 bp, Homo sapiens
aggcacccaccatca

SEQ ID NO: 2004399 - DNA, 15 bp, Homo sapiens
aggcaccccctggag

SEQ ID NO: 2004400 - DNA, 19 bp, Homo sapiens
aggcaccccctggagagaa

SEQ ID NO: 2004401 - DNA, 15 bp, Homo sapiens
aggcaccggcgctgc

SEQ ID NO: 2004402 - DNA, 18 bp, Homo sapiens
aggcaccggcgctgcagg

SEQ ID NO: 2004403 - DNA, 16 bp, Homo sapiens
aggcacctgctggaaa

SEQ ID NO: 2004404 - DNA, 14 bp, Homo sapiens
aggcacgaacccac

SEQ ID NO: 2004405 - DNA, 18 bp, Homo sapiens
aggcacgaacccacctgc

SEQ ID NO: 2004406 - DNA, 21 bp, Homo sapiens
aggcacgaacccacctgctga

SEQ ID NO: 2004407 - DNA, 21 bp, Homo sapiens
aggcacgccagtttcaccatt

SEQ ID NO: 2004408 - DNA, 19 bp, Homo sapiens
aggcacgtttggcatttct

SEQ ID NO: 2004409 - DNA, 16 bp, Homo sapiens
aggcactgctgcccag

SEQ ID NO: 2004410 - DNA, 15 bp, Homo sapiens
aggcagaagaattga

SEQ ID NO: 2004411 - DNA, 14 bp, Homo sapiens
aggcagacaagagc

SEQ ID NO: 2004412 - DNA, 18 bp, Homo sapiens
aggcagacgtggggaggg

SEQ ID NO: 2004413 - DNA, 22 bp, Homo sapiens
aggcagacgtggggagggtgga

SEQ ID NO: 2004414 - DNA, 18 bp, Homo sapiens
aggcagagaaagaagaga

SEQ ID NO: 2004415 - DNA, 21 bp, Homo sapiens
aggcagagaaagaagagacag

SEQ ID NO: 2004416 - DNA, 13 bp, Homo sapiens
aggcagagaagaa

SEQ ID NO: 2004417 - DNA, 22 bp, Homo sapiens
aggcagagaatcatacttagca

SEQ ID NO: 2004418 - DNA, 20 bp, Homo sapiens
aggcagagacaataaaacat

SEQ ID NO: 2004419 - DNA, 17 bp, Homo sapiens
aggcagagcggggaggt

SEQ ID NO: 2004420 - DNA, 13 bp, Homo sapiens
aggcagatacagg

SEQ ID NO: 2004421 - DNA, 15 bp, Homo sapiens
aggcagcaaggcccg

SEQ ID NO: 2004422 - DNA, 16 bp, Homo sapiens
aggcagcaaggcccga

SEQ ID NO: 2004423 - DNA, 18 bp, Homo sapiens
aggcagcaaggcccgagc

SEQ ID NO: 2004424 - DNA, 23 bp, Homo sapiens
aggcagcaaggcccgagcagctg

SEQ ID NO: 2004425 - DNA, 19 bp, Homo sapiens
aggcagccccattctgcct

SEQ ID NO: 2004426 - DNA, 20 bp, Homo sapiens
aggcagccccattctgcctg

SEQ ID NO: 2004427 - DNA, 22 bp, Homo sapiens
aggcagccccattctgcctgcc

SEQ ID NO: 2004428 - DNA, 12 bp, Homo sapiens
aggcagcctcca

SEQ ID NO: 2004429 - DNA, 14 bp, Homo sapiens
aggcagcctccaga

SEQ ID NO: 2004430 - DNA, 16 bp, Homo sapiens
aggcagcctccagagc

SEQ ID NO: 2004431 - DNA, 19 bp, Homo sapiens
aggcagcctccagagccag

SEQ ID NO: 2004432 - DNA, 21 bp, Homo sapiens
aggcagcctccagagccagcc

SEQ ID NO: 2004433 - DNA, 22 bp, Homo sapiens
aggcagcctccagagccagcct

SEQ ID NO: 2004434 - DNA, 23 bp, Homo sapiens
aggcagcctccagagccagcctg

SEQ ID NO: 2004435 - DNA, 13 bp, Homo sapiens
aggcagctgctct

SEQ ID NO: 2004436 - DNA, 22 bp, Homo sapiens
aggcagctggatgagacttcca

SEQ ID NO: 2004437 - DNA, 22 bp, Homo sapiens
aggcagctgtgtgggctgcaga

SEQ ID NO: 2004438 - DNA, 15 bp, Homo sapiens
aggcaggagtggcag

SEQ ID NO: 2004439 - DNA, 13 bp, Homo sapiens
aggcaggcagggc

SEQ ID NO: 2004440 - DNA, 14 bp, Homo sapiens
aggcaggcagggct

SEQ ID NO: 2004441 - DNA, 16 bp, Homo sapiens
aggcaggctccccctg

SEQ ID NO: 2004442 - DNA, 22 bp, Homo sapiens
aggcagggaaaggctctgaaag

SEQ ID NO: 2004443 - DNA, 22 bp, Homo sapiens
aggcagggaggaggcagagaag

SEQ ID NO: 2004444 - DNA, 16 bp, Homo sapiens
aggcagggaggggact

SEQ ID NO: 2004445 - DNA, 15 bp, Homo sapiens
aggcagggcagaggg

SEQ ID NO: 2004446 - DNA, 19 bp, Homo sapiens
aggcagggcagagggaatg

SEQ ID NO: 2004447 - DNA, 20 bp, Homo sapiens
aggcagggccttgcccagag

SEQ ID NO: 2004448 - DNA, 21 bp, Homo sapiens
aggcagggccttgcccagaga

SEQ ID NO: 2004449 - DNA, 22 bp, Homo sapiens
aggcagggccttgcccagagat

SEQ ID NO: 2004450 - DNA, 14 bp, Homo sapiens
aggcagggctctcc

SEQ ID NO: 2004451 - DNA, 18 bp, Homo sapiens
aggcagggctctcctggc

SEQ ID NO: 2004452 - DNA, 19 bp, Homo sapiens
aggcagggctctcctggct

SEQ ID NO: 2004453 - DNA, 13 bp, Homo sapiens
aggcaggggcgga

SEQ ID NO: 2004454 - DNA, 17 bp, Homo sapiens
aggcaggggtgggagag

SEQ ID NO: 2004455 - DNA, 14 bp, Homo sapiens
aggcagggtcagga

SEQ ID NO: 2004456 - DNA, 17 bp, Homo sapiens
aggcagggtcaggagag

SEQ ID NO: 2004457 - DNA, 12 bp, Homo sapiens
aggcagggtctc

SEQ ID NO: 2004458 - DNA, 22 bp, Homo sapiens
aggcaggtcttgaactcctggc

SEQ ID NO: 2004459 - DNA, 17 bp, Homo sapiens
aggcaggtttgccagtg

SEQ ID NO: 2004460 - DNA, 16 bp, Homo sapiens
aggcatagggaatatg

SEQ ID NO: 2004461 - DNA, 16 bp, Homo sapiens
aggcatcccaggggac

SEQ ID NO: 2004462 - DNA, 23 bp, Homo sapiens
aggcatcccaggggaccacacct

SEQ ID NO: 2004463 - DNA, 17 bp, Homo sapiens
aggcatctacacagcct

SEQ ID NO: 2004464 - DNA, 19 bp, Homo sapiens
aggcatctacacagcctgg

SEQ ID NO: 2004465 - DNA, 22 bp, Homo sapiens
aggcatctacacagcctggact

SEQ ID NO: 2004466 - DNA, 20 bp, Homo sapiens
aggcatgagggatcacaggg

SEQ ID NO: 2004467 - DNA, 22 bp, Homo sapiens
aggcatgagggatcacagggcc

SEQ ID NO: 2004468 - DNA, 16 bp, Homo sapiens
aggcatgcaccagtgc

SEQ ID NO: 2004469 - DNA, 14 bp, Homo sapiens
aggcatgcctctga

SEQ ID NO: 2004470 - DNA, 18 bp, Homo sapiens
aggcatgctggcctccca

SEQ ID NO: 2004471 - DNA, 18 bp, Homo sapiens
aggcatggagacagcgaa

SEQ ID NO: 2004472 - DNA, 21 bp, Homo sapiens
aggcatggccctggggtccca

SEQ ID NO: 2004473 - DNA, 20 bp, Homo sapiens
aggcattatttaatgtttga

SEQ ID NO: 2004474 - DNA, 17 bp, Homo sapiens
aggcatttcctgggtgg

SEQ ID NO: 2004475 - DNA, 20 bp, Homo sapiens
aggcatttctatcacatatt

SEQ ID NO: 2004476 - DNA, 23 bp, Homo sapiens
aggcatttgcctaattcctggca

SEQ ID NO: 2004477 - DNA, 12 bp, Homo sapiens
aggcattttgtt

SEQ ID NO: 2004478 - DNA, 17 bp, Homo sapiens
aggccaagagcagaggc

SEQ ID NO: 2004479 - DNA, 20 bp, Homo sapiens
aggccaagctgaagtgaagg

SEQ ID NO: 2004480 - DNA, 13 bp, Homo sapiens
aggccaaggcagg

SEQ ID NO: 2004481 - DNA, 21 bp, Homo sapiens
aggccacaccatctcctttca

SEQ ID NO: 2004482 - DNA, 15 bp, Homo sapiens
aggccacatgtcacc

SEQ ID NO: 2004483 - DNA, 22 bp, Homo sapiens
aggccaccatattcagtgctgt

SEQ ID NO: 2004484 - DNA, 14 bp, Homo sapiens
aggccaccgggaca

SEQ ID NO: 2004485 - DNA, 18 bp, Homo sapiens
aggccacgctcaggcccg

SEQ ID NO: 2004486 - DNA, 19 bp, Homo sapiens
aggccactcctccaaagga

SEQ ID NO: 2004487 - DNA, 14 bp, Homo sapiens
aggccactgtggcc

SEQ ID NO: 2004488 - DNA, 15 bp, Homo sapiens
aggccactgtggcca

SEQ ID NO: 2004489 - DNA, 19 bp, Homo sapiens
aggccactgtggccagagc

SEQ ID NO: 2004490 - DNA, 20 bp, Homo sapiens
aggccactgtggccagagct

SEQ ID NO: 2004491 - DNA, 22 bp, Homo sapiens
aggccactgtggccagagctgg

SEQ ID NO: 2004492 - DNA, 20 bp, Homo sapiens
aggccagagggagtgacaga

SEQ ID NO: 2004493 - DNA, 20 bp, Homo sapiens
aggccagaggtgctgtcagc

SEQ ID NO: 2004494 - DNA, 20 bp, Homo sapiens
aggccagccccatcttggtc

SEQ ID NO: 2004495 - DNA, 12 bp, Homo sapiens
aggccagcctgg

SEQ ID NO: 2004496 - DNA, 19 bp, Homo sapiens
aggctcctgtgctactttg

SEQ ID NO: 2004497 - DNA, 15 bp, Homo sapiens
aggctccttcatgtg

SEQ ID NO: 2004498 - DNA, 19 bp, Homo sapiens
aggctcctttagcgcccag

SEQ ID NO: 2004499 - DNA, 18 bp, Homo sapiens
aggctctgaaatcttggg

SEQ ID NO: 2004500 - DNA, 19 bp, Homo sapiens
aggctctgacccagtgaga

SEQ ID NO: 2004501 - DNA, 17 bp, Homo sapiens
aggctctgggaaggggt

SEQ ID NO: 2004502 - DNA, 13 bp, Homo sapiens
aggctctgggctc

SEQ ID NO: 2004503 - DNA, 20 bp, Homo sapiens
aggctcttcctggacctgag

SEQ ID NO: 2004504 - DNA, 20 bp, Homo sapiens
aggctcttctccttggagga

SEQ ID NO: 2004505 - DNA, 15 bp, Homo sapiens
aggctctttctgggc

SEQ ID NO: 2004506 - DNA, 20 bp, Homo sapiens
aggctctttctgggccaagt

SEQ ID NO: 2004507 - DNA, 17 bp, Homo sapiens
aggctgaccaagagaga

SEQ ID NO: 2004508 - DNA, 20 bp, Homo sapiens
aggctgaccaagagagaaag

SEQ ID NO: 2004509 - DNA, 16 bp, Homo sapiens
aggctgagactgcggg

SEQ ID NO: 2004510 - DNA, 15 bp, Homo sapiens
aggctgagcccagcc

SEQ ID NO: 2004511 - DNA, 20 bp, Homo sapiens
aggctgagcccagccacctc

SEQ ID NO: 2004512 - DNA, 13 bp, Homo sapiens
aggctgaggactt

SEQ ID NO: 2004513 - DNA, 18 bp, Homo sapiens
aggctgaggcaagagaat

SEQ ID NO: 2004514 - DNA, 14 bp, Homo sapiens
aggctgaggcagga

SEQ ID NO: 2004515 - DNA, 17 bp, Homo sapiens
aggctgaggcaggagaa

SEQ ID NO: 2004516 - DNA, 17 bp, Homo sapiens
aggctgaggcaggagga

SEQ ID NO: 2004517 - DNA, 11 bp, Homo sapiens
aggctgaggcg

SEQ ID NO: 2004518 - DNA, 18 bp, Homo sapiens
aggctgagtgagccacag

SEQ ID NO: 2004519 - DNA, 22 bp, Homo sapiens
aggctgagtgagccacagacca

SEQ ID NO: 2004520 - DNA, 11 bp, Homo sapiens
aggctgcactg

SEQ ID NO: 2004521 - DNA, 18 bp, Homo sapiens
aggctgcagaaggccaag

SEQ ID NO: 2004522 - DNA, 19 bp, Homo sapiens
aggctgcagagctgaccca

SEQ ID NO: 2004523 - DNA, 15 bp, Homo sapiens
aggctgcagcgagct

SEQ ID NO: 2004524 - DNA, 21 bp, Homo sapiens
aggctgcagtcagtcatgatg

SEQ ID NO: 2004525 - DNA, 15 bp, Homo sapiens
aggctgcatgctctg

SEQ ID NO: 2004526 - DNA, 19 bp, Homo sapiens
aggctgcatgctctggaag

SEQ ID NO: 2004527 - DNA, 18 bp, Homo sapiens
aggctgctcttgaattcc

SEQ ID NO: 2004528 - DNA, 12 bp, Homo sapiens
aggctgctgtgt

SEQ ID NO: 2004529 - DNA, 19 bp, Homo sapiens
aggctgctgtgtagctctg

SEQ ID NO: 2004530 - DNA, 12 bp, Homo sapiens
aggctggagaag

SEQ ID NO: 2004531 - DNA, 13 bp, Homo sapiens
aggctggagaagc

SEQ ID NO: 2004532 - DNA, 14 bp, Homo sapiens
aggctggagatcct

SEQ ID NO: 2004533 - DNA, 18 bp, Homo sapiens
aggctggcgtgcagtggt

SEQ ID NO: 2004534 - DNA, 22 bp, Homo sapiens
aggctggctggcccgtcatgtt

SEQ ID NO: 2004535 - DNA, 18 bp, Homo sapiens
aggctgggccagcctcag

SEQ ID NO: 2004536 - DNA, 14 bp, Homo sapiens
aggctgggcccctg

SEQ ID NO: 2004537 - DNA, 18 bp, Homo sapiens
aggctgggcttcagtggc

SEQ ID NO: 2004538 - DNA, 19 bp, Homo sapiens
aggctgggcttcagtggca

SEQ ID NO: 2004539 - DNA, 22 bp, Homo sapiens
aggctgggcttcagtggcagct

SEQ ID NO: 2004540 - DNA, 23 bp, Homo sapiens
aggctgggcttcagtggcagctg

SEQ ID NO: 2004541 - DNA, 13 bp, Homo sapiens
aggctggggccag

SEQ ID NO: 2004542 - DNA, 18 bp, Homo sapiens
aggctggtctccctccag

SEQ ID NO: 2004543 - DNA, 22 bp, Homo sapiens
aggctggtctcgaactcctgac

SEQ ID NO: 2004544 - DNA, 20 bp, Homo sapiens
aggctggtgctgtggccagg

SEQ ID NO: 2004545 - DNA, 13 bp, Homo sapiens
aggctgtatccca

SEQ ID NO: 2004546 - DNA, 18 bp, Homo sapiens
aggctgtatcccatgagc

SEQ ID NO: 2004547 - DNA, 20 bp, Homo sapiens
aggctgtggtggctgtctct

SEQ ID NO: 2004548 - DNA, 21 bp, Homo sapiens
aggctgtggtggctgtctctg

SEQ ID NO: 2004549 - DNA, 18 bp, Homo sapiens
aggctgttctgcactgaa

SEQ ID NO: 2004550 - DNA, 20 bp, Homo sapiens
aggctgttctgcactgaaaa

SEQ ID NO: 2004551 - DNA, 21 bp, Homo sapiens
aggctgttctgcactgaaaag

SEQ ID NO: 2004552 - DNA, 15 bp, Homo sapiens
aggcttaaaagagta

SEQ ID NO: 2004553 - DNA, 12 bp, Homo sapiens
aggcttcaccct

SEQ ID NO: 2004554 - DNA, 20 bp, Homo sapiens
aggcttcagcatatttatag

SEQ ID NO: 2004555 - DNA, 13 bp, Homo sapiens
aggcttccagaga

SEQ ID NO: 2004556 - DNA, 14 bp, Homo sapiens
aggcttccagagag

SEQ ID NO: 2004557 - DNA, 12 bp, Homo sapiens
aggcttccaggc

SEQ ID NO: 2004558 - DNA, 18 bp, Homo sapiens
aggcttccaggctcttcc

SEQ ID NO: 2004559 - DNA, 13 bp, Homo sapiens
aggcttcctgact

SEQ ID NO: 2004560 - DNA, 14 bp, Homo sapiens
aggcttcctgactg

SEQ ID NO: 2004561 - DNA, 23 bp, Homo sapiens
aggcttcctgactgacacaggcc

SEQ ID NO: 2004562 - DNA, 16 bp, Homo sapiens
aggcttccttcatttc

SEQ ID NO: 2004563 - DNA, 18 bp, Homo sapiens
aggcttccttcatttcct

SEQ ID NO: 2004564 - DNA, 22 bp, Homo sapiens
aggcttcttcagatcagtgctt

SEQ ID NO: 2004565 - DNA, 21 bp, Homo sapiens
aggctttcaattgtattttat

SEQ ID NO: 2004566 - DNA, 19 bp, Homo sapiens
aggctttgccatgggcctg

SEQ ID NO: 2004567 - DNA, 14 bp, Homo sapiens
agggaaaaatatat

SEQ ID NO: 2004568 - DNA, 14 bp, Homo sapiens
agggaaaatgaatt

SEQ ID NO: 2004569 - DNA, 19 bp, Homo sapiens
agggaaactgccagcaacg

SEQ ID NO: 2004570 - DNA, 13 bp, Homo sapiens
agggaaactggct

SEQ ID NO: 2004571 - DNA, 22 bp, Homo sapiens
agggaaaggctctgaaagccag

SEQ ID NO: 2004572 - DNA, 13 bp, Homo sapiens
agggaaatggagg

SEQ ID NO: 2004573 - DNA, 18 bp, Homo sapiens
agggaaatggagggtggg

SEQ ID NO: 2004574 - DNA, 19 bp, Homo sapiens
agggaacacggcctactga

SEQ ID NO: 2004575 - DNA, 17 bp, Homo sapiens
agggaacagacaggaga

SEQ ID NO: 2004576 - DNA, 19 bp, Homo sapiens
agggaaccgtctgttttta

SEQ ID NO: 2004577 - DNA, 20 bp, Homo sapiens
agggaaccgtctgtttttaa

SEQ ID NO: 2004578 - DNA, 16 bp, Homo sapiens
agggaagagggcagta

SEQ ID NO: 2004579 - DNA, 14 bp, Homo sapiens
agggaagagtgcat

SEQ ID NO: 2004580 - DNA, 12 bp, Homo sapiens
agggaagcaggc

SEQ ID NO: 2004581 - DNA, 13 bp, Homo sapiens
agggaagcaggca

SEQ ID NO: 2004582 - DNA, 14 bp, Homo sapiens
agggaagcaggcag

SEQ ID NO: 2004583 - DNA, 14 bp, Homo sapiens
agggaagcagggac

SEQ ID NO: 2004584 - DNA, 14 bp, Homo sapiens
agggaaggcaggca

SEQ ID NO: 2004585 - DNA, 14 bp, Homo sapiens
agggaaggctgctg

SEQ ID NO: 2004586 - DNA, 16 bp, Homo sapiens
agggaaggctgctgtg

SEQ ID NO: 2004587 - DNA, 19 bp, Homo sapiens
agggaataaggtacaagaa

SEQ ID NO: 2004588 - DNA, 20 bp, Homo sapiens
agggaatatgtaagtcagga

SEQ ID NO: 2004589 - DNA, 19 bp, Homo sapiens
agggaatccgcctgcagag

SEQ ID NO: 2004590 - DNA, 18 bp, Homo sapiens
agggaatgaacctggagg

SEQ ID NO: 2004591 - DNA, 15 bp, Homo sapiens
agggaatggcacagc

SEQ ID NO: 2004592 - DNA, 17 bp, Homo sapiens
agggaatgttccctgca

SEQ ID NO: 2004593 - DNA, 15 bp, Homo sapiens
agggaatttcaggaa

SEQ ID NO: 2004594 - DNA, 20 bp, Homo sapiens
agggacaaagaaatcccccc

SEQ ID NO: 2004595 - DNA, 16 bp, Homo sapiens
agggacaaaggagcct

SEQ ID NO: 2004596 - DNA, 18 bp, Homo sapiens
agggacaaaggagcctgt

SEQ ID NO: 2004597 - DNA, 19 bp, Homo sapiens
agggacaaaggagcctgtg

SEQ ID NO: 2004598 - DNA, 21 bp, Homo sapiens
agggacaaaggagcctgtgaa

SEQ ID NO: 2004599 - DNA, 14 bp, Homo sapiens
agggacaacatttt

SEQ ID NO: 2004600 - DNA, 13 bp, Homo sapiens
agggacaacccca

SEQ ID NO: 2004601 - DNA, 12 bp, Homo sapiens
agggacacacac

SEQ ID NO: 2004602 - DNA, 10 bp, Homo sapiens
agggacagag

SEQ ID NO: 2004603 - DNA, 19 bp, Homo sapiens
agggaccaaattgcttcta

SEQ ID NO: 2004604 - DNA, 21 bp, Homo sapiens
agggacgctttgggagaatgt

SEQ ID NO: 2004605 - DNA, 21 bp, Homo sapiens
agggacttcctctttctctcc

SEQ ID NO: 2004606 - DNA, 23 bp, Homo sapiens
agggacttctgtcttcacaacag

SEQ ID NO: 2004607 - DNA, 15 bp, Homo sapiens
agggacttggaagct

SEQ ID NO: 2004608 - DNA, 18 bp, Homo sapiens
agggacttggaagctccg

SEQ ID NO: 2004609 - DNA, 13 bp, Homo sapiens
agggagaatgcag

SEQ ID NO: 2004610 - DNA, 13 bp, Homo sapiens
agggagacagaga

SEQ ID NO: 2004611 - DNA, 13 bp, Homo sapiens
agggagagaagat

SEQ ID NO: 2004612 - DNA, 13 bp, Homo sapiens
agggagaggagtg

SEQ ID NO: 2004613 - DNA, 23 bp, Homo sapiens
agggagaggctgtggtggctgtc

SEQ ID NO: 2004614 - DNA, 16 bp, Homo sapiens
agggagcaactctcca

SEQ ID NO: 2004615 - DNA, 16 bp, Homo sapiens
agggagcgagggagaa

SEQ ID NO: 2004616 - DNA, 14 bp, Homo sapiens
agggaggatgccac

SEQ ID NO: 2004617 - DNA, 21 bp, Homo sapiens
agggaggatgccacagcccca

SEQ ID NO: 2004618 - DNA, 14 bp, Homo sapiens
agggaggccgaagc

SEQ ID NO: 2004619 - DNA, 14 bp, Homo sapiens
agggaggcttcctg

SEQ ID NO: 2004620 - DNA, 17 bp, Homo sapiens
agggaggcttcctgact

SEQ ID NO: 2004621 - DNA, 20 bp, Homo sapiens
agggagtgacagaggcagcc

SEQ ID NO: 2004622 - DNA, 20 bp, Homo sapiens
agggataatagacacatcaa

SEQ ID NO: 2004623 - DNA, 16 bp, Homo sapiens
agggatgccacccagc

SEQ ID NO: 2004624 - DNA, 18 bp, Homo sapiens
agggatgctgcctgagtc

SEQ ID NO: 2004625 - DNA, 19 bp, Homo sapiens
agggatgctgcctgagtca

SEQ ID NO: 2004626 - DNA, 24 bp, Homo sapiens
agggatgggatttcatgtaaccaa

SEQ ID NO: 2004627 - DNA, 12 bp, Homo sapiens
agggatttgagg

SEQ ID NO: 2004628 - DNA, 23 bp, Homo sapiens
agggcaaatgacatgcactgacc

SEQ ID NO: 2004629 - DNA, 22 bp, Homo sapiens
agggcaacaatacatgctgcta

SEQ ID NO: 2004630 - DNA, 15 bp, Homo sapiens
agggcaagaaggaaa

SEQ ID NO: 2004631 - DNA, 17 bp, Homo sapiens
agggcaaggggtttcca

SEQ ID NO: 2004632 - DNA, 12 bp, Homo sapiens
agggcaataaat

SEQ ID NO: 2004633 - DNA, 17 bp, Homo sapiens
agggcacaccgggcact

SEQ ID NO: 2004634 - DNA, 20 bp, Homo sapiens
agggcacaccgggcactcag

SEQ ID NO: 2004635 - DNA, 14 bp, Homo sapiens
agggcacaggagct

SEQ ID NO: 2004636 - DNA, 17 bp, Homo sapiens
agggcacaggagctacc

SEQ ID NO: 2004637 - DNA, 19 bp, Homo sapiens
agggcacaggagctacctg

SEQ ID NO: 2004638 - DNA, 16 bp, Homo sapiens
agggcaccgagaactc

SEQ ID NO: 2004639 - DNA, 13 bp, Homo sapiens
agggcagaagggg

SEQ ID NO: 2004640 - DNA, 12 bp, Homo sapiens
agggcagagcca

SEQ ID NO: 2004641 - DNA, 13 bp, Homo sapiens
agggcagagccat

SEQ ID NO: 2004642 - DNA, 18 bp, Homo sapiens
agggcagagccatgggcc

SEQ ID NO: 2004643 - DNA, 21 bp, Homo sapiens
agggcagagccatgggcctgg

SEQ ID NO: 2004644 - DNA, 17 bp, Homo sapiens
agggcagaggctggagg

SEQ ID NO: 2004645 - DNA, 13 bp, Homo sapiens
agggcagagggaa

SEQ ID NO: 2004646 - DNA, 16 bp, Homo sapiens
agggcagagtgggctg

SEQ ID NO: 2004647 - DNA, 20 bp, Homo sapiens
agggcagagtgggctgcctg

SEQ ID NO: 2004648 - DNA, 12 bp, Homo sapiens
agggcagcagcc

SEQ ID NO: 2004649 - DNA, 14 bp, Homo sapiens
agggcagcagccag

SEQ ID NO: 2004650 - DNA, 18 bp, Homo sapiens
agggcagcagccagccct

SEQ ID NO: 2004651 - DNA, 22 bp, Homo sapiens
agggcagcagccagccctgcct

SEQ ID NO: 2004652 - DNA, 23 bp, Homo sapiens
agggcagcagccagccctgcctg

SEQ ID NO: 2004653 - DNA, 16 bp, Homo sapiens
agggcagccaggggct

SEQ ID NO: 2004654 - DNA, 22 bp, Homo sapiens
agggcagcctccaccttgctct

SEQ ID NO: 2004655 - DNA, 16 bp, Homo sapiens
agggcagggaaactgg

SEQ ID NO: 2004656 - DNA, 21 bp, Homo sapiens
agggcagtgacaagtggaggg

SEQ ID NO: 2004657 - DNA, 12 bp, Homo sapiens
agggcagtgaga

SEQ ID NO: 2004658 - DNA, 14 bp, Homo sapiens
agggcagttcgcag

SEQ ID NO: 2004659 - DNA, 17 bp, Homo sapiens
agggcagttcgcagcca

SEQ ID NO: 2004660 - DNA, 18 bp, Homo sapiens
agggcagttcgcagccac

SEQ ID NO: 2004661 - DNA, 20 bp, Homo sapiens
agggcagttcgcagccaccc

SEQ ID NO: 2004662 - DNA, 22 bp, Homo sapiens
agggcagttcgcagccaccctg

SEQ ID NO: 2004663 - DNA, 16 bp, Homo sapiens
agggcatcaggcactg

SEQ ID NO: 2004664 - DNA, 18 bp, Homo sapiens
agggcatccgcagcccag

SEQ ID NO: 2004665 - DNA, 24 bp, Homo sapiens
agggccacactattaccatgagaa

SEQ ID NO: 2004666 - DNA, 16 bp, Homo sapiens
agggccagaaggaggg

SEQ ID NO: 2004667 - DNA, 17 bp, Homo sapiens
agggccagaaggagggc

SEQ ID NO: 2004668 - DNA, 18 bp, Homo sapiens
agggccagaaggagggca

SEQ ID NO: 2004669 - DNA, 22 bp, Homo sapiens
agggccagaaggagggcagagc

SEQ ID NO: 2004670 - DNA, 17 bp, Homo sapiens
agggccagccctacatc

SEQ ID NO: 2004671 - DNA, 18 bp, Homo sapiens
agggccaggagagagatc

SEQ ID NO: 2004672 - DNA, 12 bp, Homo sapiens
agggccagggcc

SEQ ID NO: 2004673 - DNA, 22 bp, Homo sapiens
agggccatacttttgagagggg

SEQ ID NO: 2004674 - DNA, 19 bp, Homo sapiens
agggccatgctgaagggac

SEQ ID NO: 2004675 - DNA, 12 bp, Homo sapiens
agggcccagaga

SEQ ID NO: 2004676 - DNA, 13 bp, Homo sapiens
agggcccagagag

SEQ ID NO: 2004677 - DNA, 13 bp, Homo sapiens
agggcccagctgt

SEQ ID NO: 2004678 - DNA, 14 bp, Homo sapiens
agggcccagctgta

SEQ ID NO: 2004679 - DNA, 17 bp, Homo sapiens
agggcccagctgtagcc

SEQ ID NO: 2004680 - DNA, 11 bp, Homo sapiens
agggcccctcc

SEQ ID NO: 2004681 - DNA, 23 bp, Homo sapiens
agggcccctgttcccccgctggc

SEQ ID NO: 2004682 - DNA, 12 bp, Homo sapiens
agggccctgcag

SEQ ID NO: 2004683 - DNA, 16 bp, Homo sapiens
agggcctactgccacc

SEQ ID NO: 2004684 - DNA, 21 bp, Homo sapiens
agggcctgacaggttcccagc

SEQ ID NO: 2004685 - DNA, 23 bp, Homo sapiens
agggcctgagtgctttaccttta

SEQ ID NO: 2004686 - DNA, 14 bp, Homo sapiens
agggcctgatgggg

SEQ ID NO: 2004687 - DNA, 19 bp, Homo sapiens
agggcctgatggggtggaa

SEQ ID NO: 2004688 - DNA, 23 bp, Homo sapiens
agggcctgggggcagtgactggc

SEQ ID NO: 2004689 - DNA, 13 bp, Homo sapiens
agggcctggtgtg

SEQ ID NO: 2004690 - DNA, 19 bp, Homo sapiens
agggcctgtgggagcctgc

SEQ ID NO: 2004691 - DNA, 14 bp, Homo sapiens
agggccttgcccag

SEQ ID NO: 2004692 - DNA, 20 bp, Homo sapiens
agggcgacctgcacgcactg

SEQ ID NO: 2004693 - DNA, 22 bp, Homo sapiens
agggcgataaaactaaatatat

SEQ ID NO: 2004694 - DNA, 17 bp, Homo sapiens
agggcgtgactcaccca

SEQ ID NO: 2004695 - DNA, 19 bp, Homo sapiens
agggctaccctcccccagg

SEQ ID NO: 2004696 - DNA, 21 bp, Homo sapiens
agggctagaacctagaagggc

SEQ ID NO: 2004697 - DNA, 22 bp, Homo sapiens
agggctagaacctagaagggct

SEQ ID NO: 2004698 - DNA, 18 bp, Homo sapiens
agggctagaacctggaga

SEQ ID NO: 2004699 - DNA, 19 bp, Homo sapiens
agggctagaacctggagag

SEQ ID NO: 2004700 - DNA, 22 bp, Homo sapiens
agggctagaacctggagggctg

SEQ ID NO: 2004701 - DNA, 21 bp, Homo sapiens
agggctagaacctggaggggc

SEQ ID NO: 2004702 - DNA, 23 bp, Homo sapiens
agggctagaacctggaggggcta

SEQ ID NO: 2004703 - DNA, 20 bp, Homo sapiens
agggctagggaggtggggta

SEQ ID NO: 2004704 - DNA, 13 bp, Homo sapiens
agggctcagcctg

SEQ ID NO: 2004705 - DNA, 15 bp, Homo sapiens
agggctcagcctggt

SEQ ID NO: 2004706 - DNA, 20 bp, Homo sapiens
agggctcagcggggacagct

SEQ ID NO: 2004707 - DNA, 23 bp, Homo sapiens
agggctcagcggggacagctcct

SEQ ID NO: 2004708 - DNA, 20 bp, Homo sapiens
agggctccagcatccagcct

SEQ ID NO: 2004709 - DNA, 21 bp, Homo sapiens
agggctccagcatccagcctg

SEQ ID NO: 2004710 - DNA, 14 bp, Homo sapiens
agggctccctcctg

SEQ ID NO: 2004711 - DNA, 16 bp, Homo sapiens
agggctccctcctgga

SEQ ID NO: 2004712 - DNA, 17 bp, Homo sapiens
agggctccctcctggag

SEQ ID NO: 2004713 - DNA, 19 bp, Homo sapiens
agggctcctctccagtctg

SEQ ID NO: 2004714 - DNA, 16 bp, Homo sapiens
agggctcgggcgctgt

SEQ ID NO: 2004715 - DNA, 16 bp, Homo sapiens
agggctctcctggctt

SEQ ID NO: 2004716 - DNA, 12 bp, Homo sapiens
agggctctgagg

SEQ ID NO: 2004717 - DNA, 16 bp, Homo sapiens
agggctctgaggcgcc

SEQ ID NO: 2004718 - DNA, 14 bp, Homo sapiens
agggctgaaagcca

SEQ ID NO: 2004719 - DNA, 16 bp, Homo sapiens
agggctgacctgcctc

SEQ ID NO: 2004720 - DNA, 23 bp, Homo sapiens
agggctgacctgcctctcacaca

SEQ ID NO: 2004721 - DNA, 22 bp, Homo sapiens
agggctgccactaacctgtaga

SEQ ID NO: 2004722 - DNA, 22 bp, Homo sapiens
agggctgcccctgtaggttgct

SEQ ID NO: 2004723 - DNA, 20 bp, Homo sapiens
agggctgcgagcatttccct

SEQ ID NO: 2004724 - DNA, 22 bp, Homo sapiens
agggctggaatctggagagcta

SEQ ID NO: 2004725 - DNA, 12 bp, Homo sapiens
agggctggacct

SEQ ID NO: 2004726 - DNA, 22 bp, Homo sapiens
agggctggactctggcacccag

SEQ ID NO: 2004727 - DNA, 16 bp, Homo sapiens
agggctggtctctgct

SEQ ID NO: 2004728 - DNA, 19 bp, Homo sapiens
agggctgttggacagctgc

SEQ ID NO: 2004729 - DNA, 21 bp, Homo sapiens
agggcttggggagcaggtctc

SEQ ID NO: 2004730 - DNA, 20 bp, Homo sapiens
agggcttggtaaaacacaga

SEQ ID NO: 2004731 - DNA, 14 bp, Homo sapiens
aggggaaaatagta

SEQ ID NO: 2004732 - DNA, 20 bp, Homo sapiens
aggggaaaccagtgtagcct

SEQ ID NO: 2004733 - DNA, 17 bp, Homo sapiens
aggggaataatagaaga

SEQ ID NO: 2004734 - DNA, 18 bp, Homo sapiens
aggggaataatagaagaa

SEQ ID NO: 2004735 - DNA, 19 bp, Homo sapiens
aggggaataatagaagaac

SEQ ID NO: 2004736 - DNA, 21 bp, Homo sapiens
aggggaatgtttgcctctgcc

SEQ ID NO: 2004737 - DNA, 16 bp, Homo sapiens
aggggacagcgccacc

SEQ ID NO: 2004738 - DNA, 19 bp, Homo sapiens
aggggacatttccctcctg

SEQ ID NO: 2004739 - DNA, 16 bp, Homo sapiens
aggggagaagggccag

SEQ ID NO: 2004740 - DNA, 17 bp, Homo sapiens
aggggagagggtctgga

SEQ ID NO: 2004741 - DNA, 20 bp, Homo sapiens
aggggagatactctccctga

SEQ ID NO: 2004742 - DNA, 19 bp, Homo sapiens
aggggaggatcactggagc

SEQ ID NO: 2004743 - DNA, 15 bp, Homo sapiens
aggggaggggcctag

SEQ ID NO: 2004744 - DNA, 16 bp, Homo sapiens
aggggaggggcctagg

SEQ ID NO: 2004745 - DNA, 12 bp, Homo sapiens
aggggagtgtgg

SEQ ID NO: 2004746 - DNA, 17 bp, Homo sapiens
aggggagtgtgggtgat

SEQ ID NO: 2004747 - DNA, 21 bp, Homo sapiens
aggggatagagagagaccact

SEQ ID NO: 2004748 - DNA, 14 bp, Homo sapiens
aggggatcaaagtt

SEQ ID NO: 2004749 - DNA, 18 bp, Homo sapiens
aggggcacacaatgctat

SEQ ID NO: 2004750 - DNA, 11 bp, Homo sapiens
aggggcacacc

SEQ ID NO: 2004751 - DNA, 19 bp, Homo sapiens
aggggcacaccactgccct

SEQ ID NO: 2004752 - DNA, 13 bp, Homo sapiens
aggggcacctgcc

SEQ ID NO: 2004753 - DNA, 13 bp, Homo sapiens
aggggcagccgct

SEQ ID NO: 2004754 - DNA, 15 bp, Homo sapiens
aggggcaggcctggg

SEQ ID NO: 2004755 - DNA, 23 bp, Homo sapiens
aggggccaaactggtgggaggca

SEQ ID NO: 2004756 - DNA, 12 bp, Homo sapiens
aggggcccacaa

SEQ ID NO: 2004757 - DNA, 18 bp, Homo sapiens
aggggcccacaaagggga

SEQ ID NO: 2004758 - DNA, 17 bp, Homo sapiens
aggggccccggggctgg

SEQ ID NO: 2004759 - DNA, 14 bp, Homo sapiens
aggggcctagggag

SEQ ID NO: 2004760 - DNA, 13 bp, Homo sapiens
aggggcctggcag

SEQ ID NO: 2004761 - DNA, 18 bp, Homo sapiens
aggggcctggcagccgtg

SEQ ID NO: 2004762 - DNA, 11 bp, Homo sapiens
aggggctgctg

SEQ ID NO: 2004763 - DNA, 16 bp, Homo sapiens
aggggctgctggggca

SEQ ID NO: 2004764 - DNA, 17 bp, Homo sapiens
aggggctggtccttctc

SEQ ID NO: 2004765 - DNA, 14 bp, Homo sapiens
aggggctttctgga

SEQ ID NO: 2004766 - DNA, 15 bp, Homo sapiens
agggggaagagaaat

SEQ ID NO: 2004767 - DNA, 21 bp, Homo sapiens
agggggagtttttagtttgtt

SEQ ID NO: 2004768 - DNA, 17 bp, Homo sapiens
agggggattggagggaa

SEQ ID NO: 2004769 - DNA, 18 bp, Homo sapiens
agggggcgctcaggaccc

SEQ ID NO: 2004770 - DNA, 23 bp, Homo sapiens
agggggtgattagagggaggaga

SEQ ID NO: 2004771 - DNA, 22 bp, Homo sapiens
aggggtacatttccctgtgctg

SEQ ID NO: 2004772 - DNA, 21 bp, Homo sapiens
aggggtcctgatttcagggaa

SEQ ID NO: 2004773 - DNA, 23 bp, Homo sapiens
aggggtcctgatttcagggaaat

SEQ ID NO: 2004774 - DNA, 16 bp, Homo sapiens
aggggtccttggtgtg

SEQ ID NO: 2004775 - DNA, 15 bp, Homo sapiens
aggggtctccctgga

SEQ ID NO: 2004776 - DNA, 23 bp, Homo sapiens
aggggtgcacccactcaccaggg

SEQ ID NO: 2004777 - DNA, 14 bp, Homo sapiens
aggggtgccctctg

SEQ ID NO: 2004778 - DNA, 16 bp, Homo sapiens
aggggtgccctctgga

SEQ ID NO: 2004779 - DNA, 20 bp, Homo sapiens
aggggtgggttcctcttccc

SEQ ID NO: 2004780 - DNA, 21 bp, Homo sapiens
aggggtgggttcctcttcccc

SEQ ID NO: 2004781 - DNA, 18 bp, Homo sapiens
aggggtgtgattggagtg

SEQ ID NO: 2004782 - DNA, 19 bp, Homo sapiens
aggggttggttgaggtgga

SEQ ID NO: 2004783 - DNA, 19 bp, Homo sapiens
agggtaagggagagggagg

SEQ ID NO: 2004784 - DNA, 21 bp, Homo sapiens
agggtaagggagagggaggga

SEQ ID NO: 2004785 - DNA, 14 bp, Homo sapiens
agggtaaggtgcct

SEQ ID NO: 2004786 - DNA, 15 bp, Homo sapiens
agggtaccagcagaa

SEQ ID NO: 2004787 - DNA, 23 bp, Homo sapiens
agggtaccttgaacactggggga

SEQ ID NO: 2004788 - DNA, 15 bp, Homo sapiens
agggtaggggagggt

SEQ ID NO: 2004789 - DNA, 17 bp, Homo sapiens
agggtaggggagggtgg

SEQ ID NO: 2004790 - DNA, 18 bp, Homo sapiens
agggtatcaggtgctgcc

SEQ ID NO: 2004791 - DNA, 21 bp, Homo sapiens
agggtatcaggtgctgccatc

SEQ ID NO: 2004792 - DNA, 21 bp, Homo sapiens
agggtatcccagacccctctc

SEQ ID NO: 2004793 - DNA, 21 bp, Homo sapiens
agggtatgatccttgttttaa

SEQ ID NO: 2004794 - DNA, 16 bp, Homo sapiens
agggtatgggaagcca

SEQ ID NO: 2004795 - DNA, 17 bp, Homo sapiens
agggtatgggaagccat

SEQ ID NO: 2004796 - DNA, 18 bp, Homo sapiens
agggtcaacggccctgtt

SEQ ID NO: 2004797 - DNA, 20 bp, Homo sapiens
agggtcaacggccctgttta

SEQ ID NO: 2004798 - DNA, 15 bp, Homo sapiens
agggtcaggagaggg

SEQ ID NO: 2004799 - DNA, 19 bp, Homo sapiens
agggtccagaagtccctcc

SEQ ID NO: 2004800 - DNA, 15 bp, Homo sapiens
agggtccccagctgg

SEQ ID NO: 2004801 - DNA, 15 bp, Homo sapiens
agggtccgcaccagc

SEQ ID NO: 2004802 - DNA, 19 bp, Homo sapiens
agggtcgccacacccggct

SEQ ID NO: 2004803 - DNA, 22 bp, Homo sapiens
agggtcgccacacccggctccc

SEQ ID NO: 2004804 - DNA, 15 bp, Homo sapiens
agggtctagggagag

SEQ ID NO: 2004805 - DNA, 21 bp, Homo sapiens
agggtctcactatgttgccca

SEQ ID NO: 2004806 - DNA, 13 bp, Homo sapiens
agggtctggagaa

SEQ ID NO: 2004807 - DNA, 14 bp, Homo sapiens
agggtctggagaag

SEQ ID NO: 2004808 - DNA, 19 bp, Homo sapiens
agggtctggagaagcagtg

SEQ ID NO: 2004809 - DNA, 17 bp, Homo sapiens
agggtcttcttggcagc

SEQ ID NO: 2004810 - DNA, 14 bp, Homo sapiens
agggtcttgggcta

SEQ ID NO: 2004811 - DNA, 16 bp, Homo sapiens
agggtgacatcccagg

SEQ ID NO: 2004812 - DNA, 21 bp, Homo sapiens
agggtgatgggaaagcattgt

SEQ ID NO: 2004813 - DNA, 20 bp, Homo sapiens
agggtgcagttttccaggaa

SEQ ID NO: 2004814 - DNA, 23 bp, Homo sapiens
agggtgctacgtacatgtgaggc

SEQ ID NO: 2004815 - DNA, 21 bp, Homo sapiens
agggtggaggaaggtgctgag

SEQ ID NO: 2004816 - DNA, 20 bp, Homo sapiens
agggtggatccactgtgcag

SEQ ID NO: 2004817 - DNA, 23 bp, Homo sapiens
agggtggccccctgtgccagctc

SEQ ID NO: 2004818 - DNA, 19 bp, Homo sapiens
agggtgggagagcccagcc

SEQ ID NO: 2004819 - DNA, 17 bp, Homo sapiens
agggtgggccactctcc

SEQ ID NO: 2004820 - DNA, 22 bp, Homo sapiens
agggtgggccactctcccctcc

SEQ ID NO: 2004821 - DNA, 23 bp, Homo sapiens
agggtggggcaatggggagaggc

SEQ ID NO: 2004822 - DNA, 12 bp, Homo sapiens
agggtggggccg

SEQ ID NO: 2004823 - DNA, 22 bp, Homo sapiens
agggtggggccgggtgaaaatg

SEQ ID NO: 2004824 - DNA, 16 bp, Homo sapiens
agggtggtgacctctg

SEQ ID NO: 2004825 - DNA, 17 bp, Homo sapiens
agggtggtgacctctgc

SEQ ID NO: 2004826 - DNA, 15 bp, Homo sapiens
agggttagggagggg

SEQ ID NO: 2004827 - DNA, 16 bp, Homo sapiens
agggttagggaggggt

SEQ ID NO: 2004828 - DNA, 15 bp, Homo sapiens
agggttatattttac

SEQ ID NO: 2004829 - DNA, 18 bp, Homo sapiens
agggttcagagactcagg

SEQ ID NO: 2004830 - DNA, 19 bp, Homo sapiens
agggttgaattctggagga

SEQ ID NO: 2004831 - DNA, 13 bp, Homo sapiens
agggttggcccct

SEQ ID NO: 2004832 - DNA, 15 bp, Homo sapiens
agggttgggctggtg

SEQ ID NO: 2004833 - DNA, 17 bp, Homo sapiens
agggttgggctggtgtc

SEQ ID NO: 2004834 - DNA, 23 bp, Homo sapiens
agggttgggttcatctgagcaag

SEQ ID NO: 2004835 - DNA, 18 bp, Homo sapiens
agggttggtgggctggcc

SEQ ID NO: 2004836 - DNA, 21 bp, Homo sapiens
agggttgttaatggtgcaaat

SEQ ID NO: 2004837 - DNA, 15 bp, Homo sapiens
agggttttctcttgg

SEQ ID NO: 2004838 - DNA, 13 bp, Homo sapiens
agggttttgtatt

SEQ ID NO: 2004839 - DNA, 16 bp, Homo sapiens
aggtaaaaatataaga

SEQ ID NO: 2004840 - DNA, 20 bp, Homo sapiens
aggtaactatcaatatttaa

SEQ ID NO: 2004841 - DNA, 14 bp, Homo sapiens
aggtaatgagggac

SEQ ID NO: 2004842 - DNA, 22 bp, Homo sapiens
aggtaattctccctaaggaatc

SEQ ID NO: 2004843 - DNA, 16 bp, Homo sapiens
aggtacaagaagcatt

SEQ ID NO: 2004844 - DNA, 21 bp, Homo sapiens
aggtacccctttctggctctc

SEQ ID NO: 2004845 - DNA, 16 bp, Homo sapiens
aggccagcctggcctc

SEQ ID NO: 2004846 - DNA, 19 bp, Homo sapiens
aggccagcctggcctcctg

SEQ ID NO: 2004847 - DNA, 20 bp, Homo sapiens
aggccagcctggcctcctgc

SEQ ID NO: 2004848 - DNA, 18 bp, Homo sapiens
aggccaggaatctgccat

SEQ ID NO: 2004849 - DNA, 11 bp, Homo sapiens
aggccaggagt

SEQ ID NO: 2004850 - DNA, 17 bp, Homo sapiens
aggccaggccaccagga

SEQ ID NO: 2004851 - DNA, 19 bp, Homo sapiens
aggccaggccaccaggatg

SEQ ID NO: 2004852 - DNA, 16 bp, Homo sapiens
aggccagtgccaggac

SEQ ID NO: 2004853 - DNA, 19 bp, Homo sapiens
aggccagtgccaggacagc

SEQ ID NO: 2004854 - DNA, 14 bp, Homo sapiens
aggccatgggcctc

SEQ ID NO: 2004855 - DNA, 18 bp, Homo sapiens
aggcccactgcagagatg

SEQ ID NO: 2004856 - DNA, 16 bp, Homo sapiens
aggcccagccgcagga

SEQ ID NO: 2004857 - DNA, 13 bp, Homo sapiens
aggcccagcctgt

SEQ ID NO: 2004858 - DNA, 23 bp, Homo sapiens
aggcccaggaatcggagcgaagc

SEQ ID NO: 2004859 - DNA, 14 bp, Homo sapiens
aggcccagggagca

SEQ ID NO: 2004860 - DNA, 21 bp, Homo sapiens
aggcccagggagcaatgggag

SEQ ID NO: 2004861 - DNA, 24 bp, Homo sapiens
aggcccaggtcaacatctaagcct

SEQ ID NO: 2004862 - DNA, 21 bp, Homo sapiens
aggcccatctcaggtgccact

SEQ ID NO: 2004863 - DNA, 17 bp, Homo sapiens
aggcccccacctggctc

SEQ ID NO: 2004864 - DNA, 15 bp, Homo sapiens
aggcccccaggtgcc

SEQ ID NO: 2004865 - DNA, 14 bp, Homo sapiens
aggccccccgcagc

SEQ ID NO: 2004866 - DNA, 18 bp, Homo sapiens
aggccccccgcagcaccc

SEQ ID NO: 2004867 - DNA, 22 bp, Homo sapiens
aggcccccgctggctcctccag

SEQ ID NO: 2004868 - DNA, 18 bp, Homo sapiens
aggccccgcttgtccagc

SEQ ID NO: 2004869 - DNA, 20 bp, Homo sapiens
aggccccgcttgtccagcgc

SEQ ID NO: 2004870 - DNA, 21 bp, Homo sapiens
aggccccgcttgtccagcgcc

SEQ ID NO: 2004871 - DNA, 22 bp, Homo sapiens
aggccccgcttgtccagcgcct

SEQ ID NO: 2004872 - DNA, 17 bp, Homo sapiens
aggcccctgaggactgg

SEQ ID NO: 2004873 - DNA, 21 bp, Homo sapiens
aggcccctgaggactggagac

SEQ ID NO: 2004874 - DNA, 17 bp, Homo sapiens
aggcccctggacaagca

SEQ ID NO: 2004875 - DNA, 15 bp, Homo sapiens
aggcccgagcagctg

SEQ ID NO: 2004876 - DNA, 18 bp, Homo sapiens
aggcccgagcagctgagc

SEQ ID NO: 2004877 - DNA, 19 bp, Homo sapiens
aggcccgagcagctgagca

SEQ ID NO: 2004878 - DNA, 21 bp, Homo sapiens
aggcccgagcagctgagcagg

SEQ ID NO: 2004879 - DNA, 22 bp, Homo sapiens
aggcccggccccatcagaggct

SEQ ID NO: 2004880 - DNA, 16 bp, Homo sapiens
aggcccggctccaggc

SEQ ID NO: 2004881 - DNA, 18 bp, Homo sapiens
aggccctccatgggctag

SEQ ID NO: 2004882 - DNA, 22 bp, Homo sapiens
aggccctccctgactccctgtg

SEQ ID NO: 2004883 - DNA, 20 bp, Homo sapiens
aggccctggtgtcaggcagg

SEQ ID NO: 2004884 - DNA, 13 bp, Homo sapiens
aggccctgtccca

SEQ ID NO: 2004885 - DNA, 22 bp, Homo sapiens
aggccctgtcccagcagaagag

SEQ ID NO: 2004886 - DNA, 13 bp, Homo sapiens
aggccctgtctgt

SEQ ID NO: 2004887 - DNA, 16 bp, Homo sapiens
aggcccttattttcaa

SEQ ID NO: 2004888 - DNA, 22 bp, Homo sapiens
aggcccttggggttcccccaga

SEQ ID NO: 2004889 - DNA, 13 bp, Homo sapiens
aggcccttgtcct

SEQ ID NO: 2004890 - DNA, 15 bp, Homo sapiens
aggcccttgtcctgc

SEQ ID NO: 2004891 - DNA, 23 bp, Homo sapiens
aggccgaagctaacagggaaggc

SEQ ID NO: 2004892 - DNA, 12 bp, Homo sapiens
aggccgagccaa

SEQ ID NO: 2004893 - DNA, 13 bp, Homo sapiens
aggccgcctgcca

SEQ ID NO: 2004894 - DNA, 13 bp, Homo sapiens
aggccgctgcccc

SEQ ID NO: 2004895 - DNA, 19 bp, Homo sapiens
aggccgctgccccagcccc

SEQ ID NO: 2004896 - DNA, 17 bp, Homo sapiens
aggccgctgttcaccca

SEQ ID NO: 2004897 - DNA, 13 bp, Homo sapiens
aggccgtgtctct

SEQ ID NO: 2004898 - DNA, 18 bp, Homo sapiens
aggccgtgtctctgagga

SEQ ID NO: 2004899 - DNA, 17 bp, Homo sapiens
aggcctaaaagtaaaca

SEQ ID NO: 2004900 - DNA, 16 bp, Homo sapiens
aggcctaggacctcag

SEQ ID NO: 2004901 - DNA, 19 bp, Homo sapiens
aggcctaggacctcaggcg

SEQ ID NO: 2004902 - DNA, 22 bp, Homo sapiens
aggcctcagtttctccatcagc

SEQ ID NO: 2004903 - DNA, 13 bp, Homo sapiens
aggcctcatccct

SEQ ID NO: 2004904 - DNA, 13 bp, Homo sapiens
aggcctccagcct

SEQ ID NO: 2004905 - DNA, 17 bp, Homo sapiens
aggcctccagcctctcc

SEQ ID NO: 2004906 - DNA, 18 bp, Homo sapiens
aggcctcgtaccagccag

SEQ ID NO: 2004907 - DNA, 20 bp, Homo sapiens
aggcctcgtaccagccagga

SEQ ID NO: 2004908 - DNA, 19 bp, Homo sapiens
aggcctctggaaagcaaag

SEQ ID NO: 2004909 - DNA, 14 bp, Homo sapiens
aggcctctgtgtcc

SEQ ID NO: 2004910 - DNA, 20 bp, Homo sapiens
aggcctctgtgtccttccct

SEQ ID NO: 2004911 - DNA, 22 bp, Homo sapiens
aggcctctgtgtccttccctgc

SEQ ID NO: 2004912 - DNA, 23 bp, Homo sapiens
aggcctctgtgtccttccctgca

SEQ ID NO: 2004913 - DNA, 23 bp, Homo sapiens
aggcctcttggacctctgctctg

SEQ ID NO: 2004914 - DNA, 20 bp, Homo sapiens
aggcctcttgtgctcacgct

SEQ ID NO: 2004915 - DNA, 15 bp, Homo sapiens
aggcctgatgctgcc

SEQ ID NO: 2004916 - DNA, 11 bp, Homo sapiens
aggcctgccct

SEQ ID NO: 2004917 - DNA, 12 bp, Homo sapiens
aggcctgccctc

SEQ ID NO: 2004918 - DNA, 22 bp, Homo sapiens
aggcctgccctcagggatcttg

SEQ ID NO: 2004919 - DNA, 14 bp, Homo sapiens
aggcctggaaccag

SEQ ID NO: 2004920 - DNA, 11 bp, Homo sapiens
aggcctggcca

SEQ ID NO: 2004921 - DNA, 16 bp, Homo sapiens
aggcctggccagatgc

SEQ ID NO: 2004922 - DNA, 13 bp, Homo sapiens
aggcctggccagg

SEQ ID NO: 2004923 - DNA, 14 bp, Homo sapiens
aggcctggccaggc

SEQ ID NO: 2004924 - DNA, 20 bp, Homo sapiens
aggcctggccttgtcaggac

SEQ ID NO: 2004925 - DNA, 21 bp, Homo sapiens
aggcctggccttgtcaggacc

SEQ ID NO: 2004926 - DNA, 21 bp, Homo sapiens
aggcctggggtgacccggcac

SEQ ID NO: 2004927 - DNA, 21 bp, Homo sapiens
aggcctgtgtagctgtgacct

SEQ ID NO: 2004928 - DNA, 17 bp, Homo sapiens
aggccttctctgaagga

SEQ ID NO: 2004929 - DNA, 15 bp, Homo sapiens
aggcctttccccagt

SEQ ID NO: 2004930 - DNA, 16 bp, Homo sapiens
aggccttttgactctt

SEQ ID NO: 2004931 - DNA, 16 bp, Homo sapiens
aggcgaataaatgttc

SEQ ID NO: 2004932 - DNA, 19 bp, Homo sapiens
aggcgaataaatgttcaaa

SEQ ID NO: 2004933 - DNA, 23 bp, Homo sapiens
aggcgacttcctctccagccttc

SEQ ID NO: 2004934 - DNA, 15 bp, Homo sapiens
aggcgaggagagtgg

SEQ ID NO: 2004935 - DNA, 16 bp, Homo sapiens
aggcgcagcccgaagc

SEQ ID NO: 2004936 - DNA, 22 bp, Homo sapiens
aggcgcagcccgaagcccagtt

SEQ ID NO: 2004937 - DNA, 22 bp, Homo sapiens
aggcgccccaacccgtggaggc

SEQ ID NO: 2004938 - DNA, 16 bp, Homo sapiens
aggcggaaaccttgca

SEQ ID NO: 2004939 - DNA, 20 bp, Homo sapiens
aggcggagagtacagtgagc

SEQ ID NO: 2004940 - DNA, 17 bp, Homo sapiens
aggcggctccaggtccg

SEQ ID NO: 2004941 - DNA, 13 bp, Homo sapiens
aggcggggaggag

SEQ ID NO: 2004942 - DNA, 21 bp, Homo sapiens
aggcggggaggaggagctgcc

SEQ ID NO: 2004943 - DNA, 22 bp, Homo sapiens
aggcggggaggaggagctgccg

SEQ ID NO: 2004944 - DNA, 19 bp, Homo sapiens
aggcgtcaacgtgcatttt

SEQ ID NO: 2004945 - DNA, 15 bp, Homo sapiens
aggcgtcttgtattt

SEQ ID NO: 2004946 - DNA, 16 bp, Homo sapiens
aggcgtgcaaggggct

SEQ ID NO: 2004947 - DNA, 18 bp, Homo sapiens
aggcgtgcaaggggctca

SEQ ID NO: 2004948 - DNA, 19 bp, Homo sapiens
aggcgtgcaaggggctcag

SEQ ID NO: 2004949 - DNA, 21 bp, Homo sapiens
aggctaagttcagttctgttt

SEQ ID NO: 2004950 - DNA, 18 bp, Homo sapiens
aggctaatttttatattt

SEQ ID NO: 2004951 - DNA, 12 bp, Homo sapiens
aggctacccctt

SEQ ID NO: 2004952 - DNA, 22 bp, Homo sapiens
aggctacttcggggctgggaag

SEQ ID NO: 2004953 - DNA, 16 bp, Homo sapiens
aggctattattttcac

SEQ ID NO: 2004954 - DNA, 15 bp, Homo sapiens
aggctatttctacat

SEQ ID NO: 2004955 - DNA, 13 bp, Homo sapiens
aggctcaagaggc

SEQ ID NO: 2004956 - DNA, 15 bp, Homo sapiens
aggctcaagaggccc

SEQ ID NO: 2004957 - DNA, 21 bp, Homo sapiens
aggctcacaactgtttttgaa

SEQ ID NO: 2004958 - DNA, 18 bp, Homo sapiens
aggctcagtctcaggagc

SEQ ID NO: 2004959 - DNA, 14 bp, Homo sapiens
aggctccatgggga

SEQ ID NO: 2004960 - DNA, 12 bp, Homo sapiens
aggctcctgtcc

SEQ ID NO: 2004961 - DNA, 15 bp, Homo sapiens
aggtactaaatacct

SEQ ID NO: 2004962 - DNA, 17 bp, Homo sapiens
aggtactatctgtgaag

SEQ ID NO: 2004963 - DNA, 20 bp, Homo sapiens
aggtactgatcctgtttctt

SEQ ID NO: 2004964 - DNA, 16 bp, Homo sapiens
aggtacttcctcctga

SEQ ID NO: 2004965 - DNA, 19 bp, Homo sapiens
aggtagaatgtaaagcttg

SEQ ID NO: 2004966 - DNA, 21 bp, Homo sapiens
aggtagaatgtaaagcttgtc

SEQ ID NO: 2004967 - DNA, 15 bp, Homo sapiens
aggtagagatgtgtg

SEQ ID NO: 2004968 - DNA, 18 bp, Homo sapiens
aggtagagatgtgtgtgt

SEQ ID NO: 2004969 - DNA, 22 bp, Homo sapiens
aggtagatcatcttgaatattt

SEQ ID NO: 2004970 - DNA, 20 bp, Homo sapiens
aggtagcccagcactgtgaa

SEQ ID NO: 2004971 - DNA, 23 bp, Homo sapiens
aggtagcccagcactgtgaagac

SEQ ID NO: 2004972 - DNA, 19 bp, Homo sapiens
aggtagcgagctgctctgc

SEQ ID NO: 2004973 - DNA, 21 bp, Homo sapiens
aggtagcgagctgctctgcta

SEQ ID NO: 2004974 - DNA, 18 bp, Homo sapiens
aggtagcttacctgacac

SEQ ID NO: 2004975 - DNA, 12 bp, Homo sapiens
aggtaggccctt

SEQ ID NO: 2004976 - DNA, 20 bp, Homo sapiens
aggtaggcccttgtcctgcc

SEQ ID NO: 2004977 - DNA, 23 bp, Homo sapiens
aggtaggcccttgtcctgccagc

SEQ ID NO: 2004978 - DNA, 20 bp, Homo sapiens
aggtagggccagctcacaag

SEQ ID NO: 2004979 - DNA, 15 bp, Homo sapiens
aggtataattttatg

SEQ ID NO: 2004980 - DNA, 22 bp, Homo sapiens
aggtatacaatgttctgttgta

SEQ ID NO: 2004981 - DNA, 22 bp, Homo sapiens
aggtatagctgacatctcctct

SEQ ID NO: 2004982 - DNA, 21 bp, Homo sapiens
aggtatcaggcacaggcagga

SEQ ID NO: 2004983 - DNA, 22 bp, Homo sapiens
aggtatcaggcacaggcaggaa

SEQ ID NO: 2004984 - DNA, 13 bp, Homo sapiens
aggtatctccagg

SEQ ID NO: 2004985 - DNA, 22 bp, Homo sapiens
aggtatgaccttctaggaagct

SEQ ID NO: 2004986 - DNA, 23 bp, Homo sapiens
aggtatgaccttctaggaagctc

SEQ ID NO: 2004987 - DNA, 20 bp, Homo sapiens
aggtcaaaatagtgccacta

SEQ ID NO: 2004988 - DNA, 13 bp, Homo sapiens
aggtcaacatcta

SEQ ID NO: 2004989 - DNA, 21 bp, Homo sapiens
aggtcaacatctaagcctgtt

SEQ ID NO: 2004990 - DNA, 18 bp, Homo sapiens
aggtcaatgaaatatttg

SEQ ID NO: 2004991 - DNA, 19 bp, Homo sapiens
aggtcaatgaaatatttgc

SEQ ID NO: 2004992 - DNA, 13 bp, Homo sapiens
aggtcactgggtt

SEQ ID NO: 2004993 - DNA, 18 bp, Homo sapiens
aggtcagagcctgcagtt

SEQ ID NO: 2004994 - DNA, 19 bp, Homo sapiens
aggtcagcgtgcttagcct

SEQ ID NO: 2004995 - DNA, 16 bp, Homo sapiens
aggtcaggagttccta

SEQ ID NO: 2004996 - DNA, 12 bp, Homo sapiens
aggtcccaggca

SEQ ID NO: 2004997 - DNA, 14 bp, Homo sapiens
aggtcccaggcaga

SEQ ID NO: 2004998 - DNA, 22 bp, Homo sapiens
aggtccctcctttggaccctgt

SEQ ID NO: 2004999 - DNA, 15 bp, Homo sapiens
aggtcctcagagaat

SEQ ID NO: 2005000 - DNA, 11 bp, Homo sapiens
aggtcctcctc

SEQ ID NO: 2005001 - DNA, 20 bp, Homo sapiens
aggtcctctgatacccagag

SEQ ID NO: 2005002 - DNA, 20 bp, Homo sapiens
aggtcctgaaagtctgtgtc

SEQ ID NO: 2005003 - DNA, 22 bp, Homo sapiens
aggtcctgaaagtctgtgtcca

SEQ ID NO: 2005004 - DNA, 12 bp, Homo sapiens
aggtcctgagca

SEQ ID NO: 2005005 - DNA, 13 bp, Homo sapiens
aggtcctgagcac

SEQ ID NO: 2005006 - DNA, 21 bp, Homo sapiens
aggtcctgagcactgccagga

SEQ ID NO: 2005007 - DNA, 13 bp, Homo sapiens
aggtcctgcccat

SEQ ID NO: 2005008 - DNA, 15 bp, Homo sapiens
aggtcctgcccatgt

SEQ ID NO: 2005009 - DNA, 23 bp, Homo sapiens
aggtcctgcccatgtgtcccctc

SEQ ID NO: 2005010 - DNA, 15 bp, Homo sapiens
aggtcctggcttcta

SEQ ID NO: 2005011 - DNA, 17 bp, Homo sapiens
aggtcctggtggggcag

SEQ ID NO: 2005012 - DNA, 16 bp, Homo sapiens
aggtccttctgctgga

SEQ ID NO: 2005013 - DNA, 13 bp, Homo sapiens
aggtctagacttt

SEQ ID NO: 2005014 - DNA, 16 bp, Homo sapiens
aggtctagactttctc

SEQ ID NO: 2005015 - DNA, 22 bp, Homo sapiens
aggtctccactgaggatgtgag

SEQ ID NO: 2005016 - DNA, 11 bp, Homo sapiens
aggtctcctct

SEQ ID NO: 2005017 - DNA, 17 bp, Homo sapiens
aggtctcctcttaaaaa

SEQ ID NO: 2005018 - DNA, 23 bp, Homo sapiens
aggtctcctcttaaaaaataaaa

SEQ ID NO: 2005019 - DNA, 15 bp, Homo sapiens
aggtctccttactct

SEQ ID NO: 2005020 - DNA, 20 bp, Homo sapiens
aggtctccttactctgagcc

SEQ ID NO: 2005021 - DNA, 20 bp, Homo sapiens
aggtctctccactgctctca

SEQ ID NO: 2005022 - DNA, 14 bp, Homo sapiens
aggtctctggcaga

SEQ ID NO: 2005023 - DNA, 22 bp, Homo sapiens
aggtctctggcagagaaggatg

SEQ ID NO: 2005024 - DNA, 21 bp, Homo sapiens
aggtctgaaatggaggtcctt

SEQ ID NO: 2005025 - DNA, 23 bp, Homo sapiens
aggtctgagccctggtgtgtttc

SEQ ID NO: 2005026 - DNA, 18 bp, Homo sapiens
aggtcttcttgtgtcctg

SEQ ID NO: 2005027 - DNA, 21 bp, Homo sapiens
aggtcttcttgtgtcctgatg

SEQ ID NO: 2005028 - DNA, 23 bp, Homo sapiens
aggtcttggccgactcagggacc

SEQ ID NO: 2005029 - DNA, 18 bp, Homo sapiens
aggtctttgcacatgtga

SEQ ID NO: 2005030 - DNA, 16 bp, Homo sapiens
aggtgaagtccctgtt

SEQ ID NO: 2005031 - DNA, 17 bp, Homo sapiens
aggtgaagtccctgttc

SEQ ID NO: 2005032 - DNA, 13 bp, Homo sapiens
aggtgacagagtg

SEQ ID NO: 2005033 - DNA, 24 bp, Homo sapiens
aggtgaccccagggcacaggagct

SEQ ID NO: 2005034 - DNA, 22 bp, Homo sapiens
aggtgagaccaaaggatccaga

SEQ ID NO: 2005035 - DNA, 14 bp, Homo sapiens
aggtgcaagagaca

SEQ ID NO: 2005036 - DNA, 15 bp, Homo sapiens
aggtgcaagagacag

SEQ ID NO: 2005037 - DNA, 21 bp, Homo sapiens
aggtgcaagagacagagcccc

SEQ ID NO: 2005038 - DNA, 15 bp, Homo sapiens
aggtgcagatgggct

SEQ ID NO: 2005039 - DNA, 16 bp, Homo sapiens
aggtgcagatgggctg

SEQ ID NO: 2005040 - DNA, 11 bp, Homo sapiens
aggtgcagtgg

SEQ ID NO: 2005041 - DNA, 16 bp, Homo sapiens
aggtgcagtggctcac

SEQ ID NO: 2005042 - DNA, 23 bp, Homo sapiens
aggtgcatctggggaactagagg

SEQ ID NO: 2005043 - DNA, 20 bp, Homo sapiens
aggtgccactccctgagctt

SEQ ID NO: 2005044 - DNA, 15 bp, Homo sapiens
aggtgcccaggagaa

SEQ ID NO: 2005045 - DNA, 14 bp, Homo sapiens
aggtgcctcctgtc

SEQ ID NO: 2005046 - DNA, 15 bp, Homo sapiens
aggtgcctcctgtct

SEQ ID NO: 2005047 - DNA, 18 bp, Homo sapiens
aggtgcctggtgggccac

SEQ ID NO: 2005048 - DNA, 21 bp, Homo sapiens
aggtgcctgtgaggcaggggc

SEQ ID NO: 2005049 - DNA, 16 bp, Homo sapiens
aggtgctacaaaaaca

SEQ ID NO: 2005050 - DNA, 20 bp, Homo sapiens
aggtgctacaaaaacacagc

SEQ ID NO: 2005051 - DNA, 15 bp, Homo sapiens
aggtgctcattggct

SEQ ID NO: 2005052 - DNA, 16 bp, Homo sapiens
aggtgctgccatccag

SEQ ID NO: 2005053 - DNA, 17 bp, Homo sapiens
aggtgctgccatccagg

SEQ ID NO: 2005054 - DNA, 15 bp, Homo sapiens
aggtgcttgccccca

SEQ ID NO: 2005055 - DNA, 14 bp, Homo sapiens
aggtgcttttgatg

SEQ ID NO: 2005056 - DNA, 15 bp, Homo sapiens
aggtggaagccctcc

SEQ ID NO: 2005057 - DNA, 19 bp, Homo sapiens
aggtggaagccctccttcc

SEQ ID NO: 2005058 - DNA, 21 bp, Homo sapiens
aggtggaagccctccttccac

SEQ ID NO: 2005059 - DNA, 13 bp, Homo sapiens
aggtggagtctca

SEQ ID NO: 2005060 - DNA, 17 bp, Homo sapiens
aggtggatcacctgagg

SEQ ID NO: 2005061 - DNA, 18 bp, Homo sapiens
aggtggattcctgggcaa

SEQ ID NO: 2005062 - DNA, 14 bp, Homo sapiens
aggtggcaggacca

SEQ ID NO: 2005063 - DNA, 14 bp, Homo sapiens
aggtggccactcca

SEQ ID NO: 2005064 - DNA, 17 bp, Homo sapiens
aggtggccactccagac

SEQ ID NO: 2005065 - DNA, 14 bp, Homo sapiens
aggtggctctccag

SEQ ID NO: 2005066 - DNA, 15 bp, Homo sapiens
aggtggctctccagt

SEQ ID NO: 2005067 - DNA, 13 bp, Homo sapiens
aggtgggagagac

SEQ ID NO: 2005068 - DNA, 15 bp, Homo sapiens
aggtgggcagctggg

SEQ ID NO: 2005069 - DNA, 19 bp, Homo sapiens
aggtgggcagctgggcccc

SEQ ID NO: 2005070 - DNA, 17 bp, Homo sapiens
aggtgggctgagccctg

SEQ ID NO: 2005071 - DNA, 19 bp, Homo sapiens
aggtgggctgagccctggc

SEQ ID NO: 2005072 - DNA, 22 bp, Homo sapiens
aggtggggtctttgtgagagtg

SEQ ID NO: 2005073 - DNA, 14 bp, Homo sapiens
aggtgggtccagga

SEQ ID NO: 2005074 - DNA, 23 bp, Homo sapiens
aggtgggtccaggaaggcagctg

SEQ ID NO: 2005075 - DNA, 19 bp, Homo sapiens
aggtggtcctgagacctga

SEQ ID NO: 2005076 - DNA, 22 bp, Homo sapiens
aggtggtctgcttttgctgggg

SEQ ID NO: 2005077 - DNA, 15 bp, Homo sapiens
aggtggtgccttctc

SEQ ID NO: 2005078 - DNA, 17 bp, Homo sapiens
aggtggtggaggaggag

SEQ ID NO: 2005079 - DNA, 18 bp, Homo sapiens
aggtgtcaccctgcagag

SEQ ID NO: 2005080 - DNA, 20 bp, Homo sapiens
aggtgtcaccctgcagagct

SEQ ID NO: 2005081 - DNA, 21 bp, Homo sapiens
aggtgtcatacagatttgcaa

SEQ ID NO: 2005082 - DNA, 12 bp, Homo sapiens
aggtgtcccaag

SEQ ID NO: 2005083 - DNA, 14 bp, Homo sapiens
aggtgtcccaagct

SEQ ID NO: 2005084 - DNA, 20 bp, Homo sapiens
aggtgtccctgcacttgcag

SEQ ID NO: 2005085 - DNA, 14 bp, Homo sapiens
aggtgtctgcaccc

SEQ ID NO: 2005086 - DNA, 17 bp, Homo sapiens
aggtgtctgcacccagg

SEQ ID NO: 2005087 - DNA, 22 bp, Homo sapiens
aggtgtgagtcaccaagcccag

SEQ ID NO: 2005088 - DNA, 14 bp, Homo sapiens
aggtgtggctgtca

SEQ ID NO: 2005089 - DNA, 12 bp, Homo sapiens
aggtgtggtggc

SEQ ID NO: 2005090 - DNA, 14 bp, Homo sapiens
aggtgttgaaaatg

SEQ ID NO: 2005091 - DNA, 20 bp, Homo sapiens
aggtgttgccatttctctgc

SEQ ID NO: 2005092 - DNA, 12 bp, Homo sapiens
aggtgtttatac

SEQ ID NO: 2005093 - DNA, 20 bp, Homo sapiens
aggtgtttccatttctcaat

SEQ ID NO: 2005094 - DNA, 15 bp, Homo sapiens
aggttaaaatataaa

SEQ ID NO: 2005095 - DNA, 19 bp, Homo sapiens
aggttaaaatataaattaa

SEQ ID NO: 2005096 - DNA, 20 bp, Homo sapiens
aggttaaggtgggtccagga

SEQ ID NO: 2005097 - DNA, 18 bp, Homo sapiens
aggttactcagcagcaga

SEQ ID NO: 2005098 - DNA, 21 bp, Homo sapiens
aggttaggagttcgagaccag

SEQ ID NO: 2005099 - DNA, 17 bp, Homo sapiens
aggttatctgcctggcc

SEQ ID NO: 2005100 - DNA, 18 bp, Homo sapiens
aggttatctgcctggcct

SEQ ID NO: 2005101 - DNA, 23 bp, Homo sapiens
aggttatctgcctggcctggctc

SEQ ID NO: 2005102 - DNA, 13 bp, Homo sapiens
aggttcagcttgt

SEQ ID NO: 2005103 - DNA, 16 bp, Homo sapiens
aggttccctctgagaa

SEQ ID NO: 2005104 - DNA, 17 bp, Homo sapiens
aggttccggtgtctgga

SEQ ID NO: 2005105 - DNA, 24 bp, Homo sapiens
aggttcctaagacttcagtcctgg

SEQ ID NO: 2005106 - DNA, 17 bp, Homo sapiens
aggttctggggaggaag

SEQ ID NO: 2005107 - DNA, 23 bp, Homo sapiens
aggttctggggaggaagggccag

SEQ ID NO: 2005108 - DNA, 19 bp, Homo sapiens
aggttcttcatccctttcc

SEQ ID NO: 2005109 - DNA, 16 bp, Homo sapiens
aggttgactcaagttt

SEQ ID NO: 2005110 - DNA, 17 bp, Homo sapiens
aggttgaggggctcctg

SEQ ID NO: 2005111 - DNA, 18 bp, Homo sapiens
aggttgcagggagccgag

SEQ ID NO: 2005112 - DNA, 21 bp, Homo sapiens
aggttgccccttccccatctc

SEQ ID NO: 2005113 - DNA, 22 bp, Homo sapiens
aggttgccccttccccatctcc

SEQ ID NO: 2005114 - DNA, 24 bp, Homo sapiens
aggttgtggatgctccagggcagc

SEQ ID NO: 2005115 - DNA, 14 bp, Homo sapiens
aggtttatgaaaaa

SEQ ID NO: 2005116 - DNA, 21 bp, Homo sapiens
aggtttctgagttcctgcatg

SEQ ID NO: 2005117 - DNA, 17 bp, Homo sapiens
aggtttgcacccctcct

SEQ ID NO: 2005118 - DNA, 22 bp, Homo sapiens
aggtttggggagggggaagaga

SEQ ID NO: 2005119 - DNA, 22 bp, Homo sapiens
aggtttggtgtgtggagatgca

SEQ ID NO: 2005120 - DNA, 15 bp, Homo sapiens
aggttttgtaaagat

SEQ ID NO: 2005121 - DNA, 17 bp, Homo sapiens
aggtttttatgtgcctt

SEQ ID NO: 2005122 - DNA, 21 bp, Homo sapiens
aggtttttttgtatagtaaag

SEQ ID NO: 2005123 - DNA, 12 bp, Homo sapiens
agtaaaagctaa

SEQ ID NO: 2005124 - DNA, 12 bp, Homo sapiens
agtaaactttct

SEQ ID NO: 2005125 - DNA, 20 bp, Homo sapiens
agtaaaggcctcatctcctt

SEQ ID NO: 2005126 - DNA, 16 bp, Homo sapiens
agtaaagtcaaggaga

SEQ ID NO: 2005127 - DNA, 18 bp, Homo sapiens
agtaaagtgataatttct

SEQ ID NO: 2005128 - DNA, 16 bp, Homo sapiens
agtaaagtttaaaaaa

SEQ ID NO: 2005129 - DNA, 18 bp, Homo sapiens
agtaaagtttaaaaaata

SEQ ID NO: 2005130 - DNA, 16 bp, Homo sapiens
agtaaagtttatttca

SEQ ID NO: 2005131 - DNA, 14 bp, Homo sapiens
agtaaataaattgt

SEQ ID NO: 2005132 - DNA, 18 bp, Homo sapiens
agtaaataaattgtttga

SEQ ID NO: 2005133 - DNA, 14 bp, Homo sapiens
agtaaatatttcag

SEQ ID NO: 2005134 - DNA, 19 bp, Homo sapiens
agtaaatcacgctttttga

SEQ ID NO: 2005135 - DNA, 14 bp, Homo sapiens
agtaaattggaaac

SEQ ID NO: 2005136 - DNA, 15 bp, Homo sapiens
agtaaattggaaaca

SEQ ID NO: 2005137 - DNA, 23 bp, Homo sapiens
agtaacaggaaaccacttatcac

SEQ ID NO: 2005138 - DNA, 20 bp, Homo sapiens
agtaactactttttatactc

SEQ ID NO: 2005139 - DNA, 14 bp, Homo sapiens
agtaacttttacaa

SEQ ID NO: 2005140 - DNA, 18 bp, Homo sapiens
agtaagatattatttaaa

SEQ ID NO: 2005141 - DNA, 19 bp, Homo sapiens
agtaagatattatttaaat

SEQ ID NO: 2005142 - DNA, 17 bp, Homo sapiens
agtaagcctccctcctc

SEQ ID NO: 2005143 - DNA, 19 bp, Homo sapiens
agtaagcctccctcctcgt

SEQ ID NO: 2005144 - DNA, 18 bp, Homo sapiens
agtaagctgctctattgt

SEQ ID NO: 2005145 - DNA, 20 bp, Homo sapiens
agtaagctgctctattgtag

SEQ ID NO: 2005146 - DNA, 20 bp, Homo sapiens
agtaagtaccactcaggcca

SEQ ID NO: 2005147 - DNA, 19 bp, Homo sapiens
agtaagttctgaaaactgt

SEQ ID NO: 2005148 - DNA, 20 bp, Homo sapiens
agtaagttctgaaaactgtt

SEQ ID NO: 2005149 - DNA, 20 bp, Homo sapiens
agtaatagtccaatatttgg

SEQ ID NO: 2005150 - DNA, 11 bp, Homo sapiens
agtaatataat

SEQ ID NO: 2005151 - DNA, 17 bp, Homo sapiens
agtaatgcactctcagt

SEQ ID NO: 2005152 - DNA, 18 bp, Homo sapiens
agtaatgggccaattaaa

SEQ ID NO: 2005153 - DNA, 22 bp, Homo sapiens
agtaatgggccaattaaaatat

SEQ ID NO: 2005154 - DNA, 13 bp, Homo sapiens
agtaattatcggg

SEQ ID NO: 2005155 - DNA, 19 bp, Homo sapiens
agtaattgcatttctgctc

SEQ ID NO: 2005156 - DNA, 13 bp, Homo sapiens
agtaatttattgt

SEQ ID NO: 2005157 - DNA, 22 bp, Homo sapiens
agtaatttattgtttttccttg

SEQ ID NO: 2005158 - DNA, 23 bp, Homo sapiens
agtaatttattgtttttccttgt

SEQ ID NO: 2005159 - DNA, 15 bp, Homo sapiens
agtaatttgaggaca

SEQ ID NO: 2005160 - DNA, 20 bp, Homo sapiens
agtacaataataaatcctca

SEQ ID NO: 2005161 - DNA, 16 bp, Homo sapiens
agtacaatgtttcaga

SEQ ID NO: 2005162 - DNA, 21 bp, Homo sapiens
agtacagacgtctcaagactg

SEQ ID NO: 2005163 - DNA, 21 bp, Homo sapiens
agtacagagaaattctgtggt

SEQ ID NO: 2005164 - DNA, 21 bp, Homo sapiens
agtacagtagcttaaataaat

SEQ ID NO: 2005165 - DNA, 20 bp, Homo sapiens
agtacagtgaggagggtgga

SEQ ID NO: 2005166 - DNA, 13 bp, Homo sapiens
agtacatttaata

SEQ ID NO: 2005167 - DNA, 15 bp, Homo sapiens
agtaccatagaacag

SEQ ID NO: 2005168 - DNA, 20 bp, Homo sapiens
agtacctgggaaaggaccca

SEQ ID NO: 2005169 - DNA, 17 bp, Homo sapiens
agtacctgtagtgagaa

SEQ ID NO: 2005170 - DNA, 15 bp, Homo sapiens
agtacctttgtcaca

SEQ ID NO: 2005171 - DNA, 15 bp, Homo sapiens
agtacgtttttgcat

SEQ ID NO: 2005172 - DNA, 18 bp, Homo sapiens
agtacgtttttgcattat

SEQ ID NO: 2005173 - DNA, 13 bp, Homo sapiens
agtactatgtaaa

SEQ ID NO: 2005174 - DNA, 18 bp, Homo sapiens
agtactatgtaaatttaa

SEQ ID NO: 2005175 - DNA, 17 bp, Homo sapiens
agtactcagtatagcat

SEQ ID NO: 2005176 - DNA, 13 bp, Homo sapiens
agtactctctgct

SEQ ID NO: 2005177 - DNA, 19 bp, Homo sapiens
agtactctctgctctagcc

SEQ ID NO: 2005178 - DNA, 15 bp, Homo sapiens
agtactgggaaggag

SEQ ID NO: 2005179 - DNA, 23 bp, Homo sapiens
agtactggggagaaataattgtt

SEQ ID NO: 2005180 - DNA, 16 bp, Homo sapiens
agtactgtgtacagaa

SEQ ID NO: 2005181 - DNA, 13 bp, Homo sapiens
agtacttctaaga

SEQ ID NO: 2005182 - DNA, 14 bp, Homo sapiens
agtacttctaagag

SEQ ID NO: 2005183 - DNA, 22 bp, Homo sapiens
agtacttctccaccctgctctc

SEQ ID NO: 2005184 - DNA, 20 bp, Homo sapiens
agtagaaagacagagctggg

SEQ ID NO: 2005185 - DNA, 19 bp, Homo sapiens
agtagaagcctgcagcggc

SEQ ID NO: 2005186 - DNA, 19 bp, Homo sapiens
agtagaagtctcttccagt

SEQ ID NO: 2005187 - DNA, 13 bp, Homo sapiens
agtagaattatat

SEQ ID NO: 2005188 - DNA, 15 bp, Homo sapiens
agtagaattatatct

SEQ ID NO: 2005189 - DNA, 16 bp, Homo sapiens
agtagaattatatcta

SEQ ID NO: 2005190 - DNA, 22 bp, Homo sapiens
agtagaattatatctaatttat

SEQ ID NO: 2005191 - DNA, 21 bp, Homo sapiens
agtagagaagtatccaattat

SEQ ID NO: 2005192 - DNA, 16 bp, Homo sapiens
agtagatagaaagcaa

SEQ ID NO: 2005193 - DNA, 20 bp, Homo sapiens
agtcatttattttaaaaaat

SEQ ID NO: 2005194 - DNA, 22 bp, Homo sapiens
agtcatttattttaaaaaatga

SEQ ID NO: 2005195 - DNA, 22 bp, Homo sapiens
agtcatttgctgagcatgtact

SEQ ID NO: 2005196 - DNA, 12 bp, Homo sapiens
agtccaacctgc

SEQ ID NO: 2005197 - DNA, 11 bp, Homo sapiens
agtccaagcat

SEQ ID NO: 2005198 - DNA, 13 bp, Homo sapiens
agtccaatatttg

SEQ ID NO: 2005199 - DNA, 17 bp, Homo sapiens
agtccacatcttctcag

SEQ ID NO: 2005200 - DNA, 18 bp, Homo sapiens
agtccagaataagtgctg

SEQ ID NO: 2005201 - DNA, 19 bp, Homo sapiens
agtccagaataagtgctgt

SEQ ID NO: 2005202 - DNA, 15 bp, Homo sapiens
agtccagatgccttc

SEQ ID NO: 2005203 - DNA, 21 bp, Homo sapiens
agtccagatgccttcctgtct

SEQ ID NO: 2005204 - DNA, 22 bp, Homo sapiens
agtccagatgccttcctgtctt

SEQ ID NO: 2005205 - DNA, 12 bp, Homo sapiens
agtccagccagc

SEQ ID NO: 2005206 - DNA, 14 bp, Homo sapiens
agtccagggcggga

SEQ ID NO: 2005207 - DNA, 20 bp, Homo sapiens
agtccagggcgggagtgggg

SEQ ID NO: 2005208 - DNA, 14 bp, Homo sapiens
agtccaggtcctgg

SEQ ID NO: 2005209 - DNA, 17 bp, Homo sapiens
agtccagtgacctgctg

SEQ ID NO: 2005210 - DNA, 21 bp, Homo sapiens
agtcccaaggaaagccccagc

SEQ ID NO: 2005211 - DNA, 20 bp, Homo sapiens
agtcccaccttggctgcagg

SEQ ID NO: 2005212 - DNA, 19 bp, Homo sapiens
agtcccagaaccacactgt

SEQ ID NO: 2005213 - DNA, 14 bp, Homo sapiens
agtcccccaccaca

SEQ ID NO: 2005214 - DNA, 16 bp, Homo sapiens
agtccccgtcccccag

SEQ ID NO: 2005215 - DNA, 15 bp, Homo sapiens
agtccccgtgccccg

SEQ ID NO: 2005216 - DNA, 20 bp, Homo sapiens
agtccccgtgccccgcctcc

SEQ ID NO: 2005217 - DNA, 14 bp, Homo sapiens
agtcccgtggaggg

SEQ ID NO: 2005218 - DNA, 17 bp, Homo sapiens
agtccctgggggaagcc

SEQ ID NO: 2005219 - DNA, 12 bp, Homo sapiens
agtccctgttct

SEQ ID NO: 2005220 - DNA, 18 bp, Homo sapiens
agtccctgttctcagctc

SEQ ID NO: 2005221 - DNA, 23 bp, Homo sapiens
agtccgcaagttcagggaagcag

SEQ ID NO: 2005222 - DNA, 12 bp, Homo sapiens
agtccgcctggc

SEQ ID NO: 2005223 - DNA, 12 bp, Homo sapiens
agtcctagagct

SEQ ID NO: 2005224 - DNA, 14 bp, Homo sapiens
agtcctagagctcc

SEQ ID NO: 2005225 - DNA, 15 bp, Homo sapiens
agtcctagagctcct

SEQ ID NO: 2005226 - DNA, 17 bp, Homo sapiens
agtcctagccactcagg

SEQ ID NO: 2005227 - DNA, 16 bp, Homo sapiens
agtcctcacagcctct

SEQ ID NO: 2005228 - DNA, 18 bp, Homo sapiens
agtcctcacagcctctcc

SEQ ID NO: 2005229 - DNA, 15 bp, Homo sapiens
agtcctcgtagccat

SEQ ID NO: 2005230 - DNA, 15 bp, Homo sapiens
agtcctctcttctct

SEQ ID NO: 2005231 - DNA, 16 bp, Homo sapiens
agtcctcttattccta

SEQ ID NO: 2005232 - DNA, 14 bp, Homo sapiens
agtcctcttttctg

SEQ ID NO: 2005233 - DNA, 22 bp, Homo sapiens
agtcctgggagaacctcaggct

SEQ ID NO: 2005234 - DNA, 16 bp, Homo sapiens
agtcctggtctgctca

SEQ ID NO: 2005235 - DNA, 13 bp, Homo sapiens
agtcctgtgaatt

SEQ ID NO: 2005236 - DNA, 16 bp, Homo sapiens
agtccttggtctgctg

SEQ ID NO: 2005237 - DNA, 18 bp, Homo sapiens
agtcgaattaatagcttt

SEQ ID NO: 2005238 - DNA, 15 bp, Homo sapiens
agtcggttcccacgg

SEQ ID NO: 2005239 - DNA, 17 bp, Homo sapiens
agtcgtccttactcctg

SEQ ID NO: 2005240 - DNA, 19 bp, Homo sapiens
agtcgtccttactcctgtg

SEQ ID NO: 2005241 - DNA, 14 bp, Homo sapiens
agtcgttgtgaggg

SEQ ID NO: 2005242 - DNA, 21 bp, Homo sapiens
agtctaaagctggtttaatgt

SEQ ID NO: 2005243 - DNA, 18 bp, Homo sapiens
agtctaaagtttacagta

SEQ ID NO: 2005244 - DNA, 14 bp, Homo sapiens
agtctagaaaccag

SEQ ID NO: 2005245 - DNA, 16 bp, Homo sapiens
agtctaggagctggga

SEQ ID NO: 2005246 - DNA, 18 bp, Homo sapiens
agtctatatgaaaaacaa

SEQ ID NO: 2005247 - DNA, 16 bp, Homo sapiens
agtctcactgttgccc

SEQ ID NO: 2005248 - DNA, 17 bp, Homo sapiens
agtctcactgttgccca

SEQ ID NO: 2005249 - DNA, 23 bp, Homo sapiens
agtctcactgttgcccaggctgg

SEQ ID NO: 2005250 - DNA, 17 bp, Homo sapiens
agtctcaggagcatggg

SEQ ID NO: 2005251 - DNA, 15 bp, Homo sapiens
agtctcagtccagat

SEQ ID NO: 2005252 - DNA, 14 bp, Homo sapiens
agtctcctctctga

SEQ ID NO: 2005253 - DNA, 15 bp, Homo sapiens
agtctcctctctgag

SEQ ID NO: 2005254 - DNA, 13 bp, Homo sapiens
agtctcctgacat

SEQ ID NO: 2005255 - DNA, 19 bp, Homo sapiens
agtctcctttgcactgagg

SEQ ID NO: 2005256 - DNA, 22 bp, Homo sapiens
agtctcctttgcactgagggcc

SEQ ID NO: 2005257 - DNA, 14 bp, Homo sapiens
agtctctctctccc

SEQ ID NO: 2005258 - DNA, 19 bp, Homo sapiens
agtctctgactcttgcctt

SEQ ID NO: 2005259 - DNA, 23 bp, Homo sapiens
agtctctgtataatctatttaca

SEQ ID NO: 2005260 - DNA, 13 bp, Homo sapiens
agtctcttctcca

SEQ ID NO: 2005261 - DNA, 16 bp, Homo sapiens
agtctcttctccactg

SEQ ID NO: 2005262 - DNA, 21 bp, Homo sapiens
agtctcttctccactggatgg

SEQ ID NO: 2005263 - DNA, 23 bp, Homo sapiens
agtctctttaatcttcagtttta

SEQ ID NO: 2005264 - DNA, 15 bp, Homo sapiens
agtctgaaagacaga

SEQ ID NO: 2005265 - DNA, 17 bp, Homo sapiens
agtctgagcccccggct

SEQ ID NO: 2005266 - DNA, 20 bp, Homo sapiens
agtctgaggccccaggccct

SEQ ID NO: 2005267 - DNA, 16 bp, Homo sapiens
agtctgagtaaaatct

SEQ ID NO: 2005268 - DNA, 17 bp, Homo sapiens
agtctgagtctgagtcc

SEQ ID NO: 2005269 - DNA, 13 bp, Homo sapiens
agtctgagtgggc

SEQ ID NO: 2005270 - DNA, 20 bp, Homo sapiens
agtctgattcccaagctctg

SEQ ID NO: 2005271 - DNA, 14 bp, Homo sapiens
agtctgcataaact

SEQ ID NO: 2005272 - DNA, 15 bp, Homo sapiens
agtctgcataaactt

SEQ ID NO: 2005273 - DNA, 22 bp, Homo sapiens
agtctgcataaacttcatcttc

SEQ ID NO: 2005274 - DNA, 17 bp, Homo sapiens
agtctgctatattttca

SEQ ID NO: 2005275 - DNA, 23 bp, Homo sapiens
agtctgggcaatgaaaccaaagc

SEQ ID NO: 2005276 - DNA, 17 bp, Homo sapiens
agtctgtctcaaaagaa

SEQ ID NO: 2005277 - DNA, 22 bp, Homo sapiens
agtcttccagagcctaagaaaa

SEQ ID NO: 2005278 - DNA, 20 bp, Homo sapiens
agtcttggcctgcctcccag

SEQ ID NO: 2005279 - DNA, 13 bp, Homo sapiens
agtcttgtcagaa

SEQ ID NO: 2005280 - DNA, 20 bp, Homo sapiens
agtcttgtgcttttcctatt

SEQ ID NO: 2005281 - DNA, 14 bp, Homo sapiens
agtcttgttaatta

SEQ ID NO: 2005282 - DNA, 18 bp, Homo sapiens
agtgaaagagtagtgcat

SEQ ID NO: 2005283 - DNA, 14 bp, Homo sapiens
agtgaaagcatcac

SEQ ID NO: 2005284 - DNA, 22 bp, Homo sapiens
agtgaaataattaaaaaccact

SEQ ID NO: 2005285 - DNA, 15 bp, Homo sapiens
agtgaacaactattt

SEQ ID NO: 2005286 - DNA, 22 bp, Homo sapiens
agtgaaccaaagagactggagc

SEQ ID NO: 2005287 - DNA, 13 bp, Homo sapiens
agtgaaccatcat

SEQ ID NO: 2005288 - DNA, 16 bp, Homo sapiens
agtgaagaaaagtgaa

SEQ ID NO: 2005289 - DNA, 19 bp, Homo sapiens
agtgaagaaaagtgaatgc

SEQ ID NO: 2005290 - DNA, 22 bp, Homo sapiens
agtgaagaatacttctcatttt

SEQ ID NO: 2005291 - DNA, 23 bp, Homo sapiens
agtgaagccccttgtcctctccc

SEQ ID NO: 2005292 - DNA, 21 bp, Homo sapiens
agtgaaggagaaaggagccgg

SEQ ID NO: 2005293 - DNA, 20 bp, Homo sapiens
agtgaaggagccacgtgaat

SEQ ID NO: 2005294 - DNA, 18 bp, Homo sapiens
agtgaataaacttcagca

SEQ ID NO: 2005295 - DNA, 20 bp, Homo sapiens
agtgaataaacttcagcacc

SEQ ID NO: 2005296 - DNA, 16 bp, Homo sapiens
agtgaatagctttcag

SEQ ID NO: 2005297 - DNA, 21 bp, Homo sapiens
agtgaattgtgaccaagttat

SEQ ID NO: 2005298 - DNA, 22 bp, Homo sapiens
agtgacaaattgtaactacact

SEQ ID NO: 2005299 - DNA, 16 bp, Homo sapiens
agtgacaagtggaggg

SEQ ID NO: 2005300 - DNA, 17 bp, Homo sapiens
agtgacaagtggagggg

SEQ ID NO: 2005301 - DNA, 19 bp, Homo sapiens
agtgacagagttcactata

SEQ ID NO: 2005302 - DNA, 11 bp, Homo sapiens
agtgacagcta

SEQ ID NO: 2005303 - DNA, 23 bp, Homo sapiens
agtgaccaggctcacaactgttt

SEQ ID NO: 2005304 - DNA, 19 bp, Homo sapiens
agtgaccataaaggcatgg

SEQ ID NO: 2005305 - DNA, 13 bp, Homo sapiens
agtgacccttccc

SEQ ID NO: 2005306 - DNA, 22 bp, Homo sapiens
agtgacctgaccggcacctgcg

SEQ ID NO: 2005307 - DNA, 22 bp, Homo sapiens
agtgactcggtgtaaaaccatg

SEQ ID NO: 2005308 - DNA, 18 bp, Homo sapiens
agtgactctatatagctg

SEQ ID NO: 2005309 - DNA, 13 bp, Homo sapiens
agtgactggcagg

SEQ ID NO: 2005310 - DNA, 22 bp, Homo sapiens
agtgactggcaggtgcagatgg

SEQ ID NO: 2005311 - DNA, 16 bp, Homo sapiens
agtgactgtaattaat

SEQ ID NO: 2005312 - DNA, 22 bp, Homo sapiens
agtgactgtcgtgtttacaaaa

SEQ ID NO: 2005313 - DNA, 18 bp, Homo sapiens
agtgactttacaggaggt

SEQ ID NO: 2005314 - DNA, 14 bp, Homo sapiens
agtgagaaaaagct

SEQ ID NO: 2005315 - DNA, 19 bp, Homo sapiens
agtgagaaaaagctcctgt

SEQ ID NO: 2005316 - DNA, 18 bp, Homo sapiens
agtgagaataattgtgta

SEQ ID NO: 2005317 - DNA, 20 bp, Homo sapiens
agtgagaataattgtgtaca

SEQ ID NO: 2005318 - DNA, 21 bp, Homo sapiens
agtgagaataattgtgtacaa

SEQ ID NO: 2005319 - DNA, 20 bp, Homo sapiens
agtgagaatctggctcctgt

SEQ ID NO: 2005320 - DNA, 12 bp, Homo sapiens
agtgagacacag

SEQ ID NO: 2005321 - DNA, 14 bp, Homo sapiens
agtgagacacagag

SEQ ID NO: 2005322 - DNA, 13 bp, Homo sapiens
agtgagactctgt

SEQ ID NO: 2005323 - DNA, 18 bp, Homo sapiens
agtgagactgacacctca

SEQ ID NO: 2005324 - DNA, 13 bp, Homo sapiens
agtgagagacatt

SEQ ID NO: 2005325 - DNA, 14 bp, Homo sapiens
agtgagagctgggt

SEQ ID NO: 2005326 - DNA, 22 bp, Homo sapiens
agtgagatcttacaggtatcag

SEQ ID NO: 2005327 - DNA, 20 bp, Homo sapiens
agtgagatttgtatttatat

SEQ ID NO: 2005328 - DNA, 23 bp, Homo sapiens
agtgagatttgtatttatattag

SEQ ID NO: 2005329 - DNA, 14 bp, Homo sapiens
agtgagcactaagg

SEQ ID NO: 2005330 - DNA, 13 bp, Homo sapiens
agtgagccacaga

SEQ ID NO: 2005331 - DNA, 15 bp, Homo sapiens
agtgagccacagacc

SEQ ID NO: 2005332 - DNA, 16 bp, Homo sapiens
agtgagccacagacca

SEQ ID NO: 2005333 - DNA, 11 bp, Homo sapiens
agtgagcctga

SEQ ID NO: 2005334 - DNA, 19 bp, Homo sapiens
agtgagctggaattctaaa

SEQ ID NO: 2005335 - DNA, 14 bp, Homo sapiens
agtgaggcttccag

SEQ ID NO: 2005336 - DNA, 17 bp, Homo sapiens
agtgaggcttccaggct

SEQ ID NO: 2005337 - DNA, 13 bp, Homo sapiens
agtgagggctggg

SEQ ID NO: 2005338 - DNA, 14 bp, Homo sapiens
agtgagggctgggc

SEQ ID NO: 2005339 - DNA, 18 bp, Homo sapiens
agtgagttgttgccctgg

SEQ ID NO: 2005340 - DNA, 20 bp, Homo sapiens
agtgagttgttgccctgggt

SEQ ID NO: 2005341 - DNA, 19 bp, Homo sapiens
agtgataatttctggaatt

SEQ ID NO: 2005342 - DNA, 14 bp, Homo sapiens
agtgatatatgtat

SEQ ID NO: 2005343 - DNA, 15 bp, Homo sapiens
agtgatatatgtatt

SEQ ID NO: 2005344 - DNA, 22 bp, Homo sapiens
agtgatatatgtatttattgtc

SEQ ID NO: 2005345 - DNA, 20 bp, Homo sapiens
agtgatcagtatgctgtttt

SEQ ID NO: 2005346 - DNA, 21 bp, Homo sapiens
agtgatcagtatgctgtttta

SEQ ID NO: 2005347 - DNA, 21 bp, Homo sapiens
agtgatctccatatgttacac

SEQ ID NO: 2005348 - DNA, 19 bp, Homo sapiens
agtgatggcgcgggaggca

SEQ ID NO: 2005349 - DNA, 21 bp, Homo sapiens
agtgatggcgcgggaggcacc

SEQ ID NO: 2005350 - DNA, 19 bp, Homo sapiens
agtgatggtctcacagagc

SEQ ID NO: 2005351 - DNA, 22 bp, Homo sapiens
agtgatgtgctggagctggctt

SEQ ID NO: 2005352 - DNA, 19 bp, Homo sapiens
agtgatgttgtttgggaga

SEQ ID NO: 2005353 - DNA, 17 bp, Homo sapiens
agtgatgtttttatgat

SEQ ID NO: 2005354 - DNA, 14 bp, Homo sapiens
agtgattctcctgc

SEQ ID NO: 2005355 - DNA, 17 bp, Homo sapiens
agtgattctcctgcctc

SEQ ID NO: 2005356 - DNA, 18 bp, Homo sapiens
agtgattctcctgcctca

SEQ ID NO: 2005357 - DNA, 12 bp, Homo sapiens
agtgatttcatt

SEQ ID NO: 2005358 - DNA, 23 bp, Homo sapiens
agtgcaaatactccaagcttcaa

SEQ ID NO: 2005359 - DNA, 15 bp, Homo sapiens
agtgcaacaaaatca

SEQ ID NO: 2005360 - DNA, 18 bp, Homo sapiens
agtgcaaccacacacctc

SEQ ID NO: 2005361 - DNA, 16 bp, Homo sapiens
agtgcaatttcccctc

SEQ ID NO: 2005362 - DNA, 19 bp, Homo sapiens
agtgcacacagaaatatat

SEQ ID NO: 2005363 - DNA, 12 bp, Homo sapiens
agtgcagagaaa

SEQ ID NO: 2005364 - DNA, 21 bp, Homo sapiens
agtgcagcccttcctcctgaa

SEQ ID NO: 2005365 - DNA, 17 bp, Homo sapiens
agtgcagtgagccgaga

SEQ ID NO: 2005366 - DNA, 18 bp, Homo sapiens
agtgcatccttgaactgt

SEQ ID NO: 2005367 - DNA, 14 bp, Homo sapiens
agtgcatctcagcc

SEQ ID NO: 2005368 - DNA, 20 bp, Homo sapiens
agtgcatgctctctgcagcc

SEQ ID NO: 2005369 - DNA, 22 bp, Homo sapiens
agtgcatgctctctgcagccag

SEQ ID NO: 2005370 - DNA, 15 bp, Homo sapiens
agtgccacagagaag

SEQ ID NO: 2005371 - DNA, 17 bp, Homo sapiens
agtgccacttgacattc

SEQ ID NO: 2005372 - DNA, 16 bp, Homo sapiens
agtgccaggacagctg

SEQ ID NO: 2005373 - DNA, 18 bp, Homo sapiens
agtgccaggacagctggc

SEQ ID NO: 2005374 - DNA, 19 bp, Homo sapiens
agtgccaggactccccagg

SEQ ID NO: 2005375 - DNA, 24 bp, Homo sapiens
agtgccaggactccccaggccagg

SEQ ID NO: 2005376 - DNA, 18 bp, Homo sapiens
agtgccatcccacattcg

SEQ ID NO: 2005377 - DNA, 19 bp, Homo sapiens
agtgccatttcctgtctgg

SEQ ID NO: 2005378 - DNA, 20 bp, Homo sapiens
agtgcccaccaacatcccat

SEQ ID NO: 2005379 - DNA, 20 bp, Homo sapiens
agtgcccgcctaggagttga

SEQ ID NO: 2005380 - DNA, 11 bp, Homo sapiens
agtgccctcat

SEQ ID NO: 2005381 - DNA, 17 bp, Homo sapiens
agtgccctccacagccg

SEQ ID NO: 2005382 - DNA, 12 bp, Homo sapiens
agtgcctcctgg

SEQ ID NO: 2005383 - DNA, 13 bp, Homo sapiens
agtgcctcctggc

SEQ ID NO: 2005384 - DNA, 15 bp, Homo sapiens
agtgcctcgaggcac

SEQ ID NO: 2005385 - DNA, 13 bp, Homo sapiens
agtgcctcttgtt

SEQ ID NO: 2005386 - DNA, 12 bp, Homo sapiens
agtgcctgctga

SEQ ID NO: 2005387 - DNA, 16 bp, Homo sapiens
agtgccttacctcctg

SEQ ID NO: 2005388 - DNA, 21 bp, Homo sapiens
agtgccttacctcctgcccag

SEQ ID NO: 2005389 - DNA, 18 bp, Homo sapiens
agtgcgctcttggtccct

SEQ ID NO: 2005390 - DNA, 14 bp, Homo sapiens
agtgctattctgtg

SEQ ID NO: 2005391 - DNA, 16 bp, Homo sapiens
agtgctccccacacgt

SEQ ID NO: 2005392 - DNA, 23 bp, Homo sapiens
agtgctccccacacgtgctcgca

SEQ ID NO: 2005393 - DNA, 15 bp, Homo sapiens
agtgctcggcagtca

SEQ ID NO: 2005394 - DNA, 12 bp, Homo sapiens
agtgctgagacc

SEQ ID NO: 2005395 - DNA, 14 bp, Homo sapiens
agtgctgattcagc

SEQ ID NO: 2005396 - DNA, 11 bp, Homo sapiens
agtgctgccat

SEQ ID NO: 2005397 - DNA, 12 bp, Homo sapiens
agtgctgccatg

SEQ ID NO: 2005398 - DNA, 14 bp, Homo sapiens
agtgctgccatgcc

SEQ ID NO: 2005399 - DNA, 15 bp, Homo sapiens
agtgctgccatgcca

SEQ ID NO: 2005400 - DNA, 17 bp, Homo sapiens
agtgctgccatgccact

SEQ ID NO: 2005401 - DNA, 20 bp, Homo sapiens
agtgctgggattacaagcgt

SEQ ID NO: 2005402 - DNA, 21 bp, Homo sapiens
agtgctgggattacaggtgtg

SEQ ID NO: 2005403 - DNA, 16 bp, Homo sapiens
agtgctgtacccttcc

SEQ ID NO: 2005404 - DNA, 17 bp, Homo sapiens
agtgctgtacccttcca

SEQ ID NO: 2005405 - DNA, 18 bp, Homo sapiens
agtgctgtacccttccac

SEQ ID NO: 2005406 - DNA, 22 bp, Homo sapiens
agtgctgtacccttccacctcc

SEQ ID NO: 2005407 - DNA, 16 bp, Homo sapiens
agtgctgtggcctggg

SEQ ID NO: 2005408 - DNA, 20 bp, Homo sapiens
agtgctgtggcctgggcaag

SEQ ID NO: 2005409 - DNA, 22 bp, Homo sapiens
agtgcttagaaagttattgtgt

SEQ ID NO: 2005410 - DNA, 14 bp, Homo sapiens
agtgcttcagcctg

SEQ ID NO: 2005411 - DNA, 15 bp, Homo sapiens
agtgcttcagcctga

SEQ ID NO: 2005412 - DNA, 18 bp, Homo sapiens
agtgcttctccaacactg

SEQ ID NO: 2005413 - DNA, 23 bp, Homo sapiens
agtgcttgcagatcatctgggga

SEQ ID NO: 2005414 - DNA, 19 bp, Homo sapiens
agtgctttacatgctgtgc

SEQ ID NO: 2005415 - DNA, 23 bp, Homo sapiens
agtgctttacatgctgtgctctt

SEQ ID NO: 2005416 - DNA, 18 bp, Homo sapiens
agtgctttacctttaaaa

SEQ ID NO: 2005417 - DNA, 15 bp, Homo sapiens
agtgctttattttgt

SEQ ID NO: 2005418 - DNA, 13 bp, Homo sapiens
agtgctttgtaat

SEQ ID NO: 2005419 - DNA, 12 bp, Homo sapiens
agtggaaaaaag

SEQ ID NO: 2005420 - DNA, 23 bp, Homo sapiens
agtggaaaaaagagaaaaaccaa

SEQ ID NO: 2005421 - DNA, 14 bp, Homo sapiens
agtggaagagcagc

SEQ ID NO: 2005422 - DNA, 17 bp, Homo sapiens
agtggaagagcagcctg

SEQ ID NO: 2005423 - DNA, 17 bp, Homo sapiens
agtggaatacagtgagt

SEQ ID NO: 2005424 - DNA, 15 bp, Homo sapiens
agtggaatgcaggga

SEQ ID NO: 2005425 - DNA, 16 bp, Homo sapiens
agtggaatgcagggaa

SEQ ID NO: 2005426 - DNA, 14 bp, Homo sapiens
agtggacaacaggt

SEQ ID NO: 2005427 - DNA, 17 bp, Homo sapiens
agtagatggtgaaattt

SEQ ID NO: 2005428 - DNA, 21 bp, Homo sapiens
agtagatggtgaaatttatta

SEQ ID NO: 2005429 - DNA, 23 bp, Homo sapiens
agtagcacaagttatttaaatct

SEQ ID NO: 2005430 - DNA, 14 bp, Homo sapiens
agtagcagtgattg

SEQ ID NO: 2005431 - DNA, 15 bp, Homo sapiens
agtagccaagttata

SEQ ID NO: 2005432 - DNA, 19 bp, Homo sapiens
agtagccctttctgtgtgc

SEQ ID NO: 2005433 - DNA, 18 bp, Homo sapiens
agtagccgagagcctgct

SEQ ID NO: 2005434 - DNA, 22 bp, Homo sapiens
agtagctaatgaaattgagaag

SEQ ID NO: 2005435 - DNA, 14 bp, Homo sapiens
agtagctgagagga

SEQ ID NO: 2005436 - DNA, 18 bp, Homo sapiens
agtagctgagaggaagat

SEQ ID NO: 2005437 - DNA, 14 bp, Homo sapiens
agtagctgggacta

SEQ ID NO: 2005438 - DNA, 14 bp, Homo sapiens
agtagcttaaataa

SEQ ID NO: 2005439 - DNA, 17 bp, Homo sapiens
agtagcttaaataaatt

SEQ ID NO: 2005440 - DNA, 18 bp, Homo sapiens
agtaggggaagacatgca

SEQ ID NO: 2005441 - DNA, 17 bp, Homo sapiens
agtaggtccaagggcca

SEQ ID NO: 2005442 - DNA, 17 bp, Homo sapiens
agtagtcagaagcaggt

SEQ ID NO: 2005443 - DNA, 13 bp, Homo sapiens
agtagtctctgtg

SEQ ID NO: 2005444 - DNA, 21 bp, Homo sapiens
agtagtgtcttcctagtatat

SEQ ID NO: 2005445 - DNA, 22 bp, Homo sapiens
agtagtgtcttcctagtatatt

SEQ ID NO: 2005446 - DNA, 12 bp, Homo sapiens
agtagtttgtat

SEQ ID NO: 2005447 - DNA, 12 bp, Homo sapiens
agtataaagtca

SEQ ID NO: 2005448 - DNA, 19 bp, Homo sapiens
agtatacaatatataaaaa

SEQ ID NO: 2005449 - DNA, 18 bp, Homo sapiens
agtataccatacattatc

SEQ ID NO: 2005450 - DNA, 17 bp, Homo sapiens
agtatacttttgtttca

SEQ ID NO: 2005451 - DNA, 21 bp, Homo sapiens
agtatatagtatatttatact

SEQ ID NO: 2005452 - DNA, 15 bp, Homo sapiens
agtatatatgtacag

SEQ ID NO: 2005453 - DNA, 13 bp, Homo sapiens
agtatatattcta

SEQ ID NO: 2005454 - DNA, 17 bp, Homo sapiens
agtatattatgtattta

SEQ ID NO: 2005455 - DNA, 14 bp, Homo sapiens
agtatatttatact

SEQ ID NO: 2005456 - DNA, 15 bp, Homo sapiens
agtatatttatactc

SEQ ID NO: 2005457 - DNA, 14 bp, Homo sapiens
agtatatttatagt

SEQ ID NO: 2005458 - DNA, 13 bp, Homo sapiens
agtatattttctt

SEQ ID NO: 2005459 - DNA, 15 bp, Homo sapiens
agtatcaggtctccc

SEQ ID NO: 2005460 - DNA, 12 bp, Homo sapiens
agtatcatgcat

SEQ ID NO: 2005461 - DNA, 13 bp, Homo sapiens
agtatccaattat

SEQ ID NO: 2005462 - DNA, 18 bp, Homo sapiens
agtatccaattatgtgac

SEQ ID NO: 2005463 - DNA, 21 bp, Homo sapiens
agtatccaattatgtgacaac

SEQ ID NO: 2005464 - DNA, 10 bp, Homo sapiens
agtatctcat

SEQ ID NO: 2005465 - DNA, 13 bp, Homo sapiens
agtatgaatgatg

SEQ ID NO: 2005466 - DNA, 14 bp, Homo sapiens
agtatgaatgatgt

SEQ ID NO: 2005467 - DNA, 15 bp, Homo sapiens
agtatgaatgatgtt

SEQ ID NO: 2005468 - DNA, 21 bp, Homo sapiens
agtatgaatgatgttttagaa

SEQ ID NO: 2005469 - DNA, 19 bp, Homo sapiens
agtatgcaagaagaatata

SEQ ID NO: 2005470 - DNA, 19 bp, Homo sapiens
agtatgctgttttaataat

SEQ ID NO: 2005471 - DNA, 17 bp, Homo sapiens
agtatggtggctgggtt

SEQ ID NO: 2005472 - DNA, 21 bp, Homo sapiens
agtatgtaaagtatgtaaaca

SEQ ID NO: 2005473 - DNA, 14 bp, Homo sapiens
agtatgtaatcttt

SEQ ID NO: 2005474 - DNA, 17 bp, Homo sapiens
agtatgtgatatctgaa

SEQ ID NO: 2005475 - DNA, 18 bp, Homo sapiens
agtattaatactaaaata

SEQ ID NO: 2005476 - DNA, 14 bp, Homo sapiens
agtattcaggcact

SEQ ID NO: 2005477 - DNA, 20 bp, Homo sapiens
agtattccagacctgaagaa

SEQ ID NO: 2005478 - DNA, 22 bp, Homo sapiens
agtattccatttttactaaagc

SEQ ID NO: 2005479 - DNA, 12 bp, Homo sapiens
agtattcttcat

SEQ ID NO: 2005480 - DNA, 20 bp, Homo sapiens
agtattcttcatcagcattt

SEQ ID NO: 2005481 - DNA, 13 bp, Homo sapiens
agtatttatatat

SEQ ID NO: 2005482 - DNA, 23 bp, Homo sapiens
agtatttatatatttataactca

SEQ ID NO: 2005483 - DNA, 20 bp, Homo sapiens
agtatttatttaatgttatg

SEQ ID NO: 2005484 - DNA, 23 bp, Homo sapiens
agtatttgaaactgaatgtttat

SEQ ID NO: 2005485 - DNA, 13 bp, Homo sapiens
agtatttgttaat

SEQ ID NO: 2005486 - DNA, 20 bp, Homo sapiens
agtattttattaaagcaaca

SEQ ID NO: 2005487 - DNA, 22 bp, Homo sapiens
agtattttttttactgtgcata

SEQ ID NO: 2005488 - DNA, 18 bp, Homo sapiens
agtcaaaaggtgcctgtg

SEQ ID NO: 2005489 - DNA, 13 bp, Homo sapiens
agtcaaaatttca

SEQ ID NO: 2005490 - DNA, 13 bp, Homo sapiens
agtcaaaccataa

SEQ ID NO: 2005491 - DNA, 20 bp, Homo sapiens
agtcaaaccataaacttcat

SEQ ID NO: 2005492 - DNA, 15 bp, Homo sapiens
agtcaaactgtgcca

SEQ ID NO: 2005493 - DNA, 18 bp, Homo sapiens
agtcaactggctggccag

SEQ ID NO: 2005494 - DNA, 12 bp, Homo sapiens
agtcaagaaaaa

SEQ ID NO: 2005495 - DNA, 17 bp, Homo sapiens
agtcaattagtacagta

SEQ ID NO: 2005496 - DNA, 11 bp, Homo sapiens
agtcacacaga

SEQ ID NO: 2005497 - DNA, 12 bp, Homo sapiens
agtcacacagac

SEQ ID NO: 2005498 - DNA, 15 bp, Homo sapiens
agtcacacagtgagt

SEQ ID NO: 2005499 - DNA, 23 bp, Homo sapiens
agtcacacagtgagtcgaggaca

SEQ ID NO: 2005500 - DNA, 22 bp, Homo sapiens
agtcacaccatcttaaatgaca

SEQ ID NO: 2005501 - DNA, 12 bp, Homo sapiens
agtcacagctgc

SEQ ID NO: 2005502 - DNA, 18 bp, Homo sapiens
agtcacagctgcagctgg

SEQ ID NO: 2005503 - DNA, 21 bp, Homo sapiens
agtcacagctgcagctgggcc

SEQ ID NO: 2005504 - DNA, 14 bp, Homo sapiens
agtcacatcacagg

SEQ ID NO: 2005505 - DNA, 15 bp, Homo sapiens
agtcacatcacagga

SEQ ID NO: 2005506 - DNA, 13 bp, Homo sapiens
agtcaccaagccc

SEQ ID NO: 2005507 - DNA, 19 bp, Homo sapiens
agtcaccaggaatgttaaa

SEQ ID NO: 2005508 - DNA, 19 bp, Homo sapiens
agtcaccctacctgtgcct

SEQ ID NO: 2005509 - DNA, 14 bp, Homo sapiens
agtcacccttctgg

SEQ ID NO: 2005510 - DNA, 12 bp, Homo sapiens
agtcacctcctc

SEQ ID NO: 2005511 - DNA, 14 bp, Homo sapiens
agtcacctgcaagc

SEQ ID NO: 2005512 - DNA, 17 bp, Homo sapiens
agtcacctgcaagcccc

SEQ ID NO: 2005513 - DNA, 20 bp, Homo sapiens
agtcacctgcaagccccagg

SEQ ID NO: 2005514 - DNA, 23 bp, Homo sapiens
agtcacctgcaagccccagggcc

SEQ ID NO: 2005515 - DNA, 10 bp, Homo sapiens
agtcactgtc

SEQ ID NO: 2005516 - DNA, 15 bp, Homo sapiens
agtcacttccagtgt

SEQ ID NO: 2005517 - DNA, 12 bp, Homo sapiens
agtcagaacagc

SEQ ID NO: 2005518 - DNA, 14 bp, Homo sapiens
agtcagaacagcag

SEQ ID NO: 2005519 - DNA, 20 bp, Homo sapiens
agtcagaagcaggttcttga

SEQ ID NO: 2005520 - DNA, 15 bp, Homo sapiens
agtcagactgctggg

SEQ ID NO: 2005521 - DNA, 14 bp, Homo sapiens
agtcagatgcccag

SEQ ID NO: 2005522 - DNA, 19 bp, Homo sapiens
agtcagcccgaatgcctgt

SEQ ID NO: 2005523 - DNA, 15 bp, Homo sapiens
agtcaggacctggct

SEQ ID NO: 2005524 - DNA, 17 bp, Homo sapiens
agtcaggacctggcttg

SEQ ID NO: 2005525 - DNA, 22 bp, Homo sapiens
agtcaggccttaattttcagta

SEQ ID NO: 2005526 - DNA, 21 bp, Homo sapiens
agtcagggtgggaagaaagaa

SEQ ID NO: 2005527 - DNA, 22 bp, Homo sapiens
agtcagtaggtccaagggccat

SEQ ID NO: 2005528 - DNA, 21 bp, Homo sapiens
agtcagtcatgatggcaccac

SEQ ID NO: 2005529 - DNA, 17 bp, Homo sapiens
agtcagttcccggagca

SEQ ID NO: 2005530 - DNA, 23 bp, Homo sapiens
agtcagttcccggagcacagccc

SEQ ID NO: 2005531 - DNA, 14 bp, Homo sapiens
agtcagttggagaa

SEQ ID NO: 2005532 - DNA, 14 bp, Homo sapiens
agtcataaacagca

SEQ ID NO: 2005533 - DNA, 16 bp, Homo sapiens
agtcataaacagcatt

SEQ ID NO: 2005534 - DNA, 17 bp, Homo sapiens
agtcataaacagcattt

SEQ ID NO: 2005535 - DNA, 19 bp, Homo sapiens
agtcataaacagcatttat

SEQ ID NO: 2005536 - DNA, 22 bp, Homo sapiens
agtcatagaaatacctcattcg

SEQ ID NO: 2005537 - DNA, 21 bp, Homo sapiens
agtcatgaagcccaagtgaaa

SEQ ID NO: 2005538 - DNA, 15 bp, Homo sapiens
agtcatgatctccct

SEQ ID NO: 2005539 - DNA, 17 bp, Homo sapiens
agtcatgatctccctgc

SEQ ID NO: 2005540 - DNA, 19 bp, Homo sapiens
agtcatgatctccctgccg

SEQ ID NO: 2005541 - DNA, 20 bp, Homo sapiens
agtcatgatctccctgccgc

SEQ ID NO: 2005542 - DNA, 18 bp, Homo sapiens
agtcattgtcgctcagca

SEQ ID NO: 2005543 - DNA, 23 bp, Homo sapiens
agtcattgttacaggtgtactat

SEQ ID NO: 2005544 - DNA, 14 bp, Homo sapiens
agatgaagagaagc

SEQ ID NO: 2005545 - DNA, 16 bp, Homo sapiens
agatgaagagaagctg

SEQ ID NO: 2005546 - DNA, 18 bp, Homo sapiens
agatgagatttgccagca

SEQ ID NO: 2005547 - DNA, 16 bp, Homo sapiens
agatgatcacatggaa

SEQ ID NO: 2005548 - DNA, 14 bp, Homo sapiens
caaaatttccagta

SEQ ID NO: 2005549 - DNA, 20 bp, Homo sapiens
caaaatttccagtacctttg

SEQ ID NO: 2005550 - DNA, 11 bp, Homo sapiens
caaaatttgtt

SEQ ID NO: 2005551 - DNA, 13 bp, Homo sapiens
caaaattttattc

SEQ ID NO: 2005552 - DNA, 18 bp, Homo sapiens
caaaattttattcctata

SEQ ID NO: 2005553 - DNA, 17 bp, Homo sapiens
caaacaagaatgtccct

SEQ ID NO: 2005554 - DNA, 15 bp, Homo sapiens
caaacacactgtaaa

SEQ ID NO: 2005555 - DNA, 14 bp, Homo sapiens
caaacacctcccag

SEQ ID NO: 2005556 - DNA, 23 bp, Homo sapiens
caaacactccaccccctccagct

SEQ ID NO: 2005557 - DNA, 15 bp, Homo sapiens
caaacactgaatcat

SEQ ID NO: 2005558 - DNA, 14 bp, Homo sapiens
caaacactgtgtat

SEQ ID NO: 2005559 - DNA, 21 bp, Homo sapiens
caaacagaaaagtgcaaagtt

SEQ ID NO: 2005560 - DNA, 17 bp, Homo sapiens
caaacagagccttcaca

SEQ ID NO: 2005561 - DNA, 12 bp, Homo sapiens
caaacagagggc

SEQ ID NO: 2005562 - DNA, 15 bp, Homo sapiens
caaacagtctcagga

SEQ ID NO: 2005563 - DNA, 19 bp, Homo sapiens
caaacatgtggcaacctgt

SEQ ID NO: 2005564 - DNA, 20 bp, Homo sapiens
caaacatgtggttaatgcca

SEQ ID NO: 2005565 - DNA, 20 bp, Homo sapiens
caaacattaatcaccaaagt

SEQ ID NO: 2005566 - DNA, 12 bp, Homo sapiens
caaacatttctt

SEQ ID NO: 2005567 - DNA, 14 bp, Homo sapiens
caaaccactgtaca

SEQ ID NO: 2005568 - DNA, 17 bp, Homo sapiens
caaaccaggactctgcc

SEQ ID NO: 2005569 - DNA, 18 bp, Homo sapiens
caaaccaggactctgccc

SEQ ID NO: 2005570 - DNA, 22 bp, Homo sapiens
caaaccatttaattcataatta

SEQ ID NO: 2005571 - DNA, 17 bp, Homo sapiens
caaaccatttcaaatgg

SEQ ID NO: 2005572 - DNA, 21 bp, Homo sapiens
caaacccaaaacctcatgaca

SEQ ID NO: 2005573 - DNA, 21 bp, Homo sapiens
caaaccccgaccacctgccca

SEQ ID NO: 2005574 - DNA, 13 bp, Homo sapiens
caaaccctgtggg

SEQ ID NO: 2005575 - DNA, 23 bp, Homo sapiens
caaaccctgtggggcctgatggt

SEQ ID NO: 2005576 - DNA, 15 bp, Homo sapiens
caaacccttctcttc

SEQ ID NO: 2005577 - DNA, 22 bp, Homo sapiens
caaacctcagtcatattcttat

SEQ ID NO: 2005578 - DNA, 16 bp, Homo sapiens
caaacctctatatgtt

SEQ ID NO: 2005579 - DNA, 18 bp, Homo sapiens
caaactacagaataatgt

SEQ ID NO: 2005580 - DNA, 19 bp, Homo sapiens
caaactcttgacctcaggt

SEQ ID NO: 2005581 - DNA, 13 bp, Homo sapiens
caattcctgggcc

SEQ ID NO: 2005582 - DNA, 16 bp, Homo sapiens
caattcctgggcccca

SEQ ID NO: 2005583 - DNA, 23 bp, Homo sapiens
caattctcatttgtcacacactt

SEQ ID NO: 2005584 - DNA, 18 bp, Homo sapiens
caattcttacaaacatgt

SEQ ID NO: 2005585 - DNA, 18 bp, Homo sapiens
caattgaacttaaataaa

SEQ ID NO: 2005586 - DNA, 19 bp, Homo sapiens
caattgactgtcactgttc

SEQ ID NO: 2005587 - DNA, 20 bp, Homo sapiens
caattgatacttcaggtgct

SEQ ID NO: 2005588 - DNA, 23 bp, Homo sapiens
caattgcacgcggagtgagtttt

SEQ ID NO: 2005589 - DNA, 16 bp, Homo sapiens
caaataaggatttgtt

SEQ ID NO: 2005590 - DNA, 22 bp, Homo sapiens
caaatactccaagcttcaagtg

SEQ ID NO: 2005591 - DNA, 14 bp, Homo sapiens
caaatactcttagg

SEQ ID NO: 2005592 - DNA, 15 bp, Homo sapiens
caaatatatttaatt

SEQ ID NO: 2005593 - DNA, 12 bp, Homo sapiens
caaatatgcaaa

SEQ ID NO: 2005594 - DNA, 18 bp, Homo sapiens
caaatatgcaaagcactg

SEQ ID NO: 2005595 - DNA, 21 bp, Homo sapiens
caaatatgcaaagcactgact

SEQ ID NO: 2005596 - DNA, 12 bp, Homo sapiens
caaatattagca

SEQ ID NO: 2005597 - DNA, 19 bp, Homo sapiens
caaatattagcaaagaagc

SEQ ID NO: 2005598 - DNA, 20 bp, Homo sapiens
caaatattattcaagtgcct

SEQ ID NO: 2005599 - DNA, 15 bp, Homo sapiens
caaatatttattttc

SEQ ID NO: 2005600 - DNA, 20 bp, Homo sapiens
caaatatttattttctttct

SEQ ID NO: 2005601 - DNA, 16 bp, Homo sapiens
caaatcaaagcaaggg

SEQ ID NO: 2005602 - DNA, 16 bp, Homo sapiens
caaatcacacctctgg

SEQ ID NO: 2005603 - DNA, 17 bp, Homo sapiens
caaatcacacctctggg

SEQ ID NO: 2005604 - DNA, 16 bp, Homo sapiens
caaatccatccagaat

SEQ ID NO: 2005605 - DNA, 16 bp, Homo sapiens
caaatccttgagcact

SEQ ID NO: 2005606 - DNA, 14 bp, Homo sapiens
caaatcgaatgaaa

SEQ ID NO: 2005607 - DNA, 13 bp, Homo sapiens
caaatctattcag

SEQ ID NO: 2005608 - DNA, 15 bp, Homo sapiens
caaatctgtatatgt

SEQ ID NO: 2005609 - DNA, 23 bp, Homo sapiens
caaatctgtatatgttgtaataa

SEQ ID NO: 2005610 - DNA, 21 bp, Homo sapiens
caaatcttaacttgaaggagt

SEQ ID NO: 2005611 - DNA, 19 bp, Homo sapiens
caaatgaatgaccttgttg

SEQ ID NO: 2005612 - DNA, 16 bp, Homo sapiens
caaatgacatgcactg

SEQ ID NO: 2005613 - DNA, 20 bp, Homo sapiens
caaatgacatgcactgaccc

SEQ ID NO: 2005614 - DNA, 21 bp, Homo sapiens
caaatgacatgcactgaccct

SEQ ID NO: 2005615 - DNA, 17 bp, Homo sapiens
caaatgacccaaagacc

SEQ ID NO: 2005616 - DNA, 18 bp, Homo sapiens
caaatgacccaaagacca

SEQ ID NO: 2005617 - DNA, 22 bp, Homo sapiens
caaatgattttcatcaatttaa

SEQ ID NO: 2005618 - DNA, 13 bp, Homo sapiens
caaccagcattca

SEQ ID NO: 2005619 - DNA, 16 bp, Homo sapiens
caaccagcattttact

SEQ ID NO: 2005620 - DNA, 12 bp, Homo sapiens
caaccagccaca

SEQ ID NO: 2005621 - DNA, 15 bp, Homo sapiens
caaccatcaatggaa

SEQ ID NO: 2005622 - DNA, 13 bp, Homo sapiens
caaccattccaga

SEQ ID NO: 2005623 - DNA, 18 bp, Homo sapiens
caacccaacctcatcctc

SEQ ID NO: 2005624 - DNA, 22 bp, Homo sapiens
caacccatgatgagctcctctt

SEQ ID NO: 2005625 - DNA, 14 bp, Homo sapiens
caaccccagactca

SEQ ID NO: 2005626 - DNA, 16 bp, Homo sapiens
caaccccagctggcct

SEQ ID NO: 2005627 - DNA, 13 bp, Homo sapiens
caaccccagggcc

SEQ ID NO: 2005628 - DNA, 22 bp, Homo sapiens
caaccccagggcccccacaggc

SEQ ID NO: 2005629 - DNA, 13 bp, Homo sapiens
caaccccagttct

SEQ ID NO: 2005630 - DNA, 14 bp, Homo sapiens
caaccccagttctg

SEQ ID NO: 2005631 - DNA, 17 bp, Homo sapiens
caaccccagttctgctc

SEQ ID NO: 2005632 - DNA, 20 bp, Homo sapiens
caaccccagttctgctcctc

SEQ ID NO: 2005633 - DNA, 13 bp, Homo sapiens
caacccccaccga

SEQ ID NO: 2005634 - DNA, 20 bp, Homo sapiens
caacccccaccgaagagccc

SEQ ID NO: 2005635 - DNA, 21 bp, Homo sapiens
caacccccaccgaagagccct

SEQ ID NO: 2005636 - DNA, 16 bp, Homo sapiens
caacccccagcctgct

SEQ ID NO: 2005637 - DNA, 17 bp, Homo sapiens
caacccccagcctgcta

SEQ ID NO: 2005638 - DNA, 18 bp, Homo sapiens
caaccccgcggtgctctg

SEQ ID NO: 2005639 - DNA, 21 bp, Homo sapiens
caaccccgcggtgctctggcg

SEQ ID NO: 2005640 - DNA, 16 bp, Homo sapiens
caaccccttcgctcct

SEQ ID NO: 2005641 - DNA, 18 bp, Homo sapiens
caaccccttcgctcctgt

SEQ ID NO: 2005642 - DNA, 21 bp, Homo sapiens
caaccccttcgctcctgtgtc

SEQ ID NO: 2005643 - DNA, 17 bp, Homo sapiens
caacccgtgccaagtcc

SEQ ID NO: 2005644 - DNA, 14 bp, Homo sapiens
cacctctgtaattt

SEQ ID NO: 2005645 - DNA, 20 bp, Homo sapiens
cacctcttcaccccccactc

SEQ ID NO: 2005646 - DNA, 13 bp, Homo sapiens
cacctcttccttc

SEQ ID NO: 2005647 - DNA, 22 bp, Homo sapiens
cacctcttctcttcctgtaaca

SEQ ID NO: 2005648 - DNA, 15 bp, Homo sapiens
cacctgaaccccatg

SEQ ID NO: 2005649 - DNA, 11 bp, Homo sapiens
cacctgacaca

SEQ ID NO: 2005650 - DNA, 13 bp, Homo sapiens
cacctgacacatc

SEQ ID NO: 2005651 - DNA, 15 bp, Homo sapiens
cacctgcaagcccca

SEQ ID NO: 2005652 - DNA, 21 bp, Homo sapiens
cacctgcaagccccagggcct

SEQ ID NO: 2005653 - DNA, 22 bp, Homo sapiens
cacctgcaagccccagggcctg

SEQ ID NO: 2005654 - DNA, 23 bp, Homo sapiens
cacctgcaagccccagggcctgg

SEQ ID NO: 2005655 - DNA, 21 bp, Homo sapiens
cacctgcaagtgcccgccctg

SEQ ID NO: 2005656 - DNA, 23 bp, Homo sapiens
cacctgcaagtgcccgccctgcc

SEQ ID NO: 2005657 - DNA, 19 bp, Homo sapiens
cacctgcacgtgatctgct

SEQ ID NO: 2005658 - DNA, 12 bp, Homo sapiens
cacctgccaccg

SEQ ID NO: 2005659 - DNA, 13 bp, Homo sapiens
cacctgccagcca

SEQ ID NO: 2005660 - DNA, 15 bp, Homo sapiens
cacctgccagccatc

SEQ ID NO: 2005661 - DNA, 18 bp, Homo sapiens
cacctgccagccatcaca

SEQ ID NO: 2005662 - DNA, 13 bp, Homo sapiens
cacctgccagcct

SEQ ID NO: 2005663 - DNA, 14 bp, Homo sapiens
cacctgccagcctg

SEQ ID NO: 2005664 - DNA, 17 bp, Homo sapiens
cacctgccatttgcacc

SEQ ID NO: 2005665 - DNA, 14 bp, Homo sapiens
cacctgccccagcg

SEQ ID NO: 2005666 - DNA, 22 bp, Homo sapiens
cacctgccccagcgcggcttgg

SEQ ID NO: 2005667 - DNA, 15 bp, Homo sapiens
cacctgccccctggt

SEQ ID NO: 2005668 - DNA, 19 bp, Homo sapiens
cacctgccctgcctgcatc

SEQ ID NO: 2005669 - DNA, 13 bp, Homo sapiens
cacctgccgacct

SEQ ID NO: 2005670 - DNA, 21 bp, Homo sapiens
cacctgccgacctcgtcctcc

SEQ ID NO: 2005671 - DNA, 13 bp, Homo sapiens
cacctgcttctga

SEQ ID NO: 2005672 - DNA, 14 bp, Homo sapiens
cacctgcttctgaa

SEQ ID NO: 2005673 - DNA, 15 bp, Homo sapiens
cacctgctttctcct

SEQ ID NO: 2005674 - DNA, 16 bp, Homo sapiens
cacctgctttctcctg

SEQ ID NO: 2005675 - DNA, 11 bp, Homo sapiens
cacctggcccc

SEQ ID NO: 2005676 - DNA, 18 bp, Homo sapiens
cacctggccgcctccagg

SEQ ID NO: 2005677 - DNA, 12 bp, Homo sapiens
cacctggcctgc

SEQ ID NO: 2005678 - DNA, 14 bp, Homo sapiens
cacctggcctgctg

SEQ ID NO: 2005679 - DNA, 15 bp, Homo sapiens
cacctggcctgctgg

SEQ ID NO: 2005680 - DNA, 16 bp, Homo sapiens
cacctggcctgctggg

SEQ ID NO: 2005681 - DNA, 23 bp, Homo sapiens
cacctgggccctggggcctgtac

SEQ ID NO: 2005682 - DNA, 23 bp, Homo sapiens
cacctgtactcaggaggctgagg

SEQ ID NO: 2005683 - DNA, 14 bp, Homo sapiens
cacctgtctgtctg

SEQ ID NO: 2005684 - DNA, 22 bp, Homo sapiens
cacctgtctgtctgtctgtccc

SEQ ID NO: 2005685 - DNA, 15 bp, Homo sapiens
cacctgtgcacccca

SEQ ID NO: 2005686 - DNA, 15 bp, Homo sapiens
cacctgttaaaatgt

SEQ ID NO: 2005687 - DNA, 19 bp, Homo sapiens
cacctgttaaaatgtacac

SEQ ID NO: 2005688 - DNA, 21 bp, Homo sapiens
caccttaatattattggggtt

SEQ ID NO: 2005689 - DNA, 14 bp, Homo sapiens
caccttacattcct

SEQ ID NO: 2005690 - DNA, 15 bp, Homo sapiens
caccttacattccta

SEQ ID NO: 2005691 - DNA, 17 bp, Homo sapiens
caccttaccaactttct

SEQ ID NO: 2005692 - DNA, 17 bp, Homo sapiens
caccttcaattcctggg

SEQ ID NO: 2005693 - DNA, 22 bp, Homo sapiens
caccttcccagctctccctctg

SEQ ID NO: 2005694 - DNA, 14 bp, Homo sapiens
caccttcccatgcc

SEQ ID NO: 2005695 - DNA, 20 bp, Homo sapiens
caccttcttggcttctggga

SEQ ID NO: 2005696 - DNA, 18 bp, Homo sapiens
caccttgccgagagaggc

SEQ ID NO: 2005697 - DNA, 19 bp, Homo sapiens
caccttgccgagagaggcg

SEQ ID NO: 2005698 - DNA, 12 bp, Homo sapiens
caccttgctctt

SEQ ID NO: 2005699 - DNA, 13 bp, Homo sapiens
caccttggctcaa

SEQ ID NO: 2005700 - DNA, 14 bp, Homo sapiens
caccttggctcaag

SEQ ID NO: 2005701 - DNA, 15 bp, Homo sapiens
caccttggctcaagt

SEQ ID NO: 2005702 - DNA, 13 bp, Homo sapiens
caccttggctgca

SEQ ID NO: 2005703 - DNA, 14 bp, Homo sapiens
caccttggctgcag

SEQ ID NO: 2005704 - DNA, 18 bp, Homo sapiens
caccttggctgcagggag

SEQ ID NO: 2005705 - DNA, 17 bp, Homo sapiens
caccttgggtttgtatt

SEQ ID NO: 2005706 - DNA, 14 bp, Homo sapiens
cacctttaagtcct

SEQ ID NO: 2005707 - DNA, 18 bp, Homo sapiens
cacctttgggatcagcct

SEQ ID NO: 2005708 - DNA, 23 bp, Homo sapiens
cacctttgggatcagcctccgcc

SEQ ID NO: 2005709 - DNA, 13 bp, Homo sapiens
cacctttggtgca

SEQ ID NO: 2005710 - DNA, 13 bp, Homo sapiens
cacgaaatgttat

SEQ ID NO: 2005711 - DNA, 22 bp, Homo sapiens
cacgaacccacctgctgagaga

SEQ ID NO: 2005712 - DNA, 18 bp, Homo sapiens
cacgaatttgctggggaa

SEQ ID NO: 2005713 - DNA, 12 bp, Homo sapiens
cacgactcttcc

SEQ ID NO: 2005714 - DNA, 19 bp, Homo sapiens
cacgactcttcctgcaaag

SEQ ID NO: 2005715 - DNA, 17 bp, Homo sapiens
cacgagtcacctgcaag

SEQ ID NO: 2005716 - DNA, 18 bp, Homo sapiens
cacgagtcacctgcaagc

SEQ ID NO: 2005717 - DNA, 15 bp, Homo sapiens
cacgatcttgtaaga

SEQ ID NO: 2005718 - DNA, 15 bp, Homo sapiens
cacgatgaaaaactt

SEQ ID NO: 2005719 - DNA, 14 bp, Homo sapiens
cacgatgtggccct

SEQ ID NO: 2005720 - DNA, 16 bp, Homo sapiens
cacgatgtggccctgg

SEQ ID NO: 2005721 - DNA, 18 bp, Homo sapiens
cacgatgtggccctggcc

SEQ ID NO: 2005722 - DNA, 14 bp, Homo sapiens
cacgcaacccttgc

SEQ ID NO: 2005723 - DNA, 19 bp, Homo sapiens
cacgcaacccttgctgctg

SEQ ID NO: 2005724 - DNA, 15 bp, Homo sapiens
cacgcaacttgaaat

SEQ ID NO: 2005725 - DNA, 22 bp, Homo sapiens
cacgcacatgccaatgcacgca

SEQ ID NO: 2005726 - DNA, 13 bp, Homo sapiens
cacgcaggaactc

SEQ ID NO: 2005727 - DNA, 16 bp, Homo sapiens
cacgcccgactagcag

SEQ ID NO: 2005728 - DNA, 21 bp, Homo sapiens
cacgcctataatcccagcact

SEQ ID NO: 2005729 - DNA, 21 bp, Homo sapiens
cacgcctatgatcccagcact

SEQ ID NO: 2005730 - DNA, 22 bp, Homo sapiens
cacgcctatgatcccagcactt

SEQ ID NO: 2005731 - DNA, 13 bp, Homo sapiens
cacgcctcctggc

SEQ ID NO: 2005732 - DNA, 15 bp, Homo sapiens
cacgcctcctggcca

SEQ ID NO: 2005733 - DNA, 16 bp, Homo sapiens
cacgcctcctggccag

SEQ ID NO: 2005734 - DNA, 11 bp, Homo sapiens
cacgcctgccc

SEQ ID NO: 2005735 - DNA, 15 bp, Homo sapiens
cacgcctgcccagcc

SEQ ID NO: 2005736 - DNA, 16 bp, Homo sapiens
cacgcctgcccagcct

SEQ ID NO: 2005737 - DNA, 20 bp, Homo sapiens
cacgcctgcccagcctcgca

SEQ ID NO: 2005738 - DNA, 15 bp, Homo sapiens
cacgcgtgcacacac

SEQ ID NO: 2005739 - DNA, 19 bp, Homo sapiens
cacgctcccccgcagtccc

SEQ ID NO: 2005740 - DNA, 14 bp, Homo sapiens
cacgctctggacat

SEQ ID NO: 2005741 - DNA, 17 bp, Homo sapiens
cacgctggagtgcagtg

SEQ ID NO: 2005742 - DNA, 20 bp, Homo sapiens
cacgctggagtgcagtgagc

SEQ ID NO: 2005743 - DNA, 23 bp, Homo sapiens
cacgctgtcctctcgagcccaga

SEQ ID NO: 2005744 - DNA, 17 bp, Homo sapiens
cacgctttctagctgtt

SEQ ID NO: 2005745 - DNA, 18 bp, Homo sapiens
cacggacgtttccatcag

SEQ ID NO: 2005746 - DNA, 22 bp, Homo sapiens
cacggagagaaggcccatacct

SEQ ID NO: 2005747 - DNA, 20 bp, Homo sapiens
cacggcacctgggccctggg

SEQ ID NO: 2005748 - DNA, 21 bp, Homo sapiens
cacggcacctgggccctgggg

SEQ ID NO: 2005749 - DNA, 12 bp, Homo sapiens
cacggccctgcc

SEQ ID NO: 2005750 - DNA, 15 bp, Homo sapiens
cacggccctgcccca

SEQ ID NO: 2005751 - DNA, 13 bp, Homo sapiens
cacggcggcaggg

SEQ ID NO: 2005752 - DNA, 15 bp, Homo sapiens
cacggcggcagggtg

SEQ ID NO: 2005753 - DNA, 20 bp, Homo sapiens
cacggctcactgcagcctca

SEQ ID NO: 2005754 - DNA, 21 bp, Homo sapiens
cacgggaagcctccgtcagga

SEQ ID NO: 2005755 - DNA, 12 bp, Homo sapiens
cacgggcctcag

SEQ ID NO: 2005756 - DNA, 14 bp, Homo sapiens
cacgggcctcagtt

SEQ ID NO: 2005757 - DNA, 19 bp, Homo sapiens
cagcagtggagagtgttcc

SEQ ID NO: 2005758 - DNA, 16 bp, Homo sapiens
cagcagtgtcatcaga

SEQ ID NO: 2005759 - DNA, 12 bp, Homo sapiens
cagcagtgttcc

SEQ ID NO: 2005760 - DNA, 14 bp, Homo sapiens
cagcagtgttcccc

SEQ ID NO: 2005761 - DNA, 22 bp, Homo sapiens
cagcagtgttccccatctgggt

SEQ ID NO: 2005762 - DNA, 12 bp, Homo sapiens
cagcatatttat

SEQ ID NO: 2005763 - DNA, 14 bp, Homo sapiens
cagcatccagcctg

SEQ ID NO: 2005764 - DNA, 16 bp, Homo sapiens
cagcatccagcctgtg

SEQ ID NO: 2005765 - DNA, 18 bp, Homo sapiens
cagcatccagcctgtgtg

SEQ ID NO: 2005766 - DNA, 16 bp, Homo sapiens
cagcatcctgcttcct

SEQ ID NO: 2005767 - DNA, 19 bp, Homo sapiens
cagcatctgcctctattca

SEQ ID NO: 2005768 - DNA, 18 bp, Homo sapiens
cagcatgatattttcaga

SEQ ID NO: 2005769 - DNA, 16 bp, Homo sapiens
cagcatgtggggaagc

SEQ ID NO: 2005770 - DNA, 18 bp, Homo sapiens
cagcatgtggggaagcaa

SEQ ID NO: 2005771 - DNA, 18 bp, Homo sapiens
cagcattattcctccagg

SEQ ID NO: 2005772 - DNA, 12 bp, Homo sapiens
cagcattcagca

SEQ ID NO: 2005773 - DNA, 15 bp, Homo sapiens
cagcattcagcacac

SEQ ID NO: 2005774 - DNA, 21 bp, Homo sapiens
cagcattcagcacaccccaag

SEQ ID NO: 2005775 - DNA, 15 bp, Homo sapiens
cagcattcatgccga

SEQ ID NO: 2005776 - DNA, 15 bp, Homo sapiens
cagcattccatgacc

SEQ ID NO: 2005777 - DNA, 12 bp, Homo sapiens
cagcattttact

SEQ ID NO: 2005778 - DNA, 19 bp, Homo sapiens
cagcattttcacattttgc

SEQ ID NO: 2005779 - DNA, 16 bp, Homo sapiens
cagccaaaaaggacca

SEQ ID NO: 2005780 - DNA, 20 bp, Homo sapiens
cagccaaacacagagcggga

SEQ ID NO: 2005781 - DNA, 14 bp, Homo sapiens
cagccaaacagagc

SEQ ID NO: 2005782 - DNA, 15 bp, Homo sapiens
cagccaaacagagcc

SEQ ID NO: 2005783 - DNA, 18 bp, Homo sapiens
cagccaacaaacatagaa

SEQ ID NO: 2005784 - DNA, 23 bp, Homo sapiens
cagccaacaggtggcaggaccag

SEQ ID NO: 2005785 - DNA, 21 bp, Homo sapiens
cagccaataaatcaactccag

SEQ ID NO: 2005786 - DNA, 14 bp, Homo sapiens
cagccacacagagc

SEQ ID NO: 2005787 - DNA, 15 bp, Homo sapiens
cagccacacagagcc

SEQ ID NO: 2005788 - DNA, 17 bp, Homo sapiens
cagccacacctgtcagc

SEQ ID NO: 2005789 - DNA, 14 bp, Homo sapiens
cagccacacttctc

SEQ ID NO: 2005790 - DNA, 21 bp, Homo sapiens
cagccaccccctcccccatca

SEQ ID NO: 2005791 - DNA, 15 bp, Homo sapiens
cagccaccctgagga

SEQ ID NO: 2005792 - DNA, 18 bp, Homo sapiens
cagccaccctgaggagtc

SEQ ID NO: 2005793 - DNA, 19 bp, Homo sapiens
cagccaccctgaggagtct

SEQ ID NO: 2005794 - DNA, 21 bp, Homo sapiens
cagccaccctgaggagtctga

SEQ ID NO: 2005795 - DNA, 13 bp, Homo sapiens
cagccacctccca

SEQ ID NO: 2005796 - DNA, 17 bp, Homo sapiens
cagccacctcccaagga

SEQ ID NO: 2005797 - DNA, 23 bp, Homo sapiens
cagccacggccaggccagaggga

SEQ ID NO: 2005798 - DNA, 13 bp, Homo sapiens
cagccacttggtt

SEQ ID NO: 2005799 - DNA, 22 bp, Homo sapiens
cagccacttggtttttggctct

SEQ ID NO: 2005800 - DNA, 18 bp, Homo sapiens
cagccagactggcacagt

SEQ ID NO: 2005801 - DNA, 20 bp, Homo sapiens
cagccagcaatgatgtccag

SEQ ID NO: 2005802 - DNA, 11 bp, Homo sapiens
cagccagcagc

SEQ ID NO: 2005803 - DNA, 21 bp, Homo sapiens
cagccagcagccagctctcag

SEQ ID NO: 2005804 - DNA, 14 bp, Homo sapiens
cagccagccagtct

SEQ ID NO: 2005805 - DNA, 17 bp, Homo sapiens
cagccagccagtcttgc

SEQ ID NO: 2005806 - DNA, 11 bp, Homo sapiens
cagccagccca

SEQ ID NO: 2005807 - DNA, 13 bp, Homo sapiens
cagccagcccagc

SEQ ID NO: 2005808 - DNA, 14 bp, Homo sapiens
cagccagcccagcc

SEQ ID NO: 2005809 - DNA, 17 bp, Homo sapiens
cagccagcccagcccag

SEQ ID NO: 2005810 - DNA, 19 bp, Homo sapiens
cagccagcccagcccagct

SEQ ID NO: 2005811 - DNA, 20 bp, Homo sapiens
cagccagcccagcccagctg

SEQ ID NO: 2005812 - DNA, 14 bp, Homo sapiens
cagccagccctgcc

SEQ ID NO: 2005813 - DNA, 15 bp, Homo sapiens
cagccagccctgcct

SEQ ID NO: 2005814 - DNA, 17 bp, Homo sapiens
cagccagccctgcctgg

SEQ ID NO: 2005815 - DNA, 16 bp, Homo sapiens
cagccagcgcctccct

SEQ ID NO: 2005816 - DNA, 15 bp, Homo sapiens
cagccagctcctggg

SEQ ID NO: 2005817 - DNA, 18 bp, Homo sapiens
cagccagctctcagccaa

SEQ ID NO: 2005818 - DNA, 12 bp, Homo sapiens
cagccagggcca

SEQ ID NO: 2005819 - DNA, 12 bp, Homo sapiens
cagccaggggct

SEQ ID NO: 2005820 - DNA, 22 bp, Homo sapiens
caatagactgaagagaccacag

SEQ ID NO: 2005821 - DNA, 19 bp, Homo sapiens
caatagctattgcatgtaa

SEQ ID NO: 2005822 - DNA, 16 bp, Homo sapiens
caatataaattggctt

SEQ ID NO: 2005823 - DNA, 18 bp, Homo sapiens
caatatgattttaaattt

SEQ ID NO: 2005824 - DNA, 12 bp, Homo sapiens
caatatgcttac

SEQ ID NO: 2005825 - DNA, 14 bp, Homo sapiens
caatatgtattgta

SEQ ID NO: 2005826 - DNA, 16 bp, Homo sapiens
caatatgtattgtaaa

SEQ ID NO: 2005827 - DNA, 21 bp, Homo sapiens
caatatgtattgtaaacatgt

SEQ ID NO: 2005828 - DNA, 14 bp, Homo sapiens
caatattaaataca

SEQ ID NO: 2005829 - DNA, 20 bp, Homo sapiens
caatattaaatacagacact

SEQ ID NO: 2005830 - DNA, 23 bp, Homo sapiens
caatattaaatacagacactaag

SEQ ID NO: 2005831 - DNA, 14 bp, Homo sapiens
caatattcaataaa

SEQ ID NO: 2005832 - DNA, 15 bp, Homo sapiens
caatattcaataaag

SEQ ID NO: 2005833 - DNA, 13 bp, Homo sapiens
caatattcctgaa

SEQ ID NO: 2005834 - DNA, 20 bp, Homo sapiens
caatatttaagtttgttgct

SEQ ID NO: 2005835 - DNA, 15 bp, Homo sapiens
cagctcccaccccac

SEQ ID NO: 2005836 - DNA, 22 bp, Homo sapiens
cagctcccaccccacccccttc

SEQ ID NO: 2005837 - DNA, 19 bp, Homo sapiens
cagctcccatagcgctggc

SEQ ID NO: 2005838 - DNA, 11 bp, Homo sapiens
cagctccccag

SEQ ID NO: 2005839 - DNA, 12 bp, Homo sapiens
cagctccccagg

SEQ ID NO: 2005840 - DNA, 22 bp, Homo sapiens
cagctccccaggactcaccctc

SEQ ID NO: 2005841 - DNA, 16 bp, Homo sapiens
cagctcccctcggaga

SEQ ID NO: 2005842 - DNA, 17 bp, Homo sapiens
cagctcccctcggagaa

SEQ ID NO: 2005843 - DNA, 21 bp, Homo sapiens
cagctcccctcggagaagagc

SEQ ID NO: 2005844 - DNA, 18 bp, Homo sapiens
cagctccctagtggcttc

SEQ ID NO: 2005845 - DNA, 23 bp, Homo sapiens
cagctccctagtggcttcctccg

SEQ ID NO: 2005846 - DNA, 23 bp, Homo sapiens
cagctcctctccttgggctcctg

SEQ ID NO: 2005847 - DNA, 12 bp, Homo sapiens
cagctcctctgt

SEQ ID NO: 2005848 - DNA, 19 bp, Homo sapiens
cagctcctctgtctcgagc

SEQ ID NO: 2005849 - DNA, 16 bp, Homo sapiens
cagctcctgggcagct

SEQ ID NO: 2005850 - DNA, 19 bp, Homo sapiens
cagctcctgggcagcttga

SEQ ID NO: 2005851 - DNA, 12 bp, Homo sapiens
cagctctccctc

SEQ ID NO: 2005852 - DNA, 15 bp, Homo sapiens
cagctctccctctgg

SEQ ID NO: 2005853 - DNA, 16 bp, Homo sapiens
cagctctccctctggc

SEQ ID NO: 2005854 - DNA, 18 bp, Homo sapiens
cagctctccctctggccc

SEQ ID NO: 2005855 - DNA, 23 bp, Homo sapiens
cagctctccctctggccctgcct

SEQ ID NO: 2005856 - DNA, 16 bp, Homo sapiens
cagctctctctacccg

SEQ ID NO: 2005857 - DNA, 14 bp, Homo sapiens
cagctctgtcctgg

SEQ ID NO: 2005858 - DNA, 15 bp, Homo sapiens
cagctctgtggcctg

SEQ ID NO: 2005859 - DNA, 18 bp, Homo sapiens
cagctcttcactcagcca

SEQ ID NO: 2005860 - DNA, 14 bp, Homo sapiens
cagctcttctccag

SEQ ID NO: 2005861 - DNA, 19 bp, Homo sapiens
cagctcttctccaggctgt

SEQ ID NO: 2005862 - DNA, 16 bp, Homo sapiens
cagctctttcttcttt

SEQ ID NO: 2005863 - DNA, 19 bp, Homo sapiens
cagctgacacataatttga

SEQ ID NO: 2005864 - DNA, 20 bp, Homo sapiens
cagctgagagccctgctgtg

SEQ ID NO: 2005865 - DNA, 15 bp, Homo sapiens
cagctgagcagggcc

SEQ ID NO: 2005866 - DNA, 16 bp, Homo sapiens
cagctgagcagggccg

SEQ ID NO: 2005867 - DNA, 20 bp, Homo sapiens
cagctgagcagggccgggga

SEQ ID NO: 2005868 - DNA, 13 bp, Homo sapiens
cagctgaggctgg

SEQ ID NO: 2005869 - DNA, 20 bp, Homo sapiens
cagctgaggctgggggcggg

SEQ ID NO: 2005870 - DNA, 13 bp, Homo sapiens
cagctgagtgaga

SEQ ID NO: 2005871 - DNA, 19 bp, Homo sapiens
cagctgatattatggcaag

SEQ ID NO: 2005872 - DNA, 19 bp, Homo sapiens
cagctgattttgtcactgt

SEQ ID NO: 2005873 - DNA, 20 bp, Homo sapiens
cagctgcacctgccagcctg

SEQ ID NO: 2005874 - DNA, 21 bp, Homo sapiens
cagctgcacctgccagcctgg

SEQ ID NO: 2005875 - DNA, 16 bp, Homo sapiens
cagctgcagctgggcc

SEQ ID NO: 2005876 - DNA, 23 bp, Homo sapiens
cagctgcagctgggccccatgct

SEQ ID NO: 2005877 - DNA, 19 bp, Homo sapiens
cagctgcagtcaacagttc

SEQ ID NO: 2005878 - DNA, 12 bp, Homo sapiens
cagctgcctggg

SEQ ID NO: 2005879 - DNA, 19 bp, Homo sapiens
cagctgcgggtctgaagga

SEQ ID NO: 2005880 - DNA, 19 bp, Homo sapiens
cagctgcggtccacccagg

SEQ ID NO: 2005881 - DNA, 21 bp, Homo sapiens
cagctgcggtccacccaggag

SEQ ID NO: 2005882 - DNA, 24 bp, Homo sapiens
cagctgcggtccacccaggagccc

SEQ ID NO: 2005883 - DNA, 13 bp, Homo sapiens
cagctgctctgcc

SEQ ID NO: 2005884 - DNA, 14 bp, Homo sapiens
cagctgctctgccc

SEQ ID NO: 2005885 - DNA, 17 bp, Homo sapiens
cagctgctctgcccctt

SEQ ID NO: 2005886 - DNA, 16 bp, Homo sapiens
cagctgctcttagtgc

SEQ ID NO: 2005887 - DNA, 22 bp, Homo sapiens
cagctgctcttagtgcccgcct

SEQ ID NO: 2005888 - DNA, 21 bp, Homo sapiens
cagctgctgaaacaacaaata

SEQ ID NO: 2005889 - DNA, 21 bp, Homo sapiens
cagctgctgaagttctgagcc

SEQ ID NO: 2005890 - DNA, 13 bp, Homo sapiens
cagctgcttgtcc

SEQ ID NO: 2005891 - DNA, 23 bp, Homo sapiens
cagctgcttttgtctatgggact

SEQ ID NO: 2005892 - DNA, 22 bp, Homo sapiens
cagctggaattgctgctctctg

SEQ ID NO: 2005893 - DNA, 12 bp, Homo sapiens
cagctggcctct

SEQ ID NO: 2005894 - DNA, 14 bp, Homo sapiens
cagctggcctctag

SEQ ID NO: 2005895 - DNA, 15 bp, Homo sapiens
cagctggcctctaga

SEQ ID NO: 2005896 - DNA, 23 bp, Homo sapiens
cagctggcctctagaacacccac

SEQ ID NO: 2005897 - DNA, 11 bp, Homo sapiens
cagctggctgc

SEQ ID NO: 2005898 - DNA, 12 bp, Homo sapiens
cagctggctgct

SEQ ID NO: 2005899 - DNA, 15 bp, Homo sapiens
cagcttttaataaaa

SEQ ID NO: 2005900 - DNA, 17 bp, Homo sapiens
cagcttttaataaaatt

SEQ ID NO: 2005901 - DNA, 16 bp, Homo sapiens
cagctttttgtctttt

SEQ ID NO: 2005902 - DNA, 21 bp, Homo sapiens
caggaaaaaaaaaaaaaagac

SEQ ID NO: 2005903 - DNA, 18 bp, Homo sapiens
caggaaaaaaaataatgt

SEQ ID NO: 2005904 - DNA, 15 bp, Homo sapiens
caggaaaaggcctgg

SEQ ID NO: 2005905 - DNA, 17 bp, Homo sapiens
caggaaaaggcctgggg

SEQ ID NO: 2005906 - DNA, 18 bp, Homo sapiens
caggaaaaggcctggggt

SEQ ID NO: 2005907 - DNA, 21 bp, Homo sapiens
caggaaaaggcctggggtgac

SEQ ID NO: 2005908 - DNA, 15 bp, Homo sapiens
caggaaaccctggct

SEQ ID NO: 2005909 - DNA, 19 bp, Homo sapiens
caggaaaccctggcttgct

SEQ ID NO: 2005910 - DNA, 14 bp, Homo sapiens
caggaaagccctcc

SEQ ID NO: 2005911 - DNA, 15 bp, Homo sapiens
caggaaagccctccc

SEQ ID NO: 2005912 - DNA, 20 bp, Homo sapiens
caggaaagccctcccccttc

SEQ ID NO: 2005913 - DNA, 19 bp, Homo sapiens
caggaaagctcagctactg

SEQ ID NO: 2005914 - DNA, 21 bp, Homo sapiens
caggaaatcaaatatgcaaag

SEQ ID NO: 2005915 - DNA, 23 bp, Homo sapiens
caggaaatcaaatatgcaaagca

SEQ ID NO: 2005916 - DNA, 13 bp, Homo sapiens
caggaacagagac

SEQ ID NO: 2005917 - DNA, 18 bp, Homo sapiens
caggaacagagactctgg

SEQ ID NO: 2005918 - DNA, 20 bp, Homo sapiens
caggaacagagactctggaa

SEQ ID NO: 2005919 - DNA, 23 bp, Homo sapiens
caggaacagagactctggaagcc

SEQ ID NO: 2005920 - DNA, 13 bp, Homo sapiens
caggaacgagcac

SEQ ID NO: 2005921 - DNA, 16 bp, Homo sapiens
caggaacgagcactgg

SEQ ID NO: 2005922 - DNA, 16 bp, Homo sapiens
caggaactcccagcaa

SEQ ID NO: 2005923 - DNA, 17 bp, Homo sapiens
caggaactcccagcaac

SEQ ID NO: 2005924 - DNA, 13 bp, Homo sapiens
caggaactgggcc

SEQ ID NO: 2005925 - DNA, 18 bp, Homo sapiens
caggaagaaaccccaagc

SEQ ID NO: 2005926 - DNA, 19 bp, Homo sapiens
caggaagaaaccccaagca

SEQ ID NO: 2005927 - DNA, 14 bp, Homo sapiens
caggaagagaagga

SEQ ID NO: 2005928 - DNA, 15 bp, Homo sapiens
caggaagccaggctg

SEQ ID NO: 2005929 - DNA, 19 bp, Homo sapiens
caggaaggactatgaaaag

SEQ ID NO: 2005930 - DNA, 13 bp, Homo sapiens
caggaaggcagaa

SEQ ID NO: 2005931 - DNA, 16 bp, Homo sapiens
caggaaggcagctgct

SEQ ID NO: 2005932 - DNA, 19 bp, Homo sapiens
caggaaggcagctgctctt

SEQ ID NO: 2005933 - DNA, 18 bp, Homo sapiens
caggaatcaaaaattgaa

SEQ ID NO: 2005934 - DNA, 16 bp, Homo sapiens
caggaatctcagagac

SEQ ID NO: 2005935 - DNA, 17 bp, Homo sapiens
caggaatctcagagaca

SEQ ID NO: 2005936 - DNA, 18 bp, Homo sapiens
caggaatctcagagacag

SEQ ID NO: 2005937 - DNA, 15 bp, Homo sapiens
caggacacaggcctg

SEQ ID NO: 2005938 - DNA, 19 bp, Homo sapiens
caggacacaggcctgtgta

SEQ ID NO: 2005939 - DNA, 14 bp, Homo sapiens
caggacacctgccc

SEQ ID NO: 2005940 - DNA, 16 bp, Homo sapiens
caggacacctgcccca

SEQ ID NO: 2005941 - DNA, 18 bp, Homo sapiens
caggacacctggccgcct

SEQ ID NO: 2005942 - DNA, 15 bp, Homo sapiens
caggacacggggcag

SEQ ID NO: 2005943 - DNA, 13 bp, Homo sapiens
caggacagctggc

SEQ ID NO: 2005944 - DNA, 23 bp, Homo sapiens
caggacagctggctgctgacagg

SEQ ID NO: 2005945 - DNA, 16 bp, Homo sapiens
caggacagtgcttcag

SEQ ID NO: 2005946 - DNA, 12 bp, Homo sapiens
caggaccacaaa

SEQ ID NO: 2005947 - DNA, 13 bp, Homo sapiens
caggacccaggcc

SEQ ID NO: 2005948 - DNA, 16 bp, Homo sapiens
caggacccaggccctc

SEQ ID NO: 2005949 - DNA, 14 bp, Homo sapiens
caggacccaggccg

SEQ ID NO: 2005950 - DNA, 16 bp, Homo sapiens
caggaccccaacccct

SEQ ID NO: 2005951 - DNA, 19 bp, Homo sapiens
caggacctccggggagagc

SEQ ID NO: 2005952 - DNA, 17 bp, Homo sapiens
caggacgccactcattt

SEQ ID NO: 2005953 - DNA, 21 bp, Homo sapiens
caggacgccactcatttcatc

SEQ ID NO: 2005954 - DNA, 19 bp, Homo sapiens
caggactaacactcagaag

SEQ ID NO: 2005955 - DNA, 20 bp, Homo sapiens
caggactaacactcagaagc

SEQ ID NO: 2005956 - DNA, 23 bp, Homo sapiens
caggactaacactcagaagcctg

SEQ ID NO: 2005957 - DNA, 16 bp, Homo sapiens
caggactatagcccag

SEQ ID NO: 2005958 - DNA, 15 bp, Homo sapiens
caggactcaccctca

SEQ ID NO: 2005959 - DNA, 15 bp, Homo sapiens
caggacttaaaatga

SEQ ID NO: 2005960 - DNA, 19 bp, Homo sapiens
caggacttaacggctccag

SEQ ID NO: 2005961 - DNA, 20 bp, Homo sapiens
caggacttggtctgatttca

SEQ ID NO: 2005962 - DNA, 14 bp, Homo sapiens
caggagacaggaag

SEQ ID NO: 2005963 - DNA, 14 bp, Homo sapiens
caggagagagatct

SEQ ID NO: 2005964 - DNA, 15 bp, Homo sapiens
caggagagccagccc

SEQ ID NO: 2005965 - DNA, 19 bp, Homo sapiens
caggagagccagccctccc

SEQ ID NO: 2005966 - DNA, 12 bp, Homo sapiens
caggagagggaa

SEQ ID NO: 2005967 - DNA, 17 bp, Homo sapiens
caggagatcgagaccat

SEQ ID NO: 2005968 - DNA, 20 bp, Homo sapiens
caggtggcctagcaggcaca

SEQ ID NO: 2005969 - DNA, 14 bp, Homo sapiens
caggtggctgaccc

SEQ ID NO: 2005970 - DNA, 15 bp, Homo sapiens
caggtggctgaccca

SEQ ID NO: 2005971 - DNA, 20 bp, Homo sapiens
caggtggctgacccagtccc

SEQ ID NO: 2005972 - DNA, 17 bp, Homo sapiens
caggtggggcagcttga

SEQ ID NO: 2005973 - DNA, 12 bp, Homo sapiens
caggtgtaaata

SEQ ID NO: 2005974 - DNA, 21 bp, Homo sapiens
caggtgtactatggctgtatt

SEQ ID NO: 2005975 - DNA, 12 bp, Homo sapiens
caggtgtgaacc

SEQ ID NO: 2005976 - DNA, 16 bp, Homo sapiens
caggtgtgagtcacca

SEQ ID NO: 2005977 - DNA, 17 bp, Homo sapiens
caggtgtggtggctcat

SEQ ID NO: 2005978 - DNA, 19 bp, Homo sapiens
caggtgtggtggctcatgg

SEQ ID NO: 2005979 - DNA, 20 bp, Homo sapiens
caggtgtggtgtaatttata

SEQ ID NO: 2005980 - DNA, 16 bp, Homo sapiens
caggtgtttagttgca

SEQ ID NO: 2005981 - DNA, 16 bp, Homo sapiens
caggttaggaaggcag

SEQ ID NO: 2005982 - DNA, 16 bp, Homo sapiens
caggttatgcctcatg

SEQ ID NO: 2005983 - DNA, 15 bp, Homo sapiens
caggttcccagcagc

SEQ ID NO: 2005984 - DNA, 22 bp, Homo sapiens
caggttcccagcagctgggccg

SEQ ID NO: 2005985 - DNA, 21 bp, Homo sapiens
caggttctgcgttacaacagt

SEQ ID NO: 2005986 - DNA, 18 bp, Homo sapiens
caggttcttgatgtcatg

SEQ ID NO: 2005987 - DNA, 15 bp, Homo sapiens
caggttgaccgggac

SEQ ID NO: 2005988 - DNA, 15 bp, Homo sapiens
caggttgttctgtat

SEQ ID NO: 2005989 - DNA, 14 bp, Homo sapiens
caggtttgccagtg

SEQ ID NO: 2005990 - DNA, 15 bp, Homo sapiens
caggtttgccagtga

SEQ ID NO: 2005991 - DNA, 21 bp, Homo sapiens
caggtttgccagtgaagactt

SEQ ID NO: 2005992 - DNA, 21 bp, Homo sapiens
caggtttggggagggggaaga

SEQ ID NO: 2005993 - DNA, 21 bp, Homo sapiens
caggttttcaccatagcctac

SEQ ID NO: 2005994 - DNA, 19 bp, Homo sapiens
cagtaaaaaaaaaaaatgg

SEQ ID NO: 2005995 - DNA, 21 bp, Homo sapiens
cagtaaagtttaaaaaataca

SEQ ID NO: 2005996 - DNA, 15 bp, Homo sapiens
cagtaaataaattgt

SEQ ID NO: 2005997 - DNA, 16 bp, Homo sapiens
cagtaaataaattgtt

SEQ ID NO: 2005998 - DNA, 14 bp, Homo sapiens
cagtaaatccacag

SEQ ID NO: 2005999 - DNA, 17 bp, Homo sapiens
cagtaaatccacagcca

SEQ ID NO: 2006000 - DNA, 14 bp, Homo sapiens
cagtaagtcttttt

SEQ ID NO: 2006001 - DNA, 23 bp, Homo sapiens
cagtacagagaaattctgtggtg

SEQ ID NO: 2006002 - DNA, 23 bp, Homo sapiens
cagtacctgggaaaggacccacc

SEQ ID NO: 2006003 - DNA, 15 bp, Homo sapiens
cagtactatgtaaat

SEQ ID NO: 2006004 - DNA, 17 bp, Homo sapiens
cagtactcagtatagca

SEQ ID NO: 2006005 - DNA, 14 bp, Homo sapiens
cagtacttctaaga

SEQ ID NO: 2006006 - DNA, 19 bp, Homo sapiens
cagtagacaatccccacat

SEQ ID NO: 2006007 - DNA, 16 bp, Homo sapiens
cagtagaggcatgaac

SEQ ID NO: 2006008 - DNA, 15 bp, Homo sapiens
cagtagcttaaataa

SEQ ID NO: 2006009 - DNA, 19 bp, Homo sapiens
cagtagcttaaataaattc

SEQ ID NO: 2006010 - DNA, 16 bp, Homo sapiens
cagtaggagcaagaga

SEQ ID NO: 2006011 - DNA, 18 bp, Homo sapiens
cagtaggctttatgctgt

SEQ ID NO: 2006012 - DNA, 18 bp, Homo sapiens
cagtaggtccaagggcca

SEQ ID NO: 2006013 - DNA, 16 bp, Homo sapiens
cagtagtcgtcaagtt

SEQ ID NO: 2006014 - DNA, 20 bp, Homo sapiens
cagtagtttgagaccagcct

SEQ ID NO: 2006015 - DNA, 15 bp, Homo sapiens
cagtatatttatagt

SEQ ID NO: 2006016 - DNA, 22 bp, Homo sapiens
cagtatatttatagtcacaaga

SEQ ID NO: 2006017 - DNA, 18 bp, Homo sapiens
cagtatatttgaaactgt

SEQ ID NO: 2006018 - DNA, 19 bp, Homo sapiens
cagtatgggaaccccaaat

SEQ ID NO: 2006019 - DNA, 13 bp, Homo sapiens
cagtattcttgtc

SEQ ID NO: 2006020 - DNA, 16 bp, Homo sapiens
cagtattcttgtcaaa

SEQ ID NO: 2006021 - DNA, 19 bp, Homo sapiens
cagtattgccacaatgcct

SEQ ID NO: 2006022 - DNA, 12 bp, Homo sapiens
cagtattttatt

SEQ ID NO: 2006023 - DNA, 17 bp, Homo sapiens
cagtattttattaaagc

SEQ ID NO: 2006024 - DNA, 19 bp, Homo sapiens
cagtattttattaaagcaa

SEQ ID NO: 2006025 - DNA, 14 bp, Homo sapiens
cagtattttggaga

SEQ ID NO: 2006026 - DNA, 18 bp, Homo sapiens
cagtattttggagaaatt

SEQ ID NO: 2006027 - DNA, 20 bp, Homo sapiens
cagtcaacagttcaaagaag

SEQ ID NO: 2006028 - DNA, 15 bp, Homo sapiens
cagtcacccttctgg

SEQ ID NO: 2006029 - DNA, 16 bp, Homo sapiens
cagtcacccttctggg

SEQ ID NO: 2006030 - DNA, 17 bp, Homo sapiens
cagtcagttcccggagc

SEQ ID NO: 2006031 - DNA, 12 bp, Homo sapiens
cagtcatttaaa

SEQ ID NO: 2006032 - DNA, 14 bp, Homo sapiens
cagtccagaataag

SEQ ID NO: 2006033 - DNA, 22 bp, Homo sapiens
cagtccagatgccttcctgtct

SEQ ID NO: 2006034 - DNA, 17 bp, Homo sapiens
cagtccagccagctcct

SEQ ID NO: 2006035 - DNA, 14 bp, Homo sapiens
cagtccccagccct

SEQ ID NO: 2006036 - DNA, 11 bp, Homo sapiens
cagtccccagt

SEQ ID NO: 2006037 - DNA, 14 bp, Homo sapiens
cagtccctaaagaa

SEQ ID NO: 2006038 - DNA, 12 bp, Homo sapiens
cagtccctgggg

SEQ ID NO: 2006039 - DNA, 19 bp, Homo sapiens
cagtccgccaaacactcca

SEQ ID NO: 2006040 - DNA, 21 bp, Homo sapiens
cagtccgcctggccggctcca

SEQ ID NO: 2006041 - DNA, 13 bp, Homo sapiens
cagtcctagagct

SEQ ID NO: 2006042 - DNA, 20 bp, Homo sapiens
cagtcctagagctcctgtcc

SEQ ID NO: 2006043 - DNA, 22 bp, Homo sapiens
cagtcctcacagcctctccctt

SEQ ID NO: 2006044 - DNA, 23 bp, Homo sapiens
cagtcctggaagccggccggctg

SEQ ID NO: 2006045 - DNA, 12 bp, Homo sapiens
cagtcctggcca

SEQ ID NO: 2006046 - DNA, 19 bp, Homo sapiens
cagtcctggtctgctcagg

SEQ ID NO: 2006047 - DNA, 21 bp, Homo sapiens
cagtcgcaggatccgctgcca

SEQ ID NO: 2006048 - DNA, 22 bp, Homo sapiens
cagtcgcaggatccgctgccac

SEQ ID NO: 2006049 - DNA, 23 bp, Homo sapiens
cagtcgcaggatccgctgccacc

SEQ ID NO: 2006050 - DNA, 16 bp, Homo sapiens
cagtcgtaagggttgc

SEQ ID NO: 2006051 - DNA, 18 bp, Homo sapiens
cagtctcaggagcatggg

SEQ ID NO: 2006052 - DNA, 13 bp, Homo sapiens
cagtctcagtcca

SEQ ID NO: 2006053 - DNA, 14 bp, Homo sapiens
cagtctcctgacat

SEQ ID NO: 2006054 - DNA, 15 bp, Homo sapiens
cagtctcctgacatt

SEQ ID NO: 2006055 - DNA, 17 bp, Homo sapiens
cagtctcctgacattaa

SEQ ID NO: 2006056 - DNA, 19 bp, Homo sapiens
cagtctctttaatcttcag

SEQ ID NO: 2006057 - DNA, 22 bp, Homo sapiens
cagtctgaacccttgtgcttgg

SEQ ID NO: 2006058 - DNA, 21 bp, Homo sapiens
cagtctgggtaacagggagac

SEQ ID NO: 2006059 - DNA, 23 bp, Homo sapiens
cagtctgggtctgggtttggatc

SEQ ID NO: 2006060 - DNA, 13 bp, Homo sapiens
cagtgagacacag

SEQ ID NO: 2006061 - DNA, 19 bp, Homo sapiens
cagtgagccgcatcttctc

SEQ ID NO: 2006062 - DNA, 19 bp, Homo sapiens
cagtgaggaaatggcaaca

SEQ ID NO: 2006063 - DNA, 14 bp, Homo sapiens
cagtgaggagggtg

SEQ ID NO: 2006064 - DNA, 15 bp, Homo sapiens
cagtgaggagggtgg

SEQ ID NO: 2006065 - DNA, 19 bp, Homo sapiens
cagtgagtcctcctcttcc

SEQ ID NO: 2006066 - DNA, 17 bp, Homo sapiens
cagtgagtcgaggacag

SEQ ID NO: 2006067 - DNA, 18 bp, Homo sapiens
cagtgagtcgaggacagg

SEQ ID NO: 2006068 - DNA, 20 bp, Homo sapiens
cagtgagtcgaggacaggga

SEQ ID NO: 2006069 - DNA, 15 bp, Homo sapiens
cagtgagtctcttca

SEQ ID NO: 2006070 - DNA, 18 bp, Homo sapiens
cagtgagttacagcgaga

SEQ ID NO: 2006071 - DNA, 23 bp, Homo sapiens
cagtgagttacagcgagaggcag

SEQ ID NO: 2006072 - DNA, 18 bp, Homo sapiens
cagtgatacgtacagcca

SEQ ID NO: 2006073 - DNA, 17 bp, Homo sapiens
cagtgatgggagagtag

SEQ ID NO: 2006074 - DNA, 24 bp, Homo sapiens
cagtgcaagagactctggcctcca

SEQ ID NO: 2006075 - DNA, 21 bp, Homo sapiens
cagtgcatccttgaactgtca

SEQ ID NO: 2006076 - DNA, 17 bp, Homo sapiens
cagtgcatctcagccca

SEQ ID NO: 2006077 - DNA, 11 bp, Homo sapiens
cagtgccacag

SEQ ID NO: 2006078 - DNA, 14 bp, Homo sapiens
cagtgccacagaga

SEQ ID NO: 2006079 - DNA, 15 bp, Homo sapiens
cagtgccacagagaa

SEQ ID NO: 2006080 - DNA, 20 bp, Homo sapiens
cagtgccacttgacattcct

SEQ ID NO: 2006081 - DNA, 12 bp, Homo sapiens
cagtgccaggac

SEQ ID NO: 2006082 - DNA, 13 bp, Homo sapiens
cagtgccaggaca

SEQ ID NO: 2006083 - DNA, 15 bp, Homo sapiens
cagtgccaggacagc

SEQ ID NO: 2006084 - DNA, 21 bp, Homo sapiens
cagtgccaggacagctggctg

SEQ ID NO: 2006085 - DNA, 23 bp, Homo sapiens
cagtgccaggacagctggctgct

SEQ ID NO: 2006086 - DNA, 13 bp, Homo sapiens
cagtgcccacagg

SEQ ID NO: 2006087 - DNA, 18 bp, Homo sapiens
cagtgcccacaggatcag

SEQ ID NO: 2006088 - DNA, 21 bp, Homo sapiens
cagtgcccacaggatcagtct

SEQ ID NO: 2006089 - DNA, 15 bp, Homo sapiens
cagtgcccagctaat

SEQ ID NO: 2006090 - DNA, 14 bp, Homo sapiens
cagtgcccatgcaa

SEQ ID NO: 2006091 - DNA, 19 bp, Homo sapiens
cagtgccctcattttatgt

SEQ ID NO: 2006092 - DNA, 16 bp, Homo sapiens
cagtgccgcctgtgcc

SEQ ID NO: 2006093 - DNA, 13 bp, Homo sapiens
cagtgcctcctgg

SEQ ID NO: 2006094 - DNA, 11 bp, Homo sapiens
cagtgcctgct

SEQ ID NO: 2006095 - DNA, 12 bp, Homo sapiens
cagtgcctgctg

SEQ ID NO: 2006096 - DNA, 13 bp, Homo sapiens
cagtgcctgctga

SEQ ID NO: 2006097 - DNA, 20 bp, Homo sapiens
cagtgccttacctcctgccc

SEQ ID NO: 2006098 - DNA, 22 bp, Homo sapiens
cagtgccttacctcctgcccag

SEQ ID NO: 2006099 - DNA, 17 bp, Homo sapiens
cagtgccttccataatt

SEQ ID NO: 2006100 - DNA, 12 bp, Homo sapiens
cagtgccttgga

SEQ ID NO: 2006101 - DNA, 13 bp, Homo sapiens
cagtgccttggag

SEQ ID NO: 2006102 - DNA, 12 bp, Homo sapiens
cagtgctcggca

SEQ ID NO: 2006103 - DNA, 22 bp, Homo sapiens
cagtgctctcctaccccacctc

SEQ ID NO: 2006104 - DNA, 18 bp, Homo sapiens
cagtgctgccatgccact

SEQ ID NO: 2006105 - DNA, 23 bp, Homo sapiens
cagtgctgccatgccactgccag

SEQ ID NO: 2006106 - DNA, 13 bp, Homo sapiens
cagtgctgccctg

SEQ ID NO: 2006107 - DNA, 14 bp, Homo sapiens
cagtgctgccctgc

SEQ ID NO: 2006108 - DNA, 15 bp, Homo sapiens
cagtgctgtggcctg

SEQ ID NO: 2006109 - DNA, 19 bp, Homo sapiens
cagtgctgtggcctgggca

SEQ ID NO: 2006110 - DNA, 20 bp, Homo sapiens
cagtgctgtggcctgggcaa

SEQ ID NO: 2006111 - DNA, 18 bp, Homo sapiens
cagtgcttcagcctgagg

SEQ ID NO: 2006112 - DNA, 19 bp, Homo sapiens
cagtgcttgattgcgtgga

SEQ ID NO: 2006113 - DNA, 17 bp, Homo sapiens
cagtggagaaatattta

SEQ ID NO: 2006114 - DNA, 16 bp, Homo sapiens
cagtggagagtgttcc

SEQ ID NO: 2006115 - DNA, 23 bp, Homo sapiens
cagtggcacggagagaaggccca

SEQ ID NO: 2006116 - DNA, 12 bp, Homo sapiens
cagtggcagctg

SEQ ID NO: 2006117 - DNA, 13 bp, Homo sapiens
cagtggcagctgc

SEQ ID NO: 2006118 - DNA, 15 bp, Homo sapiens
cagtggcagctgctt

SEQ ID NO: 2006119 - DNA, 19 bp, Homo sapiens
cagtggccgcaagcgcagg

SEQ ID NO: 2006120 - DNA, 15 bp, Homo sapiens
cagtggcgagaggag

SEQ ID NO: 2006121 - DNA, 20 bp, Homo sapiens
cagtggctcgctccctgtag

SEQ ID NO: 2006122 - DNA, 22 bp, Homo sapiens
cagtgggaacgtgactgcccca

SEQ ID NO: 2006123 - DNA, 22 bp, Homo sapiens
cagtgggaactctgacaagggc

SEQ ID NO: 2006124 - DNA, 18 bp, Homo sapiens
cagtgggagctgcctgtt

SEQ ID NO: 2006125 - DNA, 20 bp, Homo sapiens
cagtgggagctgcctgttca

SEQ ID NO: 2006126 - DNA, 23 bp, Homo sapiens
cagtgggagctgcctgttcagct

SEQ ID NO: 2006127 - DNA, 17 bp, Homo sapiens
cagtgggtggcacctcc

SEQ ID NO: 2006128 - DNA, 20 bp, Homo sapiens
cagtgggtgggagctccttt

SEQ ID NO: 2006129 - DNA, 14 bp, Homo sapiens
cagtggtaccagct

SEQ ID NO: 2006130 - DNA, 15 bp, Homo sapiens
cagtggtaccagctc

SEQ ID NO: 2006131 - DNA, 17 bp, Homo sapiens
cagtggtaccagctcac

SEQ ID NO: 2006132 - DNA, 18 bp, Homo sapiens
cagtggtaccagctcact

SEQ ID NO: 2006133 - DNA, 17 bp, Homo sapiens
cagtggtgaagaaaact

SEQ ID NO: 2006134 - DNA, 13 bp, Homo sapiens
cagtgtactgctt

SEQ ID NO: 2006135 - DNA, 17 bp, Homo sapiens
cagtgtatggaaataaa

SEQ ID NO: 2006136 - DNA, 17 bp, Homo sapiens
cagtgtcccctccactg

SEQ ID NO: 2006137 - DNA, 19 bp, Homo sapiens
cagtgtcccctccactgtc

SEQ ID NO: 2006138 - DNA, 20 bp, Homo sapiens
cagtgtccttggcaggctga

SEQ ID NO: 2006139 - DNA, 13 bp, Homo sapiens
cagtgtcttccat

SEQ ID NO: 2006140 - DNA, 14 bp, Homo sapiens
cagtgtcttccata

SEQ ID NO: 2006141 - DNA, 14 bp, Homo sapiens
cagtgtgacaagga

SEQ ID NO: 2006142 - DNA, 18 bp, Homo sapiens
cagtgtgatcccaagtgc

SEQ ID NO: 2006143 - DNA, 14 bp, Homo sapiens
cagtgtgcacccct

SEQ ID NO: 2006144 - DNA, 18 bp, Homo sapiens
cagtgtgcgttggaatca

SEQ ID NO: 2006145 - DNA, 11 bp, Homo sapiens
cagtgtgtgtg

SEQ ID NO: 2006146 - DNA, 20 bp, Homo sapiens
cagtgttacttttaattcct

SEQ ID NO: 2006147 - DNA, 19 bp, Homo sapiens
cagtgttcctcaccaataa

SEQ ID NO: 2006148 - DNA, 14 bp, Homo sapiens
cagtgttggctgtg

SEQ ID NO: 2006149 - DNA, 23 bp, Homo sapiens
cagtgttggctgtgtgacagaat

SEQ ID NO: 2006150 - DNA, 18 bp, Homo sapiens
cagtgtttagaagagcct

SEQ ID NO: 2006151 - DNA, 20 bp, Homo sapiens
cagtgtttagaagagcctga

SEQ ID NO: 2006152 - DNA, 22 bp, Homo sapiens
cagtgtttagaagagcctgact

SEQ ID NO: 2006153 - DNA, 23 bp, Homo sapiens
cagtgtttagaagagcctgactg

SEQ ID NO: 2006154 - DNA, 15 bp, Homo sapiens
cagtgtttcccataa

SEQ ID NO: 2006155 - DNA, 18 bp, Homo sapiens
cagtgtttcccataattt

SEQ ID NO: 2006156 - DNA, 20 bp, Homo sapiens
cagtgtttcccataattttc

SEQ ID NO: 2006157 - DNA, 22 bp, Homo sapiens
cagtgttttttcactttagcta

SEQ ID NO: 2006158 - DNA, 20 bp, Homo sapiens
cagttaaggaccgtggccct

SEQ ID NO: 2006159 - DNA, 23 bp, Homo sapiens
ccaaagccccttgctctcccctg

SEQ ID NO: 2006160 - DNA, 21 bp, Homo sapiens
ccaaagctaggcctggccaga

SEQ ID NO: 2006161 - DNA, 12 bp, Homo sapiens
ccaaaggaatcg

SEQ ID NO: 2006162 - DNA, 20 bp, Homo sapiens
ccaaaggacattatgtgtgc

SEQ ID NO: 2006163 - DNA, 14 bp, Homo sapiens
ccaaaggctccctg

SEQ ID NO: 2006164 - DNA, 14 bp, Homo sapiens
ccaaaggggctgct

SEQ ID NO: 2006165 - DNA, 17 bp, Homo sapiens
ccaaaggggctgctggg

SEQ ID NO: 2006166 - DNA, 16 bp, Homo sapiens
ccaaagtcttaaaata

SEQ ID NO: 2006167 - DNA, 15 bp, Homo sapiens
ccaaagtgcagccct

SEQ ID NO: 2006168 - DNA, 20 bp, Homo sapiens
ccaaagttttgaagtcatct

SEQ ID NO: 2006169 - DNA, 16 bp, Homo sapiens
ccaaataaatgtgtaa

SEQ ID NO: 2006170 - DNA, 21 bp, Homo sapiens
ccaaatattattcaagtgcct

SEQ ID NO: 2006171 - DNA, 11 bp, Homo sapiens
ccaaatatttt

SEQ ID NO: 2006172 - DNA, 17 bp, Homo sapiens
ccaaatccacaagccat

SEQ ID NO: 2006173 - DNA, 21 bp, Homo sapiens
ccaaatgcacaagctcagaat

SEQ ID NO: 2006174 - DNA, 22 bp, Homo sapiens
ccaaatgcatggtgcagttgac

SEQ ID NO: 2006175 - DNA, 18 bp, Homo sapiens
ccaaatgtaattgaataa

SEQ ID NO: 2006176 - DNA, 17 bp, Homo sapiens
ccaaatgtccaatataa

SEQ ID NO: 2006177 - DNA, 22 bp, Homo sapiens
ccaaattgctcctaagcttcaa

SEQ ID NO: 2006178 - DNA, 16 bp, Homo sapiens
ccaaattgcttctagg

SEQ ID NO: 2006179 - DNA, 15 bp, Homo sapiens
ccaacaaacctgctt

SEQ ID NO: 2006180 - DNA, 18 bp, Homo sapiens
ccaacaactccaggaaaa

SEQ ID NO: 2006181 - DNA, 17 bp, Homo sapiens
ccaacaataaagagctc

SEQ ID NO: 2006182 - DNA, 21 bp, Homo sapiens
ccaacaatggggtgggcccat

SEQ ID NO: 2006183 - DNA, 17 bp, Homo sapiens
ccaacacaatctttcct

SEQ ID NO: 2006184 - DNA, 20 bp, Homo sapiens
ccaacacccaaagcatggac

SEQ ID NO: 2006185 - DNA, 22 bp, Homo sapiens
ccaacacccaaagcatggacta

SEQ ID NO: 2006186 - DNA, 14 bp, Homo sapiens
ccaacacgagcagg

SEQ ID NO: 2006187 - DNA, 11 bp, Homo sapiens
ccaacagcagc

SEQ ID NO: 2006188 - DNA, 14 bp, Homo sapiens
ccaacagcttgacc

SEQ ID NO: 2006189 - DNA, 21 bp, Homo sapiens
ccaacagcttgaccagaccta

SEQ ID NO: 2006190 - DNA, 20 bp, Homo sapiens
ccaacagcttttcccaggag

SEQ ID NO: 2006191 - DNA, 22 bp, Homo sapiens
ccaacaggctgttctgcactga

SEQ ID NO: 2006192 - DNA, 12 bp, Homo sapiens
ccaacagtgagt

SEQ ID NO: 2006193 - DNA, 23 bp, Homo sapiens
ccaacatggagaaaccctgtctc

SEQ ID NO: 2006194 - DNA, 17 bp, Homo sapiens
ccaacatttaatgagca

SEQ ID NO: 2006195 - DNA, 23 bp, Homo sapiens
ccaacccaattcaggactggctc

SEQ ID NO: 2006196 - DNA, 14 bp, Homo sapiens
ccaaccccagggcc

SEQ ID NO: 2006197 - DNA, 18 bp, Homo sapiens
ccaacccgtggaggctgc

SEQ ID NO: 2006198 - DNA, 15 bp, Homo sapiens
ccaaccctcagagcc

SEQ ID NO: 2006199 - DNA, 18 bp, Homo sapiens
ccaacctaacccctttcc

SEQ ID NO: 2006200 - DNA, 23 bp, Homo sapiens
ccaacctcaatgccctgccatta

SEQ ID NO: 2006201 - DNA, 20 bp, Homo sapiens
ccaacctccccgcagagctc

SEQ ID NO: 2006202 - DNA, 14 bp, Homo sapiens
ccaacctcctgacc

SEQ ID NO: 2006203 - DNA, 16 bp, Homo sapiens
ccaacctgaccaacat

SEQ ID NO: 2006204 - DNA, 22 bp, Homo sapiens
ccaacctgaccaacatggagaa

SEQ ID NO: 2006205 - DNA, 14 bp, Homo sapiens
ccaacctggacaac

SEQ ID NO: 2006206 - DNA, 18 bp, Homo sapiens
ccaactattaaagtgcca

SEQ ID NO: 2006207 - DNA, 22 bp, Homo sapiens
ccaactcctggaagctgtgtcc

SEQ ID NO: 2006208 - DNA, 20 bp, Homo sapiens
ccaactctgcactccatggc

SEQ ID NO: 2006209 - DNA, 16 bp, Homo sapiens
ccaactggcttctgtg

SEQ ID NO: 2006210 - DNA, 17 bp, Homo sapiens
ccaactggcttctgtgc

SEQ ID NO: 2006211 - DNA, 13 bp, Homo sapiens
ccaacttcccagt

SEQ ID NO: 2006212 - DNA, 13 bp, Homo sapiens
ccaactttctgta

SEQ ID NO: 2006213 - DNA, 14 bp, Homo sapiens
ccaagaaaaagaaa

SEQ ID NO: 2006214 - DNA, 17 bp, Homo sapiens
ccaagaaaaagaaaaaa

SEQ ID NO: 2006215 - DNA, 20 bp, Homo sapiens
ccaagaaaaggcatggagac

SEQ ID NO: 2006216 - DNA, 14 bp, Homo sapiens
ccaagaacattatc

SEQ ID NO: 2006217 - DNA, 20 bp, Homo sapiens
ccaagaatagatgctgactg

SEQ ID NO: 2006218 - DNA, 15 bp, Homo sapiens
ccaagagagaaagaa

SEQ ID NO: 2006219 - DNA, 12 bp, Homo sapiens
ccaagagagaca

SEQ ID NO: 2006220 - DNA, 17 bp, Homo sapiens
ccaagagcatcatgcct

SEQ ID NO: 2006221 - DNA, 22 bp, Homo sapiens
ccaagagctacgtatttaatag

SEQ ID NO: 2006222 - DNA, 17 bp, Homo sapiens
ccaagaggactgagact

SEQ ID NO: 2006223 - DNA, 18 bp, Homo sapiens
ccaagaggactgagactg

SEQ ID NO: 2006224 - DNA, 12 bp, Homo sapiens
ccaagaggtggg

SEQ ID NO: 2006225 - DNA, 13 bp, Homo sapiens
ccaagaggtgggg

SEQ ID NO: 2006226 - DNA, 22 bp, Homo sapiens
ccaagagttctttaggtgcctc

SEQ ID NO: 2006227 - DNA, 24 bp, Homo sapiens
ccaagatgggcacatgaggagggt

SEQ ID NO: 2006228 - DNA, 21 bp, Homo sapiens
ccaagattggcctgaggctgc

SEQ ID NO: 2006229 - DNA, 20 bp, Homo sapiens
ccaagcaaaggtgaagagac

SEQ ID NO: 2006230 - DNA, 18 bp, Homo sapiens
ccaagcagcattcagcac

SEQ ID NO: 2006231 - DNA, 21 bp, Homo sapiens
ccaagcagcattcagcacacc

SEQ ID NO: 2006232 - DNA, 14 bp, Homo sapiens
ccaagccgtggctt

SEQ ID NO: 2006233 - DNA, 21 bp, Homo sapiens
ccaagccgtggcttcccgctc

SEQ ID NO: 2006234 - DNA, 20 bp, Homo sapiens
ccaagcctctgccccaaggg

SEQ ID NO: 2006235 - DNA, 13 bp, Homo sapiens
ccaagcctggtct

SEQ ID NO: 2006236 - DNA, 18 bp, Homo sapiens
ccaagctcacagttcctc

SEQ ID NO: 2006237 - DNA, 12 bp, Homo sapiens
ccaagctctgct

SEQ ID NO: 2006238 - DNA, 13 bp, Homo sapiens
ccaagctctgctc

SEQ ID NO: 2006239 - DNA, 23 bp, Homo sapiens
ccaagctgaagtgaaggagaaag

SEQ ID NO: 2006240 - DNA, 13 bp, Homo sapiens
ccaagctgaggtg

SEQ ID NO: 2006241 - DNA, 22 bp, Homo sapiens
ccaagctgaggtgcccaggaga

SEQ ID NO: 2006242 - DNA, 15 bp, Homo sapiens
ccaagctggcagctg

SEQ ID NO: 2006243 - DNA, 20 bp, Homo sapiens
ccaagctggtcccactcagt

SEQ ID NO: 2006244 - DNA, 18 bp, Homo sapiens
ccaagctgttttcttcta

SEQ ID NO: 2006245 - DNA, 15 bp, Homo sapiens
ccaagcttcaaccct

SEQ ID NO: 2006246 - DNA, 22 bp, Homo sapiens
ccaagcttcaaccctcagcctt

SEQ ID NO: 2006247 - DNA, 16 bp, Homo sapiens
ccaagcttcagagcct

SEQ ID NO: 2006248 - DNA, 19 bp, Homo sapiens
ccaagcttgtgagagctgg

SEQ ID NO: 2006249 - DNA, 23 bp, Homo sapiens
ccaagcttgtgagagctggttgc

SEQ ID NO: 2006250 - DNA, 23 bp, Homo sapiens
ccaagctttcttctacaaccaga

SEQ ID NO: 2006251 - DNA, 23 bp, Homo sapiens
ccaagctttgaatacccccagag

SEQ ID NO: 2006252 - DNA, 13 bp, Homo sapiens
ccaaggactttcc

SEQ ID NO: 2006253 - DNA, 14 bp, Homo sapiens
ccaaggagaaacag

SEQ ID NO: 2006254 - DNA, 22 bp, Homo sapiens
ccaaggagctgatttccaggcc

SEQ ID NO: 2006255 - DNA, 17 bp, Homo sapiens
ccaaggcagcctccaga

SEQ ID NO: 2006256 - DNA, 14 bp, Homo sapiens
ccaaggcccagcta

SEQ ID NO: 2006257 - DNA, 16 bp, Homo sapiens
ccaaggctctgagcaa

SEQ ID NO: 2006258 - DNA, 15 bp, Homo sapiens
ccaaggggcccacaa

SEQ ID NO: 2006259 - DNA, 17 bp, Homo sapiens
ccaaggggcccacaaag

SEQ ID NO: 2006260 - DNA, 22 bp, Homo sapiens
ccaaggggcccacaaaggggag

SEQ ID NO: 2006261 - DNA, 22 bp, Homo sapiens
ccaagggttgaattctggagga

SEQ ID NO: 2006262 - DNA, 17 bp, Homo sapiens
ccaaggtcttcagccat

SEQ ID NO: 2006263 - DNA, 21 bp, Homo sapiens
ccaaggttactcagcagcaga

SEQ ID NO: 2006264 - DNA, 16 bp, Homo sapiens
ccaagtaatataatgg

SEQ ID NO: 2006265 - DNA, 20 bp, Homo sapiens
ccaagtattttatctgtgtt

SEQ ID NO: 2006266 - DNA, 19 bp, Homo sapiens
ccaagtcaacactcttctt

SEQ ID NO: 2006267 - DNA, 20 bp, Homo sapiens
ccaagtcaacactcttcttg

SEQ ID NO: 2006268 - DNA, 20 bp, Homo sapiens
ccaagtccaacctgcctgtg

SEQ ID NO: 2006269 - DNA, 16 bp, Homo sapiens
ccaagtccacctgcct

SEQ ID NO: 2006270 - DNA, 19 bp, Homo sapiens
ccaagtccaggtcctggtg

SEQ ID NO: 2006271 - DNA, 21 bp, Homo sapiens
ccaagtggtgggaatcagatc

SEQ ID NO: 2006272 - DNA, 20 bp, Homo sapiens
ccaagttataaatcaatgtc

SEQ ID NO: 2006273 - DNA, 22 bp, Homo sapiens
ccaagttataaatcaatgtcac

SEQ ID NO: 2006274 - DNA, 20 bp, Homo sapiens
ccaagttcctgcactccaga

SEQ ID NO: 2006275 - DNA, 15 bp, Homo sapiens
catccatctgtggaa

SEQ ID NO: 2006276 - DNA, 19 bp, Homo sapiens
catccatttcatctatttc

SEQ ID NO: 2006277 - DNA, 13 bp, Homo sapiens
catcccacagtgg

SEQ ID NO: 2006278 - DNA, 21 bp, Homo sapiens
catcccacattcggaccctgc

SEQ ID NO: 2006279 - DNA, 22 bp, Homo sapiens
catcccacattcggaccctgcc

SEQ ID NO: 2006280 - DNA, 13 bp, Homo sapiens
catcccagcccca

SEQ ID NO: 2006281 - DNA, 16 bp, Homo sapiens
catcccagccccaatt

SEQ ID NO: 2006282 - DNA, 18 bp, Homo sapiens
catcttggtcctgtcacc

SEQ ID NO: 2006283 - DNA, 16 bp, Homo sapiens
catctttcttctattt

SEQ ID NO: 2006284 - DNA, 14 bp, Homo sapiens
catctttctttgga

SEQ ID NO: 2006285 - DNA, 14 bp, Homo sapiens
catcttttaatatg

SEQ ID NO: 2006286 - DNA, 20 bp, Homo sapiens
catcttttaatatgctgtgg

SEQ ID NO: 2006287 - DNA, 13 bp, Homo sapiens
catcttttctaat

SEQ ID NO: 2006288 - DNA, 14 bp, Homo sapiens
catcttttgtgaga

SEQ ID NO: 2006289 - DNA, 21 bp, Homo sapiens
catctttttcctccctttccc

SEQ ID NO: 2006290 - DNA, 19 bp, Homo sapiens
catgaaaaacacggcagct

SEQ ID NO: 2006291 - DNA, 21 bp, Homo sapiens
catgaaaaacacggcagctgt

SEQ ID NO: 2006292 - DNA, 15 bp, Homo sapiens
catgaaaactatttt

SEQ ID NO: 2006293 - DNA, 20 bp, Homo sapiens
catgaaaactattttaaagc

SEQ ID NO: 2006294 - DNA, 13 bp, Homo sapiens
catgaaaagtgct

SEQ ID NO: 2006295 - DNA, 14 bp, Homo sapiens
catgaacacacatg

SEQ ID NO: 2006296 - DNA, 13 bp, Homo sapiens
catgaacacagct

SEQ ID NO: 2006297 - DNA, 19 bp, Homo sapiens
catgaacctcaagctgcat

SEQ ID NO: 2006298 - DNA, 16 bp, Homo sapiens
catgaagctggaagca

SEQ ID NO: 2006299 - DNA, 20 bp, Homo sapiens
catgaatatttcaaaataaa

SEQ ID NO: 2006300 - DNA, 16 bp, Homo sapiens
catgaatgcacactag

SEQ ID NO: 2006301 - DNA, 22 bp, Homo sapiens
catgaatggtatggaactctct

SEQ ID NO: 2006302 - DNA, 15 bp, Homo sapiens
catgacaatgcaatg

SEQ ID NO: 2006303 - DNA, 12 bp, Homo sapiens
catgacagccag

SEQ ID NO: 2006304 - DNA, 15 bp, Homo sapiens
catgacagccagagc

SEQ ID NO: 2006305 - DNA, 12 bp, Homo sapiens
catgacatgtta

SEQ ID NO: 2006306 - DNA, 15 bp, Homo sapiens
catgacatgttatat

SEQ ID NO: 2006307 - DNA, 18 bp, Homo sapiens
catgaccctcctgtccag

SEQ ID NO: 2006308 - DNA, 21 bp, Homo sapiens
catgacctccagctttcctgt

SEQ ID NO: 2006309 - DNA, 15 bp, Homo sapiens
catgagaaatgtgaa

SEQ ID NO: 2006310 - DNA, 14 bp, Homo sapiens
catgagaagagggc

SEQ ID NO: 2006311 - DNA, 15 bp, Homo sapiens
catgagaagagggcc

SEQ ID NO: 2006312 - DNA, 17 bp, Homo sapiens
catgagaccactgttat

SEQ ID NO: 2006313 - DNA, 23 bp, Homo sapiens
catgagagaattgtatcatttga

SEQ ID NO: 2006314 - DNA, 12 bp, Homo sapiens
catgagcctcag

SEQ ID NO: 2006315 - DNA, 18 bp, Homo sapiens
catgagcctcagcatcct

SEQ ID NO: 2006316 - DNA, 22 bp, Homo sapiens
catgagcctcagcatcctggca

SEQ ID NO: 2006317 - DNA, 22 bp, Homo sapiens
catgaggcaatgtcaggaacag

SEQ ID NO: 2006318 - DNA, 13 bp, Homo sapiens
catgaggcagctt

SEQ ID NO: 2006319 - DNA, 17 bp, Homo sapiens
catgagggatcacaggg

SEQ ID NO: 2006320 - DNA, 22 bp, Homo sapiens
catgagtctacctgagcattca

SEQ ID NO: 2006321 - DNA, 16 bp, Homo sapiens
catgagtggatggatg

SEQ ID NO: 2006322 - DNA, 14 bp, Homo sapiens
catgatacccctta

SEQ ID NO: 2006323 - DNA, 14 bp, Homo sapiens
catgatattttcag

SEQ ID NO: 2006324 - DNA, 13 bp, Homo sapiens
catgatctccctg

SEQ ID NO: 2006325 - DNA, 15 bp, Homo sapiens
catgatctccctgcc

SEQ ID NO: 2006326 - DNA, 20 bp, Homo sapiens
catgatctccctgccgcctc

SEQ ID NO: 2006327 - DNA, 22 bp, Homo sapiens
catgatcttgagatttctttta

SEQ ID NO: 2006328 - DNA, 18 bp, Homo sapiens
catgatgagctcctcttc

SEQ ID NO: 2006329 - DNA, 19 bp, Homo sapiens
catgatgttaaccagaata

SEQ ID NO: 2006330 - DNA, 21 bp, Homo sapiens
catgattcatgccaattagca

SEQ ID NO: 2006331 - DNA, 16 bp, Homo sapiens
catgatttacagagaa

SEQ ID NO: 2006332 - DNA, 18 bp, Homo sapiens
catgatttagggaagcag

SEQ ID NO: 2006333 - DNA, 20 bp, Homo sapiens
catgatttagggaagcaggg

SEQ ID NO: 2006334 - DNA, 17 bp, Homo sapiens
catgatttcaatgattg

SEQ ID NO: 2006335 - DNA, 18 bp, Homo sapiens
catgatttcaatgattgt

SEQ ID NO: 2006336 - DNA, 19 bp, Homo sapiens
catgattttaagaggcttt

SEQ ID NO: 2006337 - DNA, 18 bp, Homo sapiens
catgattttatacatagt

SEQ ID NO: 2006338 - DNA, 16 bp, Homo sapiens
catgcaatgacatctt

SEQ ID NO: 2006339 - DNA, 17 bp, Homo sapiens
catgcacacaaacacct

SEQ ID NO: 2006340 - DNA, 14 bp, Homo sapiens
catgcacagctgct

SEQ ID NO: 2006341 - DNA, 14 bp, Homo sapiens
catgcaccagtgcc

SEQ ID NO: 2006342 - DNA, 18 bp, Homo sapiens
catgcactgacccttcca

SEQ ID NO: 2006343 - DNA, 22 bp, Homo sapiens
catgcagactcctcagatctga

SEQ ID NO: 2006344 - DNA, 17 bp, Homo sapiens
catgcagcttcatcaat

SEQ ID NO: 2006345 - DNA, 21 bp, Homo sapiens
catgcagcttcatcaattttt

SEQ ID NO: 2006346 - DNA, 15 bp, Homo sapiens
catgcatcatcagcc

SEQ ID NO: 2006347 - DNA, 16 bp, Homo sapiens
catgcattcctaagaa

SEQ ID NO: 2006348 - DNA, 13 bp, Homo sapiens
catgccaccctct

SEQ ID NO: 2006349 - DNA, 19 bp, Homo sapiens
catgccaccctctccatgc

SEQ ID NO: 2006350 - DNA, 19 bp, Homo sapiens
catgccatttgtactgacc

SEQ ID NO: 2006351 - DNA, 19 bp, Homo sapiens
catgcctacagataattta

SEQ ID NO: 2006352 - DNA, 11 bp, Homo sapiens
catgcctcagt

SEQ ID NO: 2006353 - DNA, 12 bp, Homo sapiens
catgcctcagtt

SEQ ID NO: 2006354 - DNA, 13 bp, Homo sapiens
catgcctcagttt

SEQ ID NO: 2006355 - DNA, 14 bp, Homo sapiens
catgcctcagtttc

SEQ ID NO: 2006356 - DNA, 13 bp, Homo sapiens
catgcctcatgcc

SEQ ID NO: 2006357 - DNA, 13 bp, Homo sapiens
catgcctctgagg

SEQ ID NO: 2006358 - DNA, 14 bp, Homo sapiens
catgcctctgaggc

SEQ ID NO: 2006359 - DNA, 21 bp, Homo sapiens
catgcctctgatatgggactg

SEQ ID NO: 2006360 - DNA, 23 bp, Homo sapiens
catgcctctgatatgggactgag

SEQ ID NO: 2006361 - DNA, 16 bp, Homo sapiens
catgcctgagggtgga

SEQ ID NO: 2006362 - DNA, 17 bp, Homo sapiens
catgcctggcccccctc

SEQ ID NO: 2006363 - DNA, 13 bp, Homo sapiens
catgcgcaggctc

SEQ ID NO: 2006364 - DNA, 19 bp, Homo sapiens
catgcgctgctcaacctct

SEQ ID NO: 2006365 - DNA, 15 bp, Homo sapiens
catgcgtatatgtgc

SEQ ID NO: 2006366 - DNA, 16 bp, Homo sapiens
catgctaagagaagta

SEQ ID NO: 2006367 - DNA, 17 bp, Homo sapiens
catgctaagagaagtag

SEQ ID NO: 2006368 - DNA, 21 bp, Homo sapiens
catgctaagagaagtagaaat

SEQ ID NO: 2006369 - DNA, 23 bp, Homo sapiens
catgctatctctgtgtgcacaaa

SEQ ID NO: 2006370 - DNA, 18 bp, Homo sapiens
catgctcaaccactgtgg

SEQ ID NO: 2006371 - DNA, 13 bp, Homo sapiens
catgctcagccct

SEQ ID NO: 2006372 - DNA, 16 bp, Homo sapiens
catgctcagcccttcc

SEQ ID NO: 2006373 - DNA, 14 bp, Homo sapiens
catgctctctgcag

SEQ ID NO: 2006374 - DNA, 15 bp, Homo sapiens
catgctctctgcagc

SEQ ID NO: 2006375 - DNA, 16 bp, Homo sapiens
catgctctctgcagcc

SEQ ID NO: 2006376 - DNA, 12 bp, Homo sapiens
catgctctgccc

SEQ ID NO: 2006377 - DNA, 16 bp, Homo sapiens
catgctctgccccaag

SEQ ID NO: 2006378 - DNA, 12 bp, Homo sapiens
catgctctggaa

SEQ ID NO: 2006379 - DNA, 17 bp, Homo sapiens
catgctctggaagcctg

SEQ ID NO: 2006380 - DNA, 18 bp, Homo sapiens
catgctgaattattttgt

SEQ ID NO: 2006381 - DNA, 22 bp, Homo sapiens
catgctggcctcccaataaagc

SEQ ID NO: 2006382 - DNA, 23 bp, Homo sapiens
catgctggcctcccaataaagct

SEQ ID NO: 2006383 - DNA, 20 bp, Homo sapiens
catgctggcctgtggcaggc

SEQ ID NO: 2006384 - DNA, 22 bp, Homo sapiens
catgctggcctgtggcaggcct

SEQ ID NO: 2006385 - DNA, 19 bp, Homo sapiens
catgctgtgctctttgaag

SEQ ID NO: 2006386 - DNA, 12 bp, Homo sapiens
catgcttcttgc

SEQ ID NO: 2006387 - DNA, 14 bp, Homo sapiens
catgcttcttgccc

SEQ ID NO: 2006388 - DNA, 17 bp, Homo sapiens
catgcttcttgcccctt

SEQ ID NO: 2006389 - DNA, 19 bp, Homo sapiens
catgcttcttgccccttgg

SEQ ID NO: 2006390 - DNA, 14 bp, Homo sapiens
catgctttaaagtg

SEQ ID NO: 2006391 - DNA, 15 bp, Homo sapiens
catgctttcccacca

SEQ ID NO: 2006392 - DNA, 23 bp, Homo sapiens
catgctttcctaaagtctctgct

SEQ ID NO: 2006393 - DNA, 15 bp, Homo sapiens
catgctttctccttt

SEQ ID NO: 2006394 - DNA, 16 bp, Homo sapiens
catgctttctcctttt

SEQ ID NO: 2006395 - DNA, 12 bp, Homo sapiens
catgctttgttt

SEQ ID NO: 2006396 - DNA, 16 bp, Homo sapiens
catggaaaagcccagt

SEQ ID NO: 2006397 - DNA, 23 bp, Homo sapiens
ccacctacttttctttcctcaga

SEQ ID NO: 2006398 - DNA, 20 bp, Homo sapiens
ccacctaggccactcctcca

SEQ ID NO: 2006399 - DNA, 16 bp, Homo sapiens
ccacctcactcctgtt

SEQ ID NO: 2006400 - DNA, 10 bp, Homo sapiens
ccacctcagc

SEQ ID NO: 2006401 - DNA, 14 bp, Homo sapiens
ccacctcagccttg

SEQ ID NO: 2006402 - DNA, 15 bp, Homo sapiens
ccacctcagccttgg

SEQ ID NO: 2006403 - DNA, 16 bp, Homo sapiens
ccacctcagccttgga

SEQ ID NO: 2006404 - DNA, 12 bp, Homo sapiens
ccacctcccacc

SEQ ID NO: 2006405 - DNA, 16 bp, Homo sapiens
ccacctcccaccccac

SEQ ID NO: 2006406 - DNA, 21 bp, Homo sapiens
ccacctcccaccccactccag

SEQ ID NO: 2006407 - DNA, 22 bp, Homo sapiens
ccacctcccctatccacccagc

SEQ ID NO: 2006408 - DNA, 22 bp, Homo sapiens
ccacctccctgccctgtcctcc

SEQ ID NO: 2006409 - DNA, 23 bp, Homo sapiens
ccacctctcaatattcaataaag

SEQ ID NO: 2006410 - DNA, 16 bp, Homo sapiens
ccacctctccttggaa

SEQ ID NO: 2006411 - DNA, 13 bp, Homo sapiens
ccacctctgctgc

SEQ ID NO: 2006412 - DNA, 19 bp, Homo sapiens
ccacctcttctcttcctgt

SEQ ID NO: 2006413 - DNA, 17 bp, Homo sapiens
ccacctcttgtcagtgc

SEQ ID NO: 2006414 - DNA, 18 bp, Homo sapiens
ccacctgacaatggcagc

SEQ ID NO: 2006415 - DNA, 19 bp, Homo sapiens
ccacctgacaatggcagct

SEQ ID NO: 2006416 - DNA, 20 bp, Homo sapiens
ccacctgacaatggcagcta

SEQ ID NO: 2006417 - DNA, 16 bp, Homo sapiens
ccacctgcaagtgccc

SEQ ID NO: 2006418 - DNA, 17 bp, Homo sapiens
ccacctgcaagtgcccg

SEQ ID NO: 2006419 - DNA, 21 bp, Homo sapiens
ccacctgcaagtgcccgccct

SEQ ID NO: 2006420 - DNA, 23 bp, Homo sapiens
ccacctgcaagtgcccgccctgc

SEQ ID NO: 2006421 - DNA, 17 bp, Homo sapiens
ccacctgccagccatca

SEQ ID NO: 2006422 - DNA, 15 bp, Homo sapiens
ccacctgctgagaga

SEQ ID NO: 2006423 - DNA, 14 bp, Homo sapiens
ccacctgcttctga

SEQ ID NO: 2006424 - DNA, 18 bp, Homo sapiens
ccacctgctttctcctgg

SEQ ID NO: 2006425 - DNA, 19 bp, Homo sapiens
ccactgtggcgttctgctg

SEQ ID NO: 2006426 - DNA, 21 bp, Homo sapiens
ccactgtggcgttctgctgcc

SEQ ID NO: 2006427 - DNA, 14 bp, Homo sapiens
ccactgtttgtcct

SEQ ID NO: 2006428 - DNA, 17 bp, Homo sapiens
ccacttaaaaaatgtcc

SEQ ID NO: 2006429 - DNA, 21 bp, Homo sapiens
ccacttaccttcaataaagta

SEQ ID NO: 2006430 - DNA, 19 bp, Homo sapiens
ccacttagaaattgcattt

SEQ ID NO: 2006431 - DNA, 21 bp, Homo sapiens
ccacttagccgtccatggcac

SEQ ID NO: 2006432 - DNA, 12 bp, Homo sapiens
ccacttcactgt

SEQ ID NO: 2006433 - DNA, 14 bp, Homo sapiens
ccacttcactgtga

SEQ ID NO: 2006434 - DNA, 13 bp, Homo sapiens
ccacttccaggag

SEQ ID NO: 2006435 - DNA, 18 bp, Homo sapiens
ccacttctctactctgga

SEQ ID NO: 2006436 - DNA, 14 bp, Homo sapiens
ccacttctctccag

SEQ ID NO: 2006437 - DNA, 22 bp, Homo sapiens
ccacttctgcgatatttttcca

SEQ ID NO: 2006438 - DNA, 20 bp, Homo sapiens
ccacttcttaaaggcctgga

SEQ ID NO: 2006439 - DNA, 22 bp, Homo sapiens
ccacttcttaaaggcctggaac

SEQ ID NO: 2006440 - DNA, 15 bp, Homo sapiens
ccacttgacattcct

SEQ ID NO: 2006441 - DNA, 19 bp, Homo sapiens
ccacttgactaataccttg

SEQ ID NO: 2006442 - DNA, 15 bp, Homo sapiens
ccacttggctgctca

SEQ ID NO: 2006443 - DNA, 17 bp, Homo sapiens
ccactttaagagagaaa

SEQ ID NO: 2006444 - DNA, 14 bp, Homo sapiens
ccactttggcttct

SEQ ID NO: 2006445 - DNA, 22 bp, Homo sapiens
ccactttggcttctcctgtgac

SEQ ID NO: 2006446 - DNA, 15 bp, Homo sapiens
ccagaaaaccccagc

SEQ ID NO: 2006447 - DNA, 14 bp, Homo sapiens
ccagaaaatataaa

SEQ ID NO: 2006448 - DNA, 23 bp, Homo sapiens
ccagaaactccttttgctgtctt

SEQ ID NO: 2006449 - DNA, 12 bp, Homo sapiens
ccagaaagaaaa

SEQ ID NO: 2006450 - DNA, 23 bp, Homo sapiens
ccagaactgaggtcactgggttc

SEQ ID NO: 2006451 - DNA, 18 bp, Homo sapiens
ccagaagaatattcagga

SEQ ID NO: 2006452 - DNA, 19 bp, Homo sapiens
ccagaagaatattcaggac

SEQ ID NO: 2006453 - DNA, 16 bp, Homo sapiens
ccagaaggagggcaga

SEQ ID NO: 2006454 - DNA, 17 bp, Homo sapiens
ccagaaggagggcagag

SEQ ID NO: 2006455 - DNA, 18 bp, Homo sapiens
ccagaaggagggcagagc

SEQ ID NO: 2006456 - DNA, 19 bp, Homo sapiens
ccagaaggagggcagagcc

SEQ ID NO: 2006457 - DNA, 20 bp, Homo sapiens
ccagaaggagggcagagcca

SEQ ID NO: 2006458 - DNA, 21 bp, Homo sapiens
ccagaaggagggcagagccat

SEQ ID NO: 2006459 - DNA, 12 bp, Homo sapiens
ccagaaggcagg

SEQ ID NO: 2006460 - DNA, 21 bp, Homo sapiens
ccagaagggagttgctcactc

SEQ ID NO: 2006461 - DNA, 23 bp, Homo sapiens
ccagaaggggcacgcctgcccag

SEQ ID NO: 2006462 - DNA, 19 bp, Homo sapiens
ccagaagtggggctctggg

SEQ ID NO: 2006463 - DNA, 13 bp, Homo sapiens
ccagaataagtgc

SEQ ID NO: 2006464 - DNA, 14 bp, Homo sapiens
ccagaataagtgct

SEQ ID NO: 2006465 - DNA, 17 bp, Homo sapiens
ccagaataagtgctgtt

SEQ ID NO: 2006466 - DNA, 21 bp, Homo sapiens
ccagaataagtgctgtttgag

SEQ ID NO: 2006467 - DNA, 13 bp, Homo sapiens
ccagaatctgctg

SEQ ID NO: 2006468 - DNA, 23 bp, Homo sapiens
ccagaatctgctgttgccatagc

SEQ ID NO: 2006469 - DNA, 20 bp, Homo sapiens
ccagaatcttcgtcctgccc

SEQ ID NO: 2006470 - DNA, 14 bp, Homo sapiens
ccagaattgcattc

SEQ ID NO: 2006471 - DNA, 15 bp, Homo sapiens
ccagacacagataca

SEQ ID NO: 2006472 - DNA, 19 bp, Homo sapiens
ccagacaccttgacagggc

SEQ ID NO: 2006473 - DNA, 12 bp, Homo sapiens
ccagacactggt

SEQ ID NO: 2006474 - DNA, 20 bp, Homo sapiens
ccagaccacctccctgccct

SEQ ID NO: 2006475 - DNA, 15 bp, Homo sapiens
ccagaccacctgcca

SEQ ID NO: 2006476 - DNA, 16 bp, Homo sapiens
ccagaccacctgccag

SEQ ID NO: 2006477 - DNA, 21 bp, Homo sapiens
ccagaccacctgccagccatc

SEQ ID NO: 2006478 - DNA, 18 bp, Homo sapiens
ccagaccattgtcttcca

SEQ ID NO: 2006479 - DNA, 22 bp, Homo sapiens
ccagaccattgtcttccaaccc

SEQ ID NO: 2006480 - DNA, 16 bp, Homo sapiens
ccagacccctggcttt

SEQ ID NO: 2006481 - DNA, 18 bp, Homo sapiens
ccagacccctggcttttc

SEQ ID NO: 2006482 - DNA, 17 bp, Homo sapiens
ccagacccctgtggcag

SEQ ID NO: 2006483 - DNA, 18 bp, Homo sapiens
ccagacccctgtggcaga

SEQ ID NO: 2006484 - DNA, 14 bp, Homo sapiens
ccagacccggctgc

SEQ ID NO: 2006485 - DNA, 12 bp, Homo sapiens
ccagaccctgaa

SEQ ID NO: 2006486 - DNA, 19 bp, Homo sapiens
ccagaccctgaagatttca

SEQ ID NO: 2006487 - DNA, 16 bp, Homo sapiens
ccagacctagacctgg

SEQ ID NO: 2006488 - DNA, 19 bp, Homo sapiens
ccagacctagacctgggcc

SEQ ID NO: 2006489 - DNA, 15 bp, Homo sapiens
ccagactcctttcct

SEQ ID NO: 2006490 - DNA, 19 bp, Homo sapiens
ccagactcctttcctctga

SEQ ID NO: 2006491 - DNA, 18 bp, Homo sapiens
ccagactttctacacctg

SEQ ID NO: 2006492 - DNA, 20 bp, Homo sapiens
ccagactttctacacctgtt

SEQ ID NO: 2006493 - DNA, 17 bp, Homo sapiens
ccagagaatcagggcag

SEQ ID NO: 2006494 - DNA, 19 bp, Homo sapiens
ccagagaatcagggcaggc

SEQ ID NO: 2006495 - DNA, 16 bp, Homo sapiens
ccagagaattcttaga

SEQ ID NO: 2006496 - DNA, 12 bp, Homo sapiens
ccagagacagga

SEQ ID NO: 2006497 - DNA, 23 bp, Homo sapiens
ccagagacaggaaaatcctctgg

SEQ ID NO: 2006498 - DNA, 18 bp, Homo sapiens
ccagagaccccttccttt

SEQ ID NO: 2006499 - DNA, 20 bp, Homo sapiens
ccagagaccccttcctttcc

SEQ ID NO: 2006500 - DNA, 18 bp, Homo sapiens
ccagagacctgaggcaga

SEQ ID NO: 2006501 - DNA, 16 bp, Homo sapiens
ccagagaggaatcaga

SEQ ID NO: 2006502 - DNA, 14 bp, Homo sapiens
ccagagagggccca

SEQ ID NO: 2006503 - DNA, 15 bp, Homo sapiens
ccagagagggcccag

SEQ ID NO: 2006504 - DNA, 23 bp, Homo sapiens
ccagagagggtggtgacctctgc

SEQ ID NO: 2006505 - DNA, 18 bp, Homo sapiens
ccagagagtcctctggat

SEQ ID NO: 2006506 - DNA, 20 bp, Homo sapiens
ccagagatgcctccaccgct

SEQ ID NO: 2006507 - DNA, 23 bp, Homo sapiens
ccagagatgcctccaccgctgcc

SEQ ID NO: 2006508 - DNA, 17 bp, Homo sapiens
ccagccccgactccagc

SEQ ID NO: 2006509 - DNA, 21 bp, Homo sapiens
ccagccccgactccagccagc

SEQ ID NO: 2006510 - DNA, 11 bp, Homo sapiens
ccagcccctcc

SEQ ID NO: 2006511 - DNA, 22 bp, Homo sapiens
ccagcccctcctccccttcctg

SEQ ID NO: 2006512 - DNA, 14 bp, Homo sapiens
ccagccccttgaga

SEQ ID NO: 2006513 - DNA, 20 bp, Homo sapiens
ccagcccgcccaaggggact

SEQ ID NO: 2006514 - DNA, 14 bp, Homo sapiens
ccagcccggcctgc

SEQ ID NO: 2006515 - DNA, 21 bp, Homo sapiens
ccagccctacatcttcagctc

SEQ ID NO: 2006516 - DNA, 14 bp, Homo sapiens
ccagccctcaggcc

SEQ ID NO: 2006517 - DNA, 15 bp, Homo sapiens
ccagccctccctgtc

SEQ ID NO: 2006518 - DNA, 16 bp, Homo sapiens
ccagccctccctgtcc

SEQ ID NO: 2006519 - DNA, 22 bp, Homo sapiens
ccagccctccctgtcctcctcg

SEQ ID NO: 2006520 - DNA, 13 bp, Homo sapiens
ccagccctgccag

SEQ ID NO: 2006521 - DNA, 15 bp, Homo sapiens
ccagccctgccagga

SEQ ID NO: 2006522 - DNA, 16 bp, Homo sapiens
ccagccctgccaggag

SEQ ID NO: 2006523 - DNA, 17 bp, Homo sapiens
ccagccctgccaggagg

SEQ ID NO: 2006524 - DNA, 21 bp, Homo sapiens
ccagccctggggtatgagctg

SEQ ID NO: 2006525 - DNA, 18 bp, Homo sapiens
ccagccctttgcaggccc

SEQ ID NO: 2006526 - DNA, 22 bp, Homo sapiens
ccagccctttgcaggcccagca

SEQ ID NO: 2006527 - DNA, 23 bp, Homo sapiens
ccagccctttgcaggcccagcag

SEQ ID NO: 2006528 - DNA, 20 bp, Homo sapiens
ccagccctttgggaggctga

SEQ ID NO: 2006529 - DNA, 19 bp, Homo sapiens
ccagccgaccggccctgcc

SEQ ID NO: 2006530 - DNA, 18 bp, Homo sapiens
ccagccgcaggaaggcag

SEQ ID NO: 2006531 - DNA, 16 bp, Homo sapiens
ccagccgccctgggct

SEQ ID NO: 2006532 - DNA, 20 bp, Homo sapiens
ccagccggggcgagtggcac

SEQ ID NO: 2006533 - DNA, 15 bp, Homo sapiens
ccagccggtgcctgg

SEQ ID NO: 2006534 - DNA, 18 bp, Homo sapiens
ccagccgtgatgctcagg

SEQ ID NO: 2006535 - DNA, 19 bp, Homo sapiens
ccagccgtgatgctcaggc

SEQ ID NO: 2006536 - DNA, 17 bp, Homo sapiens
ccagcctcagctcagcc

SEQ ID NO: 2006537 - DNA, 22 bp, Homo sapiens
ccagcctcgcatgccagagcct

SEQ ID NO: 2006538 - DNA, 16 bp, Homo sapiens
ccagcctctcccggct

SEQ ID NO: 2006539 - DNA, 13 bp, Homo sapiens
ccagcctctgtcc

SEQ ID NO: 2006540 - DNA, 10 bp, Homo sapiens
ccagcctggc

SEQ ID NO: 2006541 - DNA, 18 bp, Homo sapiens
ccagcctggcctcctgcc

SEQ ID NO: 2006542 - DNA, 13 bp, Homo sapiens
ccagcctggcttc

SEQ ID NO: 2006543 - DNA, 19 bp, Homo sapiens
ccagcctggcttctggagc

SEQ ID NO: 2006544 - DNA, 20 bp, Homo sapiens
ccagcctggcttctggagcc

SEQ ID NO: 2006545 - DNA, 22 bp, Homo sapiens
ccacatccacacacgcaggaac

SEQ ID NO: 2006546 - DNA, 13 bp, Homo sapiens
ccacatcccaggc

SEQ ID NO: 2006547 - DNA, 13 bp, Homo sapiens
ccacatccctggg

SEQ ID NO: 2006548 - DNA, 23 bp, Homo sapiens
ccacatccctgggcctgctgctg

SEQ ID NO: 2006549 - DNA, 16 bp, Homo sapiens
ccacatctctgaaagc

SEQ ID NO: 2006550 - DNA, 14 bp, Homo sapiens
ccacatctgtgtct

SEQ ID NO: 2006551 - DNA, 16 bp, Homo sapiens
ccacatcttgctctgc

SEQ ID NO: 2006552 - DNA, 18 bp, Homo sapiens
ccacatcttgctctgctg

SEQ ID NO: 2006553 - DNA, 20 bp, Homo sapiens
ccacatcttgctctgctgac

SEQ ID NO: 2006554 - DNA, 20 bp, Homo sapiens
ccacatgccatttgtactga

SEQ ID NO: 2006555 - DNA, 22 bp, Homo sapiens
ccacatgccatttgtactgacc

SEQ ID NO: 2006556 - DNA, 14 bp, Homo sapiens
ccacatgtcaccgt

SEQ ID NO: 2006557 - DNA, 19 bp, Homo sapiens
ccacatgtgacacatatgc

SEQ ID NO: 2006558 - DNA, 16 bp, Homo sapiens
ccacatgtgcacatgc

SEQ ID NO: 2006559 - DNA, 18 bp, Homo sapiens
ccacattaattagatttt

SEQ ID NO: 2006560 - DNA, 17 bp, Homo sapiens
ccacattggacttcctt

SEQ ID NO: 2006561 - DNA, 15 bp, Homo sapiens
ccaccaaactgcaca

SEQ ID NO: 2006562 - DNA, 21 bp, Homo sapiens
ccaccaaactgcacacacagc

SEQ ID NO: 2006563 - DNA, 22 bp, Homo sapiens
ccaccaaactgcacacacagct

SEQ ID NO: 2006564 - DNA, 24 bp, Homo sapiens
ccaccaaactgcacacacagctcc

SEQ ID NO: 2006565 - DNA, 15 bp, Homo sapiens
ccaccaacatcccat

SEQ ID NO: 2006566 - DNA, 12 bp, Homo sapiens
ccaccaacccat

SEQ ID NO: 2006567 - DNA, 17 bp, Homo sapiens
ccaccaactctgcactc

SEQ ID NO: 2006568 - DNA, 19 bp, Homo sapiens
ccaccaactctgcactcca

SEQ ID NO: 2006569 - DNA, 22 bp, Homo sapiens
ccacctggccccatgtctctca

SEQ ID NO: 2006570 - DNA, 12 bp, Homo sapiens
ccacctgtctgt

SEQ ID NO: 2006571 - DNA, 17 bp, Homo sapiens
ccacctgttcaggagct

SEQ ID NO: 2006572 - DNA, 19 bp, Homo sapiens
ccacctgttcaggagctga

SEQ ID NO: 2006573 - DNA, 17 bp, Homo sapiens
ccaccttcaagcaccct

SEQ ID NO: 2006574 - DNA, 17 bp, Homo sapiens
ccaccttccagtgagct

SEQ ID NO: 2006575 - DNA, 12 bp, Homo sapiens
ccaccttcccag

SEQ ID NO: 2006576 - DNA, 19 bp, Homo sapiens
ccaccttcccagctctccc

SEQ ID NO: 2006577 - DNA, 21 bp, Homo sapiens
ccaccttcccagctctccctc

SEQ ID NO: 2006578 - DNA, 14 bp, Homo sapiens
ccaccttcccatgc

SEQ ID NO: 2006579 - DNA, 12 bp, Homo sapiens
ccaccttcccca

SEQ ID NO: 2006580 - DNA, 15 bp, Homo sapiens
ccaccttccccagac

SEQ ID NO: 2006581 - DNA, 16 bp, Homo sapiens
ccaccttccccagact

SEQ ID NO: 2006582 - DNA, 18 bp, Homo sapiens
ccaccttccccagactca

SEQ ID NO: 2006583 - DNA, 16 bp, Homo sapiens
ccaccttggactcctc

SEQ ID NO: 2006584 - DNA, 19 bp, Homo sapiens
ccaccttggactcctccca

SEQ ID NO: 2006585 - DNA, 15 bp, Homo sapiens
ccaccttggctcaag

SEQ ID NO: 2006586 - DNA, 20 bp, Homo sapiens
ccacctttgggatcagcctc

SEQ ID NO: 2006587 - DNA, 16 bp, Homo sapiens
ccacgaacgctcttag

SEQ ID NO: 2006588 - DNA, 19 bp, Homo sapiens
ccacgaatttgctggggaa

SEQ ID NO: 2006589 - DNA, 16 bp, Homo sapiens
ccacgagggtcaggac

SEQ ID NO: 2006590 - DNA, 22 bp, Homo sapiens
ccacgagtaagatattatttaa

SEQ ID NO: 2006591 - DNA, 18 bp, Homo sapiens
ccacgagtcacctgcaag

SEQ ID NO: 2006592 - DNA, 14 bp, Homo sapiens
ccacgcctcctggc

SEQ ID NO: 2006593 - DNA, 18 bp, Homo sapiens
ccacgcctcctggccaga

SEQ ID NO: 2006594 - DNA, 19 bp, Homo sapiens
ccacgcctcctggccagac

SEQ ID NO: 2006595 - DNA, 14 bp, Homo sapiens
ccacgccttgacct

SEQ ID NO: 2006596 - DNA, 18 bp, Homo sapiens
ccacgctggagtgcagtg

SEQ ID NO: 2006597 - DNA, 14 bp, Homo sapiens
ccacgctgtcctct

SEQ ID NO: 2006598 - DNA, 18 bp, Homo sapiens
ccacggatgttgtcagga

SEQ ID NO: 2006599 - DNA, 15 bp, Homo sapiens
ccacggccaccctcc

SEQ ID NO: 2006600 - DNA, 21 bp, Homo sapiens
ccacggccaccctccttcccg

SEQ ID NO: 2006601 - DNA, 12 bp, Homo sapiens
ccacggccaggc

SEQ ID NO: 2006602 - DNA, 18 bp, Homo sapiens
ccacggccaggccagagg

SEQ ID NO: 2006603 - DNA, 19 bp, Homo sapiens
ccacgggcctcagtttccc

SEQ ID NO: 2006604 - DNA, 13 bp, Homo sapiens
ccacggtgcgtgg

SEQ ID NO: 2006605 - DNA, 17 bp, Homo sapiens
ccacggtgcgtggctgt

SEQ ID NO: 2006606 - DNA, 19 bp, Homo sapiens
ccacggtgcgtggctgtgg

SEQ ID NO: 2006607 - DNA, 17 bp, Homo sapiens
ccacgtctgccaggccc

SEQ ID NO: 2006608 - DNA, 22 bp, Homo sapiens
ccacgtctgccaggcccatctc

SEQ ID NO: 2006609 - DNA, 18 bp, Homo sapiens
ccacgtgagagaatctgc

SEQ ID NO: 2006610 - DNA, 20 bp, Homo sapiens
ccacgtgagagaatctgcct

SEQ ID NO: 2006611 - DNA, 14 bp, Homo sapiens
ccacgtgccaggcc

SEQ ID NO: 2006612 - DNA, 16 bp, Homo sapiens
ccacgtgccaggcccg

SEQ ID NO: 2006613 - DNA, 16 bp, Homo sapiens
ccacgtgtgcagactg

SEQ ID NO: 2006614 - DNA, 15 bp, Homo sapiens
ccacgttccttactg

SEQ ID NO: 2006615 - DNA, 21 bp, Homo sapiens
ccacgttccttactgcagaat

SEQ ID NO: 2006616 - DNA, 14 bp, Homo sapiens
ccactaaatgagct

SEQ ID NO: 2006617 - DNA, 14 bp, Homo sapiens
ccactacactccag

SEQ ID NO: 2006618 - DNA, 18 bp, Homo sapiens
ccactacactccagcctg

SEQ ID NO: 2006619 - DNA, 22 bp, Homo sapiens
ccactacctttgtccaggcctg

SEQ ID NO: 2006620 - DNA, 18 bp, Homo sapiens
ccactaggttctaggtcc

SEQ ID NO: 2006621 - DNA, 14 bp, Homo sapiens
ccactcactccagc

SEQ ID NO: 2006622 - DNA, 15 bp, Homo sapiens
ccactcactccagcc

SEQ ID NO: 2006623 - DNA, 13 bp, Homo sapiens
ccactcaggaggc

SEQ ID NO: 2006624 - DNA, 20 bp, Homo sapiens
ccactcaggccaacaagcca

SEQ ID NO: 2006625 - DNA, 14 bp, Homo sapiens
ccactcagggctgc

SEQ ID NO: 2006626 - DNA, 16 bp, Homo sapiens
ccactcagttgttcct

SEQ ID NO: 2006627 - DNA, 20 bp, Homo sapiens
ccactcatgttgttcccaca

SEQ ID NO: 2006628 - DNA, 21 bp, Homo sapiens
ccactcatgttgttcccacac

SEQ ID NO: 2006629 - DNA, 21 bp, Homo sapiens
ccactccagacccctggcttt

SEQ ID NO: 2006630 - DNA, 13 bp, Homo sapiens
ccactccagccct

SEQ ID NO: 2006631 - DNA, 16 bp, Homo sapiens
ccactccagccctgtc

SEQ ID NO: 2006632 - DNA, 16 bp, Homo sapiens
ccactccccaccttca

SEQ ID NO: 2006633 - DNA, 18 bp, Homo sapiens
ccactccctgagctttgg

SEQ ID NO: 2006634 - DNA, 20 bp, Homo sapiens
ccactcctgtcccgccttcc

SEQ ID NO: 2006635 - DNA, 14 bp, Homo sapiens
ccactcgcagtcgc

SEQ ID NO: 2006636 - DNA, 17 bp, Homo sapiens
ccactcgcagtcgcagg

SEQ ID NO: 2006637 - DNA, 23 bp, Homo sapiens
ccactctaggggtcaggctccat

SEQ ID NO: 2006638 - DNA, 23 bp, Homo sapiens
ccactctcaggaggcgcagcccg

SEQ ID NO: 2006639 - DNA, 13 bp, Homo sapiens
ccactctcccctc

SEQ ID NO: 2006640 - DNA, 18 bp, Homo sapiens
ccactctcccctccctct

SEQ ID NO: 2006641 - DNA, 22 bp, Homo sapiens
ccactctcccctccctcttcct

SEQ ID NO: 2006642 - DNA, 23 bp, Homo sapiens
ccactctcccctccctcttcctt

SEQ ID NO: 2006643 - DNA, 23 bp, Homo sapiens
ccactctgctctgatgcatcaga

SEQ ID NO: 2006644 - DNA, 12 bp, Homo sapiens
ccactctggcag

SEQ ID NO: 2006645 - DNA, 21 bp, Homo sapiens
ccactctggcagccacacttc

SEQ ID NO: 2006646 - DNA, 22 bp, Homo sapiens
ccactctggcagccacacttct

SEQ ID NO: 2006647 - DNA, 13 bp, Homo sapiens
ccactctttgcta

SEQ ID NO: 2006648 - DNA, 22 bp, Homo sapiens
ccactctttgctacaataaatg

SEQ ID NO: 2006649 - DNA, 23 bp, Homo sapiens
ccactgaaaacatttcaaagctg

SEQ ID NO: 2006650 - DNA, 14 bp, Homo sapiens
ccactgaagctggg

SEQ ID NO: 2006651 - DNA, 15 bp, Homo sapiens
ccactgacctcaccg

SEQ ID NO: 2006652 - DNA, 17 bp, Homo sapiens
ccactgacctcaccggc

SEQ ID NO: 2006653 - DNA, 17 bp, Homo sapiens
ccactgcaccgggccac

SEQ ID NO: 2006654 - DNA, 17 bp, Homo sapiens
ccactgcactccagcct

SEQ ID NO: 2006655 - DNA, 23 bp, Homo sapiens
ccagggagcaatgggagggggct

SEQ ID NO: 2006656 - DNA, 14 bp, Homo sapiens
ccagggaggagagg

SEQ ID NO: 2006657 - DNA, 16 bp, Homo sapiens
ccagggcacaggagct

SEQ ID NO: 2006658 - DNA, 11 bp, Homo sapiens
ccagggcactg

SEQ ID NO: 2006659 - DNA, 18 bp, Homo sapiens
ccagggcaggctacccct

SEQ ID NO: 2006660 - DNA, 13 bp, Homo sapiens
ccagggccacgtg

SEQ ID NO: 2006661 - DNA, 17 bp, Homo sapiens
ccagggccacgtgccag

SEQ ID NO: 2006662 - DNA, 12 bp, Homo sapiens
ccagggccaggg

SEQ ID NO: 2006663 - DNA, 18 bp, Homo sapiens
ccagggcccaaagcccag

SEQ ID NO: 2006664 - DNA, 19 bp, Homo sapiens
ccagggccccagaacacag

SEQ ID NO: 2006665 - DNA, 15 bp, Homo sapiens
ccagggcccccacag

SEQ ID NO: 2006666 - DNA, 23 bp, Homo sapiens
ccagggcccctccctctgcccca

SEQ ID NO: 2006667 - DNA, 16 bp, Homo sapiens
ccagggcccctgttcc

SEQ ID NO: 2006668 - DNA, 15 bp, Homo sapiens
ccagggccctgcaga

SEQ ID NO: 2006669 - DNA, 17 bp, Homo sapiens
ccagggcctactgccac

SEQ ID NO: 2006670 - DNA, 21 bp, Homo sapiens
ccagggcctggtgtgaggctg

SEQ ID NO: 2006671 - DNA, 18 bp, Homo sapiens
ccagggctcaaaaagttt

SEQ ID NO: 2006672 - DNA, 16 bp, Homo sapiens
ccagggctcgggcgct

SEQ ID NO: 2006673 - DNA, 16 bp, Homo sapiens
ccagggctgcccctgt

SEQ ID NO: 2006674 - DNA, 19 bp, Homo sapiens
ccagggctgcccctgtagg

SEQ ID NO: 2006675 - DNA, 18 bp, Homo sapiens
ccagggcttttcccagga

SEQ ID NO: 2006676 - DNA, 18 bp, Homo sapiens
ccaggggaccacacctcc

SEQ ID NO: 2006677 - DNA, 18 bp, Homo sapiens
ccaggggcccacagggaa

SEQ ID NO: 2006678 - DNA, 15 bp, Homo sapiens
ccaggggctccacct

SEQ ID NO: 2006679 - DNA, 23 bp, Homo sapiens
ccaggggctgctcatcacccagt

SEQ ID NO: 2006680 - DNA, 18 bp, Homo sapiens
ccaggggtctccctggag

SEQ ID NO: 2006681 - DNA, 15 bp, Homo sapiens
ccagggtaggggagg

SEQ ID NO: 2006682 - DNA, 18 bp, Homo sapiens
ccagggtaggggagggtg

SEQ ID NO: 2006683 - DNA, 22 bp, Homo sapiens
ccagggtccgcaccagctgctc

SEQ ID NO: 2006684 - DNA, 15 bp, Homo sapiens
ccagggtcctgagtg

SEQ ID NO: 2006685 - DNA, 20 bp, Homo sapiens
ccagggtcttgggctactgg

SEQ ID NO: 2006686 - DNA, 22 bp, Homo sapiens
ccagggttgatcacactctggg

SEQ ID NO: 2006687 - DNA, 16 bp, Homo sapiens
ccaggtaatgagggac

SEQ ID NO: 2006688 - DNA, 18 bp, Homo sapiens
ccaggtaatgagggactg

SEQ ID NO: 2006689 - DNA, 14 bp, Homo sapiens
ccaggtagaacaca

SEQ ID NO: 2006690 - DNA, 20 bp, Homo sapiens
ccaggtagggccagctcaca

SEQ ID NO: 2006691 - DNA, 17 bp, Homo sapiens
ccaggtatctccaggat

SEQ ID NO: 2006692 - DNA, 22 bp, Homo sapiens
ccaggtcctctgatacccagag

SEQ ID NO: 2006693 - DNA, 19 bp, Homo sapiens
ccaggtcctggtggggcag

SEQ ID NO: 2006694 - DNA, 14 bp, Homo sapiens
ccaggtccttcctt

SEQ ID NO: 2006695 - DNA, 13 bp, Homo sapiens
ccaggtctccctg

SEQ ID NO: 2006696 - DNA, 21 bp, Homo sapiens
ccaggtctctccactgctctc

SEQ ID NO: 2006697 - DNA, 21 bp, Homo sapiens
ccaggtgccaccaataaaaat

SEQ ID NO: 2006698 - DNA, 17 bp, Homo sapiens
ccaggtggctgacccag

SEQ ID NO: 2006699 - DNA, 21 bp, Homo sapiens
ccaggtggctgacccagtccc

SEQ ID NO: 2006700 - DNA, 15 bp, Homo sapiens
ccatcctgcagcctc

SEQ ID NO: 2006701 - DNA, 18 bp, Homo sapiens
ccatcctgcagcctcctc

SEQ ID NO: 2006702 - DNA, 12 bp, Homo sapiens
ccatcctggccc

SEQ ID NO: 2006703 - DNA, 14 bp, Homo sapiens
ccatcctggcccct

SEQ ID NO: 2006704 - DNA, 21 bp, Homo sapiens
ccatcctgggccttacctccc

SEQ ID NO: 2006705 - DNA, 18 bp, Homo sapiens
ccatccttcaccagagcc

SEQ ID NO: 2006706 - DNA, 19 bp, Homo sapiens
ccatccttcaccagagccc

SEQ ID NO: 2006707 - DNA, 12 bp, Homo sapiens
ccatccttccca

SEQ ID NO: 2006708 - DNA, 15 bp, Homo sapiens
ccatccttcccatga

SEQ ID NO: 2006709 - DNA, 16 bp, Homo sapiens
ccatctaagctgcagc

SEQ ID NO: 2006710 - DNA, 12 bp, Homo sapiens
ccatctagagat

SEQ ID NO: 2006711 - DNA, 22 bp, Homo sapiens
ccatctcaggtgccactccctg

SEQ ID NO: 2006712 - DNA, 19 bp, Homo sapiens
ccatctccaccctgagcct

SEQ ID NO: 2006713 - DNA, 24 bp, Homo sapiens
ccatctccaccctgagcctgacct

SEQ ID NO: 2006714 - DNA, 12 bp, Homo sapiens
ccatctccccag

SEQ ID NO: 2006715 - DNA, 13 bp, Homo sapiens
ccatctcccccat

SEQ ID NO: 2006716 - DNA, 13 bp, Homo sapiens
ccatctcctccca

SEQ ID NO: 2006717 - DNA, 16 bp, Homo sapiens
ccatctcctttcaggg

SEQ ID NO: 2006718 - DNA, 21 bp, Homo sapiens
ccatctcttcctacccaacca

SEQ ID NO: 2006719 - DNA, 22 bp, Homo sapiens
ccatctgctgccccgcttcccc

SEQ ID NO: 2006720 - DNA, 12 bp, Homo sapiens
ccatctgcttgt

SEQ ID NO: 2006721 - DNA, 14 bp, Homo sapiens
ccatctgtccctgc

SEQ ID NO: 2006722 - DNA, 22 bp, Homo sapiens
ccatctgtcttgccagccagaa

SEQ ID NO: 2006723 - DNA, 20 bp, Homo sapiens
ccatcttaaatgacagtgaa

SEQ ID NO: 2006724 - DNA, 17 bp, Homo sapiens
ccatcttcctgctgctg

SEQ ID NO: 2006725 - DNA, 20 bp, Homo sapiens
ccatcttttaatatgctgtg

SEQ ID NO: 2006726 - DNA, 22 bp, Homo sapiens
ccatgaaaatgcaacaacatgt

SEQ ID NO: 2006727 - DNA, 19 bp, Homo sapiens
ccatgaagacaggacagtg

SEQ ID NO: 2006728 - DNA, 20 bp, Homo sapiens
ccatgaagctggaagcactg

SEQ ID NO: 2006729 - DNA, 17 bp, Homo sapiens
ccatgaatcaaagacat

SEQ ID NO: 2006730 - DNA, 20 bp, Homo sapiens
ccatgaccagttctggccag

SEQ ID NO: 2006731 - DNA, 20 bp, Homo sapiens
ccatgacctccagctttcct

SEQ ID NO: 2006732 - DNA, 22 bp, Homo sapiens
ccatgacctccagctttcctgt

SEQ ID NO: 2006733 - DNA, 21 bp, Homo sapiens
ccatgagaagagggcctgtgg

SEQ ID NO: 2006734 - DNA, 20 bp, Homo sapiens
ccatgagatagcattagctg

SEQ ID NO: 2006735 - DNA, 14 bp, Homo sapiens
ccatgagcctcagc

SEQ ID NO: 2006736 - DNA, 18 bp, Homo sapiens
ccatgagcctcagcatcc

SEQ ID NO: 2006737 - DNA, 19 bp, Homo sapiens
ccatgatctgtatttaatg

SEQ ID NO: 2006738 - DNA, 15 bp, Homo sapiens
ccatgattttacaga

SEQ ID NO: 2006739 - DNA, 14 bp, Homo sapiens
ccatgcagcttcat

SEQ ID NO: 2006740 - DNA, 15 bp, Homo sapiens
ccatgccactgccag

SEQ ID NO: 2006741 - DNA, 16 bp, Homo sapiens
ccatgccactgccagg

SEQ ID NO: 2006742 - DNA, 17 bp, Homo sapiens
ccatgccactgccaggc

SEQ ID NO: 2006743 - DNA, 20 bp, Homo sapiens
ccatgccactgccaggcacc

SEQ ID NO: 2006744 - DNA, 14 bp, Homo sapiens
ccatgcctcatgcc

SEQ ID NO: 2006745 - DNA, 16 bp, Homo sapiens
ccatgcctcatgccac

SEQ ID NO: 2006746 - DNA, 17 bp, Homo sapiens
ccatgcctcatgccaca

SEQ ID NO: 2006747 - DNA, 18 bp, Homo sapiens
ccatgcctcatgccacac

SEQ ID NO: 2006748 - DNA, 23 bp, Homo sapiens
ccatgcctcatgccacaccttct

SEQ ID NO: 2006749 - DNA, 16 bp, Homo sapiens
ccatgcctgagggtgg

SEQ ID NO: 2006750 - DNA, 18 bp, Homo sapiens
ccatgcgctgctcaacct

SEQ ID NO: 2006751 - DNA, 18 bp, Homo sapiens
ccatgctcaaccactgtg

SEQ ID NO: 2006752 - DNA, 21 bp, Homo sapiens
ccatgctcaaccactgtggcg

SEQ ID NO: 2006753 - DNA, 13 bp, Homo sapiens
ccatgctctgccc

SEQ ID NO: 2006754 - DNA, 16 bp, Homo sapiens
ccatgctgaagggacc

SEQ ID NO: 2006755 - DNA, 14 bp, Homo sapiens
ccatgcttcttgcc

SEQ ID NO: 2006756 - DNA, 17 bp, Homo sapiens
ccatgcttcttgcccct

SEQ ID NO: 2006757 - DNA, 18 bp, Homo sapiens
ccatgcttcttgcccctt

SEQ ID NO: 2006758 - DNA, 20 bp, Homo sapiens
ccatgctttccttttcttcc

SEQ ID NO: 2006759 - DNA, 20 bp, Homo sapiens
ccatggacacattttctcct

SEQ ID NO: 2006760 - DNA, 14 bp, Homo sapiens
ccatggagcaggga

SEQ ID NO: 2006761 - DNA, 13 bp, Homo sapiens
ccatggaggcagg

SEQ ID NO: 2006762 - DNA, 22 bp, Homo sapiens
ccatggaggcaggctccccctg

SEQ ID NO: 2006763 - DNA, 22 bp, Homo sapiens
ccatggcaccagccccctggat

SEQ ID NO: 2006764 - DNA, 15 bp, Homo sapiens
ccaggaaggcagctg

SEQ ID NO: 2006765 - DNA, 18 bp, Homo sapiens
ccaggaaggcagctgctc

SEQ ID NO: 2006766 - DNA, 16 bp, Homo sapiens
ccaggaatctgccatt

SEQ ID NO: 2006767 - DNA, 15 bp, Homo sapiens
ccaggacaagcatgg

SEQ ID NO: 2006768 - DNA, 17 bp, Homo sapiens
ccaggacaagcatggtc

SEQ ID NO: 2006769 - DNA, 18 bp, Homo sapiens
ccaggacacctgccccag

SEQ ID NO: 2006770 - DNA, 22 bp, Homo sapiens
ccaggacacctgccccagcgcg

SEQ ID NO: 2006771 - DNA, 16 bp, Homo sapiens
ccaggacagctggctg

SEQ ID NO: 2006772 - DNA, 18 bp, Homo sapiens
ccaggacagctggctgct

SEQ ID NO: 2006773 - DNA, 20 bp, Homo sapiens
ccaggacagctggctgctga

SEQ ID NO: 2006774 - DNA, 23 bp, Homo sapiens
ccaggacagctggctgctgacag

SEQ ID NO: 2006775 - DNA, 14 bp, Homo sapiens
ccaggacgccactc

SEQ ID NO: 2006776 - DNA, 15 bp, Homo sapiens
ccaggacgccactca

SEQ ID NO: 2006777 - DNA, 16 bp, Homo sapiens
ccaggacgccactcat

SEQ ID NO: 2006778 - DNA, 23 bp, Homo sapiens
ccaggacgccactcatttcatct

SEQ ID NO: 2006779 - DNA, 19 bp, Homo sapiens
ccaggactatagcccaggt

SEQ ID NO: 2006780 - DNA, 20 bp, Homo sapiens
ccaggactatagcccaggtc

SEQ ID NO: 2006781 - DNA, 15 bp, Homo sapiens
ccaggactcaccctc

SEQ ID NO: 2006782 - DNA, 11 bp, Homo sapiens
ccaggagagag

SEQ ID NO: 2006783 - DNA, 22 bp, Homo sapiens
ccaggagagagatctagaaagt

SEQ ID NO: 2006784 - DNA, 13 bp, Homo sapiens
ccaggagagccag

SEQ ID NO: 2006785 - DNA, 19 bp, Homo sapiens
ccaggagagccagccctcc

SEQ ID NO: 2006786 - DNA, 15 bp, Homo sapiens
ccaggagcacacggc

SEQ ID NO: 2006787 - DNA, 15 bp, Homo sapiens
ccaggagcccagagg

SEQ ID NO: 2006788 - DNA, 12 bp, Homo sapiens
ccaggagcctac

SEQ ID NO: 2006789 - DNA, 21 bp, Homo sapiens
ccaggagctgagtcacctcct

SEQ ID NO: 2006790 - DNA, 18 bp, Homo sapiens
ccaggaggagaggaaagg

SEQ ID NO: 2006791 - DNA, 19 bp, Homo sapiens
ccaggaggagaggaaagga

SEQ ID NO: 2006792 - DNA, 17 bp, Homo sapiens
ccaggagggacaaagga

SEQ ID NO: 2006793 - DNA, 22 bp, Homo sapiens
ccaggagggacaaaggagcctg

SEQ ID NO: 2006794 - DNA, 15 bp, Homo sapiens
ccaggaggggcctct

SEQ ID NO: 2006795 - DNA, 16 bp, Homo sapiens
ccaggaggtcctcctc

SEQ ID NO: 2006796 - DNA, 22 bp, Homo sapiens
ccaggaggtggctatggccacc

SEQ ID NO: 2006797 - DNA, 14 bp, Homo sapiens
ccaggagttctgaa

SEQ ID NO: 2006798 - DNA, 17 bp, Homo sapiens
ccaggagtttgagacaa

SEQ ID NO: 2006799 - DNA, 20 bp, Homo sapiens
ccaggagtttgaggctgcag

SEQ ID NO: 2006800 - DNA, 21 bp, Homo sapiens
ccaggagtttgaggctgcagc

SEQ ID NO: 2006801 - DNA, 24 bp, Homo sapiens
ccaggatcccaagcgtcccgtccc

SEQ ID NO: 2006802 - DNA, 15 bp, Homo sapiens
ccaggatcccagagc

SEQ ID NO: 2006803 - DNA, 20 bp, Homo sapiens
ccaggatccctcccagatcc

SEQ ID NO: 2006804 - DNA, 19 bp, Homo sapiens
ccaggatcgctttgtactt

SEQ ID NO: 2006805 - DNA, 14 bp, Homo sapiens
ccaggtgggagaga

SEQ ID NO: 2006806 - DNA, 16 bp, Homo sapiens
ccaggtgggagagaca

SEQ ID NO: 2006807 - DNA, 23 bp, Homo sapiens
ccaggttaggaaggcagcattcc

SEQ ID NO: 2006808 - DNA, 13 bp, Homo sapiens
ccaggttggcctg

SEQ ID NO: 2006809 - DNA, 16 bp, Homo sapiens
ccagtacctttgtcac

SEQ ID NO: 2006810 - DNA, 16 bp, Homo sapiens
ccagtacttctaagag

SEQ ID NO: 2006811 - DNA, 14 bp, Homo sapiens
ccagtattcttgtc

SEQ ID NO: 2006812 - DNA, 20 bp, Homo sapiens
ccagtcacctcttctgccag

SEQ ID NO: 2006813 - DNA, 13 bp, Homo sapiens
ccagtccctgggg

SEQ ID NO: 2006814 - DNA, 19 bp, Homo sapiens
ccagtccctgggggaagcc

SEQ ID NO: 2006815 - DNA, 22 bp, Homo sapiens
ccagtccctgggggaagccctg

SEQ ID NO: 2006816 - DNA, 16 bp, Homo sapiens
ccagtcctagagctcc

SEQ ID NO: 2006817 - DNA, 19 bp, Homo sapiens
ccagtcctagagctcctgt

SEQ ID NO: 2006818 - DNA, 21 bp, Homo sapiens
ccagtcctagagctcctgtcc

SEQ ID NO: 2006819 - DNA, 24 bp, Homo sapiens
ccagtcctagagctcctgtcccta

SEQ ID NO: 2006820 - DNA, 19 bp, Homo sapiens
ccagtctggaatgcagtgg

SEQ ID NO: 2006821 - DNA, 20 bp, Homo sapiens
ccagtctggaatgcagtggt

SEQ ID NO: 2006822 - DNA, 16 bp, Homo sapiens
ccagtctgttccccat

SEQ ID NO: 2006823 - DNA, 12 bp, Homo sapiens
ccagtcttgcct

SEQ ID NO: 2006824 - DNA, 20 bp, Homo sapiens
ccagtgaacttacacttgga

SEQ ID NO: 2006825 - DNA, 18 bp, Homo sapiens
ccagtgacctgctgggta

SEQ ID NO: 2006826 - DNA, 12 bp, Homo sapiens
ccagtgactttt

SEQ ID NO: 2006827 - DNA, 15 bp, Homo sapiens
ccagtgagggctggg

SEQ ID NO: 2006828 - DNA, 20 bp, Homo sapiens
ccagtgatgtgctggagctg

SEQ ID NO: 2006829 - DNA, 13 bp, Homo sapiens
ccagtgccaggac

SEQ ID NO: 2006830 - DNA, 14 bp, Homo sapiens
ccagtgccaggaca

SEQ ID NO: 2006831 - DNA, 15 bp, Homo sapiens
ccagtgccaggacag

SEQ ID NO: 2006832 - DNA, 17 bp, Homo sapiens
ccagtgccaggacagct

SEQ ID NO: 2006833 - DNA, 18 bp, Homo sapiens
ccagtgccttacctcctg

SEQ ID NO: 2006834 - DNA, 19 bp, Homo sapiens
ccagtgccttacctcctgc

SEQ ID NO: 2006835 - DNA, 22 bp, Homo sapiens
ccagtgccttacctcctgccca

SEQ ID NO: 2006836 - DNA, 12 bp, Homo sapiens
ccagtgctgcca

SEQ ID NO: 2006837 - DNA, 18 bp, Homo sapiens
ccagtgctgccatgccac

SEQ ID NO: 2006838 - DNA, 21 bp, Homo sapiens
ccagtgctgccatgccactgc

SEQ ID NO: 2006839 - DNA, 16 bp, Homo sapiens
ccagtgggacagagga

SEQ ID NO: 2006840 - DNA, 19 bp, Homo sapiens
ccagtgtaaagaataaatg

SEQ ID NO: 2006841 - DNA, 20 bp, Homo sapiens
ccagtgtaaagaataaatga

SEQ ID NO: 2006842 - DNA, 18 bp, Homo sapiens
ccagtgtccccacgtatg

SEQ ID NO: 2006843 - DNA, 14 bp, Homo sapiens
ccagtgtcccctcc

SEQ ID NO: 2006844 - DNA, 16 bp, Homo sapiens
ccagtgtcccctccac

SEQ ID NO: 2006845 - DNA, 23 bp, Homo sapiens
ccagtgtgacaaggattgctact

SEQ ID NO: 2006846 - DNA, 21 bp, Homo sapiens
ccagtgtgcacccctccccat

SEQ ID NO: 2006847 - DNA, 17 bp, Homo sapiens
ccagtgtggctgtctgc

SEQ ID NO: 2006848 - DNA, 17 bp, Homo sapiens
ccagtgttggctgtgtg

SEQ ID NO: 2006849 - DNA, 16 bp, Homo sapiens
ccagttaagaatggaa

SEQ ID NO: 2006850 - DNA, 21 bp, Homo sapiens
ccagttaaggaccgtggccct

SEQ ID NO: 2006851 - DNA, 18 bp, Homo sapiens
ccagttacaaaaatagta

SEQ ID NO: 2006852 - DNA, 21 bp, Homo sapiens
ccagttcctttcaatggtttg

SEQ ID NO: 2006853 - DNA, 19 bp, Homo sapiens
ccagttctacaagcatatt

SEQ ID NO: 2006854 - DNA, 13 bp, Homo sapiens
ccagttctgctcc

SEQ ID NO: 2006855 - DNA, 17 bp, Homo sapiens
ccagttctgctcctctc

SEQ ID NO: 2006856 - DNA, 19 bp, Homo sapiens
ccagttgggagcactggag

SEQ ID NO: 2006857 - DNA, 23 bp, Homo sapiens
ccagttgggtggatgcctggtgg

SEQ ID NO: 2006858 - DNA, 22 bp, Homo sapiens
ccagtttccccatggggctgcg

SEQ ID NO: 2006859 - DNA, 13 bp, Homo sapiens
ccagtttgcagaa

SEQ ID NO: 2006860 - DNA, 23 bp, Homo sapiens
ccagtttgcagaaaagcacctgc

SEQ ID NO: 2006861 - DNA, 16 bp, Homo sapiens
ccataaacttcatggt

SEQ ID NO: 2006862 - DNA, 13 bp, Homo sapiens
ccataacagccaa

SEQ ID NO: 2006863 - DNA, 15 bp, Homo sapiens
ccataaggaatgtag

SEQ ID NO: 2006864 - DNA, 19 bp, Homo sapiens
ccataatagttagccctca

SEQ ID NO: 2006865 - DNA, 17 bp, Homo sapiens
ccataatcaatctatca

SEQ ID NO: 2006866 - DNA, 21 bp, Homo sapiens
ccataatctggactcctctgt

SEQ ID NO: 2006867 - DNA, 19 bp, Homo sapiens
ccataatgtataaagaaca

SEQ ID NO: 2006868 - DNA, 20 bp, Homo sapiens
ccataattatgacagttata

SEQ ID NO: 2006869 - DNA, 16 bp, Homo sapiens
ccatacacatccccag

SEQ ID NO: 2006870 - DNA, 13 bp, Homo sapiens
ccataccatcact

SEQ ID NO: 2006871 - DNA, 16 bp, Homo sapiens
cccatagcttccatga

SEQ ID NO: 2006872 - DNA, 13 bp, Homo sapiens
cccatcagacagg

SEQ ID NO: 2006873 - DNA, 20 bp, Homo sapiens
cccatcatatgacatgccac

SEQ ID NO: 2006874 - DNA, 14 bp, Homo sapiens
cccatcatcccagc

SEQ ID NO: 2006875 - DNA, 21 bp, Homo sapiens
cccatccagttcatgagaatc

SEQ ID NO: 2006876 - DNA, 14 bp, Homo sapiens
cccatcccctttcc

SEQ ID NO: 2006877 - DNA, 16 bp, Homo sapiens
cccatcccctttcctc

SEQ ID NO: 2006878 - DNA, 19 bp, Homo sapiens
cccatcccctttcctcccc

SEQ ID NO: 2006879 - DNA, 17 bp, Homo sapiens
cccatccctcggaccca

SEQ ID NO: 2006880 - DNA, 17 bp, Homo sapiens
cccatcccttcctcccc

SEQ ID NO: 2006881 - DNA, 19 bp, Homo sapiens
cccatcccttcctccccag

SEQ ID NO: 2006882 - DNA, 15 bp, Homo sapiens
cccatctcaggtgcc

SEQ ID NO: 2006883 - DNA, 16 bp, Homo sapiens
cccatctcaggtgcca

SEQ ID NO: 2006884 - DNA, 23 bp, Homo sapiens
cccatctcaggtgccactccctg

SEQ ID NO: 2006885 - DNA, 17 bp, Homo sapiens
cccatctccccaggcct

SEQ ID NO: 2006886 - DNA, 19 bp, Homo sapiens
cccatctccccaggcctcc

SEQ ID NO: 2006887 - DNA, 14 bp, Homo sapiens
cccatctctcttcc

SEQ ID NO: 2006888 - DNA, 15 bp, Homo sapiens
cccatcttcctgctg

SEQ ID NO: 2006889 - DNA, 16 bp, Homo sapiens
cccatcttcctgctgc

SEQ ID NO: 2006890 - DNA, 15 bp, Homo sapiens
cccatcttggtcctg

SEQ ID NO: 2006891 - DNA, 14 bp, Homo sapiens
cccatgacctccag

SEQ ID NO: 2006892 - DNA, 16 bp, Homo sapiens
cccatgacctccagct

SEQ ID NO: 2006893 - DNA, 20 bp, Homo sapiens
cccatgatgccgctcttctg

SEQ ID NO: 2006894 - DNA, 20 bp, Homo sapiens
cccatgctcaaccactgtgg

SEQ ID NO: 2006895 - DNA, 12 bp, Homo sapiens
cccatgctctgc

SEQ ID NO: 2006896 - DNA, 20 bp, Homo sapiens
cccatgctctgccccaagcc

SEQ ID NO: 2006897 - DNA, 17 bp, Homo sapiens
cccatgctgaattattt

SEQ ID NO: 2006898 - DNA, 23 bp, Homo sapiens
cccatgggggtgctgcagccagg

SEQ ID NO: 2006899 - DNA, 12 bp, Homo sapiens
cccatgtcacct

SEQ ID NO: 2006900 - DNA, 13 bp, Homo sapiens
cccatgtggctga

SEQ ID NO: 2006901 - DNA, 17 bp, Homo sapiens
cccatgtgtcccctcac

SEQ ID NO: 2006902 - DNA, 20 bp, Homo sapiens
cccatgtgtcccctcactct

SEQ ID NO: 2006903 - DNA, 20 bp, Homo sapiens
cccatgtgtgactccagcct

SEQ ID NO: 2006904 - DNA, 24 bp, Homo sapiens
cccatgtttaaactttgtgccttt

SEQ ID NO: 2006905 - DNA, 15 bp, Homo sapiens
cccattcacagagcc

SEQ ID NO: 2006906 - DNA, 14 bp, Homo sapiens
cccattcagacact

SEQ ID NO: 2006907 - DNA, 17 bp, Homo sapiens
cccattcagacacttca

SEQ ID NO: 2006908 - DNA, 22 bp, Homo sapiens
cccattctcatatgtagccctc

SEQ ID NO: 2006909 - DNA, 23 bp, Homo sapiens
cccattctcatatgtagccctca

SEQ ID NO: 2006910 - DNA, 20 bp, Homo sapiens
cccattctctctcctgtcca

SEQ ID NO: 2006911 - DNA, 19 bp, Homo sapiens
cccattctgcctgcccagg

SEQ ID NO: 2006912 - DNA, 22 bp, Homo sapiens
cccattctgcctgcccaggccc

SEQ ID NO: 2006913 - DNA, 19 bp, Homo sapiens
cccattcttcagtgcctag

SEQ ID NO: 2006914 - DNA, 12 bp, Homo sapiens
cccattcttcct

SEQ ID NO: 2006915 - DNA, 21 bp, Homo sapiens
cccattcttcctagttttctc

SEQ ID NO: 2006916 - DNA, 12 bp, Homo sapiens
cccccagacaga

SEQ ID NO: 2006917 - DNA, 12 bp, Homo sapiens
cccccagagacc

SEQ ID NO: 2006918 - DNA, 19 bp, Homo sapiens
cccccagcccacagagcct

SEQ ID NO: 2006919 - DNA, 23 bp, Homo sapiens
cccccagccccgactccagccag

SEQ ID NO: 2006920 - DNA, 12 bp, Homo sapiens
cccccagccctc

SEQ ID NO: 2006921 - DNA, 12 bp, Homo sapiens
cccccagcctct

SEQ ID NO: 2006922 - DNA, 12 bp, Homo sapiens
cccccagcctgg

SEQ ID NO: 2006923 - DNA, 14 bp, Homo sapiens
cccccagcctgggc

SEQ ID NO: 2006924 - DNA, 18 bp, Homo sapiens
cccccaggtgttgccatt

SEQ ID NO: 2006925 - DNA, 16 bp, Homo sapiens
cccccagtgccacaga

SEQ ID NO: 2006926 - DNA, 21 bp, Homo sapiens
cccccagtgccacagagaaga

SEQ ID NO: 2006927 - DNA, 22 bp, Homo sapiens
cccccatgtttaaactttgtgc

SEQ ID NO: 2006928 - DNA, 22 bp, Homo sapiens
cccccgcagtccccagcccttc

SEQ ID NO: 2006929 - DNA, 13 bp, Homo sapiens
cccccgccacggc

SEQ ID NO: 2006930 - DNA, 14 bp, Homo sapiens
cccccgctccagat

SEQ ID NO: 2006931 - DNA, 20 bp, Homo sapiens
ccccctcactccacactggc

SEQ ID NO: 2006932 - DNA, 12 bp, Homo sapiens
ccccctccagct

SEQ ID NO: 2006933 - DNA, 16 bp, Homo sapiens
ccccctccaggcatgc

SEQ ID NO: 2006934 - DNA, 16 bp, Homo sapiens
ccccctcccaccccca

SEQ ID NO: 2006935 - DNA, 13 bp, Homo sapiens
ccccctccccagg

SEQ ID NO: 2006936 - DNA, 23 bp, Homo sapiens
ccccctgcagcttgtagccagcc

SEQ ID NO: 2006937 - DNA, 14 bp, Homo sapiens
ccccctgccagtgc

SEQ ID NO: 2006938 - DNA, 14 bp, Homo sapiens
ccccctgctgctca

SEQ ID NO: 2006939 - DNA, 17 bp, Homo sapiens
ccccctgctgctcatcc

SEQ ID NO: 2006940 - DNA, 23 bp, Homo sapiens
ccccctggatgggcattgggctg

SEQ ID NO: 2006941 - DNA, 15 bp, Homo sapiens
ccccctggccctgcc

SEQ ID NO: 2006942 - DNA, 10 bp, Homo sapiens
ccccctgggc

SEQ ID NO: 2006943 - DNA, 23 bp, Homo sapiens
ccccctggtggacagtcctggga

SEQ ID NO: 2006944 - DNA, 13 bp, Homo sapiens
ccccctgtgccct

SEQ ID NO: 2006945 - DNA, 23 bp, Homo sapiens
cccccttgaatctgcagggagca

SEQ ID NO: 2006946 - DNA, 16 bp, Homo sapiens
ccccgacagcccagcc

SEQ ID NO: 2006947 - DNA, 15 bp, Homo sapiens
ccccgactccagcca

SEQ ID NO: 2006948 - DNA, 16 bp, Homo sapiens
ccccgactccagccag

SEQ ID NO: 2006949 - DNA, 15 bp, Homo sapiens
ccccgcagtccccag

SEQ ID NO: 2006950 - DNA, 18 bp, Homo sapiens
ccccgcagtccccagccc

SEQ ID NO: 2006951 - DNA, 21 bp, Homo sapiens
ccccgcagtccccagcccttc

SEQ ID NO: 2006952 - DNA, 14 bp, Homo sapiens
ccccgccacggcca

SEQ ID NO: 2006953 - DNA, 17 bp, Homo sapiens
ccccgcccagctgcacc

SEQ ID NO: 2006954 - DNA, 23 bp, Homo sapiens
ccccgcccagctgcacctgccag

SEQ ID NO: 2006955 - DNA, 16 bp, Homo sapiens
ccccgcggtgctctgg

SEQ ID NO: 2006956 - DNA, 13 bp, Homo sapiens
ccccgctccagat

SEQ ID NO: 2006957 - DNA, 18 bp, Homo sapiens
ccccgcttccccacagaa

SEQ ID NO: 2006958 - DNA, 15 bp, Homo sapiens
ccccgcttgtccagc

SEQ ID NO: 2006959 - DNA, 16 bp, Homo sapiens
ccccggcctctctctt

SEQ ID NO: 2006960 - DNA, 16 bp, Homo sapiens
ccccgggctctggcca

SEQ ID NO: 2006961 - DNA, 21 bp, Homo sapiens
ccccgggctctggccaccctg

SEQ ID NO: 2006962 - DNA, 17 bp, Homo sapiens
ccccgggggaggaaggg

SEQ ID NO: 2006963 - DNA, 21 bp, Homo sapiens
ccccggggtattagcacctct

SEQ ID NO: 2006964 - DNA, 12 bp, Homo sapiens
ccccgtgtggct

SEQ ID NO: 2006965 - DNA, 21 bp, Homo sapiens
ccccgttccctgtcagaggct

SEQ ID NO: 2006966 - DNA, 17 bp, Homo sapiens
cccctaacctggcttat

SEQ ID NO: 2006967 - DNA, 18 bp, Homo sapiens
cccctaagagagcacctg

SEQ ID NO: 2006968 - DNA, 20 bp, Homo sapiens
cccctagtgctattctgtgt

SEQ ID NO: 2006969 - DNA, 14 bp, Homo sapiens
cccctcactctggc

SEQ ID NO: 2006970 - DNA, 22 bp, Homo sapiens
cccctcactctgtcagccagcc

SEQ ID NO: 2006971 - DNA, 23 bp, Homo sapiens
cccctcagatgatctctccacgg

SEQ ID NO: 2006972 - DNA, 14 bp, Homo sapiens
cccctcagcccttg

SEQ ID NO: 2006973 - DNA, 17 bp, Homo sapiens
cccctcagcccttgccc

SEQ ID NO: 2006974 - DNA, 17 bp, Homo sapiens
cccctccagaccctgcc

SEQ ID NO: 2006975 - DNA, 17 bp, Homo sapiens
cccctcccacccccagc

SEQ ID NO: 2006976 - DNA, 11 bp, Homo sapiens
cccctcccagc

SEQ ID NO: 2006977 - DNA, 12 bp, Homo sapiens
cccctcccaggg

SEQ ID NO: 2006978 - DNA, 17 bp, Homo sapiens
cccctcccccctgtaaa

SEQ ID NO: 2006979 - DNA, 22 bp, Homo sapiens
cccctcctcacagttgccatgt

SEQ ID NO: 2006980 - DNA, 21 bp, Homo sapiens
cccctcgccttttaggctcag

SEQ ID NO: 2006981 - DNA, 18 bp, Homo sapiens
cccctcgctgctgctact

SEQ ID NO: 2006982 - DNA, 15 bp, Homo sapiens
cccctcggagaagag

SEQ ID NO: 2006983 - DNA, 23 bp, Homo sapiens
cccctcgtgtgactctcttggat

SEQ ID NO: 2006984 - DNA, 11 bp, Homo sapiens
cccctctcccc

SEQ ID NO: 2006985 - DNA, 14 bp, Homo sapiens
cccctctccctggg

SEQ ID NO: 2006986 - DNA, 20 bp, Homo sapiens
cccctgaaagtgacagagac

SEQ ID NO: 2006987 - DNA, 13 bp, Homo sapiens
cccctgaagactt

SEQ ID NO: 2006988 - DNA, 20 bp, Homo sapiens
cccctgagtcaactggagca

SEQ ID NO: 2006989 - DNA, 16 bp, Homo sapiens
cccctgccaccctggg

SEQ ID NO: 2006990 - DNA, 12 bp, Homo sapiens
cccctgccaggg

SEQ ID NO: 2006991 - DNA, 15 bp, Homo sapiens
cccctgccagtgcct

SEQ ID NO: 2006992 - DNA, 17 bp, Homo sapiens
cccctgccagtgcctta

SEQ ID NO: 2006993 - DNA, 15 bp, Homo sapiens
cccagcctgtcctgg

SEQ ID NO: 2006994 - DNA, 14 bp, Homo sapiens
cccagcgagccctg

SEQ ID NO: 2006995 - DNA, 15 bp, Homo sapiens
cccagcgagccctgg

SEQ ID NO: 2006996 - DNA, 19 bp, Homo sapiens
cccagcgagccctggtggc

SEQ ID NO: 2006997 - DNA, 23 bp, Homo sapiens
cccagcgagccctggtggcagtg

SEQ ID NO: 2006998 - DNA, 21 bp, Homo sapiens
cccagcgattccctctcccag

SEQ ID NO: 2006999 - DNA, 23 bp, Homo sapiens
cccagcgattccctctcccaggc

SEQ ID NO: 2007000 - DNA, 15 bp, Homo sapiens
cccagctacattcct

SEQ ID NO: 2007001 - DNA, 18 bp, Homo sapiens
cccagctacattcctcag

SEQ ID NO: 2007002 - DNA, 19 bp, Homo sapiens
cccagctacattcctcagc

SEQ ID NO: 2007003 - DNA, 23 bp, Homo sapiens
cccagctacattcctcagctgcc

SEQ ID NO: 2007004 - DNA, 14 bp, Homo sapiens
cccagctactcagg

SEQ ID NO: 2007005 - DNA, 20 bp, Homo sapiens
cccagctactcaggaggctg

SEQ ID NO: 2007006 - DNA, 22 bp, Homo sapiens
cccagctactctgtccaggcca

SEQ ID NO: 2007007 - DNA, 24 bp, Homo sapiens
cccagctactctgtccaggccact

SEQ ID NO: 2007008 - DNA, 16 bp, Homo sapiens
cccagctagggctgga

SEQ ID NO: 2007009 - DNA, 18 bp, Homo sapiens
cccagctatggccccagg

SEQ ID NO: 2007010 - DNA, 21 bp, Homo sapiens
cccagctccttttgtccccag

SEQ ID NO: 2007011 - DNA, 13 bp, Homo sapiens
cccagctctccct

SEQ ID NO: 2007012 - DNA, 13 bp, Homo sapiens
cccagctctggct

SEQ ID NO: 2007013 - DNA, 18 bp, Homo sapiens
cccagctgcacctgccag

SEQ ID NO: 2007014 - DNA, 23 bp, Homo sapiens
cccagctgcacctgccagcctgg

SEQ ID NO: 2007015 - DNA, 12 bp, Homo sapiens
cccagctgcaga

SEQ ID NO: 2007016 - DNA, 11 bp, Homo sapiens
cccagctggcc

SEQ ID NO: 2007017 - DNA, 19 bp, Homo sapiens
cccagctggtgggaagcgt

SEQ ID NO: 2007018 - DNA, 22 bp, Homo sapiens
cccagctggtgggaagcgtctg

SEQ ID NO: 2007019 - DNA, 14 bp, Homo sapiens
cccagctgtagcca

SEQ ID NO: 2007020 - DNA, 21 bp, Homo sapiens
cccagctgtgctctggacagg

SEQ ID NO: 2007021 - DNA, 15 bp, Homo sapiens
cccagcttcctggtg

SEQ ID NO: 2007022 - DNA, 18 bp, Homo sapiens
cccagctttatctgtcac

SEQ ID NO: 2007023 - DNA, 20 bp, Homo sapiens
cccagctttatctgtcacac

SEQ ID NO: 2007024 - DNA, 17 bp, Homo sapiens
cccaggactcaccctca

SEQ ID NO: 2007025 - DNA, 19 bp, Homo sapiens
cccaggagagccagccctc

SEQ ID NO: 2007026 - DNA, 23 bp, Homo sapiens
cccaggagagccagccctccctg

SEQ ID NO: 2007027 - DNA, 14 bp, Homo sapiens
cccaggagccccga

SEQ ID NO: 2007028 - DNA, 21 bp, Homo sapiens
cccaggagccccgaggccttc

SEQ ID NO: 2007029 - DNA, 22 bp, Homo sapiens
cccaggagctgagtcacctcct

SEQ ID NO: 2007030 - DNA, 14 bp, Homo sapiens
cccaggaggggcct

SEQ ID NO: 2007031 - DNA, 17 bp, Homo sapiens
cccaggaggggcctctg

SEQ ID NO: 2007032 - DNA, 14 bp, Homo sapiens
cccaggcaggccac

SEQ ID NO: 2007033 - DNA, 17 bp, Homo sapiens
cccaggcaggtcttgaa

SEQ ID NO: 2007034 - DNA, 22 bp, Homo sapiens
cccaggccaggccaccaggatg

SEQ ID NO: 2007035 - DNA, 16 bp, Homo sapiens
cccaggccccatgacc

SEQ ID NO: 2007036 - DNA, 17 bp, Homo sapiens
cccaggccccatgacct

SEQ ID NO: 2007037 - DNA, 18 bp, Homo sapiens
cccaggcccctgccaccc

SEQ ID NO: 2007038 - DNA, 21 bp, Homo sapiens
cccaggcccctgccaccctgg

SEQ ID NO: 2007039 - DNA, 16 bp, Homo sapiens
cccaggccctccatgg

SEQ ID NO: 2007040 - DNA, 19 bp, Homo sapiens
cccaggccctccatgggct

SEQ ID NO: 2007041 - DNA, 14 bp, Homo sapiens
ccctcagcccttgc

SEQ ID NO: 2007042 - DNA, 19 bp, Homo sapiens
ccctcagcccttgccccca

SEQ ID NO: 2007043 - DNA, 12 bp, Homo sapiens
ccctcaggccag

SEQ ID NO: 2007044 - DNA, 14 bp, Homo sapiens
ccctcaggccagtg

SEQ ID NO: 2007045 - DNA, 18 bp, Homo sapiens
ccctcagtcagttcccgg

SEQ ID NO: 2007046 - DNA, 17 bp, Homo sapiens
ccctcagtgctcggcag

SEQ ID NO: 2007047 - DNA, 20 bp, Homo sapiens
ccctcagtttttcggtggga

SEQ ID NO: 2007048 - DNA, 15 bp, Homo sapiens
ccctcataccatctg

SEQ ID NO: 2007049 - DNA, 13 bp, Homo sapiens
ccctcatcctttt

SEQ ID NO: 2007050 - DNA, 15 bp, Homo sapiens
ccctcattcaggaaa

SEQ ID NO: 2007051 - DNA, 14 bp, Homo sapiens
ccctcattcccctc

SEQ ID NO: 2007052 - DNA, 15 bp, Homo sapiens
ccctcattcccctcg

SEQ ID NO: 2007053 - DNA, 11 bp, Homo sapiens
ccctcattttt

SEQ ID NO: 2007054 - DNA, 13 bp, Homo sapiens
ccctccaaagccc

SEQ ID NO: 2007055 - DNA, 16 bp, Homo sapiens
ccctccacagccgcag

SEQ ID NO: 2007056 - DNA, 15 bp, Homo sapiens
ccctccaccccagga

SEQ ID NO: 2007057 - DNA, 19 bp, Homo sapiens
ccctccaccgcagaaggaa

SEQ ID NO: 2007058 - DNA, 21 bp, Homo sapiens
ccctccacgcctcctggccag

SEQ ID NO: 2007059 - DNA, 12 bp, Homo sapiens
ccctccactgtc

SEQ ID NO: 2007060 - DNA, 18 bp, Homo sapiens
ccctccagaccctgcctg

SEQ ID NO: 2007061 - DNA, 19 bp, Homo sapiens
ccctccagagacaggaaag

SEQ ID NO: 2007062 - DNA, 15 bp, Homo sapiens
ccctccagctccagt

SEQ ID NO: 2007063 - DNA, 13 bp, Homo sapiens
ccctccagctgga

SEQ ID NO: 2007064 - DNA, 11 bp, Homo sapiens
ccctccaggca

SEQ ID NO: 2007065 - DNA, 14 bp, Homo sapiens
ccctccaggcatgc

SEQ ID NO: 2007066 - DNA, 21 bp, Homo sapiens
ccctccatgtggccccaggtg

SEQ ID NO: 2007067 - DNA, 23 bp, Homo sapiens
ccctccatgtggccccaggtgcc

SEQ ID NO: 2007068 - DNA, 17 bp, Homo sapiens
ccctccatgtgggctag

SEQ ID NO: 2007069 - DNA, 12 bp, Homo sapiens
ccctcccaacct

SEQ ID NO: 2007070 - DNA, 14 bp, Homo sapiens
ccctcccaacctca

SEQ ID NO: 2007071 - DNA, 22 bp, Homo sapiens
ccctcccaccatgcgctgctca

SEQ ID NO: 2007072 - DNA, 22 bp, Homo sapiens
ccctcccagggccagggccctg

SEQ ID NO: 2007073 - DNA, 20 bp, Homo sapiens
ccctccccaaacccatcaga

SEQ ID NO: 2007074 - DNA, 16 bp, Homo sapiens
ccctccccacagtcct

SEQ ID NO: 2007075 - DNA, 21 bp, Homo sapiens
ccctccccacagtcctcacag

SEQ ID NO: 2007076 - DNA, 14 bp, Homo sapiens
ccctccccagccct

SEQ ID NO: 2007077 - DNA, 13 bp, Homo sapiens
ccctccccagggg

SEQ ID NO: 2007078 - DNA, 16 bp, Homo sapiens
ccctccccattcacag

SEQ ID NO: 2007079 - DNA, 16 bp, Homo sapiens
ccctcccctgccccca

SEQ ID NO: 2007080 - DNA, 13 bp, Homo sapiens
ccctccctacctg

SEQ ID NO: 2007081 - DNA, 15 bp, Homo sapiens
ccctccctctgcccc

SEQ ID NO: 2007082 - DNA, 16 bp, Homo sapiens
ccctccctctgcccca

SEQ ID NO: 2007083 - DNA, 13 bp, Homo sapiens
ccctccctgactc

SEQ ID NO: 2007084 - DNA, 14 bp, Homo sapiens
ccctccctgcccct

SEQ ID NO: 2007085 - DNA, 12 bp, Homo sapiens
ccctccctggcc

SEQ ID NO: 2007086 - DNA, 13 bp, Homo sapiens
ccctccctggcct

SEQ ID NO: 2007087 - DNA, 14 bp, Homo sapiens
ccctccctggcctc

SEQ ID NO: 2007088 - DNA, 11 bp, Homo sapiens
ccctccctgtc

SEQ ID NO: 2007089 - DNA, 14 bp, Homo sapiens
ccctcccttcaacc

SEQ ID NO: 2007090 - DNA, 13 bp, Homo sapiens
ccctccgccttca

SEQ ID NO: 2007091 - DNA, 21 bp, Homo sapiens
ccctccgccttcactccggtg

SEQ ID NO: 2007092 - DNA, 21 bp, Homo sapiens
ccctcctcacagttgccatgt

SEQ ID NO: 2007093 - DNA, 13 bp, Homo sapiens
ccctcctctgcca

SEQ ID NO: 2007094 - DNA, 12 bp, Homo sapiens
ccctccttccct

SEQ ID NO: 2007095 - DNA, 17 bp, Homo sapiens
ccctccttcccttctct

SEQ ID NO: 2007096 - DNA, 20 bp, Homo sapiens
ccctccttgctctgcaggca

SEQ ID NO: 2007097 - DNA, 14 bp, Homo sapiens
ccctcctttcacca

SEQ ID NO: 2007098 - DNA, 19 bp, Homo sapiens
ccctcgaaccaaggcagcc

SEQ ID NO: 2007099 - DNA, 20 bp, Homo sapiens
ccctcgaaccaaggcagcct

SEQ ID NO: 2007100 - DNA, 21 bp, Homo sapiens
ccctcgaaccaaggcagcctc

SEQ ID NO: 2007101 - DNA, 15 bp, Homo sapiens
ccctcgctgtcctgc

SEQ ID NO: 2007102 - DNA, 16 bp, Homo sapiens
ccctcgctgtcctgct

SEQ ID NO: 2007103 - DNA, 17 bp, Homo sapiens
ccctcggaagccgtctg

SEQ ID NO: 2007104 - DNA, 21 bp, Homo sapiens
ccctcggaagccgtctgactc

SEQ ID NO: 2007105 - DNA, 24 bp, Homo sapiens
ccctcgtccacaggggcaggcctg

SEQ ID NO: 2007106 - DNA, 21 bp, Homo sapiens
ccctcgtcctgtcccagaggt

SEQ ID NO: 2007107 - DNA, 23 bp, Homo sapiens
ccctctaacccccagtgccacag

SEQ ID NO: 2007108 - DNA, 14 bp, Homo sapiens
ccctctatttctct

SEQ ID NO: 2007109 - DNA, 13 bp, Homo sapiens
ccctctccatgcc

SEQ ID NO: 2007110 - DNA, 12 bp, Homo sapiens
ccctctcccagg

SEQ ID NO: 2007111 - DNA, 20 bp, Homo sapiens
ccctctcctcccccaccttc

SEQ ID NO: 2007112 - DNA, 13 bp, Homo sapiens
ccctctcctgggg

SEQ ID NO: 2007113 - DNA, 15 bp, Homo sapiens
ccctctccttcctta

SEQ ID NO: 2007114 - DNA, 14 bp, Homo sapiens
ccctctcttcccta

SEQ ID NO: 2007115 - DNA, 19 bp, Homo sapiens
ccctctgaatggtccaggg

SEQ ID NO: 2007116 - DNA, 20 bp, Homo sapiens
ccctctgagaattccaagga

SEQ ID NO: 2007117 - DNA, 12 bp, Homo sapiens
ccctctgcccca

SEQ ID NO: 2007118 - DNA, 16 bp, Homo sapiens
ccctctgccccaagca

SEQ ID NO: 2007119 - DNA, 16 bp, Homo sapiens
ccctctgccctgtata

SEQ ID NO: 2007120 - DNA, 17 bp, Homo sapiens
ccctctgccctgtatat

SEQ ID NO: 2007121 - DNA, 20 bp, Homo sapiens
ccctctgcgtcccccagccc

SEQ ID NO: 2007122 - DNA, 20 bp, Homo sapiens
ccctctgctccccagtgcta

SEQ ID NO: 2007123 - DNA, 15 bp, Homo sapiens
ccctctggattctct

SEQ ID NO: 2007124 - DNA, 13 bp, Homo sapiens
ccctctggccctg

SEQ ID NO: 2007125 - DNA, 14 bp, Homo sapiens
ccctctggccctgc

SEQ ID NO: 2007126 - DNA, 20 bp, Homo sapiens
ccggcacctacatccccagg

SEQ ID NO: 2007127 - DNA, 14 bp, Homo sapiens
ccggcatgctggcc

SEQ ID NO: 2007128 - DNA, 15 bp, Homo sapiens
ccggcatgctggcct

SEQ ID NO: 2007129 - DNA, 17 bp, Homo sapiens
ccggcatgctggcctgt

SEQ ID NO: 2007130 - DNA, 13 bp, Homo sapiens
ccggccagggcct

SEQ ID NO: 2007131 - DNA, 13 bp, Homo sapiens
ccggcccctgctg

SEQ ID NO: 2007132 - DNA, 15 bp, Homo sapiens
ccggcccctgctggt

SEQ ID NO: 2007133 - DNA, 15 bp, Homo sapiens
ccggcctccactccc

SEQ ID NO: 2007134 - DNA, 13 bp, Homo sapiens
ccggcctcttcca

SEQ ID NO: 2007135 - DNA, 21 bp, Homo sapiens
ccggcctgatgacagagcgag

SEQ ID NO: 2007136 - DNA, 12 bp, Homo sapiens
ccggctccaggc

SEQ ID NO: 2007137 - DNA, 21 bp, Homo sapiens
ccggctccaggctcctttagc

SEQ ID NO: 2007138 - DNA, 13 bp, Homo sapiens
ccggctccccctg

SEQ ID NO: 2007139 - DNA, 15 bp, Homo sapiens
ccggctcctgtcatc

SEQ ID NO: 2007140 - DNA, 14 bp, Homo sapiens
ccggctgcctgccg

SEQ ID NO: 2007141 - DNA, 15 bp, Homo sapiens
ccgggacagacctgg

SEQ ID NO: 2007142 - DNA, 18 bp, Homo sapiens
ccgggacgcttccagacc

SEQ ID NO: 2007143 - DNA, 19 bp, Homo sapiens
ccgggacgcttccagacca

SEQ ID NO: 2007144 - DNA, 21 bp, Homo sapiens
ccgggacgcttccagaccacc

SEQ ID NO: 2007145 - DNA, 22 bp, Homo sapiens
ccgggacgcttccagaccacct

SEQ ID NO: 2007146 - DNA, 23 bp, Homo sapiens
ccgggacgcttccagaccacctg

SEQ ID NO: 2007147 - DNA, 19 bp, Homo sapiens
ccgggactctccccctttc

SEQ ID NO: 2007148 - DNA, 20 bp, Homo sapiens
ccgggagcctccccctcaga

SEQ ID NO: 2007149 - DNA, 22 bp, Homo sapiens
ccgggcactcagaagacactga

SEQ ID NO: 2007150 - DNA, 16 bp, Homo sapiens
ccgggcaggtcctgcc

SEQ ID NO: 2007151 - DNA, 21 bp, Homo sapiens
ccgggcaggtcctgcccatgt

SEQ ID NO: 2007152 - DNA, 13 bp, Homo sapiens
ccgggccactcct

SEQ ID NO: 2007153 - DNA, 19 bp, Homo sapiens
ccgggcctggagaactaga

SEQ ID NO: 2007154 - DNA, 13 bp, Homo sapiens
ccgggcctggggc

SEQ ID NO: 2007155 - DNA, 16 bp, Homo sapiens
ccgggctctggccacc

SEQ ID NO: 2007156 - DNA, 17 bp, Homo sapiens
ccgggctctggccaccc

SEQ ID NO: 2007157 - DNA, 11 bp, Homo sapiens
ccgggctgccc

SEQ ID NO: 2007158 - DNA, 23 bp, Homo sapiens
ccgggctgcccttcgctgccagg

SEQ ID NO: 2007159 - DNA, 19 bp, Homo sapiens
ccgggctgggagctctgca

SEQ ID NO: 2007160 - DNA, 15 bp, Homo sapiens
ccggggaactggcca

SEQ ID NO: 2007161 - DNA, 19 bp, Homo sapiens
ccggggaactggccaagct

SEQ ID NO: 2007162 - DNA, 20 bp, Homo sapiens
ccggggaactggccaagctg

SEQ ID NO: 2007163 - DNA, 21 bp, Homo sapiens
ccggggaagctggcagcactc

SEQ ID NO: 2007164 - DNA, 23 bp, Homo sapiens
ccggggcaaggtctccttactct

SEQ ID NO: 2007165 - DNA, 16 bp, Homo sapiens
ccggggcactttcaga

SEQ ID NO: 2007166 - DNA, 12 bp, Homo sapiens
ccggggctggca

SEQ ID NO: 2007167 - DNA, 16 bp, Homo sapiens
ccggggctggcaagca

SEQ ID NO: 2007168 - DNA, 14 bp, Homo sapiens
ccgggggccagaca

SEQ ID NO: 2007169 - DNA, 19 bp, Homo sapiens
ccggggttcaagccatggc

SEQ ID NO: 2007170 - DNA, 20 bp, Homo sapiens
ccgggtccccagctccccag

SEQ ID NO: 2007171 - DNA, 14 bp, Homo sapiens
ccgggtgccattcc

SEQ ID NO: 2007172 - DNA, 20 bp, Homo sapiens
ccgggtgcctcagagcaggc

SEQ ID NO: 2007173 - DNA, 21 bp, Homo sapiens
ccgggtgcctcagagcaggct

SEQ ID NO: 2007174 - DNA, 20 bp, Homo sapiens
ccgggtgggcctggcctgag

SEQ ID NO: 2007175 - DNA, 20 bp, Homo sapiens
ccgggtgtgcctgccctgga

SEQ ID NO: 2007176 - DNA, 13 bp, Homo sapiens
ccgggtgtggcct

SEQ ID NO: 2007177 - DNA, 14 bp, Homo sapiens
ccgggtgtggcctc

SEQ ID NO: 2007178 - DNA, 20 bp, Homo sapiens
ccgggtgtggcctcagccct

SEQ ID NO: 2007179 - DNA, 17 bp, Homo sapiens
ccgggttctagtctcct

SEQ ID NO: 2007180 - DNA, 18 bp, Homo sapiens
ccggtcccttgagacctc

SEQ ID NO: 2007181 - DNA, 22 bp, Homo sapiens
ccggtcccttgagacctcagcc

SEQ ID NO: 2007182 - DNA, 21 bp, Homo sapiens
ccggtgtggtggctcacgcct

SEQ ID NO: 2007183 - DNA, 22 bp, Homo sapiens
ccgtcatctgcggggcttctgg

SEQ ID NO: 2007184 - DNA, 15 bp, Homo sapiens
ccgtcatgttcctca

SEQ ID NO: 2007185 - DNA, 14 bp, Homo sapiens
ccgtccacccaggc

SEQ ID NO: 2007186 - DNA, 15 bp, Homo sapiens
ccgtccacccaggct

SEQ ID NO: 2007187 - DNA, 23 bp, Homo sapiens
ccgtccacccaggctgcactgca

SEQ ID NO: 2007188 - DNA, 15 bp, Homo sapiens
ccgtccatggcacca

SEQ ID NO: 2007189 - DNA, 18 bp, Homo sapiens
ccgtcccaaacagagggc

SEQ ID NO: 2007190 - DNA, 15 bp, Homo sapiens
ccgtctacagatggc

SEQ ID NO: 2007191 - DNA, 18 bp, Homo sapiens
ccgtctccctaaaataaa

SEQ ID NO: 2007192 - DNA, 14 bp, Homo sapiens
ccgtctctgtcccg

SEQ ID NO: 2007193 - DNA, 14 bp, Homo sapiens
ccgtctgactccag

SEQ ID NO: 2007194 - DNA, 16 bp, Homo sapiens
ccgtctgactccagag

SEQ ID NO: 2007195 - DNA, 20 bp, Homo sapiens
ccgtctgactccagagtctg

SEQ ID NO: 2007196 - DNA, 21 bp, Homo sapiens
ccgtctggggttcagcccctc

SEQ ID NO: 2007197 - DNA, 13 bp, Homo sapiens
ccgtctgtgaatt

SEQ ID NO: 2007198 - DNA, 14 bp, Homo sapiens
ccgtcttctctcca

SEQ ID NO: 2007199 - DNA, 16 bp, Homo sapiens
ccgtgaagcagtgcct

SEQ ID NO: 2007200 - DNA, 17 bp, Homo sapiens
ccgtgaagcagtgcctc

SEQ ID NO: 2007201 - DNA, 15 bp, Homo sapiens
ccgtgcagtacaggc

SEQ ID NO: 2007202 - DNA, 14 bp, Homo sapiens
ccgtgccaagtcca

SEQ ID NO: 2007203 - DNA, 21 bp, Homo sapiens
ccgtgccaagtccaggtcctg

SEQ ID NO: 2007204 - DNA, 22 bp, Homo sapiens
ccgtgcctttctctggctccag

SEQ ID NO: 2007205 - DNA, 16 bp, Homo sapiens
ccgtggaccttcctgc

SEQ ID NO: 2007206 - DNA, 15 bp, Homo sapiens
ccgtggaggctgctc

SEQ ID NO: 2007207 - DNA, 16 bp, Homo sapiens
ccgtggaggctgctcg

SEQ ID NO: 2007208 - DNA, 22 bp, Homo sapiens
ccgtggaggctgctcggggtgc

SEQ ID NO: 2007209 - DNA, 20 bp, Homo sapiens
ccgtggccctgccctctcct

SEQ ID NO: 2007210 - DNA, 16 bp, Homo sapiens
ccgtggcccttcctgg

SEQ ID NO: 2007211 - DNA, 17 bp, Homo sapiens
ccgtggcccttcctgga

SEQ ID NO: 2007212 - DNA, 22 bp, Homo sapiens
ccgtggcccttcctggacagct

SEQ ID NO: 2007213 - DNA, 11 bp, Homo sapiens
ccgtggcttcc

SEQ ID NO: 2007214 - DNA, 23 bp, Homo sapiens
ccgtggcttcccgctcagccctc

SEQ ID NO: 2007215 - DNA, 16 bp, Homo sapiens
ccgtggtccagctctt

SEQ ID NO: 2007216 - DNA, 20 bp, Homo sapiens
ccgtggtccagctcttggcc

SEQ ID NO: 2007217 - DNA, 19 bp, Homo sapiens
ccgtggtctttgaataaag

SEQ ID NO: 2007218 - DNA, 13 bp, Homo sapiens
ccgtgtccagcac

SEQ ID NO: 2007219 - DNA, 16 bp, Homo sapiens
ccgtgtccagcacaga

SEQ ID NO: 2007220 - DNA, 19 bp, Homo sapiens
ccgtgtccagcacagaagg

SEQ ID NO: 2007221 - DNA, 16 bp, Homo sapiens
ccgtgtcccaaggagc

SEQ ID NO: 2007222 - DNA, 13 bp, Homo sapiens
ccgtgtcctgcct

SEQ ID NO: 2007223 - DNA, 16 bp, Homo sapiens
ccgtgtctctgaggac

SEQ ID NO: 2007224 - DNA, 13 bp, Homo sapiens
ccgttactctcca

SEQ ID NO: 2007225 - DNA, 18 bp, Homo sapiens
ccgttctgctggcctgga

SEQ ID NO: 2007226 - DNA, 14 bp, Homo sapiens
ccgttttcatcctg

SEQ ID NO: 2007227 - DNA, 14 bp, Homo sapiens
cctaaaatgacagc

SEQ ID NO: 2007228 - DNA, 15 bp, Homo sapiens
cctaaaattcagtgg

SEQ ID NO: 2007229 - DNA, 15 bp, Homo sapiens
cctaaagaggaaaag

SEQ ID NO: 2007230 - DNA, 18 bp, Homo sapiens
cctaaagagttattcaaa

SEQ ID NO: 2007231 - DNA, 14 bp, Homo sapiens
cctaaatccaaaga

SEQ ID NO: 2007232 - DNA, 16 bp, Homo sapiens
cctaaatccaaagaaa

SEQ ID NO: 2007233 - DNA, 16 bp, Homo sapiens
cctaaatgacctcagc

SEQ ID NO: 2007234 - DNA, 19 bp, Homo sapiens
cctaacgggggtgcggcag

SEQ ID NO: 2007235 - DNA, 22 bp, Homo sapiens
cctaacgggggtgcggcaggag

SEQ ID NO: 2007236 - DNA, 14 bp, Homo sapiens
cctaagaagctctg

SEQ ID NO: 2007237 - DNA, 12 bp, Homo sapiens
cctaagcctgtt

SEQ ID NO: 2007238 - DNA, 14 bp, Homo sapiens
cctaagtggctgct

SEQ ID NO: 2007239 - DNA, 22 bp, Homo sapiens
cctctgtctcgagcgccctgca

SEQ ID NO: 2007240 - DNA, 23 bp, Homo sapiens
cctctgtctcgagcgccctgcag

SEQ ID NO: 2007241 - DNA, 17 bp, Homo sapiens
cctctgtctctgctctt

SEQ ID NO: 2007242 - DNA, 21 bp, Homo sapiens
cctcttaaagctgcctgtagt

SEQ ID NO: 2007243 - DNA, 21 bp, Homo sapiens
cctcttaatgtatgattacat

SEQ ID NO: 2007244 - DNA, 16 bp, Homo sapiens
cctcttattcctaagg

SEQ ID NO: 2007245 - DNA, 12 bp, Homo sapiens
cctcttccccac

SEQ ID NO: 2007246 - DNA, 13 bp, Homo sapiens
cctcttcctgcca

SEQ ID NO: 2007247 - DNA, 13 bp, Homo sapiens
cctcttccttccc

SEQ ID NO: 2007248 - DNA, 17 bp, Homo sapiens
cctcttctcttcctgta

SEQ ID NO: 2007249 - DNA, 16 bp, Homo sapiens
cctcttctgccaagag

SEQ ID NO: 2007250 - DNA, 17 bp, Homo sapiens
cctcttcttcttcagaa

SEQ ID NO: 2007251 - DNA, 15 bp, Homo sapiens
cctcttggacctctg

SEQ ID NO: 2007252 - DNA, 17 bp, Homo sapiens
cctcttggacctctgct

SEQ ID NO: 2007253 - DNA, 24 bp, Homo sapiens
cctcttgggcatgctcagcccttc

SEQ ID NO: 2007254 - DNA, 17 bp, Homo sapiens
cctcttgttgcagagat

SEQ ID NO: 2007255 - DNA, 12 bp, Homo sapiens
cctctttaagag

SEQ ID NO: 2007256 - DNA, 15 bp, Homo sapiens
cctctttactccctt

SEQ ID NO: 2007257 - DNA, 19 bp, Homo sapiens
cctctttactcccttcctg

SEQ ID NO: 2007258 - DNA, 23 bp, Homo sapiens
cctctttactcccttcctggcct

SEQ ID NO: 2007259 - DNA, 16 bp, Homo sapiens
cctctttccccacctc

SEQ ID NO: 2007260 - DNA, 17 bp, Homo sapiens
cctctttccccacctct

SEQ ID NO: 2007261 - DNA, 13 bp, Homo sapiens
cctctttctctcc

SEQ ID NO: 2007262 - DNA, 15 bp, Homo sapiens
cctctttctctcctt

SEQ ID NO: 2007263 - DNA, 17 bp, Homo sapiens
cctctttctctccttct

SEQ ID NO: 2007264 - DNA, 15 bp, Homo sapiens
cctctttgcatggaa

SEQ ID NO: 2007265 - DNA, 21 bp, Homo sapiens
cctctttgcctgtgtgagcat

SEQ ID NO: 2007266 - DNA, 16 bp, Homo sapiens
cctcttttccctctct

SEQ ID NO: 2007267 - DNA, 17 bp, Homo sapiens
cctcttttccctctcta

SEQ ID NO: 2007268 - DNA, 14 bp, Homo sapiens
cctcttttggcctt

SEQ ID NO: 2007269 - DNA, 15 bp, Homo sapiens
cctgaaatttcagat

SEQ ID NO: 2007270 - DNA, 13 bp, Homo sapiens
cctgaacaagaat

SEQ ID NO: 2007271 - DNA, 15 bp, Homo sapiens
cctgaacatgacatt

SEQ ID NO: 2007272 - DNA, 23 bp, Homo sapiens
cctgaaccccatgggcttggact

SEQ ID NO: 2007273 - DNA, 14 bp, Homo sapiens
cctgaacctcagtt

SEQ ID NO: 2007274 - DNA, 18 bp, Homo sapiens
cctgaacctcagtttcct

SEQ ID NO: 2007275 - DNA, 14 bp, Homo sapiens
cctgaagatttcag

SEQ ID NO: 2007276 - DNA, 23 bp, Homo sapiens
cctgaagatttcagaggctgcag

SEQ ID NO: 2007277 - DNA, 13 bp, Homo sapiens
cctgaaggttcct

SEQ ID NO: 2007278 - DNA, 16 bp, Homo sapiens
cctgaagtcacacagt

SEQ ID NO: 2007279 - DNA, 20 bp, Homo sapiens
cctgaagtcacacagtgagt

SEQ ID NO: 2007280 - DNA, 20 bp, Homo sapiens
cctgaatggttccatgcctg

SEQ ID NO: 2007281 - DNA, 16 bp, Homo sapiens
cctgaatttgtaagca

SEQ ID NO: 2007282 - DNA, 14 bp, Homo sapiens
cctgacaatggcag

SEQ ID NO: 2007283 - DNA, 16 bp, Homo sapiens
cctgacagaaggactc

SEQ ID NO: 2007284 - DNA, 18 bp, Homo sapiens
cctgacagtcttgtgctt

SEQ ID NO: 2007285 - DNA, 14 bp, Homo sapiens
cctgacatgtctca

SEQ ID NO: 2007286 - DNA, 19 bp, Homo sapiens
cctgaccaacatggagaaa

SEQ ID NO: 2007287 - DNA, 15 bp, Homo sapiens
cctgacccagtcccc

SEQ ID NO: 2007288 - DNA, 15 bp, Homo sapiens
cctgacccctgcacc

SEQ ID NO: 2007289 - DNA, 23 bp, Homo sapiens
cctgaccctccaccgcagaagga

SEQ ID NO: 2007290 - DNA, 15 bp, Homo sapiens
cctgaccggcacctg

SEQ ID NO: 2007291 - DNA, 18 bp, Homo sapiens
cctgacctcccagcccta

SEQ ID NO: 2007292 - DNA, 20 bp, Homo sapiens
cctgacctcctcctgccctc

SEQ ID NO: 2007293 - DNA, 21 bp, Homo sapiens
cctgacgccctgcgttggagc

SEQ ID NO: 2007294 - DNA, 20 bp, Homo sapiens
cctgactccagtgagctgga

SEQ ID NO: 2007295 - DNA, 17 bp, Homo sapiens
cctgactccctgtgggg

SEQ ID NO: 2007296 - DNA, 21 bp, Homo sapiens
cctgactccctgtgggggtgg

SEQ ID NO: 2007297 - DNA, 20 bp, Homo sapiens
cctgactcctctaagccact

SEQ ID NO: 2007298 - DNA, 16 bp, Homo sapiens
cctgactctctgtgac

SEQ ID NO: 2007299 - DNA, 13 bp, Homo sapiens
cctgactgacaca

SEQ ID NO: 2007300 - DNA, 14 bp, Homo sapiens
cctgactgacacag

SEQ ID NO: 2007301 - DNA, 17 bp, Homo sapiens
cctgactgacacaggcc

SEQ ID NO: 2007302 - DNA, 18 bp, Homo sapiens
cctgactgacacaggcca

SEQ ID NO: 2007303 - DNA, 21 bp, Homo sapiens
cctgactggtgctataggctg

SEQ ID NO: 2007304 - DNA, 24 bp, Homo sapiens
cctgactgtgttcagtgccttgga

SEQ ID NO: 2007305 - DNA, 12 bp, Homo sapiens
cctgagaccaca

SEQ ID NO: 2007306 - DNA, 18 bp, Homo sapiens
cctgagaccacagagaga

SEQ ID NO: 2007307 - DNA, 18 bp, Homo sapiens
cctgagaccatttaacat

SEQ ID NO: 2007308 - DNA, 13 bp, Homo sapiens
cctgagactccag

SEQ ID NO: 2007309 - DNA, 15 bp, Homo sapiens
cctgagactccagaa

SEQ ID NO: 2007310 - DNA, 20 bp, Homo sapiens
cctgagagaaactgaggtca

SEQ ID NO: 2007311 - DNA, 17 bp, Homo sapiens
cctgagaggtgctgcag

SEQ ID NO: 2007312 - DNA, 23 bp, Homo sapiens
cctgagcaacagagtgagaccct

SEQ ID NO: 2007313 - DNA, 15 bp, Homo sapiens
cctgagcactgccag

SEQ ID NO: 2007314 - DNA, 16 bp, Homo sapiens
cctgagcactgccagg

SEQ ID NO: 2007315 - DNA, 17 bp, Homo sapiens
cctgagcactgccagga

SEQ ID NO: 2007316 - DNA, 18 bp, Homo sapiens
cctgagcactgccaggag

SEQ ID NO: 2007317 - DNA, 20 bp, Homo sapiens
cctgagcactgccaggaggg

SEQ ID NO: 2007318 - DNA, 12 bp, Homo sapiens
cctgagcccagg

SEQ ID NO: 2007319 - DNA, 14 bp, Homo sapiens
cctgagcccaggag

SEQ ID NO: 2007320 - DNA, 16 bp, Homo sapiens
cctgagcccaggagct

SEQ ID NO: 2007321 - DNA, 17 bp, Homo sapiens
cctgagcccagggaggc

SEQ ID NO: 2007322 - DNA, 18 bp, Homo sapiens
cctgagcccagggaggcc

SEQ ID NO: 2007323 - DNA, 14 bp, Homo sapiens
cctgagcctgccga

SEQ ID NO: 2007324 - DNA, 15 bp, Homo sapiens
cctgagcctgccgag

SEQ ID NO: 2007325 - DNA, 20 bp, Homo sapiens
cctgagcctgccgagcaacc

SEQ ID NO: 2007326 - DNA, 23 bp, Homo sapiens
cctgagcctgccgagcaaccgtg

SEQ ID NO: 2007327 - DNA, 13 bp, Homo sapiens
cctgagccttttc

SEQ ID NO: 2007328 - DNA, 21 bp, Homo sapiens
cctgagctagaagctggagga

SEQ ID NO: 2007329 - DNA, 15 bp, Homo sapiens
cctgagctcaggctg

SEQ ID NO: 2007330 - DNA, 18 bp, Homo sapiens
cctgagctcaggctgagc

SEQ ID NO: 2007331 - DNA, 19 bp, Homo sapiens
cctgagctcaggctgagcc

SEQ ID NO: 2007332 - DNA, 19 bp, Homo sapiens
cctgagctcggtggaccca

SEQ ID NO: 2007333 - DNA, 11 bp, Homo sapiens
cctgagctggg

SEQ ID NO: 2007334 - DNA, 17 bp, Homo sapiens
cctgagctggggccaca

SEQ ID NO: 2007335 - DNA, 21 bp, Homo sapiens
cctgaggagctgttggcctgg

SEQ ID NO: 2007336 - DNA, 16 bp, Homo sapiens
cctgaggagtctgagg

SEQ ID NO: 2007337 - DNA, 18 bp, Homo sapiens
cctgaggagtctgaggtc

SEQ ID NO: 2007338 - DNA, 17 bp, Homo sapiens
cctgaggctcaagaggc

SEQ ID NO: 2007339 - DNA, 19 bp, Homo sapiens
cctgaggctcaagaggccc

SEQ ID NO: 2007340 - DNA, 21 bp, Homo sapiens
cctgaggctgagactgcggga

SEQ ID NO: 2007341 - DNA, 15 bp, Homo sapiens
cctgagggtggagac

SEQ ID NO: 2007342 - DNA, 16 bp, Homo sapiens
cctgagggtggagact

SEQ ID NO: 2007343 - DNA, 21 bp, Homo sapiens
cctgagtcggccccacatggg

SEQ ID NO: 2007344 - DNA, 22 bp, Homo sapiens
cctgagtcggccccacatggga

SEQ ID NO: 2007345 - DNA, 23 bp, Homo sapiens
cctgagtctgctatattttcatg

SEQ ID NO: 2007346 - DNA, 19 bp, Homo sapiens
cctgagtggctgaaataaa

SEQ ID NO: 2007347 - DNA, 14 bp, Homo sapiens
cctgagtggggcca

SEQ ID NO: 2007348 - DNA, 19 bp, Homo sapiens
cctgataacaacctggaga

SEQ ID NO: 2007349 - DNA, 23 bp, Homo sapiens
cctgatactgggtacaagagcca

SEQ ID NO: 2007350 - DNA, 20 bp, Homo sapiens
cctgatcattacatggctgt

SEQ ID NO: 2007351 - DNA, 22 bp, Homo sapiens
cctgatcattacatggctgtgg

SEQ ID NO: 2007352 - DNA, 12 bp, Homo sapiens
cctgatgcccct

SEQ ID NO: 2007353 - DNA, 15 bp, Homo sapiens
cctgatgccccttcc

SEQ ID NO: 2007354 - DNA, 12 bp, Homo sapiens
cctgcctgtgtt

SEQ ID NO: 2007355 - DNA, 18 bp, Homo sapiens
cctgccttcttcggggaa

SEQ ID NO: 2007356 - DNA, 21 bp, Homo sapiens
cctgccttgatgaagcctgtg

SEQ ID NO: 2007357 - DNA, 23 bp, Homo sapiens
cctgccttgatgaagcctgtgcc

SEQ ID NO: 2007358 - DNA, 19 bp, Homo sapiens
cctgcgaaggggccctggt

SEQ ID NO: 2007359 - DNA, 20 bp, Homo sapiens
cctgcgaaggggccctggtc

SEQ ID NO: 2007360 - DNA, 15 bp, Homo sapiens
ctcaagaggcccagg

SEQ ID NO: 2007361 - DNA, 19 bp, Homo sapiens
ctcaagaggcccagggagc

SEQ ID NO: 2007362 - DNA, 20 bp, Homo sapiens
ctcaagaggcccagggagca

SEQ ID NO: 2007363 - DNA, 19 bp, Homo sapiens
ctcaagagggcactggtgg

SEQ ID NO: 2007364 - DNA, 21 bp, Homo sapiens
ctcaagagggcactggtggcc

SEQ ID NO: 2007365 - DNA, 16 bp, Homo sapiens
ctcaagatgaaggcaa

SEQ ID NO: 2007366 - DNA, 18 bp, Homo sapiens
ctcaagattatattataa

SEQ ID NO: 2007367 - DNA, 15 bp, Homo sapiens
ctcaagggtccagaa

SEQ ID NO: 2007368 - DNA, 16 bp, Homo sapiens
ctcaagggtccagaag

SEQ ID NO: 2007369 - DNA, 17 bp, Homo sapiens
ctcaagtcttccctgat

SEQ ID NO: 2007370 - DNA, 12 bp, Homo sapiens
ctcaagttttta

SEQ ID NO: 2007371 - DNA, 22 bp, Homo sapiens
ctcaataaaatcatgtacattt

SEQ ID NO: 2007372 - DNA, 19 bp, Homo sapiens
ctcaatattcaataaagct

SEQ ID NO: 2007373 - DNA, 16 bp, Homo sapiens
ctcaatattcctgaat

SEQ ID NO: 2007374 - DNA, 13 bp, Homo sapiens
ctcaatattttcc

SEQ ID NO: 2007375 - DNA, 15 bp, Homo sapiens
ctcaatgcactgaca

SEQ ID NO: 2007376 - DNA, 14 bp, Homo sapiens
ctcaatgccctgcc

SEQ ID NO: 2007377 - DNA, 16 bp, Homo sapiens
ctcaatgtgaccaggg

SEQ ID NO: 2007378 - DNA, 18 bp, Homo sapiens
ctcaattgttcttttcct

SEQ ID NO: 2007379 - DNA, 13 bp, Homo sapiens
ctcacaactgttt

SEQ ID NO: 2007380 - DNA, 20 bp, Homo sapiens
ctcacaactgtttttgaaga

SEQ ID NO: 2007381 - DNA, 15 bp, Homo sapiens
ctcacaagaagacca

SEQ ID NO: 2007382 - DNA, 13 bp, Homo sapiens
ctcacaagcccag

SEQ ID NO: 2007383 - DNA, 20 bp, Homo sapiens
ctcacaaggcagcaaggccc

SEQ ID NO: 2007384 - DNA, 22 bp, Homo sapiens
ctcacactggtggaggagctgg

SEQ ID NO: 2007385 - DNA, 21 bp, Homo sapiens
ctcacacttgggcgctctgcc

SEQ ID NO: 2007386 - DNA, 14 bp, Homo sapiens
ctcacagcctctcc

SEQ ID NO: 2007387 - DNA, 17 bp, Homo sapiens
ctcacagcctctccctt

SEQ ID NO: 2007388 - DNA, 20 bp, Homo sapiens
ctcacaggagcagacagaga

SEQ ID NO: 2007389 - DNA, 19 bp, Homo sapiens
ctcacagtctctttaatct

SEQ ID NO: 2007390 - DNA, 20 bp, Homo sapiens
ctcacagtctctttaatctt

SEQ ID NO: 2007391 - DNA, 19 bp, Homo sapiens
ctcacagttcctcgccctg

SEQ ID NO: 2007392 - DNA, 20 bp, Homo sapiens
ctcacagttcctcgccctgg

SEQ ID NO: 2007393 - DNA, 11 bp, Homo sapiens
ctcacatgccg

SEQ ID NO: 2007394 - DNA, 15 bp, Homo sapiens
ctcacatttattctg

SEQ ID NO: 2007395 - DNA, 22 bp, Homo sapiens
ctcaccaataacttcagagaag

SEQ ID NO: 2007396 - DNA, 20 bp, Homo sapiens
ctcaccagaattgtgcaaat

SEQ ID NO: 2007397 - DNA, 13 bp, Homo sapiens
ctcaccagcccca

SEQ ID NO: 2007398 - DNA, 14 bp, Homo sapiens
ctcaccagccccag

SEQ ID NO: 2007399 - DNA, 17 bp, Homo sapiens
ctcaccagccccagtgc

SEQ ID NO: 2007400 - DNA, 18 bp, Homo sapiens
ctcaccagccccagtgcc

SEQ ID NO: 2007401 - DNA, 22 bp, Homo sapiens
ctcaccagggtccgcaccagct

SEQ ID NO: 2007402 - DNA, 23 bp, Homo sapiens
ctcaccagggtccgcaccagctg

SEQ ID NO: 2007403 - DNA, 20 bp, Homo sapiens
ctcaccagtgtcccctccac

SEQ ID NO: 2007404 - DNA, 16 bp, Homo sapiens
ctcacccatgtgccaa

SEQ ID NO: 2007405 - DNA, 12 bp, Homo sapiens
ctcaccccaagg

SEQ ID NO: 2007406 - DNA, 14 bp, Homo sapiens
ctcacccccagctt

SEQ ID NO: 2007407 - DNA, 20 bp, Homo sapiens
ctcacccccaggtgttgcca

SEQ ID NO: 2007408 - DNA, 15 bp, Homo sapiens
ctcaccccgtctggg

SEQ ID NO: 2007409 - DNA, 14 bp, Homo sapiens
ctcacccgaggctg

SEQ ID NO: 2007410 - DNA, 21 bp, Homo sapiens
ctcacccgccccactccctcc

SEQ ID NO: 2007411 - DNA, 15 bp, Homo sapiens
ctcaccctcatacca

SEQ ID NO: 2007412 - DNA, 19 bp, Homo sapiens
ctcaccggcatgctggcct

SEQ ID NO: 2007413 - DNA, 13 bp, Homo sapiens
ctcacctctgcct

SEQ ID NO: 2007414 - DNA, 15 bp, Homo sapiens
ctcacctctgcctca

SEQ ID NO: 2007415 - DNA, 19 bp, Homo sapiens
ctcacctctgcctcaatgt

SEQ ID NO: 2007416 - DNA, 14 bp, Homo sapiens
ctcacctgggcctt

SEQ ID NO: 2007417 - DNA, 24 bp, Homo sapiens
ctcacctgggcctttcctgtgcca

SEQ ID NO: 2007418 - DNA, 16 bp, Homo sapiens
ctcacctggttgaccc

SEQ ID NO: 2007419 - DNA, 17 bp, Homo sapiens
ctcacctggttgaccca

SEQ ID NO: 2007420 - DNA, 21 bp, Homo sapiens
ctcaccttgtgctggggacag

SEQ ID NO: 2007421 - DNA, 20 bp, Homo sapiens
ctcacctttgcaaagttaca

SEQ ID NO: 2007422 - DNA, 19 bp, Homo sapiens
ctcacgactcttcctgcaa

SEQ ID NO: 2007423 - DNA, 14 bp, Homo sapiens
ctcacgcccagcct

SEQ ID NO: 2007424 - DNA, 19 bp, Homo sapiens
ctcacgcctgtaatcccag

SEQ ID NO: 2007425 - DNA, 22 bp, Homo sapiens
ctcacgcctgtaatcccagcac

SEQ ID NO: 2007426 - DNA, 22 bp, Homo sapiens
ctcacgcctgtaatcccagcat

SEQ ID NO: 2007427 - DNA, 20 bp, Homo sapiens
cctgcgaagtggctctcagg

SEQ ID NO: 2007428 - DNA, 16 bp, Homo sapiens
cctgcggccgggctgc

SEQ ID NO: 2007429 - DNA, 18 bp, Homo sapiens
cctgcggccgggctgccc

SEQ ID NO: 2007430 - DNA, 16 bp, Homo sapiens
cctgcggctgctgtgt

SEQ ID NO: 2007431 - DNA, 23 bp, Homo sapiens
cctgcgtcgaagctttgaaggcc

SEQ ID NO: 2007432 - DNA, 15 bp, Homo sapiens
cctgcgtgccgggag

SEQ ID NO: 2007433 - DNA, 15 bp, Homo sapiens
cctgcgttggagcca

SEQ ID NO: 2007434 - DNA, 20 bp, Homo sapiens
cctgcgttggagccactcct

SEQ ID NO: 2007435 - DNA, 17 bp, Homo sapiens
cctgctaaatgaagaga

SEQ ID NO: 2007436 - DNA, 13 bp, Homo sapiens
cctgctaatagct

SEQ ID NO: 2007437 - DNA, 18 bp, Homo sapiens
cctgctaccaaggcccag

SEQ ID NO: 2007438 - DNA, 15 bp, Homo sapiens
cctgctagagcaacc

SEQ ID NO: 2007439 - DNA, 15 bp, Homo sapiens
cctgctatttgaagt

SEQ ID NO: 2007440 - DNA, 15 bp, Homo sapiens
cctgctcccagcagc

SEQ ID NO: 2007441 - DNA, 23 bp, Homo sapiens
cctgctcccagcagccctaagga

SEQ ID NO: 2007442 - DNA, 16 bp, Homo sapiens
cctgctcccccacccc

SEQ ID NO: 2007443 - DNA, 23 bp, Homo sapiens
cctgctcccccaccccctcccca

SEQ ID NO: 2007444 - DNA, 22 bp, Homo sapiens
cctgctctccgaccagacacct

SEQ ID NO: 2007445 - DNA, 19 bp, Homo sapiens
cctgctgaaacacctccca

SEQ ID NO: 2007446 - DNA, 23 bp, Homo sapiens
cctgctgaatgatttccaaagag

SEQ ID NO: 2007447 - DNA, 17 bp, Homo sapiens
cctgctgagagacccaa

SEQ ID NO: 2007448 - DNA, 20 bp, Homo sapiens
cctgctgagagacccaagga

SEQ ID NO: 2007449 - DNA, 12 bp, Homo sapiens
cctgctgagctc

SEQ ID NO: 2007450 - DNA, 14 bp, Homo sapiens
cctgctgagctctg

SEQ ID NO: 2007451 - DNA, 15 bp, Homo sapiens
cctgctgagctctga

SEQ ID NO: 2007452 - DNA, 17 bp, Homo sapiens
cctgctgagctctgaga

SEQ ID NO: 2007453 - DNA, 18 bp, Homo sapiens
cctgctgagctctgagag

SEQ ID NO: 2007454 - DNA, 21 bp, Homo sapiens
cctgctgccgcctcccagcct

SEQ ID NO: 2007455 - DNA, 15 bp, Homo sapiens
cctgctgcctaataa

SEQ ID NO: 2007456 - DNA, 19 bp, Homo sapiens
cctgctgctgagaacctgg

SEQ ID NO: 2007457 - DNA, 22 bp, Homo sapiens
cctgctgctgagaacctggcct

SEQ ID NO: 2007458 - DNA, 11 bp, Homo sapiens
cctgctgctgt

SEQ ID NO: 2007459 - DNA, 22 bp, Homo sapiens
cctgctgctgtaactgctgagc

SEQ ID NO: 2007460 - DNA, 20 bp, Homo sapiens
cctgctggaaaccacacttc

SEQ ID NO: 2007461 - DNA, 16 bp, Homo sapiens
cctgctggcacctcag

SEQ ID NO: 2007462 - DNA, 21 bp, Homo sapiens
cctgctggcacctcagacaat

SEQ ID NO: 2007463 - DNA, 21 bp, Homo sapiens
cctgctgggaaccccgcagcc

SEQ ID NO: 2007464 - DNA, 23 bp, Homo sapiens
cctgctgggctctccacctcagc

SEQ ID NO: 2007465 - DNA, 17 bp, Homo sapiens
cctgctgggtaaactgt

SEQ ID NO: 2007466 - DNA, 15 bp, Homo sapiens
cctgctgtggcctca

SEQ ID NO: 2007467 - DNA, 13 bp, Homo sapiens
cctgctgtgggag

SEQ ID NO: 2007468 - DNA, 22 bp, Homo sapiens
cctgctgtgtgaattcccaggt

SEQ ID NO: 2007469 - DNA, 12 bp, Homo sapiens
cctgcttctctg

SEQ ID NO: 2007470 - DNA, 18 bp, Homo sapiens
cctgcttgaaggaacagt

SEQ ID NO: 2007471 - DNA, 18 bp, Homo sapiens
cctgcttgtccctgccca

SEQ ID NO: 2007472 - DNA, 14 bp, Homo sapiens
cctgctttccctcc

SEQ ID NO: 2007473 - DNA, 18 bp, Homo sapiens
cctgctttgaggacaaag

SEQ ID NO: 2007474 - DNA, 22 bp, Homo sapiens
cctgctttgggctgccctggtg

SEQ ID NO: 2007475 - DNA, 14 bp, Homo sapiens
cctgcttttccagg

SEQ ID NO: 2007476 - DNA, 22 bp, Homo sapiens
cctgcttttccaggatcctgca

SEQ ID NO: 2007477 - DNA, 15 bp, Homo sapiens
cctggaaaggctcag

SEQ ID NO: 2007478 - DNA, 22 bp, Homo sapiens
cctggaaaggctcagtctcagg

SEQ ID NO: 2007479 - DNA, 14 bp, Homo sapiens
cctggaaaggggag

SEQ ID NO: 2007480 - DNA, 21 bp, Homo sapiens
cctggaagctgtgtccttgca

SEQ ID NO: 2007481 - DNA, 18 bp, Homo sapiens
cctggaatcaaggaatcc

SEQ ID NO: 2007482 - DNA, 18 bp, Homo sapiens
cctggaattcagcaccct

SEQ ID NO: 2007483 - DNA, 19 bp, Homo sapiens
cctggaatttaattcaaag

SEQ ID NO: 2007484 - DNA, 14 bp, Homo sapiens
cctggacagctgtg

SEQ ID NO: 2007485 - DNA, 17 bp, Homo sapiens
cctggacagctgtgcct

SEQ ID NO: 2007486 - DNA, 20 bp, Homo sapiens
cctggacagctgtgcctcgc

SEQ ID NO: 2007487 - DNA, 21 bp, Homo sapiens
cctggacagctgtgcctcgct

SEQ ID NO: 2007488 - DNA, 20 bp, Homo sapiens
cctggacatttgccttgctg

SEQ ID NO: 2007489 - DNA, 22 bp, Homo sapiens
cctggaccaccagccccagcaa

SEQ ID NO: 2007490 - DNA, 17 bp, Homo sapiens
cctggaccgcttcccag

SEQ ID NO: 2007491 - DNA, 18 bp, Homo sapiens
cctggaccgcttcccaga

SEQ ID NO: 2007492 - DNA, 19 bp, Homo sapiens
cctggaccgcttcccagag

SEQ ID NO: 2007493 - DNA, 21 bp, Homo sapiens
cctggaccgcttcccagaggc

SEQ ID NO: 2007494 - DNA, 20 bp, Homo sapiens
cctggacctgagtcggcccc

SEQ ID NO: 2007495 - DNA, 13 bp, Homo sapiens
cctggactgggag

SEQ ID NO: 2007496 - DNA, 21 bp, Homo sapiens
cctggactttggttctctcca

SEQ ID NO: 2007497 - DNA, 11 bp, Homo sapiens
cctggagaagc

SEQ ID NO: 2007498 - DNA, 23 bp, Homo sapiens
cctggagagccagaacctggagg

SEQ ID NO: 2007499 - DNA, 19 bp, Homo sapiens
cctggagagctagaaccta

SEQ ID NO: 2007500 - DNA, 21 bp, Homo sapiens
cctggagagctagaacctgga

SEQ ID NO: 2007501 - DNA, 22 bp, Homo sapiens
cctggagagctagaacctggag

SEQ ID NO: 2007502 - DNA, 17 bp, Homo sapiens
cctggagaggggcctgg

SEQ ID NO: 2007503 - DNA, 21 bp, Homo sapiens
cctggagatgacttgaggcct

SEQ ID NO: 2007504 - DNA, 12 bp, Homo sapiens
cctggagatgat

SEQ ID NO: 2007505 - DNA, 16 bp, Homo sapiens
cctggagcggctctcc

SEQ ID NO: 2007506 - DNA, 20 bp, Homo sapiens
cctggagcggctctcctgag

SEQ ID NO: 2007507 - DNA, 18 bp, Homo sapiens
cctggaggacctgagcct

SEQ ID NO: 2007508 - DNA, 20 bp, Homo sapiens
cctggaggatccctccatcc

SEQ ID NO: 2007509 - DNA, 12 bp, Homo sapiens
cctggaggatga

SEQ ID NO: 2007510 - DNA, 14 bp, Homo sapiens
cctggagggaggct

SEQ ID NO: 2007511 - DNA, 20 bp, Homo sapiens
cctggagggctagaacctag

SEQ ID NO: 2007512 - DNA, 21 bp, Homo sapiens
cctggaggggctagaacctag

SEQ ID NO: 2007513 - DNA, 15 bp, Homo sapiens
cctggaggtgggaga

SEQ ID NO: 2007514 - DNA, 15 bp, Homo sapiens
cctggagtataatat

SEQ ID NO: 2007515 - DNA, 16 bp, Homo sapiens
cctggagtcccctggg

SEQ ID NO: 2007516 - DNA, 14 bp, Homo sapiens
cctggagtgcagtt

SEQ ID NO: 2007517 - DNA, 17 bp, Homo sapiens
cctggatcagcgtggcc

SEQ ID NO: 2007518 - DNA, 15 bp, Homo sapiens
cctggatgtcccctg

SEQ ID NO: 2007519 - DNA, 20 bp, Homo sapiens
cctggatgtgtggggcatgg

SEQ ID NO: 2007520 - DNA, 22 bp, Homo sapiens
cctggcaagctagaacctggag

SEQ ID NO: 2007521 - DNA, 23 bp, Homo sapiens
cctggcaagctagaacctggagg

SEQ ID NO: 2007522 - DNA, 12 bp, Homo sapiens
cctggcacacat

SEQ ID NO: 2007523 - DNA, 21 bp, Homo sapiens
cctggcacacatcaggagttc

SEQ ID NO: 2007524 - DNA, 16 bp, Homo sapiens
cctggcacagggcagt

SEQ ID NO: 2007525 - DNA, 20 bp, Homo sapiens
cctggcacccggcccctgct

SEQ ID NO: 2007526 - DNA, 21 bp, Homo sapiens
cctggcacccggcccctgctg

SEQ ID NO: 2007527 - DNA, 23 bp, Homo sapiens
cctggcacccggcccctgctggt

SEQ ID NO: 2007528 - DNA, 18 bp, Homo sapiens
cctggcacggtggctcag

SEQ ID NO: 2007529 - DNA, 21 bp, Homo sapiens
cctggcagccgtgccttcagc

SEQ ID NO: 2007530 - DNA, 22 bp, Homo sapiens
cctggcagccgtgccttcagct

SEQ ID NO: 2007531 - DNA, 17 bp, Homo sapiens
cctggcaggatgaccct

SEQ ID NO: 2007532 - DNA, 21 bp, Homo sapiens
ctcacgctcccccgcagtccc

SEQ ID NO: 2007533 - DNA, 13 bp, Homo sapiens
ctcacgctctgga

SEQ ID NO: 2007534 - DNA, 19 bp, Homo sapiens
ctcacgggcagtagctgtg

SEQ ID NO: 2007535 - DNA, 14 bp, Homo sapiens
ctcactatctctag

SEQ ID NO: 2007536 - DNA, 18 bp, Homo sapiens
ctcactatgttgcccagg

SEQ ID NO: 2007537 - DNA, 11 bp, Homo sapiens
ctcactcagga

SEQ ID NO: 2007538 - DNA, 14 bp, Homo sapiens
ctcactcaggactt

SEQ ID NO: 2007539 - DNA, 12 bp, Homo sapiens
ctcactccacca

SEQ ID NO: 2007540 - DNA, 14 bp, Homo sapiens
ctcactccagccca

SEQ ID NO: 2007541 - DNA, 14 bp, Homo sapiens
ctcactcccactgg

SEQ ID NO: 2007542 - DNA, 15 bp, Homo sapiens
ctcactcccactgga

SEQ ID NO: 2007543 - DNA, 17 bp, Homo sapiens
ctcactcctacctggta

SEQ ID NO: 2007544 - DNA, 15 bp, Homo sapiens
ctcactctgtcagcc

SEQ ID NO: 2007545 - DNA, 22 bp, Homo sapiens
ctcactctgtcgcccagtctgg

SEQ ID NO: 2007546 - DNA, 18 bp, Homo sapiens
ctcactgaggaagggaga

SEQ ID NO: 2007547 - DNA, 16 bp, Homo sapiens
ctcactgcagcctcaa

SEQ ID NO: 2007548 - DNA, 12 bp, Homo sapiens
ctcactgcccca

SEQ ID NO: 2007549 - DNA, 19 bp, Homo sapiens
ctcactgccccaccagcca

SEQ ID NO: 2007550 - DNA, 12 bp, Homo sapiens
ctcactgctcaa

SEQ ID NO: 2007551 - DNA, 16 bp, Homo sapiens
ctcactgctcaagaag

SEQ ID NO: 2007552 - DNA, 20 bp, Homo sapiens
ctcactgctcaagaagacat

SEQ ID NO: 2007553 - DNA, 21 bp, Homo sapiens
ctcactgctcaagaagacatg

SEQ ID NO: 2007554 - DNA, 20 bp, Homo sapiens
ctcactgctggggagtccct

SEQ ID NO: 2007555 - DNA, 12 bp, Homo sapiens
ctcactggctgg

SEQ ID NO: 2007556 - DNA, 20 bp, Homo sapiens
ctcactggctggggcagagg

SEQ ID NO: 2007557 - DNA, 22 bp, Homo sapiens
ctcactggggtcctggggcctc

SEQ ID NO: 2007558 - DNA, 14 bp, Homo sapiens
ctcactgttgccca

SEQ ID NO: 2007559 - DNA, 16 bp, Homo sapiens
ctcactgttgcccagg

SEQ ID NO: 2007560 - DNA, 19 bp, Homo sapiens
ctcactgttgcccaggctg

SEQ ID NO: 2007561 - DNA, 20 bp, Homo sapiens
ctcactgttgcccaggctgg

SEQ ID NO: 2007562 - DNA, 14 bp, Homo sapiens
ctcacttataccaa

SEQ ID NO: 2007563 - DNA, 15 bp, Homo sapiens
ctcacttcaatgaac

SEQ ID NO: 2007564 - DNA, 13 bp, Homo sapiens
ctcacttccctgg

SEQ ID NO: 2007565 - DNA, 14 bp, Homo sapiens
ctcacttccctggg

SEQ ID NO: 2007566 - DNA, 21 bp, Homo sapiens
ctcagaaatttttatttttct

SEQ ID NO: 2007567 - DNA, 13 bp, Homo sapiens
ctcagaagacact

SEQ ID NO: 2007568 - DNA, 20 bp, Homo sapiens
ctcagaagacactgatgggc

SEQ ID NO: 2007569 - DNA, 11 bp, Homo sapiens
ctcagaagcct

SEQ ID NO: 2007570 - DNA, 16 bp, Homo sapiens
ctcagaagcctgaggc

SEQ ID NO: 2007571 - DNA, 21 bp, Homo sapiens
ctcagaagcctgggggcctgg

SEQ ID NO: 2007572 - DNA, 16 bp, Homo sapiens
ctcagacaatccactc

SEQ ID NO: 2007573 - DNA, 14 bp, Homo sapiens
ctcagacattccaa

SEQ ID NO: 2007574 - DNA, 13 bp, Homo sapiens
ctcagacccccac

SEQ ID NO: 2007575 - DNA, 14 bp, Homo sapiens
ctcagactgctcaa

SEQ ID NO: 2007576 - DNA, 15 bp, Homo sapiens
ctcagacttgccagg

SEQ ID NO: 2007577 - DNA, 19 bp, Homo sapiens
ctcagtccagatgccttcc

SEQ ID NO: 2007578 - DNA, 20 bp, Homo sapiens
ctcagtccagatgccttcct

SEQ ID NO: 2007579 - DNA, 16 bp, Homo sapiens
ctcagtcccccaccac

SEQ ID NO: 2007580 - DNA, 14 bp, Homo sapiens
ctcagtctcaggag

SEQ ID NO: 2007581 - DNA, 15 bp, Homo sapiens
ctcagtgaagaatac

SEQ ID NO: 2007582 - DNA, 12 bp, Homo sapiens
ctcagtgccact

SEQ ID NO: 2007583 - DNA, 13 bp, Homo sapiens
ctcagtgccacta

SEQ ID NO: 2007584 - DNA, 22 bp, Homo sapiens
ctcagtgccacttgacattcct

SEQ ID NO: 2007585 - DNA, 23 bp, Homo sapiens
ctcagtgccacttgacattcctt

SEQ ID NO: 2007586 - DNA, 14 bp, Homo sapiens
ctcagtgcctcctg

SEQ ID NO: 2007587 - DNA, 14 bp, Homo sapiens
ctcagtgctcggca

SEQ ID NO: 2007588 - DNA, 13 bp, Homo sapiens
ctcagtgctctcc

SEQ ID NO: 2007589 - DNA, 22 bp, Homo sapiens
ctcagtgtcatttatgaaaaga

SEQ ID NO: 2007590 - DNA, 17 bp, Homo sapiens
ctcagtgttttagctgt

SEQ ID NO: 2007591 - DNA, 21 bp, Homo sapiens
ctcagttcaacctggtggcac

SEQ ID NO: 2007592 - DNA, 13 bp, Homo sapiens
ctcagtttcccca

SEQ ID NO: 2007593 - DNA, 17 bp, Homo sapiens
ctcagtttccccatttg

SEQ ID NO: 2007594 - DNA, 14 bp, Homo sapiens
ctcagtttcctcat

SEQ ID NO: 2007595 - DNA, 23 bp, Homo sapiens
ctcagtttttcggtgggacagcc

SEQ ID NO: 2007596 - DNA, 21 bp, Homo sapiens
ctcataagttggaccagagga

SEQ ID NO: 2007597 - DNA, 14 bp, Homo sapiens
ctcatacctctgac

SEQ ID NO: 2007598 - DNA, 15 bp, Homo sapiens
ctcatacctctgacc

SEQ ID NO: 2007599 - DNA, 21 bp, Homo sapiens
ctcatacctctgaccaacagg

SEQ ID NO: 2007600 - DNA, 19 bp, Homo sapiens
ctcatagtatggtggctgg

SEQ ID NO: 2007601 - DNA, 15 bp, Homo sapiens
ctcatatatttaagc

SEQ ID NO: 2007602 - DNA, 18 bp, Homo sapiens
ctcatatgtagccctcat

SEQ ID NO: 2007603 - DNA, 12 bp, Homo sapiens
ctcatatttaaa

SEQ ID NO: 2007604 - DNA, 13 bp, Homo sapiens
ctcatatttaaag

SEQ ID NO: 2007605 - DNA, 21 bp, Homo sapiens
ctcatattttgtatatatctg

SEQ ID NO: 2007606 - DNA, 13 bp, Homo sapiens
ctcatcacccagt

SEQ ID NO: 2007607 - DNA, 20 bp, Homo sapiens
ctcatcacccagtcctggcc

SEQ ID NO: 2007608 - DNA, 16 bp, Homo sapiens
ctcatcataaaataaa

SEQ ID NO: 2007609 - DNA, 15 bp, Homo sapiens
ctcatcatattgtat

SEQ ID NO: 2007610 - DNA, 16 bp, Homo sapiens
ctcatccccagtccca

SEQ ID NO: 2007611 - DNA, 19 bp, Homo sapiens
ctcatccccagtcccaatg

SEQ ID NO: 2007612 - DNA, 22 bp, Homo sapiens
ctcatcccctcgtcctgtccca

SEQ ID NO: 2007613 - DNA, 23 bp, Homo sapiens
ctcatctgatatgcagagtattt

SEQ ID NO: 2007614 - DNA, 14 bp, Homo sapiens
ctcatgacagccag

SEQ ID NO: 2007615 - DNA, 15 bp, Homo sapiens
ctcatgacagccaga

SEQ ID NO: 2007616 - DNA, 18 bp, Homo sapiens
ctcatgacagccagagcc

SEQ ID NO: 2007617 - DNA, 18 bp, Homo sapiens
ctcatgccacaccttctt

SEQ ID NO: 2007618 - DNA, 16 bp, Homo sapiens
ctcatgcctggccccc

SEQ ID NO: 2007619 - DNA, 20 bp, Homo sapiens
ctcatgcctggcccccctcc

SEQ ID NO: 2007620 - DNA, 18 bp, Homo sapiens
ctcatggaaactggccag

SEQ ID NO: 2007621 - DNA, 21 bp, Homo sapiens
ctcatggaaactggccagggg

SEQ ID NO: 2007622 - DNA, 18 bp, Homo sapiens
ctcatggagaaacatcct

SEQ ID NO: 2007623 - DNA, 20 bp, Homo sapiens
ctcatggcgtaatgggcctg

SEQ ID NO: 2007624 - DNA, 22 bp, Homo sapiens
ctcatggcgtaatgggcctgcc

SEQ ID NO: 2007625 - DNA, 16 bp, Homo sapiens
ctcatgggtacccaga

SEQ ID NO: 2007626 - DNA, 22 bp, Homo sapiens
ctcatgtacattggtctttcta

SEQ ID NO: 2007627 - DNA, 17 bp, Homo sapiens
ctcatgtctcagcctcc

SEQ ID NO: 2007628 - DNA, 16 bp, Homo sapiens
ctcatgtgatcctttt

SEQ ID NO: 2007629 - DNA, 17 bp, Homo sapiens
ctcatgtgtgctgtgct

SEQ ID NO: 2007630 - DNA, 23 bp, Homo sapiens
ctcatgttgaagccactgccttc

SEQ ID NO: 2007631 - DNA, 14 bp, Homo sapiens
ctcatgttgttccc

SEQ ID NO: 2007632 - DNA, 13 bp, Homo sapiens
ctcattagactgg

SEQ ID NO: 2007633 - DNA, 22 bp, Homo sapiens
ctcattcaggaaaactgacaga

SEQ ID NO: 2007634 - DNA, 12 bp, Homo sapiens
ctcattcctgta

SEQ ID NO: 2007635 - DNA, 17 bp, Homo sapiens
ctcattccttctggagg

SEQ ID NO: 2007636 - DNA, 20 bp, Homo sapiens
ctcattcgcctgtgggaaga

SEQ ID NO: 2007637 - DNA, 15 bp, Homo sapiens
ctcattctctttctt

SEQ ID NO: 2007638 - DNA, 22 bp, Homo sapiens
ctcattctgttgcccaggctgg

SEQ ID NO: 2007639 - DNA, 18 bp, Homo sapiens
ctcatttaagggaaaaat

SEQ ID NO: 2007640 - DNA, 22 bp, Homo sapiens
ctcatttaatcctcccttcctc

SEQ ID NO: 2007641 - DNA, 22 bp, Homo sapiens
ctcatttttccgtaaaaatgat

SEQ ID NO: 2007642 - DNA, 13 bp, Homo sapiens
ctcattttttaaa

SEQ ID NO: 2007643 - DNA, 19 bp, Homo sapiens
ctcatttttttccttgcaa

SEQ ID NO: 2007644 - DNA, 22 bp, Homo sapiens
ctccaaacctcctgttagctgt

SEQ ID NO: 2007645 - DNA, 18 bp, Homo sapiens
ctccaaactcctgcctgt

SEQ ID NO: 2007646 - DNA, 14 bp, Homo sapiens
ctccaaagccccac

SEQ ID NO: 2007647 - DNA, 22 bp, Homo sapiens
ctccaaaggaagtctaggagct

SEQ ID NO: 2007648 - DNA, 18 bp, Homo sapiens
ctccaaaggccctaccag

SEQ ID NO: 2007649 - DNA, 14 bp, Homo sapiens
ctccaacagcttga

SEQ ID NO: 2007650 - DNA, 23 bp, Homo sapiens
ctccaacagcttgaccagaccta

SEQ ID NO: 2007651 - DNA, 20 bp, Homo sapiens
ctccaacccaacctcatcct

SEQ ID NO: 2007652 - DNA, 20 bp, Homo sapiens
ctccaagagctacataattt

SEQ ID NO: 2007653 - DNA, 20 bp, Homo sapiens
ctccaagccattcacttccc

SEQ ID NO: 2007654 - DNA, 18 bp, Homo sapiens
ctccaagctccatctcca

SEQ ID NO: 2007655 - DNA, 19 bp, Homo sapiens
ctccaagcttcaagtgata

SEQ ID NO: 2007656 - DNA, 14 bp, Homo sapiens
ctccaaggaccagg

SEQ ID NO: 2007657 - DNA, 15 bp, Homo sapiens
ctccaaggtggggtc

SEQ ID NO: 2007658 - DNA, 16 bp, Homo sapiens
ctccaattgtaaaaaa

SEQ ID NO: 2007659 - DNA, 14 bp, Homo sapiens
ctccacagccgcag

SEQ ID NO: 2007660 - DNA, 15 bp, Homo sapiens
ctccacagccgcagc

SEQ ID NO: 2007661 - DNA, 12 bp, Homo sapiens
ctccacagtgct

SEQ ID NO: 2007662 - DNA, 16 bp, Homo sapiens
ctccacagtgctgctt

SEQ ID NO: 2007663 - DNA, 20 bp, Homo sapiens
ctccaccaacccatcagaag

SEQ ID NO: 2007664 - DNA, 16 bp, Homo sapiens
ctccaccacccaaaag

SEQ ID NO: 2007665 - DNA, 11 bp, Homo sapiens
ctccaccccag

SEQ ID NO: 2007666 - DNA, 13 bp, Homo sapiens
ctccaccccagga

SEQ ID NO: 2007667 - DNA, 14 bp, Homo sapiens
ctccaccctgagcc

SEQ ID NO: 2007668 - DNA, 13 bp, Homo sapiens
ctccaccctgctc

SEQ ID NO: 2007669 - DNA, 15 bp, Homo sapiens
ctccaccctgctctc

SEQ ID NO: 2007670 - DNA, 16 bp, Homo sapiens
ctccaccgcagaagga

SEQ ID NO: 2007671 - DNA, 18 bp, Homo sapiens
ctccaccgcagaaggaag

SEQ ID NO: 2007672 - DNA, 14 bp, Homo sapiens
ctccaccgctgcct

SEQ ID NO: 2007673 - DNA, 19 bp, Homo sapiens
ctccaccgctgcctaagtg

SEQ ID NO: 2007674 - DNA, 15 bp, Homo sapiens
ctccacctcagcctt

SEQ ID NO: 2007675 - DNA, 13 bp, Homo sapiens
ctccacctgttca

SEQ ID NO: 2007676 - DNA, 18 bp, Homo sapiens
ctccacctgttcaggagc

SEQ ID NO: 2007677 - DNA, 16 bp, Homo sapiens
ctccaccttgctcttc

SEQ ID NO: 2007678 - DNA, 20 bp, Homo sapiens
ctccaccttgttacacatta

SEQ ID NO: 2007679 - DNA, 17 bp, Homo sapiens
ctccacggtgcgtggct

SEQ ID NO: 2007680 - DNA, 21 bp, Homo sapiens
ctccacggtgcgtggctgtgg

SEQ ID NO: 2007681 - DNA, 18 bp, Homo sapiens
ctccactaaatgagctcc

SEQ ID NO: 2007682 - DNA, 19 bp, Homo sapiens
ctccactaaatgagctcct

SEQ ID NO: 2007683 - DNA, 21 bp, Homo sapiens
ctccactaaatgagctcctgc

SEQ ID NO: 2007684 - DNA, 13 bp, Homo sapiens
ctccactcactcc

SEQ ID NO: 2007685 - DNA, 19 bp, Homo sapiens
ctccactcactccagccca

SEQ ID NO: 2007686 - DNA, 13 bp, Homo sapiens
ctccactctcctt

SEQ ID NO: 2007687 - DNA, 15 bp, Homo sapiens
ctccactgccttcga

SEQ ID NO: 2007688 - DNA, 16 bp, Homo sapiens
ctccactgccttcgat

SEQ ID NO: 2007689 - DNA, 15 bp, Homo sapiens
ctccactgctctcag

SEQ ID NO: 2007690 - DNA, 17 bp, Homo sapiens
ctccactgctctcagcc

SEQ ID NO: 2007691 - DNA, 18 bp, Homo sapiens
ctccactgctctcagcct

SEQ ID NO: 2007692 - DNA, 17 bp, Homo sapiens
ctcctttggccattcca

SEQ ID NO: 2007693 - DNA, 16 bp, Homo sapiens
ctccttttgctgtctt

SEQ ID NO: 2007694 - DNA, 18 bp, Homo sapiens
ctccttttgctgtctttc

SEQ ID NO: 2007695 - DNA, 15 bp, Homo sapiens
ctccttttgtcccca

SEQ ID NO: 2007696 - DNA, 20 bp, Homo sapiens
ctccttttgtccccagggcc

SEQ ID NO: 2007697 - DNA, 16 bp, Homo sapiens
ctcctttttctacctt

SEQ ID NO: 2007698 - DNA, 17 bp, Homo sapiens
ctcctttttctaccttt

SEQ ID NO: 2007699 - DNA, 14 bp, Homo sapiens
ctcgaaccaaggca

SEQ ID NO: 2007700 - DNA, 17 bp, Homo sapiens
ctcgaaccaaggcagcc

SEQ ID NO: 2007701 - DNA, 20 bp, Homo sapiens
ctcgaaccaaggcagcctcc

SEQ ID NO: 2007702 - DNA, 15 bp, Homo sapiens
ctcgaagcccttcca

SEQ ID NO: 2007703 - DNA, 20 bp, Homo sapiens
ctcgaccacttttcagttca

SEQ ID NO: 2007704 - DNA, 14 bp, Homo sapiens
ctcgagaccatcct

SEQ ID NO: 2007705 - DNA, 19 bp, Homo sapiens
ctcgagaccatcctggccc

SEQ ID NO: 2007706 - DNA, 20 bp, Homo sapiens
ctcgagaccatcctggcccc

SEQ ID NO: 2007707 - DNA, 22 bp, Homo sapiens
ctcgagaccatcctggcccctc

SEQ ID NO: 2007708 - DNA, 16 bp, Homo sapiens
ctcgagccccctggat

SEQ ID NO: 2007709 - DNA, 17 bp, Homo sapiens
ctcgagcgccctgcaga

SEQ ID NO: 2007710 - DNA, 12 bp, Homo sapiens
ctcgaggctctt

SEQ ID NO: 2007711 - DNA, 23 bp, Homo sapiens
ctcgagggttgggttcatctgag

SEQ ID NO: 2007712 - DNA, 22 bp, Homo sapiens
ctctccaaatattattcaagtg

SEQ ID NO: 2007713 - DNA, 14 bp, Homo sapiens
ctctccaattgtaa

SEQ ID NO: 2007714 - DNA, 15 bp, Homo sapiens
ctctccaattgtaaa

SEQ ID NO: 2007715 - DNA, 14 bp, Homo sapiens
ctctccacctcagc

SEQ ID NO: 2007716 - DNA, 15 bp, Homo sapiens
ctctccacctcagcc

SEQ ID NO: 2007717 - DNA, 17 bp, Homo sapiens
ctctccacctcagcctt

SEQ ID NO: 2007718 - DNA, 18 bp, Homo sapiens
ctctccacctcagccttg

SEQ ID NO: 2007719 - DNA, 20 bp, Homo sapiens
ctctccacctcagccttgga

SEQ ID NO: 2007720 - DNA, 11 bp, Homo sapiens
ctctccactgc

SEQ ID NO: 2007721 - DNA, 15 bp, Homo sapiens
ctctccactgccttc

SEQ ID NO: 2007722 - DNA, 19 bp, Homo sapiens
ctctccactgctctcagcc

SEQ ID NO: 2007723 - DNA, 21 bp, Homo sapiens
ctctccaggctgtttcttttt

SEQ ID NO: 2007724 - DNA, 12 bp, Homo sapiens
ctctcccaggcc

SEQ ID NO: 2007725 - DNA, 11 bp, Homo sapiens
ctctcccatac

SEQ ID NO: 2007726 - DNA, 18 bp, Homo sapiens
ctctcccccgcccaaggc

SEQ ID NO: 2007727 - DNA, 20 bp, Homo sapiens
ctctgccccttctgtttcca

SEQ ID NO: 2007728 - DNA, 22 bp, Homo sapiens
ctctgccccttgggcatccacc

SEQ ID NO: 2007729 - DNA, 16 bp, Homo sapiens
ctctgcccgcagagcc

SEQ ID NO: 2007730 - DNA, 15 bp, Homo sapiens
ctctgcctccctagc

SEQ ID NO: 2007731 - DNA, 13 bp, Homo sapiens
ctctgcctccctc

SEQ ID NO: 2007732 - DNA, 15 bp, Homo sapiens
ctctgcggtggtgcc

SEQ ID NO: 2007733 - DNA, 15 bp, Homo sapiens
ctctgcgtcccccag

SEQ ID NO: 2007734 - DNA, 17 bp, Homo sapiens
ctctgcgtcccccagcc

SEQ ID NO: 2007735 - DNA, 20 bp, Homo sapiens
ctctgcgtcccccagccctc

SEQ ID NO: 2007736 - DNA, 13 bp, Homo sapiens
ctctgctccagag

SEQ ID NO: 2007737 - DNA, 17 bp, Homo sapiens
ctctgctctagccagga

SEQ ID NO: 2007738 - DNA, 23 bp, Homo sapiens
ctggatgaagattctcctgtgct

SEQ ID NO: 2007739 - DNA, 15 bp, Homo sapiens
ctggatggcaccaga

SEQ ID NO: 2007740 - DNA, 23 bp, Homo sapiens
ctggatggcaccagaggctgcag

SEQ ID NO: 2007741 - DNA, 14 bp, Homo sapiens
ctggatgtgcccac

SEQ ID NO: 2007742 - DNA, 18 bp, Homo sapiens
ctggatgtgcccacaggg

SEQ ID NO: 2007743 - DNA, 17 bp, Homo sapiens
ctggatgtgtggggcat

SEQ ID NO: 2007744 - DNA, 21 bp, Homo sapiens
ctggattaatgttttgtacaa

SEQ ID NO: 2007745 - DNA, 13 bp, Homo sapiens
ctggattccagag

SEQ ID NO: 2007746 - DNA, 20 bp, Homo sapiens
ctggattggctataacatgt

SEQ ID NO: 2007747 - DNA, 22 bp, Homo sapiens
ctggcaaaggtggctctccagt

SEQ ID NO: 2007748 - DNA, 14 bp, Homo sapiens
ctggcaacagagca

SEQ ID NO: 2007749 - DNA, 13 bp, Homo sapiens
ctggcaagcaggg

SEQ ID NO: 2007750 - DNA, 14 bp, Homo sapiens
ctggcaagcaggga

SEQ ID NO: 2007751 - DNA, 17 bp, Homo sapiens
ctggcaagcagggaaag

SEQ ID NO: 2007752 - DNA, 19 bp, Homo sapiens
ctggcaagctagaacctgg

SEQ ID NO: 2007753 - DNA, 21 bp, Homo sapiens
ctggcaatgaaaaattctcag

SEQ ID NO: 2007754 - DNA, 22 bp, Homo sapiens
ctggcacaggactgattctggg

SEQ ID NO: 2007755 - DNA, 21 bp, Homo sapiens
ctggcacagttttctgagaaa

SEQ ID NO: 2007756 - DNA, 23 bp, Homo sapiens
ctggcaccccggatcgaggacaa

SEQ ID NO: 2007757 - DNA, 20 bp, Homo sapiens
ctggcacccggcccctgctg

SEQ ID NO: 2007758 - DNA, 19 bp, Homo sapiens
ctggcacttagcccaagag

SEQ ID NO: 2007759 - DNA, 14 bp, Homo sapiens
ctggcagagaagga

SEQ ID NO: 2007760 - DNA, 22 bp, Homo sapiens
ctggcagagaaggcttcctcca

SEQ ID NO: 2007761 - DNA, 19 bp, Homo sapiens
ctggcagcactcagtgagg

SEQ ID NO: 2007762 - DNA, 14 bp, Homo sapiens
ctggcagccacact

SEQ ID NO: 2007763 - DNA, 22 bp, Homo sapiens
ctggcagccacacttctcagga

SEQ ID NO: 2007764 - DNA, 18 bp, Homo sapiens
ctggcagccaccccctcc

SEQ ID NO: 2007765 - DNA, 19 bp, Homo sapiens
ctggcagccgtgccttcag

SEQ ID NO: 2007766 - DNA, 18 bp, Homo sapiens
ctggcagctcctctcctt

SEQ ID NO: 2007767 - DNA, 15 bp, Homo sapiens
ctggcagctgagagc

SEQ ID NO: 2007768 - DNA, 19 bp, Homo sapiens
ctggcagctgagagccctg

SEQ ID NO: 2007769 - DNA, 20 bp, Homo sapiens
ctggcagctgagagccctgc

SEQ ID NO: 2007770 - DNA, 14 bp, Homo sapiens
ctggcaggaagtct

SEQ ID NO: 2007771 - DNA, 18 bp, Homo sapiens
ctggcagggtgggatgga

SEQ ID NO: 2007772 - DNA, 16 bp, Homo sapiens
ctggcaggtgcagatg

SEQ ID NO: 2007773 - DNA, 21 bp, Homo sapiens
ctggcatgacactctagtgac

SEQ ID NO: 2007774 - DNA, 22 bp, Homo sapiens
ctggcatggtgctttcaggtct

SEQ ID NO: 2007775 - DNA, 16 bp, Homo sapiens
ctggcatgtcagagcc

SEQ ID NO: 2007776 - DNA, 18 bp, Homo sapiens
ctggcattggtctgctga

SEQ ID NO: 2007777 - DNA, 13 bp, Homo sapiens
ctggccaacatgg

SEQ ID NO: 2007778 - DNA, 15 bp, Homo sapiens
ctggccaagctgagg

SEQ ID NO: 2007779 - DNA, 16 bp, Homo sapiens
ctggccaagctgaggt

SEQ ID NO: 2007780 - DNA, 21 bp, Homo sapiens
ctggccaagctgaggtgccca

SEQ ID NO: 2007781 - DNA, 16 bp, Homo sapiens
ctggccaccctggccc

SEQ ID NO: 2007782 - DNA, 17 bp, Homo sapiens
ctggccaccctggcccg

SEQ ID NO: 2007783 - DNA, 11 bp, Homo sapiens
ctggccagaga

SEQ ID NO: 2007784 - DNA, 19 bp, Homo sapiens
ctggccagagagggcccag

SEQ ID NO: 2007785 - DNA, 21 bp, Homo sapiens
ctggccagagagggcccagct

SEQ ID NO: 2007786 - DNA, 13 bp, Homo sapiens
ctggccagcaccc

SEQ ID NO: 2007787 - DNA, 14 bp, Homo sapiens
ctggccaggcatgg

SEQ ID NO: 2007788 - DNA, 13 bp, Homo sapiens
ctggccaggggtc

SEQ ID NO: 2007789 - DNA, 16 bp, Homo sapiens
ctggccagtcctagag

SEQ ID NO: 2007790 - DNA, 21 bp, Homo sapiens
ctggccagtcctagagctcct

SEQ ID NO: 2007791 - DNA, 21 bp, Homo sapiens
ctggccattttcttgcctgag

SEQ ID NO: 2007792 - DNA, 17 bp, Homo sapiens
ctggcccagagctggaa

SEQ ID NO: 2007793 - DNA, 21 bp, Homo sapiens
ctggcccagccaactgccccg

SEQ ID NO: 2007794 - DNA, 17 bp, Homo sapiens
ctggcccagcctaccct

SEQ ID NO: 2007795 - DNA, 17 bp, Homo sapiens
ctggcccatagaaacat

SEQ ID NO: 2007796 - DNA, 23 bp, Homo sapiens
ctggccccaccctcgtggacacc

SEQ ID NO: 2007797 - DNA, 20 bp, Homo sapiens
ctgaagttctgagccgggca

SEQ ID NO: 2007798 - DNA, 17 bp, Homo sapiens
ctgaataccaagtgtgt

SEQ ID NO: 2007799 - DNA, 16 bp, Homo sapiens
ctgaatcatgttaata

SEQ ID NO: 2007800 - DNA, 13 bp, Homo sapiens
ctgaatccgtggt

SEQ ID NO: 2007801 - DNA, 19 bp, Homo sapiens
ctgaatctgataggaaaag

SEQ ID NO: 2007802 - DNA, 21 bp, Homo sapiens
ctgaatctgataggaaaagaa

SEQ ID NO: 2007803 - DNA, 17 bp, Homo sapiens
ctgaatgaaatatcaga

SEQ ID NO: 2007804 - DNA, 22 bp, Homo sapiens
ctgaatgcctcaatgtgaccag

SEQ ID NO: 2007805 - DNA, 23 bp, Homo sapiens
ctgaatgcctcaatgtgaccagg

SEQ ID NO: 2007806 - DNA, 22 bp, Homo sapiens
ctgaatggaaggtttgtatatt

SEQ ID NO: 2007807 - DNA, 18 bp, Homo sapiens
ctgaatggttccatgcct

SEQ ID NO: 2007808 - DNA, 14 bp, Homo sapiens
ctgaattaagttat

SEQ ID NO: 2007809 - DNA, 15 bp, Homo sapiens
ctgaattgtccccag

SEQ ID NO: 2007810 - DNA, 16 bp, Homo sapiens
ctgaattgtccccagt

SEQ ID NO: 2007811 - DNA, 19 bp, Homo sapiens
ctgaatttgggcctcttgt

SEQ ID NO: 2007812 - DNA, 18 bp, Homo sapiens
ctgaattttaaatgttca

SEQ ID NO: 2007813 - DNA, 21 bp, Homo sapiens
ctgaatttttaaacaagtatt

SEQ ID NO: 2007814 - DNA, 17 bp, Homo sapiens
ctgacaagataaaggaa

SEQ ID NO: 2007815 - DNA, 12 bp, Homo sapiens
ctgacaagggct

SEQ ID NO: 2007816 - DNA, 15 bp, Homo sapiens
ctgacaatggcagct

SEQ ID NO: 2007817 - DNA, 22 bp, Homo sapiens
ctgacaatggcagctagactgg

SEQ ID NO: 2007818 - DNA, 15 bp, Homo sapiens
ctgacacacagctct

SEQ ID NO: 2007819 - DNA, 21 bp, Homo sapiens
ctgacacacagctctgtcctg

SEQ ID NO: 2007820 - DNA, 22 bp, Homo sapiens
ctgacacacagctctgtcctgg

SEQ ID NO: 2007821 - DNA, 23 bp, Homo sapiens
ctgacacacagctctgtcctggg

SEQ ID NO: 2007822 - DNA, 10 bp, Homo sapiens
ctgacacagg

SEQ ID NO: 2007823 - DNA, 13 bp, Homo sapiens
ctgacacaggcca

SEQ ID NO: 2007824 - DNA, 19 bp, Homo sapiens
ctgacaccgtccctcagtg

SEQ ID NO: 2007825 - DNA, 21 bp, Homo sapiens
ctgacacctaccatgctgctt

SEQ ID NO: 2007826 - DNA, 15 bp, Homo sapiens
ctgacacctcactga

SEQ ID NO: 2007827 - DNA, 15 bp, Homo sapiens
ctgacagacacaggc

SEQ ID NO: 2007828 - DNA, 17 bp, Homo sapiens
ctgacagacacaggccc

SEQ ID NO: 2007829 - DNA, 19 bp, Homo sapiens
ctgacagacacaggcccgg

SEQ ID NO: 2007830 - DNA, 23 bp, Homo sapiens
ctgacagatacatagatggacca

SEQ ID NO: 2007831 - DNA, 20 bp, Homo sapiens
ctgacagccctgcggagacc

SEQ ID NO: 2007832 - DNA, 19 bp, Homo sapiens
ctgacaggatgtggcactg

SEQ ID NO: 2007833 - DNA, 11 bp, Homo sapiens
ctgacaggcaa

SEQ ID NO: 2007834 - DNA, 21 bp, Homo sapiens
ctgacaggcaatgctggctgt

SEQ ID NO: 2007835 - DNA, 19 bp, Homo sapiens
ctgacaggttcccagcagc

SEQ ID NO: 2007836 - DNA, 15 bp, Homo sapiens
ctgacagtcttgtgc

SEQ ID NO: 2007837 - DNA, 14 bp, Homo sapiens
ctgacatctcctct

SEQ ID NO: 2007838 - DNA, 22 bp, Homo sapiens
ctgacatctcctctatcacatt

SEQ ID NO: 2007839 - DNA, 13 bp, Homo sapiens
ctgacatggcttt

SEQ ID NO: 2007840 - DNA, 13 bp, Homo sapiens
ctgacatgtctca

SEQ ID NO: 2007841 - DNA, 15 bp, Homo sapiens
ctgacatgtttcaca

SEQ ID NO: 2007842 - DNA, 23 bp, Homo sapiens
ctgacatgtttcacaacaggcat

SEQ ID NO: 2007843 - DNA, 24 bp, Homo sapiens
ctgacatgtttcacaacaggcatt

SEQ ID NO: 2007844 - DNA, 12 bp, Homo sapiens
ctgacatttcta

SEQ ID NO: 2007845 - DNA, 22 bp, Homo sapiens
ctgacatttctaacatatgtat

SEQ ID NO: 2007846 - DNA, 12 bp, Homo sapiens
ctgaccaacagg

SEQ ID NO: 2007847 - DNA, 19 bp, Homo sapiens
ctgaccaacagttccttca

SEQ ID NO: 2007848 - DNA, 17 bp, Homo sapiens
ctgaccagcctccatgc

SEQ ID NO: 2007849 - DNA, 12 bp, Homo sapiens
ctgacccactgc

SEQ ID NO: 2007850 - DNA, 16 bp, Homo sapiens
ctgacccagtccctgg

SEQ ID NO: 2007851 - DNA, 18 bp, Homo sapiens
ctgacccagtccctgggg

SEQ ID NO: 2007852 - DNA, 13 bp, Homo sapiens
ctgacccagtgag

SEQ ID NO: 2007853 - DNA, 15 bp, Homo sapiens
ctgaccccctcccct

SEQ ID NO: 2007854 - DNA, 14 bp, Homo sapiens
ctgacccctgcacc

SEQ ID NO: 2007855 - DNA, 22 bp, Homo sapiens
ctgaccctcctccactccacct

SEQ ID NO: 2007856 - DNA, 15 bp, Homo sapiens
ctgacccttccagac

SEQ ID NO: 2007857 - DNA, 18 bp, Homo sapiens
ctgacccttccagacata

SEQ ID NO: 2007858 - DNA, 16 bp, Homo sapiens
ctgaccggcacctgcg

SEQ ID NO: 2007859 - DNA, 11 bp, Homo sapiens
ctgacctccca

SEQ ID NO: 2007860 - DNA, 14 bp, Homo sapiens
ctgacctcccagcc

SEQ ID NO: 2007861 - DNA, 18 bp, Homo sapiens
ctgacctcccagccctat

SEQ ID NO: 2007862 - DNA, 18 bp, Homo sapiens
ctgacctccctctaattt

SEQ ID NO: 2007863 - DNA, 20 bp, Homo sapiens
ctgacctccctctaatttat

SEQ ID NO: 2007864 - DNA, 12 bp, Homo sapiens
ctgacctctggt

SEQ ID NO: 2007865 - DNA, 12 bp, Homo sapiens
ctgacctgcagg

SEQ ID NO: 2007866 - DNA, 14 bp, Homo sapiens
ctgacctgcctctc

SEQ ID NO: 2007867 - DNA, 22 bp, Homo sapiens
ctgacctgcctctcacacacat

SEQ ID NO: 2007868 - DNA, 15 bp, Homo sapiens
ctgacctgctgtgca

SEQ ID NO: 2007869 - DNA, 14 bp, Homo sapiens
ctgaccttggagag

SEQ ID NO: 2007870 - DNA, 21 bp, Homo sapiens
ctgaccttggagagacacagc

SEQ ID NO: 2007871 - DNA, 23 bp, Homo sapiens
ctgacctttgtcatctttcttct

SEQ ID NO: 2007872 - DNA, 13 bp, Homo sapiens
ctgacgacactga

SEQ ID NO: 2007873 - DNA, 21 bp, Homo sapiens
ctgacgacactgaagaatcaa

SEQ ID NO: 2007874 - DNA, 13 bp, Homo sapiens
ctgacgccctgcg

SEQ ID NO: 2007875 - DNA, 21 bp, Homo sapiens
ctgacggaagccaacttggct

SEQ ID NO: 2007876 - DNA, 20 bp, Homo sapiens
ctgacggacgtcctgctggc

SEQ ID NO: 2007877 - DNA, 21 bp, Homo sapiens
ctgactaccagctaactccag

SEQ ID NO: 2007878 - DNA, 14 bp, Homo sapiens
ctgactcacaagaa

SEQ ID NO: 2007879 - DNA, 14 bp, Homo sapiens
ctgactcagtccag

SEQ ID NO: 2007880 - DNA, 12 bp, Homo sapiens
ctgactccagag

SEQ ID NO: 2007881 - DNA, 21 bp, Homo sapiens
ctgactccagagtctgagccc

SEQ ID NO: 2007882 - DNA, 16 bp, Homo sapiens
ctgactccagtgagct

SEQ ID NO: 2007883 - DNA, 20 bp, Homo sapiens
ctgactccatatggaggcct

SEQ ID NO: 2007884 - DNA, 23 bp, Homo sapiens
ctgactccctgtgggggtggcca

SEQ ID NO: 2007885 - DNA, 13 bp, Homo sapiens
ctgactccttaga

SEQ ID NO: 2007886 - DNA, 21 bp, Homo sapiens
ctgactcggtcaaaatatttt

SEQ ID NO: 2007887 - DNA, 16 bp, Homo sapiens
ctgactcttgcctttc

SEQ ID NO: 2007888 - DNA, 17 bp, Homo sapiens
ctgactgacacaggcca

SEQ ID NO: 2007889 - DNA, 15 bp, Homo sapiens
ctgactgatgacaaa

SEQ ID NO: 2007890 - DNA, 19 bp, Homo sapiens
ctgactgatgttgagggaa

SEQ ID NO: 2007891 - DNA, 18 bp, Homo sapiens
ctgactgggaccaggcac

SEQ ID NO: 2007892 - DNA, 22 bp, Homo sapiens
ctgactggtgctataggctgga

SEQ ID NO: 2007893 - DNA, 22 bp, Homo sapiens
ctgactgtgttcagtgccttgg

SEQ ID NO: 2007894 - DNA, 21 bp, Homo sapiens
ctgacttggggagatggagtt

SEQ ID NO: 2007895 - DNA, 14 bp, Homo sapiens
ctgactttgctctt

SEQ ID NO: 2007896 - DNA, 15 bp, Homo sapiens
ctgactttgttgcct

SEQ ID NO: 2007897 - DNA, 22 bp, Homo sapiens
ctgactttgttgccttatcttg

SEQ ID NO: 2007898 - DNA, 23 bp, Homo sapiens
ctgactttgttgccttatcttga

SEQ ID NO: 2007899 - DNA, 23 bp, Homo sapiens
ctgagaaacccaccagcctaaga

SEQ ID NO: 2007900 - DNA, 15 bp, Homo sapiens
ctgagaaagactatt

SEQ ID NO: 2007901 - DNA, 14 bp, Homo sapiens
ctgagaacctggcc

SEQ ID NO: 2007902 - DNA, 15 bp, Homo sapiens
ctgagaacctggcct

SEQ ID NO: 2007903 - DNA, 14 bp, Homo sapiens
ctgagaagaagctg

SEQ ID NO: 2007904 - DNA, 18 bp, Homo sapiens
ctgagaagaagctgagga

SEQ ID NO: 2007905 - DNA, 15 bp, Homo sapiens
ctgagaataagaaag

SEQ ID NO: 2007906 - DNA, 16 bp, Homo sapiens
ctgagaattccaagga

SEQ ID NO: 2007907 - DNA, 22 bp, Homo sapiens
ctgagaatttaaaaataagaaa

SEQ ID NO: 2007908 - DNA, 15 bp, Homo sapiens
ctgagacaggagaat

SEQ ID NO: 2007909 - DNA, 18 bp, Homo sapiens
ctgagacccgttcgcccc

SEQ ID NO: 2007910 - DNA, 23 bp, Homo sapiens
ctgagacggcagagaccccagga

SEQ ID NO: 2007911 - DNA, 20 bp, Homo sapiens
ctgggccagcctcagctcag

SEQ ID NO: 2007912 - DNA, 20 bp, Homo sapiens
ctgggcccacagagatgcat

SEQ ID NO: 2007913 - DNA, 17 bp, Homo sapiens
ctgggcccaggctctgg

SEQ ID NO: 2007914 - DNA, 24 bp, Homo sapiens
ctgggccccaaacgggctgccctg

SEQ ID NO: 2007915 - DNA, 14 bp, Homo sapiens
ctgggccccaccac

SEQ ID NO: 2007916 - DNA, 18 bp, Homo sapiens
ctgggccccaccacctag

SEQ ID NO: 2007917 - DNA, 15 bp, Homo sapiens
ctgggccccatgctc

SEQ ID NO: 2007918 - DNA, 15 bp, Homo sapiens
ctgggcccctccacg

SEQ ID NO: 2007919 - DNA, 16 bp, Homo sapiens
ctgggcccctccacgc

SEQ ID NO: 2007920 - DNA, 17 bp, Homo sapiens
ctgggcccctccacgcc

SEQ ID NO: 2007921 - DNA, 20 bp, Homo sapiens
ctgggcccctccacgcctcc

SEQ ID NO: 2007922 - DNA, 12 bp, Homo sapiens
ctgggccctggg

SEQ ID NO: 2007923 - DNA, 13 bp, Homo sapiens
ctgggccctgggg

SEQ ID NO: 2007924 - DNA, 20 bp, Homo sapiens
ctgggccctggggcctgtac

SEQ ID NO: 2007925 - DNA, 16 bp, Homo sapiens
ctgggccggccagcct

SEQ ID NO: 2007926 - DNA, 16 bp, Homo sapiens
ctgggcctatggagag

SEQ ID NO: 2007927 - DNA, 23 bp, Homo sapiens
ctgggcctatggagagccctggg

SEQ ID NO: 2007928 - DNA, 21 bp, Homo sapiens
ctgggcctcagttcaacctgg

SEQ ID NO: 2007929 - DNA, 16 bp, Homo sapiens
ctgggcctgctgctga

SEQ ID NO: 2007930 - DNA, 20 bp, Homo sapiens
ctgggcctgctgctgagaac

SEQ ID NO: 2007931 - DNA, 23 bp, Homo sapiens
ctgggcctgcttttccaggatcc

SEQ ID NO: 2007932 - DNA, 20 bp, Homo sapiens
ctgggcctgtgcagcagccc

SEQ ID NO: 2007933 - DNA, 23 bp, Homo sapiens
ctgggcctgtgcagcagcccagc

SEQ ID NO: 2007934 - DNA, 20 bp, Homo sapiens
ctgggccttacctcccctgc

SEQ ID NO: 2007935 - DNA, 22 bp, Homo sapiens
ctgggccttacctcccctgcca

SEQ ID NO: 2007936 - DNA, 13 bp, Homo sapiens
ctgggcctttcct

SEQ ID NO: 2007937 - DNA, 17 bp, Homo sapiens
ctgggcctttcctgtgc

SEQ ID NO: 2007938 - DNA, 18 bp, Homo sapiens
ctgggcctttcctgtgcc

SEQ ID NO: 2007939 - DNA, 23 bp, Homo sapiens
ctgggcgaatctacagaacaaag

SEQ ID NO: 2007940 - DNA, 21 bp, Homo sapiens
ctgggcgacagagcgagactc

SEQ ID NO: 2007941 - DNA, 14 bp, Homo sapiens
ctgggctaccccac

SEQ ID NO: 2007942 - DNA, 15 bp, Homo sapiens
ctgggctcagggctg

SEQ ID NO: 2007943 - DNA, 18 bp, Homo sapiens
ctgggctcagggctggag

SEQ ID NO: 2007944 - DNA, 20 bp, Homo sapiens
ctgggctcagggctggagtg

SEQ ID NO: 2007945 - DNA, 21 bp, Homo sapiens
ctgggctcagggctggagtgc

SEQ ID NO: 2007946 - DNA, 14 bp, Homo sapiens
ctgggctcatcagc

SEQ ID NO: 2007947 - DNA, 17 bp, Homo sapiens
ctgggctcctggaacca

SEQ ID NO: 2007948 - DNA, 12 bp, Homo sapiens
ctgggctctcca

SEQ ID NO: 2007949 - DNA, 13 bp, Homo sapiens
ctgggctctccac

SEQ ID NO: 2007950 - DNA, 15 bp, Homo sapiens
ctgggctctccacct

SEQ ID NO: 2007951 - DNA, 13 bp, Homo sapiens
ctgggctctgccc

SEQ ID NO: 2007952 - DNA, 14 bp, Homo sapiens
ctgggctgcagaga

SEQ ID NO: 2007953 - DNA, 13 bp, Homo sapiens
ctgggctgtctgt

SEQ ID NO: 2007954 - DNA, 18 bp, Homo sapiens
ctgggctgtctgtcacca

SEQ ID NO: 2007955 - DNA, 23 bp, Homo sapiens
ctgggcttcagtggcagctgctt

SEQ ID NO: 2007956 - DNA, 19 bp, Homo sapiens
ctgggcttggggcttccta

SEQ ID NO: 2007957 - DNA, 22 bp, Homo sapiens
ctgggcttgtagaccactgtcc

SEQ ID NO: 2007958 - DNA, 23 bp, Homo sapiens
ctgggcttgtagaccactgtcct

SEQ ID NO: 2007959 - DNA, 19 bp, Homo sapiens
ctggggaacagagcgggcc

SEQ ID NO: 2007960 - DNA, 21 bp, Homo sapiens
ctggggaacagagcgggcctc

SEQ ID NO: 2007961 - DNA, 23 bp, Homo sapiens
ctggggaacagagcgggcctctt

SEQ ID NO: 2007962 - DNA, 12 bp, Homo sapiens
ctggggacaggt

SEQ ID NO: 2007963 - DNA, 13 bp, Homo sapiens
ctggggagaaagt

SEQ ID NO: 2007964 - DNA, 17 bp, Homo sapiens
ctggggatgtgggaggg

SEQ ID NO: 2007965 - DNA, 18 bp, Homo sapiens
ctggggattgggagggac

SEQ ID NO: 2007966 - DNA, 14 bp, Homo sapiens
ctggggcaagtccc

SEQ ID NO: 2007967 - DNA, 13 bp, Homo sapiens
ctggggcagaggg

SEQ ID NO: 2007968 - DNA, 17 bp, Homo sapiens
ctggggcagaggggcag

SEQ ID NO: 2007969 - DNA, 20 bp, Homo sapiens
ctggggcagaggggcagccg

SEQ ID NO: 2007970 - DNA, 21 bp, Homo sapiens
ctggggcagaggggcagccgc

SEQ ID NO: 2007971 - DNA, 13 bp, Homo sapiens
ctggggcatccca

SEQ ID NO: 2007972 - DNA, 21 bp, Homo sapiens
ctggggccacaaatcaaagca

SEQ ID NO: 2007973 - DNA, 22 bp, Homo sapiens
ctggggccacaaatcaaagcaa

SEQ ID NO: 2007974 - DNA, 18 bp, Homo sapiens
ctggggccctgggcctca

SEQ ID NO: 2007975 - DNA, 19 bp, Homo sapiens
ctggggccctgggcctcag

SEQ ID NO: 2007976 - DNA, 14 bp, Homo sapiens
ctggggcctggaga

SEQ ID NO: 2007977 - DNA, 16 bp, Homo sapiens
ctggggcctggagagg

SEQ ID NO: 2007978 - DNA, 16 bp, Homo sapiens
ctggggcctgtactgc

SEQ ID NO: 2007979 - DNA, 22 bp, Homo sapiens
ctggggcctgtactgcctgctt

SEQ ID NO: 2007980 - DNA, 22 bp, Homo sapiens
ctggggctctaacgcctgagcc

SEQ ID NO: 2007981 - DNA, 14 bp, Homo sapiens
ctggggctctggga

SEQ ID NO: 2007982 - DNA, 17 bp, Homo sapiens
ctggggctctgtgcagg

SEQ ID NO: 2007983 - DNA, 20 bp, Homo sapiens
ctggggcttctcctgaccca

SEQ ID NO: 2007984 - DNA, 13 bp, Homo sapiens
ctgggggaagggt

SEQ ID NO: 2007985 - DNA, 16 bp, Homo sapiens
ctgggggaagggtggt

SEQ ID NO: 2007986 - DNA, 21 bp, Homo sapiens
ctgggggcagtgactggcagg

SEQ ID NO: 2007987 - DNA, 18 bp, Homo sapiens
ctgggggccagctggtgc

SEQ ID NO: 2007988 - DNA, 13 bp, Homo sapiens
ctgggggcctcag

SEQ ID NO: 2007989 - DNA, 17 bp, Homo sapiens
ctgggggcctcagtgcc

SEQ ID NO: 2007990 - DNA, 18 bp, Homo sapiens
ctggtaagcagaggcttt

SEQ ID NO: 2007991 - DNA, 17 bp, Homo sapiens
ctggtaatttgtatctg

SEQ ID NO: 2007992 - DNA, 21 bp, Homo sapiens
ctggtaatttgtatctgaagg

SEQ ID NO: 2007993 - DNA, 22 bp, Homo sapiens
ctggtaatttgtatctgaagga

SEQ ID NO: 2007994 - DNA, 20 bp, Homo sapiens
ctggtatgaacttgaggaca

SEQ ID NO: 2007995 - DNA, 21 bp, Homo sapiens
ctggtatgaacttgaggacac

SEQ ID NO: 2007996 - DNA, 18 bp, Homo sapiens
ctggtcacaggactctgc

SEQ ID NO: 2007997 - DNA, 15 bp, Homo sapiens
ctggtcccactcagt

SEQ ID NO: 2007998 - DNA, 18 bp, Homo sapiens
ctggtccctcgtccacag

SEQ ID NO: 2007999 - DNA, 19 bp, Homo sapiens
ctggtcctgagggtcccca

SEQ ID NO: 2008000 - DNA, 16 bp, Homo sapiens
ctggtctccctccagc

SEQ ID NO: 2008001 - DNA, 14 bp, Homo sapiens
ctggtctcctccca

SEQ ID NO: 2008002 - DNA, 12 bp, Homo sapiens
ctggtctgaggg

SEQ ID NO: 2008003 - DNA, 14 bp, Homo sapiens
ctggtctgccctgg

SEQ ID NO: 2008004 - DNA, 17 bp, Homo sapiens
ctggtctgccctgggct

SEQ ID NO: 2008005 - DNA, 18 bp, Homo sapiens
ctggtctgtgctgccctg

SEQ ID NO: 2008006 - DNA, 21 bp, Homo sapiens
ctggtctgtgctgccctgctc

SEQ ID NO: 2008007 - DNA, 20 bp, Homo sapiens
ctggtcttgtggaattggga

SEQ ID NO: 2008008 - DNA, 21 bp, Homo sapiens
ctggtgactgcgatcttcaga

SEQ ID NO: 2008009 - DNA, 17 bp, Homo sapiens
ctggtgaggcccagcct

SEQ ID NO: 2008010 - DNA, 23 bp, Homo sapiens
ctggtgcctatttattcattcag

SEQ ID NO: 2008011 - DNA, 19 bp, Homo sapiens
ctggtgctataggctggag

SEQ ID NO: 2008012 - DNA, 20 bp, Homo sapiens
ctggtgctataggctggaga

SEQ ID NO: 2008013 - DNA, 13 bp, Homo sapiens
ctggtgctgccac

SEQ ID NO: 2008014 - DNA, 17 bp, Homo sapiens
ctggtgctgtggccagg

SEQ ID NO: 2008015 - DNA, 19 bp, Homo sapiens
ctggtgctgtggccagggt

SEQ ID NO: 2008016 - DNA, 23 bp, Homo sapiens
ctggtgctgtggccagggtgaga

SEQ ID NO: 2008017 - DNA, 18 bp, Homo sapiens
ctggtggacagtcctggg

SEQ ID NO: 2008018 - DNA, 19 bp, Homo sapiens
ctggtggacagtcctggga

SEQ ID NO: 2008019 - DNA, 21 bp, Homo sapiens
ctggtggacagtcctgggaga

SEQ ID NO: 2008020 - DNA, 22 bp, Homo sapiens
ctggtggcaccagatgcaacct

SEQ ID NO: 2008021 - DNA, 12 bp, Homo sapiens
ctggtggcagct

SEQ ID NO: 2008022 - DNA, 14 bp, Homo sapiens
ctggtggcagctgc

SEQ ID NO: 2008023 - DNA, 23 bp, Homo sapiens
ctggtggcagtgggagctgcctg

SEQ ID NO: 2008024 - DNA, 21 bp, Homo sapiens
ctggtggccatgtcgcctgcc

SEQ ID NO: 2008025 - DNA, 22 bp, Homo sapiens
ctggtggccatgtcgcctgccc

SEQ ID NO: 2008026 - DNA, 13 bp, Homo sapiens
ctggtgggccacg

SEQ ID NO: 2008027 - DNA, 17 bp, Homo sapiens
ctggtgggcctcctctg

SEQ ID NO: 2008028 - DNA, 20 bp, Homo sapiens
ctggtgtgaggctgggccag

SEQ ID NO: 2008029 - DNA, 19 bp, Homo sapiens
ctggttcaagcgattctca

SEQ ID NO: 2008030 - DNA, 20 bp, Homo sapiens
ctggttcagggttggcccct

SEQ ID NO: 2008031 - DNA, 19 bp, Homo sapiens
ctggttgcttcagacctga

SEQ ID NO: 2008032 - DNA, 17 bp, Homo sapiens
ctggttggagagctaga

SEQ ID NO: 2008033 - DNA, 23 bp, Homo sapiens
ctggttggagagctagaacctgg

SEQ ID NO: 2008034 - DNA, 19 bp, Homo sapiens
ctggtttctcagaatccaa

SEQ ID NO: 2008035 - DNA, 14 bp, Homo sapiens
ctggtttctgttct

SEQ ID NO: 2008036 - DNA, 17 bp, Homo sapiens
ctggtttgaagaatgtt

SEQ ID NO: 2008037 - DNA, 21 bp, Homo sapiens
ctgtaaaatttgtttagaagt

SEQ ID NO: 2008038 - DNA, 13 bp, Homo sapiens
ctgtaaacacagt

SEQ ID NO: 2008039 - DNA, 21 bp, Homo sapiens
ctgtaaacatagatagtgctt

SEQ ID NO: 2008040 - DNA, 15 bp, Homo sapiens
ctgtaaatacatgtg

SEQ ID NO: 2008041 - DNA, 18 bp, Homo sapiens
ctgtaaatacatgtgtgg

SEQ ID NO: 2008042 - DNA, 22 bp, Homo sapiens
ctgtaaatagttttaaatatga

SEQ ID NO: 2008043 - DNA, 22 bp, Homo sapiens
ctgtaaatatgtttgtgcctta

SEQ ID NO: 2008044 - DNA, 23 bp, Homo sapiens
ctgtaaatatgtttgtgccttaa

SEQ ID NO: 2008045 - DNA, 12 bp, Homo sapiens
ctgtaaatcact

SEQ ID NO: 2008046 - DNA, 15 bp, Homo sapiens
ctgtaaatcacttgt

SEQ ID NO: 2008047 - DNA, 16 bp, Homo sapiens
ctgtaaatcacttgta

SEQ ID NO: 2008048 - DNA, 17 bp, Homo sapiens
ctgtaaatcacttgtaa

SEQ ID NO: 2008049 - DNA, 22 bp, Homo sapiens
ctgtaaatcacttgtaaataaa

SEQ ID NO: 2008050 - DNA, 20 bp, Homo sapiens
ctgtaacacaagccacagaa

SEQ ID NO: 2008051 - DNA, 14 bp, Homo sapiens
ctgtaactgctgag

SEQ ID NO: 2008052 - DNA, 17 bp, Homo sapiens
ctgtaactgctgagcca

SEQ ID NO: 2008053 - DNA, 20 bp, Homo sapiens
ctgtaactgctgagccactc

SEQ ID NO: 2008054 - DNA, 22 bp, Homo sapiens
ctgtaagcattctgagctgggc

SEQ ID NO: 2008055 - DNA, 15 bp, Homo sapiens
ctgtaaggaactgga

SEQ ID NO: 2008056 - DNA, 21 bp, Homo sapiens
ctgtaagtttattttttctac

SEQ ID NO: 2008057 - DNA, 22 bp, Homo sapiens
ctgtaagtttattttttctaca

SEQ ID NO: 2008058 - DNA, 23 bp, Homo sapiens
ctgtaagtttattttttctacac

SEQ ID NO: 2008059 - DNA, 19 bp, Homo sapiens
ctgtaatcagttatgccgt

SEQ ID NO: 2008060 - DNA, 13 bp, Homo sapiens
ctgtaatcccagc

SEQ ID NO: 2008061 - DNA, 15 bp, Homo sapiens
ctgtaatcccagcac

SEQ ID NO: 2008062 - DNA, 19 bp, Homo sapiens
ctgtaatcccagctactca

SEQ ID NO: 2008063 - DNA, 22 bp, Homo sapiens
ctgtaatggaactgaccccctc

SEQ ID NO: 2008064 - DNA, 21 bp, Homo sapiens
ctgtaattaagtaaaccaaaa

SEQ ID NO: 2008065 - DNA, 13 bp, Homo sapiens
ctgtaattaagtg

SEQ ID NO: 2008066 - DNA, 18 bp, Homo sapiens
ctgtaattaatattccta

SEQ ID NO: 2008067 - DNA, 18 bp, Homo sapiens
ctgtaattttgtttgtaa

SEQ ID NO: 2008068 - DNA, 15 bp, Homo sapiens
ctgtacaaaaacaaa

SEQ ID NO: 2008069 - DNA, 14 bp, Homo sapiens
ctgtacaatattta

SEQ ID NO: 2008070 - DNA, 15 bp, Homo sapiens
ctgtacaatatttaa

SEQ ID NO: 2008071 - DNA, 17 bp, Homo sapiens
ctgtacaatatttaaaa

SEQ ID NO: 2008072 - DNA, 16 bp, Homo sapiens
ctgtacacgtgtcctg

SEQ ID NO: 2008073 - DNA, 18 bp, Homo sapiens
ctgtacacgtgtcctgta

SEQ ID NO: 2008074 - DNA, 19 bp, Homo sapiens
ctgtacatagatgtatcat

SEQ ID NO: 2008075 - DNA, 20 bp, Homo sapiens
ctgtaccaagccccttggcc

SEQ ID NO: 2008076 - DNA, 21 bp, Homo sapiens
ctgtagggctggacctatgtc

SEQ ID NO: 2008077 - DNA, 14 bp, Homo sapiens
ctgtaggttgctta

SEQ ID NO: 2008078 - DNA, 14 bp, Homo sapiens
ctgtagtcccagcc

SEQ ID NO: 2008079 - DNA, 20 bp, Homo sapiens
ctgtagtcctagccactcag

SEQ ID NO: 2008080 - DNA, 23 bp, Homo sapiens
ctgtagtcctagccactcaggag

SEQ ID NO: 2008081 - DNA, 18 bp, Homo sapiens
ctgtagtgagaaactgat

SEQ ID NO: 2008082 - DNA, 21 bp, Homo sapiens
ctgtagtgccccctctaaccc

SEQ ID NO: 2008083 - DNA, 13 bp, Homo sapiens
ctgtagttaggaa

SEQ ID NO: 2008084 - DNA, 15 bp, Homo sapiens
ctgtagttaggaaat

SEQ ID NO: 2008085 - DNA, 22 bp, Homo sapiens
ctgtagttaggaaataaaacct

SEQ ID NO: 2008086 - DNA, 18 bp, Homo sapiens
ctgtataaacattaaatg

SEQ ID NO: 2008087 - DNA, 18 bp, Homo sapiens
ctgtataatctatttaca

SEQ ID NO: 2008088 - DNA, 21 bp, Homo sapiens
ctgtataattctacaggatgg

SEQ ID NO: 2008089 - DNA, 15 bp, Homo sapiens
ctgtataatttaaca

SEQ ID NO: 2008090 - DNA, 16 bp, Homo sapiens
ctgtatagttaggata

SEQ ID NO: 2008091 - DNA, 18 bp, Homo sapiens
ctgtatataatactaaag

SEQ ID NO: 2008092 - DNA, 23 bp, Homo sapiens
ctgtatataatactaaagtgtct

SEQ ID NO: 2008093 - DNA, 14 bp, Homo sapiens
ctgtatatacattt

SEQ ID NO: 2008094 - DNA, 16 bp, Homo sapiens
ctgtatatatatatgt

SEQ ID NO: 2008095 - DNA, 18 bp, Homo sapiens
ctgtatatatatatgtgt

SEQ ID NO: 2008096 - DNA, 19 bp, Homo sapiens
ctgtatatatatatgtgtg

SEQ ID NO: 2008097 - DNA, 22 bp, Homo sapiens
ctgtatatatatatgtgtgtgt

SEQ ID NO: 2008098 - DNA, 14 bp, Homo sapiens
ctgtatatgttgta

SEQ ID NO: 2008099 - DNA, 15 bp, Homo sapiens
ctgtatcaaatctgt

SEQ ID NO: 2008100 - DNA, 18 bp, Homo sapiens
ctgtatcccatgagcctc

SEQ ID NO: 2008101 - DNA, 19 bp, Homo sapiens
ctgtatcccatgagcctca

SEQ ID NO: 2008102 - DNA, 14 bp, Homo sapiens
ctgtatctgtaatt

SEQ ID NO: 2008103 - DNA, 13 bp, Homo sapiens
ctgtattcagatc

SEQ ID NO: 2008104 - DNA, 17 bp, Homo sapiens
ctgtattcagatcgtat

SEQ ID NO: 2008105 - DNA, 15 bp, Homo sapiens
ctgtatttgttccca

SEQ ID NO: 2008106 - DNA, 16 bp, Homo sapiens
ctgtatttgttcccaa

SEQ ID NO: 2008107 - DNA, 16 bp, Homo sapiens
ctgtattttgccagac

SEQ ID NO: 2008108 - DNA, 14 bp, Homo sapiens
ctgtcaagtacaag

SEQ ID NO: 2008109 - DNA, 17 bp, Homo sapiens
ctgtcaatttccctgac

SEQ ID NO: 2008110 - DNA, 18 bp, Homo sapiens
ctgtcacacaaggctggg

SEQ ID NO: 2008111 - DNA, 20 bp, Homo sapiens
ctgtcacccaggctggagta

SEQ ID NO: 2008112 - DNA, 16 bp, Homo sapiens
ctgtcaccctggcccc

SEQ ID NO: 2008113 - DNA, 19 bp, Homo sapiens
ctgtcacgcagccaccagg

SEQ ID NO: 2008114 - DNA, 19 bp, Homo sapiens
ctgtcacgtgaaatattta

SEQ ID NO: 2008115 - DNA, 19 bp, Homo sapiens
ctgtcagagatctgggagg

SEQ ID NO: 2008116 - DNA, 17 bp, Homo sapiens
ctgtcagagctgttggc

SEQ ID NO: 2008117 - DNA, 19 bp, Homo sapiens
ctgtcagagctgttggcct

SEQ ID NO: 2008118 - DNA, 15 bp, Homo sapiens
ctgtcagaggctaag

SEQ ID NO: 2008119 - DNA, 21 bp, Homo sapiens
ctgtcagatgggaagacatga

SEQ ID NO: 2008120 - DNA, 17 bp, Homo sapiens
ctgtcagccagccgccc

SEQ ID NO: 2008121 - DNA, 19 bp, Homo sapiens
ctgtcagccagccgccctg

SEQ ID NO: 2008122 - DNA, 20 bp, Homo sapiens
ctgtcagccagccgccctgg

SEQ ID NO: 2008123 - DNA, 21 bp, Homo sapiens
ctgtcagccagccgccctggg

SEQ ID NO: 2008124 - DNA, 17 bp, Homo sapiens
ctgtcagcccacagcag

SEQ ID NO: 2008125 - DNA, 23 bp, Homo sapiens
ctgtcagctcccctcggagaaga

SEQ ID NO: 2008126 - DNA, 19 bp, Homo sapiens
ctgtcataagaatgaataa

SEQ ID NO: 2008127 - DNA, 14 bp, Homo sapiens
ctgtcatagaaagt

SEQ ID NO: 2008128 - DNA, 14 bp, Homo sapiens
ctgtcatagaaatt

SEQ ID NO: 2008129 - DNA, 23 bp, Homo sapiens
ctgtcatcaattaaaggcaaagg

SEQ ID NO: 2008130 - DNA, 17 bp, Homo sapiens
ctgtcatcactccctgg

SEQ ID NO: 2008131 - DNA, 18 bp, Homo sapiens
ctgtcatcactccctgga

SEQ ID NO: 2008132 - DNA, 18 bp, Homo sapiens
ctgtcatccagaaaatgt

SEQ ID NO: 2008133 - DNA, 17 bp, Homo sapiens
ctgtcatcccgctcctg

SEQ ID NO: 2008134 - DNA, 19 bp, Homo sapiens
ctgtcatcccgctcctgct

SEQ ID NO: 2008135 - DNA, 20 bp, Homo sapiens
ctgtcatcccgctcctgctg

SEQ ID NO: 2008136 - DNA, 18 bp, Homo sapiens
ctgtcatctctctggggc

SEQ ID NO: 2008137 - DNA, 16 bp, Homo sapiens
ctgtcatggaaaagcc

SEQ ID NO: 2008138 - DNA, 20 bp, Homo sapiens
ctgtcatggaaaagcccagt

SEQ ID NO: 2008139 - DNA, 19 bp, Homo sapiens
ctgtcattcaaatgggtga

SEQ ID NO: 2008140 - DNA, 16 bp, Homo sapiens
ctgtcatttgagcagg

SEQ ID NO: 2008141 - DNA, 18 bp, Homo sapiens
ctgtcatttgagcagggc

SEQ ID NO: 2008142 - DNA, 20 bp, Homo sapiens
ctgtcatttgagcagggctc

SEQ ID NO: 2008143 - DNA, 11 bp, Homo sapiens
ctgtccaagga

SEQ ID NO: 2008144 - DNA, 22 bp, Homo sapiens
ctgtccactctcggggcccttg

SEQ ID NO: 2008145 - DNA, 22 bp, Homo sapiens
ctgtccaggcactgctgcccag

SEQ ID NO: 2008146 - DNA, 15 bp, Homo sapiens
ctgtccaggccactg

SEQ ID NO: 2008147 - DNA, 17 bp, Homo sapiens
ctgtccaggccactgtg

SEQ ID NO: 2008148 - DNA, 19 bp, Homo sapiens
ctgtccaggccactgtggc

SEQ ID NO: 2008149 - DNA, 14 bp, Homo sapiens
ctgtccagtttcca

SEQ ID NO: 2008150 - DNA, 13 bp, Homo sapiens
ctgtccataaagt

SEQ ID NO: 2008151 - DNA, 18 bp, Homo sapiens
ctgtcccaccaactctgc

SEQ ID NO: 2008152 - DNA, 20 bp, Homo sapiens
ctgtcccaccaactctgcac

SEQ ID NO: 2008153 - DNA, 14 bp, Homo sapiens
ctgtcccacctctt

SEQ ID NO: 2008154 - DNA, 12 bp, Homo sapiens
ctgtcccagagg

SEQ ID NO: 2008155 - DNA, 13 bp, Homo sapiens
ctgtcccagaggt

SEQ ID NO: 2008156 - DNA, 12 bp, Homo sapiens
ctgtcccagcag

SEQ ID NO: 2008157 - DNA, 13 bp, Homo sapiens
ctgtcccctctcc

SEQ ID NO: 2008158 - DNA, 15 bp, Homo sapiens
ctgtcccctctcccc

SEQ ID NO: 2008159 - DNA, 16 bp, Homo sapiens
ctgtcccctctgtcat

SEQ ID NO: 2008160 - DNA, 22 bp, Homo sapiens
ctgtcccctggggtctctgctg

SEQ ID NO: 2008161 - DNA, 16 bp, Homo sapiens
ctgtcccggttcacct

SEQ ID NO: 2008162 - DNA, 18 bp, Homo sapiens
ctgtccctacccactctt

SEQ ID NO: 2008163 - DNA, 13 bp, Homo sapiens
ctgtccctctttg

SEQ ID NO: 2008164 - DNA, 19 bp, Homo sapiens
ctgtcccttgctgttttca

SEQ ID NO: 2008165 - DNA, 16 bp, Homo sapiens
ctgtccgcctctgccc

SEQ ID NO: 2008166 - DNA, 19 bp, Homo sapiens
ctgtccgcctctgcccgca

SEQ ID NO: 2008167 - DNA, 20 bp, Homo sapiens
ctgtccgcctctgcccgcag

SEQ ID NO: 2008168 - DNA, 17 bp, Homo sapiens
ctgtcctactctgtgtc

SEQ ID NO: 2008169 - DNA, 22 bp, Homo sapiens
cttatggggacagcataccttg

SEQ ID NO: 2008170 - DNA, 17 bp, Homo sapiens
cttattagaacaggcaa

SEQ ID NO: 2008171 - DNA, 20 bp, Homo sapiens
cttattcatgctttctcctt

SEQ ID NO: 2008172 - DNA, 21 bp, Homo sapiens
cttattcatgctttctccttt

SEQ ID NO: 2008173 - DNA, 20 bp, Homo sapiens
cttattcccaaactacagaa

SEQ ID NO: 2008174 - DNA, 14 bp, Homo sapiens
cttattcccatgtg

SEQ ID NO: 2008175 - DNA, 12 bp, Homo sapiens
cttattgcccac

SEQ ID NO: 2008176 - DNA, 13 bp, Homo sapiens
cttattggccact

SEQ ID NO: 2008177 - DNA, 16 bp, Homo sapiens
cttattggccactggg

SEQ ID NO: 2008178 - DNA, 14 bp, Homo sapiens
cttattgtacctct

SEQ ID NO: 2008179 - DNA, 15 bp, Homo sapiens
cttattgtacctctc

SEQ ID NO: 2008180 - DNA, 18 bp, Homo sapiens
cttatttaatttttgcaa

SEQ ID NO: 2008181 - DNA, 19 bp, Homo sapiens
cttatttaatttttgcaat

SEQ ID NO: 2008182 - DNA, 14 bp, Homo sapiens
cttatttccctcat

SEQ ID NO: 2008183 - DNA, 18 bp, Homo sapiens
cttatttccctcatcttg

SEQ ID NO: 2008184 - DNA, 18 bp, Homo sapiens
cttatttgtttggtcact

SEQ ID NO: 2008185 - DNA, 12 bp, Homo sapiens
cttattttcaag

SEQ ID NO: 2008186 - DNA, 16 bp, Homo sapiens
cttattttcatgtata

SEQ ID NO: 2008187 - DNA, 14 bp, Homo sapiens
cttattttccaata

SEQ ID NO: 2008188 - DNA, 20 bp, Homo sapiens
cttattttgtaataaactct

SEQ ID NO: 2008189 - DNA, 17 bp, Homo sapiens
cttatttttgacagtgt

SEQ ID NO: 2008190 - DNA, 16 bp, Homo sapiens
cttcaaagtttaataa

SEQ ID NO: 2008191 - DNA, 14 bp, Homo sapiens
cttcaaatccatcc

SEQ ID NO: 2008192 - DNA, 17 bp, Homo sapiens
cttcaaattgtcttttg

SEQ ID NO: 2008193 - DNA, 16 bp, Homo sapiens
cttcaaccattcccca

SEQ ID NO: 2008194 - DNA, 13 bp, Homo sapiens
cttcaaccctcag

SEQ ID NO: 2008195 - DNA, 14 bp, Homo sapiens
cttcaaccctcagc

SEQ ID NO: 2008196 - DNA, 15 bp, Homo sapiens
cttcaaccctcagcc

SEQ ID NO: 2008197 - DNA, 17 bp, Homo sapiens
cttcaaccttaaggact

SEQ ID NO: 2008198 - DNA, 18 bp, Homo sapiens
cttcaagaactctgggct

SEQ ID NO: 2008199 - DNA, 19 bp, Homo sapiens
cttcaagcaccctgttccc

SEQ ID NO: 2008200 - DNA, 20 bp, Homo sapiens
cttcaagcaccctgttccct

SEQ ID NO: 2008201 - DNA, 15 bp, Homo sapiens
cttcaagcacctgca

SEQ ID NO: 2008202 - DNA, 17 bp, Homo sapiens
cttcaagtgatatatgt

SEQ ID NO: 2008203 - DNA, 20 bp, Homo sapiens
cttcaagtgatatatgtatt

SEQ ID NO: 2008204 - DNA, 21 bp, Homo sapiens
cttcaagtgatatatgtattt

SEQ ID NO: 2008205 - DNA, 16 bp, Homo sapiens
cttcaagttagctcag

SEQ ID NO: 2008206 - DNA, 18 bp, Homo sapiens
cttcaagttagctcagga

SEQ ID NO: 2008207 - DNA, 20 bp, Homo sapiens
cttcaagttagctcaggagg

SEQ ID NO: 2008208 - DNA, 15 bp, Homo sapiens
cttcaatatgaagga

SEQ ID NO: 2008209 - DNA, 15 bp, Homo sapiens
cttcaattaataaaa

SEQ ID NO: 2008210 - DNA, 14 bp, Homo sapiens
cttcacaacagatt

SEQ ID NO: 2008211 - DNA, 16 bp, Homo sapiens
cttcacaaccagccac

SEQ ID NO: 2008212 - DNA, 22 bp, Homo sapiens
cttcacaaccagccacacagag

SEQ ID NO: 2008213 - DNA, 19 bp, Homo sapiens
cttcacaacctccgtgctg

SEQ ID NO: 2008214 - DNA, 21 bp, Homo sapiens
cttcacaacctccgtgctggg

SEQ ID NO: 2008215 - DNA, 16 bp, Homo sapiens
cttcacacacaggcaa

SEQ ID NO: 2008216 - DNA, 17 bp, Homo sapiens
cttcacacacaggcaac

SEQ ID NO: 2008217 - DNA, 18 bp, Homo sapiens
cttcacactgcaagagcc

SEQ ID NO: 2008218 - DNA, 12 bp, Homo sapiens
cttcacagtgtt

SEQ ID NO: 2008219 - DNA, 13 bp, Homo sapiens
cttcacagtgttt

SEQ ID NO: 2008220 - DNA, 18 bp, Homo sapiens
cttcaccagagcccatgc

SEQ ID NO: 2008221 - DNA, 16 bp, Homo sapiens
cttcacccctgcactt

SEQ ID NO: 2008222 - DNA, 16 bp, Homo sapiens
cttcacccgctgcagc

SEQ ID NO: 2008223 - DNA, 16 bp, Homo sapiens
cttcacctttggtgca

SEQ ID NO: 2008224 - DNA, 14 bp, Homo sapiens
cttcactcagccac

SEQ ID NO: 2008225 - DNA, 14 bp, Homo sapiens
cttcactccggtgt

SEQ ID NO: 2008226 - DNA, 24 bp, Homo sapiens
cttcactccggtgtgcctgcagcc

SEQ ID NO: 2008227 - DNA, 16 bp, Homo sapiens
cttcactgttgaaaat

SEQ ID NO: 2008228 - DNA, 18 bp, Homo sapiens
cttcactgttgaaaatta

SEQ ID NO: 2008229 - DNA, 19 bp, Homo sapiens
cttcagaacagaggcattt

SEQ ID NO: 2008230 - DNA, 19 bp, Homo sapiens
cttcagacacaaaagtcca

SEQ ID NO: 2008231 - DNA, 13 bp, Homo sapiens
cttcagagaagtc

SEQ ID NO: 2008232 - DNA, 14 bp, Homo sapiens
cttcagagcctagc

SEQ ID NO: 2008233 - DNA, 18 bp, Homo sapiens
cttcagagcctagccacc

SEQ ID NO: 2008234 - DNA, 21 bp, Homo sapiens
cttcagagcctagccacctcc

SEQ ID NO: 2008235 - DNA, 13 bp, Homo sapiens
cttcagagctctt

SEQ ID NO: 2008236 - DNA, 20 bp, Homo sapiens
cttcagatcagtgcttgagt

SEQ ID NO: 2008237 - DNA, 10 bp, Homo sapiens
cttcagcacc

SEQ ID NO: 2008238 - DNA, 18 bp, Homo sapiens
cttcagcatatttatagc

SEQ ID NO: 2008239 - DNA, 20 bp, Homo sapiens
cttcagcctagccgacctca

SEQ ID NO: 2008240 - DNA, 21 bp, Homo sapiens
cttcagcctagccgacctcag

SEQ ID NO: 2008241 - DNA, 20 bp, Homo sapiens
cttcagcctcccgagtagct

SEQ ID NO: 2008242 - DNA, 13 bp, Homo sapiens
cttcagcctctcc

SEQ ID NO: 2008243 - DNA, 11 bp, Homo sapiens
cttcagctccc

SEQ ID NO: 2008244 - DNA, 14 bp, Homo sapiens
cttcagctcccata

SEQ ID NO: 2008245 - DNA, 18 bp, Homo sapiens
cttcaggctcttctcctt

SEQ ID NO: 2008246 - DNA, 19 bp, Homo sapiens
cttcaggctcttctccttt

SEQ ID NO: 2008247 - DNA, 19 bp, Homo sapiens
cttcaggtggagagcacta

SEQ ID NO: 2008248 - DNA, 21 bp, Homo sapiens
cttcaggtggagagcactaga

SEQ ID NO: 2008249 - DNA, 19 bp, Homo sapiens
cttcaggttcttagtgtca

SEQ ID NO: 2008250 - DNA, 14 bp, Homo sapiens
cttcagtcttggag

SEQ ID NO: 2008251 - DNA, 19 bp, Homo sapiens
cttcagtgcatctgggaag

SEQ ID NO: 2008252 - DNA, 15 bp, Homo sapiens
cttcagtgcccacca

SEQ ID NO: 2008253 - DNA, 13 bp, Homo sapiens
cttcagtggcagc

SEQ ID NO: 2008254 - DNA, 17 bp, Homo sapiens
cttcagtgtatggaaat

SEQ ID NO: 2008255 - DNA, 20 bp, Homo sapiens
cttcagtgtatggaaataaa

SEQ ID NO: 2008256 - DNA, 21 bp, Homo sapiens
cttcatactttttttcacagt

SEQ ID NO: 2008257 - DNA, 21 bp, Homo sapiens
cttcataggcggtcatgtgtg

SEQ ID NO: 2008258 - DNA, 24 bp, Homo sapiens
cttcatcaatttttatacatatca

SEQ ID NO: 2008259 - DNA, 15 bp, Homo sapiens
cttcatccctttcca

SEQ ID NO: 2008260 - DNA, 11 bp, Homo sapiens
cttcatcctct

SEQ ID NO: 2008261 - DNA, 19 bp, Homo sapiens
cttcatctggattccagag

SEQ ID NO: 2008262 - DNA, 15 bp, Homo sapiens
cttcatcttgacatg

SEQ ID NO: 2008263 - DNA, 16 bp, Homo sapiens
cttcatcttgacatgt

SEQ ID NO: 2008264 - DNA, 22 bp, Homo sapiens
cttcatgcaatgacatcttcaa

SEQ ID NO: 2008265 - DNA, 11 bp, Homo sapiens
cttcatgcctc

SEQ ID NO: 2008266 - DNA, 21 bp, Homo sapiens
cttcatgcctcagtttcccca

SEQ ID NO: 2008267 - DNA, 13 bp, Homo sapiens
cttcattaaagtc

SEQ ID NO: 2008268 - DNA, 14 bp, Homo sapiens
cttcatttcattgt

SEQ ID NO: 2008269 - DNA, 16 bp, Homo sapiens
cttcatttcattgtat

SEQ ID NO: 2008270 - DNA, 15 bp, Homo sapiens
cttcattttcagagt

SEQ ID NO: 2008271 - DNA, 19 bp, Homo sapiens
cttcattttcagagtgaca

SEQ ID NO: 2008272 - DNA, 16 bp, Homo sapiens
cttccaaccccagctg

SEQ ID NO: 2008273 - DNA, 17 bp, Homo sapiens
cttccaaccccagctgg

SEQ ID NO: 2008274 - DNA, 18 bp, Homo sapiens
cttccaaccccagctggc

SEQ ID NO: 2008275 - DNA, 21 bp, Homo sapiens
cttccaaccccagctggcctc

SEQ ID NO: 2008276 - DNA, 16 bp, Homo sapiens
cttccacctcctagag

SEQ ID NO: 2008277 - DNA, 17 bp, Homo sapiens
cttccacctcctagagg

SEQ ID NO: 2008278 - DNA, 22 bp, Homo sapiens
cttccacctcctagaggtgggc

SEQ ID NO: 2008279 - DNA, 20 bp, Homo sapiens
cttccagaagatgccctcca

SEQ ID NO: 2008280 - DNA, 12 bp, Homo sapiens
cttccagacata

SEQ ID NO: 2008281 - DNA, 13 bp, Homo sapiens
cttccagaccacc

SEQ ID NO: 2008282 - DNA, 22 bp, Homo sapiens
cttccagaccacctgccagcca

SEQ ID NO: 2008283 - DNA, 18 bp, Homo sapiens
cttccagagagtcctctg

SEQ ID NO: 2008284 - DNA, 20 bp, Homo sapiens
cttccagagagtcctctgga

SEQ ID NO: 2008285 - DNA, 21 bp, Homo sapiens
cttccagagagtcctctggat

SEQ ID NO: 2008286 - DNA, 18 bp, Homo sapiens
cttccagctagtgaccca

SEQ ID NO: 2008287 - DNA, 23 bp, Homo sapiens
cttccaggagcaatttgcacatg

SEQ ID NO: 2008288 - DNA, 20 bp, Homo sapiens
cttccaggagcccagagggc

SEQ ID NO: 2008289 - DNA, 10 bp, Homo sapiens
cttccaggct

SEQ ID NO: 2008290 - DNA, 15 bp, Homo sapiens
cttccaggctcttcc

SEQ ID NO: 2008291 - DNA, 21 bp, Homo sapiens
cttccaggctcttcctggacc

SEQ ID NO: 2008292 - DNA, 22 bp, Homo sapiens
cttccagtgcatgttgccatga

SEQ ID NO: 2008293 - DNA, 17 bp, Homo sapiens
cttccagtttgctttgc

SEQ ID NO: 2008294 - DNA, 18 bp, Homo sapiens
cttccatgtcgcctctgc

SEQ ID NO: 2008295 - DNA, 23 bp, Homo sapiens
cttccattgcatgtattgtaaac

SEQ ID NO: 2008296 - DNA, 22 bp, Homo sapiens
cttcccaaggttactcagcagc

SEQ ID NO: 2008297 - DNA, 15 bp, Homo sapiens
cttcccaatcagcac

SEQ ID NO: 2008298 - DNA, 17 bp, Homo sapiens
cttcccaatcagcactg

SEQ ID NO: 2008299 - DNA, 22 bp, Homo sapiens
cttcccaatcagcactgaaaat

SEQ ID NO: 2008300 - DNA, 11 bp, Homo sapiens
cttcccagagg

SEQ ID NO: 2008301 - DNA, 12 bp, Homo sapiens
cttcccagaggc

SEQ ID NO: 2008302 - DNA, 14 bp, Homo sapiens
cttcccagctctcc

SEQ ID NO: 2008303 - DNA, 15 bp, Homo sapiens
cttcccagctctccc

SEQ ID NO: 2008304 - DNA, 21 bp, Homo sapiens
cttcccagctctccctctggc

SEQ ID NO: 2008305 - DNA, 22 bp, Homo sapiens
cttcccagctctccctctggcc

SEQ ID NO: 2008306 - DNA, 19 bp, Homo sapiens
cttcccaggagtggaggag

SEQ ID NO: 2008307 - DNA, 23 bp, Homo sapiens
cttcccagttcaggagtcccaag

SEQ ID NO: 2008308 - DNA, 17 bp, Homo sapiens
cttcccatcactggagc

SEQ ID NO: 2008309 - DNA, 15 bp, Homo sapiens
cttcccatccccagc

SEQ ID NO: 2008310 - DNA, 17 bp, Homo sapiens
cttcccatgatgccgct

SEQ ID NO: 2008311 - DNA, 17 bp, Homo sapiens
cttcccatgtctttctc

SEQ ID NO: 2008312 - DNA, 21 bp, Homo sapiens
cttcccatgtctttctccaaa

SEQ ID NO: 2008313 - DNA, 15 bp, Homo sapiens
cttcccatttgtaat

SEQ ID NO: 2008314 - DNA, 21 bp, Homo sapiens
cttcccatttgtaatgtatct

SEQ ID NO: 2008315 - DNA, 13 bp, Homo sapiens
cttccccacagaa

SEQ ID NO: 2008316 - DNA, 15 bp, Homo sapiens
cttccccacagaact

SEQ ID NO: 2008317 - DNA, 18 bp, Homo sapiens
cttccccagactcagctc

SEQ ID NO: 2008318 - DNA, 19 bp, Homo sapiens
cttccccagactcagctcc

SEQ ID NO: 2008319 - DNA, 19 bp, Homo sapiens
cttccccatctccatttca

SEQ ID NO: 2008320 - DNA, 13 bp, Homo sapiens
cttcccccatccc

SEQ ID NO: 2008321 - DNA, 22 bp, Homo sapiens
cttcccccatcccctttcctcc

SEQ ID NO: 2008322 - DNA, 18 bp, Homo sapiens
cttcccctacacctccct

SEQ ID NO: 2008323 - DNA, 17 bp, Homo sapiens
cttcccctcgctgtcct

SEQ ID NO: 2008324 - DNA, 19 bp, Homo sapiens
cttcccctcgctgtcctgc

SEQ ID NO: 2008325 - DNA, 21 bp, Homo sapiens
cttcccctcgctgtcctgctg

SEQ ID NO: 2008326 - DNA, 13 bp, Homo sapiens
cttccccttctgt

SEQ ID NO: 2008327 - DNA, 14 bp, Homo sapiens
cttccccttctgtg

SEQ ID NO: 2008328 - DNA, 12 bp, Homo sapiens
cttccccttgcc

SEQ ID NO: 2008329 - DNA, 14 bp, Homo sapiens
cttcccctttcctg

SEQ ID NO: 2008330 - DNA, 17 bp, Homo sapiens
cttccccttttgcctgg

SEQ ID NO: 2008331 - DNA, 16 bp, Homo sapiens
cttcccgctcagccct

SEQ ID NO: 2008332 - DNA, 23 bp, Homo sapiens
cttcccgctcagccctccctgcc

SEQ ID NO: 2008333 - DNA, 16 bp, Homo sapiens
cttccctaggctgagc

SEQ ID NO: 2008334 - DNA, 19 bp, Homo sapiens
cttccctccccacagtcct

SEQ ID NO: 2008335 - DNA, 16 bp, Homo sapiens
cttccctccttccctt

SEQ ID NO: 2008336 - DNA, 11 bp, Homo sapiens
cttccctgctt

SEQ ID NO: 2008337 - DNA, 12 bp, Homo sapiens
cttccctggctt

SEQ ID NO: 2008338 - DNA, 13 bp, Homo sapiens
cttccctgggaac

SEQ ID NO: 2008339 - DNA, 19 bp, Homo sapiens
cttcccttctctccttccc

SEQ ID NO: 2008340 - DNA, 19 bp, Homo sapiens
cttccgatgacagtgctct

SEQ ID NO: 2008341 - DNA, 14 bp, Homo sapiens
cttccgctccttta

SEQ ID NO: 2008342 - DNA, 17 bp, Homo sapiens
cttccgctcctttacct

SEQ ID NO: 2008343 - DNA, 21 bp, Homo sapiens
cttccggaagaaaaagagcca

SEQ ID NO: 2008344 - DNA, 23 bp, Homo sapiens
cttcctacacccttggacttgag

SEQ ID NO: 2008345 - DNA, 22 bp, Homo sapiens
cttcctaccaaatataaacttg

SEQ ID NO: 2008346 - DNA, 15 bp, Homo sapiens
cttcctagttttctc

SEQ ID NO: 2008347 - DNA, 22 bp, Homo sapiens
cttcctagttttctcctcccag

SEQ ID NO: 2008348 - DNA, 19 bp, Homo sapiens
cttcctcactatgacactg

SEQ ID NO: 2008349 - DNA, 20 bp, Homo sapiens
cttcctcactatgacactga

SEQ ID NO: 2008350 - DNA, 22 bp, Homo sapiens
cttcctcactatgacactgagc

SEQ ID NO: 2008351 - DNA, 18 bp, Homo sapiens
cttcctccgtccacccag

SEQ ID NO: 2008352 - DNA, 19 bp, Homo sapiens
cttcctccgtccacccagg

SEQ ID NO: 2008353 - DNA, 23 bp, Homo sapiens
cttcctccgtccacccaggctgc

SEQ ID NO: 2008354 - DNA, 24 bp, Homo sapiens
cttcctccgtccacccaggctgca

SEQ ID NO: 2008355 - DNA, 13 bp, Homo sapiens
cttcctcctccac

SEQ ID NO: 2008356 - DNA, 15 bp, Homo sapiens
cttcctcctgatggc

SEQ ID NO: 2008357 - DNA, 22 bp, Homo sapiens
cttcctcctgatggccaagagc

SEQ ID NO: 2008358 - DNA, 14 bp, Homo sapiens
cttcctcctggttc

SEQ ID NO: 2008359 - DNA, 13 bp, Homo sapiens
cttcctctccact

SEQ ID NO: 2008360 - DNA, 15 bp, Homo sapiens
cttcctctccactgc

SEQ ID NO: 2008361 - DNA, 16 bp, Homo sapiens
cttcctctccactgcc

SEQ ID NO: 2008362 - DNA, 13 bp, Homo sapiens
cttcctctgctga

SEQ ID NO: 2008363 - DNA, 14 bp, Homo sapiens
cttcctctgttcta

SEQ ID NO: 2008364 - DNA, 19 bp, Homo sapiens
cttcctgaccctccgctgc

SEQ ID NO: 2008365 - DNA, 11 bp, Homo sapiens
cttcctgactg

SEQ ID NO: 2008366 - DNA, 20 bp, Homo sapiens
cttcctgactgacacaggcc

SEQ ID NO: 2008367 - DNA, 12 bp, Homo sapiens
cttcctgctgct

SEQ ID NO: 2008368 - DNA, 14 bp, Homo sapiens
cttcctgctgctgt

SEQ ID NO: 2008369 - DNA, 18 bp, Homo sapiens
cttcctgcttaaacttga

SEQ ID NO: 2008370 - DNA, 17 bp, Homo sapiens
cttcctggacagctgtg

SEQ ID NO: 2008371 - DNA, 24 bp, Homo sapiens
cttcctggacagctgtgcctcgct

SEQ ID NO: 2008372 - DNA, 18 bp, Homo sapiens
cttcctggacctgagtcg

SEQ ID NO: 2008373 - DNA, 20 bp, Homo sapiens
cttcctggcctcactggctg

SEQ ID NO: 2008374 - DNA, 21 bp, Homo sapiens
cttcctggcctcactggctgg

SEQ ID NO: 2008375 - DNA, 21 bp, Homo sapiens
cttcctggggccccgctggga

SEQ ID NO: 2008376 - DNA, 10 bp, Homo sapiens
cttcctgggt

SEQ ID NO: 2008377 - DNA, 22 bp, Homo sapiens
cttcctgtaacacaagccacag

SEQ ID NO: 2008378 - DNA, 16 bp, Homo sapiens
cttcctgtccactctc

SEQ ID NO: 2008379 - DNA, 23 bp, Homo sapiens
cttcctgtccactctcggggccc

SEQ ID NO: 2008380 - DNA, 15 bp, Homo sapiens
cttccttcatttcct

SEQ ID NO: 2008381 - DNA, 13 bp, Homo sapiens
cttccttccctgg

SEQ ID NO: 2008382 - DNA, 15 bp, Homo sapiens
cttccttccctggct

SEQ ID NO: 2008383 - DNA, 18 bp, Homo sapiens
cttccttctttctcttcc

SEQ ID NO: 2008384 - DNA, 19 bp, Homo sapiens
cttccttctttctcttccc

SEQ ID NO: 2008385 - DNA, 20 bp, Homo sapiens
cttccttctttctcttccct

SEQ ID NO: 2008386 - DNA, 21 bp, Homo sapiens
cttccttctttctcttccctc

SEQ ID NO: 2008387 - DNA, 20 bp, Homo sapiens
cttccttgctgtcctaggcc

SEQ ID NO: 2008388 - DNA, 12 bp, Homo sapiens
cttcctttcctc

SEQ ID NO: 2008389 - DNA, 17 bp, Homo sapiens
cttcctttcctctgcag

SEQ ID NO: 2008390 - DNA, 17 bp, Homo sapiens
cttcgcaaactgatgga

SEQ ID NO: 2008391 - DNA, 14 bp, Homo sapiens
cttcgctcctgtgt

SEQ ID NO: 2008392 - DNA, 15 bp, Homo sapiens
cttcgctcctgtgtc

SEQ ID NO: 2008393 - DNA, 23 bp, Homo sapiens
cttgaactgttctggcctcagac

SEQ ID NO: 2008394 - DNA, 14 bp, Homo sapiens
cttgaactttccaa

SEQ ID NO: 2008395 - DNA, 16 bp, Homo sapiens
cttgaactttccaaaa

SEQ ID NO: 2008396 - DNA, 13 bp, Homo sapiens
cttgaagaatatt

SEQ ID NO: 2008397 - DNA, 15 bp, Homo sapiens
cttgaagaatattgt

SEQ ID NO: 2008398 - DNA, 18 bp, Homo sapiens
cttgaagaatattgttaa

SEQ ID NO: 2008399 - DNA, 20 bp, Homo sapiens
cttgaagatcgttagtatct

SEQ ID NO: 2008400 - DNA, 18 bp, Homo sapiens
cttgaagcacagagggct

SEQ ID NO: 2008401 - DNA, 19 bp, Homo sapiens
cttgaagccactgaagctg

SEQ ID NO: 2008402 - DNA, 12 bp, Homo sapiens
cttgaatatttg

SEQ ID NO: 2008403 - DNA, 18 bp, Homo sapiens
cttgaatctgttactgaa

SEQ ID NO: 2008404 - DNA, 24 bp, Homo sapiens
cttgacaacatcccacagtggcac

SEQ ID NO: 2008405 - DNA, 14 bp, Homo sapiens
cttgacattcaagg

SEQ ID NO: 2008406 - DNA, 11 bp, Homo sapiens
cttgaccagac

SEQ ID NO: 2008407 - DNA, 20 bp, Homo sapiens
cttgaccagacctagacctg

SEQ ID NO: 2008408 - DNA, 22 bp, Homo sapiens
cttgaccagacctagacctggg

SEQ ID NO: 2008409 - DNA, 22 bp, Homo sapiens
cttggactattataatttaatg

SEQ ID NO: 2008410 - DNA, 17 bp, Homo sapiens
cttggacttcctggggc

SEQ ID NO: 2008411 - DNA, 21 bp, Homo sapiens
cttggacttcctggggccccg

SEQ ID NO: 2008412 - DNA, 18 bp, Homo sapiens
cttggagaactttccatc

SEQ ID NO: 2008413 - DNA, 16 bp, Homo sapiens
cttggagagacacagc

SEQ ID NO: 2008414 - DNA, 22 bp, Homo sapiens
cttggagagcagctggctctcc

SEQ ID NO: 2008415 - DNA, 21 bp, Homo sapiens
cttggagagggacgaagaaag

SEQ ID NO: 2008416 - DNA, 13 bp, Homo sapiens
cttggaggacagt

SEQ ID NO: 2008417 - DNA, 16 bp, Homo sapiens
cttggaggacagtggg

SEQ ID NO: 2008418 - DNA, 17 bp, Homo sapiens
cttggaggccaccggga

SEQ ID NO: 2008419 - DNA, 18 bp, Homo sapiens
cttggataatgctgttgc

SEQ ID NO: 2008420 - DNA, 15 bp, Homo sapiens
cttggatttctgaat

SEQ ID NO: 2008421 - DNA, 15 bp, Homo sapiens
cttggcaacagaagc

SEQ ID NO: 2008422 - DNA, 16 bp, Homo sapiens
cttggcagagaggacc

SEQ ID NO: 2008423 - DNA, 18 bp, Homo sapiens
cttggcagtattccatgg

SEQ ID NO: 2008424 - DNA, 16 bp, Homo sapiens
cttggcccctgtgtga

SEQ ID NO: 2008425 - DNA, 20 bp, Homo sapiens
cttggcctggtgggaccagg

SEQ ID NO: 2008426 - DNA, 10 bp, Homo sapiens
cttggccttg

SEQ ID NO: 2008427 - DNA, 17 bp, Homo sapiens
cttggctgcagggagtc

SEQ ID NO: 2008428 - DNA, 13 bp, Homo sapiens
cttggctgtgagg

SEQ ID NO: 2008429 - DNA, 21 bp, Homo sapiens
cttggctgtgaggcccctgga

SEQ ID NO: 2008430 - DNA, 18 bp, Homo sapiens
cttggcttttgcttggca

SEQ ID NO: 2008431 - DNA, 20 bp, Homo sapiens
cttggcttttgcttggcaga

SEQ ID NO: 2008432 - DNA, 17 bp, Homo sapiens
cttgggaggctgaggca

SEQ ID NO: 2008433 - DNA, 13 bp, Homo sapiens
cttgggcaccccc

SEQ ID NO: 2008434 - DNA, 22 bp, Homo sapiens
cttgggcacccccagcctgggc

SEQ ID NO: 2008435 - DNA, 17 bp, Homo sapiens
ctttacatgcaatttat

SEQ ID NO: 2008436 - DNA, 16 bp, Homo sapiens
ctttacatgctgtgct

SEQ ID NO: 2008437 - DNA, 22 bp, Homo sapiens
ctttacatgctgtgctctttga

SEQ ID NO: 2008438 - DNA, 22 bp, Homo sapiens
ctttacattttatttattagct

SEQ ID NO: 2008439 - DNA, 13 bp, Homo sapiens
ctttaccactatg

SEQ ID NO: 2008440 - DNA, 13 bp, Homo sapiens
ctttacctgagac

SEQ ID NO: 2008441 - DNA, 11 bp, Homo sapiens
ctttaccttta

SEQ ID NO: 2008442 - DNA, 18 bp, Homo sapiens
ctttactcccttcctggc

SEQ ID NO: 2008443 - DNA, 18 bp, Homo sapiens
ctttagaatgagagtgtg

SEQ ID NO: 2008444 - DNA, 22 bp, Homo sapiens
ctttagaatgagagtgtgaaat

SEQ ID NO: 2008445 - DNA, 22 bp, Homo sapiens
ctttagccactggtttctcaga

SEQ ID NO: 2008446 - DNA, 15 bp, Homo sapiens
ctttagctatgtgga

SEQ ID NO: 2008447 - DNA, 15 bp, Homo sapiens
ctttaggcagcctgc

SEQ ID NO: 2008448 - DNA, 21 bp, Homo sapiens
ctttagggcttatggccaggg

SEQ ID NO: 2008449 - DNA, 22 bp, Homo sapiens
ctttagttcctactttagccac

SEQ ID NO: 2008450 - DNA, 13 bp, Homo sapiens
ctttataaacttt

SEQ ID NO: 2008451 - DNA, 12 bp, Homo sapiens
ctttatatttag

SEQ ID NO: 2008452 - DNA, 13 bp, Homo sapiens
ctttatatttagt

SEQ ID NO: 2008453 - DNA, 22 bp, Homo sapiens
ctttatcagtgatggtctcaca

SEQ ID NO: 2008454 - DNA, 21 bp, Homo sapiens
ctttatccctgaggtcacctg

SEQ ID NO: 2008455 - DNA, 16 bp, Homo sapiens
ctttatccttaggaaa

SEQ ID NO: 2008456 - DNA, 13 bp, Homo sapiens
ctttatctgtgac

SEQ ID NO: 2008457 - DNA, 21 bp, Homo sapiens
ctttatgtctgtggatttttt

SEQ ID NO: 2008458 - DNA, 20 bp, Homo sapiens
ctttatgttactacatgcac

SEQ ID NO: 2008459 - DNA, 15 bp, Homo sapiens
ctttattaatgaact

SEQ ID NO: 2008460 - DNA, 22 bp, Homo sapiens
ctttattaatgaactgtgacag

SEQ ID NO: 2008461 - DNA, 23 bp, Homo sapiens
ctttattaatgaactgtgacagg

SEQ ID NO: 2008462 - DNA, 12 bp, Homo sapiens
ctttatttatgg

SEQ ID NO: 2008463 - DNA, 21 bp, Homo sapiens
ctttattttttaagtatttat

SEQ ID NO: 2008464 - DNA, 14 bp, Homo sapiens
ctttcaaatttcac

SEQ ID NO: 2008465 - DNA, 21 bp, Homo sapiens
ctttcaacttaaatcactgag

SEQ ID NO: 2008466 - DNA, 14 bp, Homo sapiens
ctttcaaggaaagt

SEQ ID NO: 2008467 - DNA, 20 bp, Homo sapiens
ctttcaatggtttgcaagga

SEQ ID NO: 2008468 - DNA, 18 bp, Homo sapiens
ctttcaattgtattttat

SEQ ID NO: 2008469 - DNA, 14 bp, Homo sapiens
ctttcacaaaaaag

SEQ ID NO: 2008470 - DNA, 14 bp, Homo sapiens
ctttcagagccagt

SEQ ID NO: 2008471 - DNA, 21 bp, Homo sapiens
ctttcagcattaggcttttaa

SEQ ID NO: 2008472 - DNA, 23 bp, Homo sapiens
ctttcatctattctttccctaga

SEQ ID NO: 2008473 - DNA, 20 bp, Homo sapiens
ctttcattaaagcatttact

SEQ ID NO: 2008474 - DNA, 16 bp, Homo sapiens
ctttccacctgctttc

SEQ ID NO: 2008475 - DNA, 13 bp, Homo sapiens
ctttccatctgct

SEQ ID NO: 2008476 - DNA, 15 bp, Homo sapiens
ctttccatctgcttg

SEQ ID NO: 2008477 - DNA, 20 bp, Homo sapiens
ctttcccaagtattgcgaat

SEQ ID NO: 2008478 - DNA, 19 bp, Homo sapiens
ctttcccaccgccctccct

SEQ ID NO: 2008479 - DNA, 17 bp, Homo sapiens
ctttcccatgatccaga

SEQ ID NO: 2008480 - DNA, 19 bp, Homo sapiens
ctttcccatgatccagaac

SEQ ID NO: 2008481 - DNA, 20 bp, Homo sapiens
ctttcccatgatccagaact

SEQ ID NO: 2008482 - DNA, 21 bp, Homo sapiens
ctttcccatgctgaattattt

SEQ ID NO: 2008483 - DNA, 15 bp, Homo sapiens
ctttccccacctctt

SEQ ID NO: 2008484 - DNA, 16 bp, Homo sapiens
ctttccccacctcttc

SEQ ID NO: 2008485 - DNA, 21 bp, Homo sapiens
ctttccccacctcttccttcc

SEQ ID NO: 2008486 - DNA, 16 bp, Homo sapiens
ctttccccagacacat

SEQ ID NO: 2008487 - DNA, 11 bp, Homo sapiens
ctttcccccac

SEQ ID NO: 2008488 - DNA, 13 bp, Homo sapiens
ctttcccccaccc

SEQ ID NO: 2008489 - DNA, 19 bp, Homo sapiens
ctttcccccaccccagagt

SEQ ID NO: 2008490 - DNA, 21 bp, Homo sapiens
ctttcccccaccccagagttg

SEQ ID NO: 2008491 - DNA, 21 bp, Homo sapiens
ctttccccgggggaggaaggg

SEQ ID NO: 2008492 - DNA, 16 bp, Homo sapiens
ctttcccctcagagct

SEQ ID NO: 2008493 - DNA, 23 bp, Homo sapiens
ctttccctaagaggcgacttcct

SEQ ID NO: 2008494 - DNA, 20 bp, Homo sapiens
ctttccctagaggcaaacat

SEQ ID NO: 2008495 - DNA, 18 bp, Homo sapiens
ctttccctcaccccctcc

SEQ ID NO: 2008496 - DNA, 14 bp, Homo sapiens
ctttcccttccagt

SEQ ID NO: 2008497 - DNA, 20 bp, Homo sapiens
ctttccgctgtcgccccagg

SEQ ID NO: 2008498 - DNA, 18 bp, Homo sapiens
ctttcctaaagtctctgc

SEQ ID NO: 2008499 - DNA, 22 bp, Homo sapiens
ctttcctaaagtctctgctgct

SEQ ID NO: 2008500 - DNA, 15 bp, Homo sapiens
ctttcctaaatgttt

SEQ ID NO: 2008501 - DNA, 15 bp, Homo sapiens
ctttcctacaaaatg

SEQ ID NO: 2008502 - DNA, 16 bp, Homo sapiens
ctttcctacaaaatgg

SEQ ID NO: 2008503 - DNA, 20 bp, Homo sapiens
ctttcctattttcttttcca

SEQ ID NO: 2008504 - DNA, 22 bp, Homo sapiens
ctttcctccaaactcctgcctg

SEQ ID NO: 2008505 - DNA, 23 bp, Homo sapiens
gaaggcagggacagagatggagg

SEQ ID NO: 2008506 - DNA, 17 bp, Homo sapiens
gaaggcagtctgaaccc

SEQ ID NO: 2008507 - DNA, 13 bp, Homo sapiens
gaaggcgaggaga

SEQ ID NO: 2008508 - DNA, 22 bp, Homo sapiens
gaaggctacttcggggctggga

SEQ ID NO: 2008509 - DNA, 20 bp, Homo sapiens
gaaggctgcctaaggaggag

SEQ ID NO: 2008510 - DNA, 13 bp, Homo sapiens
gaaggctggctga

SEQ ID NO: 2008511 - DNA, 14 bp, Homo sapiens
gaaggctggctgag

SEQ ID NO: 2008512 - DNA, 15 bp, Homo sapiens
gaaggctggctgagt

SEQ ID NO: 2008513 - DNA, 16 bp, Homo sapiens
gaaggctggctgggca

SEQ ID NO: 2008514 - DNA, 14 bp, Homo sapiens
gaaggctggggcca

SEQ ID NO: 2008515 - DNA, 15 bp, Homo sapiens
gaaggctggggccag

SEQ ID NO: 2008516 - DNA, 16 bp, Homo sapiens
gaaggctggggccagt

SEQ ID NO: 2008517 - DNA, 19 bp, Homo sapiens
gaaggctggggccagtgta

SEQ ID NO: 2008518 - DNA, 17 bp, Homo sapiens
gaagggaataaggtaca

SEQ ID NO: 2008519 - DNA, 22 bp, Homo sapiens
gaagggaataaggtacaagaag

SEQ ID NO: 2008520 - DNA, 14 bp, Homo sapiens
gaagggacacacac

SEQ ID NO: 2008521 - DNA, 17 bp, Homo sapiens
gaagggaccttgaaggg

SEQ ID NO: 2008522 - DNA, 12 bp, Homo sapiens
gaagggagaagg

SEQ ID NO: 2008523 - DNA, 21 bp, Homo sapiens
gaagggagaaggatctagaat

SEQ ID NO: 2008524 - DNA, 16 bp, Homo sapiens
gaagggccagccctac

SEQ ID NO: 2008525 - DNA, 13 bp, Homo sapiens
gaagggccaggag

SEQ ID NO: 2008526 - DNA, 18 bp, Homo sapiens
gaagggccaggagagaga

SEQ ID NO: 2008527 - DNA, 18 bp, Homo sapiens
gaagggccagtctgggct

SEQ ID NO: 2008528 - DNA, 15 bp, Homo sapiens
gaagggcttcttctt

SEQ ID NO: 2008529 - DNA, 13 bp, Homo sapiens
gaaggggcacacc

SEQ ID NO: 2008530 - DNA, 22 bp, Homo sapiens
gaaggggcacaccactgccctg

SEQ ID NO: 2008531 - DNA, 19 bp, Homo sapiens
gaaggggccccggggctgg

SEQ ID NO: 2008532 - DNA, 14 bp, Homo sapiens
gaagggggcggcct

SEQ ID NO: 2008533 - DNA, 17 bp, Homo sapiens
gaagggggtccacccag

SEQ ID NO: 2008534 - DNA, 21 bp, Homo sapiens
gaagggggtgtgcgtgcgtgt

SEQ ID NO: 2008535 - DNA, 16 bp, Homo sapiens
gaaggggtgccctctg

SEQ ID NO: 2008536 - DNA, 13 bp, Homo sapiens
gaagggtaaagaa

SEQ ID NO: 2008537 - DNA, 19 bp, Homo sapiens
gaagggtggtctgagcacc

SEQ ID NO: 2008538 - DNA, 18 bp, Homo sapiens
gaagggttggtgggctgg

SEQ ID NO: 2008539 - DNA, 16 bp, Homo sapiens
gaaggtagcccagcac

SEQ ID NO: 2008540 - DNA, 18 bp, Homo sapiens
gaaggtagcccagcactg

SEQ ID NO: 2008541 - DNA, 12 bp, Homo sapiens
gaaggttcctga

SEQ ID NO: 2008542 - DNA, 12 bp, Homo sapiens
gaaggttgtaag

SEQ ID NO: 2008543 - DNA, 16 bp, Homo sapiens
gaaggtttgtatattg

SEQ ID NO: 2008544 - DNA, 18 bp, Homo sapiens
gaagtaaagtttatttca

SEQ ID NO: 2008545 - DNA, 19 bp, Homo sapiens
gaagtacatgaagagcagc

SEQ ID NO: 2008546 - DNA, 22 bp, Homo sapiens
gaagtatccaattatgtgacaa

SEQ ID NO: 2008547 - DNA, 11 bp, Homo sapiens
gaagtatgtgt

SEQ ID NO: 2008548 - DNA, 13 bp, Homo sapiens
gaagtcacacagt

SEQ ID NO: 2008549 - DNA, 20 bp, Homo sapiens
gaagtcagttggagaaaatg

SEQ ID NO: 2008550 - DNA, 15 bp, Homo sapiens
gaagtcataaacagc

SEQ ID NO: 2008551 - DNA, 19 bp, Homo sapiens
gaagtcatgaagcccaagt

SEQ ID NO: 2008552 - DNA, 15 bp, Homo sapiens
gaagtccctgttctc

SEQ ID NO: 2008553 - DNA, 16 bp, Homo sapiens
gaagtccctgttctca

SEQ ID NO: 2008554 - DNA, 15 bp, Homo sapiens
gaagtctaggagctg

SEQ ID NO: 2008555 - DNA, 18 bp, Homo sapiens
gaagtcttacttaaaaaa

SEQ ID NO: 2008556 - DNA, 18 bp, Homo sapiens
gaagtctttgttgcacca

SEQ ID NO: 2008557 - DNA, 17 bp, Homo sapiens
gaagtgaaggagaaagg

SEQ ID NO: 2008558 - DNA, 17 bp, Homo sapiens
gaagtgaataactgcaa

SEQ ID NO: 2008559 - DNA, 18 bp, Homo sapiens
gaagtgcaaatttgatac

SEQ ID NO: 2008560 - DNA, 12 bp, Homo sapiens
gaagtgctcccc

SEQ ID NO: 2008561 - DNA, 13 bp, Homo sapiens
gaagtgctcccca

SEQ ID NO: 2008562 - DNA, 15 bp, Homo sapiens
gaagtggctctcagg

SEQ ID NO: 2008563 - DNA, 21 bp, Homo sapiens
gaagtgggccaggacaggccc

SEQ ID NO: 2008564 - DNA, 16 bp, Homo sapiens
gaagtgggggccgctg

SEQ ID NO: 2008565 - DNA, 19 bp, Homo sapiens
gaagtgggggccgctggcc

SEQ ID NO: 2008566 - DNA, 20 bp, Homo sapiens
gaagtgggggccgctggccc

SEQ ID NO: 2008567 - DNA, 10 bp, Homo sapiens
gaagtgttca

SEQ ID NO: 2008568 - DNA, 18 bp, Homo sapiens
gaagtgttcaagaaataa

SEQ ID NO: 2008569 - DNA, 23 bp, Homo sapiens
gaagttaagcagcctttctgtgg

SEQ ID NO: 2008570 - DNA, 17 bp, Homo sapiens
gaagttgcagtgagctg

SEQ ID NO: 2008571 - DNA, 20 bp, Homo sapiens
gaagttgtgccttttatagc

SEQ ID NO: 2008572 - DNA, 15 bp, Homo sapiens
gaagtttggataacc

SEQ ID NO: 2008573 - DNA, 12 bp, Homo sapiens
gaagttttgcat

SEQ ID NO: 2008574 - DNA, 15 bp, Homo sapiens
gaagttttgtacaga

SEQ ID NO: 2008575 - DNA, 14 bp, Homo sapiens
gaataaaaaccctg

SEQ ID NO: 2008576 - DNA, 22 bp, Homo sapiens
gaataaaattgtaaaattgtat

SEQ ID NO: 2008577 - DNA, 17 bp, Homo sapiens
gaataaagcctgctttt

SEQ ID NO: 2008578 - DNA, 13 bp, Homo sapiens
gaataaagtctga

SEQ ID NO: 2008579 - DNA, 14 bp, Homo sapiens
gaataaagtctgag

SEQ ID NO: 2008580 - DNA, 16 bp, Homo sapiens
gaataaagtctgagtg

SEQ ID NO: 2008581 - DNA, 14 bp, Homo sapiens
gaataaagttgaag

SEQ ID NO: 2008582 - DNA, 16 bp, Homo sapiens
gaataaagttgaagct

SEQ ID NO: 2008583 - DNA, 11 bp, Homo sapiens
gaataaatgtt

SEQ ID NO: 2008584 - DNA, 13 bp, Homo sapiens
gaataaatgttca

SEQ ID NO: 2008585 - DNA, 23 bp, Homo sapiens
gaataaccacttaaaaaatgtcc

SEQ ID NO: 2008586 - DNA, 17 bp, Homo sapiens
gaataaggtacaagaag

SEQ ID NO: 2008587 - DNA, 23 bp, Homo sapiens
gaataaggtacaagaagcatttt

SEQ ID NO: 2008588 - DNA, 14 bp, Homo sapiens
gaataagtgctgtt

SEQ ID NO: 2008589 - DNA, 19 bp, Homo sapiens
gaataatatgctgccaaat

SEQ ID NO: 2008590 - DNA, 21 bp, Homo sapiens
gaataattgtgtacaaagtag

SEQ ID NO: 2008591 - DNA, 14 bp, Homo sapiens
gaatacagaaaatg

SEQ ID NO: 2008592 - DNA, 15 bp, Homo sapiens
gaatacccccagaga

SEQ ID NO: 2008593 - DNA, 12 bp, Homo sapiens
gaataccctttt

SEQ ID NO: 2008594 - DNA, 19 bp, Homo sapiens
gaatagcgaatcatctcaa

SEQ ID NO: 2008595 - DNA, 15 bp, Homo sapiens
gaatagctgggacta

SEQ ID NO: 2008596 - DNA, 15 bp, Homo sapiens
gaataggtcattttc

SEQ ID NO: 2008597 - DNA, 18 bp, Homo sapiens
gaatagtcgcgcaagcat

SEQ ID NO: 2008598 - DNA, 16 bp, Homo sapiens
gaatagtctgtgtgca

SEQ ID NO: 2008599 - DNA, 13 bp, Homo sapiens
gaatagtgtctga

SEQ ID NO: 2008600 - DNA, 20 bp, Homo sapiens
gaatataattgttttatctg

SEQ ID NO: 2008601 - DNA, 11 bp, Homo sapiens
gaatatattat

SEQ ID NO: 2008602 - DNA, 11 bp, Homo sapiens
gaatattcagg

SEQ ID NO: 2008603 - DNA, 14 bp, Homo sapiens
gaatattgttaaaa

SEQ ID NO: 2008604 - DNA, 18 bp, Homo sapiens
gaatatttacaataaaga

SEQ ID NO: 2008605 - DNA, 13 bp, Homo sapiens
gaatatttattac

SEQ ID NO: 2008606 - DNA, 19 bp, Homo sapiens
gaatatttcaaatgaacac

SEQ ID NO: 2008607 - DNA, 16 bp, Homo sapiens
gaatattttaacttcc

SEQ ID NO: 2008608 - DNA, 13 bp, Homo sapiens
gaatcaaaactct

SEQ ID NO: 2008609 - DNA, 16 bp, Homo sapiens
gaatcaaagacatgga

SEQ ID NO: 2008610 - DNA, 20 bp, Homo sapiens
gaatcaagctagaaggccac

SEQ ID NO: 2008611 - DNA, 22 bp, Homo sapiens
gaatcaagctagaaggccacat

SEQ ID NO: 2008612 - DNA, 20 bp, Homo sapiens
gaatcaattgtctatatgga

SEQ ID NO: 2008613 - DNA, 20 bp, Homo sapiens
gaatcacctggagggcttgg

SEQ ID NO: 2008614 - DNA, 18 bp, Homo sapiens
gaatcagaccctacccca

SEQ ID NO: 2008615 - DNA, 16 bp, Homo sapiens
gaatcaggttgacagt

SEQ ID NO: 2008616 - DNA, 14 bp, Homo sapiens
gaatcatgttggat

SEQ ID NO: 2008617 - DNA, 16 bp, Homo sapiens
gaatccatcaggactt

SEQ ID NO: 2008618 - DNA, 18 bp, Homo sapiens
gaatccctgcagcctggt

SEQ ID NO: 2008619 - DNA, 13 bp, Homo sapiens
gaatcctgcctct

SEQ ID NO: 2008620 - DNA, 14 bp, Homo sapiens
gaatcctgtcgatt

SEQ ID NO: 2008621 - DNA, 22 bp, Homo sapiens
gaatcggagcgaagcagagagg

SEQ ID NO: 2008622 - DNA, 19 bp, Homo sapiens
gaatctacagaacaaagaa

SEQ ID NO: 2008623 - DNA, 15 bp, Homo sapiens
gaatctacctgtggt

SEQ ID NO: 2008624 - DNA, 14 bp, Homo sapiens
gaatctcagagaca

SEQ ID NO: 2008625 - DNA, 12 bp, Homo sapiens
gaatctgcaggg

SEQ ID NO: 2008626 - DNA, 17 bp, Homo sapiens
gaatctgcagggagcaa

SEQ ID NO: 2008627 - DNA, 18 bp, Homo sapiens
gaatctgccattactctg

SEQ ID NO: 2008628 - DNA, 16 bp, Homo sapiens
gaatctgtgcagatga

SEQ ID NO: 2008629 - DNA, 13 bp, Homo sapiens
gaatcttactcct

SEQ ID NO: 2008630 - DNA, 23 bp, Homo sapiens
gaatgaaatcctgcttcagtgta

SEQ ID NO: 2008631 - DNA, 23 bp, Homo sapiens
gaatgaaccacatcttgctctgc

SEQ ID NO: 2008632 - DNA, 13 bp, Homo sapiens
gaatgaagcatgt

SEQ ID NO: 2008633 - DNA, 14 bp, Homo sapiens
gaatgaagcatgta

SEQ ID NO: 2008634 - DNA, 14 bp, Homo sapiens
gaatgaggtcccag

SEQ ID NO: 2008635 - DNA, 18 bp, Homo sapiens
gaatgaggtcccaggcag

SEQ ID NO: 2008636 - DNA, 14 bp, Homo sapiens
gaatgatttcatgc

SEQ ID NO: 2008637 - DNA, 16 bp, Homo sapiens
gaatgatttccaaaga

SEQ ID NO: 2008638 - DNA, 14 bp, Homo sapiens
gaatgatttttaga

SEQ ID NO: 2008639 - DNA, 22 bp, Homo sapiens
gaatgcacaccaaaaaaatact

SEQ ID NO: 2008640 - DNA, 17 bp, Homo sapiens
gaatgcagggaagaggg

SEQ ID NO: 2008641 - DNA, 17 bp, Homo sapiens
gaatgcccacaggcaaa

SEQ ID NO: 2008642 - DNA, 22 bp, Homo sapiens
gaatgcccacaggcaaatgcat

SEQ ID NO: 2008643 - DNA, 13 bp, Homo sapiens
gaatgcctcctcc

SEQ ID NO: 2008644 - DNA, 20 bp, Homo sapiens
gaatgccttccgggccgggc

SEQ ID NO: 2008645 - DNA, 17 bp, Homo sapiens
gaatgctggttttccta

SEQ ID NO: 2008646 - DNA, 11 bp, Homo sapiens
gaatggagcag

SEQ ID NO: 2008647 - DNA, 14 bp, Homo sapiens
gaatggatggggag

SEQ ID NO: 2008648 - DNA, 13 bp, Homo sapiens
gaatggcaatggt

SEQ ID NO: 2008649 - DNA, 17 bp, Homo sapiens
gaatggctatgttttta

SEQ ID NO: 2008650 - DNA, 19 bp, Homo sapiens
gaatggctatgtttttaat

SEQ ID NO: 2008651 - DNA, 21 bp, Homo sapiens
gaatggggcgatcaagtccag

SEQ ID NO: 2008652 - DNA, 14 bp, Homo sapiens
gaatggtccagggt

SEQ ID NO: 2008653 - DNA, 14 bp, Homo sapiens
gaatggtgcagaaa

SEQ ID NO: 2008654 - DNA, 22 bp, Homo sapiens
gaatggttccatgcctgagggt

SEQ ID NO: 2008655 - DNA, 15 bp, Homo sapiens
gaatgtagctggttt

SEQ ID NO: 2008656 - DNA, 11 bp, Homo sapiens
gaatgtctcag

SEQ ID NO: 2008657 - DNA, 13 bp, Homo sapiens
gaatgtgcatttc

SEQ ID NO: 2008658 - DNA, 16 bp, Homo sapiens
gaatgtgcatttcttg

SEQ ID NO: 2008659 - DNA, 22 bp, Homo sapiens
gaatgttactttggaatgacta

SEQ ID NO: 2008660 - DNA, 14 bp, Homo sapiens
gaatgttccctgca

SEQ ID NO: 2008661 - DNA, 15 bp, Homo sapiens
gaatgttccctgcac

SEQ ID NO: 2008662 - DNA, 22 bp, Homo sapiens
gaatgttccctgcaccctggaa

SEQ ID NO: 2008663 - DNA, 20 bp, Homo sapiens
gaatgtttacactctttgta

SEQ ID NO: 2008664 - DNA, 14 bp, Homo sapiens
gaatgtttattcct

SEQ ID NO: 2008665 - DNA, 22 bp, Homo sapiens
gaatgtttgaactgccaagaaa

SEQ ID NO: 2008666 - DNA, 19 bp, Homo sapiens
gaatgtttgcctctgcctc

SEQ ID NO: 2008667 - DNA, 13 bp, Homo sapiens
gaattaaatttaa

SEQ ID NO: 2008668 - DNA, 17 bp, Homo sapiens
gaattaactccattcca

SEQ ID NO: 2008669 - DNA, 21 bp, Homo sapiens
gaattaagttagggaatggca

SEQ ID NO: 2008670 - DNA, 16 bp, Homo sapiens
gaattatatctaattt

SEQ ID NO: 2008671 - DNA, 20 bp, Homo sapiens
gaattatatctaatttatac

SEQ ID NO: 2008672 - DNA, 21 bp, Homo sapiens
gaattatatctaatttataca

SEQ ID NO: 2008673 - DNA, 22 bp, Homo sapiens
gaattatatctaatttatacaa

SEQ ID NO: 2008674 - DNA, 17 bp, Homo sapiens
gaattattatgtctcaa

SEQ ID NO: 2008675 - DNA, 12 bp, Homo sapiens
gaattattttgt

SEQ ID NO: 2008676 - DNA, 20 bp, Homo sapiens
gaattatttttgtgtttcta

SEQ ID NO: 2008677 - DNA, 14 bp, Homo sapiens
gaattcacacctta

SEQ ID NO: 2008678 - DNA, 16 bp, Homo sapiens
gaattcagcaccctgg

SEQ ID NO: 2008679 - DNA, 12 bp, Homo sapiens
gaattccaagga

SEQ ID NO: 2008680 - DNA, 16 bp, Homo sapiens
gaattccaaggagttc

SEQ ID NO: 2008681 - DNA, 17 bp, Homo sapiens
gaattctaaatgctggt

SEQ ID NO: 2008682 - DNA, 18 bp, Homo sapiens
gaattctgcaactagcca

SEQ ID NO: 2008683 - DNA, 23 bp, Homo sapiens
gaattctgcaactagccaaggct

SEQ ID NO: 2008684 - DNA, 13 bp, Homo sapiens
gaattctgtgaag

SEQ ID NO: 2008685 - DNA, 18 bp, Homo sapiens
gaattctgtgaagaatga

SEQ ID NO: 2008686 - DNA, 21 bp, Homo sapiens
gaattcttatgcttataatat

SEQ ID NO: 2008687 - DNA, 15 bp, Homo sapiens
gaattgaagatgtaa

SEQ ID NO: 2008688 - DNA, 15 bp, Homo sapiens
gaattgagtgtttaa

SEQ ID NO: 2008689 - DNA, 16 bp, Homo sapiens
gaattgcctgcagaga

SEQ ID NO: 2008690 - DNA, 13 bp, Homo sapiens
gaattgctgctct

SEQ ID NO: 2008691 - DNA, 19 bp, Homo sapiens
gaattgtccatgtgcttcc

SEQ ID NO: 2008692 - DNA, 18 bp, Homo sapiens
gaatttaaaaataagaaa

SEQ ID NO: 2008693 - DNA, 14 bp, Homo sapiens
gaatttaattaatc

SEQ ID NO: 2008694 - DNA, 18 bp, Homo sapiens
gaatttaggataaagaat

SEQ ID NO: 2008695 - DNA, 19 bp, Homo sapiens
gaatttagtcacaccatct

SEQ ID NO: 2008696 - DNA, 17 bp, Homo sapiens
gaatttattattgttct

SEQ ID NO: 2008697 - DNA, 13 bp, Homo sapiens
gaatttattcaat

SEQ ID NO: 2008698 - DNA, 21 bp, Homo sapiens
gaatttcaggcattttgttct

SEQ ID NO: 2008699 - DNA, 22 bp, Homo sapiens
gacaaggaagtgggggccgctg

SEQ ID NO: 2008700 - DNA, 21 bp, Homo sapiens
gacaaggattgctactgtcct

SEQ ID NO: 2008701 - DNA, 22 bp, Homo sapiens
gacaaggattgctactgtccta

SEQ ID NO: 2008702 - DNA, 12 bp, Homo sapiens
gacaagggctga

SEQ ID NO: 2008703 - DNA, 21 bp, Homo sapiens
gacaaggtagacatggatttg

SEQ ID NO: 2008704 - DNA, 19 bp, Homo sapiens
gacaagtgagagagcaagt

SEQ ID NO: 2008705 - DNA, 19 bp, Homo sapiens
gacaatcctgaagaaacca

SEQ ID NO: 2008706 - DNA, 19 bp, Homo sapiens
gacaatgatgtgagtaccc

SEQ ID NO: 2008707 - DNA, 18 bp, Homo sapiens
gacaatgccttgggagag

SEQ ID NO: 2008708 - DNA, 16 bp, Homo sapiens
gacaattcacttcatt

SEQ ID NO: 2008709 - DNA, 15 bp, Homo sapiens
gacaattgtcttttt

SEQ ID NO: 2008710 - DNA, 23 bp, Homo sapiens
gacacacaaaatgtcacaatcct

SEQ ID NO: 2008711 - DNA, 15 bp, Homo sapiens
gacacacagctctgt

SEQ ID NO: 2008712 - DNA, 17 bp, Homo sapiens
gacacacagctctgtcc

SEQ ID NO: 2008713 - DNA, 16 bp, Homo sapiens
gacacagacccacaca

SEQ ID NO: 2008714 - DNA, 22 bp, Homo sapiens
gacacagcgtccctagcagtga

SEQ ID NO: 2008715 - DNA, 17 bp, Homo sapiens
gacacaggccagcccca

SEQ ID NO: 2008716 - DNA, 12 bp, Homo sapiens
gacacaggcccg

SEQ ID NO: 2008717 - DNA, 15 bp, Homo sapiens
gacacaggcccggct

SEQ ID NO: 2008718 - DNA, 17 bp, Homo sapiens
gacacaggcctgtgtag

SEQ ID NO: 2008719 - DNA, 22 bp, Homo sapiens
gacacaggtgcctcacgcctgt

SEQ ID NO: 2008720 - DNA, 19 bp, Homo sapiens
gacacatactcatttttca

SEQ ID NO: 2008721 - DNA, 14 bp, Homo sapiens
gacacatcaaatgc

SEQ ID NO: 2008722 - DNA, 13 bp, Homo sapiens
gacacatcccggc

SEQ ID NO: 2008723 - DNA, 21 bp, Homo sapiens
gacacattttctcctaggaga

SEQ ID NO: 2008724 - DNA, 22 bp, Homo sapiens
gacacattttctcctaggagaa

SEQ ID NO: 2008725 - DNA, 19 bp, Homo sapiens
gacaccaggagtccctggt

SEQ ID NO: 2008726 - DNA, 20 bp, Homo sapiens
gacaccaggagtccctggta

SEQ ID NO: 2008727 - DNA, 18 bp, Homo sapiens
gacaccccttatccagga

SEQ ID NO: 2008728 - DNA, 21 bp, Homo sapiens
gacaccccttatccaggactc

SEQ ID NO: 2008729 - DNA, 19 bp, Homo sapiens
gacacctaccatgctgctt

SEQ ID NO: 2008730 - DNA, 20 bp, Homo sapiens
gacacctgcacctcccccca

SEQ ID NO: 2008731 - DNA, 22 bp, Homo sapiens
gacacctgcacctccccccact

SEQ ID NO: 2008732 - DNA, 10 bp, Homo sapiens
gacacctgcc

SEQ ID NO: 2008733 - DNA, 12 bp, Homo sapiens
gacacctgcccc

SEQ ID NO: 2008734 - DNA, 15 bp, Homo sapiens
gacacctgccctgcc

SEQ ID NO: 2008735 - DNA, 12 bp, Homo sapiens
gacacctgtgca

SEQ ID NO: 2008736 - DNA, 13 bp, Homo sapiens
gacacctgtgcac

SEQ ID NO: 2008737 - DNA, 16 bp, Homo sapiens
gacacggtaggccaag

SEQ ID NO: 2008738 - DNA, 23 bp, Homo sapiens
gacacggtaggccaagctgaagt

SEQ ID NO: 2008739 - DNA, 15 bp, Homo sapiens
gacactaaccacgct

SEQ ID NO: 2008740 - DNA, 18 bp, Homo sapiens
gacactaaccacgctgga

SEQ ID NO: 2008741 - DNA, 17 bp, Homo sapiens
gacactaagttatagta

SEQ ID NO: 2008742 - DNA, 13 bp, Homo sapiens
gacactcccaggg

SEQ ID NO: 2008743 - DNA, 12 bp, Homo sapiens
gacactgtacaa

SEQ ID NO: 2008744 - DNA, 20 bp, Homo sapiens
gacactgtatgactctcctc

SEQ ID NO: 2008745 - DNA, 22 bp, Homo sapiens
gacacttgccttcttcacccag

SEQ ID NO: 2008746 - DNA, 23 bp, Homo sapiens
gacacttgccttcttcacccagc

SEQ ID NO: 2008747 - DNA, 20 bp, Homo sapiens
gacagaaaaaaataaaaaca

SEQ ID NO: 2008748 - DNA, 23 bp, Homo sapiens
gacagaatgatatccagtaagca

SEQ ID NO: 2008749 - DNA, 14 bp, Homo sapiens
gacagaatgatgga

SEQ ID NO: 2008750 - DNA, 14 bp, Homo sapiens
gacagacacaggcc

SEQ ID NO: 2008751 - DNA, 17 bp, Homo sapiens
gacagagacacctgcac

SEQ ID NO: 2008752 - DNA, 18 bp, Homo sapiens
gacagagacacctgcacc

SEQ ID NO: 2008753 - DNA, 22 bp, Homo sapiens
gacagagacagaaacagagaga

SEQ ID NO: 2008754 - DNA, 19 bp, Homo sapiens
gacagagcccccaagcctc

SEQ ID NO: 2008755 - DNA, 12 bp, Homo sapiens
gacagaggaggg

SEQ ID NO: 2008756 - DNA, 14 bp, Homo sapiens
gacagaggcagccc

SEQ ID NO: 2008757 - DNA, 16 bp, Homo sapiens
gacagaggcagcccca

SEQ ID NO: 2008758 - DNA, 23 bp, Homo sapiens
gacagaggcagccccattctgcc

SEQ ID NO: 2008759 - DNA, 17 bp, Homo sapiens
gacagaggggcagggga

SEQ ID NO: 2008760 - DNA, 16 bp, Homo sapiens
gacagagtgagactct

SEQ ID NO: 2008761 - DNA, 22 bp, Homo sapiens
gacagagtgagactctgtctca

SEQ ID NO: 2008762 - DNA, 19 bp, Homo sapiens
gacagatacatagatggac

SEQ ID NO: 2008763 - DNA, 20 bp, Homo sapiens
gacagatacatagatggacc

SEQ ID NO: 2008764 - DNA, 18 bp, Homo sapiens
gacagatagacagtgctg

SEQ ID NO: 2008765 - DNA, 18 bp, Homo sapiens
gacagatgtcagccgagc

SEQ ID NO: 2008766 - DNA, 18 bp, Homo sapiens
gacagcaacctgtagagt

SEQ ID NO: 2008767 - DNA, 14 bp, Homo sapiens
gacagcagctcagg

SEQ ID NO: 2008768 - DNA, 20 bp, Homo sapiens
gacagcagctcaggcacact

SEQ ID NO: 2008769 - DNA, 12 bp, Homo sapiens
gacagcaggtgg

SEQ ID NO: 2008770 - DNA, 23 bp, Homo sapiens
gacagcagtcttcttcacccgct

SEQ ID NO: 2008771 - DNA, 14 bp, Homo sapiens
gacagccacggcca

SEQ ID NO: 2008772 - DNA, 21 bp, Homo sapiens
gacagccacggccaggccaga

SEQ ID NO: 2008773 - DNA, 13 bp, Homo sapiens
gacagccagagcc

SEQ ID NO: 2008774 - DNA, 14 bp, Homo sapiens
gacagccagagcct

SEQ ID NO: 2008775 - DNA, 10 bp, Homo sapiens
gacagcccag

SEQ ID NO: 2008776 - DNA, 15 bp, Homo sapiens
gacagccccagggcc

SEQ ID NO: 2008777 - DNA, 18 bp, Homo sapiens
gacagccctgcggagacc

SEQ ID NO: 2008778 - DNA, 14 bp, Homo sapiens
gacagcgccacctc

SEQ ID NO: 2008779 - DNA, 21 bp, Homo sapiens
gactaacactcagaagcctgg

SEQ ID NO: 2008780 - DNA, 22 bp, Homo sapiens
gactaacactcagaagcctggg

SEQ ID NO: 2008781 - DNA, 20 bp, Homo sapiens
gactaacataaaatctgtga

SEQ ID NO: 2008782 - DNA, 23 bp, Homo sapiens
gactaaccccaacgcacaggaaa

SEQ ID NO: 2008783 - DNA, 16 bp, Homo sapiens
gactaatagagacaca

SEQ ID NO: 2008784 - DNA, 18 bp, Homo sapiens
gactaatttaaaaaataa

SEQ ID NO: 2008785 - DNA, 12 bp, Homo sapiens
gactacaggcac

SEQ ID NO: 2008786 - DNA, 13 bp, Homo sapiens
gactacaggcacc

SEQ ID NO: 2008787 - DNA, 18 bp, Homo sapiens
gactacaggcacccacca

SEQ ID NO: 2008788 - DNA, 13 bp, Homo sapiens
gactacaggtgtg

SEQ ID NO: 2008789 - DNA, 21 bp, Homo sapiens
gactacaggtgtgagtcacca

SEQ ID NO: 2008790 - DNA, 20 bp, Homo sapiens
gactaccagctaactccagt

SEQ ID NO: 2008791 - DNA, 15 bp, Homo sapiens
gactagagctttctt

SEQ ID NO: 2008792 - DNA, 16 bp, Homo sapiens
gactagaggcagggag

SEQ ID NO: 2008793 - DNA, 20 bp, Homo sapiens
gactagaggcagggagggga

SEQ ID NO: 2008794 - DNA, 15 bp, Homo sapiens
gactaggaggttccg

SEQ ID NO: 2008795 - DNA, 16 bp, Homo sapiens
gactatatacatgtgt

SEQ ID NO: 2008796 - DNA, 23 bp, Homo sapiens
gactatatagagatgtttttaaa

SEQ ID NO: 2008797 - DNA, 18 bp, Homo sapiens
gactatattgtacacacc

SEQ ID NO: 2008798 - DNA, 16 bp, Homo sapiens
gactatcacatacaat

SEQ ID NO: 2008799 - DNA, 17 bp, Homo sapiens
gactatcttactatttc

SEQ ID NO: 2008800 - DNA, 19 bp, Homo sapiens
gactcaaatctccagtatt

SEQ ID NO: 2008801 - DNA, 15 bp, Homo sapiens
gactcaagccccgga

SEQ ID NO: 2008802 - DNA, 15 bp, Homo sapiens
gactcacaagaagac

SEQ ID NO: 2008803 - DNA, 21 bp, Homo sapiens
gactcacaagaagaccagact

SEQ ID NO: 2008804 - DNA, 14 bp, Homo sapiens
gactcacctctgcc

SEQ ID NO: 2008805 - DNA, 18 bp, Homo sapiens
gactcacctctgcctcaa

SEQ ID NO: 2008806 - DNA, 17 bp, Homo sapiens
gactcacctgttacttg

SEQ ID NO: 2008807 - DNA, 16 bp, Homo sapiens
gactcagactccattt

SEQ ID NO: 2008808 - DNA, 17 bp, Homo sapiens
gactcaggatccagtcc

SEQ ID NO: 2008809 - DNA, 23 bp, Homo sapiens
gactcaggcccccacctggctca

SEQ ID NO: 2008810 - DNA, 18 bp, Homo sapiens
gactcagggccccagcac

SEQ ID NO: 2008811 - DNA, 15 bp, Homo sapiens
gactcaggttgtctg

SEQ ID NO: 2008812 - DNA, 12 bp, Homo sapiens
gactcagtgttc

SEQ ID NO: 2008813 - DNA, 17 bp, Homo sapiens
gactcatggcttagaaa

SEQ ID NO: 2008814 - DNA, 20 bp, Homo sapiens
gactcattccctagatcttt

SEQ ID NO: 2008815 - DNA, 16 bp, Homo sapiens
gactccaaagaaatgt

SEQ ID NO: 2008816 - DNA, 17 bp, Homo sapiens
gactccaagaacaattg

SEQ ID NO: 2008817 - DNA, 23 bp, Homo sapiens
gactccagaatctgctgttgcca

SEQ ID NO: 2008818 - DNA, 18 bp, Homo sapiens
gactccagagtctgagcc

SEQ ID NO: 2008819 - DNA, 19 bp, Homo sapiens
gactccagagtctgagccc

SEQ ID NO: 2008820 - DNA, 20 bp, Homo sapiens
gactccagagtctgagcccc

SEQ ID NO: 2008821 - DNA, 9 bp, Homo sapiens
gactccagc

SEQ ID NO: 2008822 - DNA, 18 bp, Homo sapiens
gactccccaggccaggcc

SEQ ID NO: 2008823 - DNA, 14 bp, Homo sapiens
gactccctccatgt

SEQ ID NO: 2008824 - DNA, 19 bp, Homo sapiens
gactccctccatgtggccc

SEQ ID NO: 2008825 - DNA, 14 bp, Homo sapiens
gactccctcccctg

SEQ ID NO: 2008826 - DNA, 16 bp, Homo sapiens
gactcctgtgcaactt

SEQ ID NO: 2008827 - DNA, 19 bp, Homo sapiens
gactcgcttagctgaaacc

SEQ ID NO: 2008828 - DNA, 13 bp, Homo sapiens
gactctaaatatt

SEQ ID NO: 2008829 - DNA, 21 bp, Homo sapiens
gactctaaattctttatttct

SEQ ID NO: 2008830 - DNA, 23 bp, Homo sapiens
gactctaaattctttatttctgt

SEQ ID NO: 2008831 - DNA, 13 bp, Homo sapiens
gactctgcccctt

SEQ ID NO: 2008832 - DNA, 12 bp, Homo sapiens
gactctgcctcc

SEQ ID NO: 2008833 - DNA, 22 bp, Homo sapiens
gactctgccttttttcacagcc

SEQ ID NO: 2008834 - DNA, 17 bp, Homo sapiens
gactctggaagcccccc

SEQ ID NO: 2008835 - DNA, 12 bp, Homo sapiens
gactctggcctc

SEQ ID NO: 2008836 - DNA, 18 bp, Homo sapiens
gactctgggtccctcgga

SEQ ID NO: 2008837 - DNA, 21 bp, Homo sapiens
gactctgggtccctcggagct

SEQ ID NO: 2008838 - DNA, 22 bp, Homo sapiens
gactctgtcaatttccctgact

SEQ ID NO: 2008839 - DNA, 17 bp, Homo sapiens
gactctgtggggccttg

SEQ ID NO: 2008840 - DNA, 18 bp, Homo sapiens
gactctgtggggccttgg

SEQ ID NO: 2008841 - DNA, 20 bp, Homo sapiens
gactcttgcctttccacctg

SEQ ID NO: 2008842 - DNA, 23 bp, Homo sapiens
gactctttgacgggaggcctcag

SEQ ID NO: 2008843 - DNA, 14 bp, Homo sapiens
gactgaaagcagca

SEQ ID NO: 2008844 - DNA, 17 bp, Homo sapiens
gactgaaagcagcagct

SEQ ID NO: 2008845 - DNA, 16 bp, Homo sapiens
gactgaaggggcacac

SEQ ID NO: 2008846 - DNA, 15 bp, Homo sapiens
gactgaatgtgccta

SEQ ID NO: 2008847 - DNA, 18 bp, Homo sapiens
gactgaattgtccccagt

SEQ ID NO: 2008848 - DNA, 13 bp, Homo sapiens
gactgacacaggc

SEQ ID NO: 2008849 - DNA, 16 bp, Homo sapiens
gactgacacaggccag

SEQ ID NO: 2008850 - DNA, 16 bp, Homo sapiens
gactgacacctcactg

SEQ ID NO: 2008851 - DNA, 14 bp, Homo sapiens
gactgagcacctgc

SEQ ID NO: 2008852 - DNA, 16 bp, Homo sapiens
gactgagcacctgctt

SEQ ID NO: 2008853 - DNA, 23 bp, Homo sapiens
gactgagcctggcccatagaaac

SEQ ID NO: 2008854 - DNA, 13 bp, Homo sapiens
gactgaggagtgg

SEQ ID NO: 2008855 - DNA, 12 bp, Homo sapiens
gactgagggaga

SEQ ID NO: 2008856 - DNA, 19 bp, Homo sapiens
gactgagtgtgggagtgca

SEQ ID NO: 2008857 - DNA, 18 bp, Homo sapiens
gactgatgacaaacccag

SEQ ID NO: 2008858 - DNA, 19 bp, Homo sapiens
gactgatgacaaacccagg

SEQ ID NO: 2008859 - DNA, 14 bp, Homo sapiens
gactgcagctgctg

SEQ ID NO: 2008860 - DNA, 22 bp, Homo sapiens
gactgcgggatggtcctggggc

SEQ ID NO: 2008861 - DNA, 20 bp, Homo sapiens
gactgctccccagccctggc

SEQ ID NO: 2008862 - DNA, 19 bp, Homo sapiens
gactgctgggactggccag

SEQ ID NO: 2008863 - DNA, 15 bp, Homo sapiens
gactggaaccaggga

SEQ ID NO: 2008864 - DNA, 23 bp, Homo sapiens
gactggagaccgcttcacccctg

SEQ ID NO: 2008865 - DNA, 14 bp, Homo sapiens
gactggagcatctg

SEQ ID NO: 2008866 - DNA, 20 bp, Homo sapiens
gactggctcacccctctccc

SEQ ID NO: 2008867 - DNA, 16 bp, Homo sapiens
gactggctggctgcag

SEQ ID NO: 2008868 - DNA, 17 bp, Homo sapiens
gactggctggctgcagt

SEQ ID NO: 2008869 - DNA, 16 bp, Homo sapiens
gactgggaccaggcac

SEQ ID NO: 2008870 - DNA, 15 bp, Homo sapiens
gactggtcctgtgtg

SEQ ID NO: 2008871 - DNA, 22 bp, Homo sapiens
gactggtgctataggctggaga

SEQ ID NO: 2008872 - DNA, 16 bp, Homo sapiens
gactgtactcctccca

SEQ ID NO: 2008873 - DNA, 17 bp, Homo sapiens
gactgtacttattttcc

SEQ ID NO: 2008874 - DNA, 22 bp, Homo sapiens
gactgtcaagtacaagcaagac

SEQ ID NO: 2008875 - DNA, 11 bp, Homo sapiens
gactgtcccac

SEQ ID NO: 2008876 - DNA, 19 bp, Homo sapiens
gactgtcccaccgggagcc

SEQ ID NO: 2008877 - DNA, 23 bp, Homo sapiens
gactgtcccaccgggagcctccc

SEQ ID NO: 2008878 - DNA, 17 bp, Homo sapiens
gactgtcgtgtttacaa

SEQ ID NO: 2008879 - DNA, 20 bp, Homo sapiens
gactgtgaaagtatgtgata

SEQ ID NO: 2008880 - DNA, 12 bp, Homo sapiens
gactgtggctgc

SEQ ID NO: 2008881 - DNA, 15 bp, Homo sapiens
gactgtggctgctag

SEQ ID NO: 2008882 - DNA, 21 bp, Homo sapiens
gactgtgttcagtgccttgga

SEQ ID NO: 2008883 - DNA, 13 bp, Homo sapiens
gacttaaagcaga

SEQ ID NO: 2008884 - DNA, 14 bp, Homo sapiens
gacttaacggctcc

SEQ ID NO: 2008885 - DNA, 16 bp, Homo sapiens
gacttaacggctccag

SEQ ID NO: 2008886 - DNA, 18 bp, Homo sapiens
gacttacatgattcattt

SEQ ID NO: 2008887 - DNA, 19 bp, Homo sapiens
gacttacatgattcatttt

SEQ ID NO: 2008888 - DNA, 17 bp, Homo sapiens
gacttagtatattttct

SEQ ID NO: 2008889 - DNA, 17 bp, Homo sapiens
gacttcacaaaatgcaa

SEQ ID NO: 2008890 - DNA, 16 bp, Homo sapiens
gacttcacactgcaag

SEQ ID NO: 2008891 - DNA, 22 bp, Homo sapiens
gacttcacactgcaagagcctt

SEQ ID NO: 2008892 - DNA, 18 bp, Homo sapiens
gacttcctggggccccgc

SEQ ID NO: 2008893 - DNA, 22 bp, Homo sapiens
gacttcctggggccccgctggg

SEQ ID NO: 2008894 - DNA, 15 bp, Homo sapiens
gacttcgactcagga

SEQ ID NO: 2008895 - DNA, 17 bp, Homo sapiens
gacttctaagtaaaacc

SEQ ID NO: 2008896 - DNA, 19 bp, Homo sapiens
gacttctaagtaaaaccac

SEQ ID NO: 2008897 - DNA, 24 bp, Homo sapiens
gacttctaagtaaaaccacagcag

SEQ ID NO: 2008898 - DNA, 15 bp, Homo sapiens
gacttctctttctta

SEQ ID NO: 2008899 - DNA, 18 bp, Homo sapiens
gacttctctttgcctcaa

SEQ ID NO: 2008900 - DNA, 20 bp, Homo sapiens
gacttctgtcttcacaacag

SEQ ID NO: 2008901 - DNA, 19 bp, Homo sapiens
gacttcttgcttgtacata

SEQ ID NO: 2008902 - DNA, 23 bp, Homo sapiens
gacttgacaacatcccacagtgg

SEQ ID NO: 2008903 - DNA, 18 bp, Homo sapiens
gacttgacagaacactgt

SEQ ID NO: 2008904 - DNA, 15 bp, Homo sapiens
gacttgagcctccat

SEQ ID NO: 2008905 - DNA, 21 bp, Homo sapiens
gacttgagcctccatttctgg

SEQ ID NO: 2008906 - DNA, 15 bp, Homo sapiens
gacttgcacatctct

SEQ ID NO: 2008907 - DNA, 13 bp, Homo sapiens
gacttggaagctc

SEQ ID NO: 2008908 - DNA, 16 bp, Homo sapiens
gacttggaagctccgc

SEQ ID NO: 2008909 - DNA, 19 bp, Homo sapiens
gacttggcaacagaagcag

SEQ ID NO: 2008910 - DNA, 19 bp, Homo sapiens
gacttgggcacccccagcc

SEQ ID NO: 2008911 - DNA, 23 bp, Homo sapiens
gacttgggcacccccagcctggg

SEQ ID NO: 2008912 - DNA, 16 bp, Homo sapiens
gacttggggaccagag

SEQ ID NO: 2008913 - DNA, 14 bp, Homo sapiens
gacttggtctgatt

SEQ ID NO: 2008914 - DNA, 19 bp, Homo sapiens
gacttgtagggatgccttt

SEQ ID NO: 2008915 - DNA, 16 bp, Homo sapiens
gacttgtgtctctgtg

SEQ ID NO: 2008916 - DNA, 22 bp, Homo sapiens
gactttatctaatacctctgtg

SEQ ID NO: 2008917 - DNA, 12 bp, Homo sapiens
gactttcaggta

SEQ ID NO: 2008918 - DNA, 16 bp, Homo sapiens
gactttcctaaatgtt

SEQ ID NO: 2008919 - DNA, 13 bp, Homo sapiens
gactttgtgatcc

SEQ ID NO: 2008920 - DNA, 12 bp, Homo sapiens
gagaaaaaccaa

SEQ ID NO: 2008921 - DNA, 17 bp, Homo sapiens
gagaaaaactttcattt

SEQ ID NO: 2008922 - DNA, 16 bp, Homo sapiens
gagaaaaagaaatgca

SEQ ID NO: 2008923 - DNA, 14 bp, Homo sapiens
gagaaaagattaaa

SEQ ID NO: 2008924 - DNA, 14 bp, Homo sapiens
gagaaaaggagaaa

SEQ ID NO: 2008925 - DNA, 13 bp, Homo sapiens
gagaaacagagac

SEQ ID NO: 2008926 - DNA, 18 bp, Homo sapiens
gagaaacatgaattattt

SEQ ID NO: 2008927 - DNA, 17 bp, Homo sapiens
gagaaacccaccagcct

SEQ ID NO: 2008928 - DNA, 12 bp, Homo sapiens
gagaaaccctgt

SEQ ID NO: 2008929 - DNA, 21 bp, Homo sapiens
gagaaaccttattgtacctct

SEQ ID NO: 2008930 - DNA, 23 bp, Homo sapiens
gagaaaccttattgtacctctct

SEQ ID NO: 2008931 - DNA, 15 bp, Homo sapiens
gagaaagaaagggaa

SEQ ID NO: 2008932 - DNA, 12 bp, Homo sapiens
gagaaagaaata

SEQ ID NO: 2008933 - DNA, 18 bp, Homo sapiens
gagaaagaagagacagga

SEQ ID NO: 2008934 - DNA, 15 bp, Homo sapiens
gagaaagactattca

SEQ ID NO: 2008935 - DNA, 18 bp, Homo sapiens
gagaaagactattcaaac

SEQ ID NO: 2008936 - DNA, 23 bp, Homo sapiens
gagaaagtacttctccaccctgc

SEQ ID NO: 2008937 - DNA, 23 bp, Homo sapiens
gagaaataaattttgtttcagaa

SEQ ID NO: 2008938 - DNA, 17 bp, Homo sapiens
gagaaatgtgaagggtg

SEQ ID NO: 2008939 - DNA, 11 bp, Homo sapiens
gagaaattatt

SEQ ID NO: 2008940 - DNA, 14 bp, Homo sapiens
gagaaattctgtgg

SEQ ID NO: 2008941 - DNA, 17 bp, Homo sapiens
gagaacaagtcacagct

SEQ ID NO: 2008942 - DNA, 20 bp, Homo sapiens
gagaacaagtcacagctgca

SEQ ID NO: 2008943 - DNA, 23 bp, Homo sapiens
gagaacaagtcacagctgcagct

SEQ ID NO: 2008944 - DNA, 14 bp, Homo sapiens
gagaacctcaggct

SEQ ID NO: 2008945 - DNA, 13 bp, Homo sapiens
gagaactgggatt

SEQ ID NO: 2008946 - DNA, 12 bp, Homo sapiens
gagaagaagctg

SEQ ID NO: 2008947 - DNA, 16 bp, Homo sapiens
gagaagaagctgagga

SEQ ID NO: 2008948 - DNA, 17 bp, Homo sapiens
gagaagaagctgaggat

SEQ ID NO: 2008949 - DNA, 15 bp, Homo sapiens
gagaagagctgttca

SEQ ID NO: 2008950 - DNA, 22 bp, Homo sapiens
gagaagagctgttcacagccag

SEQ ID NO: 2008951 - DNA, 13 bp, Homo sapiens
gagaagaggctgg

SEQ ID NO: 2008952 - DNA, 14 bp, Homo sapiens
gagaagagggcctg

SEQ ID NO: 2008953 - DNA, 15 bp, Homo sapiens
gagaagagggcctgt

SEQ ID NO: 2008954 - DNA, 16 bp, Homo sapiens
gagaagagggcctgtg

SEQ ID NO: 2008955 - DNA, 22 bp, Homo sapiens
gagaagcagcctcctaatttga

SEQ ID NO: 2008956 - DNA, 14 bp, Homo sapiens
gagaagcagtgagc

SEQ ID NO: 2008957 - DNA, 18 bp, Homo sapiens
gagaagcagtgagccgca

SEQ ID NO: 2008958 - DNA, 12 bp, Homo sapiens
gagaagccgcag

SEQ ID NO: 2008959 - DNA, 13 bp, Homo sapiens
gagaagctcattt

SEQ ID NO: 2008960 - DNA, 17 bp, Homo sapiens
gagaagctgagaagaag

SEQ ID NO: 2008961 - DNA, 23 bp, Homo sapiens
gagaagctgagaagaagctgagg

SEQ ID NO: 2008962 - DNA, 23 bp, Homo sapiens
gagaagctgatgctttgcttcaa

SEQ ID NO: 2008963 - DNA, 15 bp, Homo sapiens
gagaaggaaaaagaa

SEQ ID NO: 2008964 - DNA, 23 bp, Homo sapiens
gagaaggacccggaggggcctgg

SEQ ID NO: 2008965 - DNA, 13 bp, Homo sapiens
gagaaggagcaga

SEQ ID NO: 2008966 - DNA, 21 bp, Homo sapiens
gagaaggcccataccttctgg

SEQ ID NO: 2008967 - DNA, 14 bp, Homo sapiens
gagaaggcgaggag

SEQ ID NO: 2008968 - DNA, 21 bp, Homo sapiens
gagaagggggattggagggaa

SEQ ID NO: 2008969 - DNA, 15 bp, Homo sapiens
gagaaggtccttaat

SEQ ID NO: 2008970 - DNA, 18 bp, Homo sapiens
gagaagtatccaattatg

SEQ ID NO: 2008971 - DNA, 22 bp, Homo sapiens
gagaagtatccaattatgtgac

SEQ ID NO: 2008972 - DNA, 19 bp, Homo sapiens
gagaagtgaataactgcaa

SEQ ID NO: 2008973 - DNA, 23 bp, Homo sapiens
gagaagttaagcagcctttctgt

SEQ ID NO: 2008974 - DNA, 17 bp, Homo sapiens
gagaagttttgtacaga

SEQ ID NO: 2008975 - DNA, 22 bp, Homo sapiens
gagaataagagaaagaaaatga

SEQ ID NO: 2008976 - DNA, 14 bp, Homo sapiens
gagaataattgtgt

SEQ ID NO: 2008977 - DNA, 15 bp, Homo sapiens
gagaataattgtgta

SEQ ID NO: 2008978 - DNA, 18 bp, Homo sapiens
gagaatcgacctcactgt

SEQ ID NO: 2008979 - DNA, 17 bp, Homo sapiens
gagaatctggctcctgt

SEQ ID NO: 2008980 - DNA, 22 bp, Homo sapiens
gagaatctggctcctgtttcca

SEQ ID NO: 2008981 - DNA, 23 bp, Homo sapiens
gagaatgatagtaataggataca

SEQ ID NO: 2008982 - DNA, 20 bp, Homo sapiens
gagaatgtgattccttttga

SEQ ID NO: 2008983 - DNA, 17 bp, Homo sapiens
gagaattgggattacat

SEQ ID NO: 2008984 - DNA, 16 bp, Homo sapiens
gagaattttaaattat

SEQ ID NO: 2008985 - DNA, 19 bp, Homo sapiens
gagacaaacacctcccagg

SEQ ID NO: 2008986 - DNA, 14 bp, Homo sapiens
gagacaagccctgg

SEQ ID NO: 2008987 - DNA, 15 bp, Homo sapiens
gagacaaggaaccac

SEQ ID NO: 2008988 - DNA, 16 bp, Homo sapiens
gagacacagagatgga

SEQ ID NO: 2008989 - DNA, 22 bp, Homo sapiens
gagacacagagtggagccctca

SEQ ID NO: 2008990 - DNA, 13 bp, Homo sapiens
gagacacctgcac

SEQ ID NO: 2008991 - DNA, 18 bp, Homo sapiens
gagacacctgcacctccc

SEQ ID NO: 2008992 - DNA, 15 bp, Homo sapiens
gagacactcccaggg

SEQ ID NO: 2008993 - DNA, 18 bp, Homo sapiens
gagacactcccagggaca

SEQ ID NO: 2008994 - DNA, 17 bp, Homo sapiens
gagacacttgccttctt

SEQ ID NO: 2008995 - DNA, 14 bp, Homo sapiens
gagacagaaacaga

SEQ ID NO: 2008996 - DNA, 17 bp, Homo sapiens
gagacagaaacagagag

SEQ ID NO: 2008997 - DNA, 14 bp, Homo sapiens
cttttaatcagaca

SEQ ID NO: 2008998 - DNA, 16 bp, Homo sapiens
cttttaatgaacaaat

SEQ ID NO: 2008999 - DNA, 15 bp, Homo sapiens
cttttaatgccttcc

SEQ ID NO: 2009000 - DNA, 14 bp, Homo sapiens
cttttaattcctag

SEQ ID NO: 2009001 - DNA, 15 bp, Homo sapiens
cttttactacagtga

SEQ ID NO: 2009002 - DNA, 20 bp, Homo sapiens
cttttagggagctggtctga

SEQ ID NO: 2009003 - DNA, 20 bp, Homo sapiens
cttttagttgtatctctttt

SEQ ID NO: 2009004 - DNA, 21 bp, Homo sapiens
cttttagttttagttgcagaa

SEQ ID NO: 2009005 - DNA, 22 bp, Homo sapiens
cttttataactagtcctttact

SEQ ID NO: 2009006 - DNA, 12 bp, Homo sapiens
cttttatagcta

SEQ ID NO: 2009007 - DNA, 19 bp, Homo sapiens
cttttatagctattactgt

SEQ ID NO: 2009008 - DNA, 17 bp, Homo sapiens
cttttatccacttacct

SEQ ID NO: 2009009 - DNA, 18 bp, Homo sapiens
cttttattcattagctgt

SEQ ID NO: 2009010 - DNA, 17 bp, Homo sapiens
cttttattctgtacctt

SEQ ID NO: 2009011 - DNA, 16 bp, Homo sapiens
cttttattgtataaac

SEQ ID NO: 2009012 - DNA, 17 bp, Homo sapiens
cttttatttcttaaaca

SEQ ID NO: 2009013 - DNA, 18 bp, Homo sapiens
cttttcactgctggctgc

SEQ ID NO: 2009014 - DNA, 22 bp, Homo sapiens
cttttcagtgttttttcacttt

SEQ ID NO: 2009015 - DNA, 22 bp, Homo sapiens
cttttcataacctagccttaga

SEQ ID NO: 2009016 - DNA, 21 bp, Homo sapiens
cttttcatctccagtgtgaat

SEQ ID NO: 2009017 - DNA, 16 bp, Homo sapiens
cttttccaagcccttt

SEQ ID NO: 2009018 - DNA, 16 bp, Homo sapiens
cttttccaggatcctg

SEQ ID NO: 2009019 - DNA, 19 bp, Homo sapiens
cttttccaggatcctgcag

SEQ ID NO: 2009020 - DNA, 21 bp, Homo sapiens
cttttccaggatcctgcagga

SEQ ID NO: 2009021 - DNA, 14 bp, Homo sapiens
cttttcccaggaat

SEQ ID NO: 2009022 - DNA, 20 bp, Homo sapiens
cttttcctattttcagccca

SEQ ID NO: 2009023 - DNA, 20 bp, Homo sapiens
cttttcgcttgcttctgcag

SEQ ID NO: 2009024 - DNA, 21 bp, Homo sapiens
cttttcgcttgcttctgcagc

SEQ ID NO: 2009025 - DNA, 14 bp, Homo sapiens
cttttcttccttct

SEQ ID NO: 2009026 - DNA, 21 bp, Homo sapiens
cttttctttattgctgtgaat

SEQ ID NO: 2009027 - DNA, 22 bp, Homo sapiens
cttttgaagtagtttgtataac

SEQ ID NO: 2009028 - DNA, 12 bp, Homo sapiens
cttttgactctt

SEQ ID NO: 2009029 - DNA, 19 bp, Homo sapiens
cttttgatggggagaaagg

SEQ ID NO: 2009030 - DNA, 18 bp, Homo sapiens
cttttgcaacaagacaaa

SEQ ID NO: 2009031 - DNA, 17 bp, Homo sapiens
cttttgccattaaactt

SEQ ID NO: 2009032 - DNA, 20 bp, Homo sapiens
cttttgcccttcacagtgtt

SEQ ID NO: 2009033 - DNA, 14 bp, Homo sapiens
cttttgcctggctg

SEQ ID NO: 2009034 - DNA, 23 bp, Homo sapiens
cttttgcggttcaggaaaattga

SEQ ID NO: 2009035 - DNA, 18 bp, Homo sapiens
cttttgctgtctttctct

SEQ ID NO: 2009036 - DNA, 19 bp, Homo sapiens
cttttgggggttggatggg

SEQ ID NO: 2009037 - DNA, 20 bp, Homo sapiens
cttttgggggttggatggga

SEQ ID NO: 2009038 - DNA, 13 bp, Homo sapiens
cttttgtaagaca

SEQ ID NO: 2009039 - DNA, 20 bp, Homo sapiens
cttttgtaagacaaaggttt

SEQ ID NO: 2009040 - DNA, 16 bp, Homo sapiens
cttttgtcctgttatt

SEQ ID NO: 2009041 - DNA, 18 bp, Homo sapiens
cttttgtctatgggactc

SEQ ID NO: 2009042 - DNA, 17 bp, Homo sapiens
cttttgttgtgactttt

SEQ ID NO: 2009043 - DNA, 21 bp, Homo sapiens
cttttgtttaaatataaatgt

SEQ ID NO: 2009044 - DNA, 23 bp, Homo sapiens
ctttttataatgtggatttccta

SEQ ID NO: 2009045 - DNA, 12 bp, Homo sapiens
ctttttatactc

SEQ ID NO: 2009046 - DNA, 17 bp, Homo sapiens
ctttttcaacttggaaa

SEQ ID NO: 2009047 - DNA, 14 bp, Homo sapiens
ctttttctggaaat

SEQ ID NO: 2009048 - DNA, 19 bp, Homo sapiens
ctttttgaatgttatttgt

SEQ ID NO: 2009049 - DNA, 22 bp, Homo sapiens
ctttttgtgaaattcaacctgt

SEQ ID NO: 2009050 - DNA, 16 bp, Homo sapiens
cttttttcttatttaa

SEQ ID NO: 2009051 - DNA, 16 bp, Homo sapiens
ctttttttatgactgt

SEQ ID NO: 2009052 - DNA, 15 bp, Homo sapiens
gacagtgctgccctg

SEQ ID NO: 2009053 - DNA, 21 bp, Homo sapiens
gacagttactcttcagtttta

SEQ ID NO: 2009054 - DNA, 17 bp, Homo sapiens
gacagttcatatgtacc

SEQ ID NO: 2009055 - DNA, 14 bp, Homo sapiens
gacagttggcagag

SEQ ID NO: 2009056 - DNA, 15 bp, Homo sapiens
gacagttggcagaga

SEQ ID NO: 2009057 - DNA, 16 bp, Homo sapiens
gacagtttatttgttg

SEQ ID NO: 2009058 - DNA, 23 bp, Homo sapiens
gacatcacagcagaatgaagacc

SEQ ID NO: 2009059 - DNA, 23 bp, Homo sapiens
gacatccatgtttgtaaaactac

SEQ ID NO: 2009060 - DNA, 23 bp, Homo sapiens
gacatcccaggaggggcctctga

SEQ ID NO: 2009061 - DNA, 16 bp, Homo sapiens
gacatgaatgcacact

SEQ ID NO: 2009062 - DNA, 18 bp, Homo sapiens
gacatgatactgatgcca

SEQ ID NO: 2009063 - DNA, 21 bp, Homo sapiens
gacatgatggagcgcacctgc

SEQ ID NO: 2009064 - DNA, 21 bp, Homo sapiens
gacatgatttagggaagcagg

SEQ ID NO: 2009065 - DNA, 16 bp, Homo sapiens
gacatgcactgaccct

SEQ ID NO: 2009066 - DNA, 20 bp, Homo sapiens
gacatgcactgacccttcca

SEQ ID NO: 2009067 - DNA, 21 bp, Homo sapiens
gacatgccaccctctccatgc

SEQ ID NO: 2009068 - DNA, 17 bp, Homo sapiens
gacatggagactcctgc

SEQ ID NO: 2009069 - DNA, 16 bp, Homo sapiens
gacatggggcatagaa

SEQ ID NO: 2009070 - DNA, 20 bp, Homo sapiens
gacatgtgctattgaactga

SEQ ID NO: 2009071 - DNA, 15 bp, Homo sapiens
gacatgttatatatt

SEQ ID NO: 2009072 - DNA, 16 bp, Homo sapiens
gacatgtttcacaaca

SEQ ID NO: 2009073 - DNA, 18 bp, Homo sapiens
gacatgtttttgttttct

SEQ ID NO: 2009074 - DNA, 14 bp, Homo sapiens
gacattaaacctgg

SEQ ID NO: 2009075 - DNA, 21 bp, Homo sapiens
gacattaactcattagactgg

SEQ ID NO: 2009076 - DNA, 13 bp, Homo sapiens
gacattatgtgtg

SEQ ID NO: 2009077 - DNA, 13 bp, Homo sapiens
gacattgcctcca

SEQ ID NO: 2009078 - DNA, 15 bp, Homo sapiens
gacattgcggacagc

SEQ ID NO: 2009079 - DNA, 19 bp, Homo sapiens
gacattgtagagcttctgg

SEQ ID NO: 2009080 - DNA, 21 bp, Homo sapiens
gaccaacatggagaaaccctg

SEQ ID NO: 2009081 - DNA, 22 bp, Homo sapiens
gaccaacatggagaaaccctgt

SEQ ID NO: 2009082 - DNA, 16 bp, Homo sapiens
gaccaaccctgtttcc

SEQ ID NO: 2009083 - DNA, 13 bp, Homo sapiens
gaccaacctgacc

SEQ ID NO: 2009084 - DNA, 17 bp, Homo sapiens
gaccaactctctcctgt

SEQ ID NO: 2009085 - DNA, 17 bp, Homo sapiens
gaccaactggcttctgt

SEQ ID NO: 2009086 - DNA, 22 bp, Homo sapiens
gaccaactggcttctgtgcact

SEQ ID NO: 2009087 - DNA, 14 bp, Homo sapiens
gaccaagaaaaaga

SEQ ID NO: 2009088 - DNA, 15 bp, Homo sapiens
gaccaagagagaaag

SEQ ID NO: 2009089 - DNA, 21 bp, Homo sapiens
gaccaagatgatcacatggaa

SEQ ID NO: 2009090 - DNA, 17 bp, Homo sapiens
gaccaagatgggcacat

SEQ ID NO: 2009091 - DNA, 14 bp, Homo sapiens
gaccaagttataaa

SEQ ID NO: 2009092 - DNA, 13 bp, Homo sapiens
gaccaccagcccc

SEQ ID NO: 2009093 - DNA, 17 bp, Homo sapiens
gaccaccagccccagca

SEQ ID NO: 2009094 - DNA, 10 bp, Homo sapiens
gaccacctgc

SEQ ID NO: 2009095 - DNA, 19 bp, Homo sapiens
gaccacctgccagccatca

SEQ ID NO: 2009096 - DNA, 20 bp, Homo sapiens
gaccacctgcttctgaactc

SEQ ID NO: 2009097 - DNA, 14 bp, Homo sapiens
gaccacgctttcta

SEQ ID NO: 2009098 - DNA, 20 bp, Homo sapiens
gaccacggacgtttccatca

SEQ ID NO: 2009099 - DNA, 14 bp, Homo sapiens
gaccacgggcctca

SEQ ID NO: 2009100 - DNA, 20 bp, Homo sapiens
gaccacgggcctcagtttcc

SEQ ID NO: 2009101 - DNA, 17 bp, Homo sapiens
gaccactgtcctggctg

SEQ ID NO: 2009102 - DNA, 16 bp, Homo sapiens
gaccagaaacagggac

SEQ ID NO: 2009103 - DNA, 16 bp, Homo sapiens
gaccagaagccaaaga

SEQ ID NO: 2009104 - DNA, 12 bp, Homo sapiens
gaccagcctggc

SEQ ID NO: 2009105 - DNA, 16 bp, Homo sapiens
gaccaggacaggacca

SEQ ID NO: 2009106 - DNA, 12 bp, Homo sapiens
gaccaggatcag

SEQ ID NO: 2009107 - DNA, 18 bp, Homo sapiens
gaccaggctcacaactgt

SEQ ID NO: 2009108 - DNA, 23 bp, Homo sapiens
gaccagggcttttcccaggaata

SEQ ID NO: 2009109 - DNA, 23 bp, Homo sapiens
gaccaggggtgatttcagagagg

SEQ ID NO: 2009110 - DNA, 14 bp, Homo sapiens
gaccagtactggga

SEQ ID NO: 2009111 - DNA, 20 bp, Homo sapiens
gaccagttgggagcactgga

SEQ ID NO: 2009112 - DNA, 15 bp, Homo sapiens
gaccatcctggcccc

SEQ ID NO: 2009113 - DNA, 13 bp, Homo sapiens
gaccatcctgtcc

SEQ ID NO: 2009114 - DNA, 20 bp, Homo sapiens
gaccattgacctcagctgca

SEQ ID NO: 2009115 - DNA, 15 bp, Homo sapiens
gaccattgtcttcca

SEQ ID NO: 2009116 - DNA, 15 bp, Homo sapiens
gaccatttcaggggt

SEQ ID NO: 2009117 - DNA, 14 bp, Homo sapiens
gacccaaggaggaa

SEQ ID NO: 2009118 - DNA, 19 bp, Homo sapiens
gacccaccaaactgcacac

SEQ ID NO: 2009119 - DNA, 22 bp, Homo sapiens
gacccacccatcttcctgctgc

SEQ ID NO: 2009120 - DNA, 23 bp, Homo sapiens
gacccacccatcttcctgctgct

SEQ ID NO: 2009121 - DNA, 19 bp, Homo sapiens
gacccagagtggagtctga

SEQ ID NO: 2009122 - DNA, 22 bp, Homo sapiens
gacccagagtggagtctgagtc

SEQ ID NO: 2009123 - DNA, 16 bp, Homo sapiens
gacccagatcctcaca

SEQ ID NO: 2009124 - DNA, 17 bp, Homo sapiens
gacccagatctcatgga

SEQ ID NO: 2009125 - DNA, 12 bp, Homo sapiens
gacccagcagga

SEQ ID NO: 2009126 - DNA, 21 bp, Homo sapiens
gacccagcaggaagccaggct

SEQ ID NO: 2009127 - DNA, 23 bp, Homo sapiens
gacccagcaggaagccaggctga

SEQ ID NO: 2009128 - DNA, 22 bp, Homo sapiens
gacccagccccttgagaaacct

SEQ ID NO: 2009129 - DNA, 15 bp, Homo sapiens
gacccagctactctg

SEQ ID NO: 2009130 - DNA, 17 bp, Homo sapiens
gacccaggccgcctgcc

SEQ ID NO: 2009131 - DNA, 22 bp, Homo sapiens
gacccaggccgcctgccatacc

SEQ ID NO: 2009132 - DNA, 18 bp, Homo sapiens
gacccatagatcttctga

SEQ ID NO: 2009133 - DNA, 20 bp, Homo sapiens
gaccccaaagagcctggaga

SEQ ID NO: 2009134 - DNA, 23 bp, Homo sapiens
gaccccaaagagcctggagaagc

SEQ ID NO: 2009135 - DNA, 18 bp, Homo sapiens
gaccccagcggctgagtc

SEQ ID NO: 2009136 - DNA, 19 bp, Homo sapiens
gaccccagcggctgagtca

SEQ ID NO: 2009137 - DNA, 13 bp, Homo sapiens
gaccccagggcac

SEQ ID NO: 2009138 - DNA, 14 bp, Homo sapiens
gaccccagggcaca

SEQ ID NO: 2009139 - DNA, 20 bp, Homo sapiens
gaccctcctgtccagcaggt

SEQ ID NO: 2009140 - DNA, 15 bp, Homo sapiens
gaccctctgaatggt

SEQ ID NO: 2009141 - DNA, 13 bp, Homo sapiens
gaccctgagactc

SEQ ID NO: 2009142 - DNA, 16 bp, Homo sapiens
gaccctgagactccag

SEQ ID NO: 2009143 - DNA, 20 bp, Homo sapiens
gaccctgagtccgggaggca

SEQ ID NO: 2009144 - DNA, 11 bp, Homo sapiens
gaccctgccct

SEQ ID NO: 2009145 - DNA, 23 bp, Homo sapiens
gaccctgcccttgtttggggcag

SEQ ID NO: 2009146 - DNA, 23 bp, Homo sapiens
gaccctgcctgagcccaggagct

SEQ ID NO: 2009147 - DNA, 21 bp, Homo sapiens
gaccctgcgaaggggccctgg

SEQ ID NO: 2009148 - DNA, 19 bp, Homo sapiens
gaccctggaattcagcacc

SEQ ID NO: 2009149 - DNA, 23 bp, Homo sapiens
gaccctggaattcagcaccctgg

SEQ ID NO: 2009150 - DNA, 22 bp, Homo sapiens
gaccctggagcggctctcctga

SEQ ID NO: 2009151 - DNA, 20 bp, Homo sapiens
gaccctggttactctggtgc

SEQ ID NO: 2009152 - DNA, 19 bp, Homo sapiens
gaccctgttttccacacca

SEQ ID NO: 2009153 - DNA, 17 bp, Homo sapiens
gacccttccagacatac

SEQ ID NO: 2009154 - DNA, 21 bp, Homo sapiens
gacccttcccaatcagcactg

SEQ ID NO: 2009155 - DNA, 22 bp, Homo sapiens
gacccttcccaatcagcactga

SEQ ID NO: 2009156 - DNA, 15 bp, Homo sapiens
gacccttgcattaga

SEQ ID NO: 2009157 - DNA, 14 bp, Homo sapiens
gaccctttccttcc

SEQ ID NO: 2009158 - DNA, 23 bp, Homo sapiens
gaccctttccttccttccctggc

SEQ ID NO: 2009159 - DNA, 14 bp, Homo sapiens
gaccgaattttatt

SEQ ID NO: 2009160 - DNA, 19 bp, Homo sapiens
gaccgctacaccactctgg

SEQ ID NO: 2009161 - DNA, 22 bp, Homo sapiens
gaccgctacaccactctggcag

SEQ ID NO: 2009162 - DNA, 14 bp, Homo sapiens
gaccgcttcacccc

SEQ ID NO: 2009163 - DNA, 19 bp, Homo sapiens
gaccgcttcacccctgcac

SEQ ID NO: 2009164 - DNA, 15 bp, Homo sapiens
gaccgcttcccagag

SEQ ID NO: 2009165 - DNA, 15 bp, Homo sapiens
gaccggccctgcccc

SEQ ID NO: 2009166 - DNA, 17 bp, Homo sapiens
gaccgggctctgacagc

SEQ ID NO: 2009167 - DNA, 14 bp, Homo sapiens
gaccgggtgggcct

SEQ ID NO: 2009168 - DNA, 16 bp, Homo sapiens
gaccgggtgggcctgg

SEQ ID NO: 2009169 - DNA, 17 bp, Homo sapiens
gaccgggtgggcctggc

SEQ ID NO: 2009170 - DNA, 19 bp, Homo sapiens
gaccgggtgggcctggcct

SEQ ID NO: 2009171 - DNA, 20 bp, Homo sapiens
gaccgggtgggcctggcctg

SEQ ID NO: 2009172 - DNA, 19 bp, Homo sapiens
gaccgttttcatcctggcc

SEQ ID NO: 2009173 - DNA, 17 bp, Homo sapiens
gacctaaatgacctcag

SEQ ID NO: 2009174 - DNA, 20 bp, Homo sapiens
gacctaaatgacctcagcaa

SEQ ID NO: 2009175 - DNA, 20 bp, Homo sapiens
gacctaccagggacaagcag

SEQ ID NO: 2009176 - DNA, 18 bp, Homo sapiens
gacctagacctgggccaa

SEQ ID NO: 2009177 - DNA, 22 bp, Homo sapiens
gacctatgtcctaaggacacac

SEQ ID NO: 2009178 - DNA, 23 bp, Homo sapiens
gacctatgtcctaaggacacact

SEQ ID NO: 2009179 - DNA, 16 bp, Homo sapiens
gacctcacagtgaccc

SEQ ID NO: 2009180 - DNA, 18 bp, Homo sapiens
gacctcacagtgaccctt

SEQ ID NO: 2009181 - DNA, 20 bp, Homo sapiens
gacctcacagtgacccttcc

SEQ ID NO: 2009182 - DNA, 22 bp, Homo sapiens
gacctcaccggcatgctggcct

SEQ ID NO: 2009183 - DNA, 23 bp, Homo sapiens
gacctcaccggcatgctggcctg

SEQ ID NO: 2009184 - DNA, 14 bp, Homo sapiens
gacctcagcctgtg

SEQ ID NO: 2009185 - DNA, 19 bp, Homo sapiens
gacctcagcctgtgctgcc

SEQ ID NO: 2009186 - DNA, 14 bp, Homo sapiens
gacctcagccttcc

SEQ ID NO: 2009187 - DNA, 13 bp, Homo sapiens
gacctcaggcggg

SEQ ID NO: 2009188 - DNA, 21 bp, Homo sapiens
gacctcaggtgatccacccac

SEQ ID NO: 2009189 - DNA, 22 bp, Homo sapiens
gacctcatatcttcctcatcag

SEQ ID NO: 2009190 - DNA, 14 bp, Homo sapiens
gacctcccagccct

SEQ ID NO: 2009191 - DNA, 15 bp, Homo sapiens
gacctcccagcccta

SEQ ID NO: 2009192 - DNA, 21 bp, Homo sapiens
gacctcccagccctatggatg

SEQ ID NO: 2009193 - DNA, 22 bp, Homo sapiens
gacctcccagccctatggatgt

SEQ ID NO: 2009194 - DNA, 16 bp, Homo sapiens
gacctcctcctgccct

SEQ ID NO: 2009195 - DNA, 17 bp, Homo sapiens
gacctcctcctgccctc

SEQ ID NO: 2009196 - DNA, 17 bp, Homo sapiens
gacctcgtcctccccct

SEQ ID NO: 2009197 - DNA, 21 bp, Homo sapiens
gacctcgtcctccccctgcca

SEQ ID NO: 2009198 - DNA, 22 bp, Homo sapiens
gacctgaagggtgacatcccag

SEQ ID NO: 2009199 - DNA, 23 bp, Homo sapiens
gacctgaagggtgacatcccagg

SEQ ID NO: 2009200 - DNA, 21 bp, Homo sapiens
gacctgacaccgtccctcagt

SEQ ID NO: 2009201 - DNA, 13 bp, Homo sapiens
gacctgaccggca

SEQ ID NO: 2009202 - DNA, 12 bp, Homo sapiens
gacctgagcctg

SEQ ID NO: 2009203 - DNA, 14 bp, Homo sapiens
gacctgagcctgcc

SEQ ID NO: 2009204 - DNA, 15 bp, Homo sapiens
gacctgagcctgccg

SEQ ID NO: 2009205 - DNA, 16 bp, Homo sapiens
gacctgagtcggcccc

SEQ ID NO: 2009206 - DNA, 20 bp, Homo sapiens
gacctgcacgccaccgctgc

SEQ ID NO: 2009207 - DNA, 20 bp, Homo sapiens
gacctgcaggccaagagcag

SEQ ID NO: 2009208 - DNA, 21 bp, Homo sapiens
gacctgccccgcccagctgca

SEQ ID NO: 2009209 - DNA, 18 bp, Homo sapiens
gacctgcctctcacacac

SEQ ID NO: 2009210 - DNA, 10 bp, Homo sapiens
gacctgctga

SEQ ID NO: 2009211 - DNA, 11 bp, Homo sapiens
gacctgctgag

SEQ ID NO: 2009212 - DNA, 16 bp, Homo sapiens
gacctgctgagctctg

SEQ ID NO: 2009213 - DNA, 19 bp, Homo sapiens
gacctgctgagctctgaga

SEQ ID NO: 2009214 - DNA, 22 bp, Homo sapiens
gacctgctgagctctgagaggc

SEQ ID NO: 2009215 - DNA, 16 bp, Homo sapiens
gacctggacactaggg

SEQ ID NO: 2009216 - DNA, 12 bp, Homo sapiens
gacctggcttgg

SEQ ID NO: 2009217 - DNA, 15 bp, Homo sapiens
gacctgggccaaaag

SEQ ID NO: 2009218 - DNA, 22 bp, Homo sapiens
gacctgggccaaaagggcagcc

SEQ ID NO: 2009219 - DNA, 20 bp, Homo sapiens
gacctggttggccgtggtcc

SEQ ID NO: 2009220 - DNA, 22 bp, Homo sapiens
gacctggttggccgtggtccag

SEQ ID NO: 2009221 - DNA, 19 bp, Homo sapiens
gacctgtggggccccagag

SEQ ID NO: 2009222 - DNA, 23 bp, Homo sapiens
gaccttcctgccaccagtcactg

SEQ ID NO: 2009223 - DNA, 15 bp, Homo sapiens
gaccttctgaagatc

SEQ ID NO: 2009224 - DNA, 14 bp, Homo sapiens
gaccttgaactggg

SEQ ID NO: 2009225 - DNA, 14 bp, Homo sapiens
gaccttgttgcatg

SEQ ID NO: 2009226 - DNA, 15 bp, Homo sapiens
gacgaacggaagggt

SEQ ID NO: 2009227 - DNA, 21 bp, Homo sapiens
gacgagggatgggatttcatg

SEQ ID NO: 2009228 - DNA, 14 bp, Homo sapiens
gacgcaagggagaa

SEQ ID NO: 2009229 - DNA, 19 bp, Homo sapiens
gacgcaagggcctgatggg

SEQ ID NO: 2009230 - DNA, 22 bp, Homo sapiens
gacgcagccctgggggccagct

SEQ ID NO: 2009231 - DNA, 22 bp, Homo sapiens
gacgcatgccctcaatcccagc

SEQ ID NO: 2009232 - DNA, 16 bp, Homo sapiens
gacgccactcatttca

SEQ ID NO: 2009233 - DNA, 18 bp, Homo sapiens
gacgccactcatttcatc

SEQ ID NO: 2009234 - DNA, 19 bp, Homo sapiens
gacgccactcatttcatct

SEQ ID NO: 2009235 - DNA, 22 bp, Homo sapiens
gagatatgcacacacacggatg

SEQ ID NO: 2009236 - DNA, 16 bp, Homo sapiens
gagatatggcagcgaa

SEQ ID NO: 2009237 - DNA, 23 bp, Homo sapiens
gaggaaaaccaagccgtggcttc

SEQ ID NO: 2009238 - DNA, 15 bp, Homo sapiens
gaggaaaacgggaaa

SEQ ID NO: 2009239 - DNA, 17 bp, Homo sapiens
gaggaacctcaaactgg

SEQ ID NO: 2009240 - DNA, 15 bp, Homo sapiens
gaggaagatgaagag

SEQ ID NO: 2009241 - DNA, 19 bp, Homo sapiens
gaggaagatgaagagaagc

SEQ ID NO: 2009242 - DNA, 20 bp, Homo sapiens
gaggaagatgaagagaagct

SEQ ID NO: 2009243 - DNA, 22 bp, Homo sapiens
gaggaagatgaagagaagctga

SEQ ID NO: 2009244 - DNA, 13 bp, Homo sapiens
gaggaagggccag

SEQ ID NO: 2009245 - DNA, 14 bp, Homo sapiens
gaggaagggccagg

SEQ ID NO: 2009246 - DNA, 17 bp, Homo sapiens
gaggaagggccaggaga

SEQ ID NO: 2009247 - DNA, 18 bp, Homo sapiens
gaggaagggccaggagag

SEQ ID NO: 2009248 - DNA, 19 bp, Homo sapiens
gaggaagggccaggagaga

SEQ ID NO: 2009249 - DNA, 15 bp, Homo sapiens
gaggaaggtgctgag

SEQ ID NO: 2009250 - DNA, 18 bp, Homo sapiens
gaggaaggtgctgagctt

SEQ ID NO: 2009251 - DNA, 21 bp, Homo sapiens
gaggaataagctcccagggcc

SEQ ID NO: 2009252 - DNA, 17 bp, Homo sapiens
gaggaataattatttat

SEQ ID NO: 2009253 - DNA, 15 bp, Homo sapiens
gaggaatccagaccc

SEQ ID NO: 2009254 - DNA, 19 bp, Homo sapiens
gaggaatcgccccagactc

SEQ ID NO: 2009255 - DNA, 19 bp, Homo sapiens
gaggaattatcatgggaaa

SEQ ID NO: 2009256 - DNA, 11 bp, Homo sapiens
gaggacacatg

SEQ ID NO: 2009257 - DNA, 22 bp, Homo sapiens
gaggacagggaggtgaccccag

SEQ ID NO: 2009258 - DNA, 13 bp, Homo sapiens
gaggaccgggctg

SEQ ID NO: 2009259 - DNA, 12 bp, Homo sapiens
gaggacctgagc

SEQ ID NO: 2009260 - DNA, 14 bp, Homo sapiens
gaggacctgagcct

SEQ ID NO: 2009261 - DNA, 16 bp, Homo sapiens
gaggacctgagcctgc

SEQ ID NO: 2009262 - DNA, 18 bp, Homo sapiens
gaggacctgagcctgccg

SEQ ID NO: 2009263 - DNA, 22 bp, Homo sapiens
gaggacctgagcctgccgagca

SEQ ID NO: 2009264 - DNA, 23 bp, Homo sapiens
gaggacgtcatcggaggctgggc

SEQ ID NO: 2009265 - DNA, 21 bp, Homo sapiens
gaggactccctccatgtggcc

SEQ ID NO: 2009266 - DNA, 15 bp, Homo sapiens
gaggactgagactgg

SEQ ID NO: 2009267 - DNA, 14 bp, Homo sapiens
gaggacttgtgtct

SEQ ID NO: 2009268 - DNA, 16 bp, Homo sapiens
gaggacttttctttgt

SEQ ID NO: 2009269 - DNA, 16 bp, Homo sapiens
gaggagaaactgagaa

SEQ ID NO: 2009270 - DNA, 14 bp, Homo sapiens
gaggagaccagctc

SEQ ID NO: 2009271 - DNA, 12 bp, Homo sapiens
gaggagaccctg

SEQ ID NO: 2009272 - DNA, 13 bp, Homo sapiens
gaggagaccctgg

SEQ ID NO: 2009273 - DNA, 16 bp, Homo sapiens
gaggagaccctggaat

SEQ ID NO: 2009274 - DNA, 20 bp, Homo sapiens
gaggagagtggttgttgcca

SEQ ID NO: 2009275 - DNA, 16 bp, Homo sapiens
gaggagctgccgcaag

SEQ ID NO: 2009276 - DNA, 22 bp, Homo sapiens
gaggagctgccgcaaggccctg

SEQ ID NO: 2009277 - DNA, 23 bp, Homo sapiens
gaggagctgccgcaaggccctgt

SEQ ID NO: 2009278 - DNA, 21 bp, Homo sapiens
gaggagcttccagtgcatgtt

SEQ ID NO: 2009279 - DNA, 16 bp, Homo sapiens
gaggaggaggaaggca

SEQ ID NO: 2009280 - DNA, 14 bp, Homo sapiens
gaggaggaggagga

SEQ ID NO: 2009281 - DNA, 16 bp, Homo sapiens
gaggaggcagagaaga

SEQ ID NO: 2009282 - DNA, 21 bp, Homo sapiens
gaggaggcctgggggcaggga

SEQ ID NO: 2009283 - DNA, 13 bp, Homo sapiens
gaggagggcatgg

SEQ ID NO: 2009284 - DNA, 17 bp, Homo sapiens
gaggaggggcacctgcc

SEQ ID NO: 2009285 - DNA, 16 bp, Homo sapiens
gaggagggtggaggaa

SEQ ID NO: 2009286 - DNA, 17 bp, Homo sapiens
gaggaggtgtcccaagc

SEQ ID NO: 2009287 - DNA, 18 bp, Homo sapiens
gaggagtagctgagagga

SEQ ID NO: 2009288 - DNA, 19 bp, Homo sapiens
gaggagtagctgagaggaa

SEQ ID NO: 2009289 - DNA, 21 bp, Homo sapiens
gaggagtagctgagaggaaga

SEQ ID NO: 2009290 - DNA, 18 bp, Homo sapiens
gaggagtccagggcggga

SEQ ID NO: 2009291 - DNA, 13 bp, Homo sapiens
gaggagtctgagg

SEQ ID NO: 2009292 - DNA, 15 bp, Homo sapiens
gaggagtctgaggtc

SEQ ID NO: 2009293 - DNA, 20 bp, Homo sapiens
gaggagtctgaggtcctgag

SEQ ID NO: 2009294 - DNA, 20 bp, Homo sapiens
gaggagtttcgaggtagagt

SEQ ID NO: 2009295 - DNA, 20 bp, Homo sapiens
gaggatcactggagcccagg

SEQ ID NO: 2009296 - DNA, 20 bp, Homo sapiens
gaggatcctcacaggagcag

SEQ ID NO: 2009297 - DNA, 21 bp, Homo sapiens
gaggatcctcacaggagcaga

SEQ ID NO: 2009298 - DNA, 22 bp, Homo sapiens
gaggatctagcttcatgcctca

SEQ ID NO: 2009299 - DNA, 21 bp, Homo sapiens
gaggatggacgaacaggggcc

SEQ ID NO: 2009300 - DNA, 13 bp, Homo sapiens
gaggatggagaga

SEQ ID NO: 2009301 - DNA, 14 bp, Homo sapiens
gaggatggagagag

SEQ ID NO: 2009302 - DNA, 15 bp, Homo sapiens
gaggatggagagagg

SEQ ID NO: 2009303 - DNA, 12 bp, Homo sapiens
gaggatgttctg

SEQ ID NO: 2009304 - DNA, 22 bp, Homo sapiens
gaggatgttctggacctccccc

SEQ ID NO: 2009305 - DNA, 15 bp, Homo sapiens
gaggatttcaagcct

SEQ ID NO: 2009306 - DNA, 17 bp, Homo sapiens
gaggcaagagacagaat

SEQ ID NO: 2009307 - DNA, 15 bp, Homo sapiens
gaggcaccagctctg

SEQ ID NO: 2009308 - DNA, 19 bp, Homo sapiens
gaggcaccggcgctgcagg

SEQ ID NO: 2009309 - DNA, 14 bp, Homo sapiens
gaggcacctgctgg

SEQ ID NO: 2009310 - DNA, 15 bp, Homo sapiens
gaggcacctgctgga

SEQ ID NO: 2009311 - DNA, 12 bp, Homo sapiens
gaggcagacagc

SEQ ID NO: 2009312 - DNA, 15 bp, Homo sapiens
gaggcagacagcagc

SEQ ID NO: 2009313 - DNA, 16 bp, Homo sapiens
gaggcagacagcagct

SEQ ID NO: 2009314 - DNA, 20 bp, Homo sapiens
gaggcagacagcagctcagg

SEQ ID NO: 2009315 - DNA, 21 bp, Homo sapiens
gaggcagacagcagctcaggc

SEQ ID NO: 2009316 - DNA, 18 bp, Homo sapiens
gaggcagaggcagacagg

SEQ ID NO: 2009317 - DNA, 21 bp, Homo sapiens
gaggcagcgtgaaagcagatg

SEQ ID NO: 2009318 - DNA, 14 bp, Homo sapiens
gaggcagctccaac

SEQ ID NO: 2009319 - DNA, 19 bp, Homo sapiens
gaggcagctccaacagctt

SEQ ID NO: 2009320 - DNA, 23 bp, Homo sapiens
gaggcagggcaaatgacatgcac

SEQ ID NO: 2009321 - DNA, 17 bp, Homo sapiens
gaggcagggccttgccc

SEQ ID NO: 2009322 - DNA, 22 bp, Homo sapiens
gaggcagggccttgcccagaga

SEQ ID NO: 2009323 - DNA, 23 bp, Homo sapiens
gaggcagggccttgcccagagat

SEQ ID NO: 2009324 - DNA, 13 bp, Homo sapiens
gaggcagggtcag

SEQ ID NO: 2009325 - DNA, 14 bp, Homo sapiens
gaggcagggtctca

SEQ ID NO: 2009326 - DNA, 15 bp, Homo sapiens
gaggcagggtctcac

SEQ ID NO: 2009327 - DNA, 22 bp, Homo sapiens
gaggcagggtctcactctgtcg

SEQ ID NO: 2009328 - DNA, 19 bp, Homo sapiens
gaggcaggtggatcacctg

SEQ ID NO: 2009329 - DNA, 21 bp, Homo sapiens
gaggcatgtgatgtgcaagga

SEQ ID NO: 2009330 - DNA, 13 bp, Homo sapiens
gaggccaaggcag

SEQ ID NO: 2009331 - DNA, 15 bp, Homo sapiens
gaggccaaggcaggt

SEQ ID NO: 2009332 - DNA, 13 bp, Homo sapiens
gaggccaccggga

SEQ ID NO: 2009333 - DNA, 14 bp, Homo sapiens
gaggccagcctggc

SEQ ID NO: 2009334 - DNA, 17 bp, Homo sapiens
gaggccagcctggcctc

SEQ ID NO: 2009335 - DNA, 18 bp, Homo sapiens
gaggccaggaatctgcca

SEQ ID NO: 2009336 - DNA, 16 bp, Homo sapiens
gaggcccagcctgtcc

SEQ ID NO: 2009337 - DNA, 13 bp, Homo sapiens
gagggtccccggg

SEQ ID NO: 2009338 - DNA, 17 bp, Homo sapiens
gagggtccccgggagca

SEQ ID NO: 2009339 - DNA, 21 bp, Homo sapiens
gagggtcgccacacccggctc

SEQ ID NO: 2009340 - DNA, 13 bp, Homo sapiens
gagggtctgagga

SEQ ID NO: 2009341 - DNA, 13 bp, Homo sapiens
gagggtggagact

SEQ ID NO: 2009342 - DNA, 14 bp, Homo sapiens
gagggtggaggaag

SEQ ID NO: 2009343 - DNA, 17 bp, Homo sapiens
gagggtggggccgggtg

SEQ ID NO: 2009344 - DNA, 23 bp, Homo sapiens
gagggttgggcgtgctacctgca

SEQ ID NO: 2009345 - DNA, 14 bp, Homo sapiens
gagggttgggctgg

SEQ ID NO: 2009346 - DNA, 20 bp, Homo sapiens
gagggttgggttcatctgag

SEQ ID NO: 2009347 - DNA, 21 bp, Homo sapiens
gagggttgtactattgtttaa

SEQ ID NO: 2009348 - DNA, 14 bp, Homo sapiens
gaggtagcgagctg

SEQ ID NO: 2009349 - DNA, 21 bp, Homo sapiens
gaggtagcgagctgctctgct

SEQ ID NO: 2009350 - DNA, 15 bp, Homo sapiens
gaggtagctcccagc

SEQ ID NO: 2009351 - DNA, 16 bp, Homo sapiens
gaggtcacattcagga

SEQ ID NO: 2009352 - DNA, 19 bp, Homo sapiens
gaggtcacattcaggaaga

SEQ ID NO: 2009353 - DNA, 22 bp, Homo sapiens
gaggtcacattcaggaagatga

SEQ ID NO: 2009354 - DNA, 12 bp, Homo sapiens
gaggtcagagcc

SEQ ID NO: 2009355 - DNA, 17 bp, Homo sapiens
gaggtcagagcctgcag

SEQ ID NO: 2009356 - DNA, 12 bp, Homo sapiens
gaggtcctgagc

SEQ ID NO: 2009357 - DNA, 17 bp, Homo sapiens
gaggtcctgagcactgc

SEQ ID NO: 2009358 - DNA, 22 bp, Homo sapiens
gaggtcgaccccaaagcccctt

SEQ ID NO: 2009359 - DNA, 22 bp, Homo sapiens
gatatgagtatacaatatataa

SEQ ID NO: 2009360 - DNA, 14 bp, Homo sapiens
gatatgcagaagga

SEQ ID NO: 2009361 - DNA, 17 bp, Homo sapiens
gatatgtaaaacattta

SEQ ID NO: 2009362 - DNA, 17 bp, Homo sapiens
gatatgttgttaaacac

SEQ ID NO: 2009363 - DNA, 22 bp, Homo sapiens
gatattgtcagagttctgctct

SEQ ID NO: 2009364 - DNA, 13 bp, Homo sapiens
gatatttatatat

SEQ ID NO: 2009365 - DNA, 16 bp, Homo sapiens
gatatttatatatatt

SEQ ID NO: 2009366 - DNA, 19 bp, Homo sapiens
gatatttatggggggagaa

SEQ ID NO: 2009367 - DNA, 19 bp, Homo sapiens
gatatttattgagtgccca

SEQ ID NO: 2009368 - DNA, 14 bp, Homo sapiens
gatatttgaatctt

SEQ ID NO: 2009369 - DNA, 19 bp, Homo sapiens
gatattttcaacgcagccc

SEQ ID NO: 2009370 - DNA, 21 bp, Homo sapiens
gatattttcaacgcagccctg

SEQ ID NO: 2009371 - DNA, 21 bp, Homo sapiens
gatattttttcagaaatatgt

SEQ ID NO: 2009372 - DNA, 13 bp, Homo sapiens
gatcaaaaataaa

SEQ ID NO: 2009373 - DNA, 17 bp, Homo sapiens
gatcaaaaataaactag

SEQ ID NO: 2009374 - DNA, 22 bp, Homo sapiens
gatcaaaccccgaccacctgcc

SEQ ID NO: 2009375 - DNA, 12 bp, Homo sapiens
gatcaaagttcc

SEQ ID NO: 2009376 - DNA, 16 bp, Homo sapiens
gatcaaagttcctgtt

SEQ ID NO: 2009377 - DNA, 18 bp, Homo sapiens
gatcaaagttcctgttca

SEQ ID NO: 2009378 - DNA, 23 bp, Homo sapiens
gatcaaattcatttttttcactg

SEQ ID NO: 2009379 - DNA, 14 bp, Homo sapiens
gatcaagaaagtgt

SEQ ID NO: 2009380 - DNA, 22 bp, Homo sapiens
gatcaccagcccggcctgctcc

SEQ ID NO: 2009381 - DNA, 20 bp, Homo sapiens
gatcacggctcactgcagcc

SEQ ID NO: 2009382 - DNA, 20 bp, Homo sapiens
gatcactcaaaaaggtgtgt

SEQ ID NO: 2009383 - DNA, 12 bp, Homo sapiens
gatcactggagc

SEQ ID NO: 2009384 - DNA, 15 bp, Homo sapiens
gatcagaaggctggg

SEQ ID NO: 2009385 - DNA, 17 bp, Homo sapiens
gatcagaaggctggggc

SEQ ID NO: 2009386 - DNA, 21 bp, Homo sapiens
gatcagaaggctggggccagt

SEQ ID NO: 2009387 - DNA, 14 bp, Homo sapiens
gatcagaattttac

SEQ ID NO: 2009388 - DNA, 17 bp, Homo sapiens
gatcagccccgctcctc

SEQ ID NO: 2009389 - DNA, 13 bp, Homo sapiens
gatcagcgtggcc

SEQ ID NO: 2009390 - DNA, 17 bp, Homo sapiens
gatcagctgtttgtcat

SEQ ID NO: 2009391 - DNA, 18 bp, Homo sapiens
gatcagctgtttgtcata

SEQ ID NO: 2009392 - DNA, 17 bp, Homo sapiens
gatcaggaagagaagga

SEQ ID NO: 2009393 - DNA, 23 bp, Homo sapiens
gatcagtatgctgttttaataat

SEQ ID NO: 2009394 - DNA, 22 bp, Homo sapiens
gatcagtctgattcccaagctc

SEQ ID NO: 2009395 - DNA, 16 bp, Homo sapiens
gatcatccactgtgcc

SEQ ID NO: 2009396 - DNA, 21 bp, Homo sapiens
gatcatccactgtgccatgtg

SEQ ID NO: 2009397 - DNA, 22 bp, Homo sapiens
gatcatcccatctaagctgcag

SEQ ID NO: 2009398 - DNA, 14 bp, Homo sapiens
gatcatctggggac

SEQ ID NO: 2009399 - DNA, 18 bp, Homo sapiens
gatcattacatggctgtg

SEQ ID NO: 2009400 - DNA, 18 bp, Homo sapiens
gatcatttgttggaatga

SEQ ID NO: 2009401 - DNA, 12 bp, Homo sapiens
gatccaagctgg

SEQ ID NO: 2009402 - DNA, 17 bp, Homo sapiens
gatccaagctggtccca

SEQ ID NO: 2009403 - DNA, 21 bp, Homo sapiens
gatccaagctggtcccactca

SEQ ID NO: 2009404 - DNA, 19 bp, Homo sapiens
gatccaccctcaaatgtca

SEQ ID NO: 2009405 - DNA, 20 bp, Homo sapiens
gatccatttggacaaaatgg

SEQ ID NO: 2009406 - DNA, 20 bp, Homo sapiens
gatcccagagcttcccagga

SEQ ID NO: 2009407 - DNA, 21 bp, Homo sapiens
gatcccatccatcagctccct

SEQ ID NO: 2009408 - DNA, 15 bp, Homo sapiens
gatccctagctgtga

SEQ ID NO: 2009409 - DNA, 21 bp, Homo sapiens
gatccctagctgtgacctctc

SEQ ID NO: 2009410 - DNA, 16 bp, Homo sapiens
gatccgctgccaccac

SEQ ID NO: 2009411 - DNA, 19 bp, Homo sapiens
gatcctaactgagaatttt

SEQ ID NO: 2009412 - DNA, 18 bp, Homo sapiens
gatcctattctcaccagg

SEQ ID NO: 2009413 - DNA, 20 bp, Homo sapiens
gatcctattctcaccaggaa

SEQ ID NO: 2009414 - DNA, 17 bp, Homo sapiens
gatcctcccacctcagc

SEQ ID NO: 2009415 - DNA, 21 bp, Homo sapiens
gatcctgcaggaacgagcact

SEQ ID NO: 2009416 - DNA, 19 bp, Homo sapiens
gatcctgctgtggcctcac

SEQ ID NO: 2009417 - DNA, 19 bp, Homo sapiens
gatcctggattcactcact

SEQ ID NO: 2009418 - DNA, 13 bp, Homo sapiens
gatccttgtttta

SEQ ID NO: 2009419 - DNA, 23 bp, Homo sapiens
gatccttgttttaagattgtaat

SEQ ID NO: 2009420 - DNA, 15 bp, Homo sapiens
gatcgagccactgca

SEQ ID NO: 2009421 - DNA, 13 bp, Homo sapiens
gatcgaggacaag

SEQ ID NO: 2009422 - DNA, 16 bp, Homo sapiens
gatcgtattaattatc

SEQ ID NO: 2009423 - DNA, 18 bp, Homo sapiens
gatctaatacaaagatga

SEQ ID NO: 2009424 - DNA, 21 bp, Homo sapiens
gatctagaatgtgttttctga

SEQ ID NO: 2009425 - DNA, 21 bp, Homo sapiens
gatctagcttcatgcctcagt

SEQ ID NO: 2009426 - DNA, 15 bp, Homo sapiens
gatctatagatgacc

SEQ ID NO: 2009427 - DNA, 13 bp, Homo sapiens
gatctatgcaatt

SEQ ID NO: 2009428 - DNA, 14 bp, Homo sapiens
gatctatgcaattt

SEQ ID NO: 2009429 - DNA, 20 bp, Homo sapiens
gatctcatggaaactggcca

SEQ ID NO: 2009430 - DNA, 13 bp, Homo sapiens
gatctccaaggac

SEQ ID NO: 2009431 - DNA, 16 bp, Homo sapiens
gatctccaaggaccag

SEQ ID NO: 2009432 - DNA, 17 bp, Homo sapiens
gatctccatatgttaca

SEQ ID NO: 2009433 - DNA, 12 bp, Homo sapiens
gatctccctgcc

SEQ ID NO: 2009434 - DNA, 13 bp, Homo sapiens
gatctccctgccg

SEQ ID NO: 2009435 - DNA, 15 bp, Homo sapiens
gatctccctgccgcc

SEQ ID NO: 2009436 - DNA, 19 bp, Homo sapiens
gatctctcaggagcacagg

SEQ ID NO: 2009437 - DNA, 24 bp, Homo sapiens
gatctctcaggagcacaggcagct

SEQ ID NO: 2009438 - DNA, 11 bp, Homo sapiens
gatctctgctt

SEQ ID NO: 2009439 - DNA, 22 bp, Homo sapiens
gatctgaaaggcacactttgat

SEQ ID NO: 2009440 - DNA, 19 bp, Homo sapiens
gatctgactttaattgtgt

SEQ ID NO: 2009441 - DNA, 15 bp, Homo sapiens
gatctgcactgggtg

SEQ ID NO: 2009442 - DNA, 22 bp, Homo sapiens
gatctgcattccccgctgccca

SEQ ID NO: 2009443 - DNA, 15 bp, Homo sapiens
gatctgcctgggcct

SEQ ID NO: 2009444 - DNA, 20 bp, Homo sapiens
gatctgcctgggcctgtgca

SEQ ID NO: 2009445 - DNA, 22 bp, Homo sapiens
gatctgggaccctttccttcct

SEQ ID NO: 2009446 - DNA, 14 bp, Homo sapiens
gatctgtactgtaa

SEQ ID NO: 2009447 - DNA, 15 bp, Homo sapiens
gatctgtactgtaat

SEQ ID NO: 2009448 - DNA, 18 bp, Homo sapiens
gatctgtactgtaatttt

SEQ ID NO: 2009449 - DNA, 15 bp, Homo sapiens
gatctgtatatacaa

SEQ ID NO: 2009450 - DNA, 20 bp, Homo sapiens
gatctgtcccctctcccctc

SEQ ID NO: 2009451 - DNA, 19 bp, Homo sapiens
gatctgtttttaaaaatca

SEQ ID NO: 2009452 - DNA, 16 bp, Homo sapiens
gatcttctgaaatgaa

SEQ ID NO: 2009453 - DNA, 17 bp, Homo sapiens
gatcttgttaatgcatt

SEQ ID NO: 2009454 - DNA, 15 bp, Homo sapiens
gatctttcaggaaag

SEQ ID NO: 2009455 - DNA, 16 bp, Homo sapiens
gatcttttcaagttaa

SEQ ID NO: 2009456 - DNA, 17 bp, Homo sapiens
gatgaaattgaacctgg

SEQ ID NO: 2009457 - DNA, 21 bp, Homo sapiens
gatgaaattgaacctggtttt

SEQ ID NO: 2009458 - DNA, 21 bp, Homo sapiens
gatgaagagaagctgagaaga

SEQ ID NO: 2009459 - DNA, 14 bp, Homo sapiens
gatgaagagtgaga

SEQ ID NO: 2009460 - DNA, 15 bp, Homo sapiens
gatgaagcccgtgtc

SEQ ID NO: 2009461 - DNA, 16 bp, Homo sapiens
gatgaagggcccgaga

SEQ ID NO: 2009462 - DNA, 23 bp, Homo sapiens
gatgaatgaggtcccaggcagag

SEQ ID NO: 2009463 - DNA, 21 bp, Homo sapiens
gatgacagctcttctaaggaa

SEQ ID NO: 2009464 - DNA, 13 bp, Homo sapiens
gatgaccagaaca

SEQ ID NO: 2009465 - DNA, 18 bp, Homo sapiens
gatgaccagaacaaggtt

SEQ ID NO: 2009466 - DNA, 23 bp, Homo sapiens
gatgaccctgcgaaggggccctg

SEQ ID NO: 2009467 - DNA, 15 bp, Homo sapiens
gatgactaaaatatt

SEQ ID NO: 2009468 - DNA, 15 bp, Homo sapiens
gatgactagaggcag

SEQ ID NO: 2009469 - DNA, 21 bp, Homo sapiens
gatgactcccttaaaatagaa

SEQ ID NO: 2009470 - DNA, 14 bp, Homo sapiens
gatgactgagtcct

SEQ ID NO: 2009471 - DNA, 17 bp, Homo sapiens
gatgactgagtcctcgt

SEQ ID NO: 2009472 - DNA, 19 bp, Homo sapiens
gatgactttttttctgatt

SEQ ID NO: 2009473 - DNA, 11 bp, Homo sapiens
gatgagaaagg

SEQ ID NO: 2009474 - DNA, 18 bp, Homo sapiens
gatgagaagttaagcagc

SEQ ID NO: 2009475 - DNA, 23 bp, Homo sapiens
gatgagacttccaaacctgacag

SEQ ID NO: 2009476 - DNA, 11 bp, Homo sapiens
gatgagaggca

SEQ ID NO: 2009477 - DNA, 18 bp, Homo sapiens
gatgagagtggcttaaaa

SEQ ID NO: 2009478 - DNA, 20 bp, Homo sapiens
gatgagcagtcacactgtta

SEQ ID NO: 2009479 - DNA, 23 bp, Homo sapiens
gatgagccgctgtgagcccctgg

SEQ ID NO: 2009480 - DNA, 20 bp, Homo sapiens
gatgagggcagcagccagcc

SEQ ID NO: 2009481 - DNA, 20 bp, Homo sapiens
gatgatcagctgtttgtcat

SEQ ID NO: 2009482 - DNA, 15 bp, Homo sapiens
gatgatctactcaga

SEQ ID NO: 2009483 - DNA, 21 bp, Homo sapiens
gatgatctactcagaaatttt

SEQ ID NO: 2009484 - DNA, 14 bp, Homo sapiens
gatgatgtctcttg

SEQ ID NO: 2009485 - DNA, 16 bp, Homo sapiens
gatgatgtctcttgta

SEQ ID NO: 2009486 - DNA, 18 bp, Homo sapiens
gatgatttcagaaggaga

SEQ ID NO: 2009487 - DNA, 20 bp, Homo sapiens
gatgatttgctatcaaaata

SEQ ID NO: 2009488 - DNA, 17 bp, Homo sapiens
gatgcaagatatttata

SEQ ID NO: 2009489 - DNA, 13 bp, Homo sapiens
gatgcaccagccc

SEQ ID NO: 2009490 - DNA, 19 bp, Homo sapiens
gatgcacggcggcagggtg

SEQ ID NO: 2009491 - DNA, 16 bp, Homo sapiens
gatgcagcattatgat

SEQ ID NO: 2009492 - DNA, 13 bp, Homo sapiens
gatgcatgcgcag

SEQ ID NO: 2009493 - DNA, 12 bp, Homo sapiens
gatgccacagcc

SEQ ID NO: 2009494 - DNA, 15 bp, Homo sapiens
gatgccacagcccca

SEQ ID NO: 2009495 - DNA, 22 bp, Homo sapiens
gatgccacccagcaacacagag

SEQ ID NO: 2009496 - DNA, 19 bp, Homo sapiens
gatgcccagagggcccagg

SEQ ID NO: 2009497 - DNA, 20 bp, Homo sapiens
gatgcccagagggcccaggc

SEQ ID NO: 2009498 - DNA, 13 bp, Homo sapiens
gatgccccttccc

SEQ ID NO: 2009499 - DNA, 15 bp, Homo sapiens
gatgcctggtggcag

SEQ ID NO: 2009500 - DNA, 19 bp, Homo sapiens
gatgcctggtggcagctgc

SEQ ID NO: 2009501 - DNA, 22 bp, Homo sapiens
gatgcgagcgctatcttcacat

SEQ ID NO: 2009502 - DNA, 17 bp, Homo sapiens
gatgcggggcagagcca

SEQ ID NO: 2009503 - DNA, 12 bp, Homo sapiens
gatgctccaggg

SEQ ID NO: 2009504 - DNA, 15 bp, Homo sapiens
gatgctccagggcag

SEQ ID NO: 2009505 - DNA, 17 bp, Homo sapiens
gatgctgactgtactcc

SEQ ID NO: 2009506 - DNA, 23 bp, Homo sapiens
gatgctgccccgttccctgtcag

SEQ ID NO: 2009507 - DNA, 12 bp, Homo sapiens
gatgctgcctga

SEQ ID NO: 2009508 - DNA, 14 bp, Homo sapiens
gatgctgcctgagt

SEQ ID NO: 2009509 - DNA, 19 bp, Homo sapiens
aataaacctggagatgatg

SEQ ID NO: 2009510 - DNA, 20 bp, Homo sapiens
aataaacctggagatgatga

SEQ ID NO: 2009511 - DNA, 15 bp, Homo sapiens
ctcttcaggttctta

SEQ ID NO: 2009512 - DNA, 18 bp, Homo sapiens
ctcttccccttgcccttg

SEQ ID NO: 2009513 - DNA, 14 bp, Homo sapiens
ctcttccctcagtt

SEQ ID NO: 2009514 - DNA, 15 bp, Homo sapiens
ctcttccctccttcc

SEQ ID NO: 2009515 - DNA, 15 bp, Homo sapiens
ctcttcctacccaac

SEQ ID NO: 2009516 - DNA, 23 bp, Homo sapiens
ctcttcctcctggttcaagcgat

SEQ ID NO: 2009517 - DNA, 20 bp, Homo sapiens
gatgctggggagaatgaaga

SEQ ID NO: 2009518 - DNA, 14 bp, Homo sapiens
gatggacccctccc

SEQ ID NO: 2009519 - DNA, 13 bp, Homo sapiens
gatggaccctcgc

SEQ ID NO: 2009520 - DNA, 18 bp, Homo sapiens
gatggaccgggtgggcct

SEQ ID NO: 2009521 - DNA, 14 bp, Homo sapiens
gatggactctgaaa

SEQ ID NO: 2009522 - DNA, 21 bp, Homo sapiens
gatggacttttgggggttgga

SEQ ID NO: 2009523 - DNA, 16 bp, Homo sapiens
gatggagaaggaaggc

SEQ ID NO: 2009524 - DNA, 20 bp, Homo sapiens
gatggagccagctctgcatt

SEQ ID NO: 2009525 - DNA, 14 bp, Homo sapiens
gatggaggagaaga

SEQ ID NO: 2009526 - DNA, 16 bp, Homo sapiens
gatggagttcttgtgc

SEQ ID NO: 2009527 - DNA, 18 bp, Homo sapiens
gatggagttcttgtgcca

SEQ ID NO: 2009528 - DNA, 19 bp, Homo sapiens
gatggagttcttgtgccat

SEQ ID NO: 2009529 - DNA, 15 bp, Homo sapiens
gatggatggacagaa

SEQ ID NO: 2009530 - DNA, 16 bp, Homo sapiens
gatggatggacagaat

SEQ ID NO: 2009531 - DNA, 15 bp, Homo sapiens
gatggatttgaagca

SEQ ID NO: 2009532 - DNA, 18 bp, Homo sapiens
gatggcaccaacgggacc

SEQ ID NO: 2009533 - DNA, 14 bp, Homo sapiens
gatggccaagagca

SEQ ID NO: 2009534 - DNA, 22 bp, Homo sapiens
gatggccaagggggtggacgca

SEQ ID NO: 2009535 - DNA, 17 bp, Homo sapiens
gatggcgcgggaggcac

SEQ ID NO: 2009536 - DNA, 19 bp, Homo sapiens
gatggcgctattgcactcc

SEQ ID NO: 2009537 - DNA, 20 bp, Homo sapiens
gatggctgtgcctctgcctg

SEQ ID NO: 2009538 - DNA, 16 bp, Homo sapiens
gatgggaagatggtag

SEQ ID NO: 2009539 - DNA, 20 bp, Homo sapiens
gatgggaagatggtagcaga

SEQ ID NO: 2009540 - DNA, 22 bp, Homo sapiens
gatgggacattccaaagaacag

SEQ ID NO: 2009541 - DNA, 20 bp, Homo sapiens
gatgggaccagggatggggg

SEQ ID NO: 2009542 - DNA, 23 bp, Homo sapiens
gatgggactagagctttctttca

SEQ ID NO: 2009543 - DNA, 22 bp, Homo sapiens
gatgggcaacccccagcctgct

SEQ ID NO: 2009544 - DNA, 16 bp, Homo sapiens
gatgggcacatgagga

SEQ ID NO: 2009545 - DNA, 22 bp, Homo sapiens
gatgggcacatgaggagggtgc

SEQ ID NO: 2009546 - DNA, 12 bp, Homo sapiens
gatgggccaggg

SEQ ID NO: 2009547 - DNA, 11 bp, Homo sapiens
gatggggagaa

SEQ ID NO: 2009548 - DNA, 13 bp, Homo sapiens
gatggggagaaag

SEQ ID NO: 2009549 - DNA, 14 bp, Homo sapiens
gatggggagaaagg

SEQ ID NO: 2009550 - DNA, 14 bp, Homo sapiens
gatggggataagaa

SEQ ID NO: 2009551 - DNA, 14 bp, Homo sapiens
gatggggtgggcag

SEQ ID NO: 2009552 - DNA, 15 bp, Homo sapiens
gatgggtattaaact

SEQ ID NO: 2009553 - DNA, 13 bp, Homo sapiens
gatggtagcagat

SEQ ID NO: 2009554 - DNA, 17 bp, Homo sapiens
gatggtagcagataaag

SEQ ID NO: 2009555 - DNA, 20 bp, Homo sapiens
gatggtccgccacgaggagc

SEQ ID NO: 2009556 - DNA, 21 bp, Homo sapiens
gatggtcctggggctctgtgc

SEQ ID NO: 2009557 - DNA, 15 bp, Homo sapiens
gatggtgagctggga

SEQ ID NO: 2009558 - DNA, 16 bp, Homo sapiens
gatgtaggagggactg

SEQ ID NO: 2009559 - DNA, 19 bp, Homo sapiens
gatgtagggtaaggtgcct

SEQ ID NO: 2009560 - DNA, 21 bp, Homo sapiens
gatgtagggtaaggtgccttc

SEQ ID NO: 2009561 - DNA, 11 bp, Homo sapiens
gatgtcagcct

SEQ ID NO: 2009562 - DNA, 12 bp, Homo sapiens
gatgtcagcctt

SEQ ID NO: 2009563 - DNA, 15 bp, Homo sapiens
gatgtcagccttgca

SEQ ID NO: 2009564 - DNA, 13 bp, Homo sapiens
gatgtcatcccct

SEQ ID NO: 2009565 - DNA, 22 bp, Homo sapiens
gatgtcatgtacttcctgtgta

SEQ ID NO: 2009566 - DNA, 12 bp, Homo sapiens
gatgtccagaag

SEQ ID NO: 2009567 - DNA, 17 bp, Homo sapiens
gatgtcccaacttgtaa

SEQ ID NO: 2009568 - DNA, 22 bp, Homo sapiens
gatgtcccatctgctcctccca

SEQ ID NO: 2009569 - DNA, 15 bp, Homo sapiens
gatgtccgttccagg

SEQ ID NO: 2009570 - DNA, 22 bp, Homo sapiens
gatgtcctctttactcccttcc

SEQ ID NO: 2009571 - DNA, 16 bp, Homo sapiens
gatgtgagtgtgtgtg

SEQ ID NO: 2009572 - DNA, 20 bp, Homo sapiens
gatgtgattcaaaagatgcc

SEQ ID NO: 2009573 - DNA, 17 bp, Homo sapiens
gatgtgattcctgcatt

SEQ ID NO: 2009574 - DNA, 11 bp, Homo sapiens
gatgtgcattc

SEQ ID NO: 2009575 - DNA, 14 bp, Homo sapiens
gatgtgcccacagg

SEQ ID NO: 2009576 - DNA, 16 bp, Homo sapiens
gatgtgcccacaggga

SEQ ID NO: 2009577 - DNA, 12 bp, Homo sapiens
gatgtggccctg

SEQ ID NO: 2009578 - DNA, 13 bp, Homo sapiens
gatgtggccctgg

SEQ ID NO: 2009579 - DNA, 14 bp, Homo sapiens
gatgtggccctggc

SEQ ID NO: 2009580 - DNA, 20 bp, Homo sapiens
gatgtggccctggcctgctg

SEQ ID NO: 2009581 - DNA, 22 bp, Homo sapiens
gatgtgggagggagcagacagg

SEQ ID NO: 2009582 - DNA, 23 bp, Homo sapiens
gatgtgggagggagcagacagga

SEQ ID NO: 2009583 - DNA, 15 bp, Homo sapiens
gatgtgtggggcatg

SEQ ID NO: 2009584 - DNA, 12 bp, Homo sapiens
gatgtgttgtga

SEQ ID NO: 2009585 - DNA, 14 bp, Homo sapiens
gatgtgttgtgata

SEQ ID NO: 2009586 - DNA, 22 bp, Homo sapiens
gatgttaaaaaaataagaagaa

SEQ ID NO: 2009587 - DNA, 15 bp, Homo sapiens
tccaaggcctttttc

SEQ ID NO: 2009588 - DNA, 13 bp, Homo sapiens
tccaagtatttta

SEQ ID NO: 2009589 - DNA, 21 bp, Homo sapiens
tccaagtattttatctgtgtt

SEQ ID NO: 2009590 - DNA, 15 bp, Homo sapiens
tccaagtcaacactc

SEQ ID NO: 2009591 - DNA, 22 bp, Homo sapiens
tccaagtggtgggaatcagatc

SEQ ID NO: 2009592 - DNA, 19 bp, Homo sapiens
tccaagttcctgcactcca

SEQ ID NO: 2009593 - DNA, 22 bp, Homo sapiens
tccaagttcctgcactccagaa

SEQ ID NO: 2009594 - DNA, 12 bp, Homo sapiens
tccaatataaat

SEQ ID NO: 2009595 - DNA, 11 bp, Homo sapiens
tccaatatttg

SEQ ID NO: 2009596 - DNA, 12 bp, Homo sapiens
tccaatatttgg

SEQ ID NO: 2009597 - DNA, 18 bp, Homo sapiens
tccaatcccaccaaccct

SEQ ID NO: 2009598 - DNA, 22 bp, Homo sapiens
tccaatcccatagatgggtctg

SEQ ID NO: 2009599 - DNA, 11 bp, Homo sapiens
tccaatcctca

SEQ ID NO: 2009600 - DNA, 19 bp, Homo sapiens
tccaatggctgtaaactat

SEQ ID NO: 2009601 - DNA, 21 bp, Homo sapiens
tccaatggctgtaaactataa

SEQ ID NO: 2009602 - DNA, 21 bp, Homo sapiens
tccaatgtctttttaagctta

SEQ ID NO: 2009603 - DNA, 17 bp, Homo sapiens
tccaattatgcactggc

SEQ ID NO: 2009604 - DNA, 23 bp, Homo sapiens
tccaattatgtgacaacctttgt

SEQ ID NO: 2009605 - DNA, 23 bp, Homo sapiens
tccaattgcctcttgcaggctga

SEQ ID NO: 2009606 - DNA, 14 bp, Homo sapiens
tccaattgtaaaaa

SEQ ID NO: 2009607 - DNA, 18 bp, Homo sapiens
tccaattttctggaatac

SEQ ID NO: 2009608 - DNA, 19 bp, Homo sapiens
tccacaagattcccagaga

SEQ ID NO: 2009609 - DNA, 23 bp, Homo sapiens
tccacaagattcccagagacagg

SEQ ID NO: 2009610 - DNA, 23 bp, Homo sapiens
tccacaagcaatggacctttggg

SEQ ID NO: 2009611 - DNA, 21 bp, Homo sapiens
tccacacaaaatgtcacactt

SEQ ID NO: 2009612 - DNA, 15 bp, Homo sapiens
tccacacacgcagga

SEQ ID NO: 2009613 - DNA, 16 bp, Homo sapiens
tccacagccgcagcct

SEQ ID NO: 2009614 - DNA, 22 bp, Homo sapiens
tccacagcggaggagaccagct

SEQ ID NO: 2009615 - DNA, 15 bp, Homo sapiens
tccacaggggcaggc

SEQ ID NO: 2009616 - DNA, 18 bp, Homo sapiens
tccacaggggcaggcctg

SEQ ID NO: 2009617 - DNA, 20 bp, Homo sapiens
tccacaggggcaggcctggg

SEQ ID NO: 2009618 - DNA, 22 bp, Homo sapiens
tccacaggggcaggcctgggac

SEQ ID NO: 2009619 - DNA, 23 bp, Homo sapiens
tccacaggggcaggcctgggacc

SEQ ID NO: 2009620 - DNA, 13 bp, Homo sapiens
tccacagtctctg

SEQ ID NO: 2009621 - DNA, 15 bp, Homo sapiens
tccacagtctctggg

SEQ ID NO: 2009622 - DNA, 20 bp, Homo sapiens
tccacagtgcccagctaatt

SEQ ID NO: 2009623 - DNA, 16 bp, Homo sapiens
tccaccaacccatcag

SEQ ID NO: 2009624 - DNA, 18 bp, Homo sapiens
tccaccaacccatcagaa

SEQ ID NO: 2009625 - DNA, 17 bp, Homo sapiens
tccacccaggagccccg

SEQ ID NO: 2009626 - DNA, 19 bp, Homo sapiens
tccacccaggctgcactgc

SEQ ID NO: 2009627 - DNA, 20 bp, Homo sapiens
tccacccaggctgcactgca

SEQ ID NO: 2009628 - DNA, 18 bp, Homo sapiens
tccacccagtgctgccat

SEQ ID NO: 2009629 - DNA, 19 bp, Homo sapiens
tccacccagtgctgccatg

SEQ ID NO: 2009630 - DNA, 21 bp, Homo sapiens
tccacccagtgctgccatgcc

SEQ ID NO: 2009631 - DNA, 22 bp, Homo sapiens
tccacccatcctaccaatgcat

SEQ ID NO: 2009632 - DNA, 20 bp, Homo sapiens
tccacccccgccacggccac

SEQ ID NO: 2009633 - DNA, 22 bp, Homo sapiens
tccacccccgccacggccaccc

SEQ ID NO: 2009634 - DNA, 15 bp, Homo sapiens
tccaccccctccagc

SEQ ID NO: 2009635 - DNA, 19 bp, Homo sapiens
tccaccccctccagctcca

SEQ ID NO: 2009636 - DNA, 23 bp, Homo sapiens
tccaccctcaaatgtcagagcta

SEQ ID NO: 2009637 - DNA, 15 bp, Homo sapiens
tccaccctgagcctg

SEQ ID NO: 2009638 - DNA, 12 bp, Homo sapiens
tccaccctgctc

SEQ ID NO: 2009639 - DNA, 13 bp, Homo sapiens
tccaccctgctct

SEQ ID NO: 2009640 - DNA, 14 bp, Homo sapiens
tccaccgctgccta

SEQ ID NO: 2009641 - DNA, 15 bp, Homo sapiens
tccaccgctgcctaa

SEQ ID NO: 2009642 - DNA, 11 bp, Homo sapiens
tccacctcagc

SEQ ID NO: 2009643 - DNA, 20 bp, Homo sapiens
tccacctcctagaggtgggc

SEQ ID NO: 2009644 - DNA, 13 bp, Homo sapiens
tccacctgcctat

SEQ ID NO: 2009645 - DNA, 12 bp, Homo sapiens
tccacctgcttt

SEQ ID NO: 2009646 - DNA, 19 bp, Homo sapiens
tccacctgctttctcctgg

SEQ ID NO: 2009647 - DNA, 17 bp, Homo sapiens
tccacctggccccatgt

SEQ ID NO: 2009648 - DNA, 16 bp, Homo sapiens
tccaccttcccatgcc

SEQ ID NO: 2009649 - DNA, 19 bp, Homo sapiens
tccaccttcccatgccctg

SEQ ID NO: 2009650 - DNA, 13 bp, Homo sapiens
tccaccttgctct

SEQ ID NO: 2009651 - DNA, 21 bp, Homo sapiens
tccaccttgctcttctttctg

SEQ ID NO: 2009652 - DNA, 15 bp, Homo sapiens
tccacgcctcctggc

SEQ ID NO: 2009653 - DNA, 17 bp, Homo sapiens
tccacgcctcctggcca

SEQ ID NO: 2009654 - DNA, 18 bp, Homo sapiens
tccacgtccccctggggc

SEQ ID NO: 2009655 - DNA, 20 bp, Homo sapiens
tccactaaatgagctcctgc

SEQ ID NO: 2009656 - DNA, 12 bp, Homo sapiens
tccactcactcc

SEQ ID NO: 2009657 - DNA, 14 bp, Homo sapiens
tccactcactccag

SEQ ID NO: 2009658 - DNA, 17 bp, Homo sapiens
tccactccacctccacc

SEQ ID NO: 2009659 - DNA, 16 bp, Homo sapiens
tccactccatatttat

SEQ ID NO: 2009660 - DNA, 15 bp, Homo sapiens
tccactctcaggagg

SEQ ID NO: 2009661 - DNA, 18 bp, Homo sapiens
tccactgccaaaacaatg

SEQ ID NO: 2009662 - DNA, 13 bp, Homo sapiens
tccactgccttcg

SEQ ID NO: 2009663 - DNA, 14 bp, Homo sapiens
tccactgctctcag

SEQ ID NO: 2009664 - DNA, 12 bp, Homo sapiens
tccactggactt

SEQ ID NO: 2009665 - DNA, 16 bp, Homo sapiens
tccactggacttgagc

SEQ ID NO: 2009666 - DNA, 17 bp, Homo sapiens
tccactgtcaccctcca

SEQ ID NO: 2009667 - DNA, 12 bp, Homo sapiens
tccactgtgcag

SEQ ID NO: 2009668 - DNA, 14 bp, Homo sapiens
tccacttctctaga

SEQ ID NO: 2009669 - DNA, 20 bp, Homo sapiens
tccacttctctagagaacat

SEQ ID NO: 2009670 - DNA, 18 bp, Homo sapiens
tccactttcagtgaaagc

SEQ ID NO: 2009671 - DNA, 18 bp, Homo sapiens
tccagaaaaccccagcat

SEQ ID NO: 2009672 - DNA, 16 bp, Homo sapiens
tccagaaaatataaat

SEQ ID NO: 2009673 - DNA, 17 bp, Homo sapiens
tccagaaaatataaatg

SEQ ID NO: 2009674 - DNA, 23 bp, Homo sapiens
tccagaaaatataaatgcatgat

SEQ ID NO: 2009675 - DNA, 23 bp, Homo sapiens
tccagaaagaaggacacttgtat

SEQ ID NO: 2009676 - DNA, 17 bp, Homo sapiens
tccagaagaatattcag

SEQ ID NO: 2009677 - DNA, 18 bp, Homo sapiens
tccagaagaatattcagg

SEQ ID NO: 2009678 - DNA, 14 bp, Homo sapiens
tccagaagtggggc

SEQ ID NO: 2009679 - DNA, 23 bp, Homo sapiens
tccagaagtggggctctgggagg

SEQ ID NO: 2009680 - DNA, 22 bp, Homo sapiens
tccagaataaaacgcaaagggc

SEQ ID NO: 2009681 - DNA, 18 bp, Homo sapiens
tccagaatggtctttcta

SEQ ID NO: 2009682 - DNA, 17 bp, Homo sapiens
tccagaccacctgccag

SEQ ID NO: 2009683 - DNA, 15 bp, Homo sapiens
tccagacccctggct

SEQ ID NO: 2009684 - DNA, 16 bp, Homo sapiens
tccagacccctggctt

SEQ ID NO: 2009685 - DNA, 23 bp, Homo sapiens
tccagacccctggcttttcactg

SEQ ID NO: 2009686 - DNA, 14 bp, Homo sapiens
tccagacccggctg

SEQ ID NO: 2009687 - DNA, 22 bp, Homo sapiens
tccagaccctgaagatttcaga

SEQ ID NO: 2009688 - DNA, 13 bp, Homo sapiens
tccagaccctgcc

SEQ ID NO: 2009689 - DNA, 15 bp, Homo sapiens
tccagaccctgcctg

SEQ ID NO: 2009690 - DNA, 17 bp, Homo sapiens
tccagaccctgcctgag

SEQ ID NO: 2009691 - DNA, 16 bp, Homo sapiens
tccagacctgaagaat

SEQ ID NO: 2009692 - DNA, 12 bp, Homo sapiens
tccagagacagg

SEQ ID NO: 2009693 - DNA, 15 bp, Homo sapiens
tccagagagtggctc

SEQ ID NO: 2009694 - DNA, 19 bp, Homo sapiens
tccagagagtggctcctcc

SEQ ID NO: 2009695 - DNA, 22 bp, Homo sapiens
tccagagagtggctcctcccgg

SEQ ID NO: 2009696 - DNA, 17 bp, Homo sapiens
tccagagggacagggtg

SEQ ID NO: 2009697 - DNA, 15 bp, Homo sapiens
tccagagtctgagcc

SEQ ID NO: 2009698 - DNA, 16 bp, Homo sapiens
tccagagtctgagccc

SEQ ID NO: 2009699 - DNA, 18 bp, Homo sapiens
tccagagtgtgcagactg

SEQ ID NO: 2009700 - DNA, 15 bp, Homo sapiens
tccagatgccttcct

SEQ ID NO: 2009701 - DNA, 19 bp, Homo sapiens
tccagatgccttcctgtct

SEQ ID NO: 2009702 - DNA, 20 bp, Homo sapiens
tccccgtgccccgcctcccc

SEQ ID NO: 2009703 - DNA, 17 bp, Homo sapiens
tcccctatccacccagc

SEQ ID NO: 2009704 - DNA, 18 bp, Homo sapiens
tcccctatccacccagcc

SEQ ID NO: 2009705 - DNA, 20 bp, Homo sapiens
tcccctatccacccagccca

SEQ ID NO: 2009706 - DNA, 14 bp, Homo sapiens
tcccctcactctgt

SEQ ID NO: 2009707 - DNA, 22 bp, Homo sapiens
tcccctcactctgtcagccagc

SEQ ID NO: 2009708 - DNA, 13 bp, Homo sapiens
tcccctcagagct

SEQ ID NO: 2009709 - DNA, 13 bp, Homo sapiens
tcccctcattcag

SEQ ID NO: 2009710 - DNA, 13 bp, Homo sapiens
tcccctcccccct

SEQ ID NO: 2009711 - DNA, 16 bp, Homo sapiens
tcccctccctcttcct

SEQ ID NO: 2009712 - DNA, 18 bp, Homo sapiens
tcccctccctcttccttc

SEQ ID NO: 2009713 - DNA, 20 bp, Homo sapiens
tcccctcgtcctgtcccaga

SEQ ID NO: 2009714 - DNA, 14 bp, Homo sapiens
tcccctgaaaaact

SEQ ID NO: 2009715 - DNA, 13 bp, Homo sapiens
tcccctgccaggg

SEQ ID NO: 2009716 - DNA, 23 bp, Homo sapiens
tcccctgcccccagaccttttat

SEQ ID NO: 2009717 - DNA, 12 bp, Homo sapiens
tcccctgcctgg

SEQ ID NO: 2009718 - DNA, 19 bp, Homo sapiens
tcccctgctactcctgtgc

SEQ ID NO: 2009719 - DNA, 21 bp, Homo sapiens
tcccctgggcatcttctggct

SEQ ID NO: 2009720 - DNA, 14 bp, Homo sapiens
tcccctgggcctgg

SEQ ID NO: 2009721 - DNA, 20 bp, Homo sapiens
tcccctgtcccaccaactct

SEQ ID NO: 2009722 - DNA, 15 bp, Homo sapiens
tcccctgttcactct

SEQ ID NO: 2009723 - DNA, 16 bp, Homo sapiens
tccccttcctgcaccc

SEQ ID NO: 2009724 - DNA, 17 bp, Homo sapiens
tccccttcctgcacccg

SEQ ID NO: 2009725 - DNA, 17 bp, Homo sapiens
tccccttgcccagggct

SEQ ID NO: 2009726 - DNA, 24 bp, Homo sapiens
tccccttgcccagggctcagcctg

SEQ ID NO: 2009727 - DNA, 21 bp, Homo sapiens
tccccttgcccttgccctgac

SEQ ID NO: 2009728 - DNA, 13 bp, Homo sapiens
tcccctttcctcc

SEQ ID NO: 2009729 - DNA, 15 bp, Homo sapiens
tccccttttgcctgg

SEQ ID NO: 2009730 - DNA, 19 bp, Homo sapiens
tccccttttgcctggctgt

SEQ ID NO: 2009731 - DNA, 24 bp, Homo sapiens
tccccttttgcctggctgtggagg

SEQ ID NO: 2009732 - DNA, 21 bp, Homo sapiens
tcccgagctactctcttgcca

SEQ ID NO: 2009733 - DNA, 16 bp, Homo sapiens
tcccgagtagctggga

SEQ ID NO: 2009734 - DNA, 18 bp, Homo sapiens
tcccgagtagctgggact

SEQ ID NO: 2009735 - DNA, 13 bp, Homo sapiens
tcccgcaccaggc

SEQ ID NO: 2009736 - DNA, 18 bp, Homo sapiens
tcccgcaccaggccgggc

SEQ ID NO: 2009737 - DNA, 21 bp, Homo sapiens
tcccggactgcaagcagggct

SEQ ID NO: 2009738 - DNA, 14 bp, Homo sapiens
tcccggagcacagc

SEQ ID NO: 2009739 - DNA, 15 bp, Homo sapiens
tcccggagcacagcc

SEQ ID NO: 2009740 - DNA, 22 bp, Homo sapiens
tcccggagcacagccctgggag

SEQ ID NO: 2009741 - DNA, 13 bp, Homo sapiens
tcccggctgcctg

SEQ ID NO: 2009742 - DNA, 14 bp, Homo sapiens
tcccggctgcctgc

SEQ ID NO: 2009743 - DNA, 16 bp, Homo sapiens
tcccggctgcctgccg

SEQ ID NO: 2009744 - DNA, 14 bp, Homo sapiens
tcccgggagaggag

SEQ ID NO: 2009745 - DNA, 17 bp, Homo sapiens
tcccgggggcactgcct

SEQ ID NO: 2009746 - DNA, 19 bp, Homo sapiens
tcccgtgaaagaattattt

SEQ ID NO: 2009747 - DNA, 19 bp, Homo sapiens
tccctaaaataaaaaccag

SEQ ID NO: 2009748 - DNA, 17 bp, Homo sapiens
tccctaacatcatgcat

SEQ ID NO: 2009749 - DNA, 14 bp, Homo sapiens
tccctaactctcgg

SEQ ID NO: 2009750 - DNA, 18 bp, Homo sapiens
tccctaagaaaccccagg

SEQ ID NO: 2009751 - DNA, 18 bp, Homo sapiens
tccctaaggaatctgaaa

SEQ ID NO: 2009752 - DNA, 15 bp, Homo sapiens
tccctaatcctccaa

SEQ ID NO: 2009753 - DNA, 13 bp, Homo sapiens
tccctacccactc

SEQ ID NO: 2009754 - DNA, 18 bp, Homo sapiens
tccctacccactctttgc

SEQ ID NO: 2009755 - DNA, 17 bp, Homo sapiens
tccctacttcctgtgac

SEQ ID NO: 2009756 - DNA, 19 bp, Homo sapiens
tccctacttttcaagagtg

SEQ ID NO: 2009757 - DNA, 16 bp, Homo sapiens
tccctagatctttcta

SEQ ID NO: 2009758 - DNA, 13 bp, Homo sapiens
tccctagcagtga

SEQ ID NO: 2009759 - DNA, 18 bp, Homo sapiens
tccctagcctgcttttgt

SEQ ID NO: 2009760 - DNA, 15 bp, Homo sapiens
tccctaggagaccaa

SEQ ID NO: 2009761 - DNA, 14 bp, Homo sapiens
tccctatcaaaaca

SEQ ID NO: 2009762 - DNA, 16 bp, Homo sapiens
tccctcaaccccacca

SEQ ID NO: 2009763 - DNA, 18 bp, Homo sapiens
tccctcacccccaggtgt

SEQ ID NO: 2009764 - DNA, 15 bp, Homo sapiens
tccctcaccccctcc

SEQ ID NO: 2009765 - DNA, 17 bp, Homo sapiens
tccctcaccccctccca

SEQ ID NO: 2009766 - DNA, 18 bp, Homo sapiens
tccctcactgccttccag

SEQ ID NO: 2009767 - DNA, 13 bp, Homo sapiens
tccctccacccca

SEQ ID NO: 2009768 - DNA, 15 bp, Homo sapiens
tccctccaccccagg

SEQ ID NO: 2009769 - DNA, 17 bp, Homo sapiens
tccctccaccccaggac

SEQ ID NO: 2009770 - DNA, 18 bp, Homo sapiens
tccctccaccccaggacg

SEQ ID NO: 2009771 - DNA, 14 bp, Homo sapiens
tccctccagctgga

SEQ ID NO: 2009772 - DNA, 22 bp, Homo sapiens
tccctccagggaatccgcctgc

SEQ ID NO: 2009773 - DNA, 15 bp, Homo sapiens
tccctccccagctcc

SEQ ID NO: 2009774 - DNA, 14 bp, Homo sapiens
tccctcctcccaca

SEQ ID NO: 2009775 - DNA, 19 bp, Homo sapiens
tccctcctcccacagcctg

SEQ ID NO: 2009776 - DNA, 13 bp, Homo sapiens
tccctcctggagc

SEQ ID NO: 2009777 - DNA, 17 bp, Homo sapiens
tccctccttcccttctc

SEQ ID NO: 2009778 - DNA, 14 bp, Homo sapiens
tccctcggaagccg

SEQ ID NO: 2009779 - DNA, 16 bp, Homo sapiens
tccctcggacccacca

SEQ ID NO: 2009780 - DNA, 19 bp, Homo sapiens
tccctcgtccacaggggca

SEQ ID NO: 2009781 - DNA, 13 bp, Homo sapiens
tccctctcccagg

SEQ ID NO: 2009782 - DNA, 17 bp, Homo sapiens
tccctctcccaggcccc

SEQ ID NO: 2009783 - DNA, 20 bp, Homo sapiens
tccctctcccaggccccatg

SEQ ID NO: 2009784 - DNA, 22 bp, Homo sapiens
tccctctcggaaggctggctgg

SEQ ID NO: 2009785 - DNA, 18 bp, Homo sapiens
tccctctgacctgcaggc

SEQ ID NO: 2009786 - DNA, 22 bp, Homo sapiens
tccctctgagaattccaaggag

SEQ ID NO: 2009787 - DNA, 13 bp, Homo sapiens
tccctctgcccca

SEQ ID NO: 2009788 - DNA, 19 bp, Homo sapiens
tccctctgccccaagcagc

SEQ ID NO: 2009789 - DNA, 23 bp, Homo sapiens
tccctctgccccaagcagccagc

SEQ ID NO: 2009790 - DNA, 19 bp, Homo sapiens
tccctctggcactccagaa

SEQ ID NO: 2009791 - DNA, 19 bp, Homo sapiens
tccctctggccctgccttc

SEQ ID NO: 2009792 - DNA, 20 bp, Homo sapiens
tccctctggccctgccttct

SEQ ID NO: 2009793 - DNA, 17 bp, Homo sapiens
tccctctttgcctgtgt

SEQ ID NO: 2009794 - DNA, 15 bp, Homo sapiens
tccctgaaaacccag

SEQ ID NO: 2009795 - DNA, 18 bp, Homo sapiens
tccctgaaaacccagaga

SEQ ID NO: 2009796 - DNA, 20 bp, Homo sapiens
tccctgaaaacccagagagg

SEQ ID NO: 2009797 - DNA, 19 bp, Homo sapiens
tccctgaacatctgtgtgt

SEQ ID NO: 2009798 - DNA, 15 bp, Homo sapiens
tccctgaacctcagt

SEQ ID NO: 2009799 - DNA, 19 bp, Homo sapiens
tccctgactccctgtgggg

SEQ ID NO: 2009800 - DNA, 17 bp, Homo sapiens
tccctgactctctgtga

SEQ ID NO: 2009801 - DNA, 20 bp, Homo sapiens
tccctgactctctgtgacct

SEQ ID NO: 2009802 - DNA, 21 bp, Homo sapiens
tccctgagaaacccaccagcc

SEQ ID NO: 2009803 - DNA, 22 bp, Homo sapiens
tccctgagaaacccaccagcct

SEQ ID NO: 2009804 - DNA, 21 bp, Homo sapiens
tccctgagtcaccaggaatgt

SEQ ID NO: 2009805 - DNA, 21 bp, Homo sapiens
tccctgataacaacctggaga

SEQ ID NO: 2009806 - DNA, 11 bp, Homo sapiens
tccctgcaccc

SEQ ID NO: 2009807 - DNA, 15 bp, Homo sapiens
tccctgcaccctgga

SEQ ID NO: 2009808 - DNA, 23 bp, Homo sapiens
  misc_feature (14)..(14): n is a, c, g or t
tccctgcacctgcnttgtccctg

SEQ ID NO: 2009809 - DNA, 13 bp, Homo sapiens
tccctgcacttgc

SEQ ID NO: 2009810 - DNA, 20 bp, Homo sapiens
tccctgcacttgcagactct

SEQ ID NO: 2009811 - DNA, 21 bp, Homo sapiens
tccctgccacactcagtcccc

SEQ ID NO: 2009812 - DNA, 23 bp, Homo sapiens
tccctgccacactcagtccccca

SEQ ID NO: 2009813 - DNA, 23 bp, Homo sapiens
tccctgcccagaattcccagctg

SEQ ID NO: 2009814 - DNA, 17 bp, Homo sapiens
tccctgccctgtcctcc

SEQ ID NO: 2009815 - DNA, 20 bp, Homo sapiens
tccctggcatgaccatcctg

SEQ ID NO: 2009816 - DNA, 22 bp, Homo sapiens
tccctggcatgaccatcctgtc

SEQ ID NO: 2009817 - DNA, 22 bp, Homo sapiens
tcctgttaggtattagaaagtg

SEQ ID NO: 2009818 - DNA, 13 bp, Homo sapiens
tcctgttccctac

SEQ ID NO: 2009819 - DNA, 19 bp, Homo sapiens
tcctgttgttgttaatgaa

SEQ ID NO: 2009820 - DNA, 23 bp, Homo sapiens
tccttaaaggcaccatctaatag

SEQ ID NO: 2009821 - DNA, 19 bp, Homo sapiens
tccttaattcactcccaca

SEQ ID NO: 2009822 - DNA, 17 bp, Homo sapiens
tccttactcctgtggga

SEQ ID NO: 2009823 - DNA, 20 bp, Homo sapiens
tccttactcctgtgggagcc

SEQ ID NO: 2009824 - DNA, 16 bp, Homo sapiens
tccttactctgagccc

SEQ ID NO: 2009825 - DNA, 22 bp, Homo sapiens
tccttactctgagcccaggccg

SEQ ID NO: 2009826 - DNA, 13 bp, Homo sapiens
tccttataagaat

SEQ ID NO: 2009827 - DNA, 14 bp, Homo sapiens
tccttataagaatt

SEQ ID NO: 2009828 - DNA, 23 bp, Homo sapiens
tccttatgtttgaagagaaacct

SEQ ID NO: 2009829 - DNA, 15 bp, Homo sapiens
tccttatttatatat

SEQ ID NO: 2009830 - DNA, 18 bp, Homo sapiens
tccttcaacaattctaaa

SEQ ID NO: 2009831 - DNA, 20 bp, Homo sapiens
tccttcaacaattctaaaat

SEQ ID NO: 2009832 - DNA, 20 bp, Homo sapiens
tccttcaagaactctgggct

SEQ ID NO: 2009833 - DNA, 15 bp, Homo sapiens
tccttcaccagagcc

SEQ ID NO: 2009834 - DNA, 20 bp, Homo sapiens
tccttcaccagagcccatgc

SEQ ID NO: 2009835 - DNA, 16 bp, Homo sapiens
tccttccagctagtga

SEQ ID NO: 2009836 - DNA, 17 bp, Homo sapiens
tccttcccctttcccca

SEQ ID NO: 2009837 - DNA, 12 bp, Homo sapiens
tccttccctggc

SEQ ID NO: 2009838 - DNA, 15 bp, Homo sapiens
tccttccctggcttg

SEQ ID NO: 2009839 - DNA, 18 bp, Homo sapiens
tccttcccttctctcctt

SEQ ID NO: 2009840 - DNA, 21 bp, Homo sapiens
tccttcccttctctccttccc

SEQ ID NO: 2009841 - DNA, 18 bp, Homo sapiens
tccttccgctcctttacc

SEQ ID NO: 2009842 - DNA, 22 bp, Homo sapiens
tccttcctacacccttggactt

SEQ ID NO: 2009843 - DNA, 23 bp, Homo sapiens
tccttcctacacccttggacttg

SEQ ID NO: 2009844 - DNA, 18 bp, Homo sapiens
tccttcctcagtcctgga

SEQ ID NO: 2009845 - DNA, 14 bp, Homo sapiens
tccttcctctcaag

SEQ ID NO: 2009846 - DNA, 12 bp, Homo sapiens
tccttcctgccc

SEQ ID NO: 2009847 - DNA, 19 bp, Homo sapiens
tccttccttgctgtcctag

SEQ ID NO: 2009848 - DNA, 15 bp, Homo sapiens
tccttctgccttttt

SEQ ID NO: 2009849 - DNA, 19 bp, Homo sapiens
tccttctgtcctactctgt

SEQ ID NO: 2009850 - DNA, 13 bp, Homo sapiens
tccttcttccctg

SEQ ID NO: 2009851 - DNA, 12 bp, Homo sapiens
tccttctttctc

SEQ ID NO: 2009852 - DNA, 16 bp, Homo sapiens
tccttgatctgtatat

SEQ ID NO: 2009853 - DNA, 22 bp, Homo sapiens
tccttgatctgtatatacaata

SEQ ID NO: 2009854 - DNA, 24 bp, Homo sapiens
tccttgcacccctcactctggcct

SEQ ID NO: 2009855 - DNA, 14 bp, Homo sapiens
tccttgcacctgca

SEQ ID NO: 2009856 - DNA, 17 bp, Homo sapiens
tccttgcatcaattttt

SEQ ID NO: 2009857 - DNA, 14 bp, Homo sapiens
tccttgctctgcag

SEQ ID NO: 2009858 - DNA, 21 bp, Homo sapiens
tccttgctgtcctaggccaca

SEQ ID NO: 2009859 - DNA, 13 bp, Homo sapiens
tccttggaggcca

SEQ ID NO: 2009860 - DNA, 15 bp, Homo sapiens
tccttgggctcctgg

SEQ ID NO: 2009861 - DNA, 16 bp, Homo sapiens
tccttgggctcctggc

SEQ ID NO: 2009862 - DNA, 18 bp, Homo sapiens
tccttgggctcctggctg

SEQ ID NO: 2009863 - DNA, 23 bp, Homo sapiens
tccttgggctcctggctgccagg

SEQ ID NO: 2009864 - DNA, 14 bp, Homo sapiens
tccttgggtcctgc

SEQ ID NO: 2009865 - DNA, 16 bp, Homo sapiens
tccttggtctgctggt

SEQ ID NO: 2009866 - DNA, 15 bp, Homo sapiens
tccttgtatttaaat

SEQ ID NO: 2009867 - DNA, 17 bp, Homo sapiens
tccttgtggtttatgtc

SEQ ID NO: 2009868 - DNA, 15 bp, Homo sapiens
tccttgttttaagat

SEQ ID NO: 2009869 - DNA, 22 bp, Homo sapiens
tccttgttttaagattgtaatt

SEQ ID NO: 2009870 - DNA, 19 bp, Homo sapiens
tcctttagcgcccagttgg

SEQ ID NO: 2009871 - DNA, 23 bp, Homo sapiens
tcctttagcgcccagttgggtgg

SEQ ID NO: 2009872 - DNA, 15 bp, Homo sapiens
tcctttattgcagtt

SEQ ID NO: 2009873 - DNA, 16 bp, Homo sapiens
tcctttcacaaccttc

SEQ ID NO: 2009874 - DNA, 18 bp, Homo sapiens
tcctttcacaaccttctg

SEQ ID NO: 2009875 - DNA, 18 bp, Homo sapiens
tcctttcatccccacctt

SEQ ID NO: 2009876 - DNA, 11 bp, Homo sapiens
tcctttctatc

SEQ ID NO: 2009877 - DNA, 15 bp, Homo sapiens
tcctttctattgaaa

SEQ ID NO: 2009878 - DNA, 16 bp, Homo sapiens
tcctttctccagccag

SEQ ID NO: 2009879 - DNA, 22 bp, Homo sapiens
tcctttctctatcccaagccaa

SEQ ID NO: 2009880 - DNA, 14 bp, Homo sapiens
tcctttgagaaaga

SEQ ID NO: 2009881 - DNA, 15 bp, Homo sapiens
tcctttgcactgagg

SEQ ID NO: 2009882 - DNA, 17 bp, Homo sapiens
tcctttgcattccatga

SEQ ID NO: 2009883 - DNA, 23 bp, Homo sapiens
tcctttgcctaggaggccttctc

SEQ ID NO: 2009884 - DNA, 22 bp, Homo sapiens
tcctttgttattatcctgcatt

SEQ ID NO: 2009885 - DNA, 16 bp, Homo sapiens
tcctttgttcttacct

SEQ ID NO: 2009886 - DNA, 24 bp, Homo sapiens
tcctttgttcttacctgtatgtct

SEQ ID NO: 2009887 - DNA, 13 bp, Homo sapiens
tccttttcttcct

SEQ ID NO: 2009888 - DNA, 18 bp, Homo sapiens
tccttttcttccttcttt

SEQ ID NO: 2009889 - DNA, 21 bp, Homo sapiens
tccttttcttccttctttctc

SEQ ID NO: 2009890 - DNA, 22 bp, Homo sapiens
tcctttttgcagtatatttctg

SEQ ID NO: 2009891 - DNA, 14 bp, Homo sapiens
tccttttttaaaag

SEQ ID NO: 2009892 - DNA, 15 bp, Homo sapiens
tcgaaaattcatttc

SEQ ID NO: 2009893 - DNA, 20 bp, Homo sapiens
tcgaaacctgtccataaagt

SEQ ID NO: 2009894 - DNA, 21 bp, Homo sapiens
tcgaaacctgtccataaagta

SEQ ID NO: 2009895 - DNA, 13 bp, Homo sapiens
tcgaaccaaggca

SEQ ID NO: 2009896 - DNA, 17 bp, Homo sapiens
tcgaaccaaggcagcct

SEQ ID NO: 2009897 - DNA, 21 bp, Homo sapiens
tcgaaccaaggcagcctccag

SEQ ID NO: 2009898 - DNA, 14 bp, Homo sapiens
tcgaatgacactgt

SEQ ID NO: 2009899 - DNA, 16 bp, Homo sapiens
tcgaccctttctctga

SEQ ID NO: 2009900 - DNA, 18 bp, Homo sapiens
tcgacgccccgaacctca

SEQ ID NO: 2009901 - DNA, 14 bp, Homo sapiens
tcgagacacttgcc

SEQ ID NO: 2009902 - DNA, 13 bp, Homo sapiens
tcgagaccagcct

SEQ ID NO: 2009903 - DNA, 16 bp, Homo sapiens
tcgagaccagcctggc

SEQ ID NO: 2009904 - DNA, 14 bp, Homo sapiens
tcgagcagggtgct

SEQ ID NO: 2009905 - DNA, 15 bp, Homo sapiens
tcgagccactgcact

SEQ ID NO: 2009906 - DNA, 14 bp, Homo sapiens
tcgagcgccctgca

SEQ ID NO: 2009907 - DNA, 18 bp, Homo sapiens
tcgagcgccctgcagacc

SEQ ID NO: 2009908 - DNA, 23 bp, Homo sapiens
tcgaggacaagtgagagagcaag

SEQ ID NO: 2009909 - DNA, 13 bp, Homo sapiens
tcgaggacaggga

SEQ ID NO: 2009910 - DNA, 14 bp, Homo sapiens
tcgaggacagggag

SEQ ID NO: 2009911 - DNA, 21 bp, Homo sapiens
tcgaggcaccggcgctgcagg

SEQ ID NO: 2009912 - DNA, 23 bp, Homo sapiens
tcgaggggtcctcacctggttga

SEQ ID NO: 2009913 - DNA, 15 bp, Homo sapiens
tcgaggtgtcaccct

SEQ ID NO: 2009914 - DNA, 14 bp, Homo sapiens
tcgagtcaaaatgt

SEQ ID NO: 2009915 - DNA, 16 bp, Homo sapiens
tcgagtctacctcttc

SEQ ID NO: 2009916 - DNA, 22 bp, Homo sapiens
tcgagttctcctatcttctcca

SEQ ID NO: 2009917 - DNA, 13 bp, Homo sapiens
tcgatcctggatt

SEQ ID NO: 2009918 - DNA, 16 bp, Homo sapiens
tcgatctgtactgtaa

SEQ ID NO: 2009919 - DNA, 19 bp, Homo sapiens
tcgatctgtactgtaattt

SEQ ID NO: 2009920 - DNA, 23 bp, Homo sapiens
tcgatgaagcccaataaacctct

SEQ ID NO: 2009921 - DNA, 20 bp, Homo sapiens
tcgatgccactcctgcttct

SEQ ID NO: 2009922 - DNA, 18 bp, Homo sapiens
tcgattagactggacagc

SEQ ID NO: 2009923 - DNA, 20 bp, Homo sapiens
tcgattattccctgtacaat

SEQ ID NO: 2009924 - DNA, 20 bp, Homo sapiens
tcgcaacccgtgccaagtcc

SEQ ID NO: 2009925 - DNA, 21 bp, Homo sapiens
tcgcaccactgtgtatttaac

SEQ ID NO: 2009926 - DNA, 16 bp, Homo sapiens
tcgcaccttttatacc

SEQ ID NO: 2009927 - DNA, 16 bp, Homo sapiens
tcgcagcaggtgcaag

SEQ ID NO: 2009928 - DNA, 13 bp, Homo sapiens
tcgcagccaccct

SEQ ID NO: 2009929 - DNA, 14 bp, Homo sapiens
tcgcagccaccctg

SEQ ID NO: 2009930 - DNA, 20 bp, Homo sapiens
tcgcagcctggcggggcagg

SEQ ID NO: 2009931 - DNA, 21 bp, Homo sapiens
tcgcagcctggcggggcagga

SEQ ID NO: 2009932 - DNA, 17 bp, Homo sapiens
tctccgaccagacacct

SEQ ID NO: 2009933 - DNA, 18 bp, Homo sapiens
tctccggggtctgtgctg

SEQ ID NO: 2009934 - DNA, 19 bp, Homo sapiens
tctccggggtctgtgctgt

SEQ ID NO: 2009935 - DNA, 21 bp, Homo sapiens
tctccggggtctgtgctgtgc

SEQ ID NO: 2009936 - DNA, 23 bp, Homo sapiens
tctccggggtctgtgctgtgcct

SEQ ID NO: 2009937 - DNA, 19 bp, Homo sapiens
tctccgggtgtggcctcag

SEQ ID NO: 2009938 - DNA, 21 bp, Homo sapiens
tctccgggtgtggcctcagcc

SEQ ID NO: 2009939 - DNA, 23 bp, Homo sapiens
tctcctaaaacatgaaaattatc

SEQ ID NO: 2009940 - DNA, 17 bp, Homo sapiens
tctcctaccccacctca

SEQ ID NO: 2009941 - DNA, 16 bp, Homo sapiens
tctcctacctgctgct

SEQ ID NO: 2009942 - DNA, 17 bp, Homo sapiens
tctcctacctgctgctg

SEQ ID NO: 2009943 - DNA, 14 bp, Homo sapiens
tctcctagcccctg

SEQ ID NO: 2009944 - DNA, 15 bp, Homo sapiens
tctcctaggagaagc

SEQ ID NO: 2009945 - DNA, 21 bp, Homo sapiens
tctcctatcttctccattcta

SEQ ID NO: 2009946 - DNA, 20 bp, Homo sapiens
tctcctccattgctgttgtt

SEQ ID NO: 2009947 - DNA, 13 bp, Homo sapiens
tctcctccctgtt

SEQ ID NO: 2009948 - DNA, 23 bp, Homo sapiens
tctcctccctgttatctgctaga

SEQ ID NO: 2009949 - DNA, 12 bp, Homo sapiens
tctcctcttaaa

SEQ ID NO: 2009950 - DNA, 13 bp, Homo sapiens
tctcctcttgcca

SEQ ID NO: 2009951 - DNA, 16 bp, Homo sapiens
tctcctcttttatctt

SEQ ID NO: 2009952 - DNA, 17 bp, Homo sapiens
tctcctgaagttcagcc

SEQ ID NO: 2009953 - DNA, 16 bp, Homo sapiens
tctcctgacccagtcc

SEQ ID NO: 2009954 - DNA, 15 bp, Homo sapiens
tctcctgagaggtgc

SEQ ID NO: 2009955 - DNA, 16 bp, Homo sapiens
tctcctgagaggtgct

SEQ ID NO: 2009956 - DNA, 20 bp, Homo sapiens
tctcctgagaggtgctgcag

SEQ ID NO: 2009957 - DNA, 22 bp, Homo sapiens
tctcctgagaggtgctgcaggc

SEQ ID NO: 2009958 - DNA, 17 bp, Homo sapiens
tctcctgatttctctga

SEQ ID NO: 2009959 - DNA, 12 bp, Homo sapiens
tctcctgcctac

SEQ ID NO: 2009960 - DNA, 14 bp, Homo sapiens
tctcctgcctactc

SEQ ID NO: 2009961 - DNA, 17 bp, Homo sapiens
tctcctgcctcagcctc

SEQ ID NO: 2009962 - DNA, 22 bp, Homo sapiens
tctcctgcctgtagcagtgaga

SEQ ID NO: 2009963 - DNA, 22 bp, Homo sapiens
tctcctggcttcccatccccag

SEQ ID NO: 2009964 - DNA, 16 bp, Homo sapiens
tctcctggtctgtgct

SEQ ID NO: 2009965 - DNA, 16 bp, Homo sapiens
tctcctgtaattttgt

SEQ ID NO: 2009966 - DNA, 14 bp, Homo sapiens
tctcctgtccaacc

SEQ ID NO: 2009967 - DNA, 15 bp, Homo sapiens
tctcctgtgcccaca

SEQ ID NO: 2009968 - DNA, 18 bp, Homo sapiens
tctcctgtgcccacatcc

SEQ ID NO: 2009969 - DNA, 18 bp, Homo sapiens
tctccttcccctacacct

SEQ ID NO: 2009970 - DNA, 15 bp, Homo sapiens
tctccttccctcttt

SEQ ID NO: 2009971 - DNA, 17 bp, Homo sapiens
tctccttccctctttcc

SEQ ID NO: 2009972 - DNA, 11 bp, Homo sapiens
tctccttcctt

SEQ ID NO: 2009973 - DNA, 14 bp, Homo sapiens
tctccttccttacc

SEQ ID NO: 2009974 - DNA, 21 bp, Homo sapiens
tctccttgggctcctggctgc

SEQ ID NO: 2009975 - DNA, 23 bp, Homo sapiens
tctccttgggctcctggctgcca

SEQ ID NO: 2009976 - DNA, 13 bp, Homo sapiens
tctccttgttctg

SEQ ID NO: 2009977 - DNA, 14 bp, Homo sapiens
tctccttgttctga

SEQ ID NO: 2009978 - DNA, 14 bp, Homo sapiens
tctcctttcaggga

SEQ ID NO: 2009979 - DNA, 15 bp, Homo sapiens
tctcctttctttcta

SEQ ID NO: 2009980 - DNA, 13 bp, Homo sapiens
tctcgagcccaga

SEQ ID NO: 2009981 - DNA, 18 bp, Homo sapiens
tctcgagcccagatggaa

SEQ ID NO: 2009982 - DNA, 18 bp, Homo sapiens
tctcgagcgccctgcaga

SEQ ID NO: 2009983 - DNA, 19 bp, Homo sapiens
tctcgagcgccctgcagac

SEQ ID NO: 2009984 - DNA, 17 bp, Homo sapiens
tctcggaaggctggctg

SEQ ID NO: 2009985 - DNA, 21 bp, Homo sapiens
tctcggacctttcagctgtga

SEQ ID NO: 2009986 - DNA, 14 bp, Homo sapiens
tctcggggcccttg

SEQ ID NO: 2009987 - DNA, 22 bp, Homo sapiens
tctcggggcccttggggcctgg

SEQ ID NO: 2009988 - DNA, 15 bp, Homo sapiens
tctcgtatttaatat

SEQ ID NO: 2009989 - DNA, 12 bp, Homo sapiens
tctcgtctcctg

SEQ ID NO: 2009990 - DNA, 19 bp, Homo sapiens
tctcgtggtagaagccagt

SEQ ID NO: 2009991 - DNA, 16 bp, Homo sapiens
tctctaaaaataaaat

SEQ ID NO: 2009992 - DNA, 20 bp, Homo sapiens
tctctaaactgctgttaatt

SEQ ID NO: 2009993 - DNA, 18 bp, Homo sapiens
tctctaaatcaagtattt

SEQ ID NO: 2009994 - DNA, 19 bp, Homo sapiens
tctctaaatcttccttgtg

SEQ ID NO: 2009995 - DNA, 16 bp, Homo sapiens
tctctaagccacagct

SEQ ID NO: 2009996 - DNA, 21 bp, Homo sapiens
tctctaagccacagcttcttc

SEQ ID NO: 2009997 - DNA, 22 bp, Homo sapiens
tctctaagtttagaagcgctca

SEQ ID NO: 2009998 - DNA, 11 bp, Homo sapiens
tctctaatatg

SEQ ID NO: 2009999 - DNA, 16 bp, Homo sapiens
tctctaccccaaagaa

SEQ ID NO: 2010000 - DNA, 19 bp, Homo sapiens
tctctacccggcccagaga

SEQ ID NO: 2010001 - DNA, 17 bp, Homo sapiens
tctctagaattttaagt

SEQ ID NO: 2010002 - DNA, 12 bp, Homo sapiens
tctctagagaac

SEQ ID NO: 2010003 - DNA, 13 bp, Homo sapiens
tctctagagaaca

SEQ ID NO: 2010004 - DNA, 12 bp, Homo sapiens
tctctagccact

SEQ ID NO: 2010005 - DNA, 16 bp, Homo sapiens
tctctaggctgttttc

SEQ ID NO: 2010006 - DNA, 15 bp, Homo sapiens
tctctatatatacat

SEQ ID NO: 2010007 - DNA, 19 bp, Homo sapiens
tctctatatatacatgtat

SEQ ID NO: 2010008 - DNA, 21 bp, Homo sapiens
tctctatatatacatgtatag

SEQ ID NO: 2010009 - DNA, 14 bp, Homo sapiens
tctctatttaatat

SEQ ID NO: 2010010 - DNA, 15 bp, Homo sapiens
tctctatttaatatt

SEQ ID NO: 2010011 - DNA, 17 bp, Homo sapiens
tctctcatgaacctcaa

SEQ ID NO: 2010012 - DNA, 14 bp, Homo sapiens
tctctcattctctt

SEQ ID NO: 2010013 - DNA, 14 bp, Homo sapiens
tctctccaggaagt

SEQ ID NO: 2010014 - DNA, 14 bp, Homo sapiens
tctctcccaccccg

SEQ ID NO: 2010015 - DNA, 14 bp, Homo sapiens
tctctcctgtccaa

SEQ ID NO: 2010016 - DNA, 12 bp, Homo sapiens
tctctccttctg

SEQ ID NO: 2010017 - DNA, 15 bp, Homo sapiens
tctctcgggcccccc

SEQ ID NO: 2010018 - DNA, 16 bp, Homo sapiens
tctctcgggcccccca

SEQ ID NO: 2010019 - DNA, 18 bp, Homo sapiens
tctctcggggcgacccct

SEQ ID NO: 2010020 - DNA, 23 bp, Homo sapiens
tctctcggggcgacccctcagtg

SEQ ID NO: 2010021 - DNA, 14 bp, Homo sapiens
tctctctaaaaata

SEQ ID NO: 2010022 - DNA, 20 bp, Homo sapiens
tctctctaaaaataaaatga

SEQ ID NO: 2010023 - DNA, 21 bp, Homo sapiens
tctctctaagtttagaagcgc

SEQ ID NO: 2010024 - DNA, 20 bp, Homo sapiens
tctctctactcctacctcag

SEQ ID NO: 2010025 - DNA, 19 bp, Homo sapiens
tctctctatatatacatgt

SEQ ID NO: 2010026 - DNA, 11 bp, Homo sapiens
tctctctcctg

SEQ ID NO: 2010027 - DNA, 13 bp, Homo sapiens
tctctctctggtc

SEQ ID NO: 2010028 - DNA, 14 bp, Homo sapiens
tctctctctgtcct

SEQ ID NO: 2010029 - DNA, 19 bp, Homo sapiens
tctctctgcctatttattg

SEQ ID NO: 2010030 - DNA, 19 bp, Homo sapiens
tctctctggggccctgggc

SEQ ID NO: 2010031 - DNA, 19 bp, Homo sapiens
tctctgaagcatgtttcat

SEQ ID NO: 2010032 - DNA, 21 bp, Homo sapiens
tctctgaagcatgtttcatgt

SEQ ID NO: 2010033 - DNA, 17 bp, Homo sapiens
tctctgactcttgcctt

SEQ ID NO: 2010034 - DNA, 12 bp, Homo sapiens
tctctgagactg

SEQ ID NO: 2010035 - DNA, 17 bp, Homo sapiens
tctctgagatgcccctc

SEQ ID NO: 2010036 - DNA, 19 bp, Homo sapiens
tctctgattttcaaagctt

SEQ ID NO: 2010037 - DNA, 16 bp, Homo sapiens
tctctgcagccagccc

SEQ ID NO: 2010038 - DNA, 14 bp, Homo sapiens
tctctgctccagag

SEQ ID NO: 2010039 - DNA, 13 bp, Homo sapiens
tctctgctctagc

SEQ ID NO: 2010040 - DNA, 16 bp, Homo sapiens
tctctgctctagccag

SEQ ID NO: 2010041 - DNA, 18 bp, Homo sapiens
tctctgctctagccagga

SEQ ID NO: 2010042 - DNA, 14 bp, Homo sapiens
tctctgctcttgcc

SEQ ID NO: 2010043 - DNA, 16 bp, Homo sapiens
tctctgctcttgcctg

SEQ ID NO: 2010044 - DNA, 17 bp, Homo sapiens
tctctgctcttgcctgc

SEQ ID NO: 2010045 - DNA, 21 bp, Homo sapiens
tctctgctcttgcctgcaccc

SEQ ID NO: 2010046 - DNA, 13 bp, Homo sapiens
tctctgctgaagg

SEQ ID NO: 2010047 - DNA, 17 bp, Homo sapiens
tctctggcagagaagga

SEQ ID NO: 2010048 - DNA, 14 bp, Homo sapiens
tctttgaataaagt

SEQ ID NO: 2010049 - DNA, 17 bp, Homo sapiens
tctttgaataaagtctg

SEQ ID NO: 2010050 - DNA, 20 bp, Homo sapiens
tctttgaataaagtctgagt

SEQ ID NO: 2010051 - DNA, 14 bp, Homo sapiens
tctttgaatgcttt

SEQ ID NO: 2010052 - DNA, 15 bp, Homo sapiens
tctttgatccttctc

SEQ ID NO: 2010053 - DNA, 14 bp, Homo sapiens
tctttgcctgtgtg

SEQ ID NO: 2010054 - DNA, 16 bp, Homo sapiens
tctttgcctgtgtgag

SEQ ID NO: 2010055 - DNA, 18 bp, Homo sapiens
tctttgcctgtgtgagca

SEQ ID NO: 2010056 - DNA, 21 bp, Homo sapiens
tctttgcctgtgtgagcatct

SEQ ID NO: 2010057 - DNA, 16 bp, Homo sapiens
tctttgctacaataaa

SEQ ID NO: 2010058 - DNA, 17 bp, Homo sapiens
tctttgctacaataaat

SEQ ID NO: 2010059 - DNA, 19 bp, Homo sapiens
tctttgctacaataaatgc

SEQ ID NO: 2010060 - DNA, 20 bp, Homo sapiens
tctttgctacaataaatgct

SEQ ID NO: 2010061 - DNA, 21 bp, Homo sapiens
tctttgctacaataaatgctg

SEQ ID NO: 2010062 - DNA, 23 bp, Homo sapiens
tctttgctacaataaatgctgaa

SEQ ID NO: 2010063 - DNA, 14 bp, Homo sapiens
tctttggaatgaac

SEQ ID NO: 2010064 - DNA, 17 bp, Homo sapiens
tctttggaatgaacaat

SEQ ID NO: 2010065 - DNA, 19 bp, Homo sapiens
tctttgtaaaggtcagagt

SEQ ID NO: 2010066 - DNA, 17 bp, Homo sapiens
tctttgtaccatctgtc

SEQ ID NO: 2010067 - DNA, 14 bp, Homo sapiens
tctttgtgacagga

SEQ ID NO: 2010068 - DNA, 16 bp, Homo sapiens
tctttgtgacaggaaa

SEQ ID NO: 2010069 - DNA, 22 bp, Homo sapiens
tctttgtgacaggaaagccctc

SEQ ID NO: 2010070 - DNA, 13 bp, Homo sapiens
tctttgtgtagct

SEQ ID NO: 2010071 - DNA, 15 bp, Homo sapiens
tctttgtgtagcttt

SEQ ID NO: 2010072 - DNA, 18 bp, Homo sapiens
tctttgttggaaaagaat

SEQ ID NO: 2010073 - DNA, 22 bp, Homo sapiens
tcttttaaagaagtaaatttgt

SEQ ID NO: 2010074 - DNA, 23 bp, Homo sapiens
tcttttaaagaagtaaatttgtc

SEQ ID NO: 2010075 - DNA, 14 bp, Homo sapiens
tcttttactgtaat

SEQ ID NO: 2010076 - DNA, 15 bp, Homo sapiens
tcttttactgtaatt

SEQ ID NO: 2010077 - DNA, 22 bp, Homo sapiens
tcttttataactagtcctttac

SEQ ID NO: 2010078 - DNA, 20 bp, Homo sapiens
tcttttccactcctatggaa

SEQ ID NO: 2010079 - DNA, 13 bp, Homo sapiens
tcttttccctctc

SEQ ID NO: 2010080 - DNA, 17 bp, Homo sapiens
tcttttctctgtgcttc

SEQ ID NO: 2010081 - DNA, 15 bp, Homo sapiens
tcttttggccttgtg

SEQ ID NO: 2010082 - DNA, 21 bp, Homo sapiens
tctttttaaaaagttgcacat

SEQ ID NO: 2010083 - DNA, 22 bp, Homo sapiens
tctttttaaaaagttgcacatt

SEQ ID NO: 2010084 - DNA, 13 bp, Homo sapiens
tctttttctggaa

SEQ ID NO: 2010085 - DNA, 15 bp, Homo sapiens
tctttttctggaaat

SEQ ID NO: 2010086 - DNA, 19 bp, Homo sapiens
tcttttttaaatgaagaaa

SEQ ID NO: 2010087 - DNA, 21 bp, Homo sapiens
tcttttttcaactggctggga

SEQ ID NO: 2010088 - DNA, 15 bp, Homo sapiens
tctttttttaaattg

SEQ ID NO: 2010089 - DNA, 15 bp, Homo sapiens
tctttttttctttgg

SEQ ID NO: 2010090 - DNA, 16 bp, Homo sapiens
tctttttttgtgatgt

SEQ ID NO: 2010091 - DNA, 17 bp, Homo sapiens
tgaaaaaaagtttacaa

SEQ ID NO: 2010092 - DNA, 15 bp, Homo sapiens
tgaaaaaatgttcta

SEQ ID NO: 2010093 - DNA, 11 bp, Homo sapiens
tgaaaaacaag

SEQ ID NO: 2010094 - DNA, 21 bp, Homo sapiens
tgaaaaactgatcaaaaataa

SEQ ID NO: 2010095 - DNA, 13 bp, Homo sapiens
tgaaaaatctttt

SEQ ID NO: 2010096 - DNA, 19 bp, Homo sapiens
tgaaaacatggtagaattg

SEQ ID NO: 2010097 - DNA, 14 bp, Homo sapiens
tgaaaacccagaga

SEQ ID NO: 2010098 - DNA, 15 bp, Homo sapiens
tgaaaactattttaa

SEQ ID NO: 2010099 - DNA, 19 bp, Homo sapiens
tgaaaactcattacttttc

SEQ ID NO: 2010100 - DNA, 13 bp, Homo sapiens
tgaaaactggaat

SEQ ID NO: 2010101 - DNA, 21 bp, Homo sapiens
tgaaaactggaataagaagca

SEQ ID NO: 2010102 - DNA, 13 bp, Homo sapiens
tgaaaactgtaaa

SEQ ID NO: 2010103 - DNA, 17 bp, Homo sapiens
tgaaaactgtaaataca

SEQ ID NO: 2010104 - DNA, 15 bp, Homo sapiens
tgaaaagactccaaa

SEQ ID NO: 2010105 - DNA, 16 bp, Homo sapiens
tgaaaagactccaaag

SEQ ID NO: 2010106 - DNA, 17 bp, Homo sapiens
tgaaaagctagaattga

SEQ ID NO: 2010107 - DNA, 17 bp, Homo sapiens
tgaaaataaagtgtata

SEQ ID NO: 2010108 - DNA, 21 bp, Homo sapiens
tgaaaatatttgtatcacaaa

SEQ ID NO: 2010109 - DNA, 13 bp, Homo sapiens
tgaaaatcaaagt

SEQ ID NO: 2010110 - DNA, 14 bp, Homo sapiens
tgaaaatcaaagta

SEQ ID NO: 2010111 - DNA, 17 bp, Homo sapiens
tgaaaatcaaagtaaaa

SEQ ID NO: 2010112 - DNA, 21 bp, Homo sapiens
tgaaaatcatgaaaagaggaa

SEQ ID NO: 2010113 - DNA, 16 bp, Homo sapiens
tgaaaatcgtgacaac

SEQ ID NO: 2010114 - DNA, 17 bp, Homo sapiens
tgaaaatctaatattaa

SEQ ID NO: 2010115 - DNA, 18 bp, Homo sapiens
tgaaaatgcaacaacatg

SEQ ID NO: 2010116 - DNA, 20 bp, Homo sapiens
tgaaaatgcaacaacatgta

SEQ ID NO: 2010117 - DNA, 21 bp, Homo sapiens
tgaaaatgggttggtgcttct

SEQ ID NO: 2010118 - DNA, 14 bp, Homo sapiens
tgaaaatgtcaaag

SEQ ID NO: 2010119 - DNA, 15 bp, Homo sapiens
tgaaaatgtcagaaa

SEQ ID NO: 2010120 - DNA, 21 bp, Homo sapiens
tgaaaatgtcagaaaccagtt

SEQ ID NO: 2010121 - DNA, 14 bp, Homo sapiens
tgaaaattaacact

SEQ ID NO: 2010122 - DNA, 14 bp, Homo sapiens
tgaaaattatttaa

SEQ ID NO: 2010123 - DNA, 15 bp, Homo sapiens
tgaaaattattttaa

SEQ ID NO: 2010124 - DNA, 18 bp, Homo sapiens
tgaaaattattttaaaca

SEQ ID NO: 2010125 - DNA, 19 bp, Homo sapiens
tgaaaattattttaaacaa

SEQ ID NO: 2010126 - DNA, 21 bp, Homo sapiens
tgaaaattattttaaacaaaa

SEQ ID NO: 2010127 - DNA, 18 bp, Homo sapiens
tgaaaattcaaaaagtgt

SEQ ID NO: 2010128 - DNA, 23 bp, Homo sapiens
tgaaacaaagagttcaagaaata

SEQ ID NO: 2010129 - DNA, 22 bp, Homo sapiens
tgaaacaaataatcacattgac

SEQ ID NO: 2010130 - DNA, 20 bp, Homo sapiens
tgaaacaattattgtacact

SEQ ID NO: 2010131 - DNA, 23 bp, Homo sapiens
tgaaacaattattgtacactaac

SEQ ID NO: 2010132 - DNA, 16 bp, Homo sapiens
tgaaacacctcccagg

SEQ ID NO: 2010133 - DNA, 17 bp, Homo sapiens
tgaaacacctcccaggg

SEQ ID NO: 2010134 - DNA, 17 bp, Homo sapiens
tgaaacagatgataaat

SEQ ID NO: 2010135 - DNA, 19 bp, Homo sapiens
tgaaacagatgataaatat

SEQ ID NO: 2010136 - DNA, 21 bp, Homo sapiens
tgaaacattcacacagggctc

SEQ ID NO: 2010137 - DNA, 18 bp, Homo sapiens
tgaaacattccgaagagg

SEQ ID NO: 2010138 - DNA, 20 bp, Homo sapiens
tgaaaccacaggcccttggg

SEQ ID NO: 2010139 - DNA, 20 bp, Homo sapiens
tgaaacccattaggcatgcc

SEQ ID NO: 2010140 - DNA, 21 bp, Homo sapiens
tgaaacccattaggcatgcct

SEQ ID NO: 2010141 - DNA, 14 bp, Homo sapiens
tgaaaccctgtctc

SEQ ID NO: 2010142 - DNA, 16 bp, Homo sapiens
tgaaaccctgtctcta

SEQ ID NO: 2010143 - DNA, 16 bp, Homo sapiens
tgaaacctaaggcaac

SEQ ID NO: 2010144 - DNA, 19 bp, Homo sapiens
tgaaactcctgattttgta

SEQ ID NO: 2010145 - DNA, 22 bp, Homo sapiens
tgaaactgagatgtgaacacat

SEQ ID NO: 2010146 - DNA, 16 bp, Homo sapiens
tgaaagaattattttt

SEQ ID NO: 2010147 - DNA, 17 bp, Homo sapiens
tgaaagacagaatgtca

SEQ ID NO: 2010148 - DNA, 12 bp, Homo sapiens
tgaaagaccttc

SEQ ID NO: 2010149 - DNA, 17 bp, Homo sapiens
tgaaagaccttctccaa

SEQ ID NO: 2010150 - DNA, 15 bp, Homo sapiens
tgaaagatgcaagca

SEQ ID NO: 2010151 - DNA, 22 bp, Homo sapiens
tgaaagatggctgtgcctctgc

SEQ ID NO: 2010152 - DNA, 21 bp, Homo sapiens
tgaaagcacaggagacactgt

SEQ ID NO: 2010153 - DNA, 16 bp, Homo sapiens
tgaaagccaaatttat

SEQ ID NO: 2010154 - DNA, 17 bp, Homo sapiens
tgaaagccaaatttata

SEQ ID NO: 2010155 - DNA, 15 bp, Homo sapiens
tgaaagcctctggaa

SEQ ID NO: 2010156 - DNA, 15 bp, Homo sapiens
tgaaagggcccagag

SEQ ID NO: 2010157 - DNA, 17 bp, Homo sapiens
tgaaagggcccagagag

SEQ ID NO: 2010158 - DNA, 18 bp, Homo sapiens
tgaaagggcccagagagg

SEQ ID NO: 2010159 - DNA, 22 bp, Homo sapiens
tgaaagggctatggcaaggggg

SEQ ID NO: 2010160 - DNA, 14 bp, Homo sapiens
tgaaagtatgtgat

SEQ ID NO: 2010161 - DNA, 15 bp, Homo sapiens
tgaaagtcagatgcc

SEQ ID NO: 2010162 - DNA, 18 bp, Homo sapiens
tgaaagtcagatgcccag

SEQ ID NO: 2010163 - DNA, 12 bp, Homo sapiens
tgacctcccagc

SEQ ID NO: 2010164 - DNA, 16 bp, Homo sapiens
tgacctcccagcccta

SEQ ID NO: 2010165 - DNA, 13 bp, Homo sapiens
tgacctccctcta

SEQ ID NO: 2010166 - DNA, 18 bp, Homo sapiens
tgacctcgtgatccaccc

SEQ ID NO: 2010167 - DNA, 19 bp, Homo sapiens
tgacctgccccgcccagct

SEQ ID NO: 2010168 - DNA, 18 bp, Homo sapiens
tgacctgcctctcacaca

SEQ ID NO: 2010169 - DNA, 20 bp, Homo sapiens
tgacctgcctctcacacaca

SEQ ID NO: 2010170 - DNA, 21 bp, Homo sapiens
tgacctgcctctcacacacat

SEQ ID NO: 2010171 - DNA, 20 bp, Homo sapiens
tgacctgctgagctctgaga

SEQ ID NO: 2010172 - DNA, 21 bp, Homo sapiens
tgacctgctgggtaaactgtg

SEQ ID NO: 2010173 - DNA, 19 bp, Homo sapiens
tgacctgttagatgtgaca

SEQ ID NO: 2010174 - DNA, 20 bp, Homo sapiens
tgaccttttgacttaaagca

SEQ ID NO: 2010175 - DNA, 18 bp, Homo sapiens
tgacgattatttatttct

SEQ ID NO: 2010176 - DNA, 21 bp, Homo sapiens
tgacgccctgcgttggagcca

SEQ ID NO: 2010177 - DNA, 23 bp, Homo sapiens
tgacgccctgcgttggagccact

SEQ ID NO: 2010178 - DNA, 16 bp, Homo sapiens
tgacgggaggcctcag

SEQ ID NO: 2010179 - DNA, 19 bp, Homo sapiens
tgacggtcccacactggtg

SEQ ID NO: 2010180 - DNA, 19 bp, Homo sapiens
tgacgtcaagtctccttcc

SEQ ID NO: 2010181 - DNA, 23 bp, Homo sapiens
tgacgtcagtagtttgagaccag

SEQ ID NO: 2010182 - DNA, 23 bp, Homo sapiens
tgacgtgcacctgtactcaggag

SEQ ID NO: 2010183 - DNA, 21 bp, Homo sapiens
tgactataaacattaaaagaa

SEQ ID NO: 2010184 - DNA, 14 bp, Homo sapiens
tgactatatagaga

SEQ ID NO: 2010185 - DNA, 19 bp, Homo sapiens
tgactatatagagatgttt

SEQ ID NO: 2010186 - DNA, 18 bp, Homo sapiens
tgactatcacatacaatt

SEQ ID NO: 2010187 - DNA, 18 bp, Homo sapiens
tgactcaagtttttacaa

SEQ ID NO: 2010188 - DNA, 19 bp, Homo sapiens
tgactcaagtttttacaaa

SEQ ID NO: 2010189 - DNA, 20 bp, Homo sapiens
tgactcacaagaagaccaga

SEQ ID NO: 2010190 - DNA, 11 bp, Homo sapiens
tgactcaccca

SEQ ID NO: 2010191 - DNA, 21 bp, Homo sapiens
tgactcagcatacctgctggt

SEQ ID NO: 2010192 - DNA, 14 bp, Homo sapiens
tgactccagagtct

SEQ ID NO: 2010193 - DNA, 15 bp, Homo sapiens
tgactccagagtctg

SEQ ID NO: 2010194 - DNA, 20 bp, Homo sapiens
tgactccagcctgccctcag

SEQ ID NO: 2010195 - DNA, 18 bp, Homo sapiens
tgactccatgtgtgctgt

SEQ ID NO: 2010196 - DNA, 22 bp, Homo sapiens
tgactccatgtgtgctgtcctc

SEQ ID NO: 2010197 - DNA, 13 bp, Homo sapiens
tgactccctgtgg

SEQ ID NO: 2010198 - DNA, 23 bp, Homo sapiens
tgactccctgtgggggtggccat

SEQ ID NO: 2010199 - DNA, 14 bp, Homo sapiens
tgactccttgtggt

SEQ ID NO: 2010200 - DNA, 21 bp, Homo sapiens
tgactcgagggttgggttcat

SEQ ID NO: 2010201 - DNA, 21 bp, Homo sapiens
tgactcgcttagctgaaacct

SEQ ID NO: 2010202 - DNA, 15 bp, Homo sapiens
tgactcggtgtaaaa

SEQ ID NO: 2010203 - DNA, 15 bp, Homo sapiens
tgactcgtgctgcat

SEQ ID NO: 2010204 - DNA, 17 bp, Homo sapiens
tgactgacacaggccag

SEQ ID NO: 2010205 - DNA, 14 bp, Homo sapiens
tgactgatgacaaa

SEQ ID NO: 2010206 - DNA, 20 bp, Homo sapiens
tgactgccccaactcctgga

SEQ ID NO: 2010207 - DNA, 16 bp, Homo sapiens
tgactgcgatcttcag

SEQ ID NO: 2010208 - DNA, 17 bp, Homo sapiens
tgactgcgatcttcaga

SEQ ID NO: 2010209 - DNA, 15 bp, Homo sapiens
tgactgctgattctc

SEQ ID NO: 2010210 - DNA, 24 bp, Homo sapiens
tgactggcaggtgcagatgggctg

SEQ ID NO: 2010211 - DNA, 13 bp, Homo sapiens
tgactgtcactgt

SEQ ID NO: 2010212 - DNA, 22 bp, Homo sapiens
tgactgtcccaccgggagcctc

SEQ ID NO: 2010213 - DNA, 18 bp, Homo sapiens
tgactgtcgtgtttacaa

SEQ ID NO: 2010214 - DNA, 15 bp, Homo sapiens
tgactgtgttcagtg

SEQ ID NO: 2010215 - DNA, 17 bp, Homo sapiens
tgactgtgttcagtgcc

SEQ ID NO: 2010216 - DNA, 18 bp, Homo sapiens
tgactgtgttcagtgcct

SEQ ID NO: 2010217 - DNA, 19 bp, Homo sapiens
tgactgtttttcggacagt

SEQ ID NO: 2010218 - DNA, 17 bp, Homo sapiens
tgactgtttttgtagtg

SEQ ID NO: 2010219 - DNA, 14 bp, Homo sapiens
tgacttactgtttc

SEQ ID NO: 2010220 - DNA, 13 bp, Homo sapiens
tgacttcacagca

SEQ ID NO: 2010221 - DNA, 20 bp, Homo sapiens
tgacttcaggtggagagcac

SEQ ID NO: 2010222 - DNA, 14 bp, Homo sapiens
tgacttccacacct

SEQ ID NO: 2010223 - DNA, 20 bp, Homo sapiens
tgacttctgccccagcttta

SEQ ID NO: 2010224 - DNA, 23 bp, Homo sapiens
tgacttcttggtttggggagaaa

SEQ ID NO: 2010225 - DNA, 17 bp, Homo sapiens
tgacttgacagaacact

SEQ ID NO: 2010226 - DNA, 19 bp, Homo sapiens
tgacttgacagaacactgt

SEQ ID NO: 2010227 - DNA, 17 bp, Homo sapiens
tgacttgggcaccccca

SEQ ID NO: 2010228 - DNA, 21 bp, Homo sapiens
tgacttgggcacccccagcct

SEQ ID NO: 2010229 - DNA, 19 bp, Homo sapiens
tgacttggggagatggagt

SEQ ID NO: 2010230 - DNA, 13 bp, Homo sapiens
tgactttaattgt

SEQ ID NO: 2010231 - DNA, 14 bp, Homo sapiens
tgactttagaaaca

SEQ ID NO: 2010232 - DNA, 13 bp, Homo sapiens
tgactttcaggta

SEQ ID NO: 2010233 - DNA, 16 bp, Homo sapiens
tgactttgctctttct

SEQ ID NO: 2010234 - DNA, 18 bp, Homo sapiens
tgacttttccaagccctt

SEQ ID NO: 2010235 - DNA, 13 bp, Homo sapiens
tgacttttccatg

SEQ ID NO: 2010236 - DNA, 19 bp, Homo sapiens
tgacttttccatgtatcta

SEQ ID NO: 2010237 - DNA, 18 bp, Homo sapiens
tgacttttctggaagaca

SEQ ID NO: 2010238 - DNA, 19 bp, Homo sapiens
tgacttttctggaagacat

SEQ ID NO: 2010239 - DNA, 15 bp, Homo sapiens
tgagaaacccaccag

SEQ ID NO: 2010240 - DNA, 18 bp, Homo sapiens
tgagaaacccaccagcct

SEQ ID NO: 2010241 - DNA, 16 bp, Homo sapiens
tgagaaagaatgagca

SEQ ID NO: 2010242 - DNA, 19 bp, Homo sapiens
tgagaaagggtagaattct

SEQ ID NO: 2010243 - DNA, 16 bp, Homo sapiens
tgagaaatgaatgctg

SEQ ID NO: 2010244 - DNA, 12 bp, Homo sapiens
tgagaaatgtga

SEQ ID NO: 2010245 - DNA, 18 bp, Homo sapiens
tgagaacaagtcacagct

SEQ ID NO: 2010246 - DNA, 19 bp, Homo sapiens
tgagaacaagtcacagctg

SEQ ID NO: 2010247 - DNA, 12 bp, Homo sapiens
tgagaacctggc

SEQ ID NO: 2010248 - DNA, 14 bp, Homo sapiens
tgagaacctggcct

SEQ ID NO: 2010249 - DNA, 17 bp, Homo sapiens
tgagaagaagctgagga

SEQ ID NO: 2010250 - DNA, 17 bp, Homo sapiens
tgagaagactcctgggc

SEQ ID NO: 2010251 - DNA, 21 bp, Homo sapiens
tgagaagagggcctgtgggag

SEQ ID NO: 2010252 - DNA, 16 bp, Homo sapiens
tgagaaggcgaggaga

SEQ ID NO: 2010253 - DNA, 16 bp, Homo sapiens
tgagaaggtccttaat

SEQ ID NO: 2010254 - DNA, 20 bp, Homo sapiens
tgagaataattgtgtacaaa

SEQ ID NO: 2010255 - DNA, 15 bp, Homo sapiens
tgagaatcctgcctc

SEQ ID NO: 2010256 - DNA, 19 bp, Homo sapiens
tgagaatcgacctcactgt

SEQ ID NO: 2010257 - DNA, 20 bp, Homo sapiens
tgagaattattcctttccta

SEQ ID NO: 2010258 - DNA, 15 bp, Homo sapiens
tgagaattttaaatt

SEQ ID NO: 2010259 - DNA, 13 bp, Homo sapiens
tgagacaagccct

SEQ ID NO: 2010260 - DNA, 23 bp, Homo sapiens
tgagacacagagtggagccctca

SEQ ID NO: 2010261 - DNA, 18 bp, Homo sapiens
tgagacagccacttggtt

SEQ ID NO: 2010262 - DNA, 12 bp, Homo sapiens
tgagaccacctc

SEQ ID NO: 2010263 - DNA, 14 bp, Homo sapiens
tgagaccactgtta

SEQ ID NO: 2010264 - DNA, 17 bp, Homo sapiens
tgagaccagcctggcca

SEQ ID NO: 2010265 - DNA, 21 bp, Homo sapiens
tgagacccattcctatttctt

SEQ ID NO: 2010266 - DNA, 12 bp, Homo sapiens
tgagaccctgtc

SEQ ID NO: 2010267 - DNA, 14 bp, Homo sapiens
tgagaccctgtctc

SEQ ID NO: 2010268 - DNA, 17 bp, Homo sapiens
tgagacctcagccatga

SEQ ID NO: 2010269 - DNA, 20 bp, Homo sapiens
tgagactataaagcagtaga

SEQ ID NO: 2010270 - DNA, 22 bp, Homo sapiens
tgagactccagaatctgctgtt

SEQ ID NO: 2010271 - DNA, 15 bp, Homo sapiens
tgagactcgtctcaa

SEQ ID NO: 2010272 - DNA, 19 bp, Homo sapiens
tgagactctcttaggagca

SEQ ID NO: 2010273 - DNA, 14 bp, Homo sapiens
tgagactctgtctc

SEQ ID NO: 2010274 - DNA, 14 bp, Homo sapiens
tgagactgacacct

SEQ ID NO: 2010275 - DNA, 22 bp, Homo sapiens
tgagactgcgggatggtcctgg

SEQ ID NO: 2010276 - DNA, 13 bp, Homo sapiens
tgagactggcact

SEQ ID NO: 2010277 - DNA, 19 bp, Homo sapiens
tgagagaaaaagtgcccct

SEQ ID NO: 2010278 - DNA, 14 bp, Homo sapiens
tgcagcctccccca

SEQ ID NO: 2010279 - DNA, 15 bp, Homo sapiens
tgcagcctggtagaa

SEQ ID NO: 2010280 - DNA, 20 bp, Homo sapiens
tgcagctatgcgcaatgtgg

SEQ ID NO: 2010281 - DNA, 23 bp, Homo sapiens
tgcagctgcaccatcacacatgc

SEQ ID NO: 2010282 - DNA, 13 bp, Homo sapiens
tgcagctgggccc

SEQ ID NO: 2010283 - DNA, 14 bp, Homo sapiens
tgcagctgggcccc

SEQ ID NO: 2010284 - DNA, 19 bp, Homo sapiens
tgcagctgggccccatgct

SEQ ID NO: 2010285 - DNA, 22 bp, Homo sapiens
tgcagctgggccccatgctctg

SEQ ID NO: 2010286 - DNA, 11 bp, Homo sapiens
tgcagcttcat

SEQ ID NO: 2010287 - DNA, 11 bp, Homo sapiens
tgcagcttcct

SEQ ID NO: 2010288 - DNA, 22 bp, Homo sapiens
tgcagcttcggggcaagtgaga

SEQ ID NO: 2010289 - DNA, 16 bp, Homo sapiens
tgcagcttctgtcctg

SEQ ID NO: 2010290 - DNA, 17 bp, Homo sapiens
tgcagcttgtagccagc

SEQ ID NO: 2010291 - DNA, 22 bp, Homo sapiens
tgcagcttgtagccagccgggg

SEQ ID NO: 2010292 - DNA, 18 bp, Homo sapiens
tgcaggaacgagcactgg

SEQ ID NO: 2010293 - DNA, 22 bp, Homo sapiens
tgcaggaacgagcactggccag

SEQ ID NO: 2010294 - DNA, 23 bp, Homo sapiens
tgcaggaacgagcactggccaga

SEQ ID NO: 2010295 - DNA, 16 bp, Homo sapiens
tgcaggacttctgcct

SEQ ID NO: 2010296 - DNA, 22 bp, Homo sapiens
tgcaggccaggttatgcctcat

SEQ ID NO: 2010297 - DNA, 21 bp, Homo sapiens
tgcaggccgggtggccaatcc

SEQ ID NO: 2010298 - DNA, 16 bp, Homo sapiens
tgcaggcctgctcagg

SEQ ID NO: 2010299 - DNA, 15 bp, Homo sapiens
tgcaggctctgggct

SEQ ID NO: 2010300 - DNA, 16 bp, Homo sapiens
tgcaggctctgggctc

SEQ ID NO: 2010301 - DNA, 16 bp, Homo sapiens
tgcagggaagagggca

SEQ ID NO: 2010302 - DNA, 19 bp, Homo sapiens
tgcagggggtgtgtctgct

SEQ ID NO: 2010303 - DNA, 13 bp, Homo sapiens
tgcagtacaggca

SEQ ID NO: 2010304 - DNA, 18 bp, Homo sapiens
tgcagtagtctctgtgct

SEQ ID NO: 2010305 - DNA, 15 bp, Homo sapiens
tgcagtattgccaca

SEQ ID NO: 2010306 - DNA, 20 bp, Homo sapiens
tgcagtattttattaaagca

SEQ ID NO: 2010307 - DNA, 21 bp, Homo sapiens
tgcagtattttattaaagcaa

SEQ ID NO: 2010308 - DNA, 15 bp, Homo sapiens
tgcagtcatcagaag

SEQ ID NO: 2010309 - DNA, 12 bp, Homo sapiens
tgcagtccagaa

SEQ ID NO: 2010310 - DNA, 20 bp, Homo sapiens
tgcagtccagaataagtgct

SEQ ID NO: 2010311 - DNA, 17 bp, Homo sapiens
tgcagtcccgtggaggg

SEQ ID NO: 2010312 - DNA, 24 bp, Homo sapiens
tgcagtcccgtggagggtagggga

SEQ ID NO: 2010313 - DNA, 21 bp, Homo sapiens
tgcagtccgcagtctggcctg

SEQ ID NO: 2010314 - DNA, 18 bp, Homo sapiens
tgcagtgacgtgcacctg

SEQ ID NO: 2010315 - DNA, 22 bp, Homo sapiens
tgcagtgacgtgcacctgtact

SEQ ID NO: 2010316 - DNA, 16 bp, Homo sapiens
tgcagtgatacatgta

SEQ ID NO: 2010317 - DNA, 18 bp, Homo sapiens
tgcagtgatacatgtact

SEQ ID NO: 2010318 - DNA, 19 bp, Homo sapiens
tgcagttaatggggtagag

SEQ ID NO: 2010319 - DNA, 20 bp, Homo sapiens
tgcagttcaaatcctcacca

SEQ ID NO: 2010320 - DNA, 15 bp, Homo sapiens
tgcataaaccaatga

SEQ ID NO: 2010321 - DNA, 23 bp, Homo sapiens
tgcataagattaaaggaaggaaa

SEQ ID NO: 2010322 - DNA, 21 bp, Homo sapiens
tgcatactgatccctttccca

SEQ ID NO: 2010323 - DNA, 19 bp, Homo sapiens
tgcatagagccacgtatgt

SEQ ID NO: 2010324 - DNA, 19 bp, Homo sapiens
tgcatagttcccatgttaa

SEQ ID NO: 2010325 - DNA, 17 bp, Homo sapiens
tgcatatatacatatat

SEQ ID NO: 2010326 - DNA, 17 bp, Homo sapiens
tgcatatcggaggtggt

SEQ ID NO: 2010327 - DNA, 21 bp, Homo sapiens
tgcatcagaaagggagggctc

SEQ ID NO: 2010328 - DNA, 19 bp, Homo sapiens
tgcatcagctgctgaaaca

SEQ ID NO: 2010329 - DNA, 22 bp, Homo sapiens
tgcatcagctgctgaaacaaca

SEQ ID NO: 2010330 - DNA, 16 bp, Homo sapiens
tgcatccggagaattg

SEQ ID NO: 2010331 - DNA, 15 bp, Homo sapiens
tgcatcctcctccca

SEQ ID NO: 2010332 - DNA, 16 bp, Homo sapiens
tgcatctactcaggcc

SEQ ID NO: 2010333 - DNA, 21 bp, Homo sapiens
tgcatctagaggcttccttca

SEQ ID NO: 2010334 - DNA, 13 bp, Homo sapiens
tgcatctcagccc

SEQ ID NO: 2010335 - DNA, 11 bp, Homo sapiens
tgcatgaaaat

SEQ ID NO: 2010336 - DNA, 18 bp, Homo sapiens
tgcatgattttatacata

SEQ ID NO: 2010337 - DNA, 19 bp, Homo sapiens
tgcatgattttatacatag

SEQ ID NO: 2010338 - DNA, 22 bp, Homo sapiens
tgcatgccaaattgtagttctt

SEQ ID NO: 2010339 - DNA, 16 bp, Homo sapiens
tgcatgctctctgcag

SEQ ID NO: 2010340 - DNA, 13 bp, Homo sapiens
tgcatgctctgga

SEQ ID NO: 2010341 - DNA, 17 bp, Homo sapiens
tgcatgctctggaagcc

SEQ ID NO: 2010342 - DNA, 19 bp, Homo sapiens
tgcatggaatttgtaagtt

SEQ ID NO: 2010343 - DNA, 18 bp, Homo sapiens
tgcatggcttggggagca

SEQ ID NO: 2010344 - DNA, 22 bp, Homo sapiens
tgcatggcttggggagcagagt

SEQ ID NO: 2010345 - DNA, 23 bp, Homo sapiens
tgcatggtgcagttgacagcagg

SEQ ID NO: 2010346 - DNA, 18 bp, Homo sapiens
tgcatgtaaaatgcagtc

SEQ ID NO: 2010347 - DNA, 13 bp, Homo sapiens
tgcatgtatgtct

SEQ ID NO: 2010348 - DNA, 14 bp, Homo sapiens
tgcatgtatgtctt

SEQ ID NO: 2010349 - DNA, 15 bp, Homo sapiens
tgcatgtatgtcttg

SEQ ID NO: 2010350 - DNA, 16 bp, Homo sapiens
tgcatgtatgtcttgg

SEQ ID NO: 2010351 - DNA, 23 bp, Homo sapiens
tgcatgtatgtgcacatgtgtct

SEQ ID NO: 2010352 - DNA, 13 bp, Homo sapiens
tgcatgtatgtgt

SEQ ID NO: 2010353 - DNA, 11 bp, Homo sapiens
tgcatgtgtgt

SEQ ID NO: 2010354 - DNA, 21 bp, Homo sapiens
tgcatgtgtgtgtctgtcttt

SEQ ID NO: 2010355 - DNA, 22 bp, Homo sapiens
tgcatgtgtgttgtccttcagc

SEQ ID NO: 2010356 - DNA, 17 bp, Homo sapiens
tgcatgtgttgtacaat

SEQ ID NO: 2010357 - DNA, 17 bp, Homo sapiens
tgcatgtttactttatt

SEQ ID NO: 2010358 - DNA, 18 bp, Homo sapiens
tgcattactgcatgcact

SEQ ID NO: 2010359 - DNA, 19 bp, Homo sapiens
tgcattagaaatagacagt

SEQ ID NO: 2010360 - DNA, 20 bp, Homo sapiens
tgcattagaaatagacagta

SEQ ID NO: 2010361 - DNA, 14 bp, Homo sapiens
tgcattagaaatta

SEQ ID NO: 2010362 - DNA, 18 bp, Homo sapiens
tgcattccccgctgccca

SEQ ID NO: 2010363 - DNA, 22 bp, Homo sapiens
tgcattcggtacttacccggag

SEQ ID NO: 2010364 - DNA, 20 bp, Homo sapiens
tgcattcttttaaagtttta

SEQ ID NO: 2010365 - DNA, 14 bp, Homo sapiens
tgcattgaatatat

SEQ ID NO: 2010366 - DNA, 17 bp, Homo sapiens
tgcattgttattgtgga

SEQ ID NO: 2010367 - DNA, 17 bp, Homo sapiens
tgcatttataaatgtgt

SEQ ID NO: 2010368 - DNA, 15 bp, Homo sapiens
tgcatttctgtctct

SEQ ID NO: 2010369 - DNA, 22 bp, Homo sapiens
tgcatttcttgacttcacagca

SEQ ID NO: 2010370 - DNA, 21 bp, Homo sapiens
tgcatttgagagaagccacgc

SEQ ID NO: 2010371 - DNA, 16 bp, Homo sapiens
tgccaaagcaaaagaa

SEQ ID NO: 2010372 - DNA, 23 bp, Homo sapiens
tgccaacaccttcttggcttctg

SEQ ID NO: 2010373 - DNA, 22 bp, Homo sapiens
tgccaacatacccttctttaaa

SEQ ID NO: 2010374 - DNA, 23 bp, Homo sapiens
tgccaacatacccttctttaaat

SEQ ID NO: 2010375 - DNA, 18 bp, Homo sapiens
tgccaacctgatgcccct

SEQ ID NO: 2010376 - DNA, 23 bp, Homo sapiens
tgccaacctgatgccccttcccc

SEQ ID NO: 2010377 - DNA, 14 bp, Homo sapiens
tgccaactggtcac

SEQ ID NO: 2010378 - DNA, 18 bp, Homo sapiens
tgccaactggtcactgtg

SEQ ID NO: 2010379 - DNA, 12 bp, Homo sapiens
tgccaagagagg

SEQ ID NO: 2010380 - DNA, 15 bp, Homo sapiens
tgccaagtccaggtc

SEQ ID NO: 2010381 - DNA, 15 bp, Homo sapiens
tgccaatatgtattg

SEQ ID NO: 2010382 - DNA, 19 bp, Homo sapiens
tgccaatatgtattgtaaa

SEQ ID NO: 2010383 - DNA, 21 bp, Homo sapiens
tgccaatgaggtctgaaatgg

SEQ ID NO: 2010384 - DNA, 15 bp, Homo sapiens
tgccaattagcaatt

SEQ ID NO: 2010385 - DNA, 19 bp, Homo sapiens
tgccacaatgcctctccca

SEQ ID NO: 2010386 - DNA, 14 bp, Homo sapiens
tgccacacactgtt

SEQ ID NO: 2010387 - DNA, 13 bp, Homo sapiens
tgccacaccctcc

SEQ ID NO: 2010388 - DNA, 20 bp, Homo sapiens
tgccacaccctccccattca

SEQ ID NO: 2010389 - DNA, 21 bp, Homo sapiens
tgccacactcagtcccccacc

SEQ ID NO: 2010390 - DNA, 22 bp, Homo sapiens
tgccacactcagtcccccacca

SEQ ID NO: 2010391 - DNA, 13 bp, Homo sapiens
tgccacacttcag

SEQ ID NO: 2010392 - DNA, 19 bp, Homo sapiens
tgccttgacaacagactga

SEQ ID NO: 2010393 - DNA, 21 bp, Homo sapiens
tgccttgacaacagactgaat

SEQ ID NO: 2010394 - DNA, 20 bp, Homo sapiens
tgccttgagtctttaatccc

SEQ ID NO: 2010395 - DNA, 20 bp, Homo sapiens
tgccttgatgaagcctgtgc

SEQ ID NO: 2010396 - DNA, 20 bp, Homo sapiens
tgcctttccacctgctttct

SEQ ID NO: 2010397 - DNA, 20 bp, Homo sapiens
tgcctttctctggctccaga

SEQ ID NO: 2010398 - DNA, 13 bp, Homo sapiens
tgcctttgcctct

SEQ ID NO: 2010399 - DNA, 17 bp, Homo sapiens
tgcctttgtttctaaag

SEQ ID NO: 2010400 - DNA, 15 bp, Homo sapiens
tgccttttaaaagaa

SEQ ID NO: 2010401 - DNA, 13 bp, Homo sapiens
tgccttttatagc

SEQ ID NO: 2010402 - DNA, 17 bp, Homo sapiens
tgccttttatagctatt

SEQ ID NO: 2010403 - DNA, 23 bp, Homo sapiens
tgccttttgctgctgctgctgcg

SEQ ID NO: 2010404 - DNA, 21 bp, Homo sapiens
tgcctttttgtttttgtaaaa

SEQ ID NO: 2010405 - DNA, 22 bp, Homo sapiens
tgcgagatcgctggcagagaag

SEQ ID NO: 2010406 - DNA, 20 bp, Homo sapiens
tgcgagcatttccctcccgg

SEQ ID NO: 2010407 - DNA, 22 bp, Homo sapiens
tgcgagcatttccctcccggga

SEQ ID NO: 2010408 - DNA, 19 bp, Homo sapiens
tgcgatctgggttcactgc

SEQ ID NO: 2010409 - DNA, 20 bp, Homo sapiens
tgcgatctgggttcactgca

SEQ ID NO: 2010410 - DNA, 16 bp, Homo sapiens
tgcgatcttcagagca

SEQ ID NO: 2010411 - DNA, 18 bp, Homo sapiens
tgcgcaacaacaaggacc

SEQ ID NO: 2010412 - DNA, 22 bp, Homo sapiens
tgcgcacaaggctgaccaagag

SEQ ID NO: 2010413 - DNA, 22 bp, Homo sapiens
tgcgcctacaggagtgagcact

SEQ ID NO: 2010414 - DNA, 20 bp, Homo sapiens
tgcgcgcatgtaatcccagc

SEQ ID NO: 2010415 - DNA, 21 bp, Homo sapiens
tgcgcgcatgtaatcccagct

SEQ ID NO: 2010416 - DNA, 14 bp, Homo sapiens
tgcgcgtgtgcacg

SEQ ID NO: 2010417 - DNA, 22 bp, Homo sapiens
tgcgctaacccccagcccacag

SEQ ID NO: 2010418 - DNA, 17 bp, Homo sapiens
tgcgctcttggtccctg

SEQ ID NO: 2010419 - DNA, 15 bp, Homo sapiens
tgcgctgctcaacct

SEQ ID NO: 2010420 - DNA, 23 bp, Homo sapiens
tgcgctggtggaccacaggcatc

SEQ ID NO: 2010421 - DNA, 15 bp, Homo sapiens
tgcggacaagtttta

SEQ ID NO: 2010422 - DNA, 13 bp, Homo sapiens
tgcggccaccacc

SEQ ID NO: 2010423 - DNA, 17 bp, Homo sapiens
tgcggccttccaccggg

SEQ ID NO: 2010424 - DNA, 19 bp, Homo sapiens
tgcggccttccaccgggcc

SEQ ID NO: 2010425 - DNA, 17 bp, Homo sapiens
tgcgggagtagttggaa

SEQ ID NO: 2010426 - DNA, 17 bp, Homo sapiens
tgcgggatggtcctggg

SEQ ID NO: 2010427 - DNA, 15 bp, Homo sapiens
tgcggggcagagcca

SEQ ID NO: 2010428 - DNA, 15 bp, Homo sapiens
tgcgggtctgaagga

SEQ ID NO: 2010429 - DNA, 18 bp, Homo sapiens
tgcggtggtgccagaggt

SEQ ID NO: 2010430 - DNA, 23 bp, Homo sapiens
tgcggttcaggaaaattgaatgc

SEQ ID NO: 2010431 - DNA, 15 bp, Homo sapiens
tgcgtacgtttcctg

SEQ ID NO: 2010432 - DNA, 19 bp, Homo sapiens
tgcgtcagaccagtactgg

SEQ ID NO: 2010433 - DNA, 22 bp, Homo sapiens
tgcgtcccccagccctcaggcc

SEQ ID NO: 2010434 - DNA, 19 bp, Homo sapiens
tgcgtcctgacgccctgcg

SEQ ID NO: 2010435 - DNA, 13 bp, Homo sapiens
tgcgtcctgcaga

SEQ ID NO: 2010436 - DNA, 23 bp, Homo sapiens
tgcgtgcacatatgggtgctggc

SEQ ID NO: 2010437 - DNA, 13 bp, Homo sapiens
tgcgtgcgtgtgc

SEQ ID NO: 2010438 - DNA, 18 bp, Homo sapiens
tgcgtgctttatttatgg

SEQ ID NO: 2010439 - DNA, 16 bp, Homo sapiens
tgcgtggctgtggcac

SEQ ID NO: 2010440 - DNA, 14 bp, Homo sapiens
tgcgttggagccac

SEQ ID NO: 2010441 - DNA, 19 bp, Homo sapiens
tgcgttggagccactcctg

SEQ ID NO: 2010442 - DNA, 23 bp, Homo sapiens
tgctaaacgactccgagaacaac

SEQ ID NO: 2010443 - DNA, 19 bp, Homo sapiens
tgctaaatactgtacatag

SEQ ID NO: 2010444 - DNA, 19 bp, Homo sapiens
tgctaaatgcaaacactgt

SEQ ID NO: 2010445 - DNA, 15 bp, Homo sapiens
tgctaaattttcagt

SEQ ID NO: 2010446 - DNA, 19 bp, Homo sapiens
tgctaactgtatgtgtctt

SEQ ID NO: 2010447 - DNA, 12 bp, Homo sapiens
tgctaagaaatg

SEQ ID NO: 2010448 - DNA, 13 bp, Homo sapiens
tgctaagagaagt

SEQ ID NO: 2010449 - DNA, 12 bp, Homo sapiens
tgctaataaaac

SEQ ID NO: 2010450 - DNA, 20 bp, Homo sapiens
tgctaatcttcttatgcaat

SEQ ID NO: 2010451 - DNA, 22 bp, Homo sapiens
tgctaatcttcttatgcaattt

SEQ ID NO: 2010452 - DNA, 15 bp, Homo sapiens
tgctaattaaaaagt

SEQ ID NO: 2010453 - DNA, 15 bp, Homo sapiens
tgctacaaaaacaca

SEQ ID NO: 2010454 - DNA, 19 bp, Homo sapiens
tgctacaaaaacacagcaa

SEQ ID NO: 2010455 - DNA, 12 bp, Homo sapiens
tgctacaataaa

SEQ ID NO: 2010456 - DNA, 17 bp, Homo sapiens
tgctacagtactatgta

SEQ ID NO: 2010457 - DNA, 13 bp, Homo sapiens
tgctaccaaagca

SEQ ID NO: 2010458 - DNA, 19 bp, Homo sapiens
tgctaccaaggcccagcta

SEQ ID NO: 2010459 - DNA, 21 bp, Homo sapiens
tgctaccaaggcccagctatg

SEQ ID NO: 2010460 - DNA, 16 bp, Homo sapiens
tgctacctcactgggg

SEQ ID NO: 2010461 - DNA, 19 bp, Homo sapiens
tgctacgtacatgtgaggc

SEQ ID NO: 2010462 - DNA, 15 bp, Homo sapiens
tgctactcctgtgct

SEQ ID NO: 2010463 - DNA, 16 bp, Homo sapiens
tgctactcctgtgctc

SEQ ID NO: 2010464 - DNA, 14 bp, Homo sapiens
tgctagacagccag

SEQ ID NO: 2010465 - DNA, 17 bp, Homo sapiens
tgctagagcaacccctg

SEQ ID NO: 2010466 - DNA, 20 bp, Homo sapiens
tgctagatatcacttactca

SEQ ID NO: 2010467 - DNA, 21 bp, Homo sapiens
tgctagatatcacttactcag

SEQ ID NO: 2010468 - DNA, 22 bp, Homo sapiens
tgctagatatcacttactcagt

SEQ ID NO: 2010469 - DNA, 20 bp, Homo sapiens
tgctagccggccactttgga

SEQ ID NO: 2010470 - DNA, 23 bp, Homo sapiens
tgctagtactggggagaaataat

SEQ ID NO: 2010471 - DNA, 20 bp, Homo sapiens
tgctataggctggagaagct

SEQ ID NO: 2010472 - DNA, 17 bp, Homo sapiens
tgctatatatataaata

SEQ ID NO: 2010473 - DNA, 18 bp, Homo sapiens
tgctatattttcatgact

SEQ ID NO: 2010474 - DNA, 14 bp, Homo sapiens
tgctatcacacagt

SEQ ID NO: 2010475 - DNA, 16 bp, Homo sapiens
tgctatctctgtgtgc

SEQ ID NO: 2010476 - DNA, 21 bp, Homo sapiens
tgctatctctgtgtgcacaaa

SEQ ID NO: 2010477 - DNA, 15 bp, Homo sapiens
tgctatgacatgcaa

SEQ ID NO: 2010478 - DNA, 15 bp, Homo sapiens
tgctatgccaagcca

SEQ ID NO: 2010479 - DNA, 17 bp, Homo sapiens
tgctatggttttctcca

SEQ ID NO: 2010480 - DNA, 21 bp, Homo sapiens
tgctattctgtgttgaacaca

SEQ ID NO: 2010481 - DNA, 14 bp, Homo sapiens
tgctattgaaatta

SEQ ID NO: 2010482 - DNA, 17 bp, Homo sapiens
tgctattgaaattactg

SEQ ID NO: 2010483 - DNA, 17 bp, Homo sapiens
tgctattgaactgagcc

SEQ ID NO: 2010484 - DNA, 16 bp, Homo sapiens
tgctattgacaagtca

SEQ ID NO: 2010485 - DNA, 18 bp, Homo sapiens
tgctattgttgtgggctt

SEQ ID NO: 2010486 - DNA, 17 bp, Homo sapiens
tgctatttctggcctca

SEQ ID NO: 2010487 - DNA, 19 bp, Homo sapiens
tgctatttctggcctcagc

SEQ ID NO: 2010488 - DNA, 21 bp, Homo sapiens
tgctatttgagcatgcacagc

SEQ ID NO: 2010489 - DNA, 22 bp, Homo sapiens
tgctatttgttgtttttaacaa

SEQ ID NO: 2010490 - DNA, 19 bp, Homo sapiens
tgctattttatttgtattc

SEQ ID NO: 2010491 - DNA, 18 bp, Homo sapiens
tgctcaaatcatttaaga

SEQ ID NO: 2010492 - DNA, 18 bp, Homo sapiens
tgctcaaatctattcaga

SEQ ID NO: 2010493 - DNA, 19 bp, Homo sapiens
tgctcaaatctattcagac

SEQ ID NO: 2010494 - DNA, 15 bp, Homo sapiens
tgctcaaccactgtg

SEQ ID NO: 2010495 - DNA, 18 bp, Homo sapiens
tgctcaaccactgtggcg

SEQ ID NO: 2010496 - DNA, 21 bp, Homo sapiens
tgctcaacctctctccttctg

SEQ ID NO: 2010497 - DNA, 23 bp, Homo sapiens
tgctcaacctctctccttctggc

SEQ ID NO: 2010498 - DNA, 22 bp, Homo sapiens
tgctcaagaagacatggagact

SEQ ID NO: 2010499 - DNA, 16 bp, Homo sapiens
tgctcacatatctgtc

SEQ ID NO: 2010500 - DNA, 19 bp, Homo sapiens
tgctcacgactcttcctgc

SEQ ID NO: 2010501 - DNA, 13 bp, Homo sapiens
tgctcactcagga

SEQ ID NO: 2010502 - DNA, 15 bp, Homo sapiens
tgctcagcaggccct

SEQ ID NO: 2010503 - DNA, 19 bp, Homo sapiens
tgctcagcccttcctagaa

SEQ ID NO: 2010504 - DNA, 19 bp, Homo sapiens
tgctcaggcttgaaatgca

SEQ ID NO: 2010505 - DNA, 17 bp, Homo sapiens
tgctcaggtgcaagtgc

SEQ ID NO: 2010506 - DNA, 13 bp, Homo sapiens
tggagagaagttt

SEQ ID NO: 2010507 - DNA, 19 bp, Homo sapiens
tggagagagtattaaatat

SEQ ID NO: 2010508 - DNA, 12 bp, Homo sapiens
tggagagcagct

SEQ ID NO: 2010509 - DNA, 16 bp, Homo sapiens
tggagagcagctggct

SEQ ID NO: 2010510 - DNA, 20 bp, Homo sapiens
tggagagcagctggctctcc

SEQ ID NO: 2010511 - DNA, 20 bp, Homo sapiens
tggagagccagaacctggag

SEQ ID NO: 2010512 - DNA, 16 bp, Homo sapiens
tggagagccctgggac

SEQ ID NO: 2010513 - DNA, 14 bp, Homo sapiens
tggagagctaggag

SEQ ID NO: 2010514 - DNA, 15 bp, Homo sapiens
tggagagctaggagc

SEQ ID NO: 2010515 - DNA, 22 bp, Homo sapiens
tggagagctaggagcaaagcct

SEQ ID NO: 2010516 - DNA, 21 bp, Homo sapiens
tggagaggagggatgctgcct

SEQ ID NO: 2010517 - DNA, 18 bp, Homo sapiens
tggagagggacgaagaaa

SEQ ID NO: 2010518 - DNA, 20 bp, Homo sapiens
tggagagggacgaagaaagg

SEQ ID NO: 2010519 - DNA, 13 bp, Homo sapiens
tggagaggggcct

SEQ ID NO: 2010520 - DNA, 15 bp, Homo sapiens
tggagaggggcctgg

SEQ ID NO: 2010521 - DNA, 16 bp, Homo sapiens
tggagaggggcctggg

SEQ ID NO: 2010522 - DNA, 15 bp, Homo sapiens
tggagatgatgatga

SEQ ID NO: 2010523 - DNA, 16 bp, Homo sapiens
tggagatgatgatgat

SEQ ID NO: 2010524 - DNA, 13 bp, Homo sapiens
tggagatgcagag

SEQ ID NO: 2010525 - DNA, 18 bp, Homo sapiens
tggagcaagaaggaagga

SEQ ID NO: 2010526 - DNA, 14 bp, Homo sapiens
tggagcaagagaga

SEQ ID NO: 2010527 - DNA, 17 bp, Homo sapiens
tggagcaccaggcacga

SEQ ID NO: 2010528 - DNA, 15 bp, Homo sapiens
tggagcagaatcagt

SEQ ID NO: 2010529 - DNA, 17 bp, Homo sapiens
tggagccactcctgtcc

SEQ ID NO: 2010530 - DNA, 11 bp, Homo sapiens
tggagccagag

SEQ ID NO: 2010531 - DNA, 13 bp, Homo sapiens
tggagccagagag

SEQ ID NO: 2010532 - DNA, 22 bp, Homo sapiens
tggagcccgtgcagtacaggca

SEQ ID NO: 2010533 - DNA, 12 bp, Homo sapiens
tggagccctcag

SEQ ID NO: 2010534 - DNA, 20 bp, Homo sapiens
tggagcctcggtggccatgc

SEQ ID NO: 2010535 - DNA, 21 bp, Homo sapiens
tggagcctggcacaggactga

SEQ ID NO: 2010536 - DNA, 22 bp, Homo sapiens
tggagctaattaaggtttgccc

SEQ ID NO: 2010537 - DNA, 14 bp, Homo sapiens
tggagctgttccat

SEQ ID NO: 2010538 - DNA, 18 bp, Homo sapiens
tggagcttgtacatattg

SEQ ID NO: 2010539 - DNA, 23 bp, Homo sapiens
tggaggaaaaccaagccgtggct

SEQ ID NO: 2010540 - DNA, 20 bp, Homo sapiens
tggaggaaggtgctgagctt

SEQ ID NO: 2010541 - DNA, 13 bp, Homo sapiens
tggaggagaaata

SEQ ID NO: 2010542 - DNA, 14 bp, Homo sapiens
tggaggagaagaat

SEQ ID NO: 2010543 - DNA, 16 bp, Homo sapiens
tggaggaggaggagga

SEQ ID NO: 2010544 - DNA, 17 bp, Homo sapiens
tggaggcaaatttcagc

SEQ ID NO: 2010545 - DNA, 14 bp, Homo sapiens
tggaggcctcacac

SEQ ID NO: 2010546 - DNA, 18 bp, Homo sapiens
tggaggcctcacacccag

SEQ ID NO: 2010547 - DNA, 19 bp, Homo sapiens
tggagggaatgaacctgga

SEQ ID NO: 2010548 - DNA, 13 bp, Homo sapiens
tggagggatgcca

SEQ ID NO: 2010549 - DNA, 22 bp, Homo sapiens
tggagggcagagtgggctgcct

SEQ ID NO: 2010550 - DNA, 22 bp, Homo sapiens
tggagggctagaacctggagag

SEQ ID NO: 2010551 - DNA, 21 bp, Homo sapiens
tggagggctagaacctggagg

SEQ ID NO: 2010552 - DNA, 20 bp, Homo sapiens
tggagggctagaactggaga

SEQ ID NO: 2010553 - DNA, 22 bp, Homo sapiens
tggagggctagaatctggagag

SEQ ID NO: 2010554 - DNA, 12 bp, Homo sapiens
tggagggctgga

SEQ ID NO: 2010555 - DNA, 15 bp, Homo sapiens
tggaggggaaacgca

SEQ ID NO: 2010556 - DNA, 19 bp, Homo sapiens
tggagggggcaagcctgta

SEQ ID NO: 2010557 - DNA, 21 bp, Homo sapiens
tggaggggtgacagtggagga

SEQ ID NO: 2010558 - DNA, 14 bp, Homo sapiens
tggagggtagggga

SEQ ID NO: 2010559 - DNA, 23 bp, Homo sapiens
tggagggtaggggagtgtgggtg

SEQ ID NO: 2010560 - DNA, 14 bp, Homo sapiens
tggaggtacactct

SEQ ID NO: 2010561 - DNA, 18 bp, Homo sapiens
tggaggtcacattcagga

SEQ ID NO: 2010562 - DNA, 20 bp, Homo sapiens
tggaggtcacattcaggaag

SEQ ID NO: 2010563 - DNA, 22 bp, Homo sapiens
tggaggtcacattcaggaagat

SEQ ID NO: 2010564 - DNA, 15 bp, Homo sapiens
tggaggtgagaaaag

SEQ ID NO: 2010565 - DNA, 12 bp, Homo sapiens
tggagtgagatc

SEQ ID NO: 2010566 - DNA, 17 bp, Homo sapiens
tggagtgagcagtagaa

SEQ ID NO: 2010567 - DNA, 17 bp, Homo sapiens
tggagtgcagggaggag

SEQ ID NO: 2010568 - DNA, 15 bp, Homo sapiens
tggagtgcgctcttg

SEQ ID NO: 2010569 - DNA, 23 bp, Homo sapiens
tggagtgcgctcttggtccctgg

SEQ ID NO: 2010570 - DNA, 19 bp, Homo sapiens
tggagtgtgcgtgtgtgca

SEQ ID NO: 2010571 - DNA, 21 bp, Homo sapiens
tggagtgtgcgtgtgtgcatg

SEQ ID NO: 2010572 - DNA, 15 bp, Homo sapiens
tggagttcttgtgcc

SEQ ID NO: 2010573 - DNA, 14 bp, Homo sapiens
tggataagcgtggg

SEQ ID NO: 2010574 - DNA, 19 bp, Homo sapiens
tggataatatccactgcaa

SEQ ID NO: 2010575 - DNA, 23 bp, Homo sapiens
tggatcacagaggcttcttcaga

SEQ ID NO: 2010576 - DNA, 17 bp, Homo sapiens
tggatcagcgtggcctt

SEQ ID NO: 2010577 - DNA, 15 bp, Homo sapiens
tggatctccaaggac

SEQ ID NO: 2010578 - DNA, 21 bp, Homo sapiens
tggatctgggaccctttcctt

SEQ ID NO: 2010579 - DNA, 23 bp, Homo sapiens
tggatctgggaccctttccttcc

SEQ ID NO: 2010580 - DNA, 18 bp, Homo sapiens
tggatctgtccaaggaaa

SEQ ID NO: 2010581 - DNA, 20 bp, Homo sapiens
tggatctgtccaaggaaact

SEQ ID NO: 2010582 - DNA, 17 bp, Homo sapiens
tggatgaaattttctag

SEQ ID NO: 2010583 - DNA, 23 bp, Homo sapiens
tggatgaagattctcctgtgcta

SEQ ID NO: 2010584 - DNA, 23 bp, Homo sapiens
tggatgcctggtggcagctgcgg

SEQ ID NO: 2010585 - DNA, 23 bp, Homo sapiens
tggatgcggaacccaaattacgt

SEQ ID NO: 2010586 - DNA, 19 bp, Homo sapiens
tggatggaaatatgttcta

SEQ ID NO: 2010587 - DNA, 13 bp, Homo sapiens
tggatggacagaa

SEQ ID NO: 2010588 - DNA, 16 bp, Homo sapiens
tggatggatggacaga

SEQ ID NO: 2010589 - DNA, 17 bp, Homo sapiens
tggatgggagtgagaca

SEQ ID NO: 2010590 - DNA, 18 bp, Homo sapiens
tggatgtagtctgaggcc

SEQ ID NO: 2010591 - DNA, 22 bp, Homo sapiens
tggattatagagtatactaaaa

SEQ ID NO: 2010592 - DNA, 19 bp, Homo sapiens
tggattattcatttaaaat

SEQ ID NO: 2010593 - DNA, 15 bp, Homo sapiens
tggattctaaaatgc

SEQ ID NO: 2010594 - DNA, 18 bp, Homo sapiens
tggattgcagtccccagt

SEQ ID NO: 2010595 - DNA, 19 bp, Homo sapiens
tggatttcctattttaaaa

SEQ ID NO: 2010596 - DNA, 17 bp, Homo sapiens
tggatttctgaatggct

SEQ ID NO: 2010597 - DNA, 19 bp, Homo sapiens
tggattttcccctgaagac

SEQ ID NO: 2010598 - DNA, 15 bp, Homo sapiens
tggatttttaaatta

SEQ ID NO: 2010599 - DNA, 16 bp, Homo sapiens
tggatttttaaattat

SEQ ID NO: 2010600 - DNA, 20 bp, Homo sapiens
tggcaaagcggttgcttctg

SEQ ID NO: 2010601 - DNA, 14 bp, Homo sapiens
tggcaaatataaaa

SEQ ID NO: 2010602 - DNA, 15 bp, Homo sapiens
tggcaagaaagctgg

SEQ ID NO: 2010603 - DNA, 19 bp, Homo sapiens
tggcaagaaagctggtaaa

SEQ ID NO: 2010604 - DNA, 15 bp, Homo sapiens
tggcaagcagggaaa

SEQ ID NO: 2010605 - DNA, 21 bp, Homo sapiens
tggcaagcagggaaagctcca

SEQ ID NO: 2010606 - DNA, 22 bp, Homo sapiens
tggcaagcagggaaagctccac

SEQ ID NO: 2010607 - DNA, 14 bp, Homo sapiens
tggcaagtgaattt

SEQ ID NO: 2010608 - DNA, 23 bp, Homo sapiens
tggcaagttttgatatgagtata

SEQ ID NO: 2010609 - DNA, 16 bp, Homo sapiens
tggcaattgtccccag

SEQ ID NO: 2010610 - DNA, 15 bp, Homo sapiens
tggcaattttgtaac

SEQ ID NO: 2010611 - DNA, 22 bp, Homo sapiens
tggcacagacttctggaaggct

SEQ ID NO: 2010612 - DNA, 23 bp, Homo sapiens
tggcacagacttctggaaggctg

SEQ ID NO: 2010613 - DNA, 20 bp, Homo sapiens
tggcacagcccaaagaagga

SEQ ID NO: 2010614 - DNA, 14 bp, Homo sapiens
tggcacaggactga

SEQ ID NO: 2010615 - DNA, 15 bp, Homo sapiens
tggcacagggcagtg

SEQ ID NO: 2010616 - DNA, 21 bp, Homo sapiens
tggcaccactagggtcctggc

SEQ ID NO: 2010617 - DNA, 14 bp, Homo sapiens
tggcaccagatgca

SEQ ID NO: 2010618 - DNA, 15 bp, Homo sapiens
tggcaccagccccct

SEQ ID NO: 2010619 - DNA, 23 bp, Homo sapiens
tggcaccccggatcgaggacaag

SEQ ID NO: 2010620 - DNA, 15 bp, Homo sapiens
tgggcagtgcctcct

SEQ ID NO: 2010621 - DNA, 16 bp, Homo sapiens
tgggcagtgcctcctg

SEQ ID NO: 2010622 - DNA, 19 bp, Homo sapiens
tgggcagtgcctcctggga

SEQ ID NO: 2010623 - DNA, 17 bp, Homo sapiens
tgggcatgctcagccct

SEQ ID NO: 2010624 - DNA, 14 bp, Homo sapiens
tgggcattgggctg

SEQ ID NO: 2010625 - DNA, 15 bp, Homo sapiens
tgggcattgggctga

SEQ ID NO: 2010626 - DNA, 16 bp, Homo sapiens
tgggcattgggctgac

SEQ ID NO: 2010627 - DNA, 17 bp, Homo sapiens
tgggcattgggctgaca

SEQ ID NO: 2010628 - DNA, 18 bp, Homo sapiens
tgggccactgccagcagc

SEQ ID NO: 2010629 - DNA, 15 bp, Homo sapiens
tgggccagctgtcgc

SEQ ID NO: 2010630 - DNA, 14 bp, Homo sapiens
tgggccaggacagg

SEQ ID NO: 2010631 - DNA, 17 bp, Homo sapiens
tgggccaggacaggccc

SEQ ID NO: 2010632 - DNA, 16 bp, Homo sapiens
tgggccaggagctcag

SEQ ID NO: 2010633 - DNA, 17 bp, Homo sapiens
tgggccaggagctcagc

SEQ ID NO: 2010634 - DNA, 19 bp, Homo sapiens
tgggcccaggctctgggaa

SEQ ID NO: 2010635 - DNA, 22 bp, Homo sapiens
tgggcccaggctctgggaaggg

SEQ ID NO: 2010636 - DNA, 22 bp, Homo sapiens
tgggcccataatagttagccct

SEQ ID NO: 2010637 - DNA, 17 bp, Homo sapiens
tgggccccaccacctag

SEQ ID NO: 2010638 - DNA, 17 bp, Homo sapiens
tgggccccatgctctgc

SEQ ID NO: 2010639 - DNA, 13 bp, Homo sapiens
tgggcccctccac

SEQ ID NO: 2010640 - DNA, 17 bp, Homo sapiens
tgggcccgctttgcctg

SEQ ID NO: 2010641 - DNA, 22 bp, Homo sapiens
tgggcccggagtaatcaggcag

SEQ ID NO: 2010642 - DNA, 17 bp, Homo sapiens
tgggccggccagccttg

SEQ ID NO: 2010643 - DNA, 19 bp, Homo sapiens
tgggcctatggagagccct

SEQ ID NO: 2010644 - DNA, 21 bp, Homo sapiens
tgggcctatggagagccctgg

SEQ ID NO: 2010645 - DNA, 22 bp, Homo sapiens
tgggcctatggagagccctggg

SEQ ID NO: 2010646 - DNA, 21 bp, Homo sapiens
tgggcctccccccagcccctc

SEQ ID NO: 2010647 - DNA, 13 bp, Homo sapiens
tgggcctgctgct

SEQ ID NO: 2010648 - DNA, 17 bp, Homo sapiens
tgggcctgctgctgaga

SEQ ID NO: 2010649 - DNA, 18 bp, Homo sapiens
tgggcctgcttttccagg

SEQ ID NO: 2010650 - DNA, 19 bp, Homo sapiens
tgggcctgcttttccagga

SEQ ID NO: 2010651 - DNA, 23 bp, Homo sapiens
tgggcctgcttttccaggatcct

SEQ ID NO: 2010652 - DNA, 20 bp, Homo sapiens
tgggcctggcctgagctggg

SEQ ID NO: 2010653 - DNA, 23 bp, Homo sapiens
tgggcctggcctgagctggggcc

SEQ ID NO: 2010654 - DNA, 16 bp, Homo sapiens
tgggcctgggcctgct

SEQ ID NO: 2010655 - DNA, 16 bp, Homo sapiens
tgggcctgtgcagcag

SEQ ID NO: 2010656 - DNA, 18 bp, Homo sapiens
tgggcctgtgcagcagcc

SEQ ID NO: 2010657 - DNA, 20 bp, Homo sapiens
tgggcctgtgcagcagccca

SEQ ID NO: 2010658 - DNA, 22 bp, Homo sapiens
tgggcctgtgcagcagcccagc

SEQ ID NO: 2010659 - DNA, 17 bp, Homo sapiens
tgggccttgctttgggc

SEQ ID NO: 2010660 - DNA, 14 bp, Homo sapiens
tgggcctttcctgt

SEQ ID NO: 2010661 - DNA, 19 bp, Homo sapiens
tgggcctttcctgtgccaa

SEQ ID NO: 2010662 - DNA, 22 bp, Homo sapiens
tgggcgctctgccctccctggc

SEQ ID NO: 2010663 - DNA, 18 bp, Homo sapiens
tgggcgtttgtaaattct

SEQ ID NO: 2010664 - DNA, 13 bp, Homo sapiens
tgggctactggca

SEQ ID NO: 2010665 - DNA, 19 bp, Homo sapiens
tgggctactggcagctcct

SEQ ID NO: 2010666 - DNA, 22 bp, Homo sapiens
tgggctagggagaatgcagaga

SEQ ID NO: 2010667 - DNA, 21 bp, Homo sapiens
tgggctagtgtgagtggcagc

SEQ ID NO: 2010668 - DNA, 16 bp, Homo sapiens
tgggctagttgggctt

SEQ ID NO: 2010669 - DNA, 22 bp, Homo sapiens
tgggctcaagcagtcctcccac

SEQ ID NO: 2010670 - DNA, 15 bp, Homo sapiens
tgggctcagggctgg

SEQ ID NO: 2010671 - DNA, 17 bp, Homo sapiens
tgggctcctggaaccaa

SEQ ID NO: 2010672 - DNA, 14 bp, Homo sapiens
tgggctcctggctg

SEQ ID NO: 2010673 - DNA, 16 bp, Homo sapiens
tgggctctccacctca

SEQ ID NO: 2010674 - DNA, 17 bp, Homo sapiens
tgggctctccacctcag

SEQ ID NO: 2010675 - DNA, 20 bp, Homo sapiens
tgggctctccacctcagcct

SEQ ID NO: 2010676 - DNA, 23 bp, Homo sapiens
tgggctctccacctcagccttgg

SEQ ID NO: 2010677 - DNA, 12 bp, Homo sapiens
tgggctctgccc

SEQ ID NO: 2010678 - DNA, 18 bp, Homo sapiens
tgggctgaactgagccta

SEQ ID NO: 2010679 - DNA, 21 bp, Homo sapiens
tgggctgaactgagcctagct

SEQ ID NO: 2010680 - DNA, 21 bp, Homo sapiens
tgggctgacacctaccatgct

SEQ ID NO: 2010681 - DNA, 13 bp, Homo sapiens
tgggctgcctggg

SEQ ID NO: 2010682 - DNA, 17 bp, Homo sapiens
tgggctggtgtcacctg

SEQ ID NO: 2010683 - DNA, 12 bp, Homo sapiens
tgggctgtctgt

SEQ ID NO: 2010684 - DNA, 14 bp, Homo sapiens
tgggctgtctgtca

SEQ ID NO: 2010685 - DNA, 16 bp, Homo sapiens
tgggctgtctgtcacc

SEQ ID NO: 2010686 - DNA, 15 bp, Homo sapiens
tgggcttcagtggca

SEQ ID NO: 2010687 - DNA, 18 bp, Homo sapiens
tgggcttcagtggcagct

SEQ ID NO: 2010688 - DNA, 19 bp, Homo sapiens
tgggcttcagtggcagctg

SEQ ID NO: 2010689 - DNA, 20 bp, Homo sapiens
tgggcttcagtggcagctgc

SEQ ID NO: 2010690 - DNA, 20 bp, Homo sapiens
tgggcttctgaaacttcata

SEQ ID NO: 2010691 - DNA, 14 bp, Homo sapiens
tgggcttgttttct

SEQ ID NO: 2010692 - DNA, 15 bp, Homo sapiens
tgggctttaacaaaa

SEQ ID NO: 2010693 - DNA, 19 bp, Homo sapiens
tgggctttaacaaaacaag

SEQ ID NO: 2010694 - DNA, 16 bp, Homo sapiens
tgggctttgatttcca

SEQ ID NO: 2010695 - DNA, 14 bp, Homo sapiens
tgggctttgcaggc

SEQ ID NO: 2010696 - DNA, 17 bp, Homo sapiens
tgggctttgcaggctct

SEQ ID NO: 2010697 - DNA, 22 bp, Homo sapiens
tgggctttgcaggctctgggct

SEQ ID NO: 2010698 - DNA, 14 bp, Homo sapiens
tggggaagactgtg

SEQ ID NO: 2010699 - DNA, 24 bp, Homo sapiens
tggggaagactgtggctgctagca

SEQ ID NO: 2010700 - DNA, 21 bp, Homo sapiens
tggggaagcaagacgtcctgg

SEQ ID NO: 2010701 - DNA, 19 bp, Homo sapiens
tggggaagtgctccccaca

SEQ ID NO: 2010702 - DNA, 12 bp, Homo sapiens
tggggacactaa

SEQ ID NO: 2010703 - DNA, 12 bp, Homo sapiens
tggggagaaagt

SEQ ID NO: 2010704 - DNA, 19 bp, Homo sapiens
tggggagaaataaattttg

SEQ ID NO: 2010705 - DNA, 22 bp, Homo sapiens
tggggagcagagtataggatgg

SEQ ID NO: 2010706 - DNA, 16 bp, Homo sapiens
tggggaggaagggcca

SEQ ID NO: 2010707 - DNA, 23 bp, Homo sapiens
tggggaggaagggccaggagaga

SEQ ID NO: 2010708 - DNA, 15 bp, Homo sapiens
tggggaggcagctcc

SEQ ID NO: 2010709 - DNA, 16 bp, Homo sapiens
tggggaggcagctcca

SEQ ID NO: 2010710 - DNA, 14 bp, Homo sapiens
tggggagggggaag

SEQ ID NO: 2010711 - DNA, 16 bp, Homo sapiens
tggggagttataaaaa

SEQ ID NO: 2010712 - DNA, 17 bp, Homo sapiens
tggggagttataaaaat

SEQ ID NO: 2010713 - DNA, 14 bp, Homo sapiens
tggggatgtgggag

SEQ ID NO: 2010714 - DNA, 15 bp, Homo sapiens
tggggatgtgggagg

SEQ ID NO: 2010715 - DNA, 16 bp, Homo sapiens
tggggattgggaggga

SEQ ID NO: 2010716 - DNA, 19 bp, Homo sapiens
tggggcaagtccctgactc

SEQ ID NO: 2010717 - DNA, 14 bp, Homo sapiens
tggggcagaggggc

SEQ ID NO: 2010718 - DNA, 16 bp, Homo sapiens
tggggcagctcctctg

SEQ ID NO: 2010719 - DNA, 20 bp, Homo sapiens
tggggcagctcctctgtctc

SEQ ID NO: 2010720 - DNA, 20 bp, Homo sapiens
tggggcaggagtagctgagc

SEQ ID NO: 2010721 - DNA, 17 bp, Homo sapiens
tggggcaggctggctgg

SEQ ID NO: 2010722 - DNA, 16 bp, Homo sapiens
tggggcatagaaactg

SEQ ID NO: 2010723 - DNA, 21 bp, Homo sapiens
tggggcatggttccttccctg

SEQ ID NO: 2010724 - DNA, 16 bp, Homo sapiens
tggggcatgtgtgcct

SEQ ID NO: 2010725 - DNA, 17 bp, Homo sapiens
tggggcatgtgtgcctg

SEQ ID NO: 2010726 - DNA, 18 bp, Homo sapiens
tggggcatgtgtgcctgt

SEQ ID NO: 2010727 - DNA, 15 bp, Homo sapiens
tggggccctgggcct

SEQ ID NO: 2010728 - DNA, 17 bp, Homo sapiens
tggggccctgggcctca

SEQ ID NO: 2010729 - DNA, 19 bp, Homo sapiens
tggggcctggagaggggcc

SEQ ID NO: 2010730 - DNA, 12 bp, Homo sapiens
tggggcctggct

SEQ ID NO: 2010731 - DNA, 22 bp, Homo sapiens
tggggcctggcttgctccaggg

SEQ ID NO: 2010732 - DNA, 23 bp, Homo sapiens
tggggcctggcttgctccagggt

SEQ ID NO: 2010733 - DNA, 19 bp, Homo sapiens
tggggcctgtactgcctgc

SEQ ID NO: 2010734 - DNA, 13 bp, Homo sapiens
tggtcgcccagga

SEQ ID NO: 2010735 - DNA, 15 bp, Homo sapiens
tggtcgcccaggaga

SEQ ID NO: 2010736 - DNA, 22 bp, Homo sapiens
tggtcggggagctggggtacag

SEQ ID NO: 2010737 - DNA, 23 bp, Homo sapiens
tggtctagtagcggatctcactc

SEQ ID NO: 2010738 - DNA, 14 bp, Homo sapiens
tggtctccctccag

SEQ ID NO: 2010739 - DNA, 12 bp, Homo sapiens
tggtctcctctg

SEQ ID NO: 2010740 - DNA, 15 bp, Homo sapiens
tggtctgctgacctg

SEQ ID NO: 2010741 - DNA, 17 bp, Homo sapiens
tggtcttgagatgtctt

SEQ ID NO: 2010742 - DNA, 14 bp, Homo sapiens
tggtctttcctctg

SEQ ID NO: 2010743 - DNA, 15 bp, Homo sapiens
tggtgaaaatgtact

SEQ ID NO: 2010744 - DNA, 24 bp, Homo sapiens
tggtgaaaccctgtctctactaaa

SEQ ID NO: 2010745 - DNA, 11 bp, Homo sapiens
tggtgaaatta

SEQ ID NO: 2010746 - DNA, 18 bp, Homo sapiens
tggtgaaatttattagtt

SEQ ID NO: 2010747 - DNA, 19 bp, Homo sapiens
tggtgaaatttattagtta

SEQ ID NO: 2010748 - DNA, 13 bp, Homo sapiens
tggtgaagagtag

SEQ ID NO: 2010749 - DNA, 17 bp, Homo sapiens
tggtgacacacagcagc

SEQ ID NO: 2010750 - DNA, 17 bp, Homo sapiens
tggtgacatgtgcctgt

SEQ ID NO: 2010751 - DNA, 13 bp, Homo sapiens
tggtgacctctgc

SEQ ID NO: 2010752 - DNA, 17 bp, Homo sapiens
tggtgacctctgcctga

SEQ ID NO: 2010753 - DNA, 21 bp, Homo sapiens
tggtgagctgggaagctgtac

SEQ ID NO: 2010754 - DNA, 18 bp, Homo sapiens
tggtgaggcccagcctgt

SEQ ID NO: 2010755 - DNA, 12 bp, Homo sapiens
tggtgatggagt

SEQ ID NO: 2010756 - DNA, 20 bp, Homo sapiens
tggtgcagaaaaaaaaaaag

SEQ ID NO: 2010757 - DNA, 18 bp, Homo sapiens
tggtgcaggatggctttg

SEQ ID NO: 2010758 - DNA, 23 bp, Homo sapiens
tggtgccacttcttaaaggcctg

SEQ ID NO: 2010759 - DNA, 17 bp, Homo sapiens
tggtgcccatcctcccg

SEQ ID NO: 2010760 - DNA, 17 bp, Homo sapiens
tggtgcctggcctggca

SEQ ID NO: 2010761 - DNA, 14 bp, Homo sapiens
tggtgctaactgta

SEQ ID NO: 2010762 - DNA, 23 bp, Homo sapiens
tggtgctataggctggagaagct

SEQ ID NO: 2010763 - DNA, 22 bp, Homo sapiens
tggtgctcacgactcttcctgc

SEQ ID NO: 2010764 - DNA, 18 bp, Homo sapiens
tggtgctgccacacttca

SEQ ID NO: 2010765 - DNA, 13 bp, Homo sapiens
tggtgctgtggcc

SEQ ID NO: 2010766 - DNA, 17 bp, Homo sapiens
tggtgctttcaggtctg

SEQ ID NO: 2010767 - DNA, 21 bp, Homo sapiens
tggtggcaccagatgcaacct

SEQ ID NO: 2010768 - DNA, 13 bp, Homo sapiens
tggtggcagctgc

SEQ ID NO: 2010769 - DNA, 14 bp, Homo sapiens
tggtggcagctgcg

SEQ ID NO: 2010770 - DNA, 17 bp, Homo sapiens
tggtggcgcaagcctgt

SEQ ID NO: 2010771 - DNA, 17 bp, Homo sapiens
tggtggcgggcacctgt

SEQ ID NO: 2010772 - DNA, 15 bp, Homo sapiens
tggtgggagggggag

SEQ ID NO: 2010773 - DNA, 12 bp, Homo sapiens
tggtgggctggc

SEQ ID NO: 2010774 - DNA, 14 bp, Homo sapiens
tggtgggctggccc

SEQ ID NO: 2010775 - DNA, 18 bp, Homo sapiens
tggtgggctggcccagcc

SEQ ID NO: 2010776 - DNA, 12 bp, Homo sapiens
tggtgtaatgca

SEQ ID NO: 2010777 - DNA, 17 bp, Homo sapiens
tggtgtaatgcacaatt

SEQ ID NO: 2010778 - DNA, 18 bp, Homo sapiens
tggtgtagctcctctgct

SEQ ID NO: 2010779 - DNA, 21 bp, Homo sapiens
tggtgtatttttcaggtaggc

SEQ ID NO: 2010780 - DNA, 14 bp, Homo sapiens
tggtgtcaggcagg

SEQ ID NO: 2010781 - DNA, 14 bp, Homo sapiens
tggtgtccacctgg

SEQ ID NO: 2010782 - DNA, 17 bp, Homo sapiens
tggtgtccacctggccc

SEQ ID NO: 2010783 - DNA, 18 bp, Homo sapiens
tggtgtccagacagagcc

SEQ ID NO: 2010784 - DNA, 13 bp, Homo sapiens
tggtgtccctgcg

SEQ ID NO: 2010785 - DNA, 15 bp, Homo sapiens
tggtgtgaaagtcag

SEQ ID NO: 2010786 - DNA, 18 bp, Homo sapiens
tggtgtgaccctctgaat

SEQ ID NO: 2010787 - DNA, 11 bp, Homo sapiens
tggtgtgtttc

SEQ ID NO: 2010788 - DNA, 16 bp, Homo sapiens
tggttactctggtgct

SEQ ID NO: 2010789 - DNA, 15 bp, Homo sapiens
tggttcacactgacc

SEQ ID NO: 2010790 - DNA, 15 bp, Homo sapiens
tggttccatgcctga

SEQ ID NO: 2010791 - DNA, 19 bp, Homo sapiens
tggttccatgcctgagggt

SEQ ID NO: 2010792 - DNA, 22 bp, Homo sapiens
tggttccatgcctgagggtgga

SEQ ID NO: 2010793 - DNA, 20 bp, Homo sapiens
tggttcccaataaaagtgac

SEQ ID NO: 2010794 - DNA, 18 bp, Homo sapiens
tggttcccctgttcactc

SEQ ID NO: 2010795 - DNA, 14 bp, Homo sapiens
tggttcctctacta

SEQ ID NO: 2010796 - DNA, 16 bp, Homo sapiens
tggttccttccctggg

SEQ ID NO: 2010797 - DNA, 16 bp, Homo sapiens
tggttgtcactctaca

SEQ ID NO: 2010798 - DNA, 22 bp, Homo sapiens
tggttgttgcaccatctgcttg

SEQ ID NO: 2010799 - DNA, 19 bp, Homo sapiens
tggtttagcacaatttata

SEQ ID NO: 2010800 - DNA, 18 bp, Homo sapiens
tggtttagtgttctgtat

SEQ ID NO: 2010801 - DNA, 17 bp, Homo sapiens
tggtttcccaagagcta

SEQ ID NO: 2010802 - DNA, 19 bp, Homo sapiens
tggtttctgcgtgctttat

SEQ ID NO: 2010803 - DNA, 15 bp, Homo sapiens
tggtttgcaaggaag

SEQ ID NO: 2010804 - DNA, 17 bp, Homo sapiens
tggtttgcaaggaagcc

SEQ ID NO: 2010805 - DNA, 16 bp, Homo sapiens
tggttttcctaaatgc

SEQ ID NO: 2010806 - DNA, 20 bp, Homo sapiens
tggttttctccaagagctac

SEQ ID NO: 2010807 - DNA, 17 bp, Homo sapiens
tgtaaaaacaaaaagac

SEQ ID NO: 2010808 - DNA, 21 bp, Homo sapiens
tgtaaaaccatgtagttttaa

SEQ ID NO: 2010809 - DNA, 14 bp, Homo sapiens
tgtaaaataagtat

SEQ ID NO: 2010810 - DNA, 17 bp, Homo sapiens
tgtaaaatagcttgtat

SEQ ID NO: 2010811 - DNA, 21 bp, Homo sapiens
tgtaaaatagcttgtatagtg

SEQ ID NO: 2010812 - DNA, 21 bp, Homo sapiens
tgtaaaatcttggcacagaaa

SEQ ID NO: 2010813 - DNA, 15 bp, Homo sapiens
tgtaaaatgaaatta

SEQ ID NO: 2010814 - DNA, 18 bp, Homo sapiens
tgtaaaatgcagtccaga

SEQ ID NO: 2010815 - DNA, 14 bp, Homo sapiens
tgtaaaattgtata

SEQ ID NO: 2010816 - DNA, 21 bp, Homo sapiens
tgtaaaatttatacacacaaa

SEQ ID NO: 2010817 - DNA, 16 bp, Homo sapiens
tgtaaaatttgtttag

SEQ ID NO: 2010818 - DNA, 20 bp, Homo sapiens
tgtaaacaggagacaggaag

SEQ ID NO: 2010819 - DNA, 17 bp, Homo sapiens
tgtaaacagtgcctgct

SEQ ID NO: 2010820 - DNA, 22 bp, Homo sapiens
tgtaaacatgtgttttaattcc

SEQ ID NO: 2010821 - DNA, 17 bp, Homo sapiens
tgtaaacattcatcaag

SEQ ID NO: 2010822 - DNA, 23 bp, Homo sapiens
tgtaaactataaactactgtaat

SEQ ID NO: 2010823 - DNA, 18 bp, Homo sapiens
tgtaaactgcattagaaa

SEQ ID NO: 2010824 - DNA, 13 bp, Homo sapiens
tgtaaagcttgtc

SEQ ID NO: 2010825 - DNA, 19 bp, Homo sapiens
tgtaaagtaggaaaaataa

SEQ ID NO: 2010826 - DNA, 18 bp, Homo sapiens
tgtaaagtatgtaaacag

SEQ ID NO: 2010827 - DNA, 16 bp, Homo sapiens
tgtaaagtgtaaatcc

SEQ ID NO: 2010828 - DNA, 17 bp, Homo sapiens
tgtaaagtgtaaatcct

SEQ ID NO: 2010829 - DNA, 10 bp, Homo sapiens
tgtaaataaa

SEQ ID NO: 2010830 - DNA, 13 bp, Homo sapiens
tgtaaatacaaaa

SEQ ID NO: 2010831 - DNA, 12 bp, Homo sapiens
tgtaaatacacc

SEQ ID NO: 2010832 - DNA, 15 bp, Homo sapiens
tgtaaatacatgtgt

SEQ ID NO: 2010833 - DNA, 20 bp, Homo sapiens
tgtaaatagttttaaatatg

SEQ ID NO: 2010834 - DNA, 14 bp, Homo sapiens
tgtaaatattgtgt

SEQ ID NO: 2010835 - DNA, 17 bp, Homo sapiens
tgtaaatcacttgtaaa

SEQ ID NO: 2010836 - DNA, 19 bp, Homo sapiens
tgtaaatcacttgtaaata

SEQ ID NO: 2010837 - DNA, 20 bp, Homo sapiens
tgtaaatcacttgtaaataa

SEQ ID NO: 2010838 - DNA, 21 bp, Homo sapiens
tgtaaatcacttgtaaataaa

SEQ ID NO: 2010839 - DNA, 12 bp, Homo sapiens
tgtaaatccttt

SEQ ID NO: 2010840 - DNA, 20 bp, Homo sapiens
tgtaaatcctttttctttat

SEQ ID NO: 2010841 - DNA, 22 bp, Homo sapiens
tgtaaatcctttttctttataa

SEQ ID NO: 2010842 - DNA, 21 bp, Homo sapiens
tgtaaatgaccaagaaaaaga

SEQ ID NO: 2010843 - DNA, 23 bp, Homo sapiens
tgtaaatgaccaagaaaaagaaa

SEQ ID NO: 2010844 - DNA, 22 bp, Homo sapiens
tgtaaatgctgtcaactatgat

SEQ ID NO: 2010845 - DNA, 18 bp, Homo sapiens
tgtaaatggagcttgtac

SEQ ID NO: 2010846 - DNA, 20 bp, Homo sapiens
tgtaaatggagcttgtacat

SEQ ID NO: 2010847 - DNA, 15 bp, Homo sapiens
tgtaaattatttcat

SEQ ID NO: 2010848 - DNA, 15 bp, Homo sapiens
tgtaaatttggattt

SEQ ID NO: 2010849 - DNA, 23 bp, Homo sapiens
tgtcctgttattttttatttcca

SEQ ID NO: 2010850 - DNA, 14 bp, Homo sapiens
tgtccttcagagct

SEQ ID NO: 2010851 - DNA, 15 bp, Homo sapiens
tgtccttcagagctc

SEQ ID NO: 2010852 - DNA, 16 bp, Homo sapiens
tgtccttcagagctct

SEQ ID NO: 2010853 - DNA, 14 bp, Homo sapiens
tgtcctttgagaaa

SEQ ID NO: 2010854 - DNA, 22 bp, Homo sapiens
tgtcctttgagaaagaaataat

SEQ ID NO: 2010855 - DNA, 14 bp, Homo sapiens
tgtccttttaggaa

SEQ ID NO: 2010856 - DNA, 20 bp, Homo sapiens
tgtcgattagactggacagc

SEQ ID NO: 2010857 - DNA, 23 bp, Homo sapiens
tgtcgattagactggacagcttg

SEQ ID NO: 2010858 - DNA, 15 bp, Homo sapiens
tgtcgcccagtctgg

SEQ ID NO: 2010859 - DNA, 21 bp, Homo sapiens
tgtcgccccaggccctccctg

SEQ ID NO: 2010860 - DNA, 13 bp, Homo sapiens
tgtcgcctgcccc

SEQ ID NO: 2010861 - DNA, 16 bp, Homo sapiens
tgtcgtgtttacaaaa

SEQ ID NO: 2010862 - DNA, 19 bp, Homo sapiens
tgtctaaagagctttagtc

SEQ ID NO: 2010863 - DNA, 13 bp, Homo sapiens
tgtctacctcaca

SEQ ID NO: 2010864 - DNA, 14 bp, Homo sapiens
tgtctatgggactc

SEQ ID NO: 2010865 - DNA, 15 bp, Homo sapiens
tgtctatgggactca

SEQ ID NO: 2010866 - DNA, 16 bp, Homo sapiens
tgtctatgggactcaa

SEQ ID NO: 2010867 - DNA, 18 bp, Homo sapiens
tgtctattacctgttagt

SEQ ID NO: 2010868 - DNA, 19 bp, Homo sapiens
tgtctattcaaaatatcaa

SEQ ID NO: 2010869 - DNA, 19 bp, Homo sapiens
tgtctcaagagggcactgg

SEQ ID NO: 2010870 - DNA, 20 bp, Homo sapiens
tgtctcagcgaggtgtaaag

SEQ ID NO: 2010871 - DNA, 15 bp, Homo sapiens
tgtctcagtgctggt

SEQ ID NO: 2010872 - DNA, 22 bp, Homo sapiens
tgtctccactaaatgagctcct

SEQ ID NO: 2010873 - DNA, 23 bp, Homo sapiens
tgtctccactaaatgagctcctg

SEQ ID NO: 2010874 - DNA, 15 bp, Homo sapiens
tgtctccataatgcc

SEQ ID NO: 2010875 - DNA, 19 bp, Homo sapiens
tgtctccataatgccactg

SEQ ID NO: 2010876 - DNA, 22 bp, Homo sapiens
tgtctcctacctgctgctgcta

SEQ ID NO: 2010877 - DNA, 15 bp, Homo sapiens
tgtctcgagcgccct

SEQ ID NO: 2010878 - DNA, 17 bp, Homo sapiens
tgtctcgagcgccctgc

SEQ ID NO: 2010879 - DNA, 20 bp, Homo sapiens
tgtctcgtctcctgacatgt

SEQ ID NO: 2010880 - DNA, 15 bp, Homo sapiens
tgtctctagccgggc

SEQ ID NO: 2010881 - DNA, 22 bp, Homo sapiens
tgtctctagccgggccatgctt

SEQ ID NO: 2010882 - DNA, 21 bp, Homo sapiens
tgtctctcattctctttcttt

SEQ ID NO: 2010883 - DNA, 18 bp, Homo sapiens
tgtctctcccaccccggc

SEQ ID NO: 2010884 - DNA, 15 bp, Homo sapiens
tgtctctcttgcttt

SEQ ID NO: 2010885 - DNA, 20 bp, Homo sapiens
tgtctctgctcttgcctgca

SEQ ID NO: 2010886 - DNA, 19 bp, Homo sapiens
tgtctctgtccctcactgc

SEQ ID NO: 2010887 - DNA, 14 bp, Homo sapiens
tgtctcttgtagaa

SEQ ID NO: 2010888 - DNA, 18 bp, Homo sapiens
tgtctcttgtagaagatg

SEQ ID NO: 2010889 - DNA, 20 bp, Homo sapiens
tgtctgaagtcactgcacag

SEQ ID NO: 2010890 - DNA, 16 bp, Homo sapiens
tgtctgaggcctcatc

SEQ ID NO: 2010891 - DNA, 21 bp, Homo sapiens
tgtctgatcgttcaaagcatg

SEQ ID NO: 2010892 - DNA, 15 bp, Homo sapiens
tgtctgccagccagc

SEQ ID NO: 2010893 - DNA, 22 bp, Homo sapiens
tgtctgcccccgtcttctctcc

SEQ ID NO: 2010894 - DNA, 23 bp, Homo sapiens
tgtctgcttagtatctcatcaac

SEQ ID NO: 2010895 - DNA, 13 bp, Homo sapiens
tgtctgcttctgt

SEQ ID NO: 2010896 - DNA, 17 bp, Homo sapiens
tgtctggaaaagcactt

SEQ ID NO: 2010897 - DNA, 14 bp, Homo sapiens
tgtctggaagctga

SEQ ID NO: 2010898 - DNA, 17 bp, Homo sapiens
tgtctggaagctgagca

SEQ ID NO: 2010899 - DNA, 16 bp, Homo sapiens
tgtctggttttaacaa

SEQ ID NO: 2010900 - DNA, 13 bp, Homo sapiens
tgtctgtaagaga

SEQ ID NO: 2010901 - DNA, 18 bp, Homo sapiens
tgtctgtaagagaattct

SEQ ID NO: 2010902 - DNA, 19 bp, Homo sapiens
tgtctgtacacgtgtcctg

SEQ ID NO: 2010903 - DNA, 20 bp, Homo sapiens
tgtctgtacacgtgtcctgt

SEQ ID NO: 2010904 - DNA, 16 bp, Homo sapiens
tgtctgtctgtctgtc

SEQ ID NO: 2010905 - DNA, 13 bp, Homo sapiens
tgtctgtgcagct

SEQ ID NO: 2010906 - DNA, 15 bp, Homo sapiens
tgtctgtggattttt

SEQ ID NO: 2010907 - DNA, 14 bp, Homo sapiens
tgtcttcacaacag

SEQ ID NO: 2010908 - DNA, 19 bp, Homo sapiens
tgtcttcatttcattgtat

SEQ ID NO: 2010909 - DNA, 18 bp, Homo sapiens
tgtcttccaaccccagct

SEQ ID NO: 2010910 - DNA, 22 bp, Homo sapiens
tgtcttccaaccccagctggcc

SEQ ID NO: 2010911 - DNA, 22 bp, Homo sapiens
tgtcttcctagtatattagttt

SEQ ID NO: 2010912 - DNA, 11 bp, Homo sapiens
tgtcttctctc

SEQ ID NO: 2010913 - DNA, 21 bp, Homo sapiens
tgtcttctctcaaagggaagc

SEQ ID NO: 2010914 - DNA, 15 bp, Homo sapiens
tgtcttgcaatggca

SEQ ID NO: 2010915 - DNA, 20 bp, Homo sapiens
tgtcttgcaatggcagcctt

SEQ ID NO: 2010916 - DNA, 16 bp, Homo sapiens
tgtcttgccagccaga

SEQ ID NO: 2010917 - DNA, 16 bp, Homo sapiens
tgtcttgtacatgtgt

SEQ ID NO: 2010918 - DNA, 20 bp, Homo sapiens
tgtcttgtacatgtgtagcc

SEQ ID NO: 2010919 - DNA, 14 bp, Homo sapiens
tgtctttaaggaaa

SEQ ID NO: 2010920 - DNA, 21 bp, Homo sapiens
tgtctttaggcagcagctttt

SEQ ID NO: 2010921 - DNA, 19 bp, Homo sapiens
tgtctttcagcattaggct

SEQ ID NO: 2010922 - DNA, 16 bp, Homo sapiens
tgtcttttttcactac

SEQ ID NO: 2010923 - DNA, 19 bp, Homo sapiens
tgtgaaaatcatgaaaaga

SEQ ID NO: 2010924 - DNA, 16 bp, Homo sapiens
tgtgaaagtatgtgat

SEQ ID NO: 2010925 - DNA, 14 bp, Homo sapiens
tgtgaacatggact

SEQ ID NO: 2010926 - DNA, 16 bp, Homo sapiens
tgtgaaccaccacacc

SEQ ID NO: 2010927 - DNA, 19 bp, Homo sapiens
tgtgaaccaccacacccag

SEQ ID NO: 2010928 - DNA, 22 bp, Homo sapiens
tgtgaaccaccacacccagccc

SEQ ID NO: 2010929 - DNA, 13 bp, Homo sapiens
tgtgaacccagga

SEQ ID NO: 2010930 - DNA, 13 bp, Homo sapiens
tgtgaagaaatgg

SEQ ID NO: 2010931 - DNA, 13 bp, Homo sapiens
tgtgaagacccag

SEQ ID NO: 2010932 - DNA, 17 bp, Homo sapiens
tgtgaagacccagcagg

SEQ ID NO: 2010933 - DNA, 22 bp, Homo sapiens
tgtgaagttacacaattaattg

SEQ ID NO: 2010934 - DNA, 14 bp, Homo sapiens
tgtgaatcagaccc

SEQ ID NO: 2010935 - DNA, 18 bp, Homo sapiens
tgtgaattaaaaaagctc

SEQ ID NO: 2010936 - DNA, 22 bp, Homo sapiens
tgtgaattcccaggttggcctg

SEQ ID NO: 2010937 - DNA, 12 bp, Homo sapiens
tgtgacaaaatt

SEQ ID NO: 2010938 - DNA, 15 bp, Homo sapiens
tgtgacaacctttgt

SEQ ID NO: 2010939 - DNA, 18 bp, Homo sapiens
tgtgacaccagaataatg

SEQ ID NO: 2010940 - DNA, 16 bp, Homo sapiens
tgtgacagaatcttgt

SEQ ID NO: 2010941 - DNA, 20 bp, Homo sapiens
tgtgacagaatcttgtattt

SEQ ID NO: 2010942 - DNA, 21 bp, Homo sapiens
tgtgacaggaagcccaaggca

SEQ ID NO: 2010943 - DNA, 22 bp, Homo sapiens
tgtgacaggaagcccaaggcag

SEQ ID NO: 2010944 - DNA, 13 bp, Homo sapiens
tgtgaccaagtta

SEQ ID NO: 2010945 - DNA, 21 bp, Homo sapiens
tgtgaccacatacgtgttagg

SEQ ID NO: 2010946 - DNA, 21 bp, Homo sapiens
tgtgacccagatcctcacaac

SEQ ID NO: 2010947 - DNA, 15 bp, Homo sapiens
tgtgacctgctgagc

SEQ ID NO: 2010948 - DNA, 22 bp, Homo sapiens
tgtgacctgctgagctctgaga

SEQ ID NO: 2010949 - DNA, 14 bp, Homo sapiens
tgtgaccttctcta

SEQ ID NO: 2010950 - DNA, 15 bp, Homo sapiens
tgtgactccagcctg

SEQ ID NO: 2010951 - DNA, 12 bp, Homo sapiens
tgtgactctctt

SEQ ID NO: 2010952 - DNA, 13 bp, Homo sapiens
tgtgactgaaggg

SEQ ID NO: 2010953 - DNA, 15 bp, Homo sapiens
tgtgagaagaaatga

SEQ ID NO: 2010954 - DNA, 19 bp, Homo sapiens
tgtgagcaagcatttatgt

SEQ ID NO: 2010955 - DNA, 14 bp, Homo sapiens
tgtgagcagtgagt

SEQ ID NO: 2010956 - DNA, 12 bp, Homo sapiens
tgtgagcccctg

SEQ ID NO: 2010957 - DNA, 14 bp, Homo sapiens
tgtgagcccctggt

SEQ ID NO: 2010958 - DNA, 22 bp, Homo sapiens
tgtgagcccctggtcctgaggg

SEQ ID NO: 2010959 - DNA, 18 bp, Homo sapiens
tgtgaggcctggccaggc

SEQ ID NO: 2010960 - DNA, 15 bp, Homo sapiens
tgtgaggctgggcca

SEQ ID NO: 2010961 - DNA, 17 bp, Homo sapiens
tgtgaggctgggccagc

SEQ ID NO: 2010962 - DNA, 19 bp, Homo sapiens
tgtgaggctgggccagcct

SEQ ID NO: 2010963 - DNA, 15 bp, Homo sapiens
tgtgagtcaccaagc

SEQ ID NO: 2010964 - DNA, 20 bp, Homo sapiens
tgttacctttcccatgctga

SEQ ID NO: 2010965 - DNA, 14 bp, Homo sapiens
tgttactccacagc

SEQ ID NO: 2010966 - DNA, 21 bp, Homo sapiens
tgttactgattctcctgtcag

SEQ ID NO: 2010967 - DNA, 15 bp, Homo sapiens
tgttacttaaatagc

SEQ ID NO: 2010968 - DNA, 13 bp, Homo sapiens
tgttactttggaa

SEQ ID NO: 2010969 - DNA, 17 bp, Homo sapiens
tgttactttttagtctt

SEQ ID NO: 2010970 - DNA, 20 bp, Homo sapiens
tgttactttttagtctttta

SEQ ID NO: 2010971 - DNA, 19 bp, Homo sapiens
tgttaggaggctgcatgct

SEQ ID NO: 2010972 - DNA, 23 bp, Homo sapiens
tgttaggaggctgcatgctctgg

SEQ ID NO: 2010973 - DNA, 22 bp, Homo sapiens
tgttatcaaacaccaacataaa

SEQ ID NO: 2010974 - DNA, 14 bp, Homo sapiens
tgttatccacaagc

SEQ ID NO: 2010975 - DNA, 23 bp, Homo sapiens
tgttatcctgctagctgtagaaa

SEQ ID NO: 2010976 - DNA, 19 bp, Homo sapiens
tgttatgtatatagatgtg

SEQ ID NO: 2010977 - DNA, 15 bp, Homo sapiens
tgttattaatattgt

SEQ ID NO: 2010978 - DNA, 20 bp, Homo sapiens
tgttattatcctgcatttta

SEQ ID NO: 2010979 - DNA, 21 bp, Homo sapiens
tgttatttctatttttgtaga

SEQ ID NO: 2010980 - DNA, 18 bp, Homo sapiens
tgttattttcagtatttt

SEQ ID NO: 2010981 - DNA, 19 bp, Homo sapiens
tgttattttctttgaaatt

SEQ ID NO: 2010982 - DNA, 16 bp, Homo sapiens
tgttcacagccagact

SEQ ID NO: 2010983 - DNA, 16 bp, Homo sapiens
tgttcaccatcggcag

SEQ ID NO: 2010984 - DNA, 19 bp, Homo sapiens
tgttcacttttcctccctc

SEQ ID NO: 2010985 - DNA, 22 bp, Homo sapiens
tgttcagaaggttgctctagat

SEQ ID NO: 2010986 - DNA, 22 bp, Homo sapiens
tgttcagctccagctcaccagc

SEQ ID NO: 2010987 - DNA, 15 bp, Homo sapiens
tgttcatccaaggaa

SEQ ID NO: 2010988 - DNA, 14 bp, Homo sapiens
tgttcatggcagat

SEQ ID NO: 2010989 - DNA, 15 bp, Homo sapiens
tgttcattcactgca

SEQ ID NO: 2010990 - DNA, 13 bp, Homo sapiens
tgttcatttcctc

SEQ ID NO: 2010991 - DNA, 22 bp, Homo sapiens
tgttcccaagagcatcatgcct

SEQ ID NO: 2010992 - DNA, 13 bp, Homo sapiens
tgttcccacacac

SEQ ID NO: 2010993 - DNA, 16 bp, Homo sapiens
tgttcccattcttgca

SEQ ID NO: 2010994 - DNA, 18 bp, Homo sapiens
tgttcccccgctggcagc

SEQ ID NO: 2010995 - DNA, 14 bp, Homo sapiens
tgttccctctttct

SEQ ID NO: 2010996 - DNA, 16 bp, Homo sapiens
tgttccctgcaccctg

SEQ ID NO: 2010997 - DNA, 20 bp, Homo sapiens
tgttccctgcaccctggaaa

SEQ ID NO: 2010998 - DNA, 22 bp, Homo sapiens
tgttcccttgaccattggctgc

SEQ ID NO: 2010999 - DNA, 17 bp, Homo sapiens
tgttcctggctttgaca

SEQ ID NO: 2011000 - DNA, 20 bp, Homo sapiens
tgttcgtattctattcaaaa

SEQ ID NO: 2011001 - DNA, 18 bp, Homo sapiens
tgttctactcatatatat

SEQ ID NO: 2011002 - DNA, 14 bp, Homo sapiens
tgttctatatgcat

SEQ ID NO: 2011003 - DNA, 18 bp, Homo sapiens
tgttctcaatgcttttct

SEQ ID NO: 2011004 - DNA, 21 bp, Homo sapiens
tgttctcagctccgtcatctg

SEQ ID NO: 2011005 - DNA, 22 bp, Homo sapiens
tgttctccgggtgtggcctcag

SEQ ID NO: 2011006 - DNA, 22 bp, Homo sapiens
tgttctcctccattgctgttgt

SEQ ID NO: 2011007 - DNA, 16 bp, Homo sapiens
tgttctctgaggacac

SEQ ID NO: 2011008 - DNA, 18 bp, Homo sapiens
tgttctgaataatttctt

SEQ ID NO: 2011009 - DNA, 12 bp, Homo sapiens
tgttctgcactg

SEQ ID NO: 2011010 - DNA, 15 bp, Homo sapiens
tgttctgcactgaaa

SEQ ID NO: 2011011 - DNA, 20 bp, Homo sapiens
tgttctggacctccccctct

SEQ ID NO: 2011012 - DNA, 16 bp, Homo sapiens
tgttctggagctgctg

SEQ ID NO: 2011013 - DNA, 16 bp, Homo sapiens
tgttctggctttacat

SEQ ID NO: 2011014 - DNA, 14 bp, Homo sapiens
tgttctgggacaca

SEQ ID NO: 2011015 - DNA, 15 bp, Homo sapiens
tgttctgggacacag

SEQ ID NO: 2011016 - DNA, 23 bp, Homo sapiens
tgttctgggtgttgaccactcca

SEQ ID NO: 2011017 - DNA, 12 bp, Homo sapiens
tgttctgtattt

SEQ ID NO: 2011018 - DNA, 20 bp, Homo sapiens
tgttctgtgggcttggcctt

SEQ ID NO: 2011019 - DNA, 14 bp, Homo sapiens
tgttctgttgtaaa

SEQ ID NO: 2011020 - DNA, 13 bp, Homo sapiens
tgttctttgggga

SEQ ID NO: 2011021 - DNA, 21 bp, Homo sapiens
tgttgaaaatgagcctgtaat

SEQ ID NO: 2011022 - DNA, 14 bp, Homo sapiens
tgttgaaattatgt

SEQ ID NO: 2011023 - DNA, 21 bp, Homo sapiens
tgttgaaattatgtatgttta

SEQ ID NO: 2011024 - DNA, 22 bp, Homo sapiens
tgttgaatgcccacaggcaaat

SEQ ID NO: 2011025 - DNA, 13 bp, Homo sapiens
tgttgagacagag

SEQ ID NO: 2011026 - DNA, 14 bp, Homo sapiens
tgttgagtgttcat

SEQ ID NO: 2011027 - DNA, 18 bp, Homo sapiens
tgttgagttggacacact

SEQ ID NO: 2011028 - DNA, 19 bp, Homo sapiens
tgttgagttggacacactg

SEQ ID NO: 2011029 - DNA, 19 bp, Homo sapiens
tgttgataaattccactgg

SEQ ID NO: 2011030 - DNA, 22 bp, Homo sapiens
tgttgatcccacttcactgtga

SEQ ID NO: 2011031 - DNA, 20 bp, Homo sapiens
tgttgattgcaggaataagg

SEQ ID NO: 2011032 - DNA, 17 bp, Homo sapiens
tgttgatttgagaaatt

SEQ ID NO: 2011033 - DNA, 17 bp, Homo sapiens
tgttgcaccatctgctt

SEQ ID NO: 2011034 - DNA, 19 bp, Homo sapiens
tgttgcaccatctgcttgg

SEQ ID NO: 2011035 - DNA, 17 bp, Homo sapiens
tgttgcagagatttcct

SEQ ID NO: 2011036 - DNA, 20 bp, Homo sapiens
tgttgccaactaagccctcg

SEQ ID NO: 2011037 - DNA, 14 bp, Homo sapiens
tgttgccatagccc

SEQ ID NO: 2011038 - DNA, 16 bp, Homo sapiens
tgttgccatgaggcct

SEQ ID NO: 2011039 - DNA, 20 bp, Homo sapiens
tgttgccatttctctgctta

SEQ ID NO: 2011040 - DNA, 12 bp, Homo sapiens
tgttgcccaggc

SEQ ID NO: 2011041 - DNA, 15 bp, Homo sapiens
tgttgcccaggcagg

SEQ ID NO: 2011042 - DNA, 15 bp, Homo sapiens
tgttgcccaggctgg

SEQ ID NO: 2011043 - DNA, 19 bp, Homo sapiens
tgttgcccaggctggcctg

SEQ ID NO: 2011044 - DNA, 20 bp, Homo sapiens
tgttgcccaggctggcgtgc

SEQ ID NO: 2011045 - DNA, 12 bp, Homo sapiens
tgttgccctggg

SEQ ID NO: 2011046 - DNA, 15 bp, Homo sapiens
tgttgccttagcact

SEQ ID NO: 2011047 - DNA, 18 bp, Homo sapiens
tgttgcgcacatccctgc

SEQ ID NO: 2011048 - DNA, 14 bp, Homo sapiens
tgttgctcttggaa

SEQ ID NO: 2011049 - DNA, 15 bp, Homo sapiens
tgttgctcttggaaa

SEQ ID NO: 2011050 - DNA, 14 bp, Homo sapiens
tgttgctgaaacac

SEQ ID NO: 2011051 - DNA, 12 bp, Homo sapiens
tgttgctggact

SEQ ID NO: 2011052 - DNA, 16 bp, Homo sapiens
tgttgcttagtcactt

SEQ ID NO: 2011053 - DNA, 20 bp, Homo sapiens
tgttgcttagtcacttattt

SEQ ID NO: 2011054 - DNA, 21 bp, Homo sapiens
tgttggaaaagaatacagaaa

SEQ ID NO: 2011055 - DNA, 16 bp, Homo sapiens
tgttggaattttcaaa

SEQ ID NO: 2011056 - DNA, 16 bp, Homo sapiens
tgttggacagctgctt

SEQ ID NO: 2011057 - DNA, 18 bp, Homo sapiens
tgttggacagctgcttgt

SEQ ID NO: 2011058 - DNA, 13 bp, Homo sapiens
tgttgggaaaaag

SEQ ID NO: 2011059 - DNA, 23 bp, Homo sapiens
tgttgggaaaaaggcctctgtcc

SEQ ID NO: 2011060 - DNA, 16 bp, Homo sapiens
tgttgggaattgcatg

SEQ ID NO: 2011061 - DNA, 14 bp, Homo sapiens
tgttgtaaatattt

SEQ ID NO: 2011062 - DNA, 21 bp, Homo sapiens
tgttgtaaatatttatgtaaa

SEQ ID NO: 2011063 - DNA, 13 bp, Homo sapiens
tgttgtaaatgac

SEQ ID NO: 2011064 - DNA, 17 bp, Homo sapiens
tgttgtaaatgaccaag

SEQ ID NO: 2011065 - DNA, 21 bp, Homo sapiens
tgttgtaaatgaccaagaaaa

SEQ ID NO: 2011066 - DNA, 22 bp, Homo sapiens
tgttgtaaatgaccaagaaaaa

SEQ ID NO: 2011067 - DNA, 15 bp, Homo sapiens
tgttgtagaataata

SEQ ID NO: 2011068 - DNA, 13 bp, Homo sapiens
tgttgtcaagtat

SEQ ID NO: 2011069 - DNA, 12 bp, Homo sapiens
tgttgtgattaa

SEQ ID NO: 2011070 - DNA, 21 bp, Homo sapiens
tgttgtgattttgtacagaat

SEQ ID NO: 2011071 - DNA, 17 bp, Homo sapiens
tgttgttaatgaaaatg

SEQ ID NO: 2011072 - DNA, 11 bp, Homo sapiens
tgttgttattt

SEQ ID NO: 2011073 - DNA, 13 bp, Homo sapiens
tgttgttatttaa

SEQ ID NO: 2011074 - DNA, 14 bp, Homo sapiens
tgttgttcccacac

SEQ ID NO: 2011075 - DNA, 21 bp, Homo sapiens
tgttgttcccacacacaaacc

SEQ ID NO: 2011076 - DNA, 20 bp, Homo sapiens
tgttgttttgttttaaatac

SEQ ID NO: 2011077 - DNA, 20 bp, Homo sapiens
tgtttaaaaaaagtatatat

SEQ ID NO: 2011078 - DNA, 19 bp, Homo sapiens
tgtttaaactttgtgcctt

SEQ ID NO: 2011079 - DNA, 13 bp, Homo sapiens
ttaattttcagta

SEQ ID NO: 2011080 - DNA, 15 bp, Homo sapiens
ttacaaaaatagtag

SEQ ID NO: 2011081 - DNA, 19 bp, Homo sapiens
ttacaaaaggcagcccttt

SEQ ID NO: 2011082 - DNA, 18 bp, Homo sapiens
ttacaaatttttcctgca

SEQ ID NO: 2011083 - DNA, 18 bp, Homo sapiens
ttacaacagtaacacatc

SEQ ID NO: 2011084 - DNA, 15 bp, Homo sapiens
ttacaacattcaact

SEQ ID NO: 2011085 - DNA, 21 bp, Homo sapiens
ttacaagaattgtccatgtgc

SEQ ID NO: 2011086 - DNA, 20 bp, Homo sapiens
ttacaagcgtgagccactgc

SEQ ID NO: 2011087 - DNA, 16 bp, Homo sapiens
ttacaagtgtatatca

SEQ ID NO: 2011088 - DNA, 23 bp, Homo sapiens
ttacaataaaatcttgaaaatgc

SEQ ID NO: 2011089 - DNA, 13 bp, Homo sapiens
ttacaataaatat

SEQ ID NO: 2011090 - DNA, 14 bp, Homo sapiens
ttacaataaatatt

SEQ ID NO: 2011091 - DNA, 13 bp, Homo sapiens
ttacacaattaat

SEQ ID NO: 2011092 - DNA, 23 bp, Homo sapiens
ttacacattctcacaattgtaaa

SEQ ID NO: 2011093 - DNA, 18 bp, Homo sapiens
ttacactctctgtacaaa

SEQ ID NO: 2011094 - DNA, 14 bp, Homo sapiens
ttacactgtatttg

SEQ ID NO: 2011095 - DNA, 17 bp, Homo sapiens
ttacactgtatttgtat

SEQ ID NO: 2011096 - DNA, 20 bp, Homo sapiens
ttacagaacacgctttcaca

SEQ ID NO: 2011097 - DNA, 19 bp, Homo sapiens
ttacagatgagattccctc

SEQ ID NO: 2011098 - DNA, 22 bp, Homo sapiens
ttacagctttacacacacagat

SEQ ID NO: 2011099 - DNA, 15 bp, Homo sapiens
ttacaggtgtactat

SEQ ID NO: 2011100 - DNA, 17 bp, Homo sapiens
ttacaggtgtactatgg

SEQ ID NO: 2011101 - DNA, 15 bp, Homo sapiens
ttacagtaaataaat

SEQ ID NO: 2011102 - DNA, 16 bp, Homo sapiens
ttacagtaaataaatt

SEQ ID NO: 2011103 - DNA, 17 bp, Homo sapiens
ttacagtcaattttaca

SEQ ID NO: 2011104 - DNA, 17 bp, Homo sapiens
ttacagtgtagcttgcc

SEQ ID NO: 2011105 - DNA, 13 bp, Homo sapiens
ttacatctaatgc

SEQ ID NO: 2011106 - DNA, 12 bp, Homo sapiens
ttacatgaacac

SEQ ID NO: 2011107 - DNA, 10 bp, Homo sapiens
ttacatgacc

SEQ ID NO: 2011108 - DNA, 16 bp, Homo sapiens
ttacatgaccagaaaa

SEQ ID NO: 2011109 - DNA, 16 bp, Homo sapiens
ttacatgattcatttt

SEQ ID NO: 2011110 - DNA, 22 bp, Homo sapiens
ttacatgcaatttattaaaatg

SEQ ID NO: 2011111 - DNA, 16 bp, Homo sapiens
ttacatggctgtggtt

SEQ ID NO: 2011112 - DNA, 12 bp, Homo sapiens
ttacatgtttgc

SEQ ID NO: 2011113 - DNA, 13 bp, Homo sapiens
ttacatttttaca

SEQ ID NO: 2011114 - DNA, 16 bp, Homo sapiens
ttacatttttacaata

SEQ ID NO: 2011115 - DNA, 21 bp, Homo sapiens
ttacatttttacaataaataa

SEQ ID NO: 2011116 - DNA, 21 bp, Homo sapiens
ttaccaggcaccaaaagaagt

SEQ ID NO: 2011117 - DNA, 20 bp, Homo sapiens
ttacctaaacagatataaat

SEQ ID NO: 2011118 - DNA, 18 bp, Homo sapiens
ttacctaccacagtgtct

SEQ ID NO: 2011119 - DNA, 21 bp, Homo sapiens
ttacctaccacagtgtctgta

SEQ ID NO: 2011120 - DNA, 15 bp, Homo sapiens
ttacctcccctgcca

SEQ ID NO: 2011121 - DNA, 16 bp, Homo sapiens
ttacctcccctgccag

SEQ ID NO: 2011122 - DNA, 19 bp, Homo sapiens
ttacctcctgcccaggaga

SEQ ID NO: 2011123 - DNA, 15 bp, Homo sapiens
ttacctgcatgtgtt

SEQ ID NO: 2011124 - DNA, 19 bp, Homo sapiens
ttaccttagattagctctg

SEQ ID NO: 2011125 - DNA, 22 bp, Homo sapiens
ttaccttagattagctctggac

SEQ ID NO: 2011126 - DNA, 14 bp, Homo sapiens
ttaccttcaataaa

SEQ ID NO: 2011127 - DNA, 16 bp, Homo sapiens
ttaccttggtatatca

SEQ ID NO: 2011128 - DNA, 22 bp, Homo sapiens
ttacctttattaatgaactgtg

SEQ ID NO: 2011129 - DNA, 15 bp, Homo sapiens
ttacctttcccatgc

SEQ ID NO: 2011130 - DNA, 23 bp, Homo sapiens
ttacctttcccatgctgaattat

SEQ ID NO: 2011131 - DNA, 14 bp, Homo sapiens
ttacgctctctgtc

SEQ ID NO: 2011132 - DNA, 22 bp, Homo sapiens
ttactaaagcagtgttttcacc

SEQ ID NO: 2011133 - DNA, 19 bp, Homo sapiens
ttactaaattgtatacatt

SEQ ID NO: 2011134 - DNA, 17 bp, Homo sapiens
ttactaagccacaagaa

SEQ ID NO: 2011135 - DNA, 19 bp, Homo sapiens
ttactacttgttacctttc

SEQ ID NO: 2011136 - DNA, 21 bp, Homo sapiens
ttactacttgttacctttccc

SEQ ID NO: 2011137 - DNA, 18 bp, Homo sapiens
ttactattaagggaaagg

SEQ ID NO: 2011138 - DNA, 19 bp, Homo sapiens
ttactattttacttctaga

SEQ ID NO: 2011139 - DNA, 13 bp, Homo sapiens
ttactcagccctg

SEQ ID NO: 2011140 - DNA, 22 bp, Homo sapiens
ttactcagccctgggccccacc

SEQ ID NO: 2011141 - DNA, 21 bp, Homo sapiens
ttactctatgccccaaatata

SEQ ID NO: 2011142 - DNA, 14 bp, Homo sapiens
ttactctcaatgca

SEQ ID NO: 2011143 - DNA, 13 bp, Homo sapiens
ttactctgagccc

SEQ ID NO: 2011144 - DNA, 15 bp, Homo sapiens
ttactctgagcccag

SEQ ID NO: 2011145 - DNA, 17 bp, Homo sapiens
ttactcttatcattttt

SEQ ID NO: 2011146 - DNA, 13 bp, Homo sapiens
ttactgaaatgag

SEQ ID NO: 2011147 - DNA, 15 bp, Homo sapiens
ttactgacagaaatg

SEQ ID NO: 2011148 - DNA, 14 bp, Homo sapiens
ttactgagcttctc

SEQ ID NO: 2011149 - DNA, 12 bp, Homo sapiens
ttactgcctttg

SEQ ID NO: 2011150 - DNA, 12 bp, Homo sapiens
ttactggtttca

SEQ ID NO: 2011151 - DNA, 22 bp, Homo sapiens
ttactgtctggttttaacaatt

SEQ ID NO: 2011152 - DNA, 14 bp, Homo sapiens
ttacttaaatagca

SEQ ID NO: 2011153 - DNA, 15 bp, Homo sapiens
ttacttcctatcaag

SEQ ID NO: 2011154 - DNA, 18 bp, Homo sapiens
ttacttcgtgcgcaacaa

SEQ ID NO: 2011155 - DNA, 22 bp, Homo sapiens
ttacttcgtgtccgactcttct

SEQ ID NO: 2011156 - DNA, 15 bp, Homo sapiens
ttacttgaactttcc

SEQ ID NO: 2011157 - DNA, 13 bp, Homo sapiens
ttacttgcacaag

SEQ ID NO: 2011158 - DNA, 19 bp, Homo sapiens
ttacttgcattgaatatat

SEQ ID NO: 2011159 - DNA, 18 bp, Homo sapiens
ttactttaaaataaaaaa

SEQ ID NO: 2011160 - DNA, 21 bp, Homo sapiens
ttactttaatactcacctcct

SEQ ID NO: 2011161 - DNA, 19 bp, Homo sapiens
ttactttatccaatcctca

SEQ ID NO: 2011162 - DNA, 14 bp, Homo sapiens
ttactttgtgttca

SEQ ID NO: 2011163 - DNA, 17 bp, Homo sapiens
ttacttttaaacagtga

SEQ ID NO: 2011164 - DNA, 20 bp, Homo sapiens
ttacttttgttctgtatttt

SEQ ID NO: 2011165 - DNA, 14 bp, Homo sapiens
ttagaaaacattca

SEQ ID NO: 2011166 - DNA, 17 bp, Homo sapiens
ttagaaaacattcatcc

SEQ ID NO: 2011167 - DNA, 20 bp, Homo sapiens
ttagaaaagcaaagggtgct

SEQ ID NO: 2011168 - DNA, 23 bp, Homo sapiens
ttagaaacaaatttttttcttgt

SEQ ID NO: 2011169 - DNA, 15 bp, Homo sapiens
ttagaaatagacagt

SEQ ID NO: 2011170 - DNA, 17 bp, Homo sapiens
ttagaagagcctgactg

SEQ ID NO: 2011171 - DNA, 16 bp, Homo sapiens
ttagaagtcacacagt

SEQ ID NO: 2011172 - DNA, 19 bp, Homo sapiens
ttagaattttagaagagat

SEQ ID NO: 2011173 - DNA, 15 bp, Homo sapiens
ttagacctcagcctg

SEQ ID NO: 2011174 - DNA, 21 bp, Homo sapiens
ttagactagttgaacatctca

SEQ ID NO: 2011175 - DNA, 15 bp, Homo sapiens
ttagactggacagct

SEQ ID NO: 2011176 - DNA, 19 bp, Homo sapiens
ttagactggacagcttgtg

SEQ ID NO: 2011177 - DNA, 16 bp, Homo sapiens
ttagagaatatatttt

SEQ ID NO: 2011178 - DNA, 19 bp, Homo sapiens
ttagagaatatatttttga

SEQ ID NO: 2011179 - DNA, 18 bp, Homo sapiens
ttagaggaaaaaaatgac

SEQ ID NO: 2011180 - DNA, 18 bp, Homo sapiens
ttagagggaggagaatga

SEQ ID NO: 2011181 - DNA, 21 bp, Homo sapiens
ttagagtatgcaagaagaata

SEQ ID NO: 2011182 - DNA, 20 bp, Homo sapiens
ttagatcccatgtcacctca

SEQ ID NO: 2011183 - DNA, 17 bp, Homo sapiens
ttagattagctctggac

SEQ ID NO: 2011184 - DNA, 13 bp, Homo sapiens
ttagattccagga

SEQ ID NO: 2011185 - DNA, 19 bp, Homo sapiens
ttagcaaagagttaatata

SEQ ID NO: 2011186 - DNA, 20 bp, Homo sapiens
ttagcaaagagttaatatat

SEQ ID NO: 2011187 - DNA, 22 bp, Homo sapiens
ttagcaaagatatctcatctct

SEQ ID NO: 2011188 - DNA, 21 bp, Homo sapiens
ttagcagctcttcccctttcc

SEQ ID NO: 2011189 - DNA, 13 bp, Homo sapiens
ttagcccaagagg

SEQ ID NO: 2011190 - DNA, 19 bp, Homo sapiens
ttagcccaagaggtctgag

SEQ ID NO: 2011191 - DNA, 21 bp, Homo sapiens
ttagcccaagaggtctgagcc

SEQ ID NO: 2011192 - DNA, 10 bp, Homo sapiens
ttagcctgga

SEQ ID NO: 2011193 - DNA, 15 bp, Homo sapiens
ttagccttctctgtt

SEQ ID NO: 2011194 - DNA, 17 bp, Homo sapiens
ttcagatcagtgcttga

SEQ ID NO: 2011195 - DNA, 17 bp, Homo sapiens
ttcagatcgtattaatt

SEQ ID NO: 2011196 - DNA, 22 bp, Homo sapiens
ttcagattccacacaaaatgtc

SEQ ID NO: 2011197 - DNA, 21 bp, Homo sapiens
ttcagattcccagagcaaaat

SEQ ID NO: 2011198 - DNA, 15 bp, Homo sapiens
ttcagcacaccccaa

SEQ ID NO: 2011199 - DNA, 17 bp, Homo sapiens
ttcagcaccctgggtgc

SEQ ID NO: 2011200 - DNA, 18 bp, Homo sapiens
ttcagcattaggctttta

SEQ ID NO: 2011201 - DNA, 19 bp, Homo sapiens
ttcagcattattcctccag

SEQ ID NO: 2011202 - DNA, 18 bp, Homo sapiens
ttcagccacaaagtagtt

SEQ ID NO: 2011203 - DNA, 15 bp, Homo sapiens
ttcagcccctcctct

SEQ ID NO: 2011204 - DNA, 18 bp, Homo sapiens
ttcagcccctcctctgcc

SEQ ID NO: 2011205 - DNA, 19 bp, Homo sapiens
ttcagcccctcctctgcca

SEQ ID NO: 2011206 - DNA, 20 bp, Homo sapiens
ttcagcctagccgacctcag

SEQ ID NO: 2011207 - DNA, 19 bp, Homo sapiens
ttcagcctggccatcccca

SEQ ID NO: 2011208 - DNA, 13 bp, Homo sapiens
ttcagccttggga

SEQ ID NO: 2011209 - DNA, 22 bp, Homo sapiens
ttcagctccagctcaccagccc

SEQ ID NO: 2011210 - DNA, 13 bp, Homo sapiens
ttcagctcccata

SEQ ID NO: 2011211 - DNA, 15 bp, Homo sapiens
ttcagctctctgtat

SEQ ID NO: 2011212 - DNA, 16 bp, Homo sapiens
ttcaggaaaaggcctg

SEQ ID NO: 2011213 - DNA, 20 bp, Homo sapiens
ttcaggagagagttgaacct

SEQ ID NO: 2011214 - DNA, 17 bp, Homo sapiens
ttcaggagggtccccag

SEQ ID NO: 2011215 - DNA, 12 bp, Homo sapiens
ttcaggcactga

SEQ ID NO: 2011216 - DNA, 15 bp, Homo sapiens
ttcaggcattttgtt

SEQ ID NO: 2011217 - DNA, 15 bp, Homo sapiens
ttcaggctcttctcc

SEQ ID NO: 2011218 - DNA, 20 bp, Homo sapiens
ttcagggaaatggagggtgg

SEQ ID NO: 2011219 - DNA, 16 bp, Homo sapiens
ttcagggaagcaggca

SEQ ID NO: 2011220 - DNA, 16 bp, Homo sapiens
ttcagggccagaagga

SEQ ID NO: 2011221 - DNA, 22 bp, Homo sapiens
ttcaggggggttgtgaggcctg

SEQ ID NO: 2011222 - DNA, 16 bp, Homo sapiens
ttcagggtatcccaga

SEQ ID NO: 2011223 - DNA, 14 bp, Homo sapiens
ttcagggttggccc

SEQ ID NO: 2011224 - DNA, 16 bp, Homo sapiens
ttcagggttggcccct

SEQ ID NO: 2011225 - DNA, 13 bp, Homo sapiens
ttcaggtaggccc

SEQ ID NO: 2011226 - DNA, 14 bp, Homo sapiens
ttcaggtaggccct

SEQ ID NO: 2011227 - DNA, 14 bp, Homo sapiens
ttcaggtgaaaatg

SEQ ID NO: 2011228 - DNA, 21 bp, Homo sapiens
ttcaggtggagagcactagaa

SEQ ID NO: 2011229 - DNA, 20 bp, Homo sapiens
ttcaggtgtttagttgcaga

SEQ ID NO: 2011230 - DNA, 19 bp, Homo sapiens
ttcaggttttgtaaagatg

SEQ ID NO: 2011231 - DNA, 14 bp, Homo sapiens
ttcagtaggaactg

SEQ ID NO: 2011232 - DNA, 21 bp, Homo sapiens
ttcagtaggctttatgctgtg

SEQ ID NO: 2011233 - DNA, 21 bp, Homo sapiens
ttcagtaggtttgtgtggatg

SEQ ID NO: 2011234 - DNA, 20 bp, Homo sapiens
ttcagtattttggagaaatt

SEQ ID NO: 2011235 - DNA, 12 bp, Homo sapiens
ttcagtccgcct

SEQ ID NO: 2011236 - DNA, 21 bp, Homo sapiens
ttcagtcctggtctgctcagg

SEQ ID NO: 2011237 - DNA, 16 bp, Homo sapiens
ttcagtgagacacaga

SEQ ID NO: 2011238 - DNA, 10 bp, Homo sapiens
ttcagtgccc

SEQ ID NO: 2011239 - DNA, 13 bp, Homo sapiens
ttcagtgctgtgg

SEQ ID NO: 2011240 - DNA, 21 bp, Homo sapiens
ttcagtgctgtggcctgggca

SEQ ID NO: 2011241 - DNA, 13 bp, Homo sapiens
ttcagtggcagct

SEQ ID NO: 2011242 - DNA, 15 bp, Homo sapiens
ttcagtggcagctgc

SEQ ID NO: 2011243 - DNA, 16 bp, Homo sapiens
ttcagtggcagctgct

SEQ ID NO: 2011244 - DNA, 14 bp, Homo sapiens
ttcagtgggagaaa

SEQ ID NO: 2011245 - DNA, 17 bp, Homo sapiens
ttcagttcctctttgca

SEQ ID NO: 2011246 - DNA, 23 bp, Homo sapiens
ttcagttcctctttgcatggaat

SEQ ID NO: 2011247 - DNA, 16 bp, Homo sapiens
ttcagttgatcactgg

SEQ ID NO: 2011248 - DNA, 19 bp, Homo sapiens
ttcagttggctgacttcca

SEQ ID NO: 2011249 - DNA, 19 bp, Homo sapiens
ttcagtttcaattcagtgc

SEQ ID NO: 2011250 - DNA, 16 bp, Homo sapiens
ttcagtttgtttactt

SEQ ID NO: 2011251 - DNA, 13 bp, Homo sapiens
ttcataaactgag

SEQ ID NO: 2011252 - DNA, 21 bp, Homo sapiens
ttcataaactgagcctctttt

SEQ ID NO: 2011253 - DNA, 15 bp, Homo sapiens
ttcataacctagcct

SEQ ID NO: 2011254 - DNA, 16 bp, Homo sapiens
ttcataattagaacaa

SEQ ID NO: 2011255 - DNA, 20 bp, Homo sapiens
ttcataattagaacaatagc

SEQ ID NO: 2011256 - DNA, 20 bp, Homo sapiens
ttcataggcggtcatgtgtg

SEQ ID NO: 2011257 - DNA, 13 bp, Homo sapiens
ttcatatccagct

SEQ ID NO: 2011258 - DNA, 12 bp, Homo sapiens
ttcatcaatttt

SEQ ID NO: 2011259 - DNA, 20 bp, Homo sapiens
ttcatcaatttttatacata

SEQ ID NO: 2011260 - DNA, 21 bp, Homo sapiens
ttcatcaatttttatacatat

SEQ ID NO: 2011261 - DNA, 13 bp, Homo sapiens
ttcatccaaggaa

SEQ ID NO: 2011262 - DNA, 22 bp, Homo sapiens
ttcatccagttgcaataaaata

SEQ ID NO: 2011263 - DNA, 14 bp, Homo sapiens
ttcatcccagcccc

SEQ ID NO: 2011264 - DNA, 16 bp, Homo sapiens
ttcatcccagccccaa

SEQ ID NO: 2011265 - DNA, 18 bp, Homo sapiens
ttcatccctatttatagt

SEQ ID NO: 2011266 - DNA, 17 bp, Homo sapiens
ttcatcctggcctcctt

SEQ ID NO: 2011267 - DNA, 19 bp, Homo sapiens
ttcatcctggcctcctttt

SEQ ID NO: 2011268 - DNA, 17 bp, Homo sapiens
ttcatctatttctgaga

SEQ ID NO: 2011269 - DNA, 17 bp, Homo sapiens
ttcatctgggaggcaga

SEQ ID NO: 2011270 - DNA, 18 bp, Homo sapiens
ttcatctgttgttttgtt

SEQ ID NO: 2011271 - DNA, 23 bp, Homo sapiens
ttcatcttcaaccttaaggactt

SEQ ID NO: 2011272 - DNA, 22 bp, Homo sapiens
ttcatgaaaatagctctttcag

SEQ ID NO: 2011273 - DNA, 18 bp, Homo sapiens
ttcatgagtggatggatg

SEQ ID NO: 2011274 - DNA, 12 bp, Homo sapiens
ttcatgataatg

SEQ ID NO: 2011275 - DNA, 15 bp, Homo sapiens
ttcatgcaatgacat

SEQ ID NO: 2011276 - DNA, 21 bp, Homo sapiens
ttcatgccaattagcaattga

SEQ ID NO: 2011277 - DNA, 16 bp, Homo sapiens
ttcatgccatctgttt

SEQ ID NO: 2011278 - DNA, 12 bp, Homo sapiens
ttcatgcctcag

SEQ ID NO: 2011279 - DNA, 14 bp, Homo sapiens
ttcatgcctcagtt

SEQ ID NO: 2011280 - DNA, 17 bp, Homo sapiens
ttcatgcctcagtttcc

SEQ ID NO: 2011281 - DNA, 18 bp, Homo sapiens
ttcatgctatctctgtgt

SEQ ID NO: 2011282 - DNA, 16 bp, Homo sapiens
ttcatgtaaccaagag

SEQ ID NO: 2011283 - DNA, 15 bp, Homo sapiens
ttcatgtaataaatc

SEQ ID NO: 2011284 - DNA, 18 bp, Homo sapiens
ttcatgtaataaatctga

SEQ ID NO: 2011285 - DNA, 16 bp, Homo sapiens
ttcatgtacagcatgc

SEQ ID NO: 2011286 - DNA, 18 bp, Homo sapiens
ttcatgttttgtgactat

SEQ ID NO: 2011287 - DNA, 16 bp, Homo sapiens
ttcattaaattttcta

SEQ ID NO: 2011288 - DNA, 19 bp, Homo sapiens
ttcattcttgaaagctgtg

SEQ ID NO: 2011289 - DNA, 17 bp, Homo sapiens
ttcattgtataaaaata

SEQ ID NO: 2011290 - DNA, 15 bp, Homo sapiens
ttcatttaaaatgat

SEQ ID NO: 2011291 - DNA, 12 bp, Homo sapiens
ttcatttcattg

SEQ ID NO: 2011292 - DNA, 13 bp, Homo sapiens
ttcatttcattgt

SEQ ID NO: 2011293 - DNA, 15 bp, Homo sapiens
ttcattttcagagtg

SEQ ID NO: 2011294 - DNA, 21 bp, Homo sapiens
ttcatttttgttatccttttt

SEQ ID NO: 2011295 - DNA, 16 bp, Homo sapiens
ttccaaaacctaaaga

SEQ ID NO: 2011296 - DNA, 16 bp, Homo sapiens
ttccaaacctgacaga

SEQ ID NO: 2011297 - DNA, 20 bp, Homo sapiens
ttccaaacttctaaatgttg

SEQ ID NO: 2011298 - DNA, 20 bp, Homo sapiens
ttccaaagcacattgaaaga

SEQ ID NO: 2011299 - DNA, 11 bp, Homo sapiens
ttccaaagctc

SEQ ID NO: 2011300 - DNA, 21 bp, Homo sapiens
ttccaaatgaatgttgtctgt

SEQ ID NO: 2011301 - DNA, 23 bp, Homo sapiens
ttccaacagctcaagtcttccct

SEQ ID NO: 2011302 - DNA, 14 bp, Homo sapiens
ttccaacagtgagt

SEQ ID NO: 2011303 - DNA, 13 bp, Homo sapiens
ttccaaccccagc

SEQ ID NO: 2011304 - DNA, 12 bp, Homo sapiens
ttccaagagctg

SEQ ID NO: 2011305 - DNA, 17 bp, Homo sapiens
ttccaagcccttttaca

SEQ ID NO: 2011306 - DNA, 16 bp, Homo sapiens
ttccaaggagttccat

SEQ ID NO: 2011307 - DNA, 22 bp, Homo sapiens
ttccaagggtcttcctcctaaa

SEQ ID NO: 2011308 - DNA, 19 bp, Homo sapiens
ttccaagttcctgcactcc

SEQ ID NO: 2011309 - DNA, 13 bp, Homo sapiens
ttgaaagaccttc

SEQ ID NO: 2011310 - DNA, 12 bp, Homo sapiens
ttgaaagctgtg

SEQ ID NO: 2011311 - DNA, 21 bp, Homo sapiens
ttgaaagtgaataaacttcag

SEQ ID NO: 2011312 - DNA, 21 bp, Homo sapiens
ttgaaatcagaagcctacttt

SEQ ID NO: 2011313 - DNA, 13 bp, Homo sapiens
ttgaaatcttaaa

SEQ ID NO: 2011314 - DNA, 14 bp, Homo sapiens
ttgaaattatatct

SEQ ID NO: 2011315 - DNA, 21 bp, Homo sapiens
ttgaaattatgtatgtttaca

SEQ ID NO: 2011316 - DNA, 16 bp, Homo sapiens
ttgaaatttactgtga

SEQ ID NO: 2011317 - DNA, 14 bp, Homo sapiens
ttgaaccttggtaa

SEQ ID NO: 2011318 - DNA, 16 bp, Homo sapiens
ttgaactcctggcctc

SEQ ID NO: 2011319 - DNA, 18 bp, Homo sapiens
ttgaacttaaataaatgt

SEQ ID NO: 2011320 - DNA, 18 bp, Homo sapiens
ttgaactttccaaaacct

SEQ ID NO: 2011321 - DNA, 14 bp, Homo sapiens
ttgaagaaacagat

SEQ ID NO: 2011322 - DNA, 19 bp, Homo sapiens
ttgaagaaacagataccat

SEQ ID NO: 2011323 - DNA, 21 bp, Homo sapiens
ttgaagagagatatatctgaa

SEQ ID NO: 2011324 - DNA, 17 bp, Homo sapiens
ttgaagaggggaggggc

SEQ ID NO: 2011325 - DNA, 20 bp, Homo sapiens
ttgaagcctttttttagtaa

SEQ ID NO: 2011326 - DNA, 18 bp, Homo sapiens
ttgaaggagaaaatgcat

SEQ ID NO: 2011327 - DNA, 13 bp, Homo sapiens
ttgaaggcagtct

SEQ ID NO: 2011328 - DNA, 18 bp, Homo sapiens
ttgaagtggccagatgag

SEQ ID NO: 2011329 - DNA, 21 bp, Homo sapiens
ttgaataaagcctgcttttta

SEQ ID NO: 2011330 - DNA, 13 bp, Homo sapiens
ttgaataaagtct

SEQ ID NO: 2011331 - DNA, 15 bp, Homo sapiens
ttgaataaagtctga

SEQ ID NO: 2011332 - DNA, 19 bp, Homo sapiens
ttgaataaagtctgagtgg

SEQ ID NO: 2011333 - DNA, 21 bp, Homo sapiens
ttgaatacccccagagacctt

SEQ ID NO: 2011334 - DNA, 18 bp, Homo sapiens
ttgaatataaacactata

SEQ ID NO: 2011335 - DNA, 11 bp, Homo sapiens
ttgaatatatc

SEQ ID NO: 2011336 - DNA, 19 bp, Homo sapiens
ttgaatatattataatctt

SEQ ID NO: 2011337 - DNA, 14 bp, Homo sapiens
ttgaatatcattaa

SEQ ID NO: 2011338 - DNA, 23 bp, Homo sapiens
ttgaatctgattggacattttct

SEQ ID NO: 2011339 - DNA, 18 bp, Homo sapiens
ttgaatctgttactgaaa

SEQ ID NO: 2011340 - DNA, 21 bp, Homo sapiens
ttgaatctgttactgaaatga

SEQ ID NO: 2011341 - DNA, 17 bp, Homo sapiens
ttgaatgacaacagaag

SEQ ID NO: 2011342 - DNA, 18 bp, Homo sapiens
ttgaatgacaacagaagc

SEQ ID NO: 2011343 - DNA, 16 bp, Homo sapiens
ttgaatgcaaaccata

SEQ ID NO: 2011344 - DNA, 23 bp, Homo sapiens
ttgaatgctttttgaatgttatt

SEQ ID NO: 2011345 - DNA, 23 bp, Homo sapiens
ttgaatgttatttgttattttca

SEQ ID NO: 2011346 - DNA, 16 bp, Homo sapiens
ttgaatgtttatgttc

SEQ ID NO: 2011347 - DNA, 13 bp, Homo sapiens
ttgaattctggag

SEQ ID NO: 2011348 - DNA, 16 bp, Homo sapiens
ttgaatttcctatctg

SEQ ID NO: 2011349 - DNA, 14 bp, Homo sapiens
ttgacaacagactg

SEQ ID NO: 2011350 - DNA, 18 bp, Homo sapiens
ttgacaaggtagacatgg

SEQ ID NO: 2011351 - DNA, 14 bp, Homo sapiens
ttgacacacagcac

SEQ ID NO: 2011352 - DNA, 16 bp, Homo sapiens
ttgacacacagcactc

SEQ ID NO: 2011353 - DNA, 14 bp, Homo sapiens
ttgacagaacactg

SEQ ID NO: 2011354 - DNA, 16 bp, Homo sapiens
ttgacagaacactgtc

SEQ ID NO: 2011355 - DNA, 12 bp, Homo sapiens
ttgacagggcac

SEQ ID NO: 2011356 - DNA, 15 bp, Homo sapiens
ttgacataaagttga

SEQ ID NO: 2011357 - DNA, 11 bp, Homo sapiens
ttgacattcct

SEQ ID NO: 2011358 - DNA, 13 bp, Homo sapiens
ttgaccactccag

SEQ ID NO: 2011359 - DNA, 23 bp, Homo sapiens
ttgaccagacctagacctgggcc

SEQ ID NO: 2011360 - DNA, 14 bp, Homo sapiens
ttgacccactcaca

SEQ ID NO: 2011361 - DNA, 20 bp, Homo sapiens
ttgacccactcacacttgga

SEQ ID NO: 2011362 - DNA, 19 bp, Homo sapiens
ttgacccctttcccccacc

SEQ ID NO: 2011363 - DNA, 15 bp, Homo sapiens
ttgacctcaggtgat

SEQ ID NO: 2011364 - DNA, 17 bp, Homo sapiens
ttgaccttcccaaggtt

SEQ ID NO: 2011365 - DNA, 15 bp, Homo sapiens
ttgacgcatcctgca

SEQ ID NO: 2011366 - DNA, 15 bp, Homo sapiens
ttgacgccaccataa

SEQ ID NO: 2011367 - DNA, 19 bp, Homo sapiens
ttgacgggaggcctcagtt

SEQ ID NO: 2011368 - DNA, 13 bp, Homo sapiens
ttgactatcacat

SEQ ID NO: 2011369 - DNA, 14 bp, Homo sapiens
ttgactatcacata

SEQ ID NO: 2011370 - DNA, 19 bp, Homo sapiens
ttgactatcacatacaatt

SEQ ID NO: 2011371 - DNA, 20 bp, Homo sapiens
ttgactatcacatacaattt

SEQ ID NO: 2011372 - DNA, 20 bp, Homo sapiens
ttgactcttttatctgagtt

SEQ ID NO: 2011373 - DNA, 21 bp, Homo sapiens
ttgactcttttgccattaaac

SEQ ID NO: 2011374 - DNA, 20 bp, Homo sapiens
ttgacttgacagaacactgt

SEQ ID NO: 2011375 - DNA, 23 bp, Homo sapiens
ttgagaaaccttattgtacctct

SEQ ID NO: 2011376 - DNA, 19 bp, Homo sapiens
ttgagaaggaaaattttag

SEQ ID NO: 2011377 - DNA, 19 bp, Homo sapiens
ttgagaagttttgtacaga

SEQ ID NO: 2011378 - DNA, 11 bp, Homo sapiens
ttgagacagag

SEQ ID NO: 2011379 - DNA, 13 bp, Homo sapiens
ttgagaccagcct

SEQ ID NO: 2011380 - DNA, 16 bp, Homo sapiens
ttgagaccagcctggc

SEQ ID NO: 2011381 - DNA, 22 bp, Homo sapiens
ttgagacggcgcacctatcacc

SEQ ID NO: 2011382 - DNA, 19 bp, Homo sapiens
ttgagaggccctggggttc

SEQ ID NO: 2011383 - DNA, 13 bp, Homo sapiens
ttgagagtgtgac

SEQ ID NO: 2011384 - DNA, 18 bp, Homo sapiens
ttgagataatatctgtga

SEQ ID NO: 2011385 - DNA, 15 bp, Homo sapiens
ttgagcaattcattt

SEQ ID NO: 2011386 - DNA, 16 bp, Homo sapiens
ttgagcaattcatttc

SEQ ID NO: 2011387 - DNA, 20 bp, Homo sapiens
ttgagcaattcatttcactt

SEQ ID NO: 2011388 - DNA, 22 bp, Homo sapiens
ttgagcaattcatttcacttta

SEQ ID NO: 2011389 - DNA, 19 bp, Homo sapiens
ttgagcatgcacagctgct

SEQ ID NO: 2011390 - DNA, 22 bp, Homo sapiens
ttgagccaagcttcaaccctca

SEQ ID NO: 2011391 - DNA, 12 bp, Homo sapiens
ttgagctgtttt

SEQ ID NO: 2011392 - DNA, 18 bp, Homo sapiens
ttgagctgttttccctga

SEQ ID NO: 2011393 - DNA, 13 bp, Homo sapiens
ttgaggagtgtga

SEQ ID NO: 2011394 - DNA, 21 bp, Homo sapiens
ttgaggcaaaggccagcagca

SEQ ID NO: 2011395 - DNA, 14 bp, Homo sapiens
ttgaggctgcagcg

SEQ ID NO: 2011396 - DNA, 15 bp, Homo sapiens
ttgaggggctcctgg

SEQ ID NO: 2011397 - DNA, 19 bp, Homo sapiens
ttgaggtggtgccttctca

SEQ ID NO: 2011398 - DNA, 20 bp, Homo sapiens
ttgagtgcaacaagagcaaa

SEQ ID NO: 2011399 - DNA, 18 bp, Homo sapiens
ttgagttggacacactgt

SEQ ID NO: 2011400 - DNA, 17 bp, Homo sapiens
ttgagtttaagtctctg

SEQ ID NO: 2011401 - DNA, 23 bp, Homo sapiens
ttgagtttaagtctctgactctt

SEQ ID NO: 2011402 - DNA, 17 bp, Homo sapiens
ttgataaagatttttta

SEQ ID NO: 2011403 - DNA, 22 bp, Homo sapiens
ttgataaagattttttaataat

SEQ ID NO: 2011404 - DNA, 18 bp, Homo sapiens
ttgataaattccactgga

SEQ ID NO: 2011405 - DNA, 14 bp, Homo sapiens
ttgatagctttatt

SEQ ID NO: 2011406 - DNA, 20 bp, Homo sapiens
ttgatatacttttttcttat

SEQ ID NO: 2011407 - DNA, 21 bp, Homo sapiens
ttgatatatttcattctctta

SEQ ID NO: 2011408 - DNA, 16 bp, Homo sapiens
ttgatatgaaaaatat

SEQ ID NO: 2011409 - DNA, 16 bp, Homo sapiens
ttgatatgagtataca

SEQ ID NO: 2011410 - DNA, 22 bp, Homo sapiens
ttgatccacttcttaatgcttt

SEQ ID NO: 2011411 - DNA, 18 bp, Homo sapiens
ttgatgaaattcttgaag

SEQ ID NO: 2011412 - DNA, 14 bp, Homo sapiens
ttgatgaagcccgt

SEQ ID NO: 2011413 - DNA, 22 bp, Homo sapiens
ttgatgaagcccgtgtcctgcc

SEQ ID NO: 2011414 - DNA, 14 bp, Homo sapiens
ttgatggagatatt

SEQ ID NO: 2011415 - DNA, 21 bp, Homo sapiens
ttgatgtcatgtacttcctgt

SEQ ID NO: 2011416 - DNA, 14 bp, Homo sapiens
ttgatgtttccaga

SEQ ID NO: 2011417 - DNA, 14 bp, Homo sapiens
ttgattaatttgag

SEQ ID NO: 2011418 - DNA, 11 bp, Homo sapiens
ttgattacata

SEQ ID NO: 2011419 - DNA, 13 bp, Homo sapiens
ttgattatgcata

SEQ ID NO: 2011420 - DNA, 12 bp, Homo sapiens
ttgattattctg

SEQ ID NO: 2011421 - DNA, 13 bp, Homo sapiens
ttgattatttcct

SEQ ID NO: 2011422 - DNA, 17 bp, Homo sapiens
ttgattgtaaaaacaaa

SEQ ID NO: 2011423 - DNA, 18 bp, Homo sapiens
ttgatttatatgtgtaat

SEQ ID NO: 2011424 - DNA, 22 bp, Homo sapiens
tttaagggtttgtggaaaatga

SEQ ID NO: 2011425 - DNA, 13 bp, Homo sapiens
tttaagtatttat

SEQ ID NO: 2011426 - DNA, 20 bp, Homo sapiens
tttaagtatttatatattta

SEQ ID NO: 2011427 - DNA, 16 bp, Homo sapiens
tttaagttattttaaa

SEQ ID NO: 2011428 - DNA, 18 bp, Homo sapiens
tttaatagcaaagaattg

SEQ ID NO: 2011429 - DNA, 21 bp, Homo sapiens
tttaatatctgagaagtgtat

SEQ ID NO: 2011430 - DNA, 18 bp, Homo sapiens
tttaatatttaaacagca

SEQ ID NO: 2011431 - DNA, 20 bp, Homo sapiens
tttaatgactttttataatg

SEQ ID NO: 2011432 - DNA, 17 bp, Homo sapiens
tttaatgtgtattgaag

SEQ ID NO: 2011433 - DNA, 16 bp, Homo sapiens
tttaatgtttgattta

SEQ ID NO: 2011434 - DNA, 14 bp, Homo sapiens
tttaatgttttctg

SEQ ID NO: 2011435 - DNA, 23 bp, Homo sapiens
tttaattaatatgttcattaaat

SEQ ID NO: 2011436 - DNA, 23 bp, Homo sapiens
tttaattattatttatatatgta

SEQ ID NO: 2011437 - DNA, 14 bp, Homo sapiens
tttaattgattatt

SEQ ID NO: 2011438 - DNA, 16 bp, Homo sapiens
tttaattgcatttaaa

SEQ ID NO: 2011439 - DNA, 23 bp, Homo sapiens
tttaatttatatttgaaatttta

SEQ ID NO: 2011440 - DNA, 19 bp, Homo sapiens
tttacaaatttaattttgc

SEQ ID NO: 2011441 - DNA, 19 bp, Homo sapiens
tttacaaatttttcctgca

SEQ ID NO: 2011442 - DNA, 15 bp, Homo sapiens
tttacaagtgtatat

SEQ ID NO: 2011443 - DNA, 19 bp, Homo sapiens
tttacaataaatattctgc

SEQ ID NO: 2011444 - DNA, 20 bp, Homo sapiens
tttacagtaaataaattgtt

SEQ ID NO: 2011445 - DNA, 14 bp, Homo sapiens
tttacatgaacaca

SEQ ID NO: 2011446 - DNA, 18 bp, Homo sapiens
tttacatgaattgcattt

SEQ ID NO: 2011447 - DNA, 18 bp, Homo sapiens
tttaccagggatgtagat

SEQ ID NO: 2011448 - DNA, 18 bp, Homo sapiens
tttacccaaaaactaaat

SEQ ID NO: 2011449 - DNA, 18 bp, Homo sapiens
tttacccctgcacagttt

SEQ ID NO: 2011450 - DNA, 16 bp, Homo sapiens
tttacctgagaccagt

SEQ ID NO: 2011451 - DNA, 16 bp, Homo sapiens
tttacctgcaaaaaat

SEQ ID NO: 2011452 - DNA, 21 bp, Homo sapiens
tttacctgtgcgttactaatt

SEQ ID NO: 2011453 - DNA, 17 bp, Homo sapiens
tttaccttttctgttgt

SEQ ID NO: 2011454 - DNA, 20 bp, Homo sapiens
tttactaaagagacatattt

SEQ ID NO: 2011455 - DNA, 20 bp, Homo sapiens
tttactaaagatatcagagc

SEQ ID NO: 2011456 - DNA, 20 bp, Homo sapiens
tttactaagccacaagaaat

SEQ ID NO: 2011457 - DNA, 15 bp, Homo sapiens
tttactaagtaaaag

SEQ ID NO: 2011458 - DNA, 16 bp, Homo sapiens
tttactactattctgt

SEQ ID NO: 2011459 - DNA, 14 bp, Homo sapiens
tttactacttgtta

SEQ ID NO: 2011460 - DNA, 21 bp, Homo sapiens
tttactctatgccccaaatat

SEQ ID NO: 2011461 - DNA, 22 bp, Homo sapiens
tttactctatgccccaaatata

SEQ ID NO: 2011462 - DNA, 17 bp, Homo sapiens
tttactgagcttctctg

SEQ ID NO: 2011463 - DNA, 22 bp, Homo sapiens
tttactgctgtcattgtccatg

SEQ ID NO: 2011464 - DNA, 14 bp, Homo sapiens
tttactgtctgtaa

SEQ ID NO: 2011465 - DNA, 16 bp, Homo sapiens
tttactgtgcatacat

SEQ ID NO: 2011466 - DNA, 15 bp, Homo sapiens
tttacttgtagaaat

SEQ ID NO: 2011467 - DNA, 21 bp, Homo sapiens
tttactttatccaatcctcag

SEQ ID NO: 2011468 - DNA, 18 bp, Homo sapiens
tttacttttaaacagtga

SEQ ID NO: 2011469 - DNA, 12 bp, Homo sapiens
tttagaaaactt

SEQ ID NO: 2011470 - DNA, 16 bp, Homo sapiens
tttagaaatcattttg

SEQ ID NO: 2011471 - DNA, 13 bp, Homo sapiens
tttagaacagagg

SEQ ID NO: 2011472 - DNA, 14 bp, Homo sapiens
tttagaatatatta

SEQ ID NO: 2011473 - DNA, 21 bp, Homo sapiens
tttagagatgaattaaattta

SEQ ID NO: 2011474 - DNA, 18 bp, Homo sapiens
tttagagattaatttgtg

SEQ ID NO: 2011475 - DNA, 14 bp, Homo sapiens
tttagattccagga

SEQ ID NO: 2011476 - DNA, 12 bp, Homo sapiens
tttagatttcaa

SEQ ID NO: 2011477 - DNA, 23 bp, Homo sapiens
tttagcagtccaaagaacaagaa

SEQ ID NO: 2011478 - DNA, 13 bp, Homo sapiens
tttagccagtgac

SEQ ID NO: 2011479 - DNA, 14 bp, Homo sapiens
tttagctatgtgga

SEQ ID NO: 2011480 - DNA, 16 bp, Homo sapiens
tttagcttctctgcca

SEQ ID NO: 2011481 - DNA, 18 bp, Homo sapiens
tttaggaagcaagcttaa

SEQ ID NO: 2011482 - DNA, 14 bp, Homo sapiens
tttaggagacagtc

SEQ ID NO: 2011483 - DNA, 23 bp, Homo sapiens
tttaggatgtaactttataaata

SEQ ID NO: 2011484 - DNA, 11 bp, Homo sapiens
tttaggcagcc

SEQ ID NO: 2011485 - DNA, 17 bp, Homo sapiens
tttaggcagcctgccgc

SEQ ID NO: 2011486 - DNA, 19 bp, Homo sapiens
tttaggcagggatttgagg

SEQ ID NO: 2011487 - DNA, 19 bp, Homo sapiens
tttaggctcaggacggaag

SEQ ID NO: 2011488 - DNA, 13 bp, Homo sapiens
tttagggaagcag

SEQ ID NO: 2011489 - DNA, 15 bp, Homo sapiens
tttagggctgtagac

SEQ ID NO: 2011490 - DNA, 17 bp, Homo sapiens
tttaggggaagtatgtg

SEQ ID NO: 2011491 - DNA, 18 bp, Homo sapiens
tttaggggaagtatgtgt

SEQ ID NO: 2011492 - DNA, 20 bp, Homo sapiens
tttaggtgcctcctgtctta

SEQ ID NO: 2011493 - DNA, 15 bp, Homo sapiens
tttagtagagacagg

SEQ ID NO: 2011494 - DNA, 22 bp, Homo sapiens
tttagtagcagtgattgtctta

SEQ ID NO: 2011495 - DNA, 15 bp, Homo sapiens
tttagtcttttactc

SEQ ID NO: 2011496 - DNA, 17 bp, Homo sapiens
tttagtgttctgtattt

SEQ ID NO: 2011497 - DNA, 11 bp, Homo sapiens
tttagttcttt

SEQ ID NO: 2011498 - DNA, 13 bp, Homo sapiens
tttagttttatgg

SEQ ID NO: 2011499 - DNA, 23 bp, Homo sapiens
tttataaaagaataaaattgcac

SEQ ID NO: 2011500 - DNA, 14 bp, Homo sapiens
tttataaacttaat

SEQ ID NO: 2011501 - DNA, 13 bp, Homo sapiens
tttataaatgtgt

SEQ ID NO: 2011502 - DNA, 16 bp, Homo sapiens
tttataagcaaatttc

SEQ ID NO: 2011503 - DNA, 15 bp, Homo sapiens
tttatacaaaataat

SEQ ID NO: 2011504 - DNA, 23 bp, Homo sapiens
tttatacagaactgaattaagtt

SEQ ID NO: 2011505 - DNA, 20 bp, Homo sapiens
tttatacatagtcacaaaaa

SEQ ID NO: 2011506 - DNA, 21 bp, Homo sapiens
tttatacatagtcacaaaaat

SEQ ID NO: 2011507 - DNA, 19 bp, Homo sapiens
tttatactccatacataac

SEQ ID NO: 2011508 - DNA, 20 bp, Homo sapiens
tttatagctattactgtctg

SEQ ID NO: 2011509 - DNA, 15 bp, Homo sapiens
tttatatatatatgt

SEQ ID NO: 2011510 - DNA, 19 bp, Homo sapiens
tttatatatgaagtaagtt

SEQ ID NO: 2011511 - DNA, 22 bp, Homo sapiens
tttatatgaaatgtttcactat

SEQ ID NO: 2011512 - DNA, 16 bp, Homo sapiens
tttatattagaagtgt

SEQ ID NO: 2011513 - DNA, 22 bp, Homo sapiens
tttatattcagagatgtaccat

SEQ ID NO: 2011514 - DNA, 14 bp, Homo sapiens
tttatattgtaaat

SEQ ID NO: 2011515 - DNA, 16 bp, Homo sapiens
tttatatttggaaaga

SEQ ID NO: 2011516 - DNA, 18 bp, Homo sapiens
tttatatttggaaagaga

SEQ ID NO: 2011517 - DNA, 13 bp, Homo sapiens
tttatattttccc

SEQ ID NO: 2011518 - DNA, 14 bp, Homo sapiens
tttatcatgacatg

SEQ ID NO: 2011519 - DNA, 15 bp, Homo sapiens
tttatccaatcctca

SEQ ID NO: 2011520 - DNA, 18 bp, Homo sapiens
tttatcgtttattgctta

SEQ ID NO: 2011521 - DNA, 15 bp, Homo sapiens
tttatctgtcacaca

SEQ ID NO: 2011522 - DNA, 21 bp, Homo sapiens
tttatgaaatggttaagaatt

SEQ ID NO: 2011523 - DNA, 18 bp, Homo sapiens
tttatgaagaaaaaatac

SEQ ID NO: 2011524 - DNA, 22 bp, Homo sapiens
tttatgaagaaaaaatacattt

SEQ ID NO: 2011525 - DNA, 21 bp, Homo sapiens
tttatgactgtaaacatagat

SEQ ID NO: 2011526 - DNA, 19 bp, Homo sapiens
tttatgatttaaaaaataa

SEQ ID NO: 2011527 - DNA, 18 bp, Homo sapiens
tttatgcaaggaaggaaa

SEQ ID NO: 2011528 - DNA, 18 bp, Homo sapiens
tttatgcttaaaatatgt

SEQ ID NO: 2011529 - DNA, 19 bp, Homo sapiens
tttatgcttaaaatatgta

SEQ ID NO: 2011530 - DNA, 20 bp, Homo sapiens
tttatggatcccaattcatt

SEQ ID NO: 2011531 - DNA, 18 bp, Homo sapiens
tttatggcttataaatgt

SEQ ID NO: 2011532 - DNA, 18 bp, Homo sapiens
tttatgtctatttaagcc

SEQ ID NO: 2011533 - DNA, 14 bp, Homo sapiens
tttattaaaatgat

SEQ ID NO: 2011534 - DNA, 13 bp, Homo sapiens
tttattaaagcaa

SEQ ID NO: 2011535 - DNA, 14 bp, Homo sapiens
tttattaaagcaac

SEQ ID NO: 2011536 - DNA, 14 bp, Homo sapiens
tttattaagtctgg

SEQ ID NO: 2011537 - DNA, 20 bp, Homo sapiens
tttattacctctgatacctc

SEQ ID NO: 2011538 - DNA, 13 bp, Homo sapiens
tttattagctgta

SEQ ID NO: 2011539 - DNA, 19 bp, Homo sapiens
tttgtacagaatttttaat

SEQ ID NO: 2011540 - DNA, 21 bp, Homo sapiens
tttgtacagaatttttaatga

SEQ ID NO: 2011541 - DNA, 16 bp, Homo sapiens
tttgtacattcctgat

SEQ ID NO: 2011542 - DNA, 14 bp, Homo sapiens
tttgtaccatggtg

SEQ ID NO: 2011543 - DNA, 14 bp, Homo sapiens
tttgtactgaaaaa

SEQ ID NO: 2011544 - DNA, 15 bp, Homo sapiens
tttgtactgaaaaat

SEQ ID NO: 2011545 - DNA, 19 bp, Homo sapiens
tttgtaggggtcaaagaaa

SEQ ID NO: 2011546 - DNA, 20 bp, Homo sapiens
tttgtaggggtcaaagaaat

SEQ ID NO: 2011547 - DNA, 21 bp, Homo sapiens
tttgtaggggtcaaagaaatg

SEQ ID NO: 2011548 - DNA, 23 bp, Homo sapiens
tttgtaggggtcaaagaaatgct

SEQ ID NO: 2011549 - DNA, 17 bp, Homo sapiens
tttgtagtagttgatga

SEQ ID NO: 2011550 - DNA, 14 bp, Homo sapiens
tttgtataaataat

SEQ ID NO: 2011551 - DNA, 23 bp, Homo sapiens
tttgtatatcatgaaacacttct

SEQ ID NO: 2011552 - DNA, 12 bp, Homo sapiens
tttgtatattgt

SEQ ID NO: 2011553 - DNA, 13 bp, Homo sapiens
tttgtatctgaag

SEQ ID NO: 2011554 - DNA, 17 bp, Homo sapiens
tttgtattacatctaat

SEQ ID NO: 2011555 - DNA, 21 bp, Homo sapiens
tttgtattcatgaacttggct

SEQ ID NO: 2011556 - DNA, 22 bp, Homo sapiens
tttgtattcccttttatttcca

SEQ ID NO: 2011557 - DNA, 17 bp, Homo sapiens
tttgtatttaaaacctt

SEQ ID NO: 2011558 - DNA, 13 bp, Homo sapiens
tttgtattttcaa

SEQ ID NO: 2011559 - DNA, 17 bp, Homo sapiens
tttgtcatatattcatg

SEQ ID NO: 2011560 - DNA, 20 bp, Homo sapiens
tttgtcatatattcatgtaa

SEQ ID NO: 2011561 - DNA, 19 bp, Homo sapiens
tttgtccattttaaaaacc

SEQ ID NO: 2011562 - DNA, 20 bp, Homo sapiens
tttgtcccatttccttggag

SEQ ID NO: 2011563 - DNA, 21 bp, Homo sapiens
tttgtcctttgagaaagaaat

SEQ ID NO: 2011564 - DNA, 23 bp, Homo sapiens
tttgtgagtgactcggtgtaaaa

SEQ ID NO: 2011565 - DNA, 23 bp, Homo sapiens
tttgtgccttaaaaggagagaag

SEQ ID NO: 2011566 - DNA, 14 bp, Homo sapiens
tttgtgctgtgggc

SEQ ID NO: 2011567 - DNA, 17 bp, Homo sapiens
tttgtggcaccttttct

SEQ ID NO: 2011568 - DNA, 12 bp, Homo sapiens
tttgtgtaataa

SEQ ID NO: 2011569 - DNA, 17 bp, Homo sapiens
tttgtgtaataaaaatt

SEQ ID NO: 2011570 - DNA, 12 bp, Homo sapiens
tttgtgtgagag

SEQ ID NO: 2011571 - DNA, 13 bp, Homo sapiens
tttgtgtgattga

SEQ ID NO: 2011572 - DNA, 12 bp, Homo sapiens
tttgtgtttcta

SEQ ID NO: 2011573 - DNA, 17 bp, Homo sapiens
tttgttaaatatttaca

SEQ ID NO: 2011574 - DNA, 14 bp, Homo sapiens
tttgttcaaagttg

SEQ ID NO: 2011575 - DNA, 14 bp, Homo sapiens
tttgttctgtattt

SEQ ID NO: 2011576 - DNA, 15 bp, Homo sapiens
tttgttctttatttg

SEQ ID NO: 2011577 - DNA, 20 bp, Homo sapiens
tttgttgccttatcttgaaa

SEQ ID NO: 2011578 - DNA, 14 bp, Homo sapiens
tttgttgctgtcaa

SEQ ID NO: 2011579 - DNA, 14 bp, Homo sapiens
tttgttgctgtttt

SEQ ID NO: 2011580 - DNA, 15 bp, Homo sapiens
tttgtttcctttgtt

SEQ ID NO: 2011581 - DNA, 13 bp, Homo sapiens
tttgtttgtaatc

SEQ ID NO: 2011582 - DNA, 14 bp, Homo sapiens
tttgttttcatggt

SEQ ID NO: 2011583 - DNA, 19 bp, Homo sapiens
tttgtttttcttatccaag

SEQ ID NO: 2011584 - DNA, 16 bp, Homo sapiens
tttgtttttttccaac

SEQ ID NO: 2011585 - DNA, 22 bp, Homo sapiens
tttgtttttttccaactgtgtt

SEQ ID NO: 2011586 - DNA, 17 bp, Homo sapiens
ttttaaaaaagcttaaa

SEQ ID NO: 2011587 - DNA, 22 bp, Homo sapiens
ttttaaaaaagcttaaaacttt

SEQ ID NO: 2011588 - DNA, 14 bp, Homo sapiens
ttttaaaaaatgaa

SEQ ID NO: 2011589 - DNA, 15 bp, Homo sapiens
ttttaaaaaggcagt

SEQ ID NO: 2011590 - DNA, 15 bp, Homo sapiens
ttttaaaaatcataa

SEQ ID NO: 2011591 - DNA, 22 bp, Homo sapiens
ttttaaaaatcataaactgtgt

SEQ ID NO: 2011592 - DNA, 17 bp, Homo sapiens
ttttaaaaccatgcagc

SEQ ID NO: 2011593 - DNA, 12 bp, Homo sapiens
ttttaaaagaaa

SEQ ID NO: 2011594 - DNA, 13 bp, Homo sapiens
ttttaaaagaaat

SEQ ID NO: 2011595 - DNA, 12 bp, Homo sapiens
ttttaaaagttt

SEQ ID NO: 2011596 - DNA, 13 bp, Homo sapiens
ttttaaaagtttc

SEQ ID NO: 2011597 - DNA, 15 bp, Homo sapiens
ttttaaaagtttcaa

SEQ ID NO: 2011598 - DNA, 18 bp, Homo sapiens
ttttaaaagtttcaatgt

SEQ ID NO: 2011599 - DNA, 19 bp, Homo sapiens
ttttaaaatctgatttaat

SEQ ID NO: 2011600 - DNA, 20 bp, Homo sapiens
ttttaaacaaaatagaagct

SEQ ID NO: 2011601 - DNA, 23 bp, Homo sapiens
ttttaaacaaaatagaagctgta

SEQ ID NO: 2011602 - DNA, 19 bp, Homo sapiens
ttttaaacatgagaataaa

SEQ ID NO: 2011603 - DNA, 14 bp, Homo sapiens
ttttaaactagtaa

SEQ ID NO: 2011604 - DNA, 20 bp, Homo sapiens
ttttaaaggtagagatgtgt

SEQ ID NO: 2011605 - DNA, 21 bp, Homo sapiens
ttttaaaggtagagatgtgtg

SEQ ID NO: 2011606 - DNA, 22 bp, Homo sapiens
ttttaaagtatgttattgcata

SEQ ID NO: 2011607 - DNA, 17 bp, Homo sapiens
ttttaaataaaagcagc

SEQ ID NO: 2011608 - DNA, 14 bp, Homo sapiens
ttttaaatatgaac

SEQ ID NO: 2011609 - DNA, 18 bp, Homo sapiens
ttttaaatgaaaatgtaa

SEQ ID NO: 2011610 - DNA, 15 bp, Homo sapiens
ttttaaatgacattt

SEQ ID NO: 2011611 - DNA, 20 bp, Homo sapiens
ttttaaattataagatgtca

SEQ ID NO: 2011612 - DNA, 23 bp, Homo sapiens
ttttaacacataactagaaacct

SEQ ID NO: 2011613 - DNA, 22 bp, Homo sapiens
ttttaaccagtacttctaagag

SEQ ID NO: 2011614 - DNA, 12 bp, Homo sapiens
ttttaactagaa

SEQ ID NO: 2011615 - DNA, 17 bp, Homo sapiens
ttttaagcattcttaga

SEQ ID NO: 2011616 - DNA, 22 bp, Homo sapiens
ttttaagctgtaaaaagagaga

SEQ ID NO: 2011617 - DNA, 12 bp, Homo sapiens
ttttaagctgtt

SEQ ID NO: 2011618 - DNA, 20 bp, Homo sapiens
ttttaagggtttgtggaaaa

SEQ ID NO: 2011619 - DNA, 23 bp, Homo sapiens
ttttaagggtttgtggaaaatga

SEQ ID NO: 2011620 - DNA, 17 bp, Homo sapiens
ttttaagtatttatata

SEQ ID NO: 2011621 - DNA, 13 bp, Homo sapiens
ttttaataaaagt

SEQ ID NO: 2011622 - DNA, 21 bp, Homo sapiens
ttttaataaaattgacaacat

SEQ ID NO: 2011623 - DNA, 15 bp, Homo sapiens
ttttaataatttcat

SEQ ID NO: 2011624 - DNA, 16 bp, Homo sapiens
ttttaataatttcatc

SEQ ID NO: 2011625 - DNA, 12 bp, Homo sapiens
ttttaatacagg

SEQ ID NO: 2011626 - DNA, 22 bp, Homo sapiens
ttttaatcagacaaagtaattc

SEQ ID NO: 2011627 - DNA, 19 bp, Homo sapiens
ttttaattccaatatgatg

SEQ ID NO: 2011628 - DNA, 21 bp, Homo sapiens
ttttaatttatatttgaaatt

SEQ ID NO: 2011629 - DNA, 21 bp, Homo sapiens
ttttaatttatttcatccagt

SEQ ID NO: 2011630 - DNA, 14 bp, Homo sapiens
ttttaatttctaca

SEQ ID NO: 2011631 - DNA, 17 bp, Homo sapiens
ttttacaataaaatctt

SEQ ID NO: 2011632 - DNA, 17 bp, Homo sapiens
ttttacagagaatctga

SEQ ID NO: 2011633 - DNA, 13 bp, Homo sapiens
ttttacatgacca

SEQ ID NO: 2011634 - DNA, 18 bp, Homo sapiens
ttttacctaccacagtgt

SEQ ID NO: 2011635 - DNA, 15 bp, Homo sapiens
ttttactccagtggt

SEQ ID NO: 2011636 - DNA, 13 bp, Homo sapiens
ttttactgtctgt

SEQ ID NO: 2011637 - DNA, 14 bp, Homo sapiens
ttttagaaaacagc

SEQ ID NO: 2011638 - DNA, 22 bp, Homo sapiens
ttttagagccccccgtgtggct

SEQ ID NO: 2011639 - DNA, 19 bp, Homo sapiens
ttttagatgagattgtttt

SEQ ID NO: 2011640 - DNA, 16 bp, Homo sapiens
ttttagctctgttctt

SEQ ID NO: 2011641 - DNA, 18 bp, Homo sapiens
ttttaggaagcaagctta

SEQ ID NO: 2011642 - DNA, 15 bp, Homo sapiens
ttttagtaaatcctt

SEQ ID NO: 2011643 - DNA, 20 bp, Homo sapiens
ttttataactagtcctttac

SEQ ID NO: 2011644 - DNA, 14 bp, Homo sapiens
ttttatacatagtc

SEQ ID NO: 2011645 - DNA, 20 bp, Homo sapiens
ttttatacatatcagaaaag

SEQ ID NO: 2011646 - DNA, 12 bp, Homo sapiens
ttttatactgta

SEQ ID NO: 2011647 - DNA, 15 bp, Homo sapiens
ttttatagaaaagat

SEQ ID NO: 2011648 - DNA, 13 bp, Homo sapiens
ttttatatttagt

SEQ ID NO: 2011649 - DNA, 15 bp, Homo sapiens
ttttatcatgacatg

SEQ ID NO: 2011650 - DNA, 19 bp, Homo sapiens
ttttatcatgacatgttat

SEQ ID NO: 2011651 - DNA, 19 bp, Homo sapiens
ttttatcattttcaaaatg

SEQ ID NO: 2011652 - DNA, 12 bp, Homo sapiens
ttttatctttga

SEQ ID NO: 2011653 - DNA, 19 bp, Homo sapiens
ttttatgactgtaaacata

SEQ ID NO: 2011654 - DNA, 22 bp, Homo sapiens
gagctgttggcctcgcctgggc

SEQ ID NO: 2011655 - DNA, 20 bp, Homo sapiens
gagcttagccttgtgccctg

SEQ ID NO: 2011656 - DNA, 19 bp, Homo sapiens
gagcttattggccactggg

SEQ ID NO: 2011657 - DNA, 17 bp, Homo sapiens
gagcttccagtgcatgt

SEQ ID NO: 2011658 - DNA, 18 bp, Homo sapiens
gagcttccagtgcatgtt

SEQ ID NO: 2011659 - DNA, 14 bp, Homo sapiens
gagcttcccaggat

SEQ ID NO: 2011660 - DNA, 15 bp, Homo sapiens
gagcttcccaggatc

SEQ ID NO: 2011661 - DNA, 20 bp, Homo sapiens
gagcttctacagattttaga

SEQ ID NO: 2011662 - DNA, 17 bp, Homo sapiens
gagcttggtggctgagc

SEQ ID NO: 2011663 - DNA, 23 bp, Homo sapiens
gagctttctgtccttttggcact

SEQ ID NO: 2011664 - DNA, 21 bp, Homo sapiens
gaggaaaaacgatcgctgtga

SEQ ID NO: 2011665 - DNA, 21 bp, Homo sapiens
gagtgaacaactatttataaa

SEQ ID NO: 2011666 - DNA, 20 bp, Homo sapiens
gagtgacacccaagagggct

SEQ ID NO: 2011667 - DNA, 15 bp, Homo sapiens
gagtgacagaggcag

SEQ ID NO: 2011668 - DNA, 22 bp, Homo sapiens
gagtgacatgggtgtgccaggc

SEQ ID NO: 2011669 - DNA, 20 bp, Homo sapiens
gagtgacggtcccacactgg

SEQ ID NO: 2011670 - DNA, 16 bp, Homo sapiens
gagtgactcggtgtaa

SEQ ID NO: 2011671 - DNA, 21 bp, Homo sapiens
gagtgactcggtgtaaaacca

SEQ ID NO: 2011672 - DNA, 23 bp, Homo sapiens
gagtgagcagtagaagcctgcag

SEQ ID NO: 2011673 - DNA, 13 bp, Homo sapiens
gagtgagccacag

SEQ ID NO: 2011674 - DNA, 21 bp, Homo sapiens
gagtgagccacagaccacctg

SEQ ID NO: 2011675 - DNA, 23 bp, Homo sapiens
gagtgagccacagaccacctgct

SEQ ID NO: 2011676 - DNA, 15 bp, Homo sapiens
gagtgaggcttccag

SEQ ID NO: 2011677 - DNA, 18 bp, Homo sapiens
gagtgaggcttccaggct

SEQ ID NO: 2011678 - DNA, 22 bp, Homo sapiens
gagtgatacaacttcaagtgca

SEQ ID NO: 2011679 - DNA, 23 bp, Homo sapiens
gagtgcagtagtaattgatttga

SEQ ID NO: 2011680 - DNA, 12 bp, Homo sapiens
gagtgcagtgag

SEQ ID NO: 2011681 - DNA, 18 bp, Homo sapiens
gagtgcagtgagccgaga

SEQ ID NO: 2011682 - DNA, 22 bp, Homo sapiens
gagtgccaggactccccaggcc

SEQ ID NO: 2011683 - DNA, 22 bp, Homo sapiens
gagtgcccttaaaataatgatt

SEQ ID NO: 2011684 - DNA, 21 bp, Homo sapiens
gagtgcgctcttggtccctgg

SEQ ID NO: 2011685 - DNA, 23 bp, Homo sapiens
gagtgcgctcttggtccctggtc

SEQ ID NO: 2011686 - DNA, 17 bp, Homo sapiens
gagtggaggaggcctgg

SEQ ID NO: 2011687 - DNA, 22 bp, Homo sapiens
gagtggatctccaaggaccagg

SEQ ID NO: 2011688 - DNA, 13 bp, Homo sapiens
gagtggatggatg

SEQ ID NO: 2011689 - DNA, 11 bp, Homo sapiens
gagtggcagcc

SEQ ID NO: 2011690 - DNA, 17 bp, Homo sapiens
gagtggccggggaagct

SEQ ID NO: 2011691 - DNA, 21 bp, Homo sapiens
gagtggccggggaagctggca

SEQ ID NO: 2011692 - DNA, 14 bp, Homo sapiens
ctcagagcaggctc

SEQ ID NO: 2011693 - DNA, 22 bp, Homo sapiens
ctcagagcaggctcagactctg

SEQ ID NO: 2011694 - DNA, 19 bp, Homo sapiens
ctcagagcccctccctgct

SEQ ID NO: 2011695 - DNA, 16 bp, Homo sapiens
ctcagaggcccaggaa

SEQ ID NO: 2011696 - DNA, 15 bp, Homo sapiens
ctcagaggggccccg

SEQ ID NO: 2011697 - DNA, 16 bp, Homo sapiens
ctcagatcttgacagt

SEQ ID NO: 2011698 - DNA, 15 bp, Homo sapiens
ctcagcaaatcctct

SEQ ID NO: 2011699 - DNA, 16 bp, Homo sapiens
ctcagcaaatcctctt

SEQ ID NO: 2011700 - DNA, 13 bp, Homo sapiens
ctcagcacagact

SEQ ID NO: 2011701 - DNA, 18 bp, Homo sapiens
ctcagcagcagagagccc

SEQ ID NO: 2011702 - DNA, 18 bp, Homo sapiens
ctcagcagccccctgccc

SEQ ID NO: 2011703 - DNA, 12 bp, Homo sapiens
ctcagcagccct

SEQ ID NO: 2011704 - DNA, 15 bp, Homo sapiens
ctcagcagccctcct

SEQ ID NO: 2011705 - DNA, 21 bp, Homo sapiens
ctcagcatcctggcacccggc

SEQ ID NO: 2011706 - DNA, 14 bp, Homo sapiens
ctcagccacacccc

SEQ ID NO: 2011707 - DNA, 17 bp, Homo sapiens
ctcagccccgggcctgc

SEQ ID NO: 2011708 - DNA, 19 bp, Homo sapiens
ctcagccccgggcctgcct

SEQ ID NO: 2011709 - DNA, 23 bp, Homo sapiens
ctcagccccgggcctgcctctga

SEQ ID NO: 2011710 - DNA, 13 bp, Homo sapiens
ctcagccctcaga

SEQ ID NO: 2011711 - DNA, 14 bp, Homo sapiens
ctcagccctccctg

SEQ ID NO: 2011712 - DNA, 20 bp, Homo sapiens
ctcagccctccctgcccctc

SEQ ID NO: 2011713 - DNA, 13 bp, Homo sapiens
ctcagccctgact

SEQ ID NO: 2011714 - DNA, 19 bp, Homo sapiens
ctcagccctgactggtgct

SEQ ID NO: 2011715 - DNA, 11 bp, Homo sapiens
ctcagccctgg

SEQ ID NO: 2011716 - DNA, 12 bp, Homo sapiens
ctcagccctggg

SEQ ID NO: 2011717 - DNA, 15 bp, Homo sapiens
ctcagccctgggccc

SEQ ID NO: 2011718 - DNA, 21 bp, Homo sapiens
ctcagccctgggccccaccac

SEQ ID NO: 2011719 - DNA, 13 bp, Homo sapiens
ctcagcccttgcc

SEQ ID NO: 2011720 - DNA, 14 bp, Homo sapiens
ctcagcccttgccc

SEQ ID NO: 2011721 - DNA, 23 bp, Homo sapiens
ctcagccggcgtggcaaatataa

SEQ ID NO: 2011722 - DNA, 13 bp, Homo sapiens
ctcagcctcccaa

SEQ ID NO: 2011723 - DNA, 22 bp, Homo sapiens
ctcagcctcccaaagtgctggg

SEQ ID NO: 2011724 - DNA, 14 bp, Homo sapiens
ctcagcctcccaga

SEQ ID NO: 2011725 - DNA, 17 bp, Homo sapiens
ctcagcctcccagagtg

SEQ ID NO: 2011726 - DNA, 16 bp, Homo sapiens
ctcagcctccccctgc

SEQ ID NO: 2011727 - DNA, 18 bp, Homo sapiens
ctcagcctccccctgctg

SEQ ID NO: 2011728 - DNA, 21 bp, Homo sapiens
ctcagcctccccctgctgctc

SEQ ID NO: 2011729 - DNA, 18 bp, Homo sapiens
ctcagcctggtgggcctc

SEQ ID NO: 2011730 - DNA, 20 bp, Homo sapiens
ctcagcctggtgggcctcct

SEQ ID NO: 2011731 - DNA, 22 bp, Homo sapiens
ctcagccttccccttgcccagg

SEQ ID NO: 2011732 - DNA, 14 bp, Homo sapiens
ctcagcgaggtgta

SEQ ID NO: 2011733 - DNA, 19 bp, Homo sapiens
ctcagcggggacagctcct

SEQ ID NO: 2011734 - DNA, 13 bp, Homo sapiens
ctcagctcagcct

SEQ ID NO: 2011735 - DNA, 13 bp, Homo sapiens
ctcagctccagaa

SEQ ID NO: 2011736 - DNA, 22 bp, Homo sapiens
ctcagctccagaataccttctt

SEQ ID NO: 2011737 - DNA, 18 bp, Homo sapiens
ctcagctccgtcatctgc

SEQ ID NO: 2011738 - DNA, 23 bp, Homo sapiens
ctcagctctgacattctgattcg

SEQ ID NO: 2011739 - DNA, 14 bp, Homo sapiens
ctcagctgacacat

SEQ ID NO: 2011740 - DNA, 13 bp, Homo sapiens
ctcagctgcacat

SEQ ID NO: 2011741 - DNA, 14 bp, Homo sapiens
ctcagctgccaagc

SEQ ID NO: 2011742 - DNA, 14 bp, Homo sapiens
ctcagctgctcgca

SEQ ID NO: 2011743 - DNA, 14 bp, Homo sapiens
ctcagtcctggaag

SEQ ID NO: 2011744 - DNA, 16 bp, Homo sapiens
ctcagtctcaggagca

SEQ ID NO: 2011745 - DNA, 18 bp, Homo sapiens
ctcagtgaagaatacttc

SEQ ID NO: 2011746 - DNA, 22 bp, Homo sapiens
ctcagtgaggccgcccggcaca

SEQ ID NO: 2011747 - DNA, 20 bp, Homo sapiens
ctcagtgccacttgacattc

SEQ ID NO: 2011748 - DNA, 16 bp, Homo sapiens
ctcagtgctcggcagt

SEQ ID NO: 2011749 - DNA, 18 bp, Homo sapiens
ctcagtgctcggcagtca

SEQ ID NO: 2011750 - DNA, 20 bp, Homo sapiens
ctcagtgggacaaaccagag

SEQ ID NO: 2011751 - DNA, 20 bp, Homo sapiens
ctcagtgtcctcaggggcct

SEQ ID NO: 2011752 - DNA, 18 bp, Homo sapiens
ctcagtgttttagctgtt

SEQ ID NO: 2011753 - DNA, 13 bp, Homo sapiens
ctcagttattcag

SEQ ID NO: 2011754 - DNA, 18 bp, Homo sapiens
ctcagttcaacctggtgg

SEQ ID NO: 2011755 - DNA, 23 bp, Homo sapiens
ctcagttcaacctggtggcacca

SEQ ID NO: 2011756 - DNA, 10 bp, Homo sapiens
ctcagtttcc

SEQ ID NO: 2011757 - DNA, 11 bp, Homo sapiens
ctcagtttccc

SEQ ID NO: 2011758 - DNA, 16 bp, Homo sapiens
ctcagtttccccattg

SEQ ID NO: 2011759 - DNA, 11 bp, Homo sapiens
ctcagtttcct

SEQ ID NO: 2011760 - DNA, 21 bp, Homo sapiens
ctcagtttcctcatctgcaga

SEQ ID NO: 2011761 - DNA, 16 bp, Homo sapiens
ctcagtttctccatca

SEQ ID NO: 2011762 - DNA, 18 bp, Homo sapiens
ctcagtttctccatcagc

SEQ ID NO: 2011763 - DNA, 19 bp, Homo sapiens
ctcagtttctccatcagct

SEQ ID NO: 2011764 - DNA, 17 bp, Homo sapiens
ctcagttttatcatttt

SEQ ID NO: 2011765 - DNA, 21 bp, Homo sapiens
ctcagtttttcggtgggacag

SEQ ID NO: 2011766 - DNA, 22 bp, Homo sapiens
ctcagtttttcggtgggacagc

SEQ ID NO: 2011767 - DNA, 13 bp, Homo sapiens
ctcataacatctt

SEQ ID NO: 2011768 - DNA, 17 bp, Homo sapiens
ctcataaggcatataca

SEQ ID NO: 2011769 - DNA, 20 bp, Homo sapiens
ctcataaggttctttagctg

SEQ ID NO: 2011770 - DNA, 17 bp, Homo sapiens
ctcataagttggaccag

SEQ ID NO: 2011771 - DNA, 18 bp, Homo sapiens
ctcataagttggaccaga

SEQ ID NO: 2011772 - DNA, 12 bp, Homo sapiens
ctcataccatct

SEQ ID NO: 2011773 - DNA, 22 bp, Homo sapiens
ctcataccatctgctgccccgc

SEQ ID NO: 2011774 - DNA, 23 bp, Homo sapiens
ctcataggaaaagtacatttaat

SEQ ID NO: 2011775 - DNA, 18 bp, Homo sapiens
ctcatagtatggtggctg

SEQ ID NO: 2011776 - DNA, 21 bp, Homo sapiens
ctcatagtatggtggctgggt

SEQ ID NO: 2011777 - DNA, 13 bp, Homo sapiens
ctcatatatttaa

SEQ ID NO: 2011778 - DNA, 16 bp, Homo sapiens
ctcatatgtagccctc

SEQ ID NO: 2011779 - DNA, 14 bp, Homo sapiens
ctcatcacccagtc

SEQ ID NO: 2011780 - DNA, 19 bp, Homo sapiens
ctcatcacccagtcctggc

SEQ ID NO: 2011781 - DNA, 22 bp, Homo sapiens
ctcatcacccagtcctggccat

SEQ ID NO: 2011782 - DNA, 13 bp, Homo sapiens
ctcatcagtagat

SEQ ID NO: 2011783 - DNA, 12 bp, Homo sapiens
ctcatcataaaa

SEQ ID NO: 2011784 - DNA, 14 bp, Homo sapiens
ctcatcataaaata

SEQ ID NO: 2011785 - DNA, 14 bp, Homo sapiens
ctcatcatattgta

SEQ ID NO: 2011786 - DNA, 17 bp, Homo sapiens
ctcatcatattgtatgt

SEQ ID NO: 2011787 - DNA, 17 bp, Homo sapiens
ctcatcccctcgtcctg

SEQ ID NO: 2011788 - DNA, 15 bp, Homo sapiens
ctcatccctcggaag

SEQ ID NO: 2011789 - DNA, 13 bp, Homo sapiens
ctcatcctccttc

SEQ ID NO: 2011790 - DNA, 13 bp, Homo sapiens
ctcatcctgtgtg

SEQ ID NO: 2011791 - DNA, 18 bp, Homo sapiens
ctcatctaaaatttttct

SEQ ID NO: 2011792 - DNA, 18 bp, Homo sapiens
ctcatctcactgcccagt

SEQ ID NO: 2011793 - DNA, 12 bp, Homo sapiens
ctcatctcttct

SEQ ID NO: 2011794 - DNA, 15 bp, Homo sapiens
ctcatctcttctttt

SEQ ID NO: 2011795 - DNA, 15 bp, Homo sapiens
ctcatcttgccccct

SEQ ID NO: 2011796 - DNA, 21 bp, Homo sapiens
ctcatgaacctcaagctgcat

SEQ ID NO: 2011797 - DNA, 12 bp, Homo sapiens
ctcatgacagcc

SEQ ID NO: 2011798 - DNA, 19 bp, Homo sapiens
ctcatgacagccagagcct

SEQ ID NO: 2011799 - DNA, 20 bp, Homo sapiens
ctcatgacagccagagcctg

SEQ ID NO: 2011800 - DNA, 16 bp, Homo sapiens
ctcatgaccctcctgt

SEQ ID NO: 2011801 - DNA, 18 bp, Homo sapiens
ctcatgaccctcctgtcc

SEQ ID NO: 2011802 - DNA, 15 bp, Homo sapiens
ctcatgataatctgg

SEQ ID NO: 2011803 - DNA, 16 bp, Homo sapiens
atagaggtaccagcaa

SEQ ID NO: 2011804 - DNA, 17 bp, Homo sapiens
atagagtatactaaaaa

SEQ ID NO: 2011805 - DNA, 17 bp, Homo sapiens
atagatcctaggtgctg

SEQ ID NO: 2011806 - DNA, 19 bp, Homo sapiens
atagatgcaagatatttat

SEQ ID NO: 2011807 - DNA, 21 bp, Homo sapiens
atagatgcaagatatttatat

SEQ ID NO: 2011808 - DNA, 13 bp, Homo sapiens
atagatgggtctg

SEQ ID NO: 2011809 - DNA, 23 bp, Homo sapiens
atagatgggtctggctgagctga

SEQ ID NO: 2011810 - DNA, 13 bp, Homo sapiens
atagatgtgcaag

SEQ ID NO: 2011811 - DNA, 17 bp, Homo sapiens
atagattaatggcactg

SEQ ID NO: 2011812 - DNA, 19 bp, Homo sapiens
atagattaatggcactgat

SEQ ID NO: 2011813 - DNA, 19 bp, Homo sapiens
atagattataaaattattt

SEQ ID NO: 2011814 - DNA, 18 bp, Homo sapiens
atagatttgtattttaaa

SEQ ID NO: 2011815 - DNA, 16 bp, Homo sapiens
atagcaaaagaagaag

SEQ ID NO: 2011816 - DNA, 19 bp, Homo sapiens
atagcaaaagaagaagttt

SEQ ID NO: 2011817 - DNA, 15 bp, Homo sapiens
atagcaaagaattga

SEQ ID NO: 2011818 - DNA, 23 bp, Homo sapiens
ctgctctattgtagcatttcttg

SEQ ID NO: 2011819 - DNA, 15 bp, Homo sapiens
ctgctctcagcctcc

SEQ ID NO: 2011820 - DNA, 15 bp, Homo sapiens
ctgctctccgaccag

SEQ ID NO: 2011821 - DNA, 14 bp, Homo sapiens
ctgctctcctcttg

SEQ ID NO: 2011822 - DNA, 15 bp, Homo sapiens
ctgctctcttcagga

SEQ ID NO: 2011823 - DNA, 16 bp, Homo sapiens
ctgctctcttcaggag

SEQ ID NO: 2011824 - DNA, 18 bp, Homo sapiens
ctgctctgaggcttccag

SEQ ID NO: 2011825 - DNA, 21 bp, Homo sapiens
ctgctctgaggcttccagaga

SEQ ID NO: 2011826 - DNA, 12 bp, Homo sapiens
ctgctctgatgc

SEQ ID NO: 2011827 - DNA, 13 bp, Homo sapiens
ctgctctgatgca

SEQ ID NO: 2011828 - DNA, 11 bp, Homo sapiens
ctgctctgccc

SEQ ID NO: 2011829 - DNA, 12 bp, Homo sapiens
ctgctctgcccc

SEQ ID NO: 2011830 - DNA, 14 bp, Homo sapiens
ctgctctgcccctt

SEQ ID NO: 2011831 - DNA, 23 bp, Homo sapiens
ctgctctgccccttgggcatcca

SEQ ID NO: 2011832 - DNA, 16 bp, Homo sapiens
ctgctcttgcctgcac

SEQ ID NO: 2011833 - DNA, 17 bp, Homo sapiens
ctgctcttgcctgcacc

SEQ ID NO: 2011834 - DNA, 18 bp, Homo sapiens
ctgctcttgcctgcaccc

SEQ ID NO: 2011835 - DNA, 17 bp, Homo sapiens
ctgctgaaacacctccc

SEQ ID NO: 2011836 - DNA, 19 bp, Homo sapiens
ctgctgaaacacctcccag

SEQ ID NO: 2011837 - DNA, 11 bp, Homo sapiens
ctgctgaagag

SEQ ID NO: 2011838 - DNA, 18 bp, Homo sapiens
ctgctgaaggaataaatt

SEQ ID NO: 2011839 - DNA, 23 bp, Homo sapiens
ctgctgaatgatttccaaagaga

SEQ ID NO: 2011840 - DNA, 18 bp, Homo sapiens
ctgctgacagacacaggc

SEQ ID NO: 2011841 - DNA, 13 bp, Homo sapiens
ctgctgacaggat

SEQ ID NO: 2011842 - DNA, 19 bp, Homo sapiens
ctgctgacaggatgtggca

SEQ ID NO: 2011843 - DNA, 23 bp, Homo sapiens
ctgctgacaggatgtggcactgc

SEQ ID NO: 2011844 - DNA, 15 bp, Homo sapiens
ctgctgacagtgttg

SEQ ID NO: 2011845 - DNA, 13 bp, Homo sapiens
ctgctgacctgtt

SEQ ID NO: 2011846 - DNA, 12 bp, Homo sapiens
ctgctgagaacc

SEQ ID NO: 2011847 - DNA, 13 bp, Homo sapiens
ctgctgagaacct

SEQ ID NO: 2011848 - DNA, 19 bp, Homo sapiens
ctgctgagaacctggcctt

SEQ ID NO: 2011849 - DNA, 11 bp, Homo sapiens
ctgctgagcca

SEQ ID NO: 2011850 - DNA, 14 bp, Homo sapiens
ctgctgagccactc

SEQ ID NO: 2011851 - DNA, 17 bp, Homo sapiens
ctgctgagccactcgca

SEQ ID NO: 2011852 - DNA, 19 bp, Homo sapiens
ctgctgagctctgagaggc

SEQ ID NO: 2011853 - DNA, 23 bp, Homo sapiens
ctgctgagctctgagaggccctg

SEQ ID NO: 2011854 - DNA, 16 bp, Homo sapiens
ctgctgcaaagtgcaa

SEQ ID NO: 2011855 - DNA, 14 bp, Homo sapiens
ctgctgcaccagag

SEQ ID NO: 2011856 - DNA, 15 bp, Homo sapiens
tatttaacaagatct

SEQ ID NO: 2011857 - DNA, 14 bp, Homo sapiens
tatttaacataggt

SEQ ID NO: 2011858 - DNA, 23 bp, Homo sapiens
tatttaactctctttatgtctgt

SEQ ID NO: 2011859 - DNA, 18 bp, Homo sapiens
tatttaagcctcatattt

SEQ ID NO: 2011860 - DNA, 21 bp, Homo sapiens
tatttaagcctcatatttaaa

SEQ ID NO: 2011861 - DNA, 16 bp, Homo sapiens
tatttaagtatatagt

SEQ ID NO: 2011862 - DNA, 15 bp, Homo sapiens
tatttaatacctttg

SEQ ID NO: 2011863 - DNA, 13 bp, Homo sapiens
tatttaatagcaa

SEQ ID NO: 2011864 - DNA, 22 bp, Homo sapiens
tatttaatagcaaagaattgac

SEQ ID NO: 2011865 - DNA, 15 bp, Homo sapiens
tatttaatgttatgt

SEQ ID NO: 2011866 - DNA, 12 bp, Homo sapiens
tatttaattgtg

SEQ ID NO: 2011867 - DNA, 13 bp, Homo sapiens
tatttaattgtgt

SEQ ID NO: 2011868 - DNA, 23 bp, Homo sapiens
tatttaatttttttgagacagag

SEQ ID NO: 2011869 - DNA, 13 bp, Homo sapiens
tatttacaatgca

SEQ ID NO: 2011870 - DNA, 17 bp, Homo sapiens
tatttacatatgaaatt

SEQ ID NO: 2011871 - DNA, 21 bp, Homo sapiens
tatttacatatgaaatttaat

SEQ ID NO: 2011872 - DNA, 16 bp, Homo sapiens
tatttactgagcttct

SEQ ID NO: 2011873 - DNA, 19 bp, Homo sapiens
tatttactgagcttctctg

SEQ ID NO: 2011874 - DNA, 15 bp, Homo sapiens
tatttagttatagtt

SEQ ID NO: 2011875 - DNA, 17 bp, Homo sapiens
tatttagttatagtttc

SEQ ID NO: 2011876 - DNA, 13 bp, Homo sapiens
tatttataactca

SEQ ID NO: 2011877 - DNA, 22 bp, Homo sapiens
tatttataactcatcataaaat

SEQ ID NO: 2011878 - DNA, 11 bp, Homo sapiens
tatttatactc

SEQ ID NO: 2011879 - DNA, 13 bp, Homo sapiens
tatttatatattt

SEQ ID NO: 2011880 - DNA, 14 bp, Homo sapiens
tatttatatatttg

SEQ ID NO: 2011881 - DNA, 23 bp, Homo sapiens
tatttatattcagagatgtacca

SEQ ID NO: 2011882 - DNA, 13 bp, Homo sapiens
tatttatattgta

SEQ ID NO: 2011883 - DNA, 18 bp, Homo sapiens
tatttatcagtgacagag

SEQ ID NO: 2011884 - DNA, 22 bp, Homo sapiens
tatttatctccgcaggctattt

SEQ ID NO: 2011885 - DNA, 15 bp, Homo sapiens
tatttatgaatgtgc

SEQ ID NO: 2011886 - DNA, 17 bp, Homo sapiens
tatttatgaatgtgcat

SEQ ID NO: 2011887 - DNA, 12 bp, Homo sapiens
tatttatggctt

SEQ ID NO: 2011888 - DNA, 17 bp, Homo sapiens
tatttatggcttataaa

SEQ ID NO: 2011889 - DNA, 21 bp, Homo sapiens
tatttatggcttataaatgtg

SEQ ID NO: 2011890 - DNA, 12 bp, Homo sapiens
tatttattgggg

SEQ ID NO: 2011891 - DNA, 22 bp, Homo sapiens
tatttattgtttatttatcagt

SEQ ID NO: 2011892 - DNA, 17 bp, Homo sapiens
tatttatttactgagct

SEQ ID NO: 2011893 - DNA, 16 bp, Homo sapiens
tatttatttgaaagtc

SEQ ID NO: 2011894 - DNA, 15 bp, Homo sapiens
tatttcaatgttagc

SEQ ID NO: 2011895 - DNA, 15 bp, Homo sapiens
tatttcacaacagcc

SEQ ID NO: 2011896 - DNA, 19 bp, Homo sapiens
tatttcatacaaaactgtt

SEQ ID NO: 2011897 - DNA, 23 bp, Homo sapiens
tatttcatgattcacaactagga

SEQ ID NO: 2011898 - DNA, 18 bp, Homo sapiens
tatttcctcccccagtta

SEQ ID NO: 2011899 - DNA, 14 bp, Homo sapiens
tatttctagcagag

SEQ ID NO: 2011900 - DNA, 21 bp, Homo sapiens
tatttctcaacaaagcacagt

SEQ ID NO: 2011901 - DNA, 19 bp, Homo sapiens
tatttctcgggtgcatttg

SEQ ID NO: 2011902 - DNA, 20 bp, Homo sapiens
tatttctgtaaaatttgttt

SEQ ID NO: 2011903 - DNA, 20 bp, Homo sapiens
tatttctgtcattcaaatgg

SEQ ID NO: 2011904 - DNA, 13 bp, Homo sapiens
tatttctgtgtta

SEQ ID NO: 2011905 - DNA, 19 bp, Homo sapiens
tatttctttgtgataacaa

SEQ ID NO: 2011906 - DNA, 23 bp, Homo sapiens
tatttgagcatgcacagctgctt

SEQ ID NO: 2011907 - DNA, 16 bp, Homo sapiens
tatttgcactgtagcc

SEQ ID NO: 2011908 - DNA, 15 bp, Homo sapiens
tatttgcatgttacc

SEQ ID NO: 2011909 - DNA, 16 bp, Homo sapiens
tatttgcatgttacct

SEQ ID NO: 2011910 - DNA, 15 bp, Homo sapiens
tatttgctaattaaa

SEQ ID NO: 2011911 - DNA, 14 bp, Homo sapiens
tatttgcttattta

SEQ ID NO: 2011912 - DNA, 23 bp, Homo sapiens
tatttgtaaaagaacagtaaaca

SEQ ID NO: 2011913 - DNA, 15 bp, Homo sapiens
tatttgtaatagatg

SEQ ID NO: 2011914 - DNA, 20 bp, Homo sapiens
tatttgtaatagatgtttga

SEQ ID NO: 2011915 - DNA, 17 bp, Homo sapiens
tatttgtgtaatagaaa

SEQ ID NO: 2011916 - DNA, 17 bp, Homo sapiens
tatttgttaaatattta

SEQ ID NO: 2011917 - DNA, 14 bp, Homo sapiens
tatttgttattttc

SEQ ID NO: 2011918 - DNA, 18 bp, Homo sapiens
tatttgttattttcagta

SEQ ID NO: 2011919 - DNA, 14 bp, Homo sapiens
tatttgttcagaga

SEQ ID NO: 2011920 - DNA, 17 bp, Homo sapiens
tatttgttcccaagagc

SEQ ID NO: 2011921 - DNA, 14 bp, Homo sapiens
tatttgttttcatg

SEQ ID NO: 2011922 - DNA, 15 bp, Homo sapiens
tattttaaaaccatg

SEQ ID NO: 2011923 - DNA, 14 bp, Homo sapiens
tattttaaaagcca

SEQ ID NO: 2011924 - DNA, 23 bp, Homo sapiens
tattttaaaagccacatagagtg

SEQ ID NO: 2011925 - DNA, 16 bp, Homo sapiens
tattttaaagaattgt

SEQ ID NO: 2011926 - DNA, 20 bp, Homo sapiens
tattttaaagctgactttgt

SEQ ID NO: 2011927 - DNA, 22 bp, Homo sapiens
tattttaaagctgactttgttg

SEQ ID NO: 2011928 - DNA, 19 bp, Homo sapiens
tattttaatattttgtatt

SEQ ID NO: 2011929 - DNA, 21 bp, Homo sapiens
tattttacagagcttgaaaac

SEQ ID NO: 2011930 - DNA, 16 bp, Homo sapiens
tattttactactgtgg

SEQ ID NO: 2011931 - DNA, 15 bp, Homo sapiens
tattttagagaatgg

SEQ ID NO: 2011932 - DNA, 15 bp, Homo sapiens
tattttagatgcaat

SEQ ID NO: 2011933 - DNA, 15 bp, Homo sapiens
tattttatctgtgtt

SEQ ID NO: 2011934 - DNA, 13 bp, Homo sapiens
tattttatgattt

SEQ ID NO: 2011935 - DNA, 13 bp, Homo sapiens
tattttcaagaaa

SEQ ID NO: 2011936 - DNA, 13 bp, Homo sapiens
tattttcattaca

SEQ ID NO: 2011937 - DNA, 21 bp, Homo sapiens
tattttcattacaatggaaac

SEQ ID NO: 2011938 - DNA, 18 bp, Homo sapiens
tattttccaataaaattt

SEQ ID NO: 2011939 - DNA, 21 bp, Homo sapiens
tattttccctctcttgccttt

SEQ ID NO: 2011940 - DNA, 18 bp, Homo sapiens
tattttcgtgcatttgtg

SEQ ID NO: 2011941 - DNA, 19 bp, Homo sapiens
tattttcttcccatttgta

SEQ ID NO: 2011942 - DNA, 17 bp, Homo sapiens
tattttgacataaagtt

SEQ ID NO: 2011943 - DNA, 20 bp, Homo sapiens
tattttgtaaactcaaaata

SEQ ID NO: 2011944 - DNA, 16 bp, Homo sapiens
tattttgtaataaact

SEQ ID NO: 2011945 - DNA, 20 bp, Homo sapiens
tatttttatacaccattgtt

SEQ ID NO: 2011946 - DNA, 19 bp, Homo sapiens
tatttttattaaataaata

SEQ ID NO: 2011947 - DNA, 13 bp, Homo sapiens
tatttttatttgt

SEQ ID NO: 2011948 - DNA, 17 bp, Homo sapiens
tatttttatttgtttgt

SEQ ID NO: 2011949 - DNA, 14 bp, Homo sapiens
tatttttctaaggt

SEQ ID NO: 2011950 - DNA, 22 bp, Homo sapiens
tatttttgaaaggcatgttcct

SEQ ID NO: 2011951 - DNA, 19 bp, Homo sapiens
tatttttgaacccctgtgt

SEQ ID NO: 2011952 - DNA, 13 bp, Homo sapiens
tatttttgaataa

SEQ ID NO: 2011953 - DNA, 16 bp, Homo sapiens
tatttttgtacgttat

SEQ ID NO: 2011954 - DNA, 15 bp, Homo sapiens
tatttttgtgtttct

SEQ ID NO: 2011955 - DNA, 16 bp, Homo sapiens
tatttttgtgtttcta

SEQ ID NO: 2011956 - DNA, 18 bp, Homo sapiens
tattttttaaaataattt

SEQ ID NO: 2011957 - DNA, 15 bp, Homo sapiens
tattttttaagtatt

SEQ ID NO: 2011958 - DNA, 13 bp, Homo sapiens
tattttttaataa

SEQ ID NO: 2011959 - DNA, 15 bp, Homo sapiens
tattttttaataaaa

SEQ ID NO: 2011960 - DNA, 16 bp, Homo sapiens
tattttttaatcattt

SEQ ID NO: 2011961 - DNA, 17 bp, Homo sapiens
tattttttttaagtatt

SEQ ID NO: 2011962 - DNA, 19 bp, Homo sapiens
tcaaaaagtgtttattttt

SEQ ID NO: 2011963 - DNA, 23 bp, Homo sapiens
tcaaaaagtgtttatttttcata

SEQ ID NO: 2011964 - DNA, 17 bp, Homo sapiens
tcaaaaattacactaca

SEQ ID NO: 2011965 - DNA, 21 bp, Homo sapiens
tcaaaaattgaagagagatat

SEQ ID NO: 2011966 - DNA, 15 bp, Homo sapiens
tcaaaacagagatgt

SEQ ID NO: 2011967 - DNA, 16 bp, Homo sapiens
tcaaaacatatcaatt

SEQ ID NO: 2011968 - DNA, 17 bp, Homo sapiens
tcaaaacatatcaattc

SEQ ID NO: 2011969 - DNA, 18 bp, Homo sapiens
tcaaaacatatcaattca

SEQ ID NO: 2011970 - DNA, 19 bp, Homo sapiens
tcaaaacatatcaattcaa

SEQ ID NO: 2011971 - DNA, 22 bp, Homo sapiens
ctttgcactgagggccacacta

SEQ ID NO: 2011972 - DNA, 23 bp, Homo sapiens
ctttgcactgagggccacactat

SEQ ID NO: 2011973 - DNA, 14 bp, Homo sapiens
ctttgcagacaggc

SEQ ID NO: 2011974 - DNA, 13 bp, Homo sapiens
ctttgcaggctct

SEQ ID NO: 2011975 - DNA, 15 bp, Homo sapiens
ctttgcaggctctgg

SEQ ID NO: 2011976 - DNA, 21 bp, Homo sapiens
ctttgcatggaatttgtaagt

SEQ ID NO: 2011977 - DNA, 19 bp, Homo sapiens
ctttgccccaaggctgctc

SEQ ID NO: 2011978 - DNA, 12 bp, Homo sapiens
ctttgcctcaaa

SEQ ID NO: 2011979 - DNA, 11 bp, Homo sapiens
ctttgcctgct

SEQ ID NO: 2011980 - DNA, 12 bp, Homo sapiens
ctttgcctgctt

SEQ ID NO: 2011981 - DNA, 11 bp, Homo sapiens
ctttgcctggt

SEQ ID NO: 2011982 - DNA, 12 bp, Homo sapiens
ctttgcctgtgt

SEQ ID NO: 2011983 - DNA, 17 bp, Homo sapiens
ctttgcctgtgtgagca

SEQ ID NO: 2011984 - DNA, 18 bp, Homo sapiens
ctttgcctgtgtgagcat

SEQ ID NO: 2011985 - DNA, 17 bp, Homo sapiens
ctttgctacaataaatg

SEQ ID NO: 2011986 - DNA, 14 bp, Homo sapiens
ctttgctctttctt

SEQ ID NO: 2011987 - DNA, 13 bp, Homo sapiens
ctttgctgtctgg

SEQ ID NO: 2011988 - DNA, 16 bp, Homo sapiens
ctttggaaaaatcttg

SEQ ID NO: 2011989 - DNA, 19 bp, Homo sapiens
ctttggaaaaatcttgggc

SEQ ID NO: 2011990 - DNA, 17 bp, Homo sapiens
ctttggaagaaaaaatc

SEQ ID NO: 2011991 - DNA, 17 bp, Homo sapiens
ctttggaaggagtgaga

SEQ ID NO: 2011992 - DNA, 18 bp, Homo sapiens
ctttggaggaacagctcc

SEQ ID NO: 2011993 - DNA, 15 bp, Homo sapiens
ctttggcccaatgcc

SEQ ID NO: 2011994 - DNA, 19 bp, Homo sapiens
ctttggctattagagatca

SEQ ID NO: 2011995 - DNA, 15 bp, Homo sapiens
ctttggcttctcctg

SEQ ID NO: 2011996 - DNA, 16 bp, Homo sapiens
ctttggcttctcctgt

SEQ ID NO: 2011997 - DNA, 19 bp, Homo sapiens
ctttgggaggccaaggcag

SEQ ID NO: 2011998 - DNA, 14 bp, Homo sapiens
ctttgggaggctga

SEQ ID NO: 2011999 - DNA, 17 bp, Homo sapiens
ctttgggctttgcaggc

SEQ ID NO: 2012000 - DNA, 19 bp, Homo sapiens
ctttgggctttgcaggctc

SEQ ID NO: 2012001 - DNA, 17 bp, Homo sapiens
ctttggggaagggggag

SEQ ID NO: 2012002 - DNA, 24 bp, Homo sapiens
ctttggggacagttggcagagaag

SEQ ID NO: 2012003 - DNA, 20 bp, Homo sapiens
ctttggggcttttacaccag

SEQ ID NO: 2012004 - DNA, 14 bp, Homo sapiens
ctttggtagaaaag

SEQ ID NO: 2012005 - DNA, 22 bp, Homo sapiens
ctttggtgcagaggtttcttga

SEQ ID NO: 2012006 - DNA, 19 bp, Homo sapiens
ctttggttctctccaggaa

SEQ ID NO: 2012007 - DNA, 20 bp, Homo sapiens
ctttggttctctccaggaag

SEQ ID NO: 2012008 - DNA, 21 bp, Homo sapiens
ctttggttctctccaggaagg

SEQ ID NO: 2012009 - DNA, 21 bp, Homo sapiens
ctttggttgcttaactggctg

SEQ ID NO: 2012010 - DNA, 14 bp, Homo sapiens
ctttgtaaaggtca

SEQ ID NO: 2012011 - DNA, 15 bp, Homo sapiens
ctttgtaaaggtcag

SEQ ID NO: 2012012 - DNA, 16 bp, Homo sapiens
ctttgtaaaggtcaga

SEQ ID NO: 2012013 - DNA, 19 bp, Homo sapiens
ctttgtaatcgttatgtgt

SEQ ID NO: 2012014 - DNA, 17 bp, Homo sapiens
ctttgtaatgtcaccac

SEQ ID NO: 2012015 - DNA, 21 bp, Homo sapiens
ctttgtaatgtcaccaccttc

SEQ ID NO: 2012016 - DNA, 16 bp, Homo sapiens
ctttgtaccatctgtc

SEQ ID NO: 2012017 - DNA, 14 bp, Homo sapiens
ctttgtgacaggaa

SEQ ID NO: 2012018 - DNA, 22 bp, Homo sapiens
ctttgtgacaggaaagccctcc

SEQ ID NO: 2012019 - DNA, 23 bp, Homo sapiens
ctttgtgacaggaaagccctccc

SEQ ID NO: 2012020 - DNA, 21 bp, Homo sapiens
ctttgtgggagggtaagacaa

SEQ ID NO: 2012021 - DNA, 19 bp, Homo sapiens
ctttgttaaaaatattttc

SEQ ID NO: 2012022 - DNA, 19 bp, Homo sapiens
ctttgttattatcctgcat

SEQ ID NO: 2012023 - DNA, 22 bp, Homo sapiens
ctttgttatttttgtttcttcc

SEQ ID NO: 2012024 - DNA, 17 bp, Homo sapiens
ctttgttctttatttgt

SEQ ID NO: 2012025 - DNA, 22 bp, Homo sapiens
ctttgtttgggccactgccagc

SEQ ID NO: 2012026 - DNA, 14 bp, Homo sapiens
ctttgttttctaaa

SEQ ID NO: 2012027 - DNA, 14 bp, Homo sapiens
ctttgttttgcact

SEQ ID NO: 2012028 - DNA, 15 bp, Homo sapiens
ctttgttttgcactg

SEQ ID NO: 2012029 - DNA, 18 bp, Homo sapiens
cttttaaaacacttccat

SEQ ID NO: 2012030 - DNA, 13 bp, Homo sapiens
cttttaagaaaca

SEQ ID NO: 2012031 - DNA, 12 bp, Homo sapiens
cttttactcctt

SEQ ID NO: 2012032 - DNA, 14 bp, Homo sapiens
cttttactcctttg

SEQ ID NO: 2012033 - DNA, 17 bp, Homo sapiens
cttttactcctttgcat

SEQ ID NO: 2012034 - DNA, 20 bp, Homo sapiens
cttttactcctttgcattcc

SEQ ID NO: 2012035 - DNA, 22 bp, Homo sapiens
cttttaggaatatgttcaatgc

SEQ ID NO: 2012036 - DNA, 18 bp, Homo sapiens
cttttagttgtatctctt

SEQ ID NO: 2012037 - DNA, 22 bp, Homo sapiens
cttttagttttagttgcagaaa

SEQ ID NO: 2012038 - DNA, 17 bp, Homo sapiens
cttttatagctattact

SEQ ID NO: 2012039 - DNA, 18 bp, Homo sapiens
cttttatgttatttatat

SEQ ID NO: 2012040 - DNA, 19 bp, Homo sapiens
cttttattgtataaactat

SEQ ID NO: 2012041 - DNA, 12 bp, Homo sapiens
cttttatttcca

SEQ ID NO: 2012042 - DNA, 13 bp, Homo sapiens
cttttatttggaa

SEQ ID NO: 2012043 - DNA, 17 bp, Homo sapiens
cttttcaattatttcaa

SEQ ID NO: 2012044 - DNA, 18 bp, Homo sapiens
cttttcaattatttcaat

SEQ ID NO: 2012045 - DNA, 12 bp, Homo sapiens
cttttcacggga

SEQ ID NO: 2012046 - DNA, 19 bp, Homo sapiens
cttttcacgggaactctcc

SEQ ID NO: 2012047 - DNA, 16 bp, Homo sapiens
cttttcactgctggct

SEQ ID NO: 2012048 - DNA, 20 bp, Homo sapiens
cttttcactgctggctgcct

SEQ ID NO: 2012049 - DNA, 20 bp, Homo sapiens
cttttcataacctagcctta

SEQ ID NO: 2012050 - DNA, 18 bp, Homo sapiens
cttttccaggagttctga

SEQ ID NO: 2012051 - DNA, 22 bp, Homo sapiens
cttttccaggagttctgaagct

SEQ ID NO: 2012052 - DNA, 14 bp, Homo sapiens
cttttccccggtcc

SEQ ID NO: 2012053 - DNA, 13 bp, Homo sapiens
cttttcctccaga

SEQ ID NO: 2012054 - DNA, 17 bp, Homo sapiens
cttttctaatctctttt

SEQ ID NO: 2012055 - DNA, 15 bp, Homo sapiens
cttttctgcagaggg

SEQ ID NO: 2012056 - DNA, 19 bp, Homo sapiens
cttttctggaatgtaatca

SEQ ID NO: 2012057 - DNA, 13 bp, Homo sapiens
cttttctttttcc

SEQ ID NO: 2012058 - DNA, 19 bp, Homo sapiens
cttttctttttcccttgaa

SEQ ID NO: 2012059 - DNA, 14 bp, Homo sapiens
cttttctttttctc

SEQ ID NO: 2012060 - DNA, 21 bp, Homo sapiens
cttttgaatccatgcttgggt

SEQ ID NO: 2012061 - DNA, 23 bp, Homo sapiens
cttttgaatccatgcttgggtgt

SEQ ID NO: 2012062 - DNA, 18 bp, Homo sapiens
cttttgacttaaagcaga

SEQ ID NO: 2012063 - DNA, 14 bp, Homo sapiens
cttttgagaggggt

SEQ ID NO: 2012064 - DNA, 16 bp, Homo sapiens
cttttgatggggagaa

SEQ ID NO: 2012065 - DNA, 19 bp, Homo sapiens
cttttgccactttggcttc

SEQ ID NO: 2012066 - DNA, 20 bp, Homo sapiens
cttttgccactttggcttct

SEQ ID NO: 2012067 - DNA, 21 bp, Homo sapiens
cttttgcccttcacagtgttt

SEQ ID NO: 2012068 - DNA, 22 bp, Homo sapiens
cttttgctcttagctgtctgct

SEQ ID NO: 2012069 - DNA, 15 bp, Homo sapiens
cttttgctgtctttc

SEQ ID NO: 2012070 - DNA, 23 bp, Homo sapiens
cttttgctgtttggatgtttcca

SEQ ID NO: 2012071 - DNA, 13 bp, Homo sapiens
cttttggccttgt

SEQ ID NO: 2012072 - DNA, 14 bp, Homo sapiens
cttttggccttgtg

SEQ ID NO: 2012073 - DNA, 13 bp, Homo sapiens
cttttgtaaatgt

SEQ ID NO: 2012074 - DNA, 17 bp, Homo sapiens
cttttgtaccagtgtga

SEQ ID NO: 2012075 - DNA, 19 bp, Homo sapiens
cttttgtaccagtgtgaat

SEQ ID NO: 2012076 - DNA, 19 bp, Homo sapiens
cttttgtatttaaaacctt

SEQ ID NO: 2012077 - DNA, 18 bp, Homo sapiens
cttttgtccccagggccc

SEQ ID NO: 2012078 - DNA, 17 bp, Homo sapiens
cttttgtcctgttattt

SEQ ID NO: 2012079 - DNA, 20 bp, Homo sapiens
cttttgtccttcctgtgccc

SEQ ID NO: 2012080 - DNA, 12 bp, Homo sapiens
cttttgtggatt

SEQ ID NO: 2012081 - DNA, 16 bp, Homo sapiens
cttttgtggattgaca

SEQ ID NO: 2012082 - DNA, 14 bp, Homo sapiens
cttttgttgtgact

SEQ ID NO: 2012083 - DNA, 21 bp, Homo sapiens
ctttttaaaaagttgcacatt

SEQ ID NO: 2012084 - DNA, 19 bp, Homo sapiens
ctttttaagcttatttaat

SEQ ID NO: 2012085 - DNA, 19 bp, Homo sapiens
ctttttagggccaggcagg

SEQ ID NO: 2012086 - DNA, 13 bp, Homo sapiens
gaaattcacactg

SEQ ID NO: 2012087 - DNA, 13 bp, Homo sapiens
gaaattcccccac

SEQ ID NO: 2012088 - DNA, 21 bp, Homo sapiens
gaaattcccccacttgggagc

SEQ ID NO: 2012089 - DNA, 22 bp, Homo sapiens
gaaattgcctccttatttatca

SEQ ID NO: 2012090 - DNA, 15 bp, Homo sapiens
gaaattgttcctgat

SEQ ID NO: 2012091 - DNA, 22 bp, Homo sapiens
gaaattgtttaagtgttgtaaa

SEQ ID NO: 2012092 - DNA, 18 bp, Homo sapiens
gaaatttaaaaataaagc

SEQ ID NO: 2012093 - DNA, 20 bp, Homo sapiens
gaaatttaaactataagcaa

SEQ ID NO: 2012094 - DNA, 16 bp, Homo sapiens
gaaatttactgtgaga

SEQ ID NO: 2012095 - DNA, 19 bp, Homo sapiens
gaaatttcccacaccccag

SEQ ID NO: 2012096 - DNA, 15 bp, Homo sapiens
gaaatttgatttcta

SEQ ID NO: 2012097 - DNA, 22 bp, Homo sapiens
gaaattttactgacagaaatgc

SEQ ID NO: 2012098 - DNA, 20 bp, Homo sapiens
gaaattttctagactttctg

SEQ ID NO: 2012099 - DNA, 13 bp, Homo sapiens
gaaattttgtcca

SEQ ID NO: 2012100 - DNA, 18 bp, Homo sapiens
gaaattttgtccatttta

SEQ ID NO: 2012101 - DNA, 18 bp, Homo sapiens
gaacaaactgatgcgaaa

SEQ ID NO: 2012102 - DNA, 17 bp, Homo sapiens
gaacaaagaaaaaaata

SEQ ID NO: 2012103 - DNA, 19 bp, Homo sapiens
gaacaaagaaaaaaatata

SEQ ID NO: 2012104 - DNA, 22 bp, Homo sapiens
gaacaaagaacggcatgtgaat

SEQ ID NO: 2012105 - DNA, 19 bp, Homo sapiens
gaacaactaggcttcagca

SEQ ID NO: 2012106 - DNA, 16 bp, Homo sapiens
gaacaagcattctcct

SEQ ID NO: 2012107 - DNA, 14 bp, Homo sapiens
gaacaagtcacagc

SEQ ID NO: 2012108 - DNA, 16 bp, Homo sapiens
gaacaagtcacagctg

SEQ ID NO: 2012109 - DNA, 15 bp, Homo sapiens
gaacaatgtcagaaa

SEQ ID NO: 2012110 - DNA, 15 bp, Homo sapiens
gaacacactcagcag

SEQ ID NO: 2012111 - DNA, 17 bp, Homo sapiens
gaacacactcagcagcc

SEQ ID NO: 2012112 - DNA, 20 bp, Homo sapiens
gaacacactcagcagccccc

SEQ ID NO: 2012113 - DNA, 20 bp, Homo sapiens
gaacacagcagttctgcaga

SEQ ID NO: 2012114 - DNA, 22 bp, Homo sapiens
gaacacagcctgggaccagggc

SEQ ID NO: 2012115 - DNA, 17 bp, Homo sapiens
gaacacaggcaaaatcc

SEQ ID NO: 2012116 - DNA, 20 bp, Homo sapiens
gaacaccactttgtctctga

SEQ ID NO: 2012117 - DNA, 12 bp, Homo sapiens
gaacacccactg

SEQ ID NO: 2012118 - DNA, 14 bp, Homo sapiens
gaacacccctgtgc

SEQ ID NO: 2012119 - DNA, 15 bp, Homo sapiens
gaacacccctgtgca

SEQ ID NO: 2012120 - DNA, 22 bp, Homo sapiens
gaacacctttgttttgcactga

SEQ ID NO: 2012121 - DNA, 16 bp, Homo sapiens
gaacactgggggaggg

SEQ ID NO: 2012122 - DNA, 20 bp, Homo sapiens
gaacagactggaagcacagc

SEQ ID NO: 2012123 - DNA, 15 bp, Homo sapiens
gaacagagactctgg

SEQ ID NO: 2012124 - DNA, 16 bp, Homo sapiens
gaacagagcgggcctc

SEQ ID NO: 2012125 - DNA, 14 bp, Homo sapiens
gaacagaggcattt

SEQ ID NO: 2012126 - DNA, 19 bp, Homo sapiens
gaacaggcaagtgaagaaa

SEQ ID NO: 2012127 - DNA, 21 bp, Homo sapiens
gaacagtcacccttctgggca

SEQ ID NO: 2012128 - DNA, 18 bp, Homo sapiens
gaacagtgtttcccataa

SEQ ID NO: 2012129 - DNA, 21 bp, Homo sapiens
gaacatctcactttgccccag

SEQ ID NO: 2012130 - DNA, 17 bp, Homo sapiens
gaacatctgtcctgtga

SEQ ID NO: 2012131 - DNA, 19 bp, Homo sapiens
gaacatgcacatttatata

SEQ ID NO: 2012132 - DNA, 20 bp, Homo sapiens
gaacatgccctcagctaagc

SEQ ID NO: 2012133 - DNA, 15 bp, Homo sapiens
gaacatgcctgattt

SEQ ID NO: 2012134 - DNA, 19 bp, Homo sapiens
gaacatgtcggagtagaaa

SEQ ID NO: 2012135 - DNA, 19 bp, Homo sapiens
gaacattcgaggtgtcacc

SEQ ID NO: 2012136 - DNA, 15 bp, Homo sapiens
gaacatttacacatt

SEQ ID NO: 2012137 - DNA, 20 bp, Homo sapiens
gaacatttcttatgattttt

SEQ ID NO: 2012138 - DNA, 22 bp, Homo sapiens
gaacatttcttatgatttttaa

SEQ ID NO: 2012139 - DNA, 13 bp, Homo sapiens
gaacatttgcttt

SEQ ID NO: 2012140 - DNA, 20 bp, Homo sapiens
gaaccacatcttgctctgct

SEQ ID NO: 2012141 - DNA, 16 bp, Homo sapiens
gaaccaccacacccag

SEQ ID NO: 2012142 - DNA, 17 bp, Homo sapiens
gaaccaccacacccagc

SEQ ID NO: 2012143 - DNA, 20 bp, Homo sapiens
gaaccaccacacccagccca

SEQ ID NO: 2012144 - DNA, 16 bp, Homo sapiens
gaaccatccttcccat

SEQ ID NO: 2012145 - DNA, 17 bp, Homo sapiens
gaaccatccttcccatg

SEQ ID NO: 2012146 - DNA, 17 bp, Homo sapiens
gaacccaagtccaagca

SEQ ID NO: 2012147 - DNA, 14 bp, Homo sapiens
gaacccacctgctg

SEQ ID NO: 2012148 - DNA, 17 bp, Homo sapiens
gaacccagccctggggt

SEQ ID NO: 2012149 - DNA, 16 bp, Homo sapiens
gaacccaggaggtgga

SEQ ID NO: 2012150 - DNA, 16 bp, Homo sapiens
gaaccccatgggcttg

SEQ ID NO: 2012151 - DNA, 21 bp, Homo sapiens
gaacccctacatgaaacagaa

SEQ ID NO: 2012152 - DNA, 13 bp, Homo sapiens
gaacccctgtgtc

SEQ ID NO: 2012153 - DNA, 19 bp, Homo sapiens
gaacccctgtgtccctttt

SEQ ID NO: 2012154 - DNA, 15 bp, Homo sapiens
gaacccttgtgcttg

SEQ ID NO: 2012155 - DNA, 22 bp, Homo sapiens
gaaccgacttttctaaagctct

SEQ ID NO: 2012156 - DNA, 17 bp, Homo sapiens
gaaccgtgtccagcaca

SEQ ID NO: 2012157 - DNA, 18 bp, Homo sapiens
gaaccgtgtccagcacag

SEQ ID NO: 2012158 - DNA, 19 bp, Homo sapiens
gaacctaattcaattcaaa

SEQ ID NO: 2012159 - DNA, 20 bp, Homo sapiens
gaacctagtactctctgctc

SEQ ID NO: 2012160 - DNA, 22 bp, Homo sapiens
gaacctcaagtctagaaaccag

SEQ ID NO: 2012161 - DNA, 14 bp, Homo sapiens
gaacctcagtttcc

SEQ ID NO: 2012162 - DNA, 16 bp, Homo sapiens
gaacctggagggctag

SEQ ID NO: 2012163 - DNA, 12 bp, Homo sapiens
gaacctggcctt

SEQ ID NO: 2012164 - DNA, 10 bp, Homo sapiens
gaaccttccc

SEQ ID NO: 2012165 - DNA, 17 bp, Homo sapiens
gaacgagcactggccag

SEQ ID NO: 2012166 - DNA, 23 bp, Homo sapiens
gaacggagccccaggcctctgtg

SEQ ID NO: 2012167 - DNA, 23 bp, Homo sapiens
gaactcatcctgtgtggggaggc

SEQ ID NO: 2012168 - DNA, 18 bp, Homo sapiens
gaactccactctccttcg

SEQ ID NO: 2012169 - DNA, 11 bp, Homo sapiens
gaactcccagc

SEQ ID NO: 2012170 - DNA, 13 bp, Homo sapiens
gaactcctggcct

SEQ ID NO: 2012171 - DNA, 14 bp, Homo sapiens
gaactcctggcctc

SEQ ID NO: 2012172 - DNA, 15 bp, Homo sapiens
gaactccttgatttt

SEQ ID NO: 2012173 - DNA, 21 bp, Homo sapiens
gaactctaccctggtaggaaa

SEQ ID NO: 2012174 - DNA, 14 bp, Homo sapiens
gaactctgacaagg

SEQ ID NO: 2012175 - DNA, 15 bp, Homo sapiens
gaactctgacaaggg

SEQ ID NO: 2012176 - DNA, 19 bp, Homo sapiens
gaactgaagggggcggcct

SEQ ID NO: 2012177 - DNA, 16 bp, Homo sapiens
gaactgagccaaacac

SEQ ID NO: 2012178 - DNA, 19 bp, Homo sapiens
gaactgagcctagctacct

SEQ ID NO: 2012179 - DNA, 14 bp, Homo sapiens
gaactgccaagaaa

SEQ ID NO: 2012180 - DNA, 15 bp, Homo sapiens
gaactgccaagaaaa

SEQ ID NO: 2012181 - DNA, 12 bp, Homo sapiens
gaactggctgca

SEQ ID NO: 2012182 - DNA, 20 bp, Homo sapiens
gaactggttcaagagacact

SEQ ID NO: 2012183 - DNA, 19 bp, Homo sapiens
gaactgtcagcccacagca

SEQ ID NO: 2012184 - DNA, 12 bp, Homo sapiens
gaactgtgacag

SEQ ID NO: 2012185 - DNA, 14 bp, Homo sapiens
gaactgtgcctagt

SEQ ID NO: 2012186 - DNA, 19 bp, Homo sapiens
gaactgttgtttacttgtt

SEQ ID NO: 2012187 - DNA, 18 bp, Homo sapiens
gaacttacacttggagcc

SEQ ID NO: 2012188 - DNA, 23 bp, Homo sapiens
gaacttacacttggagcccgtgc

SEQ ID NO: 2012189 - DNA, 14 bp, Homo sapiens
gaacttcaaaatgt

SEQ ID NO: 2012190 - DNA, 14 bp, Homo sapiens
gaacttcaatcact

SEQ ID NO: 2012191 - DNA, 21 bp, Homo sapiens
gaacttcgaccctttctctga

SEQ ID NO: 2012192 - DNA, 14 bp, Homo sapiens
gaacttgaggacac

SEQ ID NO: 2012193 - DNA, 15 bp, Homo sapiens
gaacttgaggacaca

SEQ ID NO: 2012194 - DNA, 19 bp, Homo sapiens
gaacttgaggacacatgtc

SEQ ID NO: 2012195 - DNA, 21 bp, Homo sapiens
gaacttgaggacacatgtcca

SEQ ID NO: 2012196 - DNA, 22 bp, Homo sapiens
gaacttgctgctgagtgcacca

SEQ ID NO: 2012197 - DNA, 21 bp, Homo sapiens
gaactttctcttcatactttt

SEQ ID NO: 2012198 - DNA, 13 bp, Homo sapiens
gaagaaaaagaag

SEQ ID NO: 2012199 - DNA, 14 bp, Homo sapiens
gaagaaaaagaagc

SEQ ID NO: 2012200 - DNA, 14 bp, Homo sapiens
gaagaaaactatcc

SEQ ID NO: 2012201 - DNA, 17 bp, Homo sapiens
gaatatttattacctct

SEQ ID NO: 2012202 - DNA, 20 bp, Homo sapiens
gaatattttcattaaaagct

SEQ ID NO: 2012203 - DNA, 14 bp, Homo sapiens
gaatcaaaactctc

SEQ ID NO: 2012204 - DNA, 14 bp, Homo sapiens
gaatcaaggaatcc

SEQ ID NO: 2012205 - DNA, 17 bp, Homo sapiens
gaatcaatttcccagaa

SEQ ID NO: 2012206 - DNA, 22 bp, Homo sapiens
gaatcaatttcccagaagggag

SEQ ID NO: 2012207 - DNA, 16 bp, Homo sapiens
gaatcacacaagtttg

SEQ ID NO: 2012208 - DNA, 14 bp, Homo sapiens
gaatcacctggagg

SEQ ID NO: 2012209 - DNA, 19 bp, Homo sapiens
gaatcacctggagggcttg

SEQ ID NO: 2012210 - DNA, 23 bp, Homo sapiens
gaatcactgtattttcattttaa

SEQ ID NO: 2012211 - DNA, 19 bp, Homo sapiens
gaatcagacttcacactgc

SEQ ID NO: 2012212 - DNA, 13 bp, Homo sapiens
gaatcataatttt

SEQ ID NO: 2012213 - DNA, 15 bp, Homo sapiens
gaatcataattttca

SEQ ID NO: 2012214 - DNA, 17 bp, Homo sapiens
gaatcataattttcaag

SEQ ID NO: 2012215 - DNA, 20 bp, Homo sapiens
gaatcatgtcaggcctgtgt

SEQ ID NO: 2012216 - DNA, 21 bp, Homo sapiens
gaatcatgtcaggcctgtgtg

SEQ ID NO: 2012217 - DNA, 22 bp, Homo sapiens
gaatcatgttggatagtcagct

SEQ ID NO: 2012218 - DNA, 18 bp, Homo sapiens
gaatccagacccggctgc

SEQ ID NO: 2012219 - DNA, 19 bp, Homo sapiens
gaatccatcaggacttggg

SEQ ID NO: 2012220 - DNA, 18 bp, Homo sapiens
gaatcccacccacatgtg

SEQ ID NO: 2012221 - DNA, 15 bp, Homo sapiens
gaatccgcctgcaga

SEQ ID NO: 2012222 - DNA, 14 bp, Homo sapiens
gaatcctgcctctc

SEQ ID NO: 2012223 - DNA, 15 bp, Homo sapiens
gaatcgtttcaaatg

SEQ ID NO: 2012224 - DNA, 13 bp, Homo sapiens
gaatctacagaac

SEQ ID NO: 2012225 - DNA, 18 bp, Homo sapiens
gaatctagggagggggaa

SEQ ID NO: 2012226 - DNA, 12 bp, Homo sapiens
gaatctcccctc

SEQ ID NO: 2012227 - DNA, 14 bp, Homo sapiens
gaatctcccctcct

SEQ ID NO: 2012228 - DNA, 20 bp, Homo sapiens
gaatctgataggaaaagaag

SEQ ID NO: 2012229 - DNA, 19 bp, Homo sapiens
gaatctgcagggagcaact

SEQ ID NO: 2012230 - DNA, 15 bp, Homo sapiens
gaatctgtgcagatg

SEQ ID NO: 2012231 - DNA, 12 bp, Homo sapiens
gaatctgttact

SEQ ID NO: 2012232 - DNA, 15 bp, Homo sapiens
gaatctgttactgaa

SEQ ID NO: 2012233 - DNA, 21 bp, Homo sapiens
gaatgaaagggcccagagagg

SEQ ID NO: 2012234 - DNA, 18 bp, Homo sapiens
gaatgaaccacatcttgc

SEQ ID NO: 2012235 - DNA, 22 bp, Homo sapiens
gaatgaaccacatcttgctctg

SEQ ID NO: 2012236 - DNA, 18 bp, Homo sapiens
gaatgaagacctaaatga

SEQ ID NO: 2012237 - DNA, 16 bp, Homo sapiens
gaatgaagcatgtagc

SEQ ID NO: 2012238 - DNA, 16 bp, Homo sapiens
gaatgaattaaataaa

SEQ ID NO: 2012239 - DNA, 12 bp, Homo sapiens
gaatgacactgt

SEQ ID NO: 2012240 - DNA, 19 bp, Homo sapiens
gaatgaccacgggcctcag

SEQ ID NO: 2012241 - DNA, 17 bp, Homo sapiens
gaatgactataaacatt

SEQ ID NO: 2012242 - DNA, 11 bp, Homo sapiens
gaatgagcctc

SEQ ID NO: 2012243 - DNA, 22 bp, Homo sapiens
gaatgatttccaaagagaaaaa

SEQ ID NO: 2012244 - DNA, 16 bp, Homo sapiens
gaatgcagattcctgg

SEQ ID NO: 2012245 - DNA, 21 bp, Homo sapiens
gaatgcagattcctgggcctg

SEQ ID NO: 2012246 - DNA, 14 bp, Homo sapiens
gaatgcatgtaagg

SEQ ID NO: 2012247 - DNA, 19 bp, Homo sapiens
gaatgccttccgggccggg

SEQ ID NO: 2012248 - DNA, 13 bp, Homo sapiens
gaatgctgagacc

SEQ ID NO: 2012249 - DNA, 15 bp, Homo sapiens
gaatgctgtatatgt

SEQ ID NO: 2012250 - DNA, 18 bp, Homo sapiens
gaatgctttttgaatgtt

SEQ ID NO: 2012251 - DNA, 22 bp, Homo sapiens
gaatggcacagcccaaagaagg

SEQ ID NO: 2012252 - DNA, 18 bp, Homo sapiens
gaatggccctagaactgt

SEQ ID NO: 2012253 - DNA, 17 bp, Homo sapiens
gaatggcctgccttgaa

SEQ ID NO: 2012254 - DNA, 15 bp, Homo sapiens
gaatgggtttactct

SEQ ID NO: 2012255 - DNA, 22 bp, Homo sapiens
gaatggtgtgaacccgggaagc

SEQ ID NO: 2012256 - DNA, 19 bp, Homo sapiens
gaatggttccatgcctgag

SEQ ID NO: 2012257 - DNA, 15 bp, Homo sapiens
gaatgtatctcctcc

SEQ ID NO: 2012258 - DNA, 17 bp, Homo sapiens
gaatgtcaccagtcctg

SEQ ID NO: 2012259 - DNA, 17 bp, Homo sapiens
gaatgtcccttttccta

SEQ ID NO: 2012260 - DNA, 22 bp, Homo sapiens
gaatgtctttgttggaaaagaa

SEQ ID NO: 2012261 - DNA, 20 bp, Homo sapiens
gaatgttaagacttgacagt

SEQ ID NO: 2012262 - DNA, 16 bp, Homo sapiens
gaatgttccctgcacc

SEQ ID NO: 2012263 - DNA, 20 bp, Homo sapiens
gaatgttccctgcaccctgg

SEQ ID NO: 2012264 - DNA, 16 bp, Homo sapiens
gaatgtttgaactgcc

SEQ ID NO: 2012265 - DNA, 17 bp, Homo sapiens
gaatgtttgcctctgcc

SEQ ID NO: 2012266 - DNA, 18 bp, Homo sapiens
gaatgtttgcctctgcct

SEQ ID NO: 2012267 - DNA, 12 bp, Homo sapiens
gaattaaataaa

SEQ ID NO: 2012268 - DNA, 14 bp, Homo sapiens
gaattaagttattg

SEQ ID NO: 2012269 - DNA, 15 bp, Homo sapiens
gaattaatagctttt

SEQ ID NO: 2012270 - DNA, 20 bp, Homo sapiens
gaattaattggctatatgga

SEQ ID NO: 2012271 - DNA, 18 bp, Homo sapiens
gaattatatctaatttat

SEQ ID NO: 2012272 - DNA, 23 bp, Homo sapiens
gaattatatctaatttatacaaa

SEQ ID NO: 2012273 - DNA, 18 bp, Homo sapiens
gaattcagcaccctgggt

SEQ ID NO: 2012274 - DNA, 18 bp, Homo sapiens
gaattcatgtgaaaataa

SEQ ID NO: 2012275 - DNA, 13 bp, Homo sapiens
gaattccaaggag

SEQ ID NO: 2012276 - DNA, 17 bp, Homo sapiens
gaattcctgaagccaga

SEQ ID NO: 2012277 - DNA, 20 bp, Homo sapiens
gaattctaagattgtacata

SEQ ID NO: 2012278 - DNA, 19 bp, Homo sapiens
gaattctgctacctcactg

SEQ ID NO: 2012279 - DNA, 14 bp, Homo sapiens
gaattctggaggaa

SEQ ID NO: 2012280 - DNA, 17 bp, Homo sapiens
gaattctggaggaagaa

SEQ ID NO: 2012281 - DNA, 17 bp, Homo sapiens
gaattctgtgaagaatg

SEQ ID NO: 2012282 - DNA, 19 bp, Homo sapiens
gaattctttacaataaaca

SEQ ID NO: 2012283 - DNA, 20 bp, Homo sapiens
gaattgaaggagaaaatgca

SEQ ID NO: 2012284 - DNA, 14 bp, Homo sapiens
gaattgagctgcag

SEQ ID NO: 2012285 - DNA, 19 bp, Homo sapiens
gaattgagtgtttaaagtt

SEQ ID NO: 2012286 - DNA, 22 bp, Homo sapiens
gaattgcctgcagagagaagcc

SEQ ID NO: 2012287 - DNA, 14 bp, Homo sapiens
gaattgctgctctc

SEQ ID NO: 2012288 - DNA, 17 bp, Homo sapiens
gaattgggagcttggga

SEQ ID NO: 2012289 - DNA, 17 bp, Homo sapiens
gaattgtccatgtgctt

SEQ ID NO: 2012290 - DNA, 12 bp, Homo sapiens
gaattgtgcaaa

SEQ ID NO: 2012291 - DNA, 21 bp, Homo sapiens
gaatttcttggtaagaagccg

SEQ ID NO: 2012292 - DNA, 15 bp, Homo sapiens
gaattttaagtgctt

SEQ ID NO: 2012293 - DNA, 15 bp, Homo sapiens
gaattttagaagaga

SEQ ID NO: 2012294 - DNA, 14 bp, Homo sapiens
gaattttcagaccc

SEQ ID NO: 2012295 - DNA, 21 bp, Homo sapiens
gaattttctttgtgtagcttt

SEQ ID NO: 2012296 - DNA, 15 bp, Homo sapiens
gaatttttaatgact

SEQ ID NO: 2012297 - DNA, 16 bp, Homo sapiens
gaattttttgagtaat

SEQ ID NO: 2012298 - DNA, 22 bp, Homo sapiens
gaatttttttttcctagccctc

SEQ ID NO: 2012299 - DNA, 18 bp, Homo sapiens
gacaaaaacagcctcaca

SEQ ID NO: 2012300 - DNA, 15 bp, Homo sapiens
gacaaaactagagac

SEQ ID NO: 2012301 - DNA, 20 bp, Homo sapiens
gacaaaattggccagagagt

SEQ ID NO: 2012302 - DNA, 17 bp, Homo sapiens
gacaaacacctcccagg

SEQ ID NO: 2012303 - DNA, 22 bp, Homo sapiens
gacaaacacctcccaggagaca

SEQ ID NO: 2012304 - DNA, 18 bp, Homo sapiens
gacaaaccactgtacata

SEQ ID NO: 2012305 - DNA, 18 bp, Homo sapiens
gacaaagcatcattgtaa

SEQ ID NO: 2012306 - DNA, 18 bp, Homo sapiens
gacaaagggaaggctgct

SEQ ID NO: 2012307 - DNA, 18 bp, Homo sapiens
gacaaagttccaaaatgc

SEQ ID NO: 2012308 - DNA, 22 bp, Homo sapiens
gacaacagaagtcatgaagccc

SEQ ID NO: 2012309 - DNA, 21 bp, Homo sapiens
gacaacaggttttcaccatag

SEQ ID NO: 2012310 - DNA, 23 bp, Homo sapiens
gacaacaggttttcaccatagcc

SEQ ID NO: 2012311 - DNA, 16 bp, Homo sapiens
gacaacatcccacagt

SEQ ID NO: 2012312 - DNA, 13 bp, Homo sapiens
gacaacctttgtg

SEQ ID NO: 2012313 - DNA, 16 bp, Homo sapiens
gacaacctttgtgtaa

SEQ ID NO: 2012314 - DNA, 15 bp, Homo sapiens
gacaagaaatccctg

SEQ ID NO: 2012315 - DNA, 14 bp, Homo sapiens
gacaagaagctgct

SEQ ID NO: 2012316 - DNA, 21 bp, Homo sapiens
attgtataaactatcagtttg

SEQ ID NO: 2012317 - DNA, 11 bp, Homo sapiens
attgtatatat

SEQ ID NO: 2012318 - DNA, 15 bp, Homo sapiens
attgtatatatgtgt

SEQ ID NO: 2012319 - DNA, 12 bp, Homo sapiens
attgtatgatgt

SEQ ID NO: 2012320 - DNA, 21 bp, Homo sapiens
attgtatgatgtgttgtgata

SEQ ID NO: 2012321 - DNA, 22 bp, Homo sapiens
attgtattttagcagggtacat

SEQ ID NO: 2012322 - DNA, 14 bp, Homo sapiens
attgtcagatattt

SEQ ID NO: 2012323 - DNA, 21 bp, Homo sapiens
attgtccatatcagacctctg

SEQ ID NO: 2012324 - DNA, 19 bp, Homo sapiens
attgtccatgcctacagat

SEQ ID NO: 2012325 - DNA, 23 bp, Homo sapiens
attgtccatgcctacagataatt

SEQ ID NO: 2012326 - DNA, 23 bp, Homo sapiens
attgtcctcccctattttaagac

SEQ ID NO: 2012327 - DNA, 13 bp, Homo sapiens
attgtccttcaga

SEQ ID NO: 2012328 - DNA, 16 bp, Homo sapiens
attgtccttcagagct

SEQ ID NO: 2012329 - DNA, 17 bp, Homo sapiens
attgtccttcagagctc

SEQ ID NO: 2012330 - DNA, 18 bp, Homo sapiens
attgtcttttgtcatgtg

SEQ ID NO: 2012331 - DNA, 20 bp, Homo sapiens
attgtcttttgtcatgtggc

SEQ ID NO: 2012332 - DNA, 17 bp, Homo sapiens
attgtgaccaagttata

SEQ ID NO: 2012333 - DNA, 17 bp, Homo sapiens
attgtgacgattattta

SEQ ID NO: 2012334 - DNA, 23 bp, Homo sapiens
attgtgatcagaccataatgtta

SEQ ID NO: 2012335 - DNA, 21 bp, Homo sapiens
attgtgatctatcaatagtca

SEQ ID NO: 2012336 - DNA, 19 bp, Homo sapiens
attgtgatgttttgttcaa

SEQ ID NO: 2012337 - DNA, 16 bp, Homo sapiens
attgtgccaatatgta

SEQ ID NO: 2012338 - DNA, 17 bp, Homo sapiens
attgtgccaatatgtat

SEQ ID NO: 2012339 - DNA, 17 bp, Homo sapiens
attgtgcttaaattatt

SEQ ID NO: 2012340 - DNA, 24 bp, Homo sapiens
attgtgtaaattcctgttgtctga

SEQ ID NO: 2012341 - DNA, 23 bp, Homo sapiens
attgtgtaacaattttaatgcta

SEQ ID NO: 2012342 - DNA, 14 bp, Homo sapiens
attgtgtctgcatt

SEQ ID NO: 2012343 - DNA, 15 bp, Homo sapiens
attgtgtgagcttct

SEQ ID NO: 2012344 - DNA, 16 bp, Homo sapiens
attgtgtgttatttaa

SEQ ID NO: 2012345 - DNA, 18 bp, Homo sapiens
attgtgtgttatttaaat

SEQ ID NO: 2012346 - DNA, 19 bp, Homo sapiens
attgtgttgccttagcact

SEQ ID NO: 2012347 - DNA, 21 bp, Homo sapiens
attgtgttgccttagcacttc

SEQ ID NO: 2012348 - DNA, 19 bp, Homo sapiens
attgttacaggtgtactat

SEQ ID NO: 2012349 - DNA, 13 bp, Homo sapiens
attgttcctgtca

SEQ ID NO: 2012350 - DNA, 14 bp, Homo sapiens
attgttgattaatt

SEQ ID NO: 2012351 - DNA, 16 bp, Homo sapiens
attgttgctccctgtg

SEQ ID NO: 2012352 - DNA, 15 bp, Homo sapiens
attgttgtgggcttt

SEQ ID NO: 2012353 - DNA, 15 bp, Homo sapiens
attgtttatttatca

SEQ ID NO: 2012354 - DNA, 17 bp, Homo sapiens
attgtttatttatcagt

SEQ ID NO: 2012355 - DNA, 21 bp, Homo sapiens
attgtttatttatcagtgaca

SEQ ID NO: 2012356 - DNA, 15 bp, Homo sapiens
attgttttagagact

SEQ ID NO: 2012357 - DNA, 13 bp, Homo sapiens
attgttttatcat

SEQ ID NO: 2012358 - DNA, 19 bp, Homo sapiens
attgttttatctgaatttt

SEQ ID NO: 2012359 - DNA, 13 bp, Homo sapiens
atttaaaaaataa

SEQ ID NO: 2012360 - DNA, 20 bp, Homo sapiens
atttaaaaaataaaaaaata

SEQ ID NO: 2012361 - DNA, 23 bp, Homo sapiens
atttaaaaaataaaaaaatacag

SEQ ID NO: 2012362 - DNA, 22 bp, Homo sapiens
atttaaaaaataaatataattg

SEQ ID NO: 2012363 - DNA, 15 bp, Homo sapiens
atttaaaaaataact

SEQ ID NO: 2012364 - DNA, 15 bp, Homo sapiens
atttaaaaataaagc

SEQ ID NO: 2012365 - DNA, 16 bp, Homo sapiens
atttaaaaataaagct

SEQ ID NO: 2012366 - DNA, 17 bp, Homo sapiens
atttaaaaataaagcta

SEQ ID NO: 2012367 - DNA, 19 bp, Homo sapiens
atttaaaaataaagctact

SEQ ID NO: 2012368 - DNA, 15 bp, Homo sapiens
atttaaaatagcaaa

SEQ ID NO: 2012369 - DNA, 18 bp, Homo sapiens
atttaaaatagcaaaaga

SEQ ID NO: 2012370 - DNA, 22 bp, Homo sapiens
atttaaaatagcaaaagaagaa

SEQ ID NO: 2012371 - DNA, 13 bp, Homo sapiens
atttaaaatgatt

SEQ ID NO: 2012372 - DNA, 16 bp, Homo sapiens
atttaaaatgattaga

SEQ ID NO: 2012373 - DNA, 12 bp, Homo sapiens
atttaaaccagc

SEQ ID NO: 2012374 - DNA, 14 bp, Homo sapiens
atttaaaccagcag

SEQ ID NO: 2012375 - DNA, 17 bp, Homo sapiens
atttaaaccagcagaaa

SEQ ID NO: 2012376 - DNA, 19 bp, Homo sapiens
atttaaaccagcagaaaag

SEQ ID NO: 2012377 - DNA, 19 bp, Homo sapiens
atttaaactataagcaaga

SEQ ID NO: 2012378 - DNA, 14 bp, Homo sapiens
atttaaaggggaga

SEQ ID NO: 2012379 - DNA, 16 bp, Homo sapiens
atttaaatattaaata

SEQ ID NO: 2012380 - DNA, 13 bp, Homo sapiens
atttaaatctgtt

SEQ ID NO: 2012381 - DNA, 23 bp, Homo sapiens
acattatgtgtgcatgtgtgtat

SEQ ID NO: 2012382 - DNA, 20 bp, Homo sapiens
acattcacacagggctcttt

SEQ ID NO: 2012383 - DNA, 19 bp, Homo sapiens
acattccctatcaaaacat

SEQ ID NO: 2012384 - DNA, 22 bp, Homo sapiens
acattccctatcaaaacatatc

SEQ ID NO: 2012385 - DNA, 14 bp, Homo sapiens
acattccctggcct

SEQ ID NO: 2012386 - DNA, 15 bp, Homo sapiens
acattccctggcctg

SEQ ID NO: 2012387 - DNA, 12 bp, Homo sapiens
acattcctcagc

SEQ ID NO: 2012388 - DNA, 13 bp, Homo sapiens
acattcctggccc

SEQ ID NO: 2012389 - DNA, 21 bp, Homo sapiens
acattctcacaattgtaaagt

SEQ ID NO: 2012390 - DNA, 23 bp, Homo sapiens
acattctgattcgaatgacactg

SEQ ID NO: 2012391 - DNA, 23 bp, Homo sapiens
acattcttaaaggaaaagtcaac

SEQ ID NO: 2012392 - DNA, 12 bp, Homo sapiens
acattgaaagag

SEQ ID NO: 2012393 - DNA, 16 bp, Homo sapiens
acattgatttattttt

SEQ ID NO: 2012394 - DNA, 15 bp, Homo sapiens
acattgcctccacct

SEQ ID NO: 2012395 - DNA, 22 bp, Homo sapiens
acattgcggacagccacggcca

SEQ ID NO: 2012396 - DNA, 14 bp, Homo sapiens
acattggacttcct

SEQ ID NO: 2012397 - DNA, 12 bp, Homo sapiens
acattgtctgcg

SEQ ID NO: 2012398 - DNA, 16 bp, Homo sapiens
acattgttaaaataaa

SEQ ID NO: 2012399 - DNA, 16 bp, Homo sapiens
acatttacaataaata

SEQ ID NO: 2012400 - DNA, 17 bp, Homo sapiens
acatttacaataaatat

SEQ ID NO: 2012401 - DNA, 13 bp, Homo sapiens
acatttacacatt

SEQ ID NO: 2012402 - DNA, 20 bp, Homo sapiens
acatttataatgtttgctat

SEQ ID NO: 2012403 - DNA, 13 bp, Homo sapiens
acatttatacatc

SEQ ID NO: 2012404 - DNA, 17 bp, Homo sapiens
acatttatatatatatg

SEQ ID NO: 2012405 - DNA, 15 bp, Homo sapiens
acatttatctaaaag

SEQ ID NO: 2012406 - DNA, 15 bp, Homo sapiens
acatttattctgctc

SEQ ID NO: 2012407 - DNA, 16 bp, Homo sapiens
acatttcaaagctgag

SEQ ID NO: 2012408 - DNA, 12 bp, Homo sapiens
acatttccctgt

SEQ ID NO: 2012409 - DNA, 15 bp, Homo sapiens
acatttccctgtgct

SEQ ID NO: 2012410 - DNA, 14 bp, Homo sapiens
acatttctaacata

SEQ ID NO: 2012411 - DNA, 20 bp, Homo sapiens
acatttcttatgatttttaa

SEQ ID NO: 2012412 - DNA, 13 bp, Homo sapiens
acatttgatgtac

SEQ ID NO: 2012413 - DNA, 18 bp, Homo sapiens
acatttgatgtacatgtg

SEQ ID NO: 2012414 - DNA, 15 bp, Homo sapiens
acatttgccttgctg

SEQ ID NO: 2012415 - DNA, 13 bp, Homo sapiens
acatttgtacatt

SEQ ID NO: 2012416 - DNA, 19 bp, Homo sapiens
acatttgtacattcctgat

SEQ ID NO: 2012417 - DNA, 20 bp, Homo sapiens
acatttgttcatgagtggat

SEQ ID NO: 2012418 - DNA, 17 bp, Homo sapiens
acattttaaaaaacaaa

SEQ ID NO: 2012419 - DNA, 20 bp, Homo sapiens
acattttaaataaaagaaaa

SEQ ID NO: 2012420 - DNA, 16 bp, Homo sapiens
acattttatttattag

SEQ ID NO: 2012421 - DNA, 22 bp, Homo sapiens
acattttatttattagctgtaa

SEQ ID NO: 2012422 - DNA, 17 bp, Homo sapiens
acattttctctttaaaa

SEQ ID NO: 2012423 - DNA, 13 bp, Homo sapiens
acattttgccttt

SEQ ID NO: 2012424 - DNA, 19 bp, Homo sapiens
acattttgttatagaatac

SEQ ID NO: 2012425 - DNA, 21 bp, Homo sapiens
acattttgttatagaatactt

SEQ ID NO: 2012426 - DNA, 14 bp, Homo sapiens
acatttttacaata

SEQ ID NO: 2012427 - DNA, 21 bp, Homo sapiens
accaaaaaggctagtttattt

SEQ ID NO: 2012428 - DNA, 13 bp, Homo sapiens
accaaaagaagta

SEQ ID NO: 2012429 - DNA, 21 bp, Homo sapiens
accaaaagaagtaaaagcaaa

SEQ ID NO: 2012430 - DNA, 21 bp, Homo sapiens
accaaaagttacatgtttgca

SEQ ID NO: 2012431 - DNA, 23 bp, Homo sapiens
accaaaatttctttttttaaatt

SEQ ID NO: 2012432 - DNA, 21 bp, Homo sapiens
accaaagagactggagcatct

SEQ ID NO: 2012433 - DNA, 20 bp, Homo sapiens
accaaagcaccttagctggc

SEQ ID NO: 2012434 - DNA, 21 bp, Homo sapiens
accaaaggaatcgtttcaaat

SEQ ID NO: 2012435 - DNA, 12 bp, Homo sapiens
accaaatataaa

SEQ ID NO: 2012436 - DNA, 21 bp, Homo sapiens
accaaatgagcattagctact

SEQ ID NO: 2012437 - DNA, 15 bp, Homo sapiens
accaaatgatgccac

SEQ ID NO: 2012438 - DNA, 14 bp, Homo sapiens
accaaattgcttct

SEQ ID NO: 2012439 - DNA, 19 bp, Homo sapiens
accaacacgagcaggctac

SEQ ID NO: 2012440 - DNA, 22 bp, Homo sapiens
accaacaggctgttctgcactg

SEQ ID NO: 2012441 - DNA, 23 bp, Homo sapiens
accaacaggctgttctgcactga

SEQ ID NO: 2012442 - DNA, 14 bp, Homo sapiens
accaacataaaaat

SEQ ID NO: 2012443 - DNA, 24 bp, Homo sapiens
accaacatggagaaaccctgtctc

SEQ ID NO: 2012444 - DNA, 18 bp, Homo sapiens
accagctgctactcataa

SEQ ID NO: 2012445 - DNA, 14 bp, Homo sapiens
accaggacaggacc

SEQ ID NO: 2012446 - DNA, 15 bp, Homo sapiens
accaggacaggacca

SEQ ID NO: 2012447 - DNA, 20 bp, Homo sapiens
accaggcacgaacccacctg

SEQ ID NO: 2012448 - DNA, 22 bp, Homo sapiens
accaggcacgaacccacctgct

SEQ ID NO: 2012449 - DNA, 20 bp, Homo sapiens
accagggagcccctttgatg

SEQ ID NO: 2012450 - DNA, 21 bp, Homo sapiens
accagggcactgtctgcgtga

SEQ ID NO: 2012451 - DNA, 16 bp, Homo sapiens
accagggcgcaagcct

SEQ ID NO: 2012452 - DNA, 24 bp, Homo sapiens
accaggggtgatttcagagagggc

SEQ ID NO: 2012453 - DNA, 14 bp, Homo sapiens
accagtacttctaa

SEQ ID NO: 2012454 - DNA, 16 bp, Homo sapiens
accagtacttctaaga

SEQ ID NO: 2012455 - DNA, 17 bp, Homo sapiens
accagtacttctaagag

SEQ ID NO: 2012456 - DNA, 18 bp, Homo sapiens
accagtatggaagggagg

SEQ ID NO: 2012457 - DNA, 22 bp, Homo sapiens
accagtgcccaaagtctgtgtg

SEQ ID NO: 2012458 - DNA, 14 bp, Homo sapiens
accagtgccgcctg

SEQ ID NO: 2012459 - DNA, 16 bp, Homo sapiens
accagtgccgcctgtg

SEQ ID NO: 2012460 - DNA, 12 bp, Homo sapiens
accagtgtactg

SEQ ID NO: 2012461 - DNA, 16 bp, Homo sapiens
accagtgtactgcttt

SEQ ID NO: 2012462 - DNA, 13 bp, Homo sapiens
accagtgtagcct

SEQ ID NO: 2012463 - DNA, 20 bp, Homo sapiens
accagtgtcccctccactgt

SEQ ID NO: 2012464 - DNA, 23 bp, Homo sapiens
accagttctggccaggagctgga

SEQ ID NO: 2012465 - DNA, 19 bp, Homo sapiens
accagttgggagcactgga

SEQ ID NO: 2012466 - DNA, 21 bp, Homo sapiens
accataagggactgtgccaga

SEQ ID NO: 2012467 - DNA, 20 bp, Homo sapiens
accatatgtctgcttctgtc

SEQ ID NO: 2012468 - DNA, 13 bp, Homo sapiens
accatcaaatgct

SEQ ID NO: 2012469 - DNA, 12 bp, Homo sapiens
accatcaataaa

SEQ ID NO: 2012470 - DNA, 13 bp, Homo sapiens
accatcaataaag

SEQ ID NO: 2012471 - DNA, 15 bp, Homo sapiens
accatcaatggaaac

SEQ ID NO: 2012472 - DNA, 14 bp, Homo sapiens
accatcacacatgc

SEQ ID NO: 2012473 - DNA, 13 bp, Homo sapiens
accatcctattta

SEQ ID NO: 2012474 - DNA, 17 bp, Homo sapiens
accatcctgcagcctcc

SEQ ID NO: 2012475 - DNA, 17 bp, Homo sapiens
accatcctggcccctcc

SEQ ID NO: 2012476 - DNA, 19 bp, Homo sapiens
accatcctggcccctccag

SEQ ID NO: 2012477 - DNA, 18 bp, Homo sapiens
accatcttaaatgacagt

SEQ ID NO: 2012478 - DNA, 23 bp, Homo sapiens
accatgagaataagagaaagaaa

SEQ ID NO: 2012479 - DNA, 18 bp, Homo sapiens
accatgagcaattctcct

SEQ ID NO: 2012480 - DNA, 16 bp, Homo sapiens
accatgcaaatgctat

SEQ ID NO: 2012481 - DNA, 19 bp, Homo sapiens
accatgcagcttcatcaat

SEQ ID NO: 2012482 - DNA, 14 bp, Homo sapiens
accatgccaggcta

SEQ ID NO: 2012483 - DNA, 14 bp, Homo sapiens
accatgctggcggc

SEQ ID NO: 2012484 - DNA, 20 bp, Homo sapiens
accatgctggcggcgcagag

SEQ ID NO: 2012485 - DNA, 22 bp, Homo sapiens
accatggaggcaggctccccct

SEQ ID NO: 2012486 - DNA, 17 bp, Homo sapiens
accatgtaacaaccaga

SEQ ID NO: 2012487 - DNA, 11 bp, Homo sapiens
accatgtacat

SEQ ID NO: 2012488 - DNA, 17 bp, Homo sapiens
accatgtacatgaagaa

SEQ ID NO: 2012489 - DNA, 19 bp, Homo sapiens
accatgtctctaagccaac

SEQ ID NO: 2012490 - DNA, 21 bp, Homo sapiens
accatgtgtagattgcgtgga

SEQ ID NO: 2012491 - DNA, 20 bp, Homo sapiens
accatgtttgagctcagacc

SEQ ID NO: 2012492 - DNA, 14 bp, Homo sapiens
accattcacatttg

SEQ ID NO: 2012493 - DNA, 19 bp, Homo sapiens
accattcacatttgatgta

SEQ ID NO: 2012494 - DNA, 12 bp, Homo sapiens
accattccccat

SEQ ID NO: 2012495 - DNA, 22 bp, Homo sapiens
accattgacctcagctgcacat

SEQ ID NO: 2012496 - DNA, 17 bp, Homo sapiens
accattggctgcgctaa

SEQ ID NO: 2012497 - DNA, 12 bp, Homo sapiens
accattgtcttc

SEQ ID NO: 2012498 - DNA, 14 bp, Homo sapiens
accattgtcttcca

SEQ ID NO: 2012499 - DNA, 20 bp, Homo sapiens
accattgtcttccaacccca

SEQ ID NO: 2012500 - DNA, 14 bp, Homo sapiens
accatttaattcat

SEQ ID NO: 2012501 - DNA, 13 bp, Homo sapiens
acctggagggcta

SEQ ID NO: 2012502 - DNA, 20 bp, Homo sapiens
acctggagggctagaacctg

SEQ ID NO: 2012503 - DNA, 22 bp, Homo sapiens
acctggagggctagaacctggc

SEQ ID NO: 2012504 - DNA, 18 bp, Homo sapiens
acctggccgcctccagga

SEQ ID NO: 2012505 - DNA, 13 bp, Homo sapiens
acctggcctgctg

SEQ ID NO: 2012506 - DNA, 15 bp, Homo sapiens
acctggcctgctggg

SEQ ID NO: 2012507 - DNA, 17 bp, Homo sapiens
acctggcctgctgggaa

SEQ ID NO: 2012508 - DNA, 11 bp, Homo sapiens
acctggccttc

SEQ ID NO: 2012509 - DNA, 18 bp, Homo sapiens
acctgggaaaacagagga

SEQ ID NO: 2012510 - DNA, 20 bp, Homo sapiens
acctgggaaaacagaggaat

SEQ ID NO: 2012511 - DNA, 17 bp, Homo sapiens
acctgggaaaggaccca

SEQ ID NO: 2012512 - DNA, 23 bp, Homo sapiens
acctgggaaaggacccacccatc

SEQ ID NO: 2012513 - DNA, 24 bp, Homo sapiens
acctgggaaaggacccacccatct

SEQ ID NO: 2012514 - DNA, 16 bp, Homo sapiens
acctgggaaccatgaa

SEQ ID NO: 2012515 - DNA, 20 bp, Homo sapiens
acctgggaaccatgaagctg

SEQ ID NO: 2012516 - DNA, 15 bp, Homo sapiens
acctgggatatgaca

SEQ ID NO: 2012517 - DNA, 23 bp, Homo sapiens
acctgggccaaaagggcagccag

SEQ ID NO: 2012518 - DNA, 20 bp, Homo sapiens
acctgggcctttcctgtgcc

SEQ ID NO: 2012519 - DNA, 21 bp, Homo sapiens
acctggtcacaggactctgcc

SEQ ID NO: 2012520 - DNA, 22 bp, Homo sapiens
acctggtcacaggactctgcct

SEQ ID NO: 2012521 - DNA, 14 bp, Homo sapiens
acctggtctctcct

SEQ ID NO: 2012522 - DNA, 19 bp, Homo sapiens
acctgtaatcccagctact

SEQ ID NO: 2012523 - DNA, 18 bp, Homo sapiens
acctgtcagcccaagcag

SEQ ID NO: 2012524 - DNA, 14 bp, Homo sapiens
acctgtctccctgg

SEQ ID NO: 2012525 - DNA, 11 bp, Homo sapiens
acctgtctgtc

SEQ ID NO: 2012526 - DNA, 12 bp, Homo sapiens
acctgtctgtct

SEQ ID NO: 2012527 - DNA, 18 bp, Homo sapiens
acctgtctgtctgtctgt

SEQ ID NO: 2012528 - DNA, 18 bp, Homo sapiens
acctgtgcagtcccgtgg

SEQ ID NO: 2012529 - DNA, 16 bp, Homo sapiens
acctgtgttcattctt

SEQ ID NO: 2012530 - DNA, 20 bp, Homo sapiens
acctgtgtttcttgcctcat

SEQ ID NO: 2012531 - DNA, 14 bp, Homo sapiens
acctgttcaggagc

SEQ ID NO: 2012532 - DNA, 15 bp, Homo sapiens
acctgttgcacctca

SEQ ID NO: 2012533 - DNA, 17 bp, Homo sapiens
acctgtttatataattt

SEQ ID NO: 2012534 - DNA, 14 bp, Homo sapiens
acctgttttcttca

SEQ ID NO: 2012535 - DNA, 23 bp, Homo sapiens
accttaaatctgcctttgtttct

SEQ ID NO: 2012536 - DNA, 19 bp, Homo sapiens
accttaatattattggggt

SEQ ID NO: 2012537 - DNA, 14 bp, Homo sapiens
accttacattccta

SEQ ID NO: 2012538 - DNA, 15 bp, Homo sapiens
accttaccaactttc

SEQ ID NO: 2012539 - DNA, 18 bp, Homo sapiens
accttaccaactttctgt

SEQ ID NO: 2012540 - DNA, 19 bp, Homo sapiens
accttaccaactttctgta

SEQ ID NO: 2012541 - DNA, 18 bp, Homo sapiens
accttagaaatcattgta

SEQ ID NO: 2012542 - DNA, 18 bp, Homo sapiens
accttagcagctcttccc

SEQ ID NO: 2012543 - DNA, 13 bp, Homo sapiens
accttcaataaag

SEQ ID NO: 2012544 - DNA, 14 bp, Homo sapiens
acccccgccacggc

SEQ ID NO: 2012545 - DNA, 21 bp, Homo sapiens
acccccgccacggccaccctc

SEQ ID NO: 2012546 - DNA, 15 bp, Homo sapiens
acccccgctccagat

SEQ ID NO: 2012547 - DNA, 15 bp, Homo sapiens
acccccgtggtcttt

SEQ ID NO: 2012548 - DNA, 17 bp, Homo sapiens
acccccgtggtctttga

SEQ ID NO: 2012549 - DNA, 18 bp, Homo sapiens
acccccgtggtctttgaa

SEQ ID NO: 2012550 - DNA, 21 bp, Homo sapiens
acccccgtggtctttgaataa

SEQ ID NO: 2012551 - DNA, 11 bp, Homo sapiens
accccctcatt

SEQ ID NO: 2012552 - DNA, 14 bp, Homo sapiens
accccctccagctc

SEQ ID NO: 2012553 - DNA, 19 bp, Homo sapiens
accccctcccacccccagc

SEQ ID NO: 2012554 - DNA, 12 bp, Homo sapiens
accccctcccca

SEQ ID NO: 2012555 - DNA, 14 bp, Homo sapiens
accccctccccagg

SEQ ID NO: 2012556 - DNA, 16 bp, Homo sapiens
accccctccccagggg

SEQ ID NO: 2012557 - DNA, 22 bp, Homo sapiens
accccctgagtcaactggagca

SEQ ID NO: 2012558 - DNA, 13 bp, Homo sapiens
accccctgcagct

SEQ ID NO: 2012559 - DNA, 12 bp, Homo sapiens
accccctggaga

SEQ ID NO: 2012560 - DNA, 18 bp, Homo sapiens
acccccttctactgagcc

SEQ ID NO: 2012561 - DNA, 15 bp, Homo sapiens
accccgcagcccgtg

SEQ ID NO: 2012562 - DNA, 15 bp, Homo sapiens
accccgcggtgctct

SEQ ID NO: 2012563 - DNA, 18 bp, Homo sapiens
accccgcggtgctctggc

SEQ ID NO: 2012564 - DNA, 21 bp, Homo sapiens
accccgcggtgctctggcggc

SEQ ID NO: 2012565 - DNA, 14 bp, Homo sapiens
accccggatcgagg

SEQ ID NO: 2012566 - DNA, 15 bp, Homo sapiens
accccggcctccact

SEQ ID NO: 2012567 - DNA, 21 bp, Homo sapiens
accccggcctccactccccca

SEQ ID NO: 2012568 - DNA, 22 bp, Homo sapiens
accccgtctggggttcagcccc

SEQ ID NO: 2012569 - DNA, 16 bp, Homo sapiens
acccctaacctggctt

SEQ ID NO: 2012570 - DNA, 18 bp, Homo sapiens
acccctaacctggcttat

SEQ ID NO: 2012571 - DNA, 15 bp, Homo sapiens
acccctcactctggc

SEQ ID NO: 2012572 - DNA, 17 bp, Homo sapiens
acccctcactctggcct

SEQ ID NO: 2012573 - DNA, 18 bp, Homo sapiens
acccctcactctggcctc

SEQ ID NO: 2012574 - DNA, 14 bp, Homo sapiens
acccctcccaacct

SEQ ID NO: 2012575 - DNA, 20 bp, Homo sapiens
acccctccccattcacagag

SEQ ID NO: 2012576 - DNA, 20 bp, Homo sapiens
acccctgcaccagcccttcc

SEQ ID NO: 2012577 - DNA, 19 bp, Homo sapiens
acccctgcctgggttttct

SEQ ID NO: 2012578 - DNA, 20 bp, Homo sapiens
acccctgcctgggttttcta

SEQ ID NO: 2012579 - DNA, 20 bp, Homo sapiens
acccctggcttttcactgct

SEQ ID NO: 2012580 - DNA, 21 bp, Homo sapiens
acccctgttaagcaattcctt

SEQ ID NO: 2012581 - DNA, 17 bp, Homo sapiens
accccttatccaggact

SEQ ID NO: 2012582 - DNA, 15 bp, Homo sapiens
accccttcctttcct

SEQ ID NO: 2012583 - DNA, 18 bp, Homo sapiens
accccttcctttcctctg

SEQ ID NO: 2012584 - DNA, 15 bp, Homo sapiens
accccttcgctcctg

SEQ ID NO: 2012585 - DNA, 15 bp, Homo sapiens
acccctttcccccac

SEQ ID NO: 2012586 - DNA, 12 bp, Homo sapiens
acccctttcctg

SEQ ID NO: 2012587 - DNA, 19 bp, Homo sapiens
acccgagcccagctacatt

SEQ ID NO: 2012588 - DNA, 15 bp, Homo sapiens
acccgaggctgccca

SEQ ID NO: 2012589 - DNA, 12 bp, Homo sapiens
acccggaaagac

SEQ ID NO: 2012590 - DNA, 15 bp, Homo sapiens
acccggaggggcctg

SEQ ID NO: 2012591 - DNA, 21 bp, Homo sapiens
acccggaggggcctggcagcc

SEQ ID NO: 2012592 - DNA, 16 bp, Homo sapiens
acccggcaccccctgc

SEQ ID NO: 2012593 - DNA, 12 bp, Homo sapiens
acccggctcccc

SEQ ID NO: 2012594 - DNA, 21 bp, Homo sapiens
acccggctccccctgcttctc

SEQ ID NO: 2012595 - DNA, 23 bp, Homo sapiens
acccgtgccaagtccaggtcctg

SEQ ID NO: 2012596 - DNA, 21 bp, Homo sapiens
acccgttcaacttttcctttg

SEQ ID NO: 2012597 - DNA, 23 bp, Homo sapiens
acccgttctgctggcctggatct

SEQ ID NO: 2012598 - DNA, 18 bp, Homo sapiens
acctaaatgacctcagca

SEQ ID NO: 2012599 - DNA, 22 bp, Homo sapiens
acctaaatgacctcagcaaatc

SEQ ID NO: 2012600 - DNA, 16 bp, Homo sapiens
acctaccacagtgtct

SEQ ID NO: 2012601 - DNA, 19 bp, Homo sapiens
acctaccacagtgtctgta

SEQ ID NO: 2012602 - DNA, 21 bp, Homo sapiens
acctaccaccccttcctgtcc

SEQ ID NO: 2012603 - DNA, 20 bp, Homo sapiens
acctacttgtgactgaaggg

SEQ ID NO: 2012604 - DNA, 13 bp, Homo sapiens
acctagcaattcc

SEQ ID NO: 2012605 - DNA, 19 bp, Homo sapiens
acctagcatcttacaaaaa

SEQ ID NO: 2012606 - DNA, 23 bp, Homo sapiens
acctagtactctctgctctagcc

SEQ ID NO: 2012607 - DNA, 15 bp, Homo sapiens
acctatacctgtgtt

SEQ ID NO: 2012608 - DNA, 15 bp, Homo sapiens
acctatagtcccagc

SEQ ID NO: 2012609 - DNA, 17 bp, Homo sapiens
acctatatgatttatag

SEQ ID NO: 2012610 - DNA, 18 bp, Homo sapiens
acctatgtcatttcattt

SEQ ID NO: 2012611 - DNA, 22 bp, Homo sapiens
acctatgtcatttcatttccta

SEQ ID NO: 2012612 - DNA, 15 bp, Homo sapiens
acctatgtgacagac

SEQ ID NO: 2012613 - DNA, 14 bp, Homo sapiens
acctattttttaaa

SEQ ID NO: 2012614 - DNA, 12 bp, Homo sapiens
acctcaaactgg

SEQ ID NO: 2012615 - DNA, 21 bp, Homo sapiens
acctcaacccccatttctatt

SEQ ID NO: 2012616 - DNA, 15 bp, Homo sapiens
acctcaactaaccct

SEQ ID NO: 2012617 - DNA, 19 bp, Homo sapiens
acctcaatcagtctcagaa

SEQ ID NO: 2012618 - DNA, 21 bp, Homo sapiens
acctcaatcagtctcagaatg

SEQ ID NO: 2012619 - DNA, 15 bp, Homo sapiens
acctcaatgccctgc

SEQ ID NO: 2012620 - DNA, 17 bp, Homo sapiens
acctcaatgccctgcca

SEQ ID NO: 2012621 - DNA, 15 bp, Homo sapiens
acctcacagaaatgt

SEQ ID NO: 2012622 - DNA, 19 bp, Homo sapiens
acctcacagtgacccttcc

SEQ ID NO: 2012623 - DNA, 20 bp, Homo sapiens
acctcacagtgacccttccc

SEQ ID NO: 2012624 - DNA, 19 bp, Homo sapiens
acctcacccgaggctgccc

SEQ ID NO: 2012625 - DNA, 17 bp, Homo sapiens
acctcaccggcatgctg

SEQ ID NO: 2012626 - DNA, 19 bp, Homo sapiens
acctcaccggcatgctggc

SEQ ID NO: 2012627 - DNA, 14 bp, Homo sapiens
acctcacgctctgg

SEQ ID NO: 2012628 - DNA, 16 bp, Homo sapiens
acctcactatggtatg

SEQ ID NO: 2012629 - DNA, 15 bp, Homo sapiens
acctcactgaggaag

SEQ ID NO: 2012630 - DNA, 21 bp, Homo sapiens
acctcactggggtcctggggc

SEQ ID NO: 2012631 - DNA, 18 bp, Homo sapiens
acctcagacaatccactc

SEQ ID NO: 2012632 - DNA, 12 bp, Homo sapiens
acctcagcaaat

SEQ ID NO: 2012633 - DNA, 20 bp, Homo sapiens
acctcagcaaatcctcttct

SEQ ID NO: 2012634 - DNA, 17 bp, Homo sapiens
acctcagccaaacacag

SEQ ID NO: 2012635 - DNA, 22 bp, Homo sapiens
acctcagccatgaggagttgct

SEQ ID NO: 2012636 - DNA, 13 bp, Homo sapiens
acctcagcctaga

SEQ ID NO: 2012637 - DNA, 12 bp, Homo sapiens
acctcagcctcc

SEQ ID NO: 2012638 - DNA, 16 bp, Homo sapiens
acctcagcctcccaga

SEQ ID NO: 2012639 - DNA, 18 bp, Homo sapiens
acctcagcctcccagagt

SEQ ID NO: 2012640 - DNA, 23 bp, Homo sapiens
acctcagcctcccagagtgctag

SEQ ID NO: 2012641 - DNA, 17 bp, Homo sapiens
acctcagcctgtgctgc

SEQ ID NO: 2012642 - DNA, 20 bp, Homo sapiens
acctcagccttccccttgcc

SEQ ID NO: 2012643 - DNA, 12 bp, Homo sapiens
acctcagctgca

SEQ ID NO: 2012644 - DNA, 16 bp, Homo sapiens
acctcagctgcacatt

SEQ ID NO: 2012645 - DNA, 18 bp, Homo sapiens
acctcagctgcacattcc

SEQ ID NO: 2012646 - DNA, 19 bp, Homo sapiens
acctcagctgcacattcct

SEQ ID NO: 2012647 - DNA, 20 bp, Homo sapiens
acctcagctgcacattcctg

SEQ ID NO: 2012648 - DNA, 23 bp, Homo sapiens
acctcagctgcacattcctggcc

SEQ ID NO: 2012649 - DNA, 20 bp, Homo sapiens
acctcaggccaggtgcagtg

SEQ ID NO: 2012650 - DNA, 19 bp, Homo sapiens
acctcaggcttccttggca

SEQ ID NO: 2012651 - DNA, 20 bp, Homo sapiens
acctcaggtgatccacccac

SEQ ID NO: 2012652 - DNA, 21 bp, Homo sapiens
acctcaggtgatccacccacc

SEQ ID NO: 2012653 - DNA, 15 bp, Homo sapiens
acctcagtaatttag

SEQ ID NO: 2012654 - DNA, 16 bp, Homo sapiens
acctcagtgtcattta

SEQ ID NO: 2012655 - DNA, 21 bp, Homo sapiens
acctcagtgtcatttatgaaa

SEQ ID NO: 2012656 - DNA, 13 bp, Homo sapiens
acctcagtttcct

SEQ ID NO: 2012657 - DNA, 16 bp, Homo sapiens
acctcagtttcctcat

SEQ ID NO: 2012658 - DNA, 13 bp, Homo sapiens
acctcagtttctc

SEQ ID NO: 2012659 - DNA, 19 bp, Homo sapiens
acctcatatcttcctcatc

SEQ ID NO: 2012660 - DNA, 14 bp, Homo sapiens
acctcatatgctat

SEQ ID NO: 2012661 - DNA, 14 bp, Homo sapiens
acctcatgacagcc

SEQ ID NO: 2012662 - DNA, 18 bp, Homo sapiens
acctcatgcctggccccc

SEQ ID NO: 2012663 - DNA, 19 bp, Homo sapiens
acctcatggtcatggacag

SEQ ID NO: 2012664 - DNA, 14 bp, Homo sapiens
acccaggctgcact

SEQ ID NO: 2012665 - DNA, 15 bp, Homo sapiens
acccaggctgcactg

SEQ ID NO: 2012666 - DNA, 22 bp, Homo sapiens
acccagtcccagaaccacactg

SEQ ID NO: 2012667 - DNA, 14 bp, Homo sapiens
acccagtcctggcc

SEQ ID NO: 2012668 - DNA, 16 bp, Homo sapiens
acccagtcctggccat

SEQ ID NO: 2012669 - DNA, 21 bp, Homo sapiens
acccagtgctgccatgccact

SEQ ID NO: 2012670 - DNA, 15 bp, Homo sapiens
acccagtgggacaga

SEQ ID NO: 2012671 - DNA, 21 bp, Homo sapiens
acccagtgtaaagaataaatg

SEQ ID NO: 2012672 - DNA, 14 bp, Homo sapiens
acccatcagaagga

SEQ ID NO: 2012673 - DNA, 20 bp, Homo sapiens
acccatcctaccaatgcatg

SEQ ID NO: 2012674 - DNA, 13 bp, Homo sapiens
acccatctccccc

SEQ ID NO: 2012675 - DNA, 17 bp, Homo sapiens
acccatcttcctgctgc

SEQ ID NO: 2012676 - DNA, 14 bp, Homo sapiens
acccatgaatcaaa

SEQ ID NO: 2012677 - DNA, 18 bp, Homo sapiens
acccatgatgagctcctc

SEQ ID NO: 2012678 - DNA, 13 bp, Homo sapiens
acccatgccatag

SEQ ID NO: 2012679 - DNA, 17 bp, Homo sapiens
acccatgtgccaaggtg

SEQ ID NO: 2012680 - DNA, 16 bp, Homo sapiens
acccattaggcatgcc

SEQ ID NO: 2012681 - DNA, 19 bp, Homo sapiens
acccattcccccatgtggc

SEQ ID NO: 2012682 - DNA, 23 bp, Homo sapiens
acccattcccccatgtggctgaa

SEQ ID NO: 2012683 - DNA, 22 bp, Homo sapiens
acccattcgtggtgatcaatta

SEQ ID NO: 2012684 - DNA, 14 bp, Homo sapiens
accccaaagagcct

SEQ ID NO: 2012685 - DNA, 18 bp, Homo sapiens
accccaaagccccttgct

SEQ ID NO: 2012686 - DNA, 16 bp, Homo sapiens
accccaacgcacagga

SEQ ID NO: 2012687 - DNA, 15 bp, Homo sapiens
accccaagtccacct

SEQ ID NO: 2012688 - DNA, 12 bp, Homo sapiens
accccaccccct

SEQ ID NO: 2012689 - DNA, 19 bp, Homo sapiens
accccacctcatgcctggc

SEQ ID NO: 2012690 - DNA, 18 bp, Homo sapiens
accccaccttgccaagct

SEQ ID NO: 2012691 - DNA, 22 bp, Homo sapiens
accccaccttgccaagctttct

SEQ ID NO: 2012692 - DNA, 20 bp, Homo sapiens
accccactccagccctgtcc

SEQ ID NO: 2012693 - DNA, 10 bp, Homo sapiens
accccagagt

SEQ ID NO: 2012694 - DNA, 11 bp, Homo sapiens
accccagagtt

SEQ ID NO: 2012695 - DNA, 14 bp, Homo sapiens
accccagagttggg

SEQ ID NO: 2012696 - DNA, 13 bp, Homo sapiens
accccagcatcct

SEQ ID NO: 2012697 - DNA, 12 bp, Homo sapiens
accccagctggc

SEQ ID NO: 2012698 - DNA, 13 bp, Homo sapiens
accccagctggcc

SEQ ID NO: 2012699 - DNA, 16 bp, Homo sapiens
accccagctggcctct

SEQ ID NO: 2012700 - DNA, 16 bp, Homo sapiens
accccaggcatcccat

SEQ ID NO: 2012701 - DNA, 10 bp, Homo sapiens
accccagggc

SEQ ID NO: 2012702 - DNA, 11 bp, Homo sapiens
accccagggca

SEQ ID NO: 2012703 - DNA, 19 bp, Homo sapiens
accccagggcccccacagg

SEQ ID NO: 2012704 - DNA, 19 bp, Homo sapiens
accccagttctgctcctct

SEQ ID NO: 2012705 - DNA, 22 bp, Homo sapiens
accccagttctgctcctctcca

SEQ ID NO: 2012706 - DNA, 17 bp, Homo sapiens
accccatgggcttggac

SEQ ID NO: 2012707 - DNA, 18 bp, Homo sapiens
accccatttgctttcttt

SEQ ID NO: 2012708 - DNA, 15 bp, Homo sapiens
acccccaccgaagag

SEQ ID NO: 2012709 - DNA, 13 bp, Homo sapiens
acccccactctca

SEQ ID NO: 2012710 - DNA, 13 bp, Homo sapiens
acccccagagacc

SEQ ID NO: 2012711 - DNA, 14 bp, Homo sapiens
acccccagagacct

SEQ ID NO: 2012712 - DNA, 18 bp, Homo sapiens
acccccagcccacagagc

SEQ ID NO: 2012713 - DNA, 12 bp, Homo sapiens
acccccagcccc

SEQ ID NO: 2012714 - DNA, 21 bp, Homo sapiens
acccccagccccgactccagc

SEQ ID NO: 2012715 - DNA, 14 bp, Homo sapiens
acccccagcctgct

SEQ ID NO: 2012716 - DNA, 15 bp, Homo sapiens
acccccagcctgcta

SEQ ID NO: 2012717 - DNA, 14 bp, Homo sapiens
acccccagcctggg

SEQ ID NO: 2012718 - DNA, 15 bp, Homo sapiens
acccccagcctgggc

SEQ ID NO: 2012719 - DNA, 16 bp, Homo sapiens
acccccagcctgggcc

SEQ ID NO: 2012720 - DNA, 16 bp, Homo sapiens
acccccagctttgcta

SEQ ID NO: 2012721 - DNA, 18 bp, Homo sapiens
acccccagtgccacagag

SEQ ID NO: 2012722 - DNA, 17 bp, Homo sapiens
acccccatttctattta

SEQ ID NO: 2012723 - DNA, 14 bp, Homo sapiens
accccccaagctgt

SEQ ID NO: 2012724 - DNA, 20 bp, Homo sapiens
accccccagtcgagccctgc

SEQ ID NO: 2012725 - DNA, 22 bp, Homo sapiens
acgcagaggcggaaaccttgca

SEQ ID NO: 2012726 - DNA, 22 bp, Homo sapiens
acgcagcagctgggacccctcc

SEQ ID NO: 2012727 - DNA, 19 bp, Homo sapiens
acgcagccctgggggccag

SEQ ID NO: 2012728 - DNA, 21 bp, Homo sapiens
acgcagccctgggggccagct

SEQ ID NO: 2012729 - DNA, 22 bp, Homo sapiens
acgcaggcccccaggtgccagt

SEQ ID NO: 2012730 - DNA, 12 bp, Homo sapiens
acgcccagcctc

SEQ ID NO: 2012731 - DNA, 19 bp, Homo sapiens
acgcccagcctcctcccac

SEQ ID NO: 2012732 - DNA, 19 bp, Homo sapiens
acgcccagctgaggctggg

SEQ ID NO: 2012733 - DNA, 23 bp, Homo sapiens
acgcccctccctcctctggccca

SEQ ID NO: 2012734 - DNA, 16 bp, Homo sapiens
acgcctatgatcccag

SEQ ID NO: 2012735 - DNA, 17 bp, Homo sapiens
acgcctatgatcccagc

SEQ ID NO: 2012736 - DNA, 13 bp, Homo sapiens
acgcctcctggcc

SEQ ID NO: 2012737 - DNA, 15 bp, Homo sapiens
acgcctcctggccag

SEQ ID NO: 2012738 - DNA, 19 bp, Homo sapiens
acgcctgagcccagggagg

SEQ ID NO: 2012739 - DNA, 21 bp, Homo sapiens
acgcctgagcccagggaggcc

SEQ ID NO: 2012740 - DNA, 12 bp, Homo sapiens
acgcctgcccag

SEQ ID NO: 2012741 - DNA, 15 bp, Homo sapiens
acgcctgcccagcct

SEQ ID NO: 2012742 - DNA, 16 bp, Homo sapiens
acgcctgcccagcctc

SEQ ID NO: 2012743 - DNA, 17 bp, Homo sapiens
acgcctgcttgtccctg

SEQ ID NO: 2012744 - DNA, 21 bp, Homo sapiens
acgcctgcttgtccctgccca

SEQ ID NO: 2012745 - DNA, 12 bp, Homo sapiens
acgcgcacacac

SEQ ID NO: 2012746 - DNA, 17 bp, Homo sapiens
acgcgggctgtgcctta

SEQ ID NO: 2012747 - DNA, 14 bp, Homo sapiens
acgctcccccgcag

SEQ ID NO: 2012748 - DNA, 13 bp, Homo sapiens
acgctctctgtct

SEQ ID NO: 2012749 - DNA, 13 bp, Homo sapiens
acgctggaccttg

SEQ ID NO: 2012750 - DNA, 15 bp, Homo sapiens
acgctggagtgcagt

SEQ ID NO: 2012751 - DNA, 17 bp, Homo sapiens
acgctggagtgcagtga

SEQ ID NO: 2012752 - DNA, 14 bp, Homo sapiens
acgctgtcctctcg

SEQ ID NO: 2012753 - DNA, 11 bp, Homo sapiens
acgcttccaga

SEQ ID NO: 2012754 - DNA, 17 bp, Homo sapiens
acgcttccagaccacct

SEQ ID NO: 2012755 - DNA, 18 bp, Homo sapiens
acgcttccagaccacctg

SEQ ID NO: 2012756 - DNA, 22 bp, Homo sapiens
acgcttccagaccacctgccag

SEQ ID NO: 2012757 - DNA, 23 bp, Homo sapiens
acgcttccagaccacctgccagc

SEQ ID NO: 2012758 - DNA, 19 bp, Homo sapiens
acggaatagttggctagga

SEQ ID NO: 2012759 - DNA, 21 bp, Homo sapiens
acggagccccaggcctctgtg

SEQ ID NO: 2012760 - DNA, 19 bp, Homo sapiens
acggagtcccaccttggct

SEQ ID NO: 2012761 - DNA, 21 bp, Homo sapiens
acggagtcccaccttggctgc

SEQ ID NO: 2012762 - DNA, 23 bp, Homo sapiens
acggagtcccaccttggctgcag

SEQ ID NO: 2012763 - DNA, 16 bp, Homo sapiens
acggatgcacacacag

SEQ ID NO: 2012764 - DNA, 20 bp, Homo sapiens
actactgctgcaaagtgcaa

SEQ ID NO: 2012765 - DNA, 21 bp, Homo sapiens
actactgtaattaagtgcaat

SEQ ID NO: 2012766 - DNA, 20 bp, Homo sapiens
actactgtggaaaaatattt

SEQ ID NO: 2012767 - DNA, 17 bp, Homo sapiens
actacttcttggaaaaa

SEQ ID NO: 2012768 - DNA, 17 bp, Homo sapiens
actacttgttacctttc

SEQ ID NO: 2012769 - DNA, 15 bp, Homo sapiens
actactttttatact

SEQ ID NO: 2012770 - DNA, 23 bp, Homo sapiens
actactttttatactccatacat

SEQ ID NO: 2012771 - DNA, 15 bp, Homo sapiens
actagaaatctgcca

SEQ ID NO: 2012772 - DNA, 16 bp, Homo sapiens
actagaactctccatc

SEQ ID NO: 2012773 - DNA, 17 bp, Homo sapiens
actagaatttgtatttt

SEQ ID NO: 2012774 - DNA, 23 bp, Homo sapiens
actagagctgggaaacagggagc

SEQ ID NO: 2012775 - DNA, 15 bp, Homo sapiens
actagagctttcttt

SEQ ID NO: 2012776 - DNA, 14 bp, Homo sapiens
actagaggcaggga

SEQ ID NO: 2012777 - DNA, 16 bp, Homo sapiens
actagaggcagggagg

SEQ ID NO: 2012778 - DNA, 22 bp, Homo sapiens
actagatctcctatttttcaga

SEQ ID NO: 2012779 - DNA, 18 bp, Homo sapiens
actagatcttacatctgc

SEQ ID NO: 2012780 - DNA, 15 bp, Homo sapiens
actagatggcgagca

SEQ ID NO: 2012781 - DNA, 12 bp, Homo sapiens
actaggccattt

SEQ ID NO: 2012782 - DNA, 21 bp, Homo sapiens
actaggttctaggtcctggct

SEQ ID NO: 2012783 - DNA, 18 bp, Homo sapiens
actagtaatgggccaatt

SEQ ID NO: 2012784 - DNA, 19 bp, Homo sapiens
actagtattgtccatatca

SEQ ID NO: 2012785 - DNA, 15 bp, Homo sapiens
actagtgttgcttgg

SEQ ID NO: 2012786 - DNA, 18 bp, Homo sapiens
actagtttaattaactat

SEQ ID NO: 2012787 - DNA, 13 bp, Homo sapiens
actagtttccagt

SEQ ID NO: 2012788 - DNA, 17 bp, Homo sapiens
actagttttgtgccagc

SEQ ID NO: 2012789 - DNA, 13 bp, Homo sapiens
actataaacatta

SEQ ID NO: 2012790 - DNA, 18 bp, Homo sapiens
actataaaggttgacaat

SEQ ID NO: 2012791 - DNA, 20 bp, Homo sapiens
actataagcaagaaggcaaa

SEQ ID NO: 2012792 - DNA, 14 bp, Homo sapiens
actatagcccaggt

SEQ ID NO: 2012793 - DNA, 18 bp, Homo sapiens
actatagcctaggtgaca

SEQ ID NO: 2012794 - DNA, 15 bp, Homo sapiens
actatatacatgtgt

SEQ ID NO: 2012795 - DNA, 17 bp, Homo sapiens
actatatacatgtgtgt

SEQ ID NO: 2012796 - DNA, 21 bp, Homo sapiens
actatatacatgtgtgtatat

SEQ ID NO: 2012797 - DNA, 17 bp, Homo sapiens
actatcaatatttaagt

SEQ ID NO: 2012798 - DNA, 22 bp, Homo sapiens
actatcacatacaatttgcact

SEQ ID NO: 2012799 - DNA, 23 bp, Homo sapiens
actatcacatacaatttgcactg

SEQ ID NO: 2012800 - DNA, 23 bp, Homo sapiens
actatctctagagtgagaatctg

SEQ ID NO: 2012801 - DNA, 23 bp, Homo sapiens
actatctttctgataacagaatt

SEQ ID NO: 2012802 - DNA, 16 bp, Homo sapiens
actatgaaaagctaga

SEQ ID NO: 2012803 - DNA, 20 bp, Homo sapiens
actatgaaaagctagaattg

SEQ ID NO: 2012804 - DNA, 12 bp, Homo sapiens
actatgacactg

SEQ ID NO: 2012805 - DNA, 15 bp, Homo sapiens
actatgatcacagtg

SEQ ID NO: 2012806 - DNA, 17 bp, Homo sapiens
actatgatcacagtgac

SEQ ID NO: 2012807 - DNA, 13 bp, Homo sapiens
actatgctgaaga

SEQ ID NO: 2012808 - DNA, 19 bp, Homo sapiens
actatggtatgctggccag

SEQ ID NO: 2012809 - DNA, 15 bp, Homo sapiens
actatggtatttgag

SEQ ID NO: 2012810 - DNA, 15 bp, Homo sapiens
actatggttcccaat

SEQ ID NO: 2012811 - DNA, 17 bp, Homo sapiens
actatggttcccaataa

SEQ ID NO: 2012812 - DNA, 15 bp, Homo sapiens
actatgtgtcatgat

SEQ ID NO: 2012813 - DNA, 14 bp, Homo sapiens
actatgttgcccag

SEQ ID NO: 2012814 - DNA, 16 bp, Homo sapiens
actatgttgcccaggc

SEQ ID NO: 2012815 - DNA, 20 bp, Homo sapiens
actatgttgcccaggcaggt

SEQ ID NO: 2012816 - DNA, 15 bp, Homo sapiens
actattaaagtgcca

SEQ ID NO: 2012817 - DNA, 13 bp, Homo sapiens
actattacttgaa

SEQ ID NO: 2012818 - DNA, 16 bp, Homo sapiens
actattattaataaat

SEQ ID NO: 2012819 - DNA, 22 bp, Homo sapiens
actattctcggggccctgtgta

SEQ ID NO: 2012820 - DNA, 17 bp, Homo sapiens
actattctgttaaaatc

SEQ ID NO: 2012821 - DNA, 21 bp, Homo sapiens
actattctgttaaaatcagga

SEQ ID NO: 2012822 - DNA, 18 bp, Homo sapiens
actattgaagttgcagat

SEQ ID NO: 2012823 - DNA, 19 bp, Homo sapiens
actattggagggtgggaga

SEQ ID NO: 2012824 - DNA, 13 bp, Homo sapiens
actattgtttaaa

SEQ ID NO: 2012825 - DNA, 22 bp, Homo sapiens
actatttctacacagtgggaac

SEQ ID NO: 2012826 - DNA, 18 bp, Homo sapiens
actatttgtctttcagga

SEQ ID NO: 2012827 - DNA, 13 bp, Homo sapiens
actattttttaat

SEQ ID NO: 2012828 - DNA, 19 bp, Homo sapiens
actcaaattaatctttctt

SEQ ID NO: 2012829 - DNA, 18 bp, Homo sapiens
actcaagaggctgaggca

SEQ ID NO: 2012830 - DNA, 15 bp, Homo sapiens
actcaataaaatcat

SEQ ID NO: 2012831 - DNA, 22 bp, Homo sapiens
actcaatatgtgatttttgtga

SEQ ID NO: 2012832 - DNA, 12 bp, Homo sapiens
actcaatatttt

SEQ ID NO: 2012833 - DNA, 16 bp, Homo sapiens
actcaatgcactgaca

SEQ ID NO: 2012834 - DNA, 23 bp, Homo sapiens
actcaatgtgcaagttgtactgt

SEQ ID NO: 2012835 - DNA, 18 bp, Homo sapiens
actcacaagaagaccaga

SEQ ID NO: 2012836 - DNA, 16 bp, Homo sapiens
actcacatggctatgt

SEQ ID NO: 2012837 - DNA, 19 bp, Homo sapiens
actcacatggctatgtttt

SEQ ID NO: 2012838 - DNA, 19 bp, Homo sapiens
actcacatttattctgctc

SEQ ID NO: 2012839 - DNA, 20 bp, Homo sapiens
actcacatttattctgctca

SEQ ID NO: 2012840 - DNA, 21 bp, Homo sapiens
actcacatttattctgctcac

SEQ ID NO: 2012841 - DNA, 13 bp, Homo sapiens
actcaccagggtc

SEQ ID NO: 2012842 - DNA, 15 bp, Homo sapiens
actcacctcctccca

SEQ ID NO: 2012843 - DNA, 13 bp, Homo sapiens
actcacctctgcc

SEQ ID NO: 2012844 - DNA, 19 bp, Homo sapiens
actgatcaaaaataaacta

SEQ ID NO: 2012845 - DNA, 20 bp, Homo sapiens
actgatcaaaaataaactag

SEQ ID NO: 2012846 - DNA, 19 bp, Homo sapiens
actgatcaatccttcttat

SEQ ID NO: 2012847 - DNA, 19 bp, Homo sapiens
actgatgcgaaaacttgaa

SEQ ID NO: 2012848 - DNA, 21 bp, Homo sapiens
actgatggaccgggtgggcct

SEQ ID NO: 2012849 - DNA, 23 bp, Homo sapiens
actgatggaccgggtgggcctgg

SEQ ID NO: 2012850 - DNA, 22 bp, Homo sapiens
actgatgggcaacccccagcct

SEQ ID NO: 2012851 - DNA, 22 bp, Homo sapiens
actgatgttacatcacagtgtt

SEQ ID NO: 2012852 - DNA, 20 bp, Homo sapiens
actgattctgggatgctcct

SEQ ID NO: 2012853 - DNA, 20 bp, Homo sapiens
actgattgggtgccatgtgg

SEQ ID NO: 2012854 - DNA, 22 bp, Homo sapiens
actgattgggtgccatgtggag

SEQ ID NO: 2012855 - DNA, 13 bp, Homo sapiens
actgatttctcac

SEQ ID NO: 2012856 - DNA, 22 bp, Homo sapiens
actgattttgttatttttatat

SEQ ID NO: 2012857 - DNA, 22 bp, Homo sapiens
actgcaacctccacctcctgag

SEQ ID NO: 2012858 - DNA, 14 bp, Homo sapiens
actgcaacctccgc

SEQ ID NO: 2012859 - DNA, 17 bp, Homo sapiens
actgcaagacttaaata

SEQ ID NO: 2012860 - DNA, 15 bp, Homo sapiens
actgcacacacagct

SEQ ID NO: 2012861 - DNA, 17 bp, Homo sapiens
actgcacacacagctcc

SEQ ID NO: 2012862 - DNA, 14 bp, Homo sapiens
actgcaccgggcca

SEQ ID NO: 2012863 - DNA, 18 bp, Homo sapiens
actgcactccagcctggg

SEQ ID NO: 2012864 - DNA, 21 bp, Homo sapiens
actgcagaatacagtaagctg

SEQ ID NO: 2012865 - DNA, 18 bp, Homo sapiens
actgcagatagccagaca

SEQ ID NO: 2012866 - DNA, 16 bp, Homo sapiens
actgcagggactgcca

SEQ ID NO: 2012867 - DNA, 12 bp, Homo sapiens
actgcatgcact

SEQ ID NO: 2012868 - DNA, 14 bp, Homo sapiens
actgcatgcacttc

SEQ ID NO: 2012869 - DNA, 16 bp, Homo sapiens
actgccaaaacaatgc

SEQ ID NO: 2012870 - DNA, 12 bp, Homo sapiens
actgccaggagg

SEQ ID NO: 2012871 - DNA, 13 bp, Homo sapiens
actgccaggaggg

SEQ ID NO: 2012872 - DNA, 15 bp, Homo sapiens
actgccaggagggac

SEQ ID NO: 2012873 - DNA, 18 bp, Homo sapiens
actgccaggcacctggcc

SEQ ID NO: 2012874 - DNA, 20 bp, Homo sapiens
actgccaggcacctggcctg

SEQ ID NO: 2012875 - DNA, 22 bp, Homo sapiens
actgccaggcacctggcctgct

SEQ ID NO: 2012876 - DNA, 19 bp, Homo sapiens
actgccagtccccctgccc

SEQ ID NO: 2012877 - DNA, 20 bp, Homo sapiens
actgccatgcctcaagaaca

SEQ ID NO: 2012878 - DNA, 15 bp, Homo sapiens
actgccccaactcct

SEQ ID NO: 2012879 - DNA, 17 bp, Homo sapiens
actgccccaactcctgg

SEQ ID NO: 2012880 - DNA, 18 bp, Homo sapiens
actgccccaactcctgga

SEQ ID NO: 2012881 - DNA, 12 bp, Homo sapiens
actgccccacca

SEQ ID NO: 2012882 - DNA, 15 bp, Homo sapiens
actgccccaccagcc

SEQ ID NO: 2012883 - DNA, 11 bp, Homo sapiens
actgccctgcc

SEQ ID NO: 2012884 - DNA, 15 bp, Homo sapiens
actgccctgcctgcc

SEQ ID NO: 2012885 - DNA, 17 bp, Homo sapiens
actgccctgcctgccca

SEQ ID NO: 2012886 - DNA, 20 bp, Homo sapiens
actgccggtcacccaggctc

SEQ ID NO: 2012887 - DNA, 9 bp, Homo sapiens
actgcctgc

SEQ ID NO: 2012888 - DNA, 22 bp, Homo sapiens
actgcctggatgtgtttgattt

SEQ ID NO: 2012889 - DNA, 23 bp, Homo sapiens
actgccttaatgagaacatttac

SEQ ID NO: 2012890 - DNA, 11 bp, Homo sapiens
actgccttcca

SEQ ID NO: 2012891 - DNA, 21 bp, Homo sapiens
actgcgggatggtcctggggc

SEQ ID NO: 2012892 - DNA, 23 bp, Homo sapiens
actgctacaaatactcttaggaa

SEQ ID NO: 2012893 - DNA, 19 bp, Homo sapiens
actgctaggcgagtgccag

SEQ ID NO: 2012894 - DNA, 22 bp, Homo sapiens
actgctaggcgagtgccaggac

SEQ ID NO: 2012895 - DNA, 12 bp, Homo sapiens
actgctccaagt

SEQ ID NO: 2012896 - DNA, 18 bp, Homo sapiens
actgctccccagccctgg

SEQ ID NO: 2012897 - DNA, 16 bp, Homo sapiens
actgctctcagcctcc

SEQ ID NO: 2012898 - DNA, 14 bp, Homo sapiens
actgctgagccact

SEQ ID NO: 2012899 - DNA, 20 bp, Homo sapiens
actgctgatcaatgaaatgc

SEQ ID NO: 2012900 - DNA, 19 bp, Homo sapiens
actgctgcaaagtgcaaat

SEQ ID NO: 2012901 - DNA, 15 bp, Homo sapiens
actgctgcaccagag

SEQ ID NO: 2012902 - DNA, 16 bp, Homo sapiens
actgctgcccagcctc

SEQ ID NO: 2012903 - DNA, 21 bp, Homo sapiens
actgctgcccagcctccaagc

SEQ ID NO: 2012904 - DNA, 15 bp, Homo sapiens
actgctgccttaccc

SEQ ID NO: 2012905 - DNA, 18 bp, Homo sapiens
actgctgggactggccag

SEQ ID NO: 2012906 - DNA, 13 bp, Homo sapiens
actgctgtcattg

SEQ ID NO: 2012907 - DNA, 22 bp, Homo sapiens
actgctgtcattgtccatgcct

SEQ ID NO: 2012908 - DNA, 24 bp, Homo sapiens
actgcttgaggaggggcacctgcc

SEQ ID NO: 2012909 - DNA, 16 bp, Homo sapiens
actgctttcaacttaa

SEQ ID NO: 2012910 - DNA, 16 bp, Homo sapiens
actgcttttggtctgt

SEQ ID NO: 2012911 - DNA, 17 bp, Homo sapiens
actggaacttgaactga

SEQ ID NO: 2012912 - DNA, 17 bp, Homo sapiens
actggaagcacagcttc

SEQ ID NO: 2012913 - DNA, 19 bp, Homo sapiens
actggaagcacagcttcat

SEQ ID NO: 2012914 - DNA, 19 bp, Homo sapiens
actggaagcatgtaggaga

SEQ ID NO: 2012915 - DNA, 20 bp, Homo sapiens
actggaagcatgtaggagaa

SEQ ID NO: 2012916 - DNA, 16 bp, Homo sapiens
actggaatcctttcag

SEQ ID NO: 2012917 - DNA, 18 bp, Homo sapiens
actggaatcgatctgtac

SEQ ID NO: 2012918 - DNA, 19 bp, Homo sapiens
actggaatcgatctgtact

SEQ ID NO: 2012919 - DNA, 21 bp, Homo sapiens
actggaatcgatctgtactgt

SEQ ID NO: 2012920 - DNA, 13 bp, Homo sapiens
actggacatcaca

SEQ ID NO: 2012921 - DNA, 20 bp, Homo sapiens
actggaccactgggcaatga

SEQ ID NO: 2012922 - DNA, 21 bp, Homo sapiens
actggactgggttttgtctct

SEQ ID NO: 2012923 - DNA, 12 bp, Homo sapiens
actggagcccag

SEQ ID NO: 2012924 - DNA, 14 bp, Homo sapiens
actggagcccagga

SEQ ID NO: 2012925 - DNA, 19 bp, Homo sapiens
actggaggtcacattcagg

SEQ ID NO: 2012926 - DNA, 18 bp, Homo sapiens
actggagtgcagggagga

SEQ ID NO: 2012927 - DNA, 17 bp, Homo sapiens
actggagttacattaat

SEQ ID NO: 2012928 - DNA, 19 bp, Homo sapiens
actggatcttcagaaggct

SEQ ID NO: 2012929 - DNA, 14 bp, Homo sapiens
actggatgaagatt

SEQ ID NO: 2012930 - DNA, 18 bp, Homo sapiens
actggcaatatttgttct

SEQ ID NO: 2012931 - DNA, 20 bp, Homo sapiens
actggcacagttttctgaga

SEQ ID NO: 2012932 - DNA, 22 bp, Homo sapiens
actggcacagttttctgagaaa

SEQ ID NO: 2012933 - DNA, 17 bp, Homo sapiens
actggcacgtttgtgag

SEQ ID NO: 2012934 - DNA, 23 bp, Homo sapiens
actggcacgtttgtgagaagaaa

SEQ ID NO: 2012935 - DNA, 11 bp, Homo sapiens
actggcagctc

SEQ ID NO: 2012936 - DNA, 14 bp, Homo sapiens
actggcaggtgcag

SEQ ID NO: 2012937 - DNA, 17 bp, Homo sapiens
actggcattaattatta

SEQ ID NO: 2012938 - DNA, 16 bp, Homo sapiens
actggccaagctgagg

SEQ ID NO: 2012939 - DNA, 17 bp, Homo sapiens
actggccaagctgaggt

SEQ ID NO: 2012940 - DNA, 19 bp, Homo sapiens
actggccaagctgaggtgc

SEQ ID NO: 2012941 - DNA, 21 bp, Homo sapiens
actggccaagctgaggtgccc

SEQ ID NO: 2012942 - DNA, 15 bp, Homo sapiens
actggccacccaaca

SEQ ID NO: 2012943 - DNA, 17 bp, Homo sapiens
actggccagagagggcc

SEQ ID NO: 2012944 - DNA, 22 bp, Homo sapiens
actggccagagagggcccagct

SEQ ID NO: 2012945 - DNA, 20 bp, Homo sapiens
actggccagtcctagagctc

SEQ ID NO: 2012946 - DNA, 23 bp, Homo sapiens
actggccagtcctagagctcctg

SEQ ID NO: 2012947 - DNA, 12 bp, Homo sapiens
actggccccacc

SEQ ID NO: 2012948 - DNA, 13 bp, Homo sapiens
actggccccaccc

SEQ ID NO: 2012949 - DNA, 21 bp, Homo sapiens
actggctggccagtctgggtc

SEQ ID NO: 2012950 - DNA, 17 bp, Homo sapiens
actggctggctgcagtg

SEQ ID NO: 2012951 - DNA, 15 bp, Homo sapiens
actggctggggcaga

SEQ ID NO: 2012952 - DNA, 17 bp, Homo sapiens
actggctggggcagagg

SEQ ID NO: 2012953 - DNA, 22 bp, Homo sapiens
actggcttctgtgcactagcct

SEQ ID NO: 2012954 - DNA, 11 bp, Homo sapiens
actgggaaggc

SEQ ID NO: 2012955 - DNA, 15 bp, Homo sapiens
actgggatcgcacct

SEQ ID NO: 2012956 - DNA, 16 bp, Homo sapiens
actgggatgagccgct

SEQ ID NO: 2012957 - DNA, 13 bp, Homo sapiens
actgggcaatgat

SEQ ID NO: 2012958 - DNA, 18 bp, Homo sapiens
actggggagaaataattg

SEQ ID NO: 2012959 - DNA, 20 bp, Homo sapiens
actggggagttataaaaata

SEQ ID NO: 2012960 - DNA, 17 bp, Homo sapiens
actcacctctgcctcaa

SEQ ID NO: 2012961 - DNA, 15 bp, Homo sapiens
actcacctgttactt

SEQ ID NO: 2012962 - DNA, 13 bp, Homo sapiens
actcactcattcc

SEQ ID NO: 2012963 - DNA, 16 bp, Homo sapiens
actcactccagcccaa

SEQ ID NO: 2012964 - DNA, 22 bp, Homo sapiens
actcacttttctttattgctgt

SEQ ID NO: 2012965 - DNA, 16 bp, Homo sapiens
actcagaagacactga

SEQ ID NO: 2012966 - DNA, 15 bp, Homo sapiens
actcagaagcctgag

SEQ ID NO: 2012967 - DNA, 14 bp, Homo sapiens
actcagaagcctgg

SEQ ID NO: 2012968 - DNA, 21 bp, Homo sapiens
actcagaagcctgggggcctg

SEQ ID NO: 2012969 - DNA, 22 bp, Homo sapiens
actcagaagcctgggggcctgg

SEQ ID NO: 2012970 - DNA, 23 bp, Homo sapiens
actcagaagcctgggggcctggc

SEQ ID NO: 2012971 - DNA, 15 bp, Homo sapiens
actcagacattccaa

SEQ ID NO: 2012972 - DNA, 12 bp, Homo sapiens
actcagagcaga

SEQ ID NO: 2012973 - DNA, 14 bp, Homo sapiens
actcagagcagagc

SEQ ID NO: 2012974 - DNA, 17 bp, Homo sapiens
actcagcagcagagagc

SEQ ID NO: 2012975 - DNA, 19 bp, Homo sapiens
actcagcagcagagagccc

SEQ ID NO: 2012976 - DNA, 21 bp, Homo sapiens
actcagcagcagagagccctg

SEQ ID NO: 2012977 - DNA, 17 bp, Homo sapiens
actcagcagccctcctc

SEQ ID NO: 2012978 - DNA, 19 bp, Homo sapiens
actcagcagccctcctcac

SEQ ID NO: 2012979 - DNA, 22 bp, Homo sapiens
actcagcagccctcctcacccc

SEQ ID NO: 2012980 - DNA, 19 bp, Homo sapiens
actcagctctcctgctgca

SEQ ID NO: 2012981 - DNA, 20 bp, Homo sapiens
actcagctctcctgctgcag

SEQ ID NO: 2012982 - DNA, 11 bp, Homo sapiens
actcagctctg

SEQ ID NO: 2012983 - DNA, 19 bp, Homo sapiens
actcagctctgacattctg

SEQ ID NO: 2012984 - DNA, 18 bp, Homo sapiens
actcagctgtctgtggct

SEQ ID NO: 2012985 - DNA, 13 bp, Homo sapiens
actcaggaggctg

SEQ ID NO: 2012986 - DNA, 22 bp, Homo sapiens
agcaaagcctgttcatggcaga

SEQ ID NO: 2012987 - DNA, 14 bp, Homo sapiens
agcaaatcctcttc

SEQ ID NO: 2012988 - DNA, 18 bp, Homo sapiens
agcaaatcctcttctaac

SEQ ID NO: 2012989 - DNA, 15 bp, Homo sapiens
agcaaatcgaatgaa

SEQ ID NO: 2012990 - DNA, 22 bp, Homo sapiens
agcaaatcgaatgaaattaact

SEQ ID NO: 2012991 - DNA, 18 bp, Homo sapiens
agcaaatgcttaaaacaa

SEQ ID NO: 2012992 - DNA, 19 bp, Homo sapiens
agcaaatgcttaaaacaag

SEQ ID NO: 2012993 - DNA, 16 bp, Homo sapiens
agcaaatgtttctgca

SEQ ID NO: 2012994 - DNA, 17 bp, Homo sapiens
agcaaatgtttctgcag

SEQ ID NO: 2012995 - DNA, 19 bp, Homo sapiens
agcaaatttcaaaagacat

SEQ ID NO: 2012996 - DNA, 14 bp, Homo sapiens
agcaacacaagctg

SEQ ID NO: 2012997 - DNA, 16 bp, Homo sapiens
agcaacagaaaaatgg

SEQ ID NO: 2012998 - DNA, 22 bp, Homo sapiens
agcaacagagtgagaccctgtc

SEQ ID NO: 2012999 - DNA, 22 bp, Homo sapiens
agcaacaggaatctcagagaca

SEQ ID NO: 2013000 - DNA, 17 bp, Homo sapiens
agcaacagtagcaggga

SEQ ID NO: 2013001 - DNA, 14 bp, Homo sapiens
agcaacattttatt

SEQ ID NO: 2013002 - DNA, 21 bp, Homo sapiens
agcaacccctgtacccagctc

SEQ ID NO: 2013003 - DNA, 22 bp, Homo sapiens
agcaacccctgtacccagctcc

SEQ ID NO: 2013004 - DNA, 23 bp, Homo sapiens
agcaacccctgtacccagctcct

SEQ ID NO: 2013005 - DNA, 15 bp, Homo sapiens
agcaaccgtggccct

SEQ ID NO: 2013006 - DNA, 16 bp, Homo sapiens
agcaaccgtggccctt

SEQ ID NO: 2013007 - DNA, 13 bp, Homo sapiens
agcaacctcccaa

SEQ ID NO: 2013008 - DNA, 15 bp, Homo sapiens
agcaaccttcatttt

SEQ ID NO: 2013009 - DNA, 17 bp, Homo sapiens
agcaaccttcattttac

SEQ ID NO: 2013010 - DNA, 23 bp, Homo sapiens
agcaacgcaggcccccaggtgcc

SEQ ID NO: 2013011 - DNA, 21 bp, Homo sapiens
agcaactctccactccatatt

SEQ ID NO: 2013012 - DNA, 12 bp, Homo sapiens
agcaactgttgg

SEQ ID NO: 2013013 - DNA, 14 bp, Homo sapiens
agcaacttgcttct

SEQ ID NO: 2013014 - DNA, 18 bp, Homo sapiens
agcaagacctgttggtta

SEQ ID NO: 2013015 - DNA, 19 bp, Homo sapiens
agcaagacgtcctggaatg

SEQ ID NO: 2013016 - DNA, 17 bp, Homo sapiens
agcaagactgttagccc

SEQ ID NO: 2013017 - DNA, 23 bp, Homo sapiens
agcaagacttctctttgcctcaa

SEQ ID NO: 2013018 - DNA, 23 bp, Homo sapiens
agcaagagagagctcgctcttgg

SEQ ID NO: 2013019 - DNA, 20 bp, Homo sapiens
agcaaggacaacctgcccct

SEQ ID NO: 2013020 - DNA, 15 bp, Homo sapiens
agcaaggatatcaga

SEQ ID NO: 2013021 - DNA, 17 bp, Homo sapiens
agcaaggcccgagcagc

SEQ ID NO: 2013022 - DNA, 14 bp, Homo sapiens
agcaagggctccag

SEQ ID NO: 2013023 - DNA, 21 bp, Homo sapiens
agcaaggtttaaatttgttat

SEQ ID NO: 2013024 - DNA, 14 bp, Homo sapiens
agcaaggtttctgg

SEQ ID NO: 2013025 - DNA, 17 bp, Homo sapiens
agcaagtgagagctggg

SEQ ID NO: 2013026 - DNA, 17 bp, Homo sapiens
agcaagttctagagaag

SEQ ID NO: 2013027 - DNA, 13 bp, Homo sapiens
agcaataattagg

SEQ ID NO: 2013028 - DNA, 21 bp, Homo sapiens
agcaataattaggatctatgc

SEQ ID NO: 2013029 - DNA, 15 bp, Homo sapiens
agcaatatgtaaata

SEQ ID NO: 2013030 - DNA, 21 bp, Homo sapiens
agcaatgcccgtaatgcttag

SEQ ID NO: 2013031 - DNA, 21 bp, Homo sapiens
agcaatggacctttggggaag

SEQ ID NO: 2013032 - DNA, 23 bp, Homo sapiens
agcaatgggagggggctccatgg

SEQ ID NO: 2013033 - DNA, 16 bp, Homo sapiens
agcaattcatttcact

SEQ ID NO: 2013034 - DNA, 18 bp, Homo sapiens
agcaattcatttcacttt

SEQ ID NO: 2013035 - DNA, 19 bp, Homo sapiens
agcaattcatttcacttta

SEQ ID NO: 2013036 - DNA, 17 bp, Homo sapiens
agcacaagttatttaaa

SEQ ID NO: 2013037 - DNA, 14 bp, Homo sapiens
agcacaatttatat

SEQ ID NO: 2013038 - DNA, 20 bp, Homo sapiens
agcacacaggtacagcaaca

SEQ ID NO: 2013039 - DNA, 15 bp, Homo sapiens
agcacaccccaaggg

SEQ ID NO: 2013040 - DNA, 17 bp, Homo sapiens
agcacaccccaagggac

SEQ ID NO: 2013041 - DNA, 14 bp, Homo sapiens
agcacacggccctg

SEQ ID NO: 2013042 - DNA, 21 bp, Homo sapiens
agcacagcagcccctgcacaa

SEQ ID NO: 2013043 - DNA, 22 bp, Homo sapiens
agcacagcagtggagagtgttc

SEQ ID NO: 2013044 - DNA, 13 bp, Homo sapiens
agcacagccctgg

SEQ ID NO: 2013045 - DNA, 17 bp, Homo sapiens
agcacagccctgggagg

SEQ ID NO: 2013046 - DNA, 12 bp, Homo sapiens
agcacaggggcc

SEQ ID NO: 2013047 - DNA, 15 bp, Homo sapiens
agcacaggggcccca

SEQ ID NO: 2013048 - DNA, 14 bp, Homo sapiens
agatcgtattaatt

SEQ ID NO: 2013049 - DNA, 19 bp, Homo sapiens
agatcgtattaattatctg

SEQ ID NO: 2013050 - DNA, 22 bp, Homo sapiens
agatcgtattaattatctgatc

SEQ ID NO: 2013051 - DNA, 17 bp, Homo sapiens
agatcgttagtatctaa

SEQ ID NO: 2013052 - DNA, 18 bp, Homo sapiens
agatctccacggtcagat

SEQ ID NO: 2013053 - DNA, 16 bp, Homo sapiens
agatctccctccaggg

SEQ ID NO: 2013054 - DNA, 17 bp, Homo sapiens
agatctccctccaggga

SEQ ID NO: 2013055 - DNA, 16 bp, Homo sapiens
agatctcctgtaattt

SEQ ID NO: 2013056 - DNA, 15 bp, Homo sapiens
agatctgaaaggcac

SEQ ID NO: 2013057 - DNA, 20 bp, Homo sapiens
agatctgatggtgagctggg

SEQ ID NO: 2013058 - DNA, 16 bp, Homo sapiens
agatctgcactgggtg

SEQ ID NO: 2013059 - DNA, 21 bp, Homo sapiens
agatctgcagggggtgtgtct

SEQ ID NO: 2013060 - DNA, 18 bp, Homo sapiens
agatctgcctgggcctgt

SEQ ID NO: 2013061 - DNA, 22 bp, Homo sapiens
agatctgcctgggcctgtgcag

SEQ ID NO: 2013062 - DNA, 23 bp, Homo sapiens
agatctgcctgggcctgtgcagc

SEQ ID NO: 2013063 - DNA, 13 bp, Homo sapiens
agatctgcttctt

SEQ ID NO: 2013064 - DNA, 17 bp, Homo sapiens
agatcttctgaaatgaa

SEQ ID NO: 2013065 - DNA, 20 bp, Homo sapiens
agatctttttgtgaaattca

SEQ ID NO: 2013066 - DNA, 13 bp, Homo sapiens
agatgaaagagga

SEQ ID NO: 2013067 - DNA, 19 bp, Homo sapiens
agatgaagagaagctgaga

SEQ ID NO: 2013068 - DNA, 14 bp, Homo sapiens
agatgacagctctt

SEQ ID NO: 2013069 - DNA, 14 bp, Homo sapiens
agatgactgagtcc

SEQ ID NO: 2013070 - DNA, 14 bp, Homo sapiens
agatgacttgaggc

SEQ ID NO: 2013071 - DNA, 17 bp, Homo sapiens
agatgagatttgccagc

SEQ ID NO: 2013072 - DNA, 15 bp, Homo sapiens
agatgagcagtcaca

SEQ ID NO: 2013073 - DNA, 16 bp, Homo sapiens
agatgagggtgactgt

SEQ ID NO: 2013074 - DNA, 13 bp, Homo sapiens
agatgataatgga

SEQ ID NO: 2013075 - DNA, 16 bp, Homo sapiens
agatgatctactcaga

SEQ ID NO: 2013076 - DNA, 14 bp, Homo sapiens
agatgatctctcca

SEQ ID NO: 2013077 - DNA, 12 bp, Homo sapiens
agatgatgatga

SEQ ID NO: 2013078 - DNA, 21 bp, Homo sapiens
agatgattcggatttgacaaa

SEQ ID NO: 2013079 - DNA, 12 bp, Homo sapiens
agatgattctgg

SEQ ID NO: 2013080 - DNA, 19 bp, Homo sapiens
agatgcaacctcactatgg

SEQ ID NO: 2013081 - DNA, 17 bp, Homo sapiens
agatgcacacacagatg

SEQ ID NO: 2013082 - DNA, 22 bp, Homo sapiens
agatgcacacacagatgcacac

SEQ ID NO: 2013083 - DNA, 18 bp, Homo sapiens
agatgcatgcgcaggctc

SEQ ID NO: 2013084 - DNA, 16 bp, Homo sapiens
agatgccacacctgct

SEQ ID NO: 2013085 - DNA, 18 bp, Homo sapiens
agatgccattcatagaga

SEQ ID NO: 2013086 - DNA, 22 bp, Homo sapiens
agatgcccagagggcccaggca

SEQ ID NO: 2013087 - DNA, 14 bp, Homo sapiens
agatgcctccaccg

SEQ ID NO: 2013088 - DNA, 15 bp, Homo sapiens
agatgcctccaccgc

SEQ ID NO: 2013089 - DNA, 21 bp, Homo sapiens
agatgccttcctgtctttctg

SEQ ID NO: 2013090 - DNA, 23 bp, Homo sapiens
agatgctgactgtactcctccca

SEQ ID NO: 2013091 - DNA, 17 bp, Homo sapiens
agatggaaagaaagcac

SEQ ID NO: 2013092 - DNA, 22 bp, Homo sapiens
agatggaagttgcagtgagctg

SEQ ID NO: 2013093 - DNA, 19 bp, Homo sapiens
agatggaccagtagacaac

SEQ ID NO: 2013094 - DNA, 18 bp, Homo sapiens
agatggacccctcccttg

SEQ ID NO: 2013095 - DNA, 15 bp, Homo sapiens
agatggaggccgagc

SEQ ID NO: 2013096 - DNA, 18 bp, Homo sapiens
agatggctgtgcctctgc

SEQ ID NO: 2013097 - DNA, 21 bp, Homo sapiens
agatgggcacatgaggagggt

SEQ ID NO: 2013098 - DNA, 18 bp, Homo sapiens
agatgggcttgttttctt

SEQ ID NO: 2013099 - DNA, 16 bp, Homo sapiens
agatgggtattaaact

SEQ ID NO: 2013100 - DNA, 19 bp, Homo sapiens
agatgggtctggctgagct

SEQ ID NO: 2013101 - DNA, 20 bp, Homo sapiens
agatggtaatctacagctca

SEQ ID NO: 2013102 - DNA, 22 bp, Homo sapiens
agatggttagtggggtaattct

SEQ ID NO: 2013103 - DNA, 14 bp, Homo sapiens
agatgtatcattaa

SEQ ID NO: 2013104 - DNA, 13 bp, Homo sapiens
agatgtcaaatat

SEQ ID NO: 2013105 - DNA, 21 bp, Homo sapiens
agatgtcaataggaattgcat

SEQ ID NO: 2013106 - DNA, 20 bp, Homo sapiens
agatgtcagccgagccgggc

SEQ ID NO: 2013107 - DNA, 13 bp, Homo sapiens
agatgtctttagg

SEQ ID NO: 2013108 - DNA, 23 bp, Homo sapiens
agatgtctttaggcagcagcttt

SEQ ID NO: 2013109 - DNA, 19 bp, Homo sapiens
agatgtgattcctgcattt

SEQ ID NO: 2013110 - DNA, 23 bp, Homo sapiens
agatgtggcaaagtgctgtaccc

SEQ ID NO: 2013111 - DNA, 14 bp, Homo sapiens
agatgtttcacgaa

SEQ ID NO: 2013112 - DNA, 15 bp, Homo sapiens
agatgtttgtcagat

SEQ ID NO: 2013113 - DNA, 14 bp, Homo sapiens
agatgttttacaaa

SEQ ID NO: 2013114 - DNA, 15 bp, Homo sapiens
agatacactcctgct

SEQ ID NO: 2013115 - DNA, 18 bp, Homo sapiens
agatacatagatggacca

SEQ ID NO: 2013116 - DNA, 16 bp, Homo sapiens
agataccatactcatt

SEQ ID NO: 2013117 - DNA, 22 bp, Homo sapiens
agatacggttgcttcaccttgg

SEQ ID NO: 2013118 - DNA, 20 bp, Homo sapiens
agatactggaagttttgcat

SEQ ID NO: 2013119 - DNA, 16 bp, Homo sapiens
agatacttaagtgctg

SEQ ID NO: 2013120 - DNA, 17 bp, Homo sapiens
agatagaaagcaataaa

SEQ ID NO: 2013121 - DNA, 19 bp, Homo sapiens
agatagaaagcaataaaaa

SEQ ID NO: 2013122 - DNA, 16 bp, Homo sapiens
agatagaatttccaat

SEQ ID NO: 2013123 - DNA, 15 bp, Homo sapiens
agatagccagacaca

SEQ ID NO: 2013124 - DNA, 15 bp, Homo sapiens
agataggtaaatacc

SEQ ID NO: 2013125 - DNA, 17 bp, Homo sapiens
agatagtagcatacatt

SEQ ID NO: 2013126 - DNA, 17 bp, Homo sapiens
agatataaatggctggt

SEQ ID NO: 2013127 - DNA, 15 bp, Homo sapiens
agatatacaaaaaca

SEQ ID NO: 2013128 - DNA, 14 bp, Homo sapiens
agatatatttttca

SEQ ID NO: 2013129 - DNA, 16 bp, Homo sapiens
agatatcagagctctt

SEQ ID NO: 2013130 - DNA, 19 bp, Homo sapiens
agatatcagagctcttaat

SEQ ID NO: 2013131 - DNA, 16 bp, Homo sapiens
agatatgatatgtaaa

SEQ ID NO: 2013132 - DNA, 17 bp, Homo sapiens
agatatggcagcgaaag

SEQ ID NO: 2013133 - DNA, 16 bp, Homo sapiens
agatattatttaaatg

SEQ ID NO: 2013134 - DNA, 14 bp, Homo sapiens
agatatttatatat

SEQ ID NO: 2013135 - DNA, 14 bp, Homo sapiens
agatatttttgtac

SEQ ID NO: 2013136 - DNA, 22 bp, Homo sapiens
agatattttttcagaaatatgt

SEQ ID NO: 2013137 - DNA, 14 bp, Homo sapiens
agatcaaatttcac

SEQ ID NO: 2013138 - DNA, 14 bp, Homo sapiens
agatcaaccccttc

SEQ ID NO: 2013139 - DNA, 21 bp, Homo sapiens
agatcaaccccttcgctcctg

SEQ ID NO: 2013140 - DNA, 14 bp, Homo sapiens
agatcaattaattc

SEQ ID NO: 2013141 - DNA, 21 bp, Homo sapiens
agatcaatttgtaattgctta

SEQ ID NO: 2013142 - DNA, 17 bp, Homo sapiens
agatcacatattctagt

SEQ ID NO: 2013143 - DNA, 14 bp, Homo sapiens
agatcaccagcccg

SEQ ID NO: 2013144 - DNA, 21 bp, Homo sapiens
agatcaccagcccggcctgct

SEQ ID NO: 2013145 - DNA, 18 bp, Homo sapiens
agatcacgccactgcact

SEQ ID NO: 2013146 - DNA, 14 bp, Homo sapiens
agatcagccacgga

SEQ ID NO: 2013147 - DNA, 13 bp, Homo sapiens
agatcaggaagag

SEQ ID NO: 2013148 - DNA, 19 bp, Homo sapiens
agatcaggaagagaaggag

SEQ ID NO: 2013149 - DNA, 22 bp, Homo sapiens
agatcatctggggacctggttt

SEQ ID NO: 2013150 - DNA, 20 bp, Homo sapiens
agatccatttggacaaaatg

SEQ ID NO: 2013151 - DNA, 20 bp, Homo sapiens
agatcccatccatcagctcc

SEQ ID NO: 2013152 - DNA, 14 bp, Homo sapiens
agatcccatgtcac

SEQ ID NO: 2013153 - DNA, 23 bp, Homo sapiens
agatcccatgtcacctcagctga

SEQ ID NO: 2013154 - DNA, 17 bp, Homo sapiens
agatcctaggtgctgga

SEQ ID NO: 2013155 - DNA, 17 bp, Homo sapiens
agatcctctgctgactc

SEQ ID NO: 2013156 - DNA, 20 bp, Homo sapiens
agatcgagaccatcctggct

SEQ ID NO: 2013157 - DNA, 20 bp, Homo sapiens
agatcgcgccactgcactcc

SEQ ID NO: 2013158 - DNA, 19 bp, Homo sapiens
agatcgcttgagcccagga

SEQ ID NO: 2013159 - DNA, 12 bp, Homo sapiens
agatcgtattaa

SEQ ID NO: 2013160 - DNA, 16 bp, Homo sapiens
agaggagcacctgaac

SEQ ID NO: 2013161 - DNA, 19 bp, Homo sapiens
agaggagccagaagtaaag

SEQ ID NO: 2013162 - DNA, 16 bp, Homo sapiens
agaggagttgccaggg

SEQ ID NO: 2013163 - DNA, 16 bp, Homo sapiens
agaggatgatttcaga

SEQ ID NO: 2013164 - DNA, 18 bp, Homo sapiens
agaggatgatttcagaag

SEQ ID NO: 2013165 - DNA, 13 bp, Homo sapiens
agaggatgttctg

SEQ ID NO: 2013166 - DNA, 14 bp, Homo sapiens
agaggatgttctgg

SEQ ID NO: 2013167 - DNA, 19 bp, Homo sapiens
agaggcagaagtcagcccg

SEQ ID NO: 2013168 - DNA, 14 bp, Homo sapiens
agaggcagagaaag

SEQ ID NO: 2013169 - DNA, 21 bp, Homo sapiens
agaggcagagaaagaagagac

SEQ ID NO: 2013170 - DNA, 13 bp, Homo sapiens
agaggcagcccca

SEQ ID NO: 2013171 - DNA, 19 bp, Homo sapiens
agaggcagccccattctgc

SEQ ID NO: 2013172 - DNA, 21 bp, Homo sapiens
agaggcagccccattctgcct

SEQ ID NO: 2013173 - DNA, 10 bp, Homo sapiens
agaggcaggg

SEQ ID NO: 2013174 - DNA, 13 bp, Homo sapiens
agaggcagggagg

SEQ ID NO: 2013175 - DNA, 13 bp, Homo sapiens
agaggccctggat

SEQ ID NO: 2013176 - DNA, 21 bp, Homo sapiens
agaggccctggatcagcgtgg

SEQ ID NO: 2013177 - DNA, 24 bp, Homo sapiens
agaggccctggatcagcgtggcct

SEQ ID NO: 2013178 - DNA, 12 bp, Homo sapiens
agaggcctcagt

SEQ ID NO: 2013179 - DNA, 21 bp, Homo sapiens
agaggcgcgtctgccccaccc

SEQ ID NO: 2013180 - DNA, 21 bp, Homo sapiens
agaggcggaaaccttgcagca

SEQ ID NO: 2013181 - DNA, 16 bp, Homo sapiens
agaggcggcctcgtgc

SEQ ID NO: 2013182 - DNA, 22 bp, Homo sapiens
agaggcgtctcacatttttact

SEQ ID NO: 2013183 - DNA, 13 bp, Homo sapiens
agaggctgcagaa

SEQ ID NO: 2013184 - DNA, 17 bp, Homo sapiens
agaggctggaggcaggg

SEQ ID NO: 2013185 - DNA, 14 bp, Homo sapiens
agaggctgggggag

SEQ ID NO: 2013186 - DNA, 17 bp, Homo sapiens
agaggctgtggtggctg

SEQ ID NO: 2013187 - DNA, 23 bp, Homo sapiens
agaggctgtggtggctgtctctg

SEQ ID NO: 2013188 - DNA, 16 bp, Homo sapiens
agaggctttggcccaa

SEQ ID NO: 2013189 - DNA, 17 bp, Homo sapiens
agagggaatggatgggg

SEQ ID NO: 2013190 - DNA, 13 bp, Homo sapiens
agagggacagggt

SEQ ID NO: 2013191 - DNA, 20 bp, Homo sapiens
agagggaccaaattgcttct

SEQ ID NO: 2013192 - DNA, 24 bp, Homo sapiens
agagggaggagaatgagcctcggc

SEQ ID NO: 2013193 - DNA, 17 bp, Homo sapiens
agagggcagtacctggg

SEQ ID NO: 2013194 - DNA, 18 bp, Homo sapiens
agagggcagtacctggga

SEQ ID NO: 2013195 - DNA, 16 bp, Homo sapiens
agagggccaagagaga

SEQ ID NO: 2013196 - DNA, 18 bp, Homo sapiens
agagggccaagagagaca

SEQ ID NO: 2013197 - DNA, 14 bp, Homo sapiens
agagggcccagctg

SEQ ID NO: 2013198 - DNA, 21 bp, Homo sapiens
agagggcccaggcaggccacc

SEQ ID NO: 2013199 - DNA, 21 bp, Homo sapiens
agagggctgcgagcatttccc

SEQ ID NO: 2013200 - DNA, 16 bp, Homo sapiens
agaggggaagggccag

SEQ ID NO: 2013201 - DNA, 16 bp, Homo sapiens
agaggggacatttccc

SEQ ID NO: 2013202 - DNA, 12 bp, Homo sapiens
agagcagcctga

SEQ ID NO: 2013203 - DNA, 18 bp, Homo sapiens
agagcagcctgatggcca

SEQ ID NO: 2013204 - DNA, 21 bp, Homo sapiens
agagcagcctgatggccaagg

SEQ ID NO: 2013205 - DNA, 11 bp, Homo sapiens
agagcagctgg

SEQ ID NO: 2013206 - DNA, 13 bp, Homo sapiens
agagcagctggct

SEQ ID NO: 2013207 - DNA, 18 bp, Homo sapiens
agagcaggcacatggagg

SEQ ID NO: 2013208 - DNA, 19 bp, Homo sapiens
agagcaggcacatggagga

SEQ ID NO: 2013209 - DNA, 17 bp, Homo sapiens
agagcaggctcagactc

SEQ ID NO: 2013210 - DNA, 22 bp, Homo sapiens
agagcaggggtccttggtgtga

SEQ ID NO: 2013211 - DNA, 17 bp, Homo sapiens
agagcaggtgagatggg

SEQ ID NO: 2013212 - DNA, 14 bp, Homo sapiens
agagcatcatgcct

SEQ ID NO: 2013213 - DNA, 15 bp, Homo sapiens
agagcatcatgcctc

SEQ ID NO: 2013214 - DNA, 22 bp, Homo sapiens
agagcatcatgcctctgaggcc

SEQ ID NO: 2013215 - DNA, 22 bp, Homo sapiens
agagcattacgtgagccaggta

SEQ ID NO: 2013216 - DNA, 22 bp, Homo sapiens
agagccagaacctggagggcta

SEQ ID NO: 2013217 - DNA, 12 bp, Homo sapiens
agagccagccct

SEQ ID NO: 2013218 - DNA, 17 bp, Homo sapiens
agagccagccctccctg

SEQ ID NO: 2013219 - DNA, 18 bp, Homo sapiens
agagccagcctgggactc

SEQ ID NO: 2013220 - DNA, 16 bp, Homo sapiens
agagccaggctctgcc

SEQ ID NO: 2013221 - DNA, 13 bp, Homo sapiens
agagccagggtct

SEQ ID NO: 2013222 - DNA, 13 bp, Homo sapiens
agagccatgggcc

SEQ ID NO: 2013223 - DNA, 16 bp, Homo sapiens
agagccatgggcctgg

SEQ ID NO: 2013224 - DNA, 17 bp, Homo sapiens
agagccatgggcctggg

SEQ ID NO: 2013225 - DNA, 19 bp, Homo sapiens
agagccatgggcctgggcc

SEQ ID NO: 2013226 - DNA, 20 bp, Homo sapiens
agagccatgggcctgggcct

SEQ ID NO: 2013227 - DNA, 22 bp, Homo sapiens
agagccatgggcctgggcctgc

SEQ ID NO: 2013228 - DNA, 14 bp, Homo sapiens
agagcccaagtgcc

SEQ ID NO: 2013229 - DNA, 18 bp, Homo sapiens
agagcccaagtgccatcc

SEQ ID NO: 2013230 - DNA, 21 bp, Homo sapiens
agagcccagcagggcctcaaa

SEQ ID NO: 2013231 - DNA, 14 bp, Homo sapiens
agagcccagccatt

SEQ ID NO: 2013232 - DNA, 14 bp, Homo sapiens
agagcccatgctca

SEQ ID NO: 2013233 - DNA, 15 bp, Homo sapiens
agagcccatgctcaa

SEQ ID NO: 2013234 - DNA, 15 bp, Homo sapiens
agagccccacacgga

SEQ ID NO: 2013235 - DNA, 17 bp, Homo sapiens
agagccccacacggagg

SEQ ID NO: 2013236 - DNA, 14 bp, Homo sapiens
agagccccactccc

SEQ ID NO: 2013237 - DNA, 15 bp, Homo sapiens
agagcccccaagcct

SEQ ID NO: 2013238 - DNA, 16 bp, Homo sapiens
agagcccccaagcctc

SEQ ID NO: 2013239 - DNA, 20 bp, Homo sapiens
agagcccccaagcctctgcc

SEQ ID NO: 2013240 - DNA, 13 bp, Homo sapiens
agagcccccaagg

SEQ ID NO: 2013241 - DNA, 16 bp, Homo sapiens
actcctgtgggagcct

SEQ ID NO: 2013242 - DNA, 19 bp, Homo sapiens
actcctgtgggagcctcgc

SEQ ID NO: 2013243 - DNA, 17 bp, Homo sapiens
actcctgttacttacct

SEQ ID NO: 2013244 - DNA, 11 bp, Homo sapiens
actccttcctg

SEQ ID NO: 2013245 - DNA, 15 bp, Homo sapiens
actccttcctgcccc

SEQ ID NO: 2013246 - DNA, 21 bp, Homo sapiens
actccttgtggtttatgtcat

SEQ ID NO: 2013247 - DNA, 16 bp, Homo sapiens
actcgcagtcgcagga

SEQ ID NO: 2013248 - DNA, 16 bp, Homo sapiens
actcggagagggctgc

SEQ ID NO: 2013249 - DNA, 21 bp, Homo sapiens
actcgggaggctgaggcagga

SEQ ID NO: 2013250 - DNA, 17 bp, Homo sapiens
actcggtgtaaaaccat

SEQ ID NO: 2013251 - DNA, 18 bp, Homo sapiens
actctaaatatttcatga

SEQ ID NO: 2013252 - DNA, 19 bp, Homo sapiens
actctacccatattacaga

SEQ ID NO: 2013253 - DNA, 22 bp, Homo sapiens
actctaccctggtaggaaagca

SEQ ID NO: 2013254 - DNA, 17 bp, Homo sapiens
actctacgccaaagtgc

SEQ ID NO: 2013255 - DNA, 22 bp, Homo sapiens
actctacgccaaagtgcagccc

SEQ ID NO: 2013256 - DNA, 20 bp, Homo sapiens
actctactgcaagacttaaa

SEQ ID NO: 2013257 - DNA, 18 bp, Homo sapiens
actctagaacatgcacat

SEQ ID NO: 2013258 - DNA, 13 bp, Homo sapiens
actctagcctggg

SEQ ID NO: 2013259 - DNA, 20 bp, Homo sapiens
actctagtgacttcctggtg

SEQ ID NO: 2013260 - DNA, 14 bp, Homo sapiens
actctatagacttt

SEQ ID NO: 2013261 - DNA, 20 bp, Homo sapiens
actctatagttattgtttta

SEQ ID NO: 2013262 - DNA, 22 bp, Homo sapiens
actctcaatgcattttcaagat

SEQ ID NO: 2013263 - DNA, 24 bp, Homo sapiens
actctcaggaggcgcagcccgaag

SEQ ID NO: 2013264 - DNA, 13 bp, Homo sapiens
actgggggagggg

SEQ ID NO: 2013265 - DNA, 14 bp, Homo sapiens
actgggtaatgaaa

SEQ ID NO: 2013266 - DNA, 20 bp, Homo sapiens
actgggtaatgaaacaaaga

SEQ ID NO: 2013267 - DNA, 15 bp, Homo sapiens
actgggtacttgtgg

SEQ ID NO: 2013268 - DNA, 17 bp, Homo sapiens
actgggtacttgtggac

SEQ ID NO: 2013269 - DNA, 20 bp, Homo sapiens
actgggtacttgtggacaca

SEQ ID NO: 2013270 - DNA, 23 bp, Homo sapiens
actgggtacttgtggacacagct

SEQ ID NO: 2013271 - DNA, 21 bp, Homo sapiens
actgggttatttttgtccctg

SEQ ID NO: 2013272 - DNA, 23 bp, Homo sapiens
actgggttatttttgtccctgct

SEQ ID NO: 2013273 - DNA, 13 bp, Homo sapiens
actgggttgactt

SEQ ID NO: 2013274 - DNA, 20 bp, Homo sapiens
actgggttgactttcaggta

SEQ ID NO: 2013275 - DNA, 20 bp, Homo sapiens
actgggtttctctgtatagt

SEQ ID NO: 2013276 - DNA, 18 bp, Homo sapiens
actgggtttgtttttcaa

SEQ ID NO: 2013277 - DNA, 19 bp, Homo sapiens
actgggttttgtctctgca

SEQ ID NO: 2013278 - DNA, 22 bp, Homo sapiens
actgggttttgtctctgcatct

SEQ ID NO: 2013279 - DNA, 17 bp, Homo sapiens
actggtccactcagggc

SEQ ID NO: 2013280 - DNA, 18 bp, Homo sapiens
actggtccactcagggct

SEQ ID NO: 2013281 - DNA, 23 bp, Homo sapiens
actggtgctataggctggagaag

SEQ ID NO: 2013282 - DNA, 18 bp, Homo sapiens
actggtgttaagatatat

SEQ ID NO: 2013283 - DNA, 16 bp, Homo sapiens
actggttgtgaataat

SEQ ID NO: 2013284 - DNA, 20 bp, Homo sapiens
actggtttatccacccacaa

SEQ ID NO: 2013285 - DNA, 22 bp, Homo sapiens
actggtttgttgcagccaaaga

SEQ ID NO: 2013286 - DNA, 19 bp, Homo sapiens
actgtaaatatgtttgtgc

SEQ ID NO: 2013287 - DNA, 11 bp, Homo sapiens
actgtaaatca

SEQ ID NO: 2013288 - DNA, 13 bp, Homo sapiens
actgtaaatcact

SEQ ID NO: 2013289 - DNA, 16 bp, Homo sapiens
actgtaaatcacttgt

SEQ ID NO: 2013290 - DNA, 17 bp, Homo sapiens
actgtaaatcacttgta

SEQ ID NO: 2013291 - DNA, 19 bp, Homo sapiens
actgtaaatcacttgtaaa

SEQ ID NO: 2013292 - DNA, 23 bp, Homo sapiens
actgtaaatcacttgtaaataaa

SEQ ID NO: 2013293 - DNA, 13 bp, Homo sapiens
actgtaaatgtat

SEQ ID NO: 2013294 - DNA, 14 bp, Homo sapiens
actgtaagtttatt

SEQ ID NO: 2013295 - DNA, 14 bp, Homo sapiens
actgtaattttgtt

SEQ ID NO: 2013296 - DNA, 22 bp, Homo sapiens
actgtaattttgtttgtaatcc

SEQ ID NO: 2013297 - DNA, 12 bp, Homo sapiens
actgtacataga

SEQ ID NO: 2013298 - DNA, 13 bp, Homo sapiens
actgtactcctcc

SEQ ID NO: 2013299 - DNA, 22 bp, Homo sapiens
actgtactgagacattacagtt

SEQ ID NO: 2013300 - DNA, 17 bp, Homo sapiens
actgtacttaataaatt

SEQ ID NO: 2013301 - DNA, 23 bp, Homo sapiens
actgtacttattttccaataaaa

SEQ ID NO: 2013302 - DNA, 18 bp, Homo sapiens
actgtagaatgatttcat

SEQ ID NO: 2013303 - DNA, 16 bp, Homo sapiens
actgtatcaaatctgt

SEQ ID NO: 2013304 - DNA, 22 bp, Homo sapiens
actgtatctctaatacagtgtg

SEQ ID NO: 2013305 - DNA, 13 bp, Homo sapiens
actgtatgctgga

SEQ ID NO: 2013306 - DNA, 15 bp, Homo sapiens
actgtcaagtcatga

SEQ ID NO: 2013307 - DNA, 22 bp, Homo sapiens
actgtccgcctctgcccgcaga

SEQ ID NO: 2013308 - DNA, 23 bp, Homo sapiens
actgtcctacccaccctcctttc

SEQ ID NO: 2013309 - DNA, 18 bp, Homo sapiens
actgtcgtgtttacaaaa

SEQ ID NO: 2013310 - DNA, 23 bp, Homo sapiens
actgtctcaagagggcactggtg

SEQ ID NO: 2013311 - DNA, 15 bp, Homo sapiens
actgtctctcatgaa

SEQ ID NO: 2013312 - DNA, 17 bp, Homo sapiens
actgtctctcatgaacc

SEQ ID NO: 2013313 - DNA, 17 bp, Homo sapiens
actgtctggttttaaca

SEQ ID NO: 2013314 - DNA, 18 bp, Homo sapiens
actgtctggttttaacaa

SEQ ID NO: 2013315 - DNA, 17 bp, Homo sapiens
actgtctgtaagagaat

SEQ ID NO: 2013316 - DNA, 14 bp, Homo sapiens
actgtcttcacaac

SEQ ID NO: 2013317 - DNA, 22 bp, Homo sapiens
actgtcttgcctgccagggccc

SEQ ID NO: 2013318 - DNA, 21 bp, Homo sapiens
actgtgaagacccagcaggaa

SEQ ID NO: 2013319 - DNA, 22 bp, Homo sapiens
actgtgacaccagaataatgag

SEQ ID NO: 2013320 - DNA, 11 bp, Homo sapiens
actgtgacagg

SEQ ID NO: 2013321 - DNA, 12 bp, Homo sapiens
actgtgagactg

SEQ ID NO: 2013322 - DNA, 15 bp, Homo sapiens
actgtgagactgtat

SEQ ID NO: 2013323 - DNA, 23 bp, Homo sapiens
actgtgatcaggctatgtatgga

SEQ ID NO: 2013324 - DNA, 23 bp, Homo sapiens
actgtgatggggtgggcagggct

SEQ ID NO: 2013325 - DNA, 13 bp, Homo sapiens
actgtgcaggagt

SEQ ID NO: 2013326 - DNA, 17 bp, Homo sapiens
actgtgcatacatgttc

SEQ ID NO: 2013327 - DNA, 17 bp, Homo sapiens
actgtgccctgccttca

SEQ ID NO: 2013328 - DNA, 18 bp, Homo sapiens
actgtgccctgccttcag

SEQ ID NO: 2013329 - DNA, 18 bp, Homo sapiens
actgtgcgttttagagta

SEQ ID NO: 2013330 - DNA, 14 bp, Homo sapiens
actgtgcttacagt

SEQ ID NO: 2013331 - DNA, 23 bp, Homo sapiens
actgtgcttacagtgactgtcgt

SEQ ID NO: 2013332 - DNA, 14 bp, Homo sapiens
actgtggaaaaata

SEQ ID NO: 2013333 - DNA, 15 bp, Homo sapiens
actgtggaaaaatat

SEQ ID NO: 2013334 - DNA, 15 bp, Homo sapiens
actgtggccagagct

SEQ ID NO: 2013335 - DNA, 17 bp, Homo sapiens
actgtggccagagctgg

SEQ ID NO: 2013336 - DNA, 14 bp, Homo sapiens
actgtggctgcaga

SEQ ID NO: 2013337 - DNA, 19 bp, Homo sapiens
actgtggctgctagcactt

SEQ ID NO: 2013338 - DNA, 20 bp, Homo sapiens
actgtgttcagtgccttgga

SEQ ID NO: 2013339 - DNA, 19 bp, Homo sapiens
actgtgttggccaggctgg

SEQ ID NO: 2013340 - DNA, 20 bp, Homo sapiens
actgtgttggccaggctggt

SEQ ID NO: 2013341 - DNA, 14 bp, Homo sapiens
actgttactccaca

SEQ ID NO: 2013342 - DNA, 21 bp, Homo sapiens
actgttactttttagtctttt

SEQ ID NO: 2013343 - DNA, 22 bp, Homo sapiens
actgttactttttagtctttta

SEQ ID NO: 2013344 - DNA, 18 bp, Homo sapiens
actgttcacgttgggtgg

SEQ ID NO: 2013345 - DNA, 20 bp, Homo sapiens
actgttctgtgtgggtctgg

SEQ ID NO: 2013346 - DNA, 13 bp, Homo sapiens
actgttgaaaatt

SEQ ID NO: 2013347 - DNA, 14 bp, Homo sapiens
actgttgcccaggc

SEQ ID NO: 2013348 - DNA, 21 bp, Homo sapiens
actgttgctcaaatctattca

SEQ ID NO: 2013349 - DNA, 15 bp, Homo sapiens
actgttgtacaagct

SEQ ID NO: 2013350 - DNA, 14 bp, Homo sapiens
actgtttcttacct

SEQ ID NO: 2013351 - DNA, 21 bp, Homo sapiens
actgtttgccttctactttta

SEQ ID NO: 2013352 - DNA, 14 bp, Homo sapiens
actgtttttgaaga

SEQ ID NO: 2013353 - DNA, 16 bp, Homo sapiens
actgtttttgaagaag

SEQ ID NO: 2013354 - DNA, 14 bp, Homo sapiens
acttaaaaaaatga

SEQ ID NO: 2013355 - DNA, 16 bp, Homo sapiens
acttaaaaaaatgaca

SEQ ID NO: 2013356 - DNA, 17 bp, Homo sapiens
acttaaaagattcacta

SEQ ID NO: 2013357 - DNA, 13 bp, Homo sapiens
acttaaaatattt

SEQ ID NO: 2013358 - DNA, 16 bp, Homo sapiens
acttaaagcttgtttg

SEQ ID NO: 2013359 - DNA, 16 bp, Homo sapiens
acttaacattgattta

SEQ ID NO: 2013360 - DNA, 19 bp, Homo sapiens
acttaacggctccaggatt

SEQ ID NO: 2013361 - DNA, 13 bp, Homo sapiens
acttaactgtgtg

SEQ ID NO: 2013362 - DNA, 21 bp, Homo sapiens
acttaactgtgtgaagaaatg

SEQ ID NO: 2013363 - DNA, 22 bp, Homo sapiens
acttaactgtgtgaagaaatgg

SEQ ID NO: 2013364 - DNA, 15 bp, Homo sapiens
actttgatctctgct

SEQ ID NO: 2013365 - DNA, 16 bp, Homo sapiens
actttgatctctgctt

SEQ ID NO: 2013366 - DNA, 17 bp, Homo sapiens
actttgatgcatttcca

SEQ ID NO: 2013367 - DNA, 21 bp, Homo sapiens
actttgccccagttacaaaaa

SEQ ID NO: 2013368 - DNA, 17 bp, Homo sapiens
actttgctctttcttga

SEQ ID NO: 2013369 - DNA, 18 bp, Homo sapiens
actttggccaagcaagag

SEQ ID NO: 2013370 - DNA, 17 bp, Homo sapiens
actttggcttctcctgt

SEQ ID NO: 2013371 - DNA, 14 bp, Homo sapiens
actttgggaggcca

SEQ ID NO: 2013372 - DNA, 15 bp, Homo sapiens
actttgggaggccaa

SEQ ID NO: 2013373 - DNA, 14 bp, Homo sapiens
actttgggcccaga

SEQ ID NO: 2013374 - DNA, 19 bp, Homo sapiens
actttggtacatggccagt

SEQ ID NO: 2013375 - DNA, 13 bp, Homo sapiens
actttgtcccgct

SEQ ID NO: 2013376 - DNA, 18 bp, Homo sapiens
actttgtgttcaccttgt

SEQ ID NO: 2013377 - DNA, 18 bp, Homo sapiens
actttgttgccttatctt

SEQ ID NO: 2013378 - DNA, 15 bp, Homo sapiens
acttttaaacagtga

SEQ ID NO: 2013379 - DNA, 21 bp, Homo sapiens
acttttccatgtatctacctc

SEQ ID NO: 2013380 - DNA, 21 bp, Homo sapiens
acttttctttattgctgtgaa

SEQ ID NO: 2013381 - DNA, 20 bp, Homo sapiens
acttttggataatatccact

SEQ ID NO: 2013382 - DNA, 12 bp, Homo sapiens
acttttgtaaga

SEQ ID NO: 2013383 - DNA, 17 bp, Homo sapiens
acttttgtaccagtgtg

SEQ ID NO: 2013384 - DNA, 18 bp, Homo sapiens
acttttgttctgtatttt

SEQ ID NO: 2013385 - DNA, 13 bp, Homo sapiens
acttttgtttcag

SEQ ID NO: 2013386 - DNA, 10 bp, Homo sapiens
actttttagc

SEQ ID NO: 2013387 - DNA, 17 bp, Homo sapiens
actttttagtcttttac

SEQ ID NO: 2013388 - DNA, 19 bp, Homo sapiens
actttttataatgtggatt

SEQ ID NO: 2013389 - DNA, 14 bp, Homo sapiens
actttttattcaat

SEQ ID NO: 2013390 - DNA, 22 bp, Homo sapiens
actttttattcaattctgtata

SEQ ID NO: 2013391 - DNA, 23 bp, Homo sapiens
acttttttatttaaaaaactaaa

SEQ ID NO: 2013392 - DNA, 15 bp, Homo sapiens
agaaaaaaaaaaaga

SEQ ID NO: 2013393 - DNA, 16 bp, Homo sapiens
agaaaaaaaaaaagaa

SEQ ID NO: 2013394 - DNA, 21 bp, Homo sapiens
agaaaaaaagtttgccagaag

SEQ ID NO: 2013395 - DNA, 15 bp, Homo sapiens
agaaaaaaatatatt

SEQ ID NO: 2013396 - DNA, 15 bp, Homo sapiens
agaaaaaataaatgg

SEQ ID NO: 2013397 - DNA, 23 bp, Homo sapiens
agaaaaaccaatgattcataaca

SEQ ID NO: 2013398 - DNA, 21 bp, Homo sapiens
agaaaaagttgcagtctcaga

SEQ ID NO: 2013399 - DNA, 23 bp, Homo sapiens
agaaaaatatatatgtgcagtat

SEQ ID NO: 2013400 - DNA, 16 bp, Homo sapiens
agaaaacctttcttca

SEQ ID NO: 2013401 - DNA, 19 bp, Homo sapiens
agaaaacgcacctccatcc

SEQ ID NO: 2013402 - DNA, 20 bp, Homo sapiens
agaaaacggagagtgcttgg

SEQ ID NO: 2013403 - DNA, 15 bp, Homo sapiens
agaaaactgaaaatc

SEQ ID NO: 2013404 - DNA, 14 bp, Homo sapiens
agaaaactggaaat

SEQ ID NO: 2013405 - DNA, 16 bp, Homo sapiens
agaaaagaaaaccatt

SEQ ID NO: 2013406 - DNA, 20 bp, Homo sapiens
agaaaagaacgtattttaaa

SEQ ID NO: 2013407 - DNA, 21 bp, Homo sapiens
agaaaagattaaaattagtga

SEQ ID NO: 2013408 - DNA, 18 bp, Homo sapiens
agaaaagatttaagtaat

SEQ ID NO: 2013409 - DNA, 15 bp, Homo sapiens
agaaaagcacctgcc

SEQ ID NO: 2013410 - DNA, 16 bp, Homo sapiens
agaaaagcacctgccg

SEQ ID NO: 2013411 - DNA, 14 bp, Homo sapiens
agaaaagctttgaa

SEQ ID NO: 2013412 - DNA, 15 bp, Homo sapiens
agaaaagtagaatta

SEQ ID NO: 2013413 - DNA, 17 bp, Homo sapiens
agaaaagtagaattata

SEQ ID NO: 2013414 - DNA, 22 bp, Homo sapiens
agaaaagtagaattatatctaa

SEQ ID NO: 2013415 - DNA, 19 bp, Homo sapiens
agaaaagtgcttagaaagt

SEQ ID NO: 2013416 - DNA, 11 bp, Homo sapiens
agaaaatgaag

SEQ ID NO: 2013417 - DNA, 23 bp, Homo sapiens
agaaacacaaatgtaaaataagt

SEQ ID NO: 2013418 - DNA, 14 bp, Homo sapiens
agaaacacaatatt

SEQ ID NO: 2013419 - DNA, 14 bp, Homo sapiens
agaaacagagacag

SEQ ID NO: 2013420 - DNA, 19 bp, Homo sapiens
agaaacagagacaggccca

SEQ ID NO: 2013421 - DNA, 17 bp, Homo sapiens
agaaacagagagagaca

SEQ ID NO: 2013422 - DNA, 15 bp, Homo sapiens
agaaacagataccat

SEQ ID NO: 2013423 - DNA, 21 bp, Homo sapiens
agaaacagggacaaagaaatc

SEQ ID NO: 2013424 - DNA, 13 bp, Homo sapiens
agaaacagttaac

SEQ ID NO: 2013425 - DNA, 17 bp, Homo sapiens
agaaacatgaattattt

SEQ ID NO: 2013426 - DNA, 17 bp, Homo sapiens
agaaacatgacactgac

SEQ ID NO: 2013427 - DNA, 15 bp, Homo sapiens
agaaaccagtatgga

SEQ ID NO: 2013428 - DNA, 17 bp, Homo sapiens
agaaacccaccagccta

SEQ ID NO: 2013429 - DNA, 18 bp, Homo sapiens
agaaacccaccagcctaa

SEQ ID NO: 2013430 - DNA, 13 bp, Homo sapiens
agaaaccccaagc

SEQ ID NO: 2013431 - DNA, 18 bp, Homo sapiens
agaaaccttattgtacct

SEQ ID NO: 2013432 - DNA, 20 bp, Homo sapiens
agaaacgaagccatctttct

SEQ ID NO: 2013433 - DNA, 20 bp, Homo sapiens
agaaactcacgatgaaattg

SEQ ID NO: 2013434 - DNA, 21 bp, Homo sapiens
agaaactccttttgctgtctt

SEQ ID NO: 2013435 - DNA, 19 bp, Homo sapiens
agaaactcgatgaatgtgt

SEQ ID NO: 2013436 - DNA, 19 bp, Homo sapiens
agaaactgaaaactgtaaa

SEQ ID NO: 2013437 - DNA, 12 bp, Homo sapiens
agaaactgagga

SEQ ID NO: 2013438 - DNA, 13 bp, Homo sapiens
agaaactgaggag

SEQ ID NO: 2013439 - DNA, 16 bp, Homo sapiens
agaaactgaggagtag

SEQ ID NO: 2013440 - DNA, 21 bp, Homo sapiens
agaaactgaggagtagctgag

SEQ ID NO: 2013441 - DNA, 15 bp, Homo sapiens
agaaactttctttct

SEQ ID NO: 2013442 - DNA, 19 bp, Homo sapiens
agaaactttgatctctgct

SEQ ID NO: 2013443 - DNA, 22 bp, Homo sapiens
agaaactttgatctctgcttac

SEQ ID NO: 2013444 - DNA, 19 bp, Homo sapiens
agaaacttttttatttaaa

SEQ ID NO: 2013445 - DNA, 22 bp, Homo sapiens
agaaagaaaattagtaattgta

SEQ ID NO: 2013446 - DNA, 20 bp, Homo sapiens
agaaagaacggaagaagaga

SEQ ID NO: 2013447 - DNA, 12 bp, Homo sapiens
agaaagaagaga

SEQ ID NO: 2013448 - DNA, 13 bp, Homo sapiens
agaaagaagagac

SEQ ID NO: 2013449 - DNA, 12 bp, Homo sapiens
agaaagaagccc

SEQ ID NO: 2013450 - DNA, 18 bp, Homo sapiens
agaaagaaggaagtgaag

SEQ ID NO: 2013451 - DNA, 19 bp, Homo sapiens
agaaagactattcaaacag

SEQ ID NO: 2013452 - DNA, 23 bp, Homo sapiens
agaaagagagagaattctttcaa

SEQ ID NO: 2013453 - DNA, 20 bp, Homo sapiens
agaaagaggtgaccccaggg

SEQ ID NO: 2013454 - DNA, 21 bp, Homo sapiens
agaaagaggtgaccccagggc

SEQ ID NO: 2013455 - DNA, 23 bp, Homo sapiens
agaaagaggtgaccccagggcac

SEQ ID NO: 2013456 - DNA, 19 bp, Homo sapiens
agaaagatggatgtgcttt

SEQ ID NO: 2013457 - DNA, 21 bp, Homo sapiens
agaaagcaagccaatttggaa

SEQ ID NO: 2013458 - DNA, 13 bp, Homo sapiens
agaagcagtgagc

SEQ ID NO: 2013459 - DNA, 23 bp, Homo sapiens
agaagcagtgagccgcatcttct

SEQ ID NO: 2013460 - DNA, 17 bp, Homo sapiens
agaagcagtgtttctac

SEQ ID NO: 2013461 - DNA, 14 bp, Homo sapiens
agaagccaaatttt

SEQ ID NO: 2013462 - DNA, 14 bp, Homo sapiens
agaagccaggagca

SEQ ID NO: 2013463 - DNA, 15 bp, Homo sapiens
agaagccgcagggac

SEQ ID NO: 2013464 - DNA, 14 bp, Homo sapiens
agaagccgggaaca

SEQ ID NO: 2013465 - DNA, 16 bp, Homo sapiens
agaagccgggaacaga

SEQ ID NO: 2013466 - DNA, 16 bp, Homo sapiens
agaagcctctgcctcc

SEQ ID NO: 2013467 - DNA, 13 bp, Homo sapiens
agaagcctggggg

SEQ ID NO: 2013468 - DNA, 17 bp, Homo sapiens
agaagcctgggggcctg

SEQ ID NO: 2013469 - DNA, 19 bp, Homo sapiens
agaagcggtttccaggcca

SEQ ID NO: 2013470 - DNA, 21 bp, Homo sapiens
agaagctcatttagttagaaa

SEQ ID NO: 2013471 - DNA, 13 bp, Homo sapiens
agaagctcccaga

SEQ ID NO: 2013472 - DNA, 21 bp, Homo sapiens
agaagctcccagatgctgggg

SEQ ID NO: 2013473 - DNA, 15 bp, Homo sapiens
agaagctgagaagaa

SEQ ID NO: 2013474 - DNA, 16 bp, Homo sapiens
agaagctgagaagaag

SEQ ID NO: 2013475 - DNA, 12 bp, Homo sapiens
agaagctgagga

SEQ ID NO: 2013476 - DNA, 15 bp, Homo sapiens
agaagctgaggatcc

SEQ ID NO: 2013477 - DNA, 16 bp, Homo sapiens
agaagcttcagaagtt

SEQ ID NO: 2013478 - DNA, 17 bp, Homo sapiens
agaaggaaaaagaaagt

SEQ ID NO: 2013479 - DNA, 16 bp, Homo sapiens
agaaggaaaaggcagg

SEQ ID NO: 2013480 - DNA, 22 bp, Homo sapiens
agaaggaaggagactcacctct

SEQ ID NO: 2013481 - DNA, 19 bp, Homo sapiens
agaaggaaggaggcagact

SEQ ID NO: 2013482 - DNA, 11 bp, Homo sapiens
agaaggaaggc

SEQ ID NO: 2013483 - DNA, 19 bp, Homo sapiens
agaaggaaggcagggagga

SEQ ID NO: 2013484 - DNA, 20 bp, Homo sapiens
acttataagtgggagctaaa

SEQ ID NO: 2013485 - DNA, 18 bp, Homo sapiens
acttatatggaaattctg

SEQ ID NO: 2013486 - DNA, 20 bp, Homo sapiens
acttatcagctacttaagag

SEQ ID NO: 2013487 - DNA, 16 bp, Homo sapiens
acttatgctagtttat

SEQ ID NO: 2013488 - DNA, 12 bp, Homo sapiens
acttatttgagt

SEQ ID NO: 2013489 - DNA, 22 bp, Homo sapiens
acttatttgagtgattatttgt

SEQ ID NO: 2013490 - DNA, 21 bp, Homo sapiens
acttattttctggatctatct

SEQ ID NO: 2013491 - DNA, 15 bp, Homo sapiens
acttcaaatatagag

SEQ ID NO: 2013492 - DNA, 23 bp, Homo sapiens
acttcaagcatggctattttata

SEQ ID NO: 2013493 - DNA, 16 bp, Homo sapiens
acttcaagttaaagtg

SEQ ID NO: 2013494 - DNA, 16 bp, Homo sapiens
acttcacacacaggca

SEQ ID NO: 2013495 - DNA, 19 bp, Homo sapiens
acttcacactgcaagagcc

SEQ ID NO: 2013496 - DNA, 21 bp, Homo sapiens
acttcactgtgaggggaaggc

SEQ ID NO: 2013497 - DNA, 20 bp, Homo sapiens
acttcagaacatgctggata

SEQ ID NO: 2013498 - DNA, 13 bp, Homo sapiens
acttcagcccagc

SEQ ID NO: 2013499 - DNA, 13 bp, Homo sapiens
acttcagctctgt

SEQ ID NO: 2013500 - DNA, 22 bp, Homo sapiens
acttcaggtggagagcactaga

SEQ ID NO: 2013501 - DNA, 23 bp, Homo sapiens
acttcatggcctttgataaatgt

SEQ ID NO: 2013502 - DNA, 15 bp, Homo sapiens
acttcattcttgaaa

SEQ ID NO: 2013503 - DNA, 17 bp, Homo sapiens
acttcattttcagagtg

SEQ ID NO: 2013504 - DNA, 22 bp, Homo sapiens
acttccagtgttggctgtgtga

SEQ ID NO: 2013505 - DNA, 17 bp, Homo sapiens
acttccataatctggac

SEQ ID NO: 2013506 - DNA, 16 bp, Homo sapiens
acttcctgtgtactct

SEQ ID NO: 2013507 - DNA, 13 bp, Homo sapiens
acttctaaatgtt

SEQ ID NO: 2013508 - DNA, 14 bp, Homo sapiens
acttctaaatgttg

SEQ ID NO: 2013509 - DNA, 13 bp, Homo sapiens
acttctaagtaaa

SEQ ID NO: 2013510 - DNA, 17 bp, Homo sapiens
acttctcaggacacagg

SEQ ID NO: 2013511 - DNA, 18 bp, Homo sapiens
acttctcaggacacaggc

SEQ ID NO: 2013512 - DNA, 20 bp, Homo sapiens
acttctcaggacacaggcct

SEQ ID NO: 2013513 - DNA, 21 bp, Homo sapiens
acttctcaggacacaggcctg

SEQ ID NO: 2013514 - DNA, 22 bp, Homo sapiens
acttctcatcatattgtatgta

SEQ ID NO: 2013515 - DNA, 23 bp, Homo sapiens
acttctcatcatattgtatgtaa

SEQ ID NO: 2013516 - DNA, 19 bp, Homo sapiens
acttctcattttttaaaaa

SEQ ID NO: 2013517 - DNA, 15 bp, Homo sapiens
acttctccaccctgc

SEQ ID NO: 2013518 - DNA, 18 bp, Homo sapiens
acttctccaccctgctct

SEQ ID NO: 2013519 - DNA, 14 bp, Homo sapiens
acttctctttctta

SEQ ID NO: 2013520 - DNA, 17 bp, Homo sapiens
acttctctttgcctcaa

SEQ ID NO: 2013521 - DNA, 21 bp, Homo sapiens
acttctctttgcctcaaataa

SEQ ID NO: 2013522 - DNA, 17 bp, Homo sapiens
acttctgccccagcttt

SEQ ID NO: 2013523 - DNA, 16 bp, Homo sapiens
acttctggaaggctgg

SEQ ID NO: 2013524 - DNA, 19 bp, Homo sapiens
acttctggaaggctggctg

SEQ ID NO: 2013525 - DNA, 20 bp, Homo sapiens
acttctggaaggctggctga

SEQ ID NO: 2013526 - DNA, 21 bp, Homo sapiens
acttctggaaggctggctgag

SEQ ID NO: 2013527 - DNA, 22 bp, Homo sapiens
acttctgtcttcacaacagatt

SEQ ID NO: 2013528 - DNA, 16 bp, Homo sapiens
acttcttaaaagttgt

SEQ ID NO: 2013529 - DNA, 15 bp, Homo sapiens
acttcttggaaaaaa

SEQ ID NO: 2013530 - DNA, 21 bp, Homo sapiens
acttcttggaaaaaaattaca

SEQ ID NO: 2013531 - DNA, 19 bp, Homo sapiens
acttcttggtttggggaga

SEQ ID NO: 2013532 - DNA, 22 bp, Homo sapiens
acttcttggtttggggagaaat

SEQ ID NO: 2013533 - DNA, 22 bp, Homo sapiens
acttctttcctctccaattgta

SEQ ID NO: 2013534 - DNA, 15 bp, Homo sapiens
acttcttttataact

SEQ ID NO: 2013535 - DNA, 16 bp, Homo sapiens
acttgaaattatatct

SEQ ID NO: 2013536 - DNA, 21 bp, Homo sapiens
acttgaactgattcacatctc

SEQ ID NO: 2013537 - DNA, 19 bp, Homo sapiens
acttgaatactctcacaag

SEQ ID NO: 2013538 - DNA, 14 bp, Homo sapiens
acttgaatctgtta

SEQ ID NO: 2013539 - DNA, 19 bp, Homo sapiens
acttgaatctgttactgaa

SEQ ID NO: 2013540 - DNA, 19 bp, Homo sapiens
acttgacaacatcccacag

SEQ ID NO: 2013541 - DNA, 13 bp, Homo sapiens
acttgacattcct

SEQ ID NO: 2013542 - DNA, 22 bp, Homo sapiens
acttgagcctccatttctggct

SEQ ID NO: 2013543 - DNA, 14 bp, Homo sapiens
acttgagctgtata

SEQ ID NO: 2013544 - DNA, 16 bp, Homo sapiens
acttgagctgtatata

SEQ ID NO: 2013545 - DNA, 14 bp, Homo sapiens
acttgaggacacat

SEQ ID NO: 2013546 - DNA, 15 bp, Homo sapiens
acttgaggacacatg

SEQ ID NO: 2013547 - DNA, 19 bp, Homo sapiens
acttgaggctggcactccc

SEQ ID NO: 2013548 - DNA, 15 bp, Homo sapiens
acttgagggtaataa

SEQ ID NO: 2013549 - DNA, 17 bp, Homo sapiens
acttgagggtaataaac

SEQ ID NO: 2013550 - DNA, 18 bp, Homo sapiens
acttgagggtaataaact

SEQ ID NO: 2013551 - DNA, 19 bp, Homo sapiens
acttgatatagaaagctgt

SEQ ID NO: 2013552 - DNA, 22 bp, Homo sapiens
acttgcagactctacagaggcc

SEQ ID NO: 2013553 - DNA, 19 bp, Homo sapiens
acttgcattgaatatatta

SEQ ID NO: 2013554 - DNA, 20 bp, Homo sapiens
acttgccttcttcacccagc

SEQ ID NO: 2013555 - DNA, 20 bp, Homo sapiens
acttgcgtcctgcagaggac

SEQ ID NO: 2013556 - DNA, 23 bp, Homo sapiens
acttgctctctggccttttccta

SEQ ID NO: 2013557 - DNA, 23 bp, Homo sapiens
acttgctgcctgaagaacagtaa

SEQ ID NO: 2013558 - DNA, 14 bp, Homo sapiens
acttggaaaaagaa

SEQ ID NO: 2013559 - DNA, 18 bp, Homo sapiens
acttggaaaaagaaagaa

SEQ ID NO: 2013560 - DNA, 21 bp, Homo sapiens
acttggaaaaatccagaaaga

SEQ ID NO: 2013561 - DNA, 21 bp, Homo sapiens
acttgggaggctgaggcagga

SEQ ID NO: 2013562 - DNA, 21 bp, Homo sapiens
acttgggcacccccagcctgg

SEQ ID NO: 2013563 - DNA, 16 bp, Homo sapiens
acttgggcgctctgcc

SEQ ID NO: 2013564 - DNA, 15 bp, Homo sapiens
acttgggtcttccct

SEQ ID NO: 2013565 - DNA, 19 bp, Homo sapiens
acttggtttttggctcttt

SEQ ID NO: 2013566 - DNA, 16 bp, Homo sapiens
acttgtaaataaatag

SEQ ID NO: 2013567 - DNA, 19 bp, Homo sapiens
acttgtaaataaatagatt

SEQ ID NO: 2013568 - DNA, 18 bp, Homo sapiens
acttgtactatgttaata

SEQ ID NO: 2013569 - DNA, 18 bp, Homo sapiens
acttgtagaaatctgtaa

SEQ ID NO: 2013570 - DNA, 19 bp, Homo sapiens
acttgtagaaatctgtaat

SEQ ID NO: 2013571 - DNA, 19 bp, Homo sapiens
acttgtataaatgtatata

SEQ ID NO: 2013572 - DNA, 16 bp, Homo sapiens
acttgtctattacctg

SEQ ID NO: 2013573 - DNA, 12 bp, Homo sapiens
acttgtctgagg

SEQ ID NO: 2013574 - DNA, 22 bp, Homo sapiens
acttgtctgaggcctcatccct

SEQ ID NO: 2013575 - DNA, 23 bp, Homo sapiens
acttgtgtatgatccaagtattt

SEQ ID NO: 2013576 - DNA, 16 bp, Homo sapiens
acttgtgtctctgtgc

SEQ ID NO: 2013577 - DNA, 15 bp, Homo sapiens
acttgttcacaggtt

SEQ ID NO: 2013578 - DNA, 20 bp, Homo sapiens
acttgttccttctgcttctc

SEQ ID NO: 2013579 - DNA, 16 bp, Homo sapiens
acttgtttgtaagatt

SEQ ID NO: 2013580 - DNA, 15 bp, Homo sapiens
actttaaaagatgaa

SEQ ID NO: 2013581 - DNA, 19 bp, Homo sapiens
aggcggtcatgtgtgcatg

SEQ ID NO: 2013582 - DNA, 22 bp, Homo sapiens
aggcggtcatgtgtgcatgtga

SEQ ID NO: 2013583 - DNA, 16 bp, Homo sapiens
aggcggtttccaggaa

SEQ ID NO: 2013584 - DNA, 14 bp, Homo sapiens
aggcgttggtgcca

SEQ ID NO: 2013585 - DNA, 15 bp, Homo sapiens
aggcgttggtgccac

SEQ ID NO: 2013586 - DNA, 18 bp, Homo sapiens
aggctaagttcagttctg

SEQ ID NO: 2013587 - DNA, 22 bp, Homo sapiens
aggctaatttttttgtatttta

SEQ ID NO: 2013588 - DNA, 23 bp, Homo sapiens
aggctaatttttttgtattttag

SEQ ID NO: 2013589 - DNA, 20 bp, Homo sapiens
aggctacttcggggctggga

SEQ ID NO: 2013590 - DNA, 20 bp, Homo sapiens
aggctagagtgcagtggcat

SEQ ID NO: 2013591 - DNA, 22 bp, Homo sapiens
aggatgtaaacagtgcctgctg

SEQ ID NO: 2013592 - DNA, 19 bp, Homo sapiens
aggatgtccgttccaggag

SEQ ID NO: 2013593 - DNA, 20 bp, Homo sapiens
aggatgtccgttccaggagc

SEQ ID NO: 2013594 - DNA, 16 bp, Homo sapiens
aggatgtggcactgct

SEQ ID NO: 2013595 - DNA, 15 bp, Homo sapiens
aggatgttctgggac

SEQ ID NO: 2013596 - DNA, 16 bp, Homo sapiens
aggatgttctgggaca

SEQ ID NO: 2013597 - DNA, 22 bp, Homo sapiens
aggatgttttgtcccatttcct

SEQ ID NO: 2013598 - DNA, 14 bp, Homo sapiens
aggatgtttttcat

SEQ ID NO: 2013599 - DNA, 14 bp, Homo sapiens
aggattccaaagtt

SEQ ID NO: 2013600 - DNA, 18 bp, Homo sapiens
aggattcctctctcaggt

SEQ ID NO: 2013601 - DNA, 14 bp, Homo sapiens
aggattgaagagca

SEQ ID NO: 2013602 - DNA, 22 bp, Homo sapiens
aggattgaagagcattgcatgg

SEQ ID NO: 2013603 - DNA, 22 bp, Homo sapiens
aggattgctactgtcctaccca

SEQ ID NO: 2013604 - DNA, 17 bp, Homo sapiens
aggattgcttgagccca

SEQ ID NO: 2013605 - DNA, 21 bp, Homo sapiens
aggattgcttgagcccaggag

SEQ ID NO: 2013606 - DNA, 21 bp, Homo sapiens
aggatttaacagtcatttaaa

SEQ ID NO: 2013607 - DNA, 17 bp, Homo sapiens
aggatttatttaaaata

SEQ ID NO: 2013608 - DNA, 16 bp, Homo sapiens
aggatttcaagcctgc

SEQ ID NO: 2013609 - DNA, 19 bp, Homo sapiens
aggatttcatgatttcatt

SEQ ID NO: 2013610 - DNA, 21 bp, Homo sapiens
aggatttcattgactgaactg

SEQ ID NO: 2013611 - DNA, 19 bp, Homo sapiens
aggattttaacaaaagcaa

SEQ ID NO: 2013612 - DNA, 23 bp, Homo sapiens
aggattttaacaaaagcaagact

SEQ ID NO: 2013613 - DNA, 17 bp, Homo sapiens
aggcaaaatccttgctt

SEQ ID NO: 2013614 - DNA, 15 bp, Homo sapiens
aggcaaacatttctt

SEQ ID NO: 2013615 - DNA, 16 bp, Homo sapiens
aggcaaagcccctgga

SEQ ID NO: 2013616 - DNA, 19 bp, Homo sapiens
aggcaaatataagctggga

SEQ ID NO: 2013617 - DNA, 15 bp, Homo sapiens
aggcaaatgcagttt

SEQ ID NO: 2013618 - DNA, 15 bp, Homo sapiens
aggcaactgaggcag

SEQ ID NO: 2013619 - DNA, 12 bp, Homo sapiens
aggcaagagaaa

SEQ ID NO: 2013620 - DNA, 12 bp, Homo sapiens
aggcaagagaat

SEQ ID NO: 2013621 - DNA, 17 bp, Homo sapiens
aggcaagcacctcctgc

SEQ ID NO: 2013622 - DNA, 20 bp, Homo sapiens
aggcaagcacctcctgcctc

SEQ ID NO: 2013623 - DNA, 13 bp, Homo sapiens
aggcaagcccctc

SEQ ID NO: 2013624 - DNA, 16 bp, Homo sapiens
aggcaagcccctcagc

SEQ ID NO: 2013625 - DNA, 20 bp, Homo sapiens
aggcaagcccctcagccctt

SEQ ID NO: 2013626 - DNA, 21 bp, Homo sapiens
aggcaagcccctcagcccttg

SEQ ID NO: 2013627 - DNA, 17 bp, Homo sapiens
aggcaagtgaagaaaag

SEQ ID NO: 2013628 - DNA, 18 bp, Homo sapiens
aggcaagtttctagctag

SEQ ID NO: 2013629 - DNA, 14 bp, Homo sapiens
aggcaatgctggct

SEQ ID NO: 2013630 - DNA, 15 bp, Homo sapiens
aggcaatgctggctg

SEQ ID NO: 2013631 - DNA, 16 bp, Homo sapiens
aggcaatgctggctgt

SEQ ID NO: 2013632 - DNA, 19 bp, Homo sapiens
aggcaatgtcaggaacaga

SEQ ID NO: 2013633 - DNA, 23 bp, Homo sapiens
aggcaatgtcaggaacagaagga

SEQ ID NO: 2013634 - DNA, 14 bp, Homo sapiens
aggcacacagcagc

SEQ ID NO: 2013635 - DNA, 18 bp, Homo sapiens
aggcacacagcagccccc

SEQ ID NO: 2013636 - DNA, 20 bp, Homo sapiens
aggcacacttcttcttggtc

SEQ ID NO: 2013637 - DNA, 18 bp, Homo sapiens
aggcacaggacacctggc

SEQ ID NO: 2013638 - DNA, 13 bp, Homo sapiens
aggcacaggcagg

SEQ ID NO: 2013639 - DNA, 19 bp, Homo sapiens
aggcacaggcaggaagaga

SEQ ID NO: 2013640 - DNA, 21 bp, Homo sapiens
aggcacaggcaggaagagaga

SEQ ID NO: 2013641 - DNA, 20 bp, Homo sapiens
aggcaccaaaagaagtaaaa

SEQ ID NO: 2013642 - DNA, 14 bp, Homo sapiens
aggcaccatctccc

SEQ ID NO: 2013643 - DNA, 16 bp, Homo sapiens
aggcaccccctggaga

SEQ ID NO: 2013644 - DNA, 13 bp, Homo sapiens
aggcaccggcgct

SEQ ID NO: 2013645 - DNA, 14 bp, Homo sapiens
aggcaccggcgctg

SEQ ID NO: 2013646 - DNA, 17 bp, Homo sapiens
aggcaccggcgctgcag

SEQ ID NO: 2013647 - DNA, 13 bp, Homo sapiens
aggcacctgctgg

SEQ ID NO: 2013648 - DNA, 14 bp, Homo sapiens
aggcacctgctgga

SEQ ID NO: 2013649 - DNA, 13 bp, Homo sapiens
aggcacctggcct

SEQ ID NO: 2013650 - DNA, 14 bp, Homo sapiens
aggcacctggcctg

SEQ ID NO: 2013651 - DNA, 21 bp, Homo sapiens
aggcacctggcctgctgggaa

SEQ ID NO: 2013652 - DNA, 19 bp, Homo sapiens
aggcaccttagtggctttt

SEQ ID NO: 2013653 - DNA, 17 bp, Homo sapiens
aggcacgaacccacctg

SEQ ID NO: 2013654 - DNA, 19 bp, Homo sapiens
aggcacgaacccacctgct

SEQ ID NO: 2013655 - DNA, 15 bp, Homo sapiens
aggcactggtggcat

SEQ ID NO: 2013656 - DNA, 18 bp, Homo sapiens
aggcagaataagaaaaca

SEQ ID NO: 2013657 - DNA, 16 bp, Homo sapiens
aggcagacaagagctg

SEQ ID NO: 2013658 - DNA, 19 bp, Homo sapiens
aggcagacaagagctgctg

SEQ ID NO: 2013659 - DNA, 19 bp, Homo sapiens
aggcagacgtggggagggt

SEQ ID NO: 2013660 - DNA, 22 bp, Homo sapiens
aggcagacttccctgaatgtat

SEQ ID NO: 2013661 - DNA, 13 bp, Homo sapiens
aggcagagaaaga

SEQ ID NO: 2013662 - DNA, 15 bp, Homo sapiens
aggcagagaaagaag

SEQ ID NO: 2013663 - DNA, 19 bp, Homo sapiens
aggcagagaaagaagagac

SEQ ID NO: 2013664 - DNA, 22 bp, Homo sapiens
aggcagagaaagaagagacagg

SEQ ID NO: 2013665 - DNA, 14 bp, Homo sapiens
aggcagagaatcat

SEQ ID NO: 2013666 - DNA, 21 bp, Homo sapiens
aggcagagacaataaaacatt

SEQ ID NO: 2013667 - DNA, 20 bp, Homo sapiens
aggcagagcggggaggtgcc

SEQ ID NO: 2013668 - DNA, 17 bp, Homo sapiens
aggcagaggatgttctg

SEQ ID NO: 2013669 - DNA, 13 bp, Homo sapiens
aggcagcctccag

SEQ ID NO: 2013670 - DNA, 17 bp, Homo sapiens
aggcagcctccagagcc

SEQ ID NO: 2013671 - DNA, 20 bp, Homo sapiens
aggcagcctccagagccagc

SEQ ID NO: 2013672 - DNA, 11 bp, Homo sapiens
aggcagcctgc

SEQ ID NO: 2013673 - DNA, 13 bp, Homo sapiens
aggcaggaagaga

SEQ ID NO: 2013674 - DNA, 14 bp, Homo sapiens
aggcaggaagagag

SEQ ID NO: 2013675 - DNA, 17 bp, Homo sapiens
aggcaggaagagagaga

SEQ ID NO: 2013676 - DNA, 23 bp, Homo sapiens
aggcaggaagagagagagagagg

SEQ ID NO: 2013677 - DNA, 18 bp, Homo sapiens
aggcagggacagagatgg

SEQ ID NO: 2013678 - DNA, 18 bp, Homo sapiens
aggcagggcaaatgacat

SEQ ID NO: 2013679 - DNA, 14 bp, Homo sapiens
aggcagggcagagg

SEQ ID NO: 2013680 - DNA, 23 bp, Homo sapiens
aggcagggccttgcccagagatg

SEQ ID NO: 2013681 - DNA, 13 bp, Homo sapiens
aggcagggctctc

SEQ ID NO: 2013682 - DNA, 22 bp, Homo sapiens
aggcagggctctcctggcttcc

SEQ ID NO: 2013683 - DNA, 15 bp, Homo sapiens
aggcaggggtgggag

SEQ ID NO: 2013684 - DNA, 22 bp, Homo sapiens
aggcagggtctcactctgtcgc

SEQ ID NO: 2013685 - DNA, 21 bp, Homo sapiens
aggcaggtcttgaactcctgg

SEQ ID NO: 2013686 - DNA, 13 bp, Homo sapiens
aggcaggtgcctg

SEQ ID NO: 2013687 - DNA, 16 bp, Homo sapiens
aggcagtctgaaccct

SEQ ID NO: 2013688 - DNA, 18 bp, Homo sapiens
aggcagttcaaagcagga

SEQ ID NO: 2013689 - DNA, 13 bp, Homo sapiens
aggcatcccaggg

SEQ ID NO: 2013690 - DNA, 17 bp, Homo sapiens
aggcatcccaggggacc

SEQ ID NO: 2013691 - DNA, 18 bp, Homo sapiens
aggcatctacacagcctg

SEQ ID NO: 2013692 - DNA, 14 bp, Homo sapiens
aggcatctgcaccc

SEQ ID NO: 2013693 - DNA, 19 bp, Homo sapiens
aggcatgaacacacatgga

SEQ ID NO: 2013694 - DNA, 22 bp, Homo sapiens
aggcatgcaccagtgccgcctg

SEQ ID NO: 2013695 - DNA, 14 bp, Homo sapiens
aggcatgctggcct

SEQ ID NO: 2013696 - DNA, 13 bp, Homo sapiens
aggcatggccctg

SEQ ID NO: 2013697 - DNA, 20 bp, Homo sapiens
aggcatggtggcacacgcct

SEQ ID NO: 2013698 - DNA, 19 bp, Homo sapiens
aggcatgttctctgaggac

SEQ ID NO: 2013699 - DNA, 14 bp, Homo sapiens
aggcattaaatttt

SEQ ID NO: 2013700 - DNA, 22 bp, Homo sapiens
aggcattaaattttagcaaaga

SEQ ID NO: 2013701 - DNA, 14 bp, Homo sapiens
aggcattatttaat

SEQ ID NO: 2013702 - DNA, 14 bp, Homo sapiens
aggcatttcctggg

SEQ ID NO: 2013703 - DNA, 23 bp, Homo sapiens
aggccaaaattaccaaaaatctt

SEQ ID NO: 2013704 - DNA, 16 bp, Homo sapiens
aggccaaatgcacaag

SEQ ID NO: 2013705 - DNA, 22 bp, Homo sapiens
aggccaaatgcacaagctcaga

SEQ ID NO: 2013706 - DNA, 14 bp, Homo sapiens
aggccaagaatcaa

SEQ ID NO: 2013707 - DNA, 18 bp, Homo sapiens
aggccaagagcagaggca

SEQ ID NO: 2013708 - DNA, 17 bp, Homo sapiens
aggagccccgaggcctt

SEQ ID NO: 2013709 - DNA, 22 bp, Homo sapiens
aggagccccgaggccttctctg

SEQ ID NO: 2013710 - DNA, 19 bp, Homo sapiens
aggagccggaccaagatgg

SEQ ID NO: 2013711 - DNA, 20 bp, Homo sapiens
aggagcctgtgaacccagga

SEQ ID NO: 2013712 - DNA, 22 bp, Homo sapiens
aggagcctgtgaacccaggaca

SEQ ID NO: 2013713 - DNA, 12 bp, Homo sapiens
aggagctacctg

SEQ ID NO: 2013714 - DNA, 16 bp, Homo sapiens
aggagctacctgtgtg

SEQ ID NO: 2013715 - DNA, 23 bp, Homo sapiens
aggagctctgaatctgataggaa

SEQ ID NO: 2013716 - DNA, 16 bp, Homo sapiens
aggagctgagtcacct

SEQ ID NO: 2013717 - DNA, 14 bp, Homo sapiens
aggagcttccagtg

SEQ ID NO: 2013718 - DNA, 19 bp, Homo sapiens
aggagcttccagtgcatgt

SEQ ID NO: 2013719 - DNA, 20 bp, Homo sapiens
aggagcttccagtgcatgtt

SEQ ID NO: 2013720 - DNA, 21 bp, Homo sapiens
aggagcttccagtgcatgttg

SEQ ID NO: 2013721 - DNA, 23 bp, Homo sapiens
aggagcttccagtgcatgttgcc

SEQ ID NO: 2013722 - DNA, 13 bp, Homo sapiens
aggagcttctctg

SEQ ID NO: 2013723 - DNA, 13 bp, Homo sapiens
aggaggaaggcaa

SEQ ID NO: 2013724 - DNA, 15 bp, Homo sapiens
aggaggaaggcaaag

SEQ ID NO: 2013725 - DNA, 21 bp, Homo sapiens
aggaggaataagctcccaggg

SEQ ID NO: 2013726 - DNA, 22 bp, Homo sapiens
aggaggaatcatgtcaggcctg

SEQ ID NO: 2013727 - DNA, 23 bp, Homo sapiens
aggaggaatcatgtcaggcctgt

SEQ ID NO: 2013728 - DNA, 15 bp, Homo sapiens
aggaggacttgcagg

SEQ ID NO: 2013729 - DNA, 18 bp, Homo sapiens
aggaggagctgccgcaag

SEQ ID NO: 2013730 - DNA, 14 bp, Homo sapiens
aggaggaggaggaa

SEQ ID NO: 2013731 - DNA, 15 bp, Homo sapiens
aggaggaggaggaag

SEQ ID NO: 2013732 - DNA, 13 bp, Homo sapiens
aggaggattgctt

SEQ ID NO: 2013733 - DNA, 20 bp, Homo sapiens
aggaggattgcttcttgtga

SEQ ID NO: 2013734 - DNA, 21 bp, Homo sapiens
aggaggattgcttgagcccag

SEQ ID NO: 2013735 - DNA, 17 bp, Homo sapiens
aggaggcgcagcccgaa

SEQ ID NO: 2013736 - DNA, 23 bp, Homo sapiens
aggaggcgcagcccgaagcccag

SEQ ID NO: 2013737 - DNA, 16 bp, Homo sapiens
aggaggctagcaaagc

SEQ ID NO: 2013738 - DNA, 20 bp, Homo sapiens
aggaggctcaacaataaaac

SEQ ID NO: 2013739 - DNA, 17 bp, Homo sapiens
aggaggctgaggcagga

SEQ ID NO: 2013740 - DNA, 19 bp, Homo sapiens
aggaggctgaggcaggagg

SEQ ID NO: 2013741 - DNA, 21 bp, Homo sapiens
aggaggctgcatgctctggaa

SEQ ID NO: 2013742 - DNA, 18 bp, Homo sapiens
aggagggacaaaggagcc

SEQ ID NO: 2013743 - DNA, 20 bp, Homo sapiens
aggagggcaagggccatgct

SEQ ID NO: 2013744 - DNA, 14 bp, Homo sapiens
aggagggcagagcc

SEQ ID NO: 2013745 - DNA, 17 bp, Homo sapiens
aggagggcagagccatg

SEQ ID NO: 2013746 - DNA, 16 bp, Homo sapiens
aggagggcatgggagg

SEQ ID NO: 2013747 - DNA, 15 bp, Homo sapiens
aggaggggcacctgc

SEQ ID NO: 2013748 - DNA, 12 bp, Homo sapiens
aggaggggcctc

SEQ ID NO: 2013749 - DNA, 14 bp, Homo sapiens
aggaggggcctctg

SEQ ID NO: 2013750 - DNA, 21 bp, Homo sapiens
aggagggggtcgtggagagct

SEQ ID NO: 2013751 - DNA, 21 bp, Homo sapiens
aggagggtggaggaaggtgct

SEQ ID NO: 2013752 - DNA, 23 bp, Homo sapiens
aggagggttgggcgtgctacctg

SEQ ID NO: 2013753 - DNA, 14 bp, Homo sapiens
aggaggtggcagcc

SEQ ID NO: 2013754 - DNA, 18 bp, Homo sapiens
aggaggtggcagccctgt

SEQ ID NO: 2013755 - DNA, 14 bp, Homo sapiens
aggaggtgtcccaa

SEQ ID NO: 2013756 - DNA, 16 bp, Homo sapiens
aggaggttggtgactg

SEQ ID NO: 2013757 - DNA, 23 bp, Homo sapiens
aggaggttgtggatgctccaggg

SEQ ID NO: 2013758 - DNA, 18 bp, Homo sapiens
aggagtagctgagaggaa

SEQ ID NO: 2013759 - DNA, 20 bp, Homo sapiens
aggagtagctgagaggaaga

SEQ ID NO: 2013760 - DNA, 18 bp, Homo sapiens
aggagtatgcagggagct

SEQ ID NO: 2013761 - DNA, 16 bp, Homo sapiens
aggagtcaactggctg

SEQ ID NO: 2013762 - DNA, 21 bp, Homo sapiens
aggagtcaactggctggccag

SEQ ID NO: 2013763 - DNA, 14 bp, Homo sapiens
aggagtccagggcg

SEQ ID NO: 2013764 - DNA, 14 bp, Homo sapiens
aggagtcccaagga

SEQ ID NO: 2013765 - DNA, 16 bp, Homo sapiens
aggagtctgaggtcct

SEQ ID NO: 2013766 - DNA, 20 bp, Homo sapiens
aggagtctgaggtcctgagc

SEQ ID NO: 2013767 - DNA, 23 bp, Homo sapiens
aggagtctgaggtcctgagcact

SEQ ID NO: 2013768 - DNA, 14 bp, Homo sapiens
aggagtctgtgctc

SEQ ID NO: 2013769 - DNA, 16 bp, Homo sapiens
aggagtctgtgctctt

SEQ ID NO: 2013770 - DNA, 18 bp, Homo sapiens
aggagtggaggaggcctg

SEQ ID NO: 2013771 - DNA, 16 bp, Homo sapiens
aggagttaagagtagc

SEQ ID NO: 2013772 - DNA, 17 bp, Homo sapiens
aggagttaagagtagca

SEQ ID NO: 2013773 - DNA, 16 bp, Homo sapiens
aggagttcgagaccag

SEQ ID NO: 2013774 - DNA, 22 bp, Homo sapiens
aggagttcgagaccagcctggc

SEQ ID NO: 2013775 - DNA, 17 bp, Homo sapiens
aggagttcgaggctgca

SEQ ID NO: 2013776 - DNA, 20 bp, Homo sapiens
aggagttctgaagctgacag

SEQ ID NO: 2013777 - DNA, 21 bp, Homo sapiens
aggagttgctgtttgtttgac

SEQ ID NO: 2013778 - DNA, 21 bp, Homo sapiens
aggagtttgagacaagccctg

SEQ ID NO: 2013779 - DNA, 24 bp, Homo sapiens
aggagtttgagacaagccctggca

SEQ ID NO: 2013780 - DNA, 20 bp, Homo sapiens
aggagtttgaggctgcagcg

SEQ ID NO: 2013781 - DNA, 24 bp, Homo sapiens
aggagtttgaggctgcagcgagct

SEQ ID NO: 2013782 - DNA, 17 bp, Homo sapiens
aggagttttttttaacc

SEQ ID NO: 2013783 - DNA, 18 bp, Homo sapiens
aggatatcagagctggga

SEQ ID NO: 2013784 - DNA, 16 bp, Homo sapiens
aggatcactggagccc

SEQ ID NO: 2013785 - DNA, 22 bp, Homo sapiens
aggatcagaatggaaagaaact

SEQ ID NO: 2013786 - DNA, 12 bp, Homo sapiens
aggatcagtctg

SEQ ID NO: 2013787 - DNA, 15 bp, Homo sapiens
aggatccgctgccac

SEQ ID NO: 2013788 - DNA, 16 bp, Homo sapiens
aggatccgctgccacc

SEQ ID NO: 2013789 - DNA, 17 bp, Homo sapiens
aggatccgctgccacca

SEQ ID NO: 2013790 - DNA, 22 bp, Homo sapiens
aggatcctattctcaccaggaa

SEQ ID NO: 2013791 - DNA, 16 bp, Homo sapiens
aggatcctcacaggag

SEQ ID NO: 2013792 - DNA, 17 bp, Homo sapiens
aggatcctcacaggagc

SEQ ID NO: 2013793 - DNA, 21 bp, Homo sapiens
aggatcctcacaggagcagac

SEQ ID NO: 2013794 - DNA, 12 bp, Homo sapiens
aggatcctgcag

SEQ ID NO: 2013795 - DNA, 13 bp, Homo sapiens
aggatcctgcagg

SEQ ID NO: 2013796 - DNA, 19 bp, Homo sapiens
aggatctctcaggagcaca

SEQ ID NO: 2013797 - DNA, 20 bp, Homo sapiens
aggatctctcaggagcacag

SEQ ID NO: 2013798 - DNA, 20 bp, Homo sapiens
aggatctgtttttaaaaatc

SEQ ID NO: 2013799 - DNA, 22 bp, Homo sapiens
aggatgaaggcgtgcaaggggc

SEQ ID NO: 2013800 - DNA, 18 bp, Homo sapiens
aggatgaagggcccgaga

SEQ ID NO: 2013801 - DNA, 21 bp, Homo sapiens
aggatgaatgaggtcccaggc

SEQ ID NO: 2013802 - DNA, 19 bp, Homo sapiens
aggatgactttttttctga

SEQ ID NO: 2013803 - DNA, 22 bp, Homo sapiens
aggatgaggaacctcaaactgg

SEQ ID NO: 2013804 - DNA, 13 bp, Homo sapiens
aggatgccacagc

SEQ ID NO: 2013805 - DNA, 15 bp, Homo sapiens
aggatgccacagccc

SEQ ID NO: 2013806 - DNA, 20 bp, Homo sapiens
aggatgccacagccccacag

SEQ ID NO: 2013807 - DNA, 20 bp, Homo sapiens
aggatggacgaacaggggcc

SEQ ID NO: 2013808 - DNA, 15 bp, Homo sapiens
aggatggtgcaggat

SEQ ID NO: 2013809 - DNA, 21 bp, Homo sapiens
aggatggtgcaggatggcttt

SEQ ID NO: 2013810 - DNA, 19 bp, Homo sapiens
aggatgtaaacagtgcctg

SEQ ID NO: 2013811 - DNA, 14 bp, Homo sapiens
aggctagttccttt

SEQ ID NO: 2013812 - DNA, 18 bp, Homo sapiens
aggctattattttcactg

SEQ ID NO: 2013813 - DNA, 19 bp, Homo sapiens
aggctattattttcactgt

SEQ ID NO: 2013814 - DNA, 19 bp, Homo sapiens
aggctatttgttcagagag

SEQ ID NO: 2013815 - DNA, 18 bp, Homo sapiens
aggctcaagaggcccagg

SEQ ID NO: 2013816 - DNA, 21 bp, Homo sapiens
aggctcaagaggcccagggag

SEQ ID NO: 2013817 - DNA, 23 bp, Homo sapiens
aggctcacaactgtttttgaaga

SEQ ID NO: 2013818 - DNA, 16 bp, Homo sapiens
aggctcagtctcagga

SEQ ID NO: 2013819 - DNA, 17 bp, Homo sapiens
aggctcagtctcaggag

SEQ ID NO: 2013820 - DNA, 19 bp, Homo sapiens
aggctcagtctcaggagca

SEQ ID NO: 2013821 - DNA, 22 bp, Homo sapiens
aggctccaccccatccagttca

SEQ ID NO: 2013822 - DNA, 16 bp, Homo sapiens
aggctccatggggaag

SEQ ID NO: 2013823 - DNA, 14 bp, Homo sapiens
aggctccattagga

SEQ ID NO: 2013824 - DNA, 13 bp, Homo sapiens
aggctcctgtgct

SEQ ID NO: 2013825 - DNA, 18 bp, Homo sapiens
aggctctgaaagccagct

SEQ ID NO: 2013826 - DNA, 16 bp, Homo sapiens
aggctctgcctggagg

SEQ ID NO: 2013827 - DNA, 11 bp, Homo sapiens
aggctctggga

SEQ ID NO: 2013828 - DNA, 12 bp, Homo sapiens
aggctctgggaa

SEQ ID NO: 2013829 - DNA, 14 bp, Homo sapiens
aggctctgggctca

SEQ ID NO: 2013830 - DNA, 19 bp, Homo sapiens
aggctctgggctcagggct

SEQ ID NO: 2013831 - DNA, 20 bp, Homo sapiens
aggctctgggctcagggctg

SEQ ID NO: 2013832 - DNA, 21 bp, Homo sapiens
aggctctgggctcagggctgg

SEQ ID NO: 2013833 - DNA, 18 bp, Homo sapiens
aggctcttcctggacctg

SEQ ID NO: 2013834 - DNA, 22 bp, Homo sapiens
aggctcttcctggacctgagtc

SEQ ID NO: 2013835 - DNA, 13 bp, Homo sapiens
aggctcttctcct

SEQ ID NO: 2013836 - DNA, 14 bp, Homo sapiens
aggctcttctcctt

SEQ ID NO: 2013837 - DNA, 21 bp, Homo sapiens
aggctcttctccttggaggac

SEQ ID NO: 2013838 - DNA, 21 bp, Homo sapiens
aggctctttggggtcagccag

SEQ ID NO: 2013839 - DNA, 22 bp, Homo sapiens
aggctctttggggtcagccagg

SEQ ID NO: 2013840 - DNA, 14 bp, Homo sapiens
aggctgaccaagag

SEQ ID NO: 2013841 - DNA, 18 bp, Homo sapiens
aggctgaccaagagagaa

SEQ ID NO: 2013842 - DNA, 19 bp, Homo sapiens
aggctgaccaagagagaaa

SEQ ID NO: 2013843 - DNA, 14 bp, Homo sapiens
aggctgagacagga

SEQ ID NO: 2013844 - DNA, 17 bp, Homo sapiens
aggctgagcccagccac

SEQ ID NO: 2013845 - DNA, 15 bp, Homo sapiens
aggctgaggcagaag

SEQ ID NO: 2013846 - DNA, 17 bp, Homo sapiens
aggctgaggcagaagaa

SEQ ID NO: 2013847 - DNA, 15 bp, Homo sapiens
aggctgaggcaggag

SEQ ID NO: 2013848 - DNA, 19 bp, Homo sapiens
aggctgagtgagccacaga

SEQ ID NO: 2013849 - DNA, 15 bp, Homo sapiens
aggctgcactgcagt

SEQ ID NO: 2013850 - DNA, 19 bp, Homo sapiens
aggctgcactgcagtgatg

SEQ ID NO: 2013851 - DNA, 17 bp, Homo sapiens
aggctgcagaaggccaa

SEQ ID NO: 2013852 - DNA, 20 bp, Homo sapiens
aggctgctcggggtgcacag

SEQ ID NO: 2013853 - DNA, 21 bp, Homo sapiens
aggctgctcggggtgcacagg

SEQ ID NO: 2013854 - DNA, 22 bp, Homo sapiens
aggctgctcggggtgcacagga

SEQ ID NO: 2013855 - DNA, 20 bp, Homo sapiens
aggctgctgtgtagctctgt

SEQ ID NO: 2013856 - DNA, 20 bp, Homo sapiens
aggctggagaagctcaccca

SEQ ID NO: 2013857 - DNA, 13 bp, Homo sapiens
aggctggaggcag

SEQ ID NO: 2013858 - DNA, 14 bp, Homo sapiens
aggctggaggcagg

SEQ ID NO: 2013859 - DNA, 17 bp, Homo sapiens
aggctggaggcagggcc

SEQ ID NO: 2013860 - DNA, 18 bp, Homo sapiens
aggctggaggcagggcct

SEQ ID NO: 2013861 - DNA, 19 bp, Homo sapiens
aggctggaggcagggcctt

SEQ ID NO: 2013862 - DNA, 13 bp, Homo sapiens
aggctggcgtgca

SEQ ID NO: 2013863 - DNA, 11 bp, Homo sapiens
aggctggctga

SEQ ID NO: 2013864 - DNA, 15 bp, Homo sapiens
aggctggctgaaaat

SEQ ID NO: 2013865 - DNA, 15 bp, Homo sapiens
aggctgggccagcct

SEQ ID NO: 2013866 - DNA, 16 bp, Homo sapiens
aggctgggccagcctc

SEQ ID NO: 2013867 - DNA, 20 bp, Homo sapiens
aggctgggccagcctcagct

SEQ ID NO: 2013868 - DNA, 21 bp, Homo sapiens
aggctgggccagcctcagctc
